United States Patent 9,254,311 (MODIFIED POLYNUCLEOTIDES FOR THE PRODUCTION OF PROTEINS) - sequence listing, part 27

SEQ ID NO: 57774 - DNA, 1110 bp, Artificial Sequence
  Description of Artificial Sequence: Synthetic coding sequence
atgccagagtgctgggatggggtgggggagggcaatgccggagctgtaaagctggccggacttggagaccctcggtggagtcctggccatctcttgtctcctggtcaccaggaacatgacatcgaaactccatacgggttgctacatgttgtgattagaggaagccctaagggcaaccggccagcaatcttgacgtaccacgacgtcggactgaatcacaagctttgtttcaacacttttttcaactttgaagatatgcaggaaattaccaaacattttgttgtctgtcacgtcgacgcacccggtcaacaggtcggtgctagtcagtttccacaggggtaccaatttcctagcatggaacaattagcagctatgctcccctccgttgtccagcacttcggctttaagtacgtcatcggcatcggggtgggagcaggagcttatgtgctcgccaagtttgcactcatctttcctgacctcgtggaggggctagtacttgttaatatcgatccaaatggaaagggatggatagactgggcggcaaccaaactcagcggcttgacttccacccttccggacactgttttgagtcatctcttttcacaagaagaattagtcaacaacacggagctggtgcagtcatatagacagcagatcggcaatgtggtgaatcaggcaaatcttcagcttttctggaatatgtacaatagccgacgagatcttgacataaatagacctggaacggtgcccaatgctaagactctccgttgtccagtcatgcttgtggtcggcgacaatgcccctgccgaagacggagtggtcgagtgcaattctaagttagatccaacaactactaccttcctgaagatggctgactctggtggtctgcctcaggttacccagccgggaaaactgaccgaggccttcaaatactttctgcagggcatgggctacatgcccagtgcctccatgacacgattggcccgtagtagaacggcttccctaacctcggctagcagtgtggacgggagccggccacaggcatgcacacactccgaatcctctgaaggcctggggcaggtgaaccataccatggaggtgtcatgctag

SEQ ID NO: 57775 - DNA, 1116 bp, Artificial Sequence
  Description of Artificial Sequence: Synthetic coding sequence
atggccggattgcaggaactccggttcccagaggaaaaacctctgcttcgcggtcaggatgcaactgaactggagtccagtgatgctttcctcctggcagccgacacagactggaaagagcatgatattgaaacgccctacgggctccttcacgtcgttatcagaggttcacccaaggggaaccgcccagcaattctgacatatcacgatgtggggttaaaccacaagttgtgcttcaatacattcttcaattttgaggacatgcaagagataaccaagcacttcgtggtctgtcatgttgacgcaccaggacagcaggtgggagccagccagttcccacagggctatcaattcccttctatggagcagctcgcggctatgctgcccagcgtagtgcagcactttgggtttaaatacgtgattggtattggagttggcgctggtgcctacgtgctggccaaattcgccctgatttttcccgacctagtggaaggcctcgtgctggtaaatattgaccccaatggcaaggggtggatcgattgggccgcaactaagctgagcggcctaacgagcactctgccagatacagttttgagccacctgttctcacaggaagagctcgtcaacaacaccgagttggtgcagtcttacaggcagcagattggaaatgtggtaaaccaagctaatttgcaacttttttggaatatgtataattctcgacgtgacttggacatcaaccgcccaggcaccgtgcccaatgcgaagacgcttcgctgccctgtgatgcttgtggttggggacaatgcccctgctgaggacggggttgttgaatgtaactccaagctcgatccaacaaccacaacattcttgaagatggcagacagcggtggccttccccaggtgacacagccagggaaattaacagaggcattcaagtactttttgcaaggcatgggttatatgcccagtgctagcatgacccgactggcaagaagtcgcaccgcctctctaacatctgcctccagcgtagatgggtctaggccccaagcctgtacgcacagtgagagttcggagggcctcggacaggtaaatcacactatggaggttagctgttag

SEQ ID NO: 57776 - DNA, 1176 bp, Artificial Sequence
  Description of Artificial Sequence: Synthetic coding sequence
atgaaggtgttgggccaccgccttgaactgctcacaggccttctcctgcacgacgtgactatggcgggactgcaggaactcaggtttccggaggaaaagccactactacgcggacaagacgctacagagctggaatccagcgacgcgtttcttttggctgctgacacagactggaaagaacatgacatcgaaacaccctacggcctcctgcacgtcgttatacgtgggagccctaagggcaatagacctgccattctcacctaccacgatgtgggactgaatcataagctttgcttcaatacattcttcaacttcgaagatatgcaagagatcactaaacatttcgtggtgtgtcatgtcgacgcccctggccagcaggtgggggcaagccagtttccacaggggtatcagttcccatccatggaacagctggcggcaatgctccccagcgtggtacagcacttcggatttaaatatgtaattgggattggcgtgggggctggtgcctacgtgctggcaaaattcgccctgatcttccccgatctcgtggagggactggtcctggtgaacatcgaccccaacggcaaggggtggattgattgggcggctaccaaactgagtgggctgacctctacgttgcctgataccgttctgtcccatctgttcagccaagaagagctagtcaacaatacagagcttgtccagtcatacaggcagcagataggcaacgttgtcaatcaggccaacctccaattgttttggaacatgtataatagtcgacgtgatctggacataaacagacccggaaccgtgccaaatgcaaaaacactgagatgccctgtaatgttagtggtcggggacaatgccccagccgaagatggggttgtcgaatgcaactccaagttggatccaacgactacaactttcctgaagatggctgactcgggtggcctgccacaagtgacccagcccggaaaattgaccgaagcttttaagtatttcctccagggcatggggtacatgcccagcgcaagcatgacccgactggcacggagccgcactgcttcgctgacatcagcttcgtcagtggacgggtcacggccacaggcgtgtactcattctgagtcctctgagggactcggccaggttaaccatacaatggaggtatcttgctag

SEQ ID NO: 57777 - DNA, 894 bp, Artificial Sequence
  Description of Artificial Sequence: Synthetic coding sequence
atgcaggagattacgaagcatttcgtggtgtgccacgtcgacgctcccggacagcaagttggtgcttcacaatttccccaggggtatcaattcccttcaatggagcagttggctgcgatgctaccttctgtcgtccaacatttcggcttcaagtacgttatcggcatcggggtcggggctggagcatacgtgctcgcgaaatttgctctgatcttcccagacctcgtggaggggctggtcctggtcaacattgatccgaatggcaaaggctggattgattgggcggctaccaagttgagcgggctgacctccaccttacccgataccgtcctgtcgcatctgttttcacaggaagagctggtcaataacaccgagcttgtccagtcttatcggcagcaaattggaaatgtggttaatcaggccaacctgcagttgttctggaacatgtacaatagccgcagagatttggatattaatcggcctggcacggttcctaacgcgaaaacactccggtgcccagtcatgctggtagtgggagacaatgcccctgccgaagacggagttgtcgagtgcaattcaaaactcgatccaactaccacaacattcttaaagatggccgacagcggcggacttccccaggtcacacagccaggcaaattgaccgaagcctttaagtattttctgcagggtatggggtacatagcatacttgaaagacagacgactttcaggcggagccgtgccgagcgcttctatgacgaggctggcgagaagtcggaccgcaagcctgacaagcgccagctccgtggacggaagccggccacaagcttgtacccatagcgagagctctgagggtctcggacaagtcaatcatactatggaggtctcttgttag

SEQ ID NO: 57778 - DNA, 1020 bp, Artificial Sequence
  Description of Artificial Sequence: Synthetic coding sequence
atgcccgagtgttgggacggcgaacacgacatcgagacgccgtacgggctgctgcatgtcgttatcagaggctcacctaaaggcaatcgcccagccattcttacgtaccatgacgtgggtctgaaccacaagctctgtttcaatacctttttcaacttcgaggatatgcaggaaatcactaaacattttgtcgtgtgccacgtcgacgctccgggtcagcaagtgggcgcttcgcaattccctcaggggtaccagttcccctccatggaacagctggctgccatgttgccatcagtggtccaacatttcggattcaagtacgtgataggtatcggggtgggagcaggcgcttatgttctcgccaagttcgcgctaattttccccgatctggtcgagggcctcgtgttggtaaatatcgacccaaatgggaaggggtggattgactgggccgctactaagctgtctggacttactagcaccctgccagatactgtgctctcacacttgttcagtcaagaagaactcgtgaacaacactgagttggtgcagtcgtatcgacagcaaattggtaacgtagtgaatcaggctaacctccagttattttggaatatgtacaactcacggcgtgatctggacattaacagacccggtacagtcccaaatgccaagacgttgcgctgtcctgtgatgttggtcgtgggtgataacgctcccgctgaagacggggtggtcgagtgtaattctaaactcgatcctactactacaacctttctgaaaatggccgacagtggtgggctcccccaggtgacccagccaggcaagttgactgaagctttcaaatattttttgcaggggatgggatacatgccctccgccagtatgacaagactcgcccgatctagaacagcatccctgacgagcgccagttctgtggacgggtcccgcccacaagcctgcacacatagcgagtcctccgagggcctgggccaggtcaaccatactatggaggtgtcatgttag

SEQ ID NO: 57779 - DNA, 1059 bp, Artificial Sequence
  Description of Artificial Sequence: Synthetic coding sequence
atgcctgagtgctgggatggagaacacgacatagagacaccttacgggctgctccacgtggtaatacgtggttcccctaagggcaaccgacctgccattttaacctatcatgacgtgggcctcaatcataagctgtgttttaataccttctttaattttgaagatatgcaggagatcactaagcatttcgtcgtctgtcacgtggatgcgccaggtcaacaggtgggcgcatcgcagttcccccagggataccagtttccaagcatggagcagctggccgctatgctccctagcgtggtacagcattttggctttaagtacgtgattgggatcggcgtcggcgcaggtgcctacgtactagctaaattcgcgcttatctttcctgacctggtggagggcctcgttctggtgaacatcgatcctaacggcaagggctggattgactgggctgccacgaagttgtctgggctgacatcaacattacccgacacagtcctgagccatctgtttagtcaggaggagttggttaataataccgagctggtccagtcctaccgacaacagatcggcaacgtagtgaaccaagccaatctccagcttttttggaacatgtataatagtagaagggacctcgatataaacaggccaggaacagtgccgaacgcaaaaaccctcaggtgtccggtcatgctcgtggtaggcgacaatgcacccgctgaagacggagtggtggagtgtaatagcaaattagaccctaccacaacgacgtttcttaaaatggccgactctggaggccttccacaggtgacacagcccggaaaattgacggaggctttcaagtattttctgcaggggatgggctatattgcctatcttaaggacagacggcttagcgggggagccgtgccatctgccagcatgacaaggctggccaggtccagaaccgcttccctaaccagcgcaagctccgtcgatggcagccggccacaggcctgtacacacagcgaaagcagtgaggggttgggccaggtgaaccacaccatggaagtgtcctgctag

SEQ ID NO: 57780 - DNA, 345 bp, Artificial Sequence
  Description of Artificial Sequence: Synthetic coding sequence
atgatcgcacgcagaaatcccgaacccctacgctttttacccgacgaagctaggtcactcccgccacctaagctcacagatcctcgtctgctctatatcggatttttaggttactgctctggccttatagacaatcttatccgcaggcgacccatcgccaccgctggactccacagacaactcctgtacatcaccgcattcttttttgccggatattacctcgtgaaaagggaggactacctttacgccgtgcgggaccgcgagatgttcgggtatatgaagttgcaccctgaggacttccccgaggaggatgtctattgttgcggagctgaaagaagaggctag

SEQ ID NO: 57781 - DNA, 732 bp, Artificial Sequence
  Description of Artificial Sequence: Synthetic coding sequence
atggaggactcttttctgcagagtttcggtcgtcttagtcttcagcctcagcagcagcaacagcgccagcgtccacctcgtccacctcccaggggtacccctccccgacggcattcttttaggaagcatctgtatttattacggggactgcccggtagtggaaaaacaactctggcccgacagttacagcacgacttccccagagccctgatctttagcacagacgacttcttctttagggaggatggcgcatacgaattcaaccccgattttctcgaggaagctcacgaatggaaccagaagcgtgctaggaaagctatgaggaatggcatctccccaatcatcatagataacactaaccttcacgcctgggagatgaaaccttacgcagtcatggcgctggagaacaactacgaggtgatctttcgagagccggacactcgctggaaatttaatgtccaggaattggcaaggaggaacatccacggcgtctccagagagaaaatacaccgaatgaaggagcgatacgagcacgacgtaacctttcacagtgttctgcacgcagaaaagccaagccggatgaatcggaatcaggataggaacaatgccctaccctcaaataatgcacgctattggaacagctacaccgagtttcctaatagacgtgctcacggaggcttcacaaacgagtcctcctaccaccgtcggggaggctgtcaccacggctattag

SEQ ID NO: 57782 - DNA, 414 bp, Artificial Sequence
  Description of Artificial Sequence: Synthetic coding sequence
atgcgcaacggtatcagtccaatcataattgacaataccaacctacacgcctgggaaatgaaaccctacgcagtgatggccttggaaaacaattacgaggttatttttcgcgagcctgatactcgttggaagtttaatgtgcaagaactggcaagaaggaacatccacggagtgtctagggaaaagatccataggatgaaggaaagatacgaacacgacgtgacttttcacagcgtgctgcatgctgaaaagccatcccgtatgaatcggaatcaggataggaacaacgccctgccaagtaacaatgctagatattggaacagttatacagagtttcccaatcggagggcacatggtggcttcacaaacgagtctagttaccatcgcaggggcggatgtcaccatgggtactag

SEQ ID NO: 57783 - DNA, 522 bp, Artificial Sequence
  Description of Artificial Sequence: Synthetic coding sequence
atggaggactcatttcttcagtcctttggtcgtttgagcctacagccccagcaacagcagcagcgccagcgccctcctcgccctccccctaggggcaccccacctagacgtcactcatttcgcaaacacctctatctccttcggggattgccaggaagcggcaaaacaacactggcccgtcagctgcaacacgatttcccccgagcactgatcttttcaacggatgattttttctttagagaggacggcgcttacgagtttaacccagatttcctcgaggaggcacatgagtggaatcagaaaagagcgaggaaggctatgagaaatggtataagtcccatcatcatagacaacacaaacctgcatgcctgggagatgaagccatacgctgtcatggttttccagaccgagcagaagaacctgttcagacttgaaatggacatggttgtgtttagaccagagatgaaaaagcatagctggtgtctcaagcgtaagaaccctcctaacgagaggaccgtgtag

SEQ ID NO: 57784 - DNA, 1752 bp, Artificial Sequence
  Description of Artificial Sequence: Synthetic coding sequence
atgtcttatggagaaatcgaaggcaaatttttgggcccaagagaagaggtaacaagcgaacctagatgcaagaagctcaagtccacaacagaaagctacgtcttccacaatcacagcaacgccgatttccaccggatacaggaaaaaaccgggaatgactgggtgcctgtgaccatcattgacgtacggggacacagctacctgcaagagaataagattaaaaccactgatctccatagaccccttcacgacgagatgcctgggaataggccagatgtcatagaatcgattgattcacaggtgcttcaagaagctcggcctcctctggtgtcagccgacgacgagatttacagtacatcaaaagcctttatcggcccaatctacaaaccaccagagaagaaaaagagaaatgaaggcaggaacgaggcccacgttctgaatggtataaacgataggggtggacagaaagaaaagcagaaatttaattctgagaagagcgaaattgataatgaactttttcagttctacaaggaaattgaggaattagaaaaggagaaagatgggtttgagaacagctgcaaggagagcgaacccagccaggaacaattcgttcccttctatgagggtcacaacaacggcctgctgaagcccgatgaggaaaaaaaagatctgagcaacaaggctatgcccagccattgcgactaccagcagaacctggggaatgaaccagacaagtacccctgcaacggccaggtgatcccaacattttgtgatacaagttttacttcatttcgccctgagtggcaatcagtgtacccttttatcgttccttacggaccaccgcttccatccctgaattaccatcttaatattcaaaggttcagcggaccgcctaacccccctagtaatatcttccaggcccaggatgatagtcagatccagaacggctattatgtaaacaactgccacgtaaattggaattgtatgacattcgaccagaacaacgaatacaccgattgctccgagaacagaagctcggtgcacccaagtggcaacgggtgctccatgcaggatcgctacgtgtctaacggcttttgcgaggtgagggagaggtgttggaaggaccactgtatggacaaacataacgggacagatcgattcgtaaaccagcagttccaagaagagaaacttaacaagttgcagaaattactcatcctgttgcggggactccctggctccgggaagaccaccctgagcagaatcctgctgggccagaatagggatggtattgtgttttctacagacgattactttcaccatcaagatggctacagatacaacgtcaatcaattaggggacgcgcatgattggaaccaaaaccgagcaaaacaagctattgatcaggggaggtctcccgtgataatcgacaacaccaacatccaagcttgggaaatgaagccgtacgtggaggtggccattgggaaaggctacagagtagagttccatgagccagagacctggtggaaattcgacccagaagagctggaaaagcgcaataaacatggagtgagtcggaaaaagatcgcacagatgttggatagatacgagtatcaaatgtctattagtatcgtcatgaattctgtggagccctcacacaaatccacacaacggcctcctccgccacaggggaggcagaggtggggaggatctctggggtcccacaatcgcgtttgtgtgactaataaccactag

SEQ ID NO: 57785 - DNA, 2214 bp, Artificial Sequence
  Description of Artificial Sequence: Synthetic coding sequence
atggcactatgtagtgccctcatgaccattttcacgatcaaaatggggacagcaaaacaggctatcgaccaaggcagatctcctgttatcattgataacacaaacatccaggcatgggagatgaagccatatgtggaggtggcgattgggaagggataccgagtggaattccacgagcctgagacctggtggaagttcgacccggaagagctcgaaaagaggaacaaacacggagtctcaagaaaaaagatcgcccaaatgctggatagatacgaatatcaaatgtcaataagtatcgtgatgaattccgtcgagccatcccataaatctacacaaagaccaccgcctccccaggggcgacagagggagcgggtcctcaaaaaaacaggccacagactctccaaaaccaagcaaaaacgtaataggaagcggaacaaaaagcagaattcacaaaacagaatcatggaggaaaattccttggaattcctgtccgatctcacacccggtgaccaggacccctcacagagcgaggaagaagatattgaaaaaactcgacgcgaaagcgagtacccattcatcgatggtctccagaatgaggttggcgactttgttaccggctacaaggagaaaaggtggaaaaacaaggatccgaaggactcgttccagaatgtgatgtcaattgttgaattggataatacaccaaaaaactacctgagcaaagaaggggacaatctgttcgtgagcctgctccttaggcccaacgaaatttcagtaacttgtccgatcctgacacagaacctgtcctgtgtcacgacagacgattgctccgggatgaaagtagaaaagcatattcgaaatcgccacacgattgccctcgacactcaggatctgtcagcagaaacatcatgcctctttatgaaaaagcgagagatagtcgataagaatctgagccacgagcctatattgtgccaccagcacggtattagaatgtccgataaggtattgcgagaggagcaggtttataccacaaaaataaatcactgggcattcttcaccactaacctgagcgatgaggatctccagttgggtagtgaccgccaaccctacttcggctcttggcccgcaggtcctcacaagtttatttgtgaacagagaccaaaaaaagatcgcgcatgcaagttagcaggccctgattcacgtggtcaatggatacagatgattttcaccagcgtggccgcaagcgagcctggtaacaatccagaaatcctgactgataagctgcttatcggcaatgaagatttctctcctcctccggagactatggacagcttcatcgagacgaacttattccggagctgtctcccccagccagatataccgaagaacgccctggaatctaccaaaaataagaagaggcgtaaaaagcgcatctttaacctggtgccaaacttcgacctactggggcagagcagaatcggtgtgaaggagcgcgagaaatgcgacctcctgaccaaaaaccacggcttgaagataaccctcggcgaggagaaggaccggatatcagaacggaattctgaagaggaaaacaagcaaaaactcatgacctttgaccatcaccctctgtggttttaccttgacatcattaaagccacccctttgaatatcgatggccagagatacagtcactgcttgagctttaaccgacttaggtgtagcgccagtctgtataagaactatatccccagttttgtgttgcacaacctctcttccatctggaaaccttcctttacaaacaagaagctgttcctaacttttgaatcccagactagggtgggtaacaagctgaacgacgccggattcataagtcccgaaattctccactcccacccagacacttcctgttcgctgggagtgacaagcgacttccacttcttgaacgagcggttcgatcgcaaactcaaacgatgggaggaaccaaaggaactcccagccgaggacagccaagatctgacatctaccgactaccgttcgctcgagttgcccctctcccagggcttcgccttccagctcgttaaattattcggctctcccggagtgcccatggaatctctgctgccagatgactacgtggtccctctggattggaagacactgaaaatgatatatttgcagtggaagatgtctgtcgagaaacgacagaaaaaaattggttag

SEQ ID NO: 57786 - DNA, 2259 bp, Artificial Sequence
  Description of Artificial Sequence: Synthetic coding sequence
atgagctacggcgaaatcgaagaattctgtttagttcgtatagtaatggccttatgttccgccctgatgactatatttaccatcaagatgggtaccgccaaacaggcaatagatcagggccgaagccccgtgattattgataataccaacatccaagcctgggaaatgaagccatacgtcgaagtcgccatcggcaaaggctaccgagtggagttccacgaaccagagacatggtggaaattcgaccccgaggaactcgagaagagaaacaaacacggggtatctcggaaaaagattgctcaaatgcttgatcgatacgagtaccagatgtcaatttccatcgtaatgaattcagtggagccgtctcacaaatccacgcagagaccgccaccgcctcaggggagacagagggagagagtgctgaagaagacagggcaccgattgagtaagaccaaacaaaagcgtaatagaaaacggaataagaagcaaaactcacagaatcggatcatggaggaaaattccttggagtttctcagcgatcttacacccggagaccaggacccatctcagtccgaagaggaggacatcgagaaaacacgtagggagtctgagtaccccttcattgacggactacagaatgaagtgggtgactttgtcacaggctacaaagaaaaaaggtggaagaacaaggatccaaaggacagcttccagaacgtcatgagcatagttgagcttgataacacacctaagaattacctttcgaaagagggtgacaacttgtttgtctcactgctgctgcgcccaaatgagatttctgttacatgccctattttgacacagaacttgagttgtgtgactacagatgactgcagcgggatgaaggtggaaaagcatatccgaaaccgtcacacaatcgctcttgatactcaggacctgagtgctgagacatcctgtttgttcatgaagaagcgcgaaattgtggataagaacctgtctcacgagccaattctgtgccatcagcacggcatccgaatgagcgacaaggtcctccgggaggagcaggtgtacacaacgaagattaaccactgggctttcttcacgactaacctctcagacgaggacctgcaactgggcagtgaccgacaaccttatttcggcagctggcccgctggccctcacaaattcatctgcgagcagcgacccaagaaagatcgggcatgtaaattggccggtccggactcccgagggcagtggattcaaatgatctttacgagcgtggcggcttccgagccaggcaataaccccgaaatactcaccgacaagctgttgattggtaacgaggacttctcacctcctccagaaactatggactcctttattgagacaaacctgtttcgcagttgtctcccacagcccgacatcccaaagaacgcgctggaaagcactaagaataaaaagcgcagaaaaaagcggatttttaaccttgtgccaaactttgatctcctgggccagtcgagaattggtgtgaaagaacgggagaagtgtgatctcctgacaaaaaaccatggcctaaaaatcacacttggagaggaaaaagacaggatctccgagcggaactctgaggaggaaaacaaacaaaaactgatgacttttgatcaccaccccctgtggttctacctcgatatcattaaagccacgcctctcaacattgatggccagcgctactcacactgcctgagttttaatagactcaggtgctctgccagtctgtacaagaactatatcccttccttcgtgctgcacaatctatcatctatctggaagccttccttcacgaataagaagcttttcctgacgtttgaaagccagactcgtgttgggaataagctaaacgacgctggtttcataagtcctgagatccttcatagtcaccctgatacgtcatgttccctcggcgtcacatctgacttccatttcctaaatgagcgctttgaccgcaaactgaagagatgggaagagccaaaggagctgcctgccgaagacagccaagatttgacatccactgattatcggtctctggagttgcccttgagccaggggttcgcctttcagttagtcaaactcttcggatcacctggtgtccccatggaaagtttacttcctgatgattacgtggtcccactggattggaagactctgaaaatgatttatctccagtggaagatgtctgttgaaaaaaggcagaagaagattggctag

SEQ ID NO: 57787 - DNA, 513 bp, Artificial Sequence
  Description of Artificial Sequence: Synthetic coding sequence
atgctgattaaggttaaaactctgacagggaaggaaatcgagatcgatatcgagccaactgataaagtggagcgtatcaaggaaagagtcgaagaaaaagagggaataccccctcaacagcaacgtctcatctactctggcaaacaaatcgacggaaccgtccgggatcgccgtggtcaggatgtgagactgtaccctgaagttccagaggtactcaaaagattgcagagcttgggagtgccaggggcagcagccagtcgtacgagtgagatcgaaggcgctaaccaactgttggagttattcgacctattccgttatttcgtccaccgggaaatctaccccggttccaagataactcattttgagcgcctgcagcaaaaaactggcataccattttctcagatgatcttttttgacgatgagaggagaaacattgtggatgtttctaaactgggtgtcacctgtatccacatccaaaacggcatgaacctccaaaccctgtcccagggatag

SEQ ID NO: 57788 - DNA, 339 bp, Artificial Sequence
  Description of Artificial Sequence: Synthetic coding sequence
atgtggaaaggcggaagatctcacccgtttttaccgtgttcctctagacgggctgggagtgggggacagctggactcgattcttcctcaccagtcacctgcatggggcccatggggctgcaaggacctctcctcgggcgtgcctagttttctcactagcagtattctgtggaagtcagccgtcttcgctgaggacaatggattgaaaattcacctttgctcttacaagagagacgatctcgtgctgttttacgattgcaccagctttgtgctgactttcgggccttcaccctggttcctgactcaaggatttttaaatccactcgagttttcagcttag

SEQ ID NO: 57789 - DNA, 2577 bp, Artificial Sequence
  Description of Artificial Sequence: Synthetic coding sequence
atgctccaaacaaaggacttaatctggaccctgtttttccttggaacggccgtgagcctgcaggtggatattgtcccaagtcagggggagattagcgttggtgagagcaagttcttcttatgtcaggtggcaggagacgctaaagataaggatatctcatggttttcacctaatggcgaaaagctcactccaaaccaacaacggatcagcgtagtttggaacgatgactccagctccacccttacgatttacaacgccaacattgatgatgccggtatatataagtgtgtagtgaccggcgaggatggatctgaaagtgaagctacagtcaacgtgaaaatattccagaaacttatgttcaaaaatgcgcctaccccgcaagaattcagggaaggcgaggatgcagtgatcgtgtgcgatgtggtgagcagccttccacctaccatcatttggaagcataaagggagagatgttattttgaaaaaagacgtcaggttcatcgtgctttcgaataattatctgcagatccggggtattaagaaaaccgacgagggtacctatcgctgcgagggtcgcatattagccagaggcgaaatcaatttcaaagacattcaggttatagtgaatgtgcctcccaccatccaggctagacaaaacattgttaatgccactgccaatctcgggcagtcagtgacgttggtatgtgatgctgagggctttccagagcccacaatgtcatggacaaaagacggcgaacagattgagcaggaggaagacgacgaaaagtacattttcagtgacgatagcagtcagcttaccattaaaaaggttgacaaaaacgatgaggctgagtatatctgcatagctgagaacaaagccggtgagcaggacgccacaatacatctgaaggtgttcgcaaaacctaagataacatatgtcgagaatcagactgccatggaactcgaggagcaggtaaccttgacatgcgaagccagcggtgatccaattccaagtatcacttggaggacttccacccgcaatatatccagcgaggagaaggcttcttggacgcgaccggagaagcaagagaccttagacggacatatggtggtgcggtcccatgcacgcgtcagctcgctgactctgaaaagtattcaatacaccgacgctggggaatatatttgcacggcctccaatacaattggccaggatagtcaatctatgtaccttgaagtccagtacgcacccaagttgcagggtcctgtcgccgtgtatacttgggaagggaatcaggtgaatatcacctgtgaagtgtttgcctacccttcagccaccattagctggttccgtgacggacagctgttaccaagctccaactactcaaacattaagatttacaataccccatccgcctcttatctggaggtcactcccgactccgaaaacgatttcgggaactataattgtacagccgtcaatcgaattggacaagaatctctcgagtttatcttagttcaagccgacactcctagttccccaagcatcgatcaagtggaaccttattcttcaactgcacaggtccaattcgatgagccagaggccactgggggagtccccattttaaagtataaagccgagtggcgtgctgtcggcgaggaagtttggcactcaaaatggtatgatgccaaggaggcctccatggaagggatcgtgactattgtggggctgaaaccggagactacatacgccgtgaggctggccgcactgaatggcaaaggtcttggagagatctctgcagcatccgaatttaaaacacagccagtgcagggggaaccgagtgcacccaagctggaaggacagatgggcgaagacgggaattcaatcaaggtcaacctcattaagcaagacgacggcggatctcctatacgtcactacctagtgcggtatagagctctgtccagtgaatggaagcccgagataaggctgccaagtgggagtgaccatgtgatgctaaagtctctggattggaatgccgagtacgaggtgtacgtcgtggccgaaaaccagcagggaaagagtaaagcggctcactttgtgttcaggaccagtgctcaaccaaccgccatccccgcaaatggatcccccaccagtggtctatctactggagccatcgttgggattttaatcgttatctttgtgcttctgctggtggtggtagacattacgtgctactttttaaataagtgcgggcttttcatgtgcattgcagtgaatttatgtgggaaggctggccctggcgctaagggaaaggacatggaggaaggaaaggctgccttctctaaagacgagtctaaagagcctatcgtcgaagtacgaaccgaggaggagagaaccccaaaccacgacggcggtaagcatactgagccaaatgaaaccacacccctgaccgaaccagagaaagggcctgtggaggccaagcctgagtgccaagaaactgaaaccaagcccgctccagctgaagtgaaaacggtccctaatgacgccactcagaccaaggaaaatgagtccaaagcgtag

SEQ ID NO: 57790 - DNA, 2181 bp, Artificial Sequence
  Description of Artificial Sequence: Synthetic coding sequence
atgctccagacaaaggacctgatttggacactgttttttctcggcaccgcggtgagtcttcaggtcgacattgttccttcacaaggcgaaatctccgtgggcgaatctaagttcttcttgtgccaagtcgctggagacgcaaaggacaaggacatttcctggttcagccctaatggcgagaaactgactcccaatcagcagcgaatctctgttgtttggaacgatgacagctcgtctactctgaccatctataacgctaacatagacgacgcgggaatttataagtgtgtcgtgacaggcgaggacggaagtgagtcagaggccaccgtgaatgtgaaaatctttcagaaattgatgttcaagaacgcccctaccccccaggaattcagggaaggcgaagacgctgtgatcgtgtgcgacgtggtcagttccctgcccccaaccatcatctggaaacataagggtagggacgtgattttgaagaaagatgtgagatttatcgtgctgagtaataactacctgcagattagggggatcaagaagaccgatgagggtacctataggtgcgaggggagaatcctcgcaaggggcgagataaatttcaaggacatccaagtgatagtgaatgtccctcctaccattcaggccaggcaaaacatcgtgaacgcaaccgctaacctaggccagtcagtcacgctagtatgtgacgccgagggctttccggaacctacgatgtcttggaccaaggatggagaacagattgagcaagaggaggatgacgaaaaatacatcttctctgacgattcctcccagctgactataaagaaagtcgacaaaaatgatgaggctgagtatatctgcatcgcggaaaacaaggccggtgagcaagatgccaccattcacctcaaggtgttcgcgaaacctaagataacctacgtcgagaatcaaactgcaatggaacttgaggagcaggtcactttgacctgcgaggcttctggagatcccattcccagcatcacctggcggaccagtaccaggaacatcagctcagaagaaaaaacactggacggacatatggtagtgagatcccacgccagagtttcctctctgacacttaaatctattcagtacacagatgccggtgagtatatttgcacagcaagcaatacgattggacaggattcccagtccatgtatctcgaggtgcagtacgctccaaagcttcaaggtccggtggcagtatacacctgggagggaaaccaagtgaatattacttgcgaagtgttcgcttatcctagcgcaaccatttcctggttcagggacggccagctcctgccatcatctaactattccaatatcaaaatatataatactccgtcggcatcatatttggaagtgacgcccgacagcgagaatgacttcggaaactataattgcacagctgtcaataggataggtcaggaatcactcgagttcatcctggtgcaagcggatacaccaagtagtccaagcatcgaccaggtcgaaccttacagctcaactgcccaagtgcagttcgatgagcctgaggcaacaggcggtgtacccatcctgaagtataaggcggaatggcgtgccgtgggagaagaggtctggcacagtaagtggtatgacgccaaagaagcgtccatggaaggaattgtgactatcgtggggctaaaacccgagactacctacgcagttagactggcggctcttaatggtaaggggttaggggagatttcagccgcatcagagttcaagactcagccggtgcagggagagccttccgcacctaagctcgaggggcagatgggtgaagacggaaactccatcaaggtgaacctcattaaacaagacgatggcggatctcccatccgccattacctagttcgctaccgcgcactgagcagtgagtggaagcccgaaataaggctgccttcgggcagcgaccatgttatgctaaagagccttgactggaatgccgagtatgaagtttatgtggttgccgaaaaccaacaaggaaaaagcaaggccgctcactttgtgtttagaaccagcgctcagcctacagccatacccgctacgctcgggggtaactccgcctcatatacatttgtctccctcctcttttccgccgtgacactgctcttgctatgctag

SEQ ID NO: 57791 - DNA, 2286 bp, Artificial Sequence
  Description of Artificial Sequence: Synthetic coding sequence
atgctgcaaacaaaggacctgatctggacgctattctttctggggaccgccgtctctctgcaagtggatatcgtgccaagtcagggcgagatatctgtgggcgagtccaaatttttcttgtgtcaggtggctggggatgccaaggacaaagatatctcctggtttagccctaacggcgagaagctcactcccaaccaacagcgaatctcagttgtatggaacgacgatagcagttctaccttaacaatctacaatgccaatatcgatgatgccggaatctacaaatgcgttgttacgggcgaggatggcagcgaatcagaggctaccgtgaacgtgaagatcttccagaaactgatgttcaaaaatgcgccaactccgcaggaatttagagagggagaggacgccgtgatagtatgtgatgtggtgtcttccttgcctccaacgatcatatggaagcataaagggcgtgacgtgatcctgaagaaagacgttagattcatcgtgctgagtaacaattacttgcagatcaggggaattaaaaagaccgatgagggcacctaccggtgcgagggcagaatccttgccagaggcgagattaattttaaagacatccaggtgatcgtgaacgtaccgcctacaattcaggcgcgacaaaatatagtaaatgccaccgcaaatctaggccaatctgtgactctcgtctgtgacgctgagggctttcctgaacccacaatgagctggacaaaggacggcgaacaaatagagcaggaggaggatgatgagaagtacattttcagtgatgactcaagtcagctaacaatcaagaaggtggacaagaatgatgaagcagagtatatctgcattgccgagaataaagccggtgaacaggacgctactattcatctgaaggtatttgcgaagccaaaaatcacatatgtggaaaaccagactgctatggagctggaagagcaggttacactcacgtgtgaggcctctggagaccccatccccagcataacgtggaggacctcaacacggaatatcagttcagaagaaaagaccctggatggtcacatggttgttaggagtcatgcccgtgtttcctctctgacactcaagagcatccaatataccgacgccggagaatacatctgtactgccagcaacaccatcggccaggatagccagtccatgtacctggaagtccagtatgctccgaagctacaaggccctgtcgctgtgtatacctgggaaggcaatcaggtgaacataacttgtgaagtcttcgcttatccatcggccaccatcagctggttccgggatgggcaactacttccttctagcaactacagtaatattaagatctataacactccttccgcctcttatctcgaagtgactcctgattctgagaatgacttcggcaattataactgcaccgcagtcaaccgtatcgggcaggaatccctggaatttatactggtgcaggcagatactccatcatcaccctcgatcgatcaggtggagccttactcttctaccgcacaggtgcagttcgacgagccagaagcaacagggggagtgccaatcctgaagtacaaggctgagtggagagctgtgggagaggaggtgtggcattcaaaatggtatgatgctaaagaagcatcaatggagggcatcgtgacgattgtggggctaaagccggaaacaacctacgccgtacgattagctgcactgaatgggaagggactgggggagatttctgctgcatccgagtttaagacgcagcctgtgcattccccacccccacctgcttccgcatcctcatctacacccgtgcctctaagccctccagatactacctggcctctgcccgcattggccactacggaacccgcaaaaggggagccttcagcacctaagttagagggacagatgggcgaagacggtaactcaattaaggtcaatctgatcaagcaagatgacggtggatcccctattcggcactacctggtccgctaccgagccctgagctccgaatggaagcccgagataagacttccatcaggatctgaccacgtgatgctcaagtctctggattggaatgctgagtacgaggtgtacgtggtggccgagaatcaacaaggcaaatccaaggcggcacacttcgtgttcaggacaagcgctcaaccaacggcgatcccggcaacactgggtggcaactcggcaagctacacgttcgtctccctgctcttctccgccgtgacactcctcttactctgttag

SEQ ID NO: 57792 - DNA, 1668 bp, Artificial Sequence
  Description of Artificial Sequence: Synthetic coding sequence
atgggcaacacagttcacaggactctgccggatccgagccctcccgctcgtttattggctaccaggccctgctgcggtccaggaccggagaggcgtccagtactcggtgaagctcccaggtttcacgctcaggccaagggaaaaaacgtgcgcctggacggacatagcaggcgcgctacccgacgaaatagcttttgtaacggtgttacctttacccagcgcccaattcgtttatatgaacaggtgcgcctgcgtctggtagccgtgagaccaggctggagtggggctcttagatttggcttcaccgcccatgacccgagcctgatgtcggcacaagatattccaaaatacgcgtgtcccgacctggttactcgccctgggtactgggctaaagccctgccggagaacctggctctgagagacaccgtcctggcatactgggccgatagacacgggcgagtgttttattcagtgaatgacggggagcccgtcctgttccattgcggagtggctgtgggcggacctttgtgggccttgatagacgtttacgggatcacagacgaggtgcagcttttggagtcagcatttgcggatactttgactccagcaaggctctcacaagcacgctttagcgcatgtttgccgcctagctcccacgacgcagccaacttcgataataatgagcttgagaacaatcaggttgtggctaaacttggccacctggccctcggcagggcgcctgggccaccaccggctgatgcagccgctgcagccatcccctgcggtccgagggaacgcccacggcctgccagcagccccgcactgcttgaggccgatttacggttccacgctacacggggacctgacgtgtcactctcagctgacaggaaggtggcatgtgccccacgcccagacggcggtaggaccctagtgttctccgaacgtcccctaagacccggtgagagcctcttcgtagaagtagggagaccaggcctagccgctccaggtgcattagcttttggaattacttcttgcgacccgggagttctgagacccaacgaattaccggctgatcctgatgcccttttagataggaaagaatactgggtagtggctcgggctggacctgtcccttctgggggagacgccctgtctttcactctgagacccggtggcgacgtcttgctggggattaacggccgtccccgtgggcgtctgctatgcgtcgacaccacccaagcgttgtgggcattcttcgcagtgagggggggagtggccggacagcttcgcctgctcggcaccctccagtcttcaccagctaccaccaccccgtccgggagcctcagcggtagccaagacgactccgattccgatatgaccttcagcgtgaatcaatcctcaagcgcaagcgagtcatccttggtgacagccccatcaagccccctgtccccacccgtctcaccagtcttctccccacccgaacctgccggtatcaagaacggcgagtgcacagtgtgtttcgatggtgaggtggacaccgtgatctatacctgcggtcatatgtgcctgtgtcattcctgcggtttgcggctgaagcggcaggcaagggcctgttgccctatctgcagacggccaattaaagacgtgattaaaatttaccgaccatag

SEQ ID NO: 57793 - DNA, 4683 bp, Artificial Sequence
  Description of Artificial Sequence: Synthetic coding sequence
atggctgcgggatccggcggttcgggcggtagcgggggaggcccagggccaggtccgggtggaggcggtggcccatctggcagcggcagtgggcctgggtccaatggtgggttgggtagcggcggagaattgcacccacgcaccggtcggctcgtcagcctgagcgcttgtggcagaactgcccgaagacaacagcccggtcaggagttcaaccatggactggtgctctcaagggagcctctgagagatgggcgtgttttcactgtacgcatcgatcgaaaggttaatagctggagcggttccatcgaaataggagtgacagcactcgatccaagtgtgctggacttcccgagtagcgccacaggattgaagggtgggtcatgggtggtttcgggatgcagcgttctcagggatggcagaagcgtactggaggagtacggtcaagatctggaccagctgggcgagggcgaccgtgtgggtgtggagagaaccgtggcaggagaattacggctgtgggtgaacggtagagactgtggcgtagccgctacgggactccccccaagagtgtgggccgttgtagatctgtatgggaagtgcacccagatcacagttcttccacctgaaccaggcttttctccaccgacaccaattccaacgcccccactggagcccctggccccaaccgaggactctgccctagctgagcagggtacttcggctgatgaagcattcatggtgtcaccagctcaggccaggccagaaacttttcccaactctctggaatcacacaatgatttcgcgaatatggaactaagtgaggtcgtctctaacactatcttatccgcgtacaatgggggattgcttaacgttaacctgtcatccccccctgctggagagggcttgggaagcagcggggctgccacttctcccattcttacttcaaatgacgcactcttgttccatgagaagtgcgggacgctgattaagctgagcaataacaataagactgctgaacggaggcggccactggacgaattcaacaacggggtggtcatgaccaaccgaccactccgggataacgagatgtttgaaatccggatcgataagcttgtggacaaatggagtggcagtatcgagataggtgtgaccacacataaccccaatagcctggaataccctgccacaatgacaaacctgcaatcaggtaccatcatgatgtccggatgcgggatcttaactaacggcaaggggacccgccgtgaatattgcgaattctccttggatgagctgcaggaaggggatcacatcgggcttacacgtaaatctaacagcgctctccacttttttattaatgggatcgatcagggcgtggcgacacccctgactcctccggtggtctacggtgtggtggacctctacggcatggccgtgaaggtcacaattgtgcataacaataaccattccgataggctacgaaggaacaatgccatcctgcgggctctcagcccagagggggcattacggagggcagcacccgctgcacaggctgaaccagaacgcctactctttcaccccaactgcggacagaaggcagctatcacacacgaaggcaggaccgccctgagaccgcatgccacggacgatttcaatcatggagtggtgctgtccagtagagcactgcgcgacggtgaggtctttcaagtccgaatcgacaagatggttgataaatgggccggaagcattgagataggtgtcacaacacacaatcctgcatacttgcagctgccatccaccatgaccaatcttagatctgggacatggatgatgaccgggaacggggtcatgcataacggcaccaccatcctggacgagtatgggcataatctggataggctgaaggccggtgacaccgtcggggtggtgcgtagagaggacggcacgttgcacttctttgttaacggcatgacacaaggacctgctgcctggaacgtgcctccaggggtgtacgccgtggtcgacttatacggccaggccgctcaagctaccatcgtagacgacgtagaggtggctccagtgccagaaccactgcctgaagggaacaatcaggtgtcgccatccagtccatcctccggtgcgggaggtagtgatctgcggtttcatcaacttcacggcagtaacgccgtgataaccaacggcggaaggactgccctgcggcataactgccgttctgagttcaacgacgccatcgtcatcagtaaccgtgctctgcgcgacggcgagctatttgagatcgtgattcagaagatggtggaccggtggagcgggtccattgaggccggagtgactgctatacgcccagaagacttagaatttcccaatacaatgactgacatcgactacgatacatggatgctaagcggaaccgccatcatgcaggatgggaacaccatgaggaacaactacggctgcgatctggacgctctcggaaccggtgcgagaattggcatgatgcggacggctaaaggggaccttcattactttattaacgggcaagaccagggcgcagcctgttccgggcttccgcctgaggtttacgccgtcgtggatctctacggccagtgcgtccaagtctctattacaaatgccacagggcctatggataattctttagccacatctaacaccgccacagagaagtcttttccgttgcacagcccagtggccggagtcgctcacaggtttcatagcacctgcgggaagaatgtcaccctggaggaggacgggacccgtgctgtgagggccgctggatacgcccacggactggtgttcagtacaaaggagctgcgagcagaggaagtgtttgaggtaaaggtggaagaactggacgagaaatgggcgggatcactgcgtctgggccttaccactctggcccctggagagatgggcccaggagctggcggagggggaccaggcttaccacctagtctgcctgaactgcggaccaagacaacatggatggtcagctcttgcgaggtgcgaagggacgggcaactgcaaagaatgaattacggaaggaacctcgagcgcttaggggtcggcagtcgagtgggagtgcgccgaggcgctgatgatacgatgcacatcctggtcgacggcgaagatatgggacctgctgccactggaatagccaaaaacgtttgggccgtcctggacttgtacggacccgtgaggggagtcagcatcgtctcaagcacaaggctcgaggagagtgagggcacccagccccctagtccatcttccgacacaggaagcgaaggggaagaggatgacgagggtgaggaacacgggctgggtgggcagaacgaggtagggatcatcccaaccaccctggagtttctcgagaatcatggcaagaatatcctgctgtcaaacggtaatagaactgcgaccagagttgcatcatataatcagggaattgttgtcattaatcagccactggtgcctcaactccttgtccaagtgaggatcgactttctgaaccggcagtggacttcatccctggtcctgggcgttattacatgtgcgcctgaaagactgaactttcccgcaagcgcatgtgccctgaaacgggcagcctggctgctgcgaggacggggagtctttcataatggtcttaaaatttgtgagaagttcggtccaaacctagacacatgccccgaaggcacaattcttggactgcggctggactcctctggtggcttacacctacacgttaacggagtcgatcaaggagtcgcggtacctgacgtcccccaaccttgccacgctctggtggacctgtacggtcagtgcgaacaggtcacaatcgtcaatccagaaccaggcgctgccagtggaaaatctgcgggaacacagggggatatggagaaggccgacatggtggatggtataaaggagagcgtgtgctggggtccacccccagcggcatctcccctcaaaagttgtgagtatcacgctctgtgctctaggttccaggaacttttactgctgcccgaagactattttatgccaccccctaaacggagcttatgttattgcgagagctgtcgaaagctacgaggagatgaagcacatcggcgaagaggcgaaccaccgagagagtacgcactgcctttcggctggtgccggttcaacctacgggtcaatccgagattagaagccggaactctgactaagaaatggcatatggcgtatcacggatcaaatgttgccgctgtgcggagggtgcttgatcggggtgagctgggcgcagggaccgctagcattctttcatgcaggcctctgaaaggagagcctggtgtggggttcgaagaacccggtgaaaattgtgcacctcccagggaggaacagccaccacctgtactgttgagcccttccttgcagtacgctggtgccgagaccctagcttcaaaggtgcagttccgcgacccaaagtctcagcgaacccaccaggcacaagttgctttccaggtgtgtgtgcggccagggagctatactccaggccctccgtctgctgcgttaggagagcccccagatccccactttagcccggcagagctggagtgggtaacgaaagagaaaggagcgactctgctctgcgcccttttggtgagagtcgaatag

SEQ ID NO: 57794 - DNA, 4689 bp, Artificial Sequence
  Description of Artificial Sequence: Synthetic coding sequence
atggcagcgggttccggtggatcgggagggtccggcggtggccctggtcccggtcctggcggtgggggtgggcctagtggttcagggagtgggcctggcagtaacgggggactcggatcaggtggggaactgcacccccgtaccgggcgtctggtgtccttgtccgcctgtggccgtacagcccgacgtcagcagcctggccaggagttcaaccacggcttggtactttctagggaacccctgcgggatggcagagtatttaccgtgaggatcgacaggaaagtgaattcatggagtggttcaatagagatcggcgtaaccgccctcgacccatcagttctagacttcccttcaagcgcaaccggcctaaaagggggaagctgggtggtgagcggatgctccgtactcagggacgggagatcagtgttggaggagtatgggcaagatcttgaccagctcggtgaaggcgatcgcgttggcgtggaacggactgtggcaggggaactgcggttgtgggtcaacgggagagactgtggagtcgccgctaccggactgccgcctcgtgtttgggccgtcgtggacctgtacgggaaatgcacacagataactgtcctgccccctgagcccggattttctccacctaccccaatccctacacctccattagaacccctggcacccaccgaggatagtgccctggccgaacaagggacctccgcagacgaggcattcatggtcagtcctgcgcaggccaggccagagaccttccccaattcccttgagagccataatgatttcgctaacatggagctgagcgaagttgtttctaatactattctgtccgcgtacaacggagggttgctcaatgtgaatttgtcatctcctcctgcaggcgaaggactgggttcgtctggagctgccaccagtccaatcttgacctctaatgatgccctcctttttcatgagaagtgtgggactctgatcaagctctccaacaacaataagaccgcggagcgtcgcagaccccttgacgagtttaataacggggtcgtgatgaccaaccgccctctgcgtgataacgagatgttcgaaatccggatcgacaaattagtcgacaagtggagtggatctatcgaaattggagtcactactcataatcctaattcactggagtaccctgccaccatgaccaatctacagagtggtactatcatgatgagcggctgtggaatcttgaccaatggcaaaggaacacggagggaatattgcgaattttcactcgatgagctgcaagagggcgatcacattggacttaccagaaagtccaattcggccctgcatttttttatcaatggcattgatcagggcgtggcgacccccttaacccctcccgtcgtttacggcgtggttgatttgtacggaatggctgtgaaagtcaccatagtgcacaataacaaccatagtgatagactgaggcggaataatgccatcctacgcgcattgtccccagaaggcgcattacggagagcagctcccgcagcccaagccgagcccgaacgcctgttgttccaccctaactgcggacaaaaagcagctatcacacacgagggaagaactgccctgcgtccccatgccaccgatgactttaatcacggcgtggtgcttagctctagagcactacgcgacggtgaagtttttcaggtccgtatcgacaaaatggttgacaagtgggccggaagcattgaaataggcgtgaccacacataacccagcttatttgcagctgccgtcgacaatgaccaatctgcgctccggaacctggatgatgacggggaatggcgtaatgcataacggaaccactatccttgatgagtacggccataacttggatcggctgaaggcaggggataccgtgggcgtggtccgcagagaagatgggacactccatttcttcgttaacggaatgactcagggccctgccgcttggaacgtgccaccaggcgtgtatgccgttgtggacctctatggtcaggccgctcaagctactattgtcgatgatgtggaagtggcacctgtgccagagcctcttcccgagggaaacaatcaagtgtctccaagctcgccatcctccggcgcaggcggtagcgatttgcgctttcaccagcttcacggatctaatgcagttattaccaatggaggacgcacagcattgcggcacaattgccgcagtgagttcaacgacgcaattgtaatttctaaccgagcactacgtgacggcgaactgtttgaaatcgtgattcagaaaatggtcgaccgatggtccggatccattgaagccggagtcacagctattcggcctgaagaccttgagtttcctaataccatgaccgacattgattatgacacctggatgttaagcggcacagcgatcatgcaggacggtaataccatgagaaataactatggctgcgacctggacgcattgggaacaggcgcacgtatcggtatgatgaggacggccaaaggggacctccattactttatcaatggacaagaccagggcgctgcctgttcaggcttaccccctgggaaggaggtgtatgccgttgtggacttatacgggcaatgtgtgcaggtgtcaatcacaaacgcgactgggccaatggacaactcactagctaccagtaacacggctacagagaaatcctttcctctgcacagtcccgtggcaggtgtggctcaccgctttcactcaacttgtggcaaaaatgtcaccttagaagaggacggaacacgcgctgttcgagccgcaggatacgcacacggactcgtcttctctacaaaggaattgcgcgctgaggaggtgttcgaagtcaaggtagaagaattggatgaaaaatgggctggatcacttagactgggtctgacaacgctcgcacctggggagatgggacccggagcaggtggagggggaccaggcctgcctccgtcccttccagaacttaggaccaaaaccacatggatggtctcctcttgtgaagttagaagggatgggcagctacagcgaatgaattatggccgaaatctcgaacgacttggtgtggggtcccgggtgggagtccgcaggggtgcagacgatactatgcacatcctggtcgatggggaagacatgggcccagctgccacaggcattgccaagaatgtttgggccgtgcttgacctgtacgggcctgtccgaggggtttctatcgttagcagcactagactcgaagagtccgagggaacacaacctccaagcccctccagtgacaccgggagtgagggggaagaggatgacgagggagaggagcatggtttgggcggacagaacgaggtcggcatcatccctaccaccctagaatttctggagaaccatggaaagaatattctgctttccaatgggaatcgcactgctaccagagtggcttcttataaccagggcatcgtcgtaataaatcagccactagtgccacagctgctggtccaggtgcgcatagactttctcaaccggcagtggacgtcttctctggtgttgggggttattacctgtgcccctgagcgactgaacttccctgcatcggcctgcgccctcaaaagagctgcgtggttgcttaggggccgaggcgtgttccataacggacttaaaatctgcgagaaattcggtccaaatcttgatacctgtcctgagggtactatactgggactccgcttagactctagtggagggctgcatcttcacgtgaatggtgtggaccagggtgtggctgtgccagacgttccccagccatgtcacgcgctggttgacttgtatggacagtgcgagcaggtaaccattgtgaatccagagccgggtgccgctagcgggaaatcggccggaacccagggcgacatggagaaggccgatatggttgacggcattaaggagtcagtctgctggggaccccctcctgcggctagcccattgaaatcatgtgaataccatgccctctgtagtaggtttcaggagttactgcttctgcccgaggattatttcatgcctccccctaagcggtcattatgctactgcgagagttgtcggaagttgagaggcgatgaagcccacagaaggcggggtgaacccccacgggaatacgccttaccctttggatggtgccggtttaacctgcgcgtgaacccacggctggaggccggtaccctcactaaaaagtggcatatggcctaccatggctccaatgtggccgcagtccgcagagtcctggatcgtggggagctgggagctggaactgcctctattctgagctgccgacccctgaaaggggagcctggagtaggctttgaagagcctggtgagaattgtgccccaccacgagaagagcagccgccaccggtgctgctgtctccttcacttcagtatgctggcgcagagaccttagcaagcaaggtgcagtttcgggaccccaagagtcagcgcacccaccaagcacaggtagctttccaggtctgcgtccgcccaggttcgtacactccaggccctccgtctgcggcacttggggaacccccagacccccacttctcgccggcagagttagagtgggtcactaaggaaaagggggctaccctcctttgtgctctgctggtccgtgttgagtag

SEQ ID NO: 57795 - DNA, 2760 bp, Artificial Sequence
  Description of Artificial Sequence: Synthetic coding sequence
atggtgaagcagaataacatcattcctggggaaacccagatcctcttgcggtttactgggtgggagtcgaaagtcaatgccaaaaagcagctgccggtcggaatcaagtgcgagccaatggatcaggtgcccgacagtacctcatccgccaccaacgtgtccatggttgtcagcgcgggtccctggtcaagcgagaaggccgagatgaacatcctggaaatcaacgaaaaactgcgccctcagctagctgaaaataagcagcaattccggaatctcaaggagcgttgcttcctgacccagctggctggcttcctggccaaccgccaaaagaagtataaatacgaagagtgtaaggacctcatcaaattcatgttacggaacgagaggcagtttaaggaggagaagctggcagagcagctcaaacaagccgaggagttgcgacagtacaaagtcctcgtccatagccaggaacgagagctgactcaattaagggagaaactgcgggagggacgagacgcgtctcgaagccttaacgagcacctgcaggcgctgctaacgccagatgagcctgacaaatctcagggccaggacttacaggaacagctggccgagggatgtcgtctggcacaacatctggtccagaaactcagccccgagaacgatgaggacgaggatgaggacgtccaggtcgaggaggacgagaaagtcctggaatcctctgccccacgcgaagtgcagaaagctgaggaatctaaagtgccagaggattcgcttgaagagtgtgccataacatgttctaattcccacggtccttgcgactctattcagccacataagaacatcaagatcactttcgaggaggataaggtcaattcctcccttgtggtggatcgggagtcgtcccacgatggatgtcaagacgccctgaatatcctgcctgtcccgggtcctacatcctccgccaccaacgtctctatggtggtgtcagccggtcctctcagctcggagaaagcggaaatgaacatcctcgagatcaacgagaagttatgcccacagctggccgagaaaaagcagcagtttcgttctctgaaagagaaatgctttgtgacacaggtagcctgtttcctggcaaagcagcagaataaatataaatacgaggaatgcaaggatctgattaagagtatgcttcgaaatgaaaggcagtttaaagaagaaaaacttgctgaacagctcaaacaggctgaagagctgagacagtacaaagtgttagtgcattcccaggagcgggaattgacccaactgcgggaaaaactgagggaaggaagagatgcttcccgatcattaaacgaacaccttcaagccctgctgacccccgatgagccagataaatcccagggccaagacctgcaggagcagctggcagagggttgccgattagcacagcatctggttcagaaattgagcccagagaacgacaatgatgatgatgaggatgtacaggtggaagttgcagagaaagtgcagaaaagctcttcacccagagaaatgcagaaagccgaggagaaagaagtgccagaggacagcctggaggagtgtgcaatcacatgttcaaacagccacgggccttacgacagcaaccaaccacaccgcaagaccaagatcactttcgaggaggacaaggtcgattctacgttgatcggttcatcttctcacgtggagtgggaagatgctgtgcacatcatccctgagaatgagagcgacgatgaagaagaggaggagaagggccctgtttctccgaggaacctccaagagtcagaggaggaggaggttccccaagagtcatgggatgaggggtattccacactgtcaatacccccagagcgtctggcctcctaccagtcctactcctccactttccattctctagaagaacaacaggtgtgcatggcagtggatatcggtcgccaccgatgggatcaggtgaaaaaagaagaccaggaagcaaccggacccaggttgtctcgcgaattgctggacgagaaggagccagaggtactccaggactcccttgaccgctgttactccactccttccgtctatcttggtttgactgacagctgtcagccttacagatcggctttttacgtgctggaacagcagcgcatcgggctcgccgtggacatggatgagattgagaaatatcaagaggtcgaagaggatcaagatccttcctgccctcgcctttcaagggaacttctagccgagaaagagccggaagttctccaggattcattggaccgatgttacagcactcccagcggctatctggagctgcctgatctgggccagccctatcggtcagctgtgtattccctcgaagaacagtacctaggcttagccctcgacgtggaccgaatcaaaaaggaccaagaagaagaagaagatcaggggccaccctgtccccgactctctagagagctgctggaagtagtcgagcccgaagtcctgcaggattcccttgacgtcatacagctgctgcccgtggttctcaatagtctcaccccagcatccccaacagaggtgccatttatgcactggagaaagaatatgcttgcctttctgctaacttgggagaagctgaaaaggagaggacggggtcggaaagaaggtgaggaggaccagagacggaaggaagagggcgaagagaagaaagggaaaaagataaagacacatcacgcgccaggctcagctgcctgttag

SEQ ID NO: 57796 - DNA, 2373 bp, Artificial Sequence
  Description of Artificial Sequence: Synthetic coding sequence
atgttctcgaatagtaccggaaggctgcccggacagcctacccaagagatccagcagtataaggtcctggtccattcccaggagcgcgaactgactcaactgagggaaaaactgagggagggccgagatgcctcacggagcctcaatgagcaccttcaggccctgctcactcccgacgaacccgacaaatcccaaggacaggatctgcaggagcaactcgctgaggggtgtagacttgctcagcatttagtgcagaagctgagccccgagaacgatgaggacgaggacgaagacgttcaggtcgaggaggatgagaaagtgctggagagctccgccccacgcgaggtccaaaaggcagaggaaagcaaggtaccagaggatagcctggaggaatgtgcaataacctgcagtaacagccatggtccttgcgacagcattcagcctcacaagaatatcaaaataacatttgaggaagacaaggtcaattcatcacttgtcgttgatagggaaagctcacacgatggttgccaggacgctctgaacattcttccagtccctggacccacctcaagcgcgaccaacgtgagcatggtagtatcggcaggacctctgagttcagaaaaggcagagatgaacattctcgaaataaatgagaaactgtgtcctcaattggctgagaaaaagcaacagttccgaagtctgaaggagaagtgctttgtgacccaagtagcatgctttttggctaaacaacagaacaagtacaagtacgaggagtgtaaagacctgattaagagtatgctgcgcaatgaacggcagttcaaagaggagaaactagccgagcagttaaagcaagccgaggagctcagacagtataaagtcttggtccacagtcaggagagggaactgacacagttaagagaaaaattaagagaaggcagagatgcgtcgcggtcactaaatgagcacctccaagctttactgacgcctgacgagccggacaaaagccagggccaggaccttcaagagcagctggcagaaggctgccgcctggcacagcaccttgtgcagaagctttcaccggaaaacgataatgacgatgatgaggatgtgcaggtcgaggtggccgagaaagtgcagaagagctctagcccccgagaaatgcagaaagcagaggagaaagaggtccccgaagacagcctggaggagtgcgcgatcacttgctcgaatagccatgggccatacgatagcaaccagccgcataggaagactaagattactttcgaggaggataaggtcgacagcaccctcattggatcctcatctcatgtggagtgggaggatgccgtgcacatcatccccgaaaacgagagcgatgacgaagaggaggaagagaaggggccagtttcacccagaaatcttcaggagagcgaagaagaagaggtgcctcaggagtcttgggatgaagggtactccactctctcaatcccccctgaacgacttgccagctatcagagctattccagtacattccacagcctcgaggagcaacaggtatgtatggccgtggacatcggccgtcatcgctgggatcaggtcaaaaaggaggaccaggaagctacagggccaagactctcacgagagttattggatgagaaggaacccgaggtcctgcaggactcccttgaccggtgctattctaccccctcagtctatctggggctcaccgactcttgccagccataccggagtgctttctacgtgctcgaacagcagagaattggactggccgttgatatggatgaaatcgagaagtatcaagaggttgaggaggatcaggaccccagctgtcctcgcctgagtagggagcttctcgccgagaaggagcctgaggttctccaggatagtcttgacagatgctacagcaccccaagcggctacttggagttacctgatctgggccagccttacagatcagccgtgtattcccttgaagagcagtacttgggtctcgcccttgatgtcgatcggattaagaaagatcaagaggaagaagaggaccaagggcctccctgccctcgactctctagggaactcctggaagtcgtcgagccggaagtgctgcaggactccctcgatgtgattcaattgctccccgtggttttaaatagcctgacccccgcttccccgacagaagtgccattcatgcactggagaaagaacatgctggcatttttactcacctgggagaagctgaagcgaagaggcagaggcagaaaggagggcgaggaagaccagcggagaaaggaggagggagaggagaagaaggggaaaaagattaaaacccaccacgcccctggcagtgctgcatgctag

SEQ ID NO: 57797 - DNA, 1101 bp, Artificial Sequence
  Description of Artificial Sequence: Synthetic coding sequence
ctggccagttatcagtcctattcatctacttttcacagcctagaggagcagcaggtttgtatggctgtggatataggcaggcacaggtgggatcaggtaaagaaagaggaccaggaagctactggacctcgcctgagtagggaacttttggacgagaaggaacccgaagttttgcaggactccttagatcggtgttacagtactccaagcgtgtacttggggcttaccgatagctgccaaccatataggagcgccttctacgtcctggaacaacagaggataggtttggcagttgatatggacgaaatagagaagtatcaggaggtggaggaggaccaggatccatcttgcccgaggctttcacgcgaactgctcgctgagaaagagcccgaagtgttgcaggattccctggatcggtgctattccactcctagcggatacctggagctacctgatctgggacagccgtacaggagcgccgtttacagtctcgaagagcagtatctgggactggctctcgatgtggacagaattaagaaagaccaggaggaggaggaagaccagggcccaccctgcccaagactgtcaagagagctactcgaggtggttgaacctgaagtactgcaagacagtctgtgctacagcactccctcgagctgtctggaacaaccagactcttgccaaccttatggatcatctttctacgccctggaggaaaagcatgtcggttttagcttggatgtcggtgagatcgagaaaaagggcaagggcaaaaagagaaggggtaggcgatctaagaaaaagagacggaggggcaggaaggagggagaggaggatcagaatcccccttgtccaagactgtctagcgtcctgatggaggttgaggtgccagaagtcctccaagactcactggacaggtactattctaccccttctatgtattttgaattacctgactccttccagcactatcggagcgtgttttattcctttgaagagcaacacattagtttcgcactcgatatggataacaggttttttacgctcacagtccggtccctgcatcttgtgttccagatgggagttattttcccgcagtag

SEQ ID NO: 57798 - DNA, 2517 bp, Artificial Sequence
  Description of Artificial Sequence: Synthetic coding sequence
atggtcgtatcagccggtccatggtcgtctgaaaaagcagagatgaacattctagaaattaacgagaaattgcgccctcagctggcggaaaacaagcaacaatttcggaatctcaaagagcgctgtttcctcactcaacttgcgggatttttggcaaatagacataaaaaatataaatacgaggaatgtaaagacctgataaagtttatgttgcgtaatgaaagacagttcaaagaagagaaattagctgagcagctaaagcaagctgaggaactgcgtcaatacaaggttctggtgcattcccaggaacgcgagcttacgcaacttagggagaagttaagggaaggaagagacgccagtcgatcgctcaacgagcacttacaggcactcttgacacccgacgagccagacaaaagccaaggccaggatcttcaagagcagctggccgaaggatgccgccttgcacagcatttggtccaaaaactctcccccgagaacgacgaggacgaagatgaagacgtacaagtcgaggaggatgagaaggtacttgaatccagcgccccacgcgaagttcagaaggctgaagaatccaaagtgcccgaggactcccttgaagagtgtgcgattacatgcagcaattctcacgggccatgtgattctatccagccacataaaaacattaagataacttttgaggaggataaggtaaactcttccctcgtggttgacagggagtcctcccacgatggctgtcaggacgctctgaacatcttgccagtgcctggtcccacctcttcagccaccaatgtgtctatggtcgtcagtgcaggacccctttcctccgagaaggcagagatgaatattctcgaaatcaatgaaaagctatgtcctcagttagccgagaaaaaacaacagtttagaagcctaaaggagaagtgttttgtgactcaggttgcctgctttctcgctaagcagcagaacaaatacaaatacgaagagtgcaaggacctcattaagtctatgctgagaaatgaaaggcaattcaaggaagaaaagctcgctgagcagttaaagcaggccgaagagctgcggcaatacaaggtgttggtgcactctcaggagcgggagctgacgcagctgagggagaagttacgggaggggagggacgcatcgcggtcattgaacgagcatctgcaggctctgcttactccggacgagcctgataagtctcaaggccaagatctccaggagcagttagctgaaggctgccgactagcacagcatttggttcagaagctgtctccggagaacgacaacgatgatgacgaggatgtgcaggtggaggttgctgagaaagtgcagaagtcaagcagccccagagagatgcagaaggccgaggagaaggaggtccccgaggattctctggaagagtgcgcaattacctgcagcaactctcacggcccatatgattcaaaccagcctcacaggaagccaaaaagtcacctccgcaagacaaagtcaacacaactctctctggcccatccactcatgctgaacggacgcatgttatatacattaagccaaaagatgaaagtgatgatgagaaagagaaaaaagaagggccagtgcctgccaggtatatgccgctctctaaagcgcaggaaaagcccaagatcccccggaatgaaggtgatccgcctgtctcaattcttgctgaaagggcaccggtgggatcaggtaaaaaaggaggaccaggaagctacaggcccaaggctctcccgagagctcctggacgagaaggaacctgaagttctgcaggacagtctggatagatgctacagtaccccttctgtgtatcttggccttaccgactcttgtcagccttacaggagtgctttctatgtactggagcagcaaaggatcgggctggcggtggacatggacgagattgaaaaataccaggaagtcgaggaagaccaggacccttcatgcccccgtttgtcccgagagcttttggcagagaaagagccagaagtcctgcaggattcactagaccgttgctatagcacaccctccggctacctcgaacttccagatctgggccagccctaccgatcagcagtctattctctcgaagaacagtacttggggctggctttagatgtggatagaatcaaaaaagatcaggaagaggaggaggaccagggaccaccctgtccaagactgagccgagagctcctggaagtagtggaacctgaggtgttgcaggactcactcgacgtaatacagctcttaccagtggtactgaattcactaaccccagcctctcccaccgaggttccgtttatgcattggcgcaagaacatgctggccttcctgcttacctgggaaaagctgaaacggaggggacgcggtaggaaagaaggcgaggaagaccagcgaagaaaagaggagggggaggaaaaaaagggcaagaagatcaaaacccaccatgcccctggcagtgctgcctgctag

SEQ ID NO: 57799 - DNA, 258 bp, Artificial Sequence
  Description of Artificial Sequence: Synthetic coding sequence
gagatgcagaaggctgaggaaaaagaagtgcctgaagactccctagaagagtgtgcaattacctgcagtaacagtcatggcccatacgatagtaatcagccccaccgcaagaccaagataacatttgaggaggacaaggttgacagtactctcattggtagcagctctcacgttgagtgggaggatgccgtccacatcatcccagaaaatgaaagtgatgacgaagaagaggaggagaaaggccctgtgtccccttag

SEQ ID NO: 57800 - DNA, 3570 bp, Artificial Sequence
  Description of Artificial Sequence: Synthetic coding sequence
atggcccgacagccccctccaccatgggtgcatgcggcatttctgctatgtctgctgagcctagggggtgccatcgaaattccaatggacttaacccagccgcctacaataacaaaacagtctgccaaagaccatatcgtagaccctcgggataacattctgattgagtgtgaggcgaaaggtaaccctgccccaagttttcactggacccgcaacagcaggtttttcaacattgcaaaagaccccagggtgagtatgcgcagacgtagtggaacactggtgattgacttcaggtcaggaggcagacccgaggagtacgagggcgagtatcagtgctttgcaagaaacaagttcggtactgctctcagcaacaggattcgcttgcaggttagtaaatctccactctggccgaaggagaacctcgatcctgtggtcgtgcaggagggcgcacccctgactctccagtgtaaccctccgcctgggctgccttccccggtgatcttctggatgagtagctcaatggaacccattacccaggataaacgtgtgagccagggccacaacggggatctatactttagcaacgtgatgctccaagacatgcagacggactatagctgcaatgcacgtttccatttcactcatacaattcagcagaaaaatccattcacccttaaggtgctcaccaatcacccttataatgatagcagcctccgcaaccacccagatatgtactccgctcggggtgtcgcggagagaacccccagcttcatgtacccccaaggcactgcatcttctcaaatggttctgcggggtatggacctcttactggaatgtattgcttctggggttcctaccccagatattgcctggtacaaaaaagggggagacttaccgtcagacaaagccaagtttgaaaattttaataaagcacttagaattactaacgtgtccgaggaggacagcggagagtacttctgcttggcctcaaacaagatggggagcattcgtcacaccataagtgttagggtgaaagccgctccttattggctggatgaacctaagaacctgattctcgccccaggcgaagacgggagacttgtgtgtcgggctaacggcaaccccaagcctactgtccagtggatggttaacggtgagcccctccagtccgccccacccaaccccaatcgcgaggtggcgggagatactatcatctttcgggatacacagatctcgtcccgggctgtatatcagtgcaatacttccaacgaacacgggtatctgttggcaaatgctttcgtgtccgtgctcgacgttccaccaaggatgctaagcccacgaaaccagctgattagagtgatcctgtataataggaccagattagattgcccctttttcgggagccccatccccacacttcgatggtttaagaacggccagggctccaaccttgacggcggaaattatcatgtgtatgaaaatggcagccttgagatcaaaatgattcgcaaggaagaccaggggatttatacctgtgtggccactaacatcttagggaaggctgaaaaccaggtgcggctggaggttaaggatccaaccagaatttatcgcatgccagaagatcaggtcgcccgtaggggtacgactgtccaactggagtgccgggtgaaacatgatccctccctgaagttgactgtatcctggcttaaggacgacgagccgctgtatataggcaatagaatgaagaaggaagacgattctctgaccattttcggcgtcgccgagagggaccagggcagctacacttgtgttgcctctaccgagctggaccaggatcttgcgaaagcttatctgacagttctggccgatcaggctactccaacaaaccgcctggccgctttaccgaaaggcaggcctgaccgccctcgtgatctggagctaacggatctcgcggagcggagtgtccggctgacttggattcctggcgacgcaaacaactctcccattacggactatgtggttcagttcgaggaagatcaatttcagcccggtgtttggcatgaccacagcaagtatccagggtctgttaacagcgccgtgctccgcctgagtccatacgtcaactaccagttccgcgttatcgccatcaacgaagtgggaagttctcacccatctctgccaagcgagcgctatcgtacctcaggggcaccgcctgagagcaatccaggcgatgtcaagggagaaggcacgaggaaaaacaatatggagatcacttggacccccatgaatgctaccagcgcgttcggacctaatctacgctatattgtgaagtggcggaggagagagacaagagaagcctggaataatgtcaccgtgtggggttcacgatatgtggtgggccaaacccccgtgtatgtgccatacgaaatccgcgtgcaggcggaaaacgacttcggcaaaggcccagaaccagaatcagtgattggctatagtggggaagattatccacgcgctgctccaaccgaggtgaaggtgcgggtgatgaactcgaccgccataagcctgcaatggaacagagtatactcggataccgtccaggggcagctgagagagtaccgagcctattactggagggaaagttctcttctcaagaatctctgggtgtcccaaaagagacagcaggcgtcgttcccaggcgaccggctccggggtgtcgtgtcaagattgtttccatacagcaactacaagttggagatggtggtggtgaatggtagaggcgacgggcctaggtccgagaccaaggaatttaccacgcccgagggagtgccctccgcccctcggcgtttccgtgtgagacagccaaacctggagaccataaatctggagtgggaccaccccgagcatccaaacggaatcatgataggatatactctcaagtacgtggccttcaacggaacaaaagtaggcaaacagatcgtggagaacttcagcccaaatcaaacaaagtttacagtgcagaggacagatccggtgtcacgatacagatttactctctccgccaggacgcaggttggctcaggagaagccgtgacagaggaaagccctgctcccccaaacgaaggatccccattggctgcgtatacgaataatcaagccgatatagctactcaaggatggttcattggtcttatgtgcgcgattgctctgctggtactgatcctgttgatagtgtgcttcatcaagcgaagcagaggcggtaagtaccctgtgagagaaaagaaagacgtgcctctgggaccagaagatcccaaagaggaggacgggagcttcgactactctgatgaggacaataagcccctgcaaggaagccagacttccctggacggcaccattaaacagcaggagtccgatgactcactcgtcgactatggggaaggtggggagggtcaattcaacgaagacggctcgtttatcggtcagtacacagttaagaaggacaaggaagaaaccgaaggaaatgaatccagtgaagctactagtcctgtcaatgccatttatagccttgcctag

SEQ ID NO: 57801 - DNA, 3774 bp, Artificial Sequence
  Description of Artificial Sequence: Synthetic coding sequence
atggccaggcaacccccacctccatgggtgcacgccgcattccttctttgtctgctaagtctaggtggcgctatcgagattccaatggaccccaatccccagcacaggctgacacaaccgcctaccatcaccaaacagtcagccaaagaccatatcgtggatccaagagataacatcctgatcgagtgtgaggccaaaggcaatcctgccccaagctttcactggactcggaattccaggttcttcaacattgctaaggatccacgagtttccatgcggcgacggtctggtacgctcgtgattgactttcgtagtggaggacgtccagaggaatacgaaggagagtaccagtgctttgcccgtaacaagtttggcactgctctgagcaaccgaatcagacttcaggtctctaaatccccactgtggcccaaagagaatctagaccccgtggtcgtgcaggagggagcccctctgacacttcagtgcaacccacctcctggactgccgtctccggtgatcttttggatgtcatcaagtatggagcctataacacaggataaaagggtgagccaagggcacaatggagacctctacttcagcaatgtaatgctccaggatatgcaaaccgactacagctgcaatgccaggttccacttcacacataccatccaacagaaaaacccctttacacttaaagtgttgaccactaggggcgtggccgaacggacgccttcatttatgtacccccagggcaccgcttccagccagatggtcttgagaggtatggacctgttattggagtgcattgctagtggcgtgcccaccccagatattgcctggtataagaaaggaggggatttgccttctgataaggcaaagtttgagaattttaacaaagcacttaggataactaacgtatcggaagaggacagcggggagtatttctgtcttgcatccaataaaatggggagtatacggcacacaatcagcgtgagggtcaaggctgccccatactggctggacgaacctaagaacctcatcctcgcacctggcgaggatggacgtctggtgtgccgagcaaatggtaatcctaaaccaaccgttcagtggatggtcaacggcgagcccttgcagagcgcacctccaaatccaaatcgagaagtggctggtgacaccatcatctttcgggacacccagatctctagtcgcgcagtctatcaatgcaacacttcaaatgaacacggctacttgcttgccaatgcttttgttagcgtgcttgacgtgcctccgcgaatgcttagtcccagaaaccagcttattagagttattctgtataatcggacgaggctcgattgcccattctttggatcaccaatcccaacccttcgttggttcaagaacgggcaggggtctaacctcgacggaggcaattatcatgtttacgagaacgggagtctggaaatcaaaatgatccgcaaggaagatcaggggatatatacctgtgtcgcgaccaacatcctggggaaggccgaaaatcaggtgcgcctggaggtgaaagatcctacgcgcatctatagaatgcctgaggatcaggtggctcggagaggcactactgtgcagctagaatgcagggttaagcacgatccgtcgctcaaactgaccgttagctggctgaaagacgacgaacccctttatattggcaacagaatgaagaaggaggatgacagcctcacgatcttcggagttgctgaaagggatcaggggtcctatacttgcgtcgcatcgacagagctggaccaggacctggccaaagcttacctaactgtcttagcagaccaagctacacccaccaacaggctagctgccctgcctaaaggccgtccagaccgccctagagatttggaacttactgacttggctgagcggagtgtccggctgacctggattccaggagatgcaaacaactctcctatcacagattatgtggttcaattcgaggaggaccagtttcaacccggtgtgtggcatgaccatagtaaatatcccggttccgtcaattctgctgttctgcggctgagcccctacgtaaattatcagttccgggtcatcgccatcaacgaagttggatcttctcacccatccctgccgagcgagcggtacagaactagcggggcaccgcctgaatctaatcccggagacgtcaagggggaaggaacaaggaagaacaatatggaaatcacgtggacgccaatgaatgcaacaagcgcgttcgggcctaatctgcggtacatcgttaagtggagacggagggagacccgagaggcctggaataacgtcactgtctggggaagccgatatgtggtggggcagactccagtatacgtgccctatgaaataagagttcaggcggagaatgacttcggcaaggggcctgagccagagagtgtcataggatattccggggaggactatcccagagcggcacctaccgaagttaaggtccgggtaatgaattccaccgcgatttcacttcagtggaatagagtatatagcgacactgtgcagggacaactgagggaataccgcgcatactattggcgcgagtcctccctgctgaaaaacctctgggtaagccaaaagagacagcaggccagctttccaggtgacagactgcgcggtgtggtgagtcgactgttcccatactccaactacaaactcgagatggtggttgtgaatggcagaggagacggacccagatccgagacaaaagaatttacaaccccagagggagttccttccgcacctaggcggtttcgtgtgaggcaaccaaacctcgagacgattaacctggaatgggatcatcccgagcatcctaatggaattatgatcggctacaccctgaagtatgtggcctttaacgggactaaagtgggtaagcagatcgtggaaaacttttccccaaatcagacaaaattcaccgtgcagagaaccgaccctgtttccagatatcggttcacccttagcgccaggacccaagttggatctggtgaagccgtcacagaagagtcacctgccccacccaatgaaggatcccccgttatgtctccaccaactctcccgcctactacggtgggggcaacaggggctgtgagctccaccgatgccaccgctattgccgcaactacagaggcgacaacggtccccatcattccgaccgtggcacctaccactatagccactactacaaccgtggccacgaccactaccactaccgctgccgctacaaccaccacagaaagtcctcccaccactacttcaggcacgaagattcatgagagtgcttatactaataaccaggccgacatcgcaacacagggatggtttatcggcttgatgtgcgcgattgccctgctggtcttgatacttctgatcgtgtgcttcattaaacggtcacgtgggggaaagtatccagtccgcgagaagaaagacgtgccactgggcccagaggaccccaaagaggaggatggtagcttcgattattcagacgaggataataaaccattacagggaagtcagacctctctcgacgggaccattaagcagcaggaatcagatgactccctggttgattacggggaaggaggtgaagggcagttcaacgaggacggttcatttataggccaatacacagtgaagaaggacaaggaagaaaccgagggtaacgaatctagcgaagctacatccccggttaacgctatctattcactggcctag

SEQ ID NO: 57802 - DNA, 3675 bp, Artificial Sequence
  Description of Artificial Sequence: Synthetic coding sequence
atggcaagacagcctcctcccccttgggtgcatgctgcgttcctgctctgtctgctgagtctgggcggagcaattgagattccaatggatccaaaccctcagcaccgcttgacccagccccctacaatcacaaagcagagcgccaaggaccatatcgtggatccaagggataatattttgattgagtgtgaggctaagggaaacccggctccaagctttcactggacacggaattcacggttcttcaatatcgctaaagatcccagggtgagcatgaggaggaggagcggaacgctagtcatagattttcgttccggagggcgtccagaagaatacgaaggtgaataccagtgcttcgcccgaaataagtttgggacggccttatctaacaggatacgactgcaggtgtcaaagtctcccctatggcctaaagaaaatctcgaccccgtggtcgtgcaggaaggtgcgccattaaccctccagtgcaaccctccccctggattgccgtccccagtgattttctggatgtccagcagtatggaacccattacacaggacaagcgtgtgtcgcaggggcacaacggtgacctgtatttttctaacgtcatgttgcaagacatgcagaccgattatagctgtaacgctaggttccatttcactcacaccatccagcagaagaatccttttacactgaaggtgttaacgaccagaggggtggcggagaggacgcccagctttatgtatccccagggaaccgcttcttcccagatggtcttgaggggtatggatctgctcctggaatgtatagcctcaggtgtaccaacaccagatatcgcctggtacaaaaaaggcggagatttgcccagtgacaaggctaagttcgaaaactttaataaggccctcagaatcactaacgtgtcagaggaggacagtggagaatacttctgcctcgcatccaacaaaatgggctcgataaggcacaccatctccgtacgggtgaaagcagctccttactggctcgacgagcctaagaatttgatcttggcaccgggtgaagacggccgtctcgtctgccgcgctaacggcaatcctaagcctactgtgcagtggatggtaaatggagagccccttcagagcgcccctcccaatcccaacagggaagtggctggtgacacaattattttcagagacacacagatttcctcacgggctgtttatcagtgtaatacctcaaacgaacacggatatctgttggccaacgctttcgtttcagtcctcgacgtgccacctagaatgctgagccccagaaaccagctgattagagtcatattgtacaaccggacccgcctggactgtcccttttttgggagtccgatcccaaccctgagatggttcaagaacggccaaggctccaatctcgacgggggaaattaccatgtttacgagaacggtagccttgaaatcaagatgatcagaaaggaagatcaaggcatttatacatgtgttgccactaatattttggggaaggcagaaaatcaggtgcggctcgaagtcaaagacccaactagaatttacaggatgccggaagaccaggtggctcgaagagggactaccgtgcagttggagtgcagagtgaagcacgatccgagcttaaagctgacagtgtcttggctcaaagatgacgagccactctacataggaaatagaatgaaaaaggaagatgattccctgaccatattcggtgttgcagagcgggatcaaggctcctatacatgcgttgcctcaacggaactggaccaggacctggcgaaagcatacctcacagttctggcggaccaggcaactcctactaatagactagcagcgctgcccaaaggtcgtccggaccgcccacgggacctcgagctgactgatctagccgaaagaagcgtaagactgacctggatccccggtgacgcaaataattccccgatcacagactacgtggtgcagtttgaggaagatcagttccagcccggtgtttggcatgatcactcaaagtaccctgggtccgtgaattccgctgtgttgcgcctgagcccctatgtgaactatcagttccgtgtcatcgctattaacgaggtgggaagcagccaccctagcttgccatctgaacgctacaggacctcaggcgcacctcccgaatcaaacccaggagacgtgaagggtgagggcacaaggaagaacaatatggaaatcacttggactcctatgaatgccacctctgcatttggacctaacttgagatacattgtcaagtggcgtcgacgagagactcgagaggcttggaataatgtcactgtctggggaagcagatacgttgtcggtcagacccccgtgtacgtaccctacgagatccgtgtgcaagccgagaatgacttcgggaaaggtcccgaaccggaatccgtgatcggttacagcggggaagactaccccagagctgctcctacggaggtaaaggtgcgggtcatgaacagcactgcaatctcactccagtggaacagggtgtattctgacaccgtccagggtcagctgcgtgaatatagggcatactactggcgtgagtccagtttgttgaagaacctttgggtgagccagaagcgacagcaagcgagtttccctggagaccggctaaggggtgttgtcagtaggctcttcccttattctaactacaagcttgagatggtcgtggtgaacgggagaggcgacggcccacgatccgagacaaaagagttcacgacgccagagggcgtgcctagcgcacctcgcagattcagagtacggcagcctaacctcgagacaattaaccttgaatgggatcatcccgaacatcctaacgggatcatgatcggctacacacttaagtacgtagccttcaacggaactaaggttggcaagcagattgtggaaaactttagtcctaaccagaccaagttcaccgtacagaggactgaccccgtctcaagatacaggtttactcttagcgccaggacacaggtcggctctggcgaggctgttaccgaggaatcacccgctcccccaaacgaaggcaaccacacgaaaaagaccgtccccgtgaaagctcaagctcagcctatacagctcaccgatctctacccaggcatgacttacacacttcgggtctactcccgagacaatgaagggatatccagcactgtaataacctttatgacatccaccgcctatacaaacaaccaggccgatatcgctacacaggggtggtttattggactcatgtgtgccatcgctctcctcgttctcattttgctgatagtgtgctttatcaaacggagcaggggaggcaaataccctgtccgcgaaaagaaggatgtgccgctaggccctgaggatccaaaggaagaagatggaagcttcgactacagcgatgaggacaacaagccgctacagggcagccagacttccctggatggcacgatcaagcaacaggagagtgacgacagcctagtggactacggcgaaggcggagaaggccagtttaatgaggatgggtcctttattggacagtacactgtgaaaaaagataaggaagagaccgagggaaacgaatcctctgaggcgacatcgcccgtcaacgcaatctactcactggcctag

SEQ ID NO: 57803 - DNA, 3723 bp, Artificial Sequence
  Description of Artificial Sequence: Synthetic coding sequence
atggccaggcagccaccaccaccctgggtgcatgccgctttcctgctttgccttctcagtttagggggagccattgagatcccgatggacccctcgattcagaacgaactgacccagcccccaaccattacgaagcagagcgcaaaagatcatatcgtggatcccagggacaacattttaatcgaatgtgaggctaaaggaaaccccgcaccgagctttcactggaccaggaacagtcgtttttttaatatagctaaagacccacgcgtgtccatgaggagacggtccggtacactcgtcattgatttccgctctggcggtcgcccagaagagtacgagggggaataccaatgttttgctagaaacaagttcggcacggcactctcaaataggattcggttacaggtttccaagtctcccctttggccgaaagagaacctggacccagtagtagtgcaggaaggcgcacctctcacgcttcagtgcaaccccccaccagggctacctagccctgtgatattctggatgtcttcatctatggagccaatcacacaagacaaacgcgtgagccaggggcataatggggacctgtatttttcaaacgtaatgctgcaggatatgcaaacagattactcctgcaatgcaaggttccatttcacacatacaatccagcagaagaacccattcacgctgaaagtgctcacaaccagaggcgtggccgagcggactccaagtttcatgtacccccagggtacggcttcttcccagatggtactccggggaatggatctgctcctggagtgtatcgcatccggagtgccaacgcccgacatcgcctggtataaaaagggcggagaccttccctccgataaggccaaattcgagaacttcaacaaagcacttcgaattaccaacgttagcgaagaagattccggggagtacttctgtctggcctccaataagatgggctctattcgtcataccataagcgtgagggtgaaggccgcaccttattggctagacgagcctaagaaccttattctggcccctggcgaggacggacggttggtctgccgggcaaacgggaaccctaaaccgaccgtgcagtggatggtcaacggtgaaccactgcaatctgccccacctaaccctaaccgtgaagtcgcgggtgacacgatcattttcagggacacacaaatttcatcccgcgcagtgtaccagtgcaacaccagcaacgaacatggctacctgctcgctaacgccttcgtgagcgtcctggacgtcccccctagaatgcttagcccaaggaatcaactcatcagagtcattctctacaataggactcgtctggattgtcctttcttcggctcgccaataccaaccctgcgttggttcaaaaacgggcagggttccaatctcgacgggggaaactaccacgtgtacgagaacggctctcttgagataaaaatgataagaaaggaagaccagggtatttacacgtgtgtcgcaactaacatcctgggcaaagctgagaatcaggtgcgtctggaggtgaaagatcctactcgcatctacaggatgccagaggatcaagtggcaaggagaggcacaacagtgcaattagagtgtagggtgaagcatgatccaagtctgaaacttactgtgagctggctgaaggatgacgagcctctttatataggcaacaggatgaaaaaggaagatgattcgctgactatctttggcgttgccgagcgcgatcaggggtcgtacacctgcgtagcatcaactgaactggaccaagatctggctaaagcctaccttaccgttctggccgatcaggctacaccaactaacagactggcggctctacctaagggtaggccagataggcccagagacttagagctgaccgatctggctgagagatcagtccggctgacatggattcccggtgacgctaacaattcgccaattaccgactatgtggttcagttcgaggaggatcagtttcagcccggagtttggcacgatcacagcaaataccctggaagtgtcaattccgcggtgctgagactgagtccatatgtaaactatcagtttcgggtaatcgcgataaacgaagtcggcagctcacatccatctcttccatcagaacgctatcgaactagtggagcaccacccgaatctaaccccggagacgtgaagggtgaaggaaccagaaagaataatatggaaatcacatggactcccatgaacgccacatctgccttcggacctaacctgcgctacatcgtcaagtggaggaggcgcgagacccgcgaggcatggaataacgtcactgtgtggggaagccgttacgtcgttgggcagacacctgtctacgtgccctatgagatacgggttcaggctgagaacgattttggtaaggggccagagccagagagcgtgatcggttacagtggggaagatctgccatccgctccgaggcggttccgggtgcggcaacctaatcttgagactatcaatctggaatgggaccacccggaacatccaaacgggatcatgatcggctataccttgaagtatgtggcctttaacggtacaaaggtgggcaagcagatcgttgagaactttagtccaaaccagaccaaattcaccgtgcaacgcaccgatcctgtgagcaggtatcggtttacattgagtgccagaacccaggtggggtcaggtgaagccgtgaccgaagagagccctgccccaccaaatgaagccactcctaccgctgccccaccaactcttccaccaactaccgtcggcgcaaccggcgctgtcagcagcacagatgcaaccgcgatagctgcaactacggaggctactaccgtgcccattattccgacagtggcccctacaaccatcgccaccacaacaaccgttgcaacaaccaccacaacaaccgcggcagcaaccaccactactgaaagccctcctaccacaacatctggaacgaagattcacgagagtgcaccagacgaacaaagtatctggaacgttaccgtactgccaaacagtaagtgggccaacatcacttggaaacacaatttcggtcctggtacggacttcgtggtggagtatatcgattcgaaccacacgaagaaaaccgtgccagtgaaagcacaagcgcaacccatacagctcacagatctgtaccctggcatgacatatacactgcgcgtgtattcacgagacaacgaaggcatatctagtactgtgattaccttcatgacatctaccgcctacaccaataaccaggccgacatagctacacagggatggttcataggacttatgtgtgcgatcgctttactcgtactgatacttctgatcgtatgcttcatcaagcggtcccgaggcggaaaatacccagttcgggagaagaaggacgtccccctcggacccgaggaccctaaagaggaggatggctcattcgactactctgacgaagataataagccactccagggctcccaaacatctctggacggcacgatcaagcagcaagaaagcgatgattcccttgtggattacggtgaaggaggcgaaggccagttcaatgaagacggatccttcatcggacagtatacagtgaaaaaggacaaagaggagacagagggtaacgagtcctccgaagccaccagccccgtcaacgctatttacagtctggcttag

SEQ ID NO: 57804 - DNA, 3510 bp, Artificial Sequence
  Description of Artificial Sequence: Synthetic coding sequence
atggctcggcagcctccgccaccatgggtccatgccgcatttcttctttgtttgctttccctggggggagccatcgagatcccaatggacctgacgcagcccccaaccatcaccaagcagtcagcgaaggatcatattgtggatccacgtgacaacattctcatagaatgcgaagccaaaggaaaccccgcaccctctttccattggacccggaactcaaggttctttaatatagctaaggaccccagagtctccatgaggagacgcagcgggaccctagttatagactttagaagtggcggaaggcctgaagagtacgaaggcgagtatcaatgttttgcacgtaataagtttgggaccgcgctgtccaaccggatacgcttgcaggtaagcaagagtccactgtggccaaaagaaaatctggacccagtcgtcgtgcaggagggcgctcctttaacattgcagtgcaacccccctcctgggctgccatcaccagttatcttctggatgtcgtcctcaatggagcctatcacgcaggataagagggtgagtcagggccacaacggggacctgtatttctctaatgttatgctccaggacatgcagaccgattacagctgcaatgccagatttcacttcactcacaccattcagcagaaaaacccattcacactcaaggtgctgactaaccatccctacaatgattcgtctctgagaaaccaccctgatatgtactctgcacgaggcgtcgcagaaaggacgccgagcttcatgtacccccagggcaccgcatcctcccagatggtgctgaggggaatggacctgctcttggagtgcatcgcttccggggtgccaacccctgatattgcatggtacaagaaaggcggagatttgccctcagataaggccaagttcgaaaattttaacaaggccctaagaattactaacgtgagtgaggaggattccggagagtacttctgtctggcatctaacaagatggggagtattagacatacaattagtgtgagggtcaaagctgctccctactggttggacgaacctaaaaatctgatcctcgcaccaggagaagacggcagactggtctgccgcgctaatggtaaccctaagccaacggttcaatggatggtgaacggcgagccattgcagagtgcaccccctaaccctaaccgtgaagtcgccggtgacaccatcattttccgggatacccaaatttcttctagggctgtctaccaatgcaatacgagcaatgaacacggttatctgttggcgaacgcattcgtgtctgtcctggatgtgcctcctcgtatgttaagtcccaggaatcagttgatccgcgtgatcctgtacaaccggacgcgtctggattgtcctttttttggaagtccaatcccaaccttacgctggtttaagaatgggcaggggtccaatttagacggtgggaattaccacgtttacgaaaacggatccctggaaataaaaatgataagaaaagaggaccagggaatttatacttgtgtggcaaccaatattcttggaaaggccgagaatcaggtgagactggaggtgaaggaccccactcgtatctataggatgccggaggatcaggtggctagaagaggaactacagttcaactggagtgcagagtaaaacacgatcctagtctgaagctcactgtaagctggctgaaggacgacgaacccctctacatcgggaaccgcatgaaaaaggaagatgactcgctgactatcttcggtgtggctgaacgtgatcaaggaagttacacgtgtgtcgcaagcaccgagctcgatcaggacctggctaaagcatacttgaccgtactgggacgccctgatagacccagagatctggagctcactgatctcgcagagcgaagtgtgaggctaacatggatacccggagacgcaaacaactctcctattaccgactatgttgtgcagtttgaagaggatcagttccagcctggcgtttggcacgaccacagtaaataccccggaagcgtcaatagcgctgtcttacggctgtctccgtatgtgaactatcagttcagggtaattgctatcaatgaggtcggttcatcccacccatccctgccttcggagagataccgcacatccggcgcacctcctgagtcaaatcctggggacgtcaagggggaaggcacccgaaagaacaatatggagatcacctggactcctatgaacgccaccagtgccttcgggcctaatcttcgctacattgtaaaatggcggcgaagagaaacacgggaggcatggaacaatgtgactgtttggggcagcagatacgtggtcggccagacccccgtatatgtgccatacgagatcagagttcaggcagagaatgactttgggaaaggcccagaaccagagtccgtgatcggatacagcggcgaggattatcctagagccgctcctaccgaggtgaaggtgagagtgatgaacagcactgcaatcagtctgcagtggaatagggtgtatagcgatacagtacagggccagctaagagaatatcgcgcatactattggcgggaaagtagccttctaaagaacctgtgggtgtctcaaaaaagacagcaggccagcttccccggagacaggctgcgtggcgttgtaagtaggcttttcccctatagtaattacaagcttgagatggtggtcgtgaacgggagaggggatggtcctcggtctgaaaccaaggaattcacaacacccgaaggcgtgcctagcgctccgagaaggttcagggtgcgacaaccaaacctggagactatcaacctggagtgggaccatccagagcacccgaatggtattatgattggttacactctgaagtacgtcgcctttaacggaacaaaagtcggcaagcagattgtggaaaacttctcgcccaaccaaactaaatttaccgttcagcgtactgaccccgtgagtagatacagattcaccctctccgccaggacacaggtgggctcgggagaggcggtgactgaagaatccccagctccacccaacgaagcatatactaataatcaggcggacatcgcgacgcagggttggtttatagggttgatgtgcgctattgccctgctggttctcatccttcttatcgtctgctttatcaagaggtccaggggaggcaagtatcctgtgcgagaaaaaaaggacgtgccattgggcccagaagatcctaaggaggaagatggaagcttcgactattcagatgaggacaacaagccattgcagggctcccagacatctctcgatgggacaatcaagcaacaggaaagcgacgacagcctggtggattatggggaggggggagagggtcagtttaatgaagatggatcttttattggccagtacacagtgaaaaaggataaggaagagaccgaagggaacgaatcatctgaagctacctccccagtaaatgcaatttattctctggcttag

SEQ ID NO: 57805 - DNA, 3216 bp, Artificial Sequence
  Description of Artificial Sequence: Synthetic coding sequence
atggccaggcagccgccacccccatgggtccacgctgcttttctgttatgtttgctgtctttgggcggagcaatcgagattccaatggatcccaatcctcagcatcggctcacgcaacctccaacgatcactaagcagtccgccaaggaccatattgtggatccaagggacaatatcctcatcgagtgcgaagcaaaagggaatcccgctccatcatttcattggacacggaatagtaggttctttaacattgctaaagatccacgggtgagcatgagacggaggagtggaacgctcgtgattgacttcagatcagggggtcggccagaggagtatgagggcgagtaccagtgttttgctagaaataaattcggcacggcactgtccaaccgcatacgattacaagtgtcaaaatctccactgtggcctaaggaaaacctggatcccgtggtggtacaggagggtgctccactaacattacagtgcaaccccccacccggtctcccctctcctgttatcttctggatgtcaagtagtatggagcccatcacgcaagataaaagagtaagtcagggccacaatggcgatctgtactttagcaacgtgatgttgcaggatatgcagacagattactcctgtaacgcacggttccatttcacacacaccatccagcagaaaaatcccttcaccttgaaagttttgacaaccaggggagtggcggagcgaaccccaagctttatgtatccacagggaacagcctcctcgcagatggtcttacggggtatggaccttctgctggagtgcatcgcatcaggcgtccccacgcccgatatcgcatggtataagaaaggaggggacctgccgagtgacaaggccaaattcgaaaacttcaacaaggccctgcgaatcacaaatgtctctgaggaggactccggcgaatacttctgtctggcaagcaataaaatgggaagcatccggcacaccataagcgtgcgcgtaaaggccgctccatattggctggatgagcccaaaaatctgattctagcaccaggcgaggacggccgactggtttgtagagccaacggaaaccccaagccaacggtgcagtggatggtgaacggggaacctctccagagcgccccaccaaaccccaaccgcgaagtggctggggacacgataatatttcgtgacactcagatctcctccagggctgtctatcaatgtaacacttctaacgaacatgggtatttgttggccaacgctttcgtgtcggtgttagacgtgccacctaggatgttgagccctagaaaccagttaattagagttattctctataatagaacgaggttggactgtcctttttttggttctcccatacctactcttagatggtttaaaaacggtcagggttctaatctggatgggggaaactaccacgtttacgagaatggatctcttgaaatcaagatgatcaggaaggaggatcagggaatctacacctgcgtcgccactaacatcttaggaaaagcagagaaccaggttcgcttggaggtaaaggatcctactcgaatataccgaatgccagaggaccaggtggccagaaggggaacgacagtgcaactagaatgcagagtcaagcacgacccaagcctgaagcttactgtgtcatggctgaaggacgatgaacctctttacattggaaataggatgaagaaagaggatgattcactgaccatttttggagtggccgagcgagaccaggggagttatacatgcgtcgccagcacagagctagaccaagatctcgcgaaggcttacctgacggtgctggctgaccaggcgacacctaccaataggctggccgctttacccaaaggaagacctgatagacccagagatctcgagctgaccgaccttgcagaacgcagtgttcggctgacttggattcccggtgacgcgaataattctcctattaccgattacgtggtacagtttgaggaagaccagtttcaacccggtgtgtggcatgatcactctaaatatccgggtagtgtgaattccgctgtacttaggctgtcaccctatgtgaactatcagtttcgtgtgattgccatcaatgaagttggaagtagtcacccctccttgccgagtgagcgctacagaacctccggagctcctccggaaagtaaccccggtgatgtaaaaggcgagggtacccgcaaaaataacatggagataacctggaccccaatgaatgcgacgagcgctttcggacccaatcttcggtacattgttaaatggaggcggagggagaccagggaagcatggaacaatgttacagtgtggggcagtcgatatgtggtaggacagacccccgtctacgtcccatacgagatccgggttcaagccgagaatgactttggtaaagggcctgagcccgaaagcgtgattggctactctggcgaggacctgccaagtgctcccaggagatttcgggttaggcagccaaatttggagaccattaacctcgaatgggaccaccccgaacaccctaacggtatcatgatcggctatacactgaaatacgtggcattcaatgggaccaaagttgggaagcagatagtggaaaacttcagccctaaccaaaccaaattcaccgtgcaaagaacagatccagtatctaggtaccgtttcaccttgtctgctaggactcaggtaggatcgggagaggctgtgacagaggagagtcctgccccacccaatgaaggaagcccagtgatgtcgtatacgaacaatcaggccgacattgccacccagggctggttcatcggcctgatgtgcgccatcgcccttctggtgttgattcttctcattgtttgttttattaaaaggtcgagaggtgggaaatacccggtcagagaaaagaaagatgtcccccttgggcctgaagaccccaaggaggaggacgggagctttgactacagcgatgaagacaataagccactgcagggcagccagacatccttggacgggaccattaagcagcaagagagtgatgacagcctcgttgattatggcgaggggggagagggacagttcaatgaggatgggagttttattggccaatataccgtaaagaaagataaggaagaaaccgagggaaacgaaagttccgaggcaacttcacccgtgaatgctatatatagccttgcttag

SEQ ID NO: 57806 - DNA, 3807 bp, Artificial Sequence
  Description of Artificial Sequence: Synthetic coding sequence
atggccaggcagcctcctcctccctgggtgcacgccgcttttctgctgtgcctgcttagcctgggcggagcaattgagatcccgatggaccccaatccgcagcacaggttgacccaaccacctactataacgaagcagagcgcaaaggaccatattgtcgacccaagggacaatattctcatcgagtgcgaagccaaggggaatcctgcacccagtttccactggacacgcaatagcaggttctttaatatcgctaaagacccaagagtgagcatgcgcaggaggtccggtaccctcgtgattgattttcgcagcggcggacggcctgaggaatatgagggggaataccagtgctttgccagaaataagttcggtaccgctctgtcgaacagaataagattgcaggtgtctaagagtcctttatggccgaaggaaaatctagaccccgtggtcgtgcaagagggtgcccctctcaccctccaatgtaacccccctcctggcctgccctctccggtgatcttttggatgagctcttctatggaacccatcacgcaggacaagcgggtgagccagggccataacggcgacctgtactttagcaatgtgatgcttcaggacatgcaaaccgattacagttgtaacgcacggttccatttcacccatacgatccaacagaagaatccattcacgttgaaagtgctcaccacccgcggagtcgcggaacgcacaccatcctttatgtaccctcaaggcactgcatcctcccagatggtattacgaggaatggacttgcttcttgaatgtattgcaagtggcgtccccactcctgacattgcatggtacaagaaagggggagacctccccagtgataaagccaagttcgaaaacttcaacaaagcactgcgcattactaacgtttctgaagaagatagcggtgaatacttttgcctggcttccaacaagatggggagcataaggcacacaatctccgtgagagtgaaagcagccccatactggcttgatgaaccaaagaacctgatccttgcaccaggagaggacgggagactggtgtgccgtgctaacggcaatcccaaacctactgtccaatggatggtcaatggtgagcccctgcagtctgccccacctaaccctaaccgggaggtggccggtgatacgatcatctttagggacactcagatttcttctagagcggtttaccaatgcaatacttctaacgaacacggctacttattggccaatgctttcgtgtcagtgctcgacgttcccccacgcatgctgagccctcggaaccagctgatcagagtaattctctacaataggacaaggctagactgtccatttttcggcagccccataccaactctgcgctggttcaagaacggccaggggtcaaatctggatggagggaactatcatgtctatgagaacggctccttggagatcaaaatgattcgcaaggaagatcagggaatatatacatgcgtggcgactaatattctgggcaaagctgagaaccaggtccgcctggaggtgaaggatcccacacgaatctataggatgcctgaggatcaagtagcacgcagaggaactaccgttcaattggagtgccgcgttaagcatgatccaagcttaaaactcactgtgagttggctgaaggacgatgaacccctgtatatagggaacaggatgaagaaggaagatgacagtcttacgatttttggggtcgccgagagagaccaaggaagctacacttgcgtggcgagcacagaactcgatcaggacctagcaaaggcatatctgacagtgttggccgatcaagcaacccctaccaatcgcctggccgctcttcccaagggcagaccggacagaccacgggatcttgagctgactgatcttgcagagaggtcagtgcgcctgacctggattccaggtgatgcgaataattccccaatcactgattacgttgtgcaattcgaggaggaccaattccagccaggagtgtggcatgatcactcaaaatacccaggcagtgtgaactccgctgtattgcggttgagcccctatgtgaactaccagttcagagttattgcaatcaacgaggtgggttcttcgcacccctctctgcccagcgagaggtatcggacttccggtgcacctccagagtccaaccccggtgacgtgaaaggtgagggaacccggaagaacaacatggagattacgtggacaccaatgaacgccacatcggctttcgggccaaatctccggtacattgtgaaatggcggaggagagagacacgggaggcctggaacaacgtaactgtgtggggatcccggtatgtggtgggacagacaccggtctacgtcccgtacgagattcgggtgcaggccgagaacgattttgggaagggacccgagcccgagtctgtcataggatactctggggaggattaccctcgcgcagcaccgacagaagttaaagttagagttatgaatagcacagcaatctcgcttcagtggaatcgcgtttactctgatacagtacagggccagctgcgggaataccgcgcttactattggcgtgaaagctctctgctcaagaatctatgggtgtcccagaaacggcaacaggccagcttccctggggaccgcctgcgtggagttgtcagccggctgtttccatattctaattacaagctcgaaatggttgtcgtgaatggccgaggagatggcccacggtctgagacaaaagagttcacgaccccagagggagtacccagtgcccctcgccgatttcgggtaaggcagccaaacttagagaccattaaccttgaatgggaccatccagagcatcctaatgggatcatgataggctatacactcaagtacgtagctttcaacggcaccaaggtgggcaaacagattgtggaaaacttttctcccaaccaaactaaatttacagtccagagaactgacccagtgagtaggtaccggttcacactgagcgcgcgtacccaggtgggaagcggggaggcagtgacagaagagtcacccgcacctccgaacgaaggcagtcccgtgatgtcaccagacgagcaaagtatctggaatgtgactgtgctgcctaacagcaaatgggctaatatcacgtggaagcacaatttcggtcctggcaccgacttcgtcgtggagtacatcgactccaaccacaccaagaagaccgtgcctgttaaggcacaagcacaacccattcagttgaccgatctgtatcccggaatgacatacaccctgcgcgtttacagccgagacaatgaaggcatttccagtaccgtgataacctttatgaccagcactgcctatacaaataatcaggccgacatcgctacccagggctggttcattggcctgatgtgcgctatcgcactgctagtcctgatcctgctcatagtgtgctttattaaaagaagcagaggaggaaaataccctgttagagagaaaaaggatgtccctctcggtcccgaagacccgaaggaagaggatggttcttttgattactccgatgaggacaacaaaccattacaaggctcacaaacatctttggatggcacaattaaacagcaagagtctgacgactccctggttgactatggagaaggcggtgagggacagttcaacgaagatggttcattcatcggccagtatacagtgaagaaggacaaagaggaaacagagggtaatgagagctcagaagcaaccagtcccgtgaacgccatttacagtctggcatag

SEQ ID NO: 57807 - DNA, 3999 bp, Artificial Sequence
  Description of Artificial Sequence: Synthetic coding sequence
atggcccgacagcctcccccaccgtgggtgcacgctgcgttcctcctgtgtctgctgtcccttggcggagcaattgagatacctatggatttgagcattgagactaccgtcacacaacctcctactattacaaaacagtctgccaaggatcatattgtcgaccctcgagacaacatactgatcgagtgcgaggcaaagggcaatcctgcccctagcttccactggactagaaattcccgatttttcaacattgccaaagacccccgtgtttctatgaggcggagaagcggcactctggttattgatttcagaagcggaggacgaccggaagagtacgagggtgaataccagtgttttgctcggaacaagttcggcactgccttgtctaaccgcattcggctccaagtctcaaagagccctctttggccaaaggaaaacttggatcccgtggtcgttcaagaaggagccccattgaccctacagtgtaacccgccacccggactgcctagtccggtaatcttttggatgtcatccagcatggaaccaattacccaggataagcgggtcagccagggacataacggggacctctatttttccaacgtcatgttgcaagatatgcaaactgactacagttgtaatgctcgttttcatttcactcacacaatacagcagaagaatccctttaccctgaaagtgttgactactaggggagtggccgagagaacaccatcgtttatgtaccctcagggaactgcctcaagccagatggttctgagaggcatggatcttcttttggagtgtatcgcaagtggtgtccctacacccgatatcgcctggtacaaaaaggggggtgatctcccctccgacaaggcaaagtttgaaaactttaacaaagcgctcaggatcactaacgtctcggaggaggactctggcgagtacttctgcctggcctccaataaaatgggctccattcgacacactatttccgtaagggtgaaagctgccccttattggctcgatgaaccaaaaaacctcatccttgcgccaggcgaggatggcaggctagtctgtagagccaacggtaaccccaaacccaccgtgcagtggatggtaaacggagaacctctgcaatctgcgcctcccaacccaaatcgcgaggtagccggagataccataatcttcagggacacgcagatttcttcgagagcagtgtaccagtgtaacaccagcaacgagcatggatatttgctagctaatgcatttgtgtcggtactagatgtaccacccagaatgctcagcccacggaaccagctcataagagttattctgtataataggactcgactggattgtccgttttttggtagtccgataccaacgctgagatggtttaagaacgggcaggggagcaacttggacggtggaaattaccacgtgtatgaaaacggctctctggagatcaaaatgatcagaaaagaagatcaggggatatatacttgtgtggcaacaaacatcttagggaaagctgaaaatcaggtcagactggaagtcaaagatccaacaagaatatatcgtatgcctgaagaccaggtggcccgacggggtaccacagtgcagctggaatgccgggtcaaacacgacccgagcctgaaactaacagtcagttggctaaaggacgacgagcctctgtacatcggaaaccgcatgaaaaaggaggacgattctttgaccattttcggtgtcgctgaacgcgatcagggaagctacacctgtgttgcgagcacagaattggatcaggacctggctaaggcgtatctgaccgtcctggggagacccgacaggccacgggatctcgagctgaccgacctcgcagaaaggagtgtgaggcttacctggattccaggcgacgctaacaattctcccatcaccgattatgttgtgcaattcgaagaagaccagttccagcctggcgtctggcatgaccatagtaaataccccggaagcgtgaattcggctgtccttcggctttcaccgtatgtgaactatcagtttagggttatcgccatcaatgaagtgggcagttcccacccttcgctgccgtctgagagataccgaaccagcggggctcccccagagtccaatcccggagacgtgaagggagaaggaacccgcaagaacaacatggagatcacgtggaccccaatgaacgccacgagcgccttcggcccaaatctccggtatatcgtgaaatggagacgcagggaaacccgcgaggcgtggaataatgtgactgtttggggtagtcggtatgtcgtcggccagactcccgtctacgtgccatatgaaatcagagtacaggccgagaacgacttcggcaagggaccagagcctgaaagcgtcataggctactcaggcgaagattaccccagagccgctcctaccgaggtgaaggtccgggtgatgaattcgaccgctatctccctgcagtggaaccgggtttactccgataccgtgcagggtcagcttagggaatatagagcctattattggcgggagtcctctctgctgaagaacctatgggtctctcaaaagcgccagcaggcgtcttttcctggcgatcgactcaggggagtggtctctaggctcttcccttattccaactacaagctcgagatggtggtcgtgaatggcaggggagacggcccacggtccgaaaccaaagagtttacaacccccgagggcgtgccctctgccccacgtcggttccgcgtccggcagcccaatctcgagactattaatctcgagtgggatcaccctgagcaccctaatggaattatgatagggtatacactgaaatacgtcgctttcaacggcactaaggtgggcaaacagatcgtggaaaacttttcccctaatcagactaagtttaccgtgcagaggacagacccagtgtcaaggtacagattcaccctttccgcaagaactcaggtcggctccggagaggctgtaacagaagaatcaccagctccccctaatgaggggaggtgtatggccgctgcacccggagtaaaggggccttccgtcggggctacaggtgccgtcagcagcaccgacgccaccgctatagccgctactactgaagctaccaccgtacccatcatcccaaccgtggctccgactacaattgctaccaccacaacagttgcaaccactaccactaccactgccgcagcgaccaccactacagaaagtccgcctactacaacttcggggacaaagatccatgagagcgctcctgatgagcaatcaatatggaatgtgaccgtgctgccgaattccaagtgggccaacatcacgtggaagcataacttcgggcctggtactgatttcgtagttgaatacattgactcaaatcatactaaaaaaacggtgcctgtgaaagctcaggctcaaccgattcaattaacggatctttacccgggtatgacttacacactcagagtctactcccgcgacaacgagggcatatctagtacagtgattaccttcatgacttctacagcctatacgaacaaccaggcggatatcgctacgcagggctggtttattggactcatgtgcgcaatcgcactgctggttctgatactcctcatagtatgctttataaaaaggagccgtggtggtaaataccccgtacgggaaaagaaagatgtgcctcttgggcctgaagatcccaaggaggaagatggctctttcgactatagcgatgaggataataagcccctgcaaggttctcagacctccctggacggcactatcaagcagcaggagagcgatgactcactggtcgattacggcgagggtggggagggtcagttcaatgaggatggaagctttatcggccagtatacagtgaaaaaagataaagaggaaacagaaggcaacgagtcaagcgaagccacttccccggtcaatgccatctactctttggcctag

SEQ ID NO: 57808 - DNA, 4044 bp, Artificial Sequence
  Description of Artificial Sequence: Synthetic coding sequence
atggcgagacagccacctcccccttgggtccacgccgcatttctgctctgccttcttagcctcggcggtgctatcgaaatccccatggaccctaatcctcagcataggctgacccagcccccaaccatcaccaagcaatcagccaaggatcatatagtggacccaagggataacattctgattgagtgtgaagctaaggggaacccagcaccctcatttcattggacccgaaattccagatttttcaacattgctaaggatccacgcgttagcatgcgtcgcagaagtggcactctggttatagatttccgcagtggaggcaggcctgaagaatacgagggagaataccagtgttttgctcgaaataaattcggcacagctctcagtaatagaattcgcctgcaagtcagcaaatcaccattatggcccaaggaaaacctggaccccgtcgtggtccaggagggggcacccctcacactccaatgcaatccacctcccggtctgcccagtcccgtgatcttctggatgtcatccagcatggagccgatcactcaggataagagagtttcgcaagggcataacggagacctgtatttctccaacgtaatgcttcaggatatgcagacagattactcatgtaatgcgcgttttcacttcacccacacgatccaacagaaaaatccgttcaccctaaaagtgcttactacgcgcggtgtcgccgaaaggacgccctctttcatgtacccgcaggggacggccagctcacagatggtgcttcgaggaatggatttactgctagagtgtatagcctcgggggtgccaactcccgacatagcatggtacaagaagggcggagatcttccctcagacaaggctaaattcgaaaatttcaacaaggctctgcggattaccaacgttagcgaagaggacagcggtgagtacttttgtctcgcatccaataagatgggttctatcaggcacaccatatcagttcgagtgaaggccgcaccgtactggttggatgagccaaagaatctaattctagcacctggcgaagacggcaggctggtgtgccgggcaaacggaaatcccaagcctaccgttcagtggatggtcaacggcgaaccgctccagagcgcccctccaaacccaaaccgggaggtggccggtgatacaatcatcttcagagacacccaaatctcctcaagggccgtgtaccaatgcaatacttctaatgagcacggctatctgttggcgaacgcttttgtgtccgttcttgacgtgcccccaagaatgctatccccccgaaatcagctgatcagggtgatcttgtacaatagaaccaggctcgactgtccattcttcggttctccgattcctacgttacgctggttcaaaaacggccaggggtctaatctcgacggaggcaactaccacgtgtatgagaacgggtctctcgagatcaagatgatcagaaaggaggatcagggaatctacacctgtgtagcaacaaacatcctcgggaaagccgagaatcaggtgaggctggaggtcaaggatccaacccggatataccggatgcccgaggaccaagtggcgagaagaggaacaaccgtgcagctagaatgtagagtgaagcacgatccgtccctgaaactgacagttagctggctgaaagatgacgagcctttatatattggtaacagaatgaagaaagaggatgactccctcactatctttggagtcgctgaacgggatcagggctcctacacctgtgtagctagcacggaactcgatcaagaccttgcgaaagcttatctcactgtgctggctgaccaggctactcccaccaaccggctagccgcactgccaaaaggacggcctgaccgcccaagagatctcgagctaactgacctcgcagaaagaagtgttaggctgacttggattcccggagatgctaacaactcaccgatcacagattatgtcgtccagtttgaggaagaccagtttcaaccaggtgtgtggcatgaccacagcaagtatcctgggagcgtgaatagcgcagtgctgcgcctgagcccctacgtcaattaccagtttagggttatcgcaataaatgaggttgggagcagccacccctccttaccgtctgagcggtataggacgagcggcgcaccacccgaaagtaacccaggagatgtcaagggggaaggtactcggaaaaacaacatggaaatcacctggacccctatgaatgccacctccgctttcggtcccaatctacgctatattgtgaagtggagaaggcgggagacccgagaggcatggaacaacgttactgtgtggggtagccggtacgttgtcggacagacgcctgtgtatgtcccctacgagattcgagtacaagccgagaacgatttcggcaagggtcccgagcccgagtctgtgatcggctactccggagaagactatcccagagctgcacccacggaagtgaaggtccgagttatgaattccaccgccatttccctccagtggaaccgtgtgtattcagacaccgtgcaagggcagcttagggagtatagggcctactactggagagagtcttctctgcttaaaaatctttgggtgagccagaagaggcagcaagcgtcatttcctggtgaccgactccgcggagtggtaagtcggcttttcccatattccaactataagctcgagatggtggttgttaatgggcgtggagatgggccaagaagcgagaccaaggagtttaccactccggagggcgtcccctcggctcctaggagatttcgggtccgacaacccaacctcgaaacaataaaccttgagtgggatcacccggaacaccccaatggtatcatgattgggtacactctgaagtacgtggcattcaatggcaccaaggtgggtaagcagattgtcgagaacttttcccctaaccaaactaagttcacagtgcagcgcacagacccagtctcccgttatcgcttcacactatcagcgcgtactcaggtcggatctggagaggctgttacagaagagtctcctgcccctccaaacgagggcagtcctgtgatgtccccccctaccctaccgccaaccactgtgggcgcaacaggcgcagtttcatccacagatgctacagctatcgctgctaccaccgaggccaccacagtacctattattccaacagtggccccaacaaccatagccacaacaaccaccgtggccacaacaacaactactaccgcagccgcaacgacgaccacagagtccccaccaacaacaacgagcggaacaaagatacatgagtctgctccagacgaacagagcatctggaacgtgactgtgctccctaattctaaatgggctaatataacatggaagcataactttgggccaggaacggattttgttgtggagtatatagacagcaaccatactaaaaaaaccgtgccagtgaaagcacaagctcagccaatacagcttactgatctgtaccccggtatgacctacaccctgcgagtgtactcacgggataacgaagggatatcatctactgtgattacattcatgacatccactgcttatacgaacaatcaggccgacattgctacacaaggctggttcatcggactgatgtgcgcaattgccctgctggtgcttatccttctgatcgtctgcttcatcaagcgatcccggggagggaaataccccgtgagagaaaaaaaggacgtgccgctaggcccagaggatcccaaagaggaggatggaagcttcgactacagtgacgaggacaacaagccacttcagggtagccagacaagcttggatggcactataaaacagcaggagtccgatgacagtctggtggactacggtgagggaggggaggggcagtttaacgaagatggatccttcatcggccagtacactgtcaaaaaagataaggaagaaacagaggggaatgagtcaagtgaggccaccagcccagtgaacgccatttactcccttgcttag

SEQ ID NO: 57809 - DNA, 3723 bp, Artificial Sequence
  Description of Artificial Sequence: Synthetic coding sequence
atggcaaggcagcctccccctccatgggtccacgcagccttcttgctgtgtttactctccctaggtggtgctatcgaaatccccatggaccccagcatacagaacgaactaacccagcctcccactatcacaaagcaaagcgcaaaagatcacatagtggacccaagggataacatcctgatcgaatgtgaagctaagggaaatcctgctcccagcttccactggacgagaaatagtaggttctttaacatagcgaaggacccacgggtgagcatgcgcaggcgatcaggaactctggtgatcgactttaggtccggtggtcgcccagaggagtatgaaggggaataccagtgctttgctaggaataaattcggcacagccctcagtaaccgcattcggttacaagtgagcaagtccccactctggcctaaggagaatttagatccagtggtcgtacaggaaggtgcgcctcttactctccagtgtaatccaccgcctgggcttccatcacccgtcattttttggatgagctcttcaatggagccgatcacacaggacaaacgagtcagtcagggtcataacggagatctgtacttttcaaatgtgatgctgcaggatatgcagacagattattcatgcaatgcaagattccacttcacccataccatccaacagaagaatcccttcacactaaaggttctgacaactagaggtgtcgccgaacgaacaccgtcctttatgtatccccagggcactgcatcctctcagatggtactaaggggcatggatcttctgcttgaatgtatcgcctctggcgtgcccacccctgacattgcatggtacaaaaaggggggtgacctccccagcgacaaggcgaagttcgaaaattttaataaagcccttagaattaccaacgtttctgaagaagattctggagaatacttttgcttggcctcaaacaaaatggggagtattcgacacaccatttccgtgcgagtcaaagctgcgccttattggctcgatgaacccaagaacctaatattggcccctggggaggatggcagactggtgtgtagggccaacggcaaccctaagcctaccgtgcagtggatggtcaacggagagcctctccagtctgccccaccaaaccctaaccgggaggtggctggggataccattatatttcgggacacgcagatttcatccagggcagtgtaccagtgcaacacctcaaacgagcatggataccttctcgctaacgcctttgtctcagtgctggacgtgccccctagaatgctgtctcccaggaaccagttaatcagggtgatactttataacagaactaggctggattgtccatttttcggttccccaattcccacgctacgctggtttaaaaatggccaaggatcaaacctcgacggaggcaactatcacgtgtatgaaaatgggtcacttgagatcaagatgattcgcaaagaggatcagggaatctacacatgtgttgcaacaaatatcctcggcaaggccgagaatcaggtaagacttgaggtcaaggatccaacccggatttaccgaatgccggaggatcaggttgccagaagggggacaacagtccagcttgagtgcagagttaagcatgatccctccttgaagctgacagtgtcttggctcaaggacgatgagcccctctacattggtaatagaatgaaaaaggaagacgatagcctcactatcttcggagtggccgaaagggaccaggggagctacacctgtgttgcaagtactgagctggaccaggacttggccaaagcgtacctcacagtactcgcggaccaggctacgccaaccaacagactcgccgcactccccaaaggcagacccgaccggccaagagacctggagctgactgacttggcagaacgaagcgtgcggcttacttggattccaggcgacgccaacaattctcccattactgattatgtggttcagttcgaagaggaccagtttcagccaggggtatggcatgatcactccaaataccctggtagcgtgaattctgcagtgctgagactttctccctacgtgaactaccaatttcgcgtcatcgctatcaatgaagtcggctcctctcacccttcccttccatctgagagataccggacaagcggtgctccaccggagagtaaccctggcgatgtgaaaggagaggggactaggaagaataacatggagatcacttggactcctatgaacgctacttccgctttcggaccaaatcttcgctatatagtgaaatggcgcagaagggagacacgggaggcatggaataacgtgacggtgtggggtagccgatacgtggtggggcagacccccgtttatgtcccttacgagattcgggtccaggccgagaatgattttggtaaaggcccagagcctgagtccgtcatcgggtactccggagaggacttgccttctgccccaaggagattcagggtacggcagcctaacttagagaccataaatctggaatgggaccatccagagcaccctaatggaatcatgatcggatataccctcaagtatgtggccttcaacggtactaaagttggtaaacagattgttgagaacttctcccctaatcagaccaagtttaccgtacagcggactgatccagtgtctaggtaccgtttcaccctctcagctcggacccaggttggttccggtgaggcagtgacagaggagagcccggcaccaccaaatgaagctacccccaccgcggctccacccaccctgcccccaactaccgttggagccactggagccgtaagctctactgatgccacggccatcgccgcaaccacagaagccacgactgtgcccatcatcccaacggttgccccaacgacaatcgcaactacgacgactgttgccacaactaccactaccaccgcggctgcgactactactaccgaaagtccccctaccactacatcggggactaaaatccacgagtcggcacctgatgagcagagcatctggaacgtgaccgtgctgcctaacagtaagtgggccaatattacttggaaacacaactttggccctgggaccgattttgtggttgagtacatcgatagtaaccacacaaagaaaaccgtgccggtgaaagctcaggctcaacccatccagttgacagacctataccccggaatgacctacacactccgcgtctattcccgggataatgagggcataagcagtaccgttataactttcatgactagcactgcttatactaacaaccaggcagacattgctactcaggggtggtttatcgggctcatgtgtgccattgcgctactggtactcattttgctaatagtttgcttcatcaagagaagcaggggaggcaaatatcccgtacgcgagaaaaaggatgtgcctctgggacccgaagaccccaaggaagaggacgggagtttcgattattcagacgaggacaataagcccttacagggatctcagacaagcttggacgggacgatcaaacagcaagaatccgatgattctctggtggactatggcgaaggcggagagggccagttcaacgaagatggtagcttcattggacaatacacagtcaagaaagataaggaggagaccgaggggaacgagtctagtgaggccacttcccccgtgaacgcaatctattcactcgcttag

SEQ ID NO: 57810 - DNA, 1860 bp, Artificial Sequence
  Description of Artificial Sequence: Synthetic coding sequence
atggcacggcaacctcctccaccttgggttcatgcagcttttttgctttgtctcttgtctttgggcggagctattgagatcccgatggatccatctatccagaacgagctaacccaaccccctaccattacaaaacagagtgctaaagaccatatcgtagaccccagggacaatatacttattgaatgcgaggccaaagggaatccagcgccatcgtttcactggacccgcaacagcagattctttaatatagccaaggacccacgggtcagcatgcggagaaggtccggaacactcgtgattgactttcggagtggcggtaggcctgaggagtacgaaggcgaataccagtgctttgctagaaacaaattcggaaccgccctatcaaacaggatccgactgcaggtaagtaagagccccctgtggcctaaggaaaacctcgatcctgtcgttgtacaggagggtgcccctctgacgttacaatgtaacccgcctcccggactcccatcgccagtcattttctggatgtctagttccatggagcctatcacacaagacaagcgagtgagtcagggacacaacggggatctgtattttagtaatgtgatgctgcaggacatgcagactgattatagttgtaatgcaaggtttcatttcactcacactattcagcagaaaaatcctttcactctgaaggtgcttaccacccgcggtgtggcagagcgcacacccagtttcatgtacccccagggtacagcaagttctcaaatggttctccgtggaatggatcttctgctagaatgtatcgctagcggggtgccaaccccagacatcgcctggtacaaaaaaggaggggacttgccatctgacaaggccaagtttgagaacttcaacaaagctctgagaattactaacgtgagcgaagaggattcaggagagtacttctgtctagcatctaacaagatgggatccatacgccatacgatctccgtccgggtgaaggccgctccatattggctggatgagcctaagaacctcatccttgcccctggtgaggacgggaggctggtctgccgggcaaacgggaatccaaaacctacagtgcagtggatggtgaatggcgaaccactccagagtgctcctcctaatccgaacagagaggtggccggtgatactattatcttcagggatacacagatcagtagtcgtgccgtctatcagtgcaacacctcaaacgaacacgggtatctgttggccaatgcctttgtcagcgttctggatgtgccaccccgaatgttgagcccacgcaatcagttaatccgggtcatcctgtacaatcgcaccagacttgattgtcctttctttggcagccctattcccactctgaggtggtttaagaacggacagggatcaaacctggacggaggtaattatcacgtgtacgagaacggcagcctagagataaagatgatcaggaaagaggatcaggggatttacacatgtgtggccactaacatactggggaaggccgagaaccaagtgcgcctggaagtgaaagacccaaccaggatctacagaatgccagaggaccaggtggcacgacggggaactactgttcagctggaatgccgggttaagcatgaccctagtttgaagttaacagtgtcttggctgaaggacgacgagcctctctacataggcaatcgaatgaagaaggaggacgatagcctgacaattttcggggtcgccgaacgggatcagggttcttatacctgtgtggcttctacggagctggatcaagatctggccaaggcctatttaaccgtcctcgggaactgtccctgcagcccttggcactag

SEQ ID NO: 57811 - DNA, 3525 bp, Artificial Sequence
  Description of Artificial Sequence: Synthetic coding sequence
atggcccgacagcccccacccccatgggttcacgctgcatttctgctctgcctgttgtcactgggaggcgctatagaaatacctatggacctcacccagcctcctacaataaccaagcagtctgccaaagaccacatcgtagacccacgcgacaacattctcatcgaatgcgaggccaaaggtaatccggctccctctttccattggacacggaactctcgcttctttaacatcgcaaaggatccacgtgtgtctatgaggagacggtcaggaaccttagtcatcgatttccgcagtggaggaagaccagaagagtacgaaggggaatatcagtgctttgctcggaacaagttcggaaccgctctaagcaacagaatacggcttcaggtcagtaaatcccctctttggccaaaagaaaatttggaccctgtcgtcgtgcaggaaggcgcacctcttaccctgcagtgcaatccccctcctggtcttcccagtcccgtcatcttctggatgagcagcagcatggaacctattacccaggataaacgtgtctctcagggccacaacggcgatctgtactttagtaacgtgatgctccaggacatgcagaccgattacagctgtaatgctcggttccatttcactcacacaatccaacaaaagaaccccttcacactaaaagtgttgactaatcatccttataacgatagcagtctgcgaaatcatccagacatgtacagcgcgaggggcgtggctgagaggacgccttcctttatgtatccccaaggcacagcctcgtcccaaatggtgctccggggaatggatctcctgctggaatgcattgccagtggcgtcccaaccccagacatcgcttggtacaagaagggaggcgatttacccagcgataaggctaagtttgagaactttaataaggcgcttaggatcactaatgtgtccgaagaggactccggggagtacttttgcttggcttctaacaagatggggtcaataagacatacaatctccgtgcgagttaaggcggcaccttactggctggacgagccaaagaacctcatactcgcacccggagaggatggcaggcttgtctgtcgggcaaacgggaacccaaagcctacagttcagtggatggtgaatggcgaaccgctgcagagcgctccaccaaatccgaatcgggaagtggccggtgacactattatctttagagacacccagatctctagcagagctgtgtatcagtgcaacacaagcaacgagcacgggtatctcctggccaatgcttttgttagcgtccttgatgttcctccccgtatgctgtccccgaggaaccagctcataagggtcatcttgtataatcgcacacggcttgactgtcctttctttgggagtcctatccctaccctgaggtggttcaaaaacgggcagggttccaatctcgatggcggtaactatcatgtttacgagaacggcagccttgagatcaagatgataagaaaagaggatcagggtatttacacgtgtgttgccactaacatcctaggaaaggctgaaaatcaggtgaggttagaagtgaaggatcccactagaatttaccgcatgccagaagatcaggtggcgagacggggtactacagtccagctcgagtgcagggtaaagcacgaccctagcttgaagctgacagtgtcgtggctcaaagatgacgagcctctgtacatcggaaacagaatgaagaaggaggacgacagcctcaccatatttggagtggcagaaagagaccaagggtcctacacatgtgtggcctctacggaattggaccaggatttagccaaggcatacttgactgtgttagggaggcctgaccgaccaagggatttagagcttacggacctagccgagaggtccgtgagacttacgtggatccctggggacgcaaataactctcccatcaccgattacgtggtgcagttcgaagaagatcaatttcagccaggtgtgtggcatgaccacagcaagtatcccggatcagtgaactctgccgtgctgcgcttgtccccgtacgtaaactatcagttccgtgtgattgccattaacgaggtggggagctcccaccctagtctgccaagtgagaggtacaggacttccggggcacctcccgagagcaatccgggtgatgtgaagggggagggtacacgtaaaaacaacatggagatcacctggacccctatgaatgcgacctcagcctttggtcctaacctgcgatatattgtgaagtggcgtcggagggaaacaagagaagcctggaataatgtaacagtgtggggaagtcgatacgtggtgggtcaaactcccgtgtatgtgccttacgaaattagagtacaggcagagaatgacttcgggaagggccctgagccggaatccgttatcgggtactccggcgaggactacccacgggctgctcctacggaggttaaagtgagggtgatgaattccacagccatttccctccagtggaatagagtgtattccgacacagttcagggtcagctgagggaatatagagcatactactggcgcgagtcatccctgctaaaaaatttgtgggtctctcaaaaaagacagcaggcatcctttcctggcgataggctgcgcggagtggtatcacggttgtttccttactccaattacaaactggagatggtggtcgtgaatggtcggggtgacggtcccagaagtgagacgaaagaattcaccaccccagagggcgtgccgtctgctcccagaaggttcagggtgaggcagcctaatctggaaacaattaacctggaatgggaccacccggagcatcccaacggcattatgattggctatacgttgaaatacgtggcgttcaacggaacaaaggtaggaaaacagattgtagagaacttttcccccaaccagacaaaattcactgtccagagaacggatccagtctctaggtaccggttcacattgagcgctcgaacccaagtggggtcaggagaggctgtcacagaagagtcccctgctcctcccaatgaggcaacccctacagccgcatatacgaacaaccaagcagacattgcaactcagggctggtttataggcctgatgtgcgccatcgctctgttggttctgatcctgctgatcgtctgcttcatcaagcgatcaagagggggtaagtatccagtgagggagaaaaaggacgtgccactcggacctgaggatccaaaagaggaagatggttcgttcgactacagcgacgaggataataaacctctgcagggttcgcagacctccctggacggcactattaagcagcaagagtccgatgactccctcgtggactacggcgagggcggagagggccagttcaatgaggacggctcattcatcggccagtacactgtgaaaaaggataaggaggagactgaggggaatgagagctcggaggccacctcgccagtaaacgcgatctactccttagcttag

SEQ ID NO: 57812 - DNA, 3498 bp, Artificial Sequence
  Description of Artificial Sequence: Synthetic coding sequence
atcgaaatccccatggatctcacccagcctccgacaattacaaaacagtccgcaaaggaccatatagtagatccaagggacaacatcctaatagaatgcgaggcaaaggggaaccctgccccaagctttcactggacgcggaatagcagattttttaatatcgctaaagacccaagggtgtcaatgaggcgtcggtccggcacccttgtgatagatttccgaagtggcggacgccctgaagagtacgagggggagtaccagtgcttcgccagaaataagtttggaacagccttatctaataggatccgcttgcaagtgagcaagagtcccctatggcctaaagaaaacctagatccggtggtggtgcaagaaggtgcccctctaaccctgcagtgcaacccacccccaggactgcctagtcctgttatattctggatgagctctagcatggagcccatcactcaggataagcgcgtttcccagggacataacggtgacctctacttcagcaacgtgatgcttcaggatatgcagactgactacagctgcaacgcccgttttcactttacccatacaattcaacaaaagaatccattcacactcaaggtgctgacgaaccacccttacaacgactccagcttgcggaaccatccagatatgtattcagccaggggggtagccgagcgaacaccgagcttcatgtacccacagggaacggcatcatcacagatggtgcttagaggaatggacctcctgcttgaatgcattgcctctggagttcctaccccagatattgcttggtataagaaggggggtgatctcccaagtgacaaggctaagtttgaaaatttcaacaaagctttaagaattacaaatgtgagcgaggaagattcgggagagtacttttgcctggcatccaataagatgggatcaatccgccacaccattagcgttagagtgaaagcagccccatactggctggacgagcctaaaaatctcatccttgctcccggagaagacgggaggctcgtgtgccgggcaaatggcaatccaaagccgacagtccagtggatggtgaacggggagccattgcaatccgctcctcctaacccaaatcgcgaggtagcgggagacaccatcattttccgcgatacacaaatttcgtccagagctgtttaccagtgcaataccagcaacgaacacggttatctcttagccaacgctttcgtctcagtgctcgatgtgccaccccgaatgctttctcccaggaaccaactgatcagggtgattctatacaatcggaccagacttgactgcccgttttttgggtcaccaattcctacacttcggtggttcaagaatgggcaaggctctaacctcgacggcggtaactatcatgtctacgagaatggtagcctggagatcaagatgatccggaaggaggatcagggcatttatacatgtgttgctaccaacattttaggaaaagcagaaaatcaggtccggctcgaggtgaaagatcccaccagaatttatagaatgcccgaggaccaggtggcaagaagggggaccactgtgcaactcgaatgccgcgtgaaacacgaccctagcttgaaactaaccgtttcatggctaaaagacgatgagcccctgtatatcggtaacaggatgaaaaaggaagatgacagtttgacgattttcggcgtagcagaaagggatcagggctcatacacttgtgttgcgtctacagaattagaccaggatctcgccaaggcgtatctgaccgttctggccgaccaggcgactcccactaatcgactggctgcactgcctaagggcaggcccgatcgcccacgggatctggaactgacagatttggcagagaggtcggtaaggctcacgtggataccaggggacgccaacaacagccccatcacagactatgtcgtgcagttcgaggaagaccagtttcagcctggcgtgtggcatgaccatagcaaatacccaggatctgtcaacagcgcggttttgcgcctttccccatacgttaattatcagttccgagtgattgctatcaatgaggtggggtcctcacacccctctctgccttctgagagataccgtacttcgggcgcacccccagaatctaaccctggcgatgtgaagggcgagggcacccggaagaacaacatggaaattacctggacaccgatgaacgcaactagtgcgttcggcccaaacttgaggtacattgtgaagtggcgcaggcgagaaactagagaggcgtggaataatgtcactgtgtgggggtcacgctacgtggttggacagacgccagtgtacgtgccctatgagataagagtacaggctgagaatgactttggcaagggtccggagcctgagtctgttatcgggtacagcggagaggattacccgcgtgccgcacccactgaagttaaggttagagttatgaattccacagccatatccctccaatggaacagagtatactctgacaccgtgcaggggcaactccgggaatacagggcctactactggcgggagagcagtctgctgaagaacctgtgggttagccagaaacgccagcaagcaagtttcccgggagaccggctgcgcggagtggtgtcgcgtttattcccctacagcaattacaagctggaaatggtggtggtgaatggacgaggggatggaccgcgttccgaaaccaaagagttcactacccccgagggcgttccctcagcaccaagacgcttcagggttaggcagccaaatctagagaccataaatctcgagtgggatcatcctgagcaccccaatggcattatgatcggatatacgctgaaatacgtggccttcaatgggacgaaggtggggaagcagattgtcgaaaacttttcccccaaccaaacaaagtttacagtccagcgaacagaccccgtaagccgataccgcttcacactgtcagcaagaacacaggtgggcagtggtgaggctgtaaccgaagaatctccggctcctcctaatgaggctacacctactgcagcctacacgaacaatcaagccgacatcgcgacccaaggatggttcatcggcctgatgtgtgcaatagcactgctggtccttatacttctcattgtctgctttattaaacggagtcgcggaggaaagtatccagtacgggaaaagaaagatgttcctttaggacctgaggacccgaaggaggaggatggctcattcgactatagtgatgaggacaacaagccattacaggggagtcagacttctcttgatgggaccatcaagcagcaggaaagcgacgatagccttgtcgattacggggaggggggagagggccaattcaacgaggacgggtccttcattgggcaatatactgtgaagaaggataaggaggagactgaaggcaatgaatctagcgaagctaccagccccgttaatgcaatttacagcctggcgtag

SEQ ID NO: 57813 - DNA, 909 bp, Artificial Sequence
  Description of Artificial Sequence: Synthetic coding sequence
atggccagacaaccccctccaccctgggtacacgcagcttttcttctgtgcctcctgtcactcgggggtgctatagagatcccgatggacccctctattcagaatgagctgactcagccgcctactataaccaagcaaagtgcgaaggaccacatcgtagaccccagggataacattcttattgaatgtgaggcgaagggaaacccggcacctagctttcattggacaagaaactcacgctttttcaatatcgccaaggacccacgggtgtcaatgaggcggagatcaggcacgcttgtgatagatttccgtagcgggggacgcccagaggagtatgaaggggaatatcaatgcttcgcacgcaataagtttggcactgcgctgtcaaacagaataagacttcaggttagcaagagccccctgtggcctaaggaaaacctggaccccgtagttgttcaggagggcgctcctctgacactgcagtgcaatccgccacctggattacctagcccagttatcttctggatgtcaagcagtatggagccgattacgcaggacaagcgtgtaagtcagggacacaacggagacttatatttttctaacgtaatgctccaggatatgcaaaccgactattcatgtaatgcccgattccactttacacataccattcagcagaaaaaccctttcaccctcaaagtgctgaccacacggggtgtggctgagcgaacccccagcttcatgtaccctcagggaaccgccagcagccagatggtgctacggggaatggatctgctcttggagtgtatcgcttccggcgtgccgacccccgatatcgcttggtacaagaagggaggcgacttaccctccgacaaagcaaagttcgagaactttaacaaggcactgcgatag

SEQ ID NO: 57814 - DNA, 390 bp, Artificial Sequence
  Description of Artificial Sequence: Synthetic coding sequence
atggctcgccagcccccacccccatgggtgcatgccgcatttctactgtgtctactcagcttaggaggagctatcgaaatccccatggatccttcaatccaaaacgagctcactcagcctcccacaatcactaaacagagtgcaaaagaccatatcgtggatcctagagacaatatcctgattgaatgcgaagcaaagggtaatcctgcaccttcgttccactggacacggaactcacgatttttcaatattgccaaagatccaagggtgagcatgcgtaggcggtcaggaaccctggtgattgacttccgatccggcggacggccagaagaatatgagggtgagtatcagtgcttcgctcgcaacaagttcggtacggccctttcctag

SEQ ID NO: 57815 - DNA, 3510 bp, Artificial Sequence
  Description of Artificial Sequence: Synthetic coding sequence
atggcgcgacagccccctccgccatgggtacacgctgcgttcctactttgccttctttctctggggggagccatcgagattcctatggaccttacccagcctccaacaattaccaagcagtcagctaaggaccatatcgtagatcctcgggacaatattctgatagagtgtgaggcaaagggtaatccagcaccttccttccactggaccagaaacagccggttttttaatatcgctaaagacccgcgagttagcatgagaaggaggagcgggacactggttatagactttagatcaggtggcagacctgaagagtatgagggagagtatcaatgtttcgctcgcaacaagtttgggaccgccctgtctaaccggataagacttcaggtgagcaaaagccccctctggccgaaggagaatcttgaccccgtggtggtgcaggagggggcacccctaacgctgcagtgcaacccccctcccggactgccatcgcccgtaatattctggatgtcctcttcgatggaacccattacacaggacaaaagggtctctcaggggcacaacggtgatctgtacttttccaacgtgatgctccaggatatgcagactgactactcgtgcaacgcacggttccactttactcatacaatacaacaaaaaaatcctttcacactgaaagtcttgacaaatcacccctataatgactcctccctaaggaatcacccagatatgtacagcgcaagaggtgtagctgagcggacacctagttttatgtacccgcagggaactgccagcagccagatggtcttgaggggtatggatctgttgctggaatgcatcgcctccggggtcccgaccccagacatcgcttggtataagaaaggcggtgacctgccatctgacaaagcaaagttcgaaaatttcaacaaggctctgcggatcacaaatgtttccgaagaggatagcggggagtacttctgtctcgccagtaataagatgggcagtatccggcacaccatctctgtaagagtcaaggcagcaccctattggctggacgaacctaagaaccttattttggctccgggagaggatgggcgtttggtctgcagggccaacgggaatccgaagccaacagtccagtggatggtgaacggggaacccctccaaagcgcccctccaaaccccaacagagaagttgctggagacacaatcatttttcgtgatactcagatttcttctcgagccgtgtaccagtgcaacacctctaacgaacatgggtatctactggccaacgcgttcgttagtgtcctagacgtcccacctcgaatgctttcacctcggaatcagctgattcgtgtgatcctgtacaatcgaacgcgtcttgactgtccctttttcggatcaccaattcccacccttagatggttcaaaaatgggcagggatccaatttggacggtggtaactaccacgtttatgaaaatggaagtttggagattaaaatgatccgaaaggaggaccagggtatctatacatgtgtcgctactaatatccttgggaaggctgagaaccaagtcaggctggaagtcaaagaccccacacgaatttatcggatgccagaggaccaggtcgctcggagaggcacaactgtccagctggaatgtagggtaaagcacgatccttctttgaaactcactgtctcctggcttaaggacgatgagccactctatattggaaacaggatgaagaaggaagacgacagcctgactattttcggcgttgcagagcgcgatcaaggctcctatacatgtgtcgcaagcacagagttggaccaagacctcgctaaggcttaccttaccgttctgggccgaccagacagacctcgggacttggagctgaccgacctcgctgaaagaagcgtgagactgacatggatccccggtgatgccaataattccccaatcaccgactacgtggtccagtttgaggaagatcagttccagccgggagtgtggcacgaccactcgaagtaccctggatcagtgaattccgcggtactgcgactgtccccttatgtcaattaccagtttagagttattgccatcaatgaagtgggatctagtcatcccagtttgcccagcgagaggtatcggacctcgggtgcaccccctgaaagcaacccaggggatgtgaagggggagggaacccggaagaacaatatggaaatcacatggacacctatgaacgcaacttctgcgtttgggccaaacttgaggtatatcgttaaatggagacgcagagagacccgcgaggcctggaacaacgtcaccgtgtggggctcccgatatgtggtgggccagaccccagtgtatgtaccctatgaaatccgggtgcaagcagagaacgacttcggcaagggcccagagcctgagagcgtgatcggatacagcggggaggactaccctagggcggcacctactgaggtaaaagtgcgagtgatgaatagcactgctatctccctgcagtggaatagggtatacagcgataccgttcagggccagttgcgagagtacagggcgtactactggcgcgaatctagtctgctgaagaatctttgggtgagtcagaagaggcagcaggcctcatttcctggagacaggctacgcggtgttgtgagccgtttgttcccctactccaattataagcttgaaatggtggtggtcaacggacgcggagacggtcctagatctgagacgaaggaattcacaactccagaaggagttcccagcgcccctcggagatttcgtgtaagacagcccaacctggagaccatcaaccttgaatgggaccatccggagcaccctaatggcatcatgattggatacactctcaagtacgtcgcttttaacggaactaaggtcgggaaacagatagtagaaaatttctcccctaatcagacaaagttcactgtgcaacgcactgatccagtttcccgctaccgattcacgctttcagcaagaactcaagttggaagtggagaggcggtgactgaggaaagccccgctcccccaaacgaagcatacaccaacaatcaggccgacatcgccacacagggatggtttatcggacttatgtgtgcgatcgccctactcgtgctgatactactcatagtgtgcttcatcaaaaggtctaggggaggaaagtaccccgttcgtgagaagaaggatgtgccgctggggcctgaggacccaaaggaagaggatggtagttttgattattccgatgaggataataagcccctgcagggatcacaaaccagtctcgatggcaccatcaaacagcaggagagtgatgattctctagtcgattacggggagggaggggagggtcagttcaatgaggatggttcgtttattggccagtataccgttaagaaagataaagaagaaacggaaggaaacgaatcatcggaagctaccagccccgtcaatgcaatctactccctggcctag

SEQ ID NO: 57816 - DNA, 3525 bp, Artificial Sequence
  Description of Artificial Sequence: Synthetic coding sequence
atggcgagacaaccccctcctccatgggtccatgcggcattcttactgtgcctcctgtctctgggcggagctatagagatccccatggatctgacacagcctcccactataaccaagcaaagcgctaaggatcatatcgttgacccacgagacaacatactgatcgagtgcgaggccaaaggtaatcctgccccttcttttcattggactagaaacagcagattctttaatatagctaaggacccacgggttagcatgcgcagacgcagcggcacgttagtgatagattttagatcaggtggtcggcctgaggagtacgagggcgagtaccagtgcttcgctcggaacaaattcggcactgcgttgagcaatagaataagactccaagtgagtaagtcaccattatggcccaaagaaaatcttgatcctgttgtggtacaggagggagcgcctttgaccctgcaatgtaaccctccaccaggacttccgagtccagtcatattttggatgagctcttctatggagccaatcacccaagataagcgggtctctcaaggacataatggcgacctatacttttcaaacgtgatgctgcaggacatgcaaaccgattactcctgcaatgctaggtttcattttacccacactattcagcagaaaaatccttttaccctcaaggttctcaccaatcacccatacaacgactcaagtctcagaaaccaccccgacatgtatagtgccagaggcgtggctgagcggaccccttcctttatgtacccacaaggaaccgccagctctcaaatggttcttcggggtatggacctcctgctagaatgcattgcatccggtgtgcctacccctgatatcgcttggtataaaaaagggggtgacctgcccagcgacaaagctaagtttgaaaactttaataaggctcttagaattaccaacgtatcggaagaggactcaggggaatatttttgtctggcatctaacaaaatgggcagcatcaggcatactatcagcgttcgagtgaaagccgctccctactggctcgatgagccaaagaacctcatactagcccctggggaagacggcaggctcgtatgccgcgctaatggaaacccaaagcctacggtccagtggatggtgaatggggagcccttacagtctgctcctcctaatcccaatcgtgaggtcgctggcgataccattatcttcagggacacccaaatcagttctagggctgtctatcaatgcaatacaagcaacgagcatggatatctccttgcgaatgcctttgtgtcggtgctggacgtcccaccgagaatgctgtccccaaggaaccaactcatccgagttattctctataatagaactcgcctagactgtccctttttcggctctcctattcccactctgcgctggtttaaaaacgggcagggctccaacctcgacggcggaaactatcacgtgtacgaaaacggttccctggaaatcaagatgattcggaaggaagaccagggcatttatacttgcgtggctacaaacattctgggtaaagccgagaatcaagttcgcttagaagtgaaggaccctacacgcatttatcggatgcccgaggatcaggtggcaagaaggggcactacagtccagctggaatgccgggtgaagcatgatccttctctcaaactgactgtcagttggcttaaggacgatgagcctctgtacatcggcaacagaatgaaaaaagaggacgatagtttaaccatcttcggagtcgcggagagggaccaagggagctatacttgcgtggcatccacagagctcgatcaggacctggccaaggcctatctgaccgtcttggggagacccgaccgcccaagggaccttgagctgacagacttagctgagagatccgtgaggctcacatggattcctggagacgctaacaattctcccattaccgactacgtggtgcaatttgaggaagaccagttccagcccggagtttggcatgatcatagcaagtacccagggtccgtgaactccgccgtgctgaggctcagcccttacgttaactaccaatttcgcgtcattgctattaacgaagttggctctagccatccctctctgcctagcgagcgataccggacctctggcgctccccctgaatccaatcctggcgacgtcaagggggaagggacaaggaaaaacaatatggagattacctggacaccaatgaacgctacaagtgcatttgggcctaacttgcgatacatcgtcaaatggaggcggagggagacccgggaggcatggaataacgttactgtgtggggctcccgctacgtggttggtcagactccggtgtacgtgccatacgagattcgcgtgcaggcagagaatgatttcggtaagggtcccgaaccagagtctgtcattggatattctggggaagattatccaagggcagcccctaccgaggtaaaggtgcgagtcatgaattcgacggccatctcactgcaatggaatagagtctactctgatacagtgcagggacagcttcgagagtatagagcctattattggcgagagagttcacttctgaagaatctctgggtgtcacaaaaaagacagcaggcctcattcccaggcgacaggctccggggagtggtgagccgcctgtttccctactcaaactataaacttgagatggtcgtggtgaacggtcgcggtgacggaccgcgatcagagacaaaggagttcactactcccgagggtgtaccctccgctccaagacgattccgggtgaggcagccaaatcttgaaactatcaacttggagtgggaccaccctgaacacccgaatggtatcatgattgggtataccctgaaatacgtggcctttaacggcaccaaagtggggaaacagatcgtcgagaacttcagtccaaatcagacaaagttcaccgttcaaaggacagatcccgtatctagatatcggttcactcttagcgcaaggactcaagtgggatcaggtgaagccgtaaccgaagaatcccctgcacccccaaatgaggccactccgacagctgcctacactaataatcaggcggatatagcaacccagggttggtttattggcctgatgtgtgcaattgccctgctggtcttaattcttctgatcgtttgtttcattaaacggtctcgaggaggaaagtatccagtgcgagaaaagaaagacgtgcctctggggccagaggatccgaaggaagaagatggatcttttgattattcggacgaagataataagccactgcaaggctctcagaccagtctggacggtaccattaagcagcaggaatctgacgacagcctggttgactacggagagggcggagaaggtcagttcaacgaagatggttcttttatcgggcagtataccgtgaagaaggacaaagaagaaaccgagggcaacgagtccagtgaggccacaagtcccgtgaacgccatttactcactggcttag

SEQ ID NO: 57817 - DNA, 1503 bp, Artificial Sequence
  Description of Artificial Sequence: Synthetic coding sequence
ctgaagttccttgccgtgctgttagctgctggaatgctggcatttctgggcgctgtgatttgcattatagcaagcgtcccactggccgcttccccagctagggctcttcctggtggagccgacaacgccagcgtcgcgtcgggtgcggcagcaagtccagggcctcagagaagcctgtctgcccttcacggtgccggaggcagtgcaggacccccagctctcccaggcgctcccgcagcatctgcccatcctctccctccagggccactgttttcgcggttcctatgcacgcccttagccgctgcctgtccctctggggctcagcagggagacgccgctggtgcagccccaggcgaaagggaggagctcttactcctccagtccacggcagagcagctgagacagactgcgctacagcaggaggccaggattcgagctgaccaggacactataagagagctgacaggcaaactgggtaggtgcgagagcggcttgcctagaggactgcagggtgctgggcctagaagggacaccatggctgatggaccctgggacagcccagctttgatattagaacttgaagatgccgtgcgcgctttgcgggataggatagatagactagagcaggagctccccgcaagagtcaatttgtctgctgcgcctgctcctgtttctgcggtccctacaggcctgcacagcaaaatggaccagctcgagggccagttgctggcccaggtgctggcccttgagaaggagagagtcgccctttctcattcctctaggcgtcagcggcaggaagtcgagaaggagctcgatgtactgcaaggacgtgtagccgaactggagcacggttctagcgcatacagccccccagatgcatttaagatcagcattcccatccgtaacaactatatgtacgccagggtgaggaaagctcttcccgagctgtacgctttcactgcttgcatgtggttacgctcccgatccagtggaacaggacagggtacaccatttagctactccgtccctggccaggctaacgaaatcgtgctactagaggcagggcacgagcctatggaactgcttatcaatgacaaggtcgcccagttgcccctgagtctgaaagataacggctggcaccacatttgcatagcttggaccactcgagacggactttggtcggcttatcaggatggcgagttgcaaggtagcggagagaatcttgcggcttggcatcctataaagcctcatggcatccttattctgggacaggagcaggataccctgggagggaggttcgacgccactcaggccttcgtcggcgacatcgcccagttcaatttatgggatcacgcactgactccagcccaggtgctgggcatcgcaaactgcacggccccactcctggggaatgtgttaccttgggaagacaagttggtggaggcctttggcggagcgacaaaagccgcttttgacgtctgcaagggtcgagccaaggcctag

SEQ ID NO: 57818 - DNA, 2526 bp, Artificial Sequence
  Description of Artificial Sequence: Synthetic coding sequence
atgaatttgctgtaccgcaaaacaaagcttgagtggcgccagcacaaggaggaagaggcgaagaggtctagctcgaaggaagtggccccagccggaagtgctggacccgcagccggacagggcccaggcgtccgtgtcagggacattgcaagcctccgcagatctttgcgcatggggttcatgacaatgcctgcctcccaggaacacacacctcacccctgccggagcgccatggcgcctcgctcactcagctgtcactccgtgggtagcatggattcggtgggaggcggtccagggggtgcctcaggtgggttgacagaggactcatccacaaggaggcctcctgccaaacccaggcgccatccctcgaccaaactgagcatggtgggccctggcagcggggctgaaaccccaccttctaaaaaagctggttcccagaaaccaaccccagagggccgtgagtcaagcaggaaagtcccaccgcaaaaacctcggcgaagccctaatacacagctgtccgtctctttcgatgaatcatgcccccctggtcctagtccgcgaggcggaaacctgcccttgcagcgactgactcggggaagccgcgtcgcgggagaccccgatgtgggggctcaggaggaacctgtatacattgagatggtgggtgacgtgtttcggggaggagggagatccgggggaggcctggcgggtccacctctggggggagggggaccaacacctccggctggagcggactctgatagcgaggagagtgaggccatttatgaggagatgaagtatcccctgccagaggaggcgggtgaaggccgtgccaacgggccaccaccgctaactgccacttctcctccccagcagcctcacgcccttcctccccacgctcatcggagacccgctagtgccctacctagtagacgcgatggcacacccactaagaccaccccctgtgagattccacctcccttcccgaatctcctgcagcaccgcccaccactgctggcatttcctcaagcaaaatccgctagcaggacccccggagatggggtgtctcgcctgcctgtcctttgccattcaaaagaaccagcgggtagtaccccagctccccaggtccctgcaagggagagagagaccccaccaccccctccccctccccctgcagctaatttactgctgctgggcccatctggaagagcaaggtctcattctaccccacttcccccacagggcagtggccagccccgaggtgaacgagagctaccaaattcacactccatgatctgtccaaaagctgcaggcgctcccgcagccccacccgctccagcagccctcctccccggaccccctaaagataaagctgtttcctacacaatggtctactcagccgtgaaggtgactacacatagcgtcctccctgctgggcctcccctcggcgcaggcgaaccgaaaactgagaaggagataagtgtgctgcacggaatgttatgcactagctccaggccgcctgtgcccggtaaaaccagcccgcacgggggagccatgggcgcagccgctggagtgttgcaccacaggggatgtctcgccagtccccacagcttacccgacccgactgtggggcctttaactcctctgtggacttatccagccacagcagcgggtctgaagaggcctccagcttacgagtctctcaaggctggcggagttctgaacaaagggtgcggagttggagctcctagcccaatggtcaagattcagcttcaagaacagggaactgatggtggagcttttgcgtctatcagctgcgctcatgtgatagcctccgccggtactcccgaagaggaggaggaggaggtgggcgctgctacctttggcgctgggtgggccctccagcgaaaagtgctctacggtggaaggaaagccaaggaactcgacaaagtcgaggacggggctagggcttggaacggctctgccgagggcccagggaaagtcgagcgcgaggaccggggaccaggaactagcgggattccagtgaggtctcagggcgcagaaggtctgctggccagaattcaccatggagatagagggggaagtcggaccgccctccccatcccttgccaaacatttcctgcctgccacaggaatggggacttcacaggtgggtaccgcctgggcagaagcgctagtacgagcggggttagacaggtggtactacatacaccacgtccctgttctcagcctcgagacgcactgtcccagccacatcctgctctccctctgcccttgccactgcctcctcaaccagcaagagagcgcgacggaaaactgcttgaggtcattgagaggaagagatgtgtctgcaaggaaattaaggcccgacacaggcccgatagaggactctgcaaacaggaaagtatgccaatccttccatcctggaggaggggcccagagcccaggaagagcggcactcccccatgtcgcagacagcacaccgtcctgtgggatactgctatatag

SEQ ID NO: 57819 - DNA, 2529 bp, Artificial Sequence
  Description of Artificial Sequence: Synthetic coding sequence
atgaatctgctatatcggaaaacaaaactcgaatggaggcagcacaaggaggaggaagccaagcggagctcttccaaggaggttgccccagctggatctgcaggacctgccgctgggcagggccctggagtgcgtgttagagacatcgctagccttagacgctcactgaggatggggtttatgactatgcctgcaagccaggagcatacaccacatccttgtcgctcagctatggctccacgctctctttcctgccattcagtcggttcaatggattctgttgggggtggccctggcggagcttccggtggtctgaccgaggacagcagtaccaggcgtcctcccgcaaaacccagacgccacccctcgacaaagctctctatggttggccctggaagtggggcagagactcccccatcgaaaaaagccggttcccaaaagccgactcctgagggcagggagtcttcccgcaaggtcccgccacagaaacccaggcgaagtccgaatacccagctgtccgtcagtttcgacgagtcttgcccacctggccctagccctaggggtggtaacctccctcttcagagactgacgagaggaagccgagttgctggggaccctgatgttggtgctcaagaggagccggtgtatatcgaaatggtcggcgacgtgttccgtggagggggtaggagcggtggaggactggcgggtccccctttgggcggaggaggacctactccaccagctggcgcagattctgacagtgaagaatctgaagccatttatgaagagatgaagtacccacttcccgaggaagctggtgaggggagagccaacggtccccctcccctaacagccacatctccccctcagcagccgcatgccctgcctccgcatgcccaccgtcggcctgcaagcgcgttgccctcccgcagggacggcacacccacaaagaccacaccgtgcgaaatcccgcctcctttccctaatctgttacagcacagaccacctttactggcctttccccaggccaaaagcgctagcaggaccccgggtgacggcgtgtcaagactgccagtactgtgtcacagtaaagaaccggctgggtccacacctgcacctcaagtgcctgctcgcgagcgtgagacccctccacctccacccccaccccctgctgcaaacttgctcctcctggggccttcggggcgagcaaggtctcattcaacacctctcccgcctcaggggtcaggtcaacctagaggtgaacgagaactaccaaacagtcactcaatgatttgccctaaggcagccggtgctcctgccgcaccaccagctcctgcagctctcctccctggacctcctaaagacaaggctgtaagttatactatggtgtacagcgcagtaaaagttaccacccactctgtccttccagccggaccgccactgggagctggcgagcccaagacggagaaagaaattagcgtgcttcatggaatgctttgtacatccagtaggccaccagttccagggaagacttccccgcacggaggggctatgggcgcagccgcaggggtgctacatcacaggggatgtctggcttctcctcattcacttcctgaccctactgtcgggcctctcacacccctgtggacctatccagccaccgccgctggtctcaaacgcccaccagcatacgagtccctaaaggccggaggggtcctcaataagggctgtggtgtcggggcaccttcaccgatggtcaaaatacagctccaagagcaaggaaccgacgggggtgcatttgcatcaatcagctgtgcacacgtgatcgcctcagcaggcacccctgaggaagaggaggaggaggtcggcgctgctaccttcggcgcagggtgggctttacagagaaaagtcctctatggcggaaggaaggcaaaagagttggatacagaagtggaagatggagcgagagcttggaacgggtctgcagaggggcctggaaaggtagagcgagaggaccggggtccagggacatctggcatccccgtgcgaagtcaaggcgcagaagggctccttgcccgaatccaccatggagaccgcggagggtctcgaactgcgctgccaattccttgccagacgttccccgcttgccaccggaatggcgattttacagggggttatcgccttggcagatccgcgtctacttccggcgtccgacaggtggtgctgcacacccccagaccttgcagtcagcccagagatgcactctcccaaccacaccccgctctcccactgccgctgcctctgccgccacaaccagcacgcgagagggacggcaagctgctcgaagtcattgagagaaagagatgcgtttgcaaagagatcaaagcaagacatcgtcccgatcgcggtttgtgtaagcaggagagcatgccaattttacctagttggaggcgcggtcctgaaccgagaaaaagtggaacacccccatgtagaaggcaacacaccgtgttgtgggatactgctatctag

SEQ ID NO: 57820 - DNA, 2358 bp, Artificial Sequence
  Description of Artificial Sequence: Synthetic coding sequence
atgggattcatgaccatgcctgcctcccaggagcacacccctcatccgtgccgttcagcaatggcacctaggtctctatcctgtcatagtgtcggatcaatggatagcgtgggcggtggtcctggaggtgcttcaggcggtcttacagaggattcctccacccggcgacctcctgctaagcctcggagacatccatctacaaagctgagtatggtggggcctggttcaggggcagagaccccaccctccaaaaaggcgggatcacaaaaacccacacccgagggtcgcgaaagctctaggaaagtaccgccacagaagcctcgccgatccccgaatactcagctgagtgtgtcatttgatgagtcctgcccacccggaccatcacctagaggaggaaacctccctttgcagaggctgactaggggatctagggtagcaggagatcccgatgttggagctcaggaggaacctgtctacatcgaaatggtcggagatgtgttccgcggtggcggtagatcaggcggaggtctcgctggacccccactcgggggaggcggtcccacaccacctgcaggagctgactcagactccgaggaatccgaggcgatctacgaggagatgaagtacccattacccgaagaagcaggcgaagggagggctaacggacctccacctttaacagctacatctccccctcagcagcctcatgctctgccaccacacgcccatagacgccctgcgtcagccctgccttctcgtcgggatggcacacccactaaaacaacaccttgtgaaatcccccctcctttccctaatctattacagcaccgcccacctctcctggccttcccacaggctaagtctgcgagccggacccctggagatggtgtgtcgcggctgcctgtcttgtgtcactctaaggaacctgctggaagcacaccagcaccacaggtacccgctcgggagcgggaaacacctccacccccacctcctcctccagctgcaaatctcttgctgctcggcccaagcggccgtgccaggtctcattcgacacccttacccccacagggcagtggccaacccagaggagagcgggaactgcccaactcccatagtatgatctgccctaaggctgctggagccccagccgctcctccagcgccagcggcactgctgcccggtccacccaaggacaaggccgtatcatacacaatggtttacagtgcagtgaaagttacaacccactccgttctccccgctggcccacctctgggagctggcgaacccaagaccgagaaggaaatcagtgtgctccatggcatgctgtgtacgagtagtcgacctcccgtgcctggcaaaaccagtccgcatggtggtgccatgggtgcagccgctggagtgttacaccaccggggttgcctggccagcccccactctctgcctgatcctactgtcggtcctcttacacctctgtggacatacccggctaccgcagccggattgaaacggcctccagcctacgaaagtctgaaagctggaggggtgctgaataagggctgcggtgtgggggctccatcccccatggtcaagattcagctgcaggagcaggggaccgacggcggagcatttgcctccatatcatgtgcacacgtcatcgcctccgcaggaacccccgaggaagaggaggaggaagtcggtgccgctacattcggcgcaggctgggctctccaaagaaaggtgttatacggaggaaggaaggccaaagagttggatacagaggtggaggacggagcgagggcttggaatgggtccgcggagggtccagggaaggtcgagagagaggacagaggaccaggcacctctggtattcctgtgcgtagccagggcgcagagggcctgttagcgaggatacaccacggagaccgcggtggaagcaggactgcacttcctataccctgtcaaactttcccagcgtgccacaggaatggcgattttaccgggggttaccgcctcgggaggtcagcctctacaagcggcgtgaggcaggtggttctgcacacccctagaccgtgcagccagcccagggatgctcttagtcagccacaccccgctctgcccctgcctctgccccttcctccacaacctgccagggagcgcgacggcaagctgttggaagtaatcgagaggaaacgatgtgtatgtaaagagataaaggcaagacatcggcctgatagaggactgtgcaagcaggaatccatgccaatcctgccctcctggaggaggggccctgagcctcgcaagagcggcacaccgccatgtcgacgccagcatacggtattgtgggacaccgcgatttag

SEQ ID NO: 57821 - DNA, 1962 bp, Artificial Sequence
  Description of Artificial Sequence: Synthetic coding sequence
atgattagcagcaagatgatgtcctctaaccctgaggaagaccctcttgacacctttctgcagtacatagaggacatggggatgaaagcatacgatggtcttgtcatacagaatgcatcagacatcgccagggagaatgataggttgcgaaacgaaacaaacctcgcttacctcaaagaaaagaatgagaaacgtcgacgacaggaggaggcaatcaaacggatagggggtgaagtgggcaggggtcacgaagggagttacgtcggcaagcacttccgcatggggtttatgaccatgcctgcacctcaagatagactccctcatccgtgttcttccggattctccgtgcgttcacagtctcttcactcggttggtgggaccgatgacgattcgtcctgcggctctcgccgacagcctcctcctaaacctaagcgcgatccatcaacaaagctctcaacttctagtgaaacggtgtcgtctaccgcggcttctaagtccggcaaaaccccagaaaggactgaggcctcagctaagcctcggcctcatagtgacgaatattccaagaagattccgcctccgaaaccaaaacgaaaccctaatacccagctgagtacctctttcgacgagacttacatcaagaagcacggccctcgtcggacatctctgcccagggattcatcactgtctcagatgggaagtcctgcaggcgaccctgaggaggaggaaccagtttacatcgaaatggtgggcaacatcctgagggatttccgtaaagaggacgacgaccagagcgaggccgtgtatgaggaaatgaagtaccccattttcgacgatctgggtcaagatgctaagtgcgacttcgatcaccatagttgctcgagtcagtgtgctactcctaccgtccctgatctggattttgctaaagctagcgttccctgtccacctaaaggcctgctgtgcgacattccccctccctttccgaatctgctttctcaccgccctccgttattagtgttccccccagctccagtccattgctcgccaaactctgatgaatcaccactgacacctttagaagtgaccaagctgcccgtgctcgagaacgtgagctacatgaagcaacccgctggagctagtccatctactctgccctctcatgtgcctggtcacgcaaagctggaaaaggaacaggccgctgctctcggccctgcaagcgccactcccgctctgagttctagcccaccacctccatctacactgtatagaacccagtcaccgcatggttatcccaagagccattcaacttctccttctccagtcagcatgggaagatccctaaccccactgagcctaaaaaggccacccccatatgacgcagtgcattctggctctctgagccgatcaagtccatctgtcccacacagcaccccacgcccagtaagccaagacggcgctaagatggtcaatgccgcagttaacacttacggcgctgcacctggtggttccaggtctagaactccaaccagccccctggaagagctaacctctctcttctcctccggcaggtcactgctgcggaaatcctcaagcggacgcagatcaaaggaacccgctgaaaaaagcacagaagagctcaaagtgagatctcattccacagagcctctgcctaaactggataacaaggagagaggacaccatggtgcgagcagctcccgcgaacccgtcaaggcacaggaatgggatggcactcccggaacccctgtggtcacatcgcggctgggtaggtgctccgtgagccctaccctgctggctgggaaccactcttccgaacccaaggtgtcttgtaagctaggacggtccgctagtaccagcggagtgccaccgccaagcgtgacgccccttaggcaatcttcagaccttcagcagtctcaggtgccgtcgagcctagcgaacagggactag

SEQ ID NO: 57822 - DNA, 435 bp, Artificial Sequence
  Description of Artificial Sequence: Synthetic coding sequence
atgatatcctctaaaatgatgagcagtaacccggaggaggaccctttggatacctttcttcaatatatcgaggacatgggtatgaaagcatacgacggtcttgtgattcagaatgcctcagacatcgcaagagagaatgatcggctccgtaatgagacaaacttggcctacctcaaagaaaagaacgagaagcggaggcgtcaggaagaagcgataaagcggattaatagagggactgaatcccctaaaccccagcacggggcaattactaaggtcggccagcaaggcaagcgacctccatggggagtatttttacaaagagcatgccagtccagcggcatgggttggaatacacgggatacctgcgggcaccagtctaccagaaagatgctgtgtgaaccacacctagtgagcgggaaaccgcaattccgatag

SEQ ID NO: 57823 - DNA, 498 bp, Artificial Sequence
  Description of Artificial Sequence: Synthetic coding sequence
ctcgcctggcgcccaggggagcgtggggcaccggctagtcgtcctcgcctagcactccttctgcttctcttgctcctgccgctgccctctggcgcttggtacaaacacgtggcatccccaaggtaccacaccgtgggcagggctgcgggacttctgatgggcctgcgtagatctccctatctgtggagaagggcgctgagggcagccgctggacccttggctagagacaccctatcccctgaacccgctgcccgagaggctcccctcctcctcccaagctgggtacaggagctgtgggagacaagaagaagaagctcccaagcaggtatacccgtgagagccccaaggagcccgagggccccagagccggctttggagccggagtcattggacttcagtggagcgggtcagcgtcttcgcagagatgtctcacggcctgcagtggaccctgctgcaaatcgcctggggctaccatgcctggctccaggcccattttag

SEQ ID NO: 57824 - DNA, 1260 bp, Artificial Sequence
  Description of Artificial Sequence: Synthetic coding sequence
atgaacagacatctgtggaagtctcagctctgcgagatggtgcaacctagtggcggtccggcagctgaccaggacgttttaggcgaagagtcgccattgggtaagcccgcaatgctgcacctgccttcagaacagggcgctcccgagacactacagcgatgtctggaagaaaatcaggagttgagagacgcaattcgccagagtaaccagatacttcgcgagagatgtgaagaattgctccactttcaggcaagtcagagggaggagaaagagttcttgatgtgtaagtttcaggaggcacgtaagcttgttgaaaggcttgggcttgagaagctggatctcaaacggcagaaagagcaggccctgcgtgaggtcgagcacttgaaacgctgccagcagcaaatggcagaagacaaggccagcgtgaaagcgcaggttacctccctgttgggggagctccaggaatcccagtctagactcgaagctgccaccaaggaatgccaggccttggaaggaagggccagggccgcaagcgagcaggctcggcagctcgagtctgagagagaggcgctgcagcagcagcactcagtgcaggtggatcagctgcggatgcagggtcagagcgtggaggcggcattgagaatggagagacaagccgcttctgaggagaaacgaaagcttgcacaactgcaggtggcctaccaccaactgttccaagagtacgacaaccatatcaaatccagcgtggtggggtccgaacgtaagagaggcatgcaactcgaagatttgaaacaacagctgcagcaggccgaggaggctctggtggcaaaacaagaggtcatcgataaattaaaggaggaggcagagcagcataagatcgtgatggagactgtgccggttctaaaggcccaggccgatatctacaaagccgacttccaagcagaaagacaggcccgagaaaaacttgccgagaaaaaggagcttctgcaggagcagttggagcagctacagagagagtatagcaaactgaaggcatcgtgccaggaaagcgcgagaattgaggacatgagaaaaaggcacgttgaggtttcacaggctcctctgcccccagcgccagcctatctgagtagtccactggcattaccgtcccagaggaggtcacctccagaagagcccccagatttctgttgccctaagtgccaatatcaggccccagacatggacacgctccaaatccacgtgatggaatgtatcgagtag

SEQ ID NO: 57825 - DNA, 1209 bp, Artificial Sequence
  Description of Artificial Sequence: Synthetic coding sequence
atgcccccagtttcacgctcttcctacagcgaggacatagtgggaagtagaagaaggcggagatcgagctcagggtcccctccaagtccccagtcaagatgttcatcatgggatggctgtagcagatctcattccagaggtagagaggggctgagacctccgtggagcgaactggatgtgggtgctctgtacccattttctcggtcaggcagccgaggcaggctgcccaggtttcggaattatgcattcgcctcctcatggagcacatcttattctgggtaccggtaccacagacactgctacgctgaggagcgccagtccgccgaggactacgaaaaagaagagagccacagacagcgcaggctcaaagaacgcgagcgtatcggtgagctgggcgctcccgaagtatggggcccttcgcctaagtttcctcagctcgactctgatgagcatacaccggtagaggacgaagaagaagttacgcatcaaaagtcctcaagcagtgatagcaactctgaggagcaccggaagaaaaagacctctcgaagccgcaacaagaaaaagagaaaaaacaagtcttccaagaggaagcaccgcaaatattcagattccgacagcaactcagagtctgacacgaactccgatagtgacgacgacaagaagcgcgttaaagctaaaaagaagaaaaaaaagaagaaacacaagactaaaaagaagaagaataagaaaactaagaaagaatctagtgattccagctgtaaggactcagaagaggacctatcagaagccacttggatggaacaaccaaacgtcgccgacaccatggatctgataggcccagaagcccctattatccacacgtcccaagatgaaaagccattgaaatatggtcatgctcttttgcccggtgaaggagcagcaatggccgaatatgtgaaggctggcaagagaatccctcgcagaggtgaaatcggacttacaagcgaagaaatcggctccttcgagtgtagtgggtacgtgatgagtggcagtcggcaccgacggatggaagccgtgaggctcaggaaggagaaccaaatctattccgccgatgaaaagcgcgcacttgcaagtttcaatcaagaggaacggaggaaaagagagagcaagattttggcctcttttcgcgagatggtgcacaaaaagactaaagagaaagacgacaaatag

SEQ ID NO: 57826 - DNA, 576 bp, Artificial Sequence
  Description of Artificial Sequence: Synthetic coding sequence
atggggaagagctgcaaggtcgtggtttgcggtcaggcatctgtcgggaaaacgtcgatcctcgagcagctgctttacggtaaccatgttgtcggcagtgagatgatcgaaacccaggaggatatatacgtggggagtatcgagactgaccgcggtgtaagggaacaagtccgcttctacgataccagaggacttagggacggagctgagctgccacggcattgcttcagttgtactgacggatacgtactcgtgtactctaccgattcccgggagtctttccagcgcgtcgagctgttgaagaaggagattgacaagagtaaagataaaaaagaggtgacaatcgtcgtattgggtaacaagtgtgacttgcaagaacaaagacgcgtggacccggacgtggctcagcactgggccaagtctgagaaggtgaaactttgggaggtatcggtcgcggacagacggtccctgctggagccctttgtttaccttgcctccaagatgacacagccccagtccaagagtgccttccccctgtcacggaaaaacaagggctccggttccctggacggctag

SEQ ID NO: 57827 - DNA, 2181 bp, Artificial Sequence
  Description of Artificial Sequence: Synthetic coding sequence
atggcggctccagggggaaggggaaggtcattgtccggcttactcccggcacagacctcacttgaatatgcactcctagacgcggtgacacagcaggaaaaagatagtctggtctaccagtacctgcaaaaagtcgatggttgggaacaggatctgtcagtgcccgaattcccggagggcctcgagtggctgaataccgaagagcccattagcgtgtataaggacctctgcggcaagattgtggtgctcgactttttcacttactgttgcatcaactgtatacatttgcttcccgacctgcacgcccttgagcatacgtattctgataaagatggactgctgatcattggagtacactctgccaagtttcccaacgagaaggtgttagataatataaagtctgcagttttaagatacaacattacacaccccatggtgaacgacgcggacgctagtctatggcaggaactcgaggtatcctgctggccaactcttgtgattctcggcccaagggggaacatgttgttctctctcatcggcgagggacataaggataaattgttcttgtatacgtcaatagcgctgaagtactacaaagaccgaggacagataagggacaataagatcggcattaagttgtataaagattctttgccaccttcaccactactgtttcccggaaaggtcacagtggatcaggtgaccgatcgactggtgatcgcggacaccggccaccacaggatcctggtggtctggaaaaacggccaaattcagtacagcatcggtggtccaaacccgggtagaaaggacgggatattttccgagagcacctttaacagtccgcagggtgttgcgatcatgaacaacatcatctatgtagccgatactgaaaatcacctgatcaggaagatcgacctcgaggcagaaaaggtcagcacagtggccggaattgggatccaggggaccgataaagaagggggtgccaagggagaacagcagcctatttcctcaccttgggacgtcgtttttggcacaagcggtagcgaagttcagcgcggagacattctgtggatcgccatggccggaacccatcaaatttgggccttacttctggactccggaaagctcccaaagaaaaacgaactgactaaaggcacatgcctgagatttgccggatctggcaacgaagagaaccgtaacaatgcttatcctcataaggccggttttgcacagccctccgggctctccctggctagcgaggatccttggagctgcttatttgtggctgactctgaaagcagcactgtaaggacagttagcctgaaagatggtgctgtgaagcacctggtgggtggcgaacgcgaccctatgaacctgttcgcttttggagacgttgatggggtcggcatcaacgccaaactgcagcatcctctaggtgtgacctgggacaaaaaacgcaacctcttatacgttgccgattcgtacaaccacaagattaaggttgttgatccgaagacaaagaactgcaccacacttgccggaaccggcgacaccaacaatgttactagttccagctttactgagtctacatttaatgagccaggcggtctgtgcataggagaaaatggagaactgctctacgtagctgacaccaacaatcaccagattaaagtgatggacttggaaactaagatggtttcagtactacctatattccgatcagagaatgcagtcgtggatggcccattcctggtggaaaagcagaagacgctgcccaagcttcctaagagtgctccaagcatccgtctgtctccggtgaccgcatgcgccggtcagactttacagttcaagctgcgattggatcttccttcaggcagcaaattaaccgaaggcgtgtcttcatgttggttcctcaccgctgaaggcaatgagtggttactgcagggccagattgctgctggcgacatcgagaacataagctctcagccaacaatatcactccagataccagatgactgtctgtctcttgaagcgatcgtgagcgtgtctgtgttcctctactactgcagtgcggactcttcggcttgcatgatgaaggccattctttttagccagccactccagatcacggatacacagcagggctgcattgcacctgtcgaattacggtacgtgttttag

SEQ ID NO: 57828 - DNA, 372 bp, Artificial Sequence
  Description of Artificial Sequence: Synthetic coding sequence
atgctcgggctggaagggccatgctgggtcggtcctggtcctgacggcggactggctgtttcagaggagttcggggatgtgagactgtttggttcagccagacagcctctgggctctctaggtgggtggactgggcatacctttggctgcccggctgggatatgctcaaacagtgaaggcaatgttatagtagccgacgagcagagaagacaggttacattgttcccacgcgctggccctcctatctgtctggtctccgaaggactcggccagccgcttggcgtggcttgcgcaccgcaaggtcaactattagtggcagacgccaaagacaactctattaaagtgtatcagggactcaaagaattggcatag

SEQ ID NO: 57829 - DNA, 372 bp, Artificial Sequence
  Description of Artificial Sequence: Synthetic coding sequence
atgcttggactcgaaggtccatgttgggtgggccctgggccagatggcggactggcagtgtccgaagagttcggggatgtgagactctttggcagtgcacgccaaccgctggggagcctgggcggatggactggacacacgttcggttgccctgccggtatttgctctaactcagagggaaatgttatcgttgcagacgagcagaggcgtcaggtaaccctgtttccacgagccggaccccctatttgtctggtatcggaagggctgggccagcctcttggcgttgcctgcgctcctcaggggcagctcctggtcgccgatgctaaagataattcaattaaggtgtaccaaggactgaaggagcttgcttag

SEQ ID NO: 57830 - DNA, 4821 bp, Artificial Sequence
  Description of Artificial Sequence: Synthetic coding sequence
atggtggttttcataaatgcgaagattaagtcactcataaaactgttcaagaagaagactgtgagcaacttagacgaagaaagtaggtggaccgtccactacacggctccttggcaccagcaggagaacgtctttctgcctacaacaagaccgccatgtgtggaagacctgcacaggcaggcgaagctgaatctaaagtcagtgttgagagagtgcgacaagctaaggcacgatggctacagatcttctcagtactactcacaggggcctacatttgctgcaaacgccagccccttttgcgacgattaccaggacgaggatgaggagactgaccagaagtgttctctcagcagcagcgaagaggagcggttcattagcatccggagaccaaaaacgcccgcaagcagtgacttttcggatttaaacactcaaaccaactggacaaaatctctgcccctgcctacccctgaagaaaaaatgaggcaacaggcccaaaccgtgcaggccgacgtggtcccaattaacattacaggagagaacttcgatcggcaggcatctttgcgtcgtagcctcatttataccgacacgcttgtcaggcgtcccaagaaggtcaaacggcgaaagaccatcactggggtgcccgataatattcagaaggaactggcctccggtacgggccaggatgatgccgacgggcatagcgtgtatactcctgatcattattcaacccttggccgtttcaacagctgtcgatccgccggtcagcggtcagaaacccgggactctagttgccagaccgaagacgtgaaggtcgtgcccccaagcatgcggaggatacgggcacagaagggtcaaggcatcgcagcccagatggggcatttttctgggtcttccggaaacatgtctgtgctaagcgacagcgcaggaatcgtttttccttccagactggattcggatgccggtttccactccttgcctagatctggcgcacgcgctaacattcagtctttggagccccgactcggcgcattaggcccagccggagatatgaatgggacatttttgtatcagcgaggtcaccctcaagccgatgaaaatctgggccacttaggaggagcttccggaactggaacccttttacgacctaagtcacaggaactgcggcacttcgagagcgaaaacattatgtctcctgcttgtgtggtcagccctcacgcgacttactccacctctatcatcccaaatgccactctgagtagctcctctgaggttatagctataccaactgctcaatcagcgggacaacgcgaatcaaaatcttctgggtcctctcacgcacgaatcaagagccgcgatcatttgatatcgcgtcatgctgtgaagggggatccccagagcccaggccgacattggaatgagggtcatgccacaattctgagtcaggacctagatccccactcacctggcgaacccgctctgctgagcctgtgcgattctgcagtgcccctgaatgctcccgctaatcgagagaacggctcacaagccatgccgtacaactgtcgcaacaatctggcattcccagcacatcctcaagatgtagacggcaaaagcgagagctcttactccgggggagggggtcactcctccagtgagccctgggagtacaaatcctctgggaacgggagggcctcccctctcaagccacatctggcaactccgggatacagcactcccacatctaatatgagtagttgttccctggaccagacctctaacaaagaggatgctggctctctgtattccgaggaccacgatgggtattgcgcatctgtgcatacagattcgggccacgggtctggcaacctgtgtaatagcagcgacggctttggtaatccacggcatagcgtcatcaatgtgtttgtaggcagggcgcagaagaatcagggtgaccggtccaactaccaagataagtccctttcgcgcaatatttctttgaagaaggcaaagaaacctcccttgccccctagccgcaccgactcattgcggcgtatcccaaaaaaaagctcacaatgcaatggacaggttctcaacgagagcctgatcgccaccctccaacactccctgcagctgagcctgccaggtaagtcaggctcctcaccttctcagtcgccttgttcagatctggaagaaccttggttgcccaggtctcggtctcagtctacagttagtgccggatcctccatgacgagtgcaactaccccaaatgtctactccttgtgcggggcaaccccaagccagagtgatactagcagtgtgaaatccgaatacaccgatccctggggctattatattgattacaccggtatgcaggaggacccaggaaaccccgctggcggatgctcaacaagcagcggggtcccaactggaaatggtccggtacggcacgtgcaagaagggtccagggccactatgcctcaagtgccgggtgggagcgtgaagcccaagattatgtcaccggaaaagagtcaccgggttatctcccctagtagcggctactctagtcaatccaacactccaaccgcgttaactccagttccggttttcttgaagtccgttagcccagctaacggtaaggggaaacctaagccaaaagtgccagagaggaagtcctctctcatctccagtgtgagtattagcagttcaagtacgtcactttcatcttcgacatctacggagggcagtggcaccatgaaaaagctcgatcccgctgtgggtagccctcccgcacccccaccccctcccgtgccatccccaccgtttccttgcccggctgaccgctcgccgttcctcccaccccctcctcccgttactgactgcagtcagggctcccccctcccccactcccccgtgttccctccgcctcctccggaagcactgatccctttctgtagcccaccagattggtgtctgagtccaccgaggccagccctcagccccatcttacccgattctcccgtgagcttgcctctccccccacccctgctaccctctagtgagccacccccagccccacccctcgatcctaagttcatgaaggatactcgccctcccttcaccaattcaggacagcccgaaagctcaagaggatccctgcgccctccctccacaaaggaggagacctcacgacctccaatgccacttattactacggaggccctgcagatggtgcagctgaggcccgtccgcaagaattccggtgccgaggccgcacaactgtcagaacggacagctcaggaacagcggacacctgtcgctcctcagtaccacctgaagcccagcgcctttttaaagtctcgcaattcaacaaacgagatggaaagcgaatcacagcctgctagtgtgacttccagcttacctacacctgcaaagtcatcatctcagggcgatcatggtagtgccgcagaacgcggtggaccagtgtctcgctctccaggggctccgagtgccggtgaggcagaggcccgtcctagtcccagcacaacaccattgccagacagtagcccgagtcggaaacctcccccaattagcaagaagcccaagcttttcctggtcgttccccctccccagaaagattttgctgtcgaacccgcagagaatgtgtccgaagctctgcgcgcagtcccaagtcccactactggagaagagggatcagttcactcaagagaggccaaggagtcctctgctgctcaggcaggatctcatgcgacacatcccggtacctccgtgctggagggcggtgccgcaggtagcatgtccccatctagagtcgaggccaacgtgcctatggtgcagccagacgtatcccccgctcccaagcaagaggagccagcagaaaatagcgcagacacggggggtgacggagagagttgtctcagtcaacaggacggcgctgccggtgttcccgagactaacgccgctgggtcctcatcggaggcttgtgattttctaaaagaggatggcaacgacgaagttatgacgcccagccgtcccagaaccaccgaggacctcttcgccgcaattcacagatctaagcgaaaagtgctcggtcgtcgcgattccgatgatgaccacagcaggaatcacagcccctcgcctccagtcactccaaccggcgcagccccatcactcgccagtccgaaacaggtgggttccattcaaaggtcgatccgcaagagcagcaccagcagtgacaatttcaaggctctcctgctgaagaagggatctcgctccgatacatccgcccgaatgagtgccgctgagatgttgaagaacacagatcccaggttccaacgtagtagatccgaaccctcaccagacgcgcctgagtctccttcaagttgttctccgagcaagaatcgaagagcacaggaagagtgggctaaaaatgaaggtctgatgccaaggtcgctgtctttttctgggccaagatacggcagatctagaacccccccttcggctgccagcagtcgttatagtatgaggaaccgcatccagagcagccctatgaccgtgatttccgagggggagggagaagcggtggagcctgtggacagcatcgcacgcggagccttgggagccgcagagggctgttccctggacggtctggccagagaggagatggacgagggcggactgctttgcggggaaggccctgctgcgtccctgcagccgcaagcgccaggaccagttgatggcactgcttcggctgaagggagggaaccttcccctcagtgcggcggaagcctctccgaagaaagttag

SEQ ID NO: 57831 - DNA, 4832 bp, Artificial Sequence
  Description of Artificial Sequence: Synthetic coding sequence
atgaagaaagagggctcgtctggctctttccggctgcagccaaacaccggaagtttgtccagagctgtctcttggatcaacttttcctctctgtctcgccaaactaaaaggttattccgttcggacggcgagttgagcgtctgcggtcagcaggttgaagtggatgacgagaactggatataccgcgcacaaccaaggaaagccgtgtcaaatctcgacgaagaatctcggtggactgttcattacacagctccttggcaccagcaggagaatgtgttcctgccaaccaccagacctccttgcgtcgaagacctccacagacaggcaaagctcaatttaaaatctgtgttacgcgaatgtgacaaactcaggcatgacgggtacagatcttcccagtattacagccagggacccaccttcgccgctaacgcttccccattctgtgatgattaccaagacgaggacgaggaaaccgatcagaagtgctcattatcgtccagcgaagaggaaagatttataagcatccgtcgccctaagaccccggcttctagcgacttctccgacctgaacacccagaccaactggaccaaaagccttcccttgccgaccccagaagagaagatgagacaacaggctcagactgtccaggcagacgtggtcccaatcaacattacggccagtggcacagggcaagacgacgccgacggacacagtgtatacacccccgaccactacagtactctcggccgtttcaatagctgtagatctgccggtcagagaagcgaaacacgtgactcttcctgccagacggaggatgtgaaggtggtcccgcctagtatgaggcggatcagagcccagaaagggcagggaattgctgcccagatgggccacttttctgggtcatccgggaatatgtccgttctgagcgattccgctggtatcgtttttccgagcaggctggattcagatgctggttttcatagtctgcctcgctctggcgcacgtgcaaatatccagagcctcgagccacgccttggcgctctgggcccagccggagacatgaacggaacatttctgtaccagagaggccaccctcaggctgacgaaaatctgggtcatctgggcggagcctccggaaccggaaccctactgagaccaaagtcccaggagttaagacacttcgaaagtgaaaacattatgagtcctgcttgcgtggtgagcccacacgccacctatagtacctcaatcatacctaatgccacattgtctagttcctctgaggtgatcgcaattcctaccgcccagtccgccggacagcgggagtctaagagctccgggtcgagccatgccagaatcaagagcagagaccatctaatatcgcggcatgctgtcaagggcgacccgcagtcgccagggcgacactggaatgaagggcatgctacaattctcagccaggacctagaccctcactcgcctggggaaccagcgctgctgtccttgtgtgattctgcagttcctctgaacgcccctgcaaatcgcgagaacggtagccaagccatgccctacaactgtcgtaataacttggccttccctgctcatccccaggacgtggatggcaagtcagagtctagttacagcggtggagggggtcatagcagtagcgagccttgggaatacaagtccagcgggaacggaagagccagtcctctgaagcctcatctggcaacccctggctactccacccctaccagcaacatgtcaagctgttcactggatcagacttccaacaaagaggatgctggatctctctacagcgaagaccatgatggatactgtgcatctgtacacacggattccggccatgggtccgggaatctgtgtaattcgtctgacgggttcggtaatccgcgacactctgtcattaacgtcttcgtcgggcgagcacaaaagaaccaaggcgaccgctctaattatcaagataaaagcctgtctcgaaacatctctctcaaaaaggccaagaagccaccactgcctccctccaggacagacagccttcgtcgtatccctaaaaaatcttcgcagtgtaatgggcaggtgctgaatgaatcactcattgccaccctgcagcacagcctccagctgtcactccccggaaaaagcggaagcagccctagtcagtcaccttgtagtgacctggaagaaccatggctgcccagaagtagaagccagtccactgtgtctgcgggatcctccatgactagcgcgactaccccgaatgtctacagtttgtgcggagccacaccttcccaaagtgatacctcgtccgtcaagtcagagtacaccgatccctggggttattacatcgactacactgggatgcaggaagaccccggaaatccggcagggggatgcagtacttcctccggcgtcccgacaggcaatggccctgtccgccacgttcaggaaggaagcagagcgaccatgccccaggttcctggaggaagtgtgaagcccaaaatcatgtccccagaaaagtcccacagagtcatcagtccttcttccggctattcctctcaatctaatacccccacagccttaacccccgtgcccgtgtttctcaaatctgtgtctcctgccaatggaaagggaaagcctaagcccaaggtgcctgagcggaagtcctccctgatcagcagtgtctctataagcagcagtagcactagcctcagttcatccactagtactgaagggtctggcacaatgaaaaagctagaccccgcagtcggctctccgcctgcccctccacctccccctgtgcccagccccccttttccatgccccgcagataggtctccctttctgccccctccaccccctgttaccgattgctcccagggttctccactccctcactctccagtatttcccccacctccacctgaagcactgatacctttctgctctcctcctgattggtgcctcagcccccctcggccagcattgtctccaatcctgccagacagcccagtcagccttccccttcctcctcccttactcccatcctcggagccaccccctgctccgccactagaccctaagttcatgaaggatacgcggcctccgtttacaaattctggccaacctgagagcagccgcggatccttaaggccaccatcaactaaagaagagacaagcaggccccctatgcctctcatcaccactgaggctctgcaaatggtgcagcttcgccctgtgcgaaagaacagcggggcagaggcagctcagctgtcagagaggactgcacaggaacagcggacccccgtagccccacaatatcatctcaaacccagtgcattccttaagagtcggaactcaacgaatgagatggagtccgagagccaaccagcatccgtaacttcgagtctcccgactcccgcaaagagttccagtcagggggaccacggctctgcagcggaaaggggtggacctgtctcccggtcaccaggagctccctctgccggagaggcggaagcccgtccgagcccatctaccacgcccctgccagacagttcgccatcccggaaacctcctcccataagcaaaaagcctaagctgtttctggtggtccctccccctcaaaaggatttcgctgttgagccagccgagaacgtctcagaagctctccgggcagtgccctccccgactacaggcgaggagggctctgtacactcacgcgaggctaaggaaagttctgccgctcaggctggttcccacgcgacacatcctggcacgtcggtgctggagggaggcgctgctggtagtatgagccctagcagggttgaagctaacgttcccatggtccagcctgacgtgagccctgcgcctaaacaggaggagcccgcagagaactctgcagacaccggtggcgacggagaatcatgtttatcacaacaggacggggcagccggtgtcccggaaaccaacgccgctggaagcagttccgaggcctgcgacttcctcaaggaagatggcaacgacgaagtgatgacacccagtagacctcgcaccacggaagatttattcgctgcaatacacagatcaaagcggaaggtgcttggcagaagagactccgacgatgaccatagtcggaaccactctccttcccctccggtgacaccaactggggctgctccctcactggccagtccaaagcaggtgggttcaattcagcgatctattcgcaaaagttctacctcctccgacaatttcaaagcgctgctgttgaagaagggaagccgctccgatacatcagctcgaatgtcggccgctgagatgcttaagaacaccgatcccaggttccaaaggtcacggtccgaaccgagccccgacgctcctgaatcacctagctcttgttccccctcaaaaaataggagagcacaagaggagtgggctaagaacgaaggacttatgcccagaagcttaagctttagcggacccagatatgggagatcacgtactccaccaagcgctgcctcgtcccgatattccatgcgaaatcggatacagtcctcacccatgacagtgatcagcgaaggcgaaggcgaggccgtcgaaccagtggatagcattgcaagaggagccttaggagccgctgaaggatgcagcctggatggtttggcacgcgaggagatggacgaggggggtcttctatgcggagaggggcctgccgcaagcctgcaacctcaagccccaggtccagtggacggaacagccagcgcggaaggtcgagagccgtccccccagtgcggaggctctctgagtgaagagtcata

SEQ ID NO: 57832 - DNA, 2130 bp, Artificial Sequence
  Description of Artificial Sequence: Synthetic coding sequence
atggagtctatgggaatggtgtactcggtgccgtctagttgtaacgggccaacagagtctaccttctctacttcctggaaaggagacgccttcacttatatgacaccttcggctactagccagtccaaccaggtgaatgagaatggcaaaaacccatcttgcggaaattcatgggtcagtttaaataaagtccccccattggtacctaaggaggcggctactctgctagtagccagagacaacccagctggatgctccgggtcagctggttaccctgagcggctgattcagcagcggcacatgcctgagagaccttctaaaattgggttgctgacgtcagggaccagccgccttgaaacgggccctggaggcgctagccggttccgcgaaagatctcttagcgttcctactgattccgggaccacagacgttgactacgacgaggagcagaaggctaacgaggcatgtgccctcccatttgcgagtacctcttctgagggcagcaactcggccgataatattgcgtccctgagcgcccagcaggaggctcagcacagaagacagagaagtaagagcatctctctacggaaagctaagaagaaacccagtcctcccacccgcagtgtgtctttggtgaaggacgaaccgggactcctgcccgagggtggttctgcattaccaaaggaccagagaccgaagtcactctgcctgtccctggagcatcaagggcaccattcttctcatcctgacgcccagggtcaccccgcaatacccaaccataaggatcccgagagcacacagtttagccatcactggtatttgacagattggaaatcaggagacacatatcagtctctttcctccagtagtacggctacgggaaccaccgtgattgagtgtactcaggtgcagggctcttcagaaagtttggctagccccagtacttccagggccacgactcctagtcaactgtccattgaagtagaggcgagggagatcagttcaccagggaggccacctggcctaatgtctccgtctagcggctactcgagccagagcgaaaccccaacccccaccgtgtctatgtccctgactctgggtcacctccctcctccttcaagttctgtccgtgttagacctgtggtgcctgaaaggaaatcatctctgccccctacatcacccatggaaaagttcccgaaatctcgcttatcgtttgacttgccactgacaagctctcctaatcttgacttgagcggaatgtcgattagcattcgcagcaaaaccaaggtgtctaggcaccacagtgagaccaattttggtgttaaactggcccaaaaaaccaaccccaatcaaccaatcatgcccatggtgacgcagtcagatttgagatctgtccggctgcgaagcgtaagtaaatctgaaccagaggatgacatagaatcacctgagtatgccgaggaaccgagagcagaagaagtattcacactcccagagcgcaaaaccaaaccccctgttgccgagaagccccctgtggcaagacgtcctccgtcccttgtacataaacccccatctgttccggaggagtatgccctaacgtcacccacactcgcaatgccccctaggagctccatccagcacgcccgacccctcccccaagacagttatactgttgtgcggaagccaaagcctagcagcttcccagacggaagatctcccggtgagagtaccgccccaagcagcctcgtgtttactccgtttgcatctagcagcgacgctttcttttccgggactcagcagcctccacagggttccgtcgaggatgagggcccaaaggtgagagtcctgcctgaaaggatatctttacagtctcaagaagaggcagagaagaagaaggggaaaatccccccaccagtgcccaagaagccaagcgtattgtacctccccctgacatcccctaccgcgcagatggaggcttatgtcgctgagcctaggcttcccttgtcccctatcattaccctcgaagaagatactaagtgtcccgctacaggcgacgacctccagtctttgggacagcgagtcacttctacacctcaggctgattccgaaagagaggcctctcctctgggatag

SEQ ID NO: 57833 - DNA, 2130 bp, Artificial Sequence
  Description of Artificial Sequence: Synthetic coding sequence
atggaaagcatgggtatggtctattcagtgccaagctcctgtaatggcccaaccgagagcaccttcagtacatcctggaaaggcgacgcctttacttatatgactcccagcgcaacgtctcaaagcaaccaggtaaacgaaaacggaaagaacccatcatgtgggaactcctgggtgtccttgaataaggtgccccctctcgtgcctaaagaggcagcaactctgttggtagcaagggataatcccgctgggtgctcaggatcagctggctaccctgaacgacttatccaacaacggcatatgcctgagcggccttctaagatcggcctattgactagtggtacctccaggctggaaaccggtcccggaggagcttcacggttccgagagaggtcactcagcgtacccacagatagcggcacaacggacgtggactacgatgaagaacagaaagctaacgaagcgtgtgcactcccattcgcctccacctctagcgagggatcaaattccgccgataacattgcaagcctttccgctcagcaggaggcacagcaccgtcggcagcggtccaagagtatctccctgagaaaggcgaaaaaaaagccttcaccccctactaggagcgtgtctttagtgaaagatgagccaggcctcttgcctgaaggcggatcagctttaccaaaggatcagcgtcccaaatccttgtgtctttctctggagcatcagggtcaccactcgtctcaccccgacgcacagggacaccccgctatcccaaaccacaaagatccagaatcaacccagtttagtcaccactggtacctgactgactggaagtctggcgatacctaccagagcttgagcagtagcagtacagctacaggcaccacggtaatagagtgcactcaggttcaaggatcctccgagtctttagcttccccaagcacctctagagctacaacacccagccagctgagtattgaagtagaagctagggagattagctcccccggaagaccccctggcctgatgagcccttctagcggatactcttctcagtccgagacacctacacccaccgtgagcatgtccctgacactaggccacctaccccctccttcgtcctcagtcagggtgcgacctgtagttccagaaaggaagagctcactgccccctacctctcctatggagaagttccccaagtcacgcctgtccttcgatcttccactgacgtctagccctaacttggaccttagtggtatgtccatctctatacgatccaagacaaaagtgagtcgacaccacagcgagactaactttggcgtgaaactcgcacaaaagaccaaccccaatcagcccataatgccgatggtgacccagagcgacctgaggtcagtgcggctccggtctgtaagtaagagtgagccagaggatgacattgagagcccagagtatgctgaggaaccgagggccgaagaagtgttcaccttgcctgagaggaaaaccaagcctcccgtggcggaaaaacctcccgtcgcacgaaggcctccctctctcgtgcacaagccccctagtgtgccagaggaatacgccctgaccagtccgactttggcaatgcccccaaggtcttccatccaacacgctcgacccctgccccaggatagctacacggtggtccgcaaacctaaaccttctagcttccctgatggaaggagccctggagaaagcactgctccttcttctctggtcttcactccttttgccagctcttcggatgctttcttttcaggcacacaacagccacctcagggctcagttgaggatgagggacccaaggtcagggtgctaccagaaaggataagtctgcagtctcaggaggaggccgaaaagaagaaagggaagataccaccaccagttccgaagaagccttccgtgctgtatctgcctctgacatctccaactgcgcagatggaggcgtacgtcgcggaacccagactccctctcagccctatcatcaccctggaagaggatacaaagtgccctgccaccggcgacgatctgcagagtcttggacagagagtcacatcaaccccacaggctgattccgagagagaagcaagcccacttggctag

SEQ ID NO: 57834 - DNA, 3678 bp, Artificial Sequence
  Description of Artificial Sequence: Synthetic coding sequence
atgcctttctatcgcagaacagtggtgcctcaacgcctctgtccacgcaacccaccccagcagctggccgagctgagggacgtgagtcacctggctgccctctctctgctgaggcagctggccgacctgtgtgggcactcattggcattactggaggacctagaagggcatctgctcgcactaggcaggcggactgactcactgtaccgtcgcacagtgcggctgcgacggagattaccatgccgccttctcgggcctgaagaggacgaagaagaacttgcagctgcaaacagcggcagagagaatgccacagccacagcacactcacgatcatcttggagacagcctgttaatgtctttctctcctctgggaggccaccatccgtcgaggagttattgcgagaggctcaactgaacttgcaaagtctccttcaggaggagtacgaggagcagtactctgaggccaggctggtggggcaaacctttcggagcagcgatgaggctaccaaacctactccaaacccacgccctcagtccgcccgaagactggaatttatcctcatgcccacaaaaagacaattgtctgaggatgagacaacaacacaaggcgtgcgtgctcccgaagcgagcctttcattaagcaccactgccgacaaacagacagcctggaattctctgtttcctttgccaattctcgaggagaagcgatggccccaactgtgttccactcaaagcgatattgtgcccatcaacataagcgggcagcagttcgacaagcatgcctctctaagacacagcctcttcaatactgagaccgctgtcaaccccaaatccacgctacgaagacgacgcacaataatcggtttttccaatttttcccagagggaccagggtcacagtaactcccccgcaggatctgtggcccactccaccacctctgatatccgaccatcccattccgttcccgagggagtgcatggcagagtggccgtgggccaggacgctcggtttccctctctgaccagccccgtcctccggactccgtcctccgagcctgacgagccacaccaagctcgatctggcccaaacccccctggtatggagagtatgggaatggtgtactcagtgccctccagttgtaacggaccaacagagtccacctttagtacctcctggaaaggggacgcctttacttacatgactccgagtgcgactagtcaatcaaatcaggtgaatgaaaacggcaagaatccttcttgtgggaattcctgggtgtcgctcaacaaggtgccgccattggtccctaaagaggccgctaccttactggtcgctagggataatccagcagggtgcagcggttcagccggatatcctgaaagactaattcagcagaggcacatgcccgagcgcccaagtaaaattggtctcctgacatctggcacttctcgcctggagaccggacccggaggcgcttctcgattcagagagcggagcctcagtgtgccaacagactccgggaccacagacgtcgattatgatgaagaacagaaagctaacgaggcttgtgccctaccattcgctagcacatcaagcgagggcagcaactctgcagacaacattgcctccttgtctgcccaacaggaggcgcaacacaggcgacaaagatcgaaatccatatctctccggaaggcaaaaaaaaaaccatcacctcccacgcgatcagtgtctttggtgaaagacgagcctggccttttgccagagggcggtagtgcactgccgaaggaccaaaggccgaaaagcctgtgtctttctctggaacatcaagggcaccacagcagccatccagacgcacagggccatcccgctattcccaaccataaagatcctgagtccactcagttcagccaccactggtacttgaccgattggaaatccggtgacacataccagtctctttccagctcaagcactgctacaggtacaacagtgatcgaatgcacacaagtgcaggggtccagtgagagtctcgcctccccttccacatctcgcgcaacaacgccctcccagttgtcaattgaggtcgaggcgcgtgaaatcagctcgcccggacgccctcccggtctgatgagcccttcttccggttattctagccagtccgagacacccacacccaccgtctccatgtcccttacgctgggacacctgcctccaccaagctcctcagtgcgagtcagacccgttgtgcctgagaggaaaagctccttgccaccaacttcccccatggaaaaattcccgaagtccaggctgtcctttgacctaccactcacatcatcgccgaaccttgatctctccggcatgtctatcagtattcggtctaaaactaaggtttccaggcatcactccgaaacgaacttcggcgtcaagctagcccagaagaccaaccccaaccagccgattatgcccatggtgactcaatcagatctgaggagcgttcgattgcgtagcgtctcaaagagcgagcctgaggatgatatcgaaagcccagagtatgccgaggagccgagggcagaggaggtgtttacccttcctgaaaggaagaccaaaccccctgtggctgagaagccccctgtagctagacggcctccatctcttgtccacaagccccctagcgtccccgaggaatacgctctgacctctcctaccctcgccatgccaccgagaagcagcatccaacacgccaggcccctgcctcaggattcttacactgtcgtacgaaagccgaagccatcaagtttccccgatgggcgatcccctggcgagagtacggcgccatctagtctggtgtttacaccctttgcctcttcgtccgatgcttttttcagcgggacacagcaacctccacagggaagtgttgaagacgagggcccaaaagtccgggtcctcccagaaagaatttcactgcagagtcaggaggaggccgagaagaagaaaggcaagatcccgcctcccgtccctaaaaagccttcagtgctctacttaccactaacttctcctacagcgcaaatggaagcttacgtcgcggaacccagactgccccttagcccgattataactctagaagaagacacgaaatgccctgccacaggggacgatctccagtccctgggacagcgagtgacttccaccccccaagctgactccgaacgggaagccagccctctcggctcaagcgtggaaccgggaacagaggaaaaaagtctcatttccgacaaaaccgcagagtggatcgctgaagatgacgatgatgtttttgtcgcctcacgcaccaccgaagacttgttcactgtgatccacaggagcaagagaaaacttctggggtggaaagagcccggagaggcctttgtagggggtcgcacatcgagccactcaccaatcaaaaacacagcagaatctccgatctctgaatccaccgccacggcagggtctggaagcagtgctaatctggacgctggaagaaatgacgattttaaggctctcctccagaaaaaagggtccaaggctacccccaggtctcggccatctgctgctgagctgctcaaaaccaccaaccctctggctcgccgtatcatagcccagttctccaaggattacgagacaacggataatccctctacttag

SEQ ID NO: 57835 - DNA, 2139 bp, Artificial Sequence
  Description of Artificial Sequence: Synthetic coding sequence
atgccagaccaagacaaaaaagtgaagaccaccgaaaaatcaacagataagcagcaggagatcacgattagagactattcagatctgaagcgcctgcgttgtttactcaatgttcagagctccaaacaacagctgccagccattaatttcgatagcgctcagaactccatgacgaagtccgaacccgctatacgggctggtggccacagggcacgcggacagtggcacgagtcaactgaggccgtcgagctcgagaacttcagtattaactacaagaatgaacggaatttttcaaagcatccccagagaaaactattccaggagatattcaccgccctcgtgaagaaccgcctcatctcacgagaatgggtgaacagagcccctagtatacatttcctaagggttctcatttgtttgagactgttgatgcgcgatccctgctaccaggagattctgcactctcttggaggaatagaaaatttagcccagtatatggaaatcgttgcgaatgagtacctgggttacggagaggagcagcacacagtggacaaactcgtcaacatgacctatatcttccagaagttggccgcagttaaagatcagagagaatgggtcaccacctctggcgctcacaagacactggtcaatttgctcggcgcacgagacacaaatgtgcttctgggatcattgttagcactggccagcctggccgaatcgcaagaatgcagagaaaaaattagcgaactgaacatcgttgagaacctgctgatgatacttcacgagtacgaccttctatccaaacgcctcaccgcagagctgctgcggcttctgtgtgcagaaccacaagtgaaagaacaagtcaagttatatgagggaatcccagtgctactatccttgctgcactccgatcacttaaaactgttgtggtcaatcgtatggatcctcgtacaggtctgcgaggatcctgagacgagcgtcgaaatccggatttggggcggaataaagcaactgctgcacattctgcagggagacaggaacttcgtgtctgatcacagcagcattggatcattgagctccgctaacgccgctggcagaatccagcagctccacctgtcagaagatttgagtcctcgggagattcaggagaacacgttttccctacaagctgcttgctgcgccgcattgaccgagcttgtcttgaatgacaccaacgcacaccaggtggtgcaagagaatggcgtttacactatcgcaaaactcatcttgcctaataagcagaaaaacgccgctaaatcaaatctattacagtgctacgctttccgagctcttagattcctatttagcatggagaggaacagaccactgttcaaacggctgtttcccaccgatctttttgagatttttattgatataggacattatgttcgggacatctctgcttacgaagagttagtctccaagctgaacctcttagtcgaggatgaactaaaacagatcgccgagaacatcgagtccatcaatcaaaataaagccccactgaagtacataggcaattacgccatactcgaccatttaggctcaggcgcatttggctgcgtatataaagttcgaaaacatagcgggcaaaacttgctggcgatgaaggaagtgaatctgcacaatcccgcatttggaaaagataaaaaggacagagattcgtcggtgagaaatattgtgtccgaactgactatcatcaaagaacaactctatcatcctaacatcgtacgttactacaagacatttttagaaaacgatcgtctctatatcgttatggagctgatcgagggcgcaccactcggggaacatttttcctccctcaaggaaaagcatcatcacttcacggaagaacgattgtggaagatctttatccaactctgtctcgccctgcgctatttgcataaggaaaaacggattgtccaccgtgacctaactcccaacaatatcatgttaggggataaggacaaagtgacagtgactgacttcggacttgctaaacagaaacaagaaaattccaagctcacttccgtggtagggacaatcctatacagttgtgttcagcatttatatctccggtcccccgcacccgctctcgctacttag

SEQ ID NO: 57836 - DNA, 1215 bp, Artificial Sequence
  Description of Artificial Sequence: Synthetic coding sequence
atggaactcattgagggggcacccctgggtgaacatttctcatccctgaaagagaagcaccaccattttaccgaagagcgtttgtggaaaattttcattcagctctgcctggctctgcggtatttgcacaaagaaaagcggatcgtgcaccgcgatctgacacccaataacatcatgttgggcgataaggacaaggttacagttactgatttcggtcttgctaagcaaaaacaggagaattccaaattaacaagcgttgttgggacaatactgtatagttgcccagaagtattgaagagcgagccgtatggcgagaaagctgatgtatgggctgttggttgcattctataccagatggccaccctgtctccaccgttttactcaacaaacatgctgagcctcgctacaaaaatagtggaagcagtgtacgagccggttcctgagggcatatactccgaaaaggtgactgacactattagtcgttgcctcacccctgatgccgaggccaggcctgacatagtcgaagtgagttccatgatctcagatgtcatgatgaagtatctggacaacctctcgaccagtcagctcagcctagaaaagaagttggagcgggaacgacgaagaactcagcgctatttcatggaggcaaaccggaacacggtcacatgtcaccacgagctggcagtcctcagtcacgagacttttgagaaagcctccctgagttccagctcctctggcgctgccagcctgaaaagcgagctatccgagtccgccgacctgccccctgagggcttccaagcaagctatggcaaagatgaagatagggcttgcgacgaaatcctaagcgatgacaacttcaatctggagaatgctgaaaaagacacatactccgaggtggatgatgagctggacatttctgacaactcttccagctcatcctcaagtcccctgaaagagtccaccttcaacatcctgaagagatcattctcggcttctggcggtgaacgccagtcccagacccgggattttactggcggtaccgggtcgcgccctagaccggcacttctgcccttagatctgctcctgaaagtgccacctcacatgctgagggcccatatcaaagagatagaggctgaactcgtgacagggtggcagagccactctttgccagccgtaatcctgaggaacctcaaagaccatggttcaacatactag

SEQ ID NO: 57837 - DNA, 1284 bp, Artificial Sequence
  Description of Artificial Sequence: Synthetic coding sequence
atggtgccagtgcagcctgcagaacccccagaggtcctcaaatctgagccttatggcgagaaggccgatgtatgggctgtcggatgcatcctgtaccagatggccaccctgtcaccccctttttatagcaccaatatgctgtctctggcgaccaaaatcgtcgaagccgtttatgagcctgttccggaaggtatttacagcgagaaagtgacggatacaataagccggtgcttgacaccagacgccgaggctcgcccagacatcgttgaagtcagtagcatgattagtgatgtgatgatgaaatatttggataatctcagtacctcacagctgtctcttgagaagaagctggaaagggagcggaggaggacccagaggtacttcatggaagccaataggaatactgtcacctgtcaccatgaacttgcagtgctgagccatgaaacgttcgagaaggcttctctgtctagtagttcctccggggctgcatctctgaaaagcgagctgagcgagtctgccgacctacctcccgaaggattccaggccagctatggtaaagacgaggatcgcgcttgcgatgagattctcagcgacgataattttaatcttgaaaatgctgaaaaggatacgtattcggaggtggatgacgagctcgatatttctgataattcaagttcatccagttcctctcccctcaaagagtcaacattcaatatcttgaaacgctctttctctgcctccggcggagagcgccagagtcagaccagagattttactggtggcaccgggagtagaccaaggccagcttccgccggtattgccgtaagtcaaaggaaggtgagacaaatctctgaccctatccagcagatcctgattcaacttcacaagatcatttatatcacgcagctgccacccgcactacatcataatcttaagcggagggtgatcgaaagattcaagaagagcctgtttagccagcagtccaacccatgtaacctgaagagtgagattaagaaactctcccaaggctctcccgaacccatcgagccgaacttttttactgctgattaccatcttctgcatcgatctagcgggggtaattccttgtcacccaacgatccgacgggcctccccacatctatcgaacttgaggagggaatcacttacgagcagatgcagaccgtgattgaagaggtactcgaagagtctggttactataacttcacatccaatcgttaccactcttacccttggggcacgaagaaccatcccaccaagagatag

SEQ ID NO: 57838 - DNA, 1425 bp, Artificial Sequence
  Description of Artificial Sequence: Synthetic coding sequence
atggtgccagtgcagcccgctgaaccaccagaggtgcttaagtcagaaccttatggcgaaaaagccgatgtgtgggctgtcgggtgtattttataccaaatggctactctgtcccctcccttctacagtaccaatatgctcagcttagcaaccaaaattgtcgaggcagtgtatgaaccagtgcccgaaggcatttactccgaaaaggtgactgacaccatctcccgttgtctcactcctgacgctgaggccagaccggacattgtggaggtgtctagcatgatttccgacgttatgatgaaatacttagataacttgtccacatcccagctctctttggaaaaaaagttggagcgggagcggcgtaggacccagcgttattttatggaggctaatcggaacacagtcacgtgccatcacgaactcgccgtgctcagccacgagacctttgagaaagcttctttatcctcatcatctagcggcgctgcttcactgaagagcgagctgtccgaaagtgccgacttacctccagagggattccaagcgtcatacgggaaagatgaagaccgtgcgtgcgacgaaatcctgagcgacgataatttcaacctcgaaaacgccgaaaaagacacatattcagaggttgacgatgaacttgacatcagcgacaacagttcttcctcctcttctagcccactgaaggaaagcacttttaatattctgaagagatcgtttagcgcttctggcggtgagagacagagtcaaacgcgcgatttcaccggcggtaccggttccagaccacgcccagccctcttaccactggacctcttactgaaggtgccgccacatatgctgagagctcatataaaggaaatcgaagccgagctagttaccggatggcagagccattccctaccagctgtgatcctccgaaacctaaaagaccacgcgtccgccggtattgcagtctctcagcgaaaggtcagacagatctctgatccgatccagcagatcctgattcagctgcataagatcatctatatcacgcaattgcctcctgccctgcatcacaatctgaaaagaagagtgatcgagcggtttaagaagagtctatttagccagcagagtaacccttgtaatctaaagtccgagataaagaaactgtcgcaaggctcacctgaacctattgagcctaactttttcacggccgattatcacttgctgcatcgcagttctggcggaaacagtttgagccctaacgatccaactggcctcccaacctcgatagaacttgaggagggcattacatacgaacaaatgcagaccgtcatcgaggaagtgctggaagaatcgggatactacaacttcacatcgaatagataccactcttatccctggggtactaaaaatcaccccacgaagcgatag

SEQ ID NO: 57839 - DNA, 2178 bp, Artificial Sequence
  Description of Artificial Sequence: Synthetic coding sequence
atgccagatcaggacaagaaggtcaagaccaccgagaaatctaccgacaagcagcaggaaatcaccattagagattacagcgaccttaagcgcttacgatgcctgcttaatgttcagagcagcaagcagcagctaccagccataaactttgactccgctcagaactctatgactaaaagtgagccagctatccgtgccggaggtcatcgtgctagaggccagtggcatgagtccactgaagccgtggagctggagaacttttccattaattacaaaaacgaacggaattttagtaagcatcctcagcgcaaactgtttcaggagatctttaccgccctcgtgaagaaccggcttatctcccgagagtgggttaatcgagctccatcaatccacttcctgcgggtgctcatttgtttgaggctcctaatgcgcgatccatgctatcaggagatactgcactcgctgggtggaatagagaacctggctcagtacatggagatcgtggcaaatgagtacttgggctacggagaagagcagcacacggtggataaattggtcaacatgacatacatcttccagaagcttgcggctgtcaaagatcaaagagaatgggtaacaacttccggcgctcataagaccctggttaaccttcttggggctcgggataccaatgtactcctaggctcactcctggctctggcttcattggcagagagccaggagtgtcgagaaaagatttctgaacttaatatagtagagaacttgctaatgatcttgcacgagtacgatttactgtctaagcggcttacagctgaactcctgcgcctgctttgcgctgaacctcaagttaaagaacaggtcaaactgtacgaaggcatcccagttctcctcagcctcctccattcagaccacctgaaactgctgtggtccatcgtttggatactggtacaggtgtgtgaggacccagagacatccgttgagatccggatctgggggggaatcaagcagctgctccacattctccagggtgataggaacttcgtctctgatcattcatccataggtagcctgtcaagcgctaatgctgccggaaggatacagcagctgcacctctccgaagaccttagcccgcgtgagattcaggagaacactttcagtctgcaggctgcctgctgcgctgctctcaccgaactggtacttaacgacactaacgctcaccaggtggtccaggaaaatggagtctatacgatagccaagctgattctgccaaacaaacagaaaaacgccgctaagtcaaatcttttacagtgttatgccttccgggctctccgcttcctctttagcatggagaggaaccggcctctgtttaagaggttatttcctaccgatctcttcgagatatttattgatatcgggcactacgtgagggatatcagcgcgtatgaagagttagtcagtaagctgaatctgctggtcgaggatgagctaaaacagattgccgaaaatatcgagtccatcaaccagaacaaagcccctctaaaatacattggaaactacgcgattttggaccatctggggtccggcgcatttggatgtgtctacaaagtcaggaagcacagtggtcaaaatctgcttgctatgaaagaggtgaaccttcataaccctgcttttggtaaagataagaaggatcgcgactcaagcgtccggaatatcgtttctgaacttacgatcattaaagagcaattgtaccacccgaatattgtgcgatattacaagacctttctggagaacgaccgcttgtatatcgtcatggaacttattgagggcgctcctttaggggagcatttttcttccttgaaggagaagcaccatcactttactgaagagcgcctctggaaaatttttattcagctgtgcctcgccctgcggtacctccacaaagagaagcgtatcgtgcaccgggacctgaccccaaacaacatcatgctcggggacaaggacaaagttacagtgtcatgtctaaaatgcgcagcaccgcttccatctctgtcttgtagttgcagcggccacattaagagagcaggttcatcctttgcattttgctatcactggaaactccctgacgctagccaggaagcgaatgccatcatggttcccgtgcaaccagccgaaccttag

SEQ ID NO: 57840 - DNA, 291 bp, Artificial Sequence
  Description of Artificial Sequence: Synthetic coding sequence
atgccagatcaagacaagaaagtcaagaccaccgagaaaagcacagacaaacaacaggagataaccatccgagactactctgatttgaaacggctgaggtgtcttttaaacgtgcagtctagcaaacagcaattacccgctatcaacttcgattcggctcagaactcaatgacaaaatcagaacctgcgattagggcaggtggccatcgcgcacgcggacagtggcatgaatctacggaggccgtggagcttgaaaatttctctatcaattacaagaacgaaagaaactag

SEQ ID NO: 57841 - DNA, 402 bp, Artificial Sequence
  Description of Artificial Sequence: Synthetic coding sequence
atgcctgaccaggacaaaaaggtgaagaccacagaaaagtcgacggataagcagcaagagattacaatacgcgattactccgacctcaagcgactaaggtgcttacttaacgtgcagagcagtaaacagcagctgccagcaatcaatttcgactctgcacaaaactcgatgacaaagtccgaacctgccatacgagccggtggccaccgggcaagaggacagtggcatgaatccactgaagcagtggaacttgaaaacttcagtataaactacaaaaacgaaagaaatttttccaagcacccccagcgtaaattgtttcaggagatctttactgccctcgtgaaaaaccgccttatctcaagagaatgggtgaatagagcaccttccatccactttttgtag

SEQ ID NO: 57842 - DNA, 2127 bp, Artificial Sequence
  Description of Artificial Sequence: Synthetic coding sequence
atggataaatacgacgtaataaaagcgatcggacagggagcctttggcaaggcgtaccttgcaaaaggtaaatcggattctaagcattgtgtaatcaaagaaataaactttgagaagatgcccatacaggagaaagaggcaagcaagaaagaggtgattctgctcgagaagatgaagcatcctaacatcgtggccttcttcaattcattccaggagaatggccgtctgttcatagtgatggagtactgcgatggaggagacctgatgaaacggataaatagacagagaggagtactcttcagcgaagaccagatcctgggatggttcgtgcagatttctctgggcttgaaacacattcatgaccggaagatcctgcatagagatattaaagctcagaacatttttctgagtaagaacgggatggtggccaagctgggcgacttcgggatcgccagagttcttaataactccatggagctggctagaacctgtatcggaactccatattacctgtctcctgagatatgccagaacaagccatacaacaataagacagatatctggtctctggggtgtgtcctgtatgaactgtgtactttgaagcatcccttcgagggaaacaacctacagcaactggtgttaaaaatttgccaggcccacttcgctcccatatccccaggcttttctagggaactccactcactgatcagtcagctattccaggtttcacccagagataggccaagtatcaactctattttgaagaggccatttcttgaaaatctcatacctaagtacctgacccccgaagtgatccaggaagagtttagtcatatgttgatctgccgcgctggggcaccagcctccagacacgcaggaaaggtggtgcagaagtgcaagatccagaaagtccgatttcaagggaaatgtccaccacgcagtcggattagtgtgcctattaaacggaatgccattcttcatcggaatgaatggcggcctccagctggagctcagaaagcccgttcaataaagatgatcgaacgtcctaagatcgcagccgtttgtgggcactatgattactactacgctcagctggacatgctcaggagacgtgcccataagccgagctaccatccaattccccaggaaaataccggcgtcgaggactatggacaggagacaagacacggcccttcaccatcccagtggcctgctgagtacctacaaaggaaattcgaggcacagcaatataagctgaaggtggagaaacagctgggcctgaggcctagctccgccgaaccaaattacaatcagcgtcaggaactaaggtcaaacggcgaagaaccccgattccaggagctgcctttcaggaaaaatgagatgaaagagcaagagtactggaagcaactggaggaaatccgtcagcaataccacaacgatatgaaggaaatccgaaaaaagatgggcagagaacccgaagagaactctaagataagccacaagacctacttggtaaaaaaaagcaacctaccggtacaccaggacgctagtgagggagaggccccagtgcaaatggagttccggagttgctgtcctggatggagcgcgatggcaaggtcctggctcacagctacctccgcctcccaggacattgagaaggatcttaagcagatgcgtctacaaaataccaaagaatcaaagaaccccgaacagaaatataaagccaagaaaggcgtcaagtttgagatcaatctggacaaatgcatcagtgatgagaacatcctgcaggaggaggaagccatggacatccccaacgagaccctcacgtttgaggatggaatgaagttcaaggaatacgaatgtgtgaaggaacacggagactacaccgacaaagcgtttgaaaaacttcactgccccgaggccggattctctacccagaccgtggcggcagtgggcaataggcgacagtgggatggcggagcgcctcaaacccttttgcaaatgatggcagtggcggatatcaccagtacgtgtccaacggggccagattctgagtccgtcctcagtgtgagcagacaggagggcaagacaaaggacccctactcccccgttctgatcctgatgtag

SEQ ID NO: 57843 - DNA, 429 bp, Artificial Sequence
  Description of Artificial Sequence: Synthetic coding sequence
atgaatataaatccctgtctcgttttgtgcgagtgcagcctgtccatttcgctggatgctgacccacttgtgtctcctttcgcaaccggtccctgtccaggagcacccagggaagtggtcgccatgcagtccgatgtggggcagggtttccccatgcagtcaaactggcgcgcaccagtgcacgcatgtactagcggggctgtccgtaaaggctggcctgggtgcggacgcaggagacataaaatgggcggagggcctgtgtcctgggagcagcgacagaaagaggttgaagctgcccaagggtcagaagaaaggggccctggcagtttggctgtctctctgttgtccctggctgtggggatccatcgtatatctcccatccttgggtttcacatttgttgtatgcaggtgttgatggtgctcaagtag

SEQ ID NO: 57844 - DNA, 744 bp, Artificial Sequence
  Description of Artificial Sequence: Synthetic coding sequence
atgctggtcctccggtcaggactcactaaagccctggcgtcccggacactcgccccacaggtgtgctcatcctttgccactggccctaggcagtacgatggcacattctacgaatttcgtacatattaccttaagccaagcaatatgaacgccttcatggaaaacctgaaaaagaatatccacctgcgcacctcatatagcgagttggtcggtttctggtcagtagagtttggcggacgcaccaacaaggtgtttcacatctggaaatacgataactttgcccaccgcgcagaggttcggaaagctctcgccaattgcaaggagtggcaggagcagagtatcatccccaacctcgccagaattgacaaacaggagactgagatcacttacctgatcccatggtccaaactagagaaaccaccaaaagagggtgtgtacgagctggctgtttttcagatgaagccgggagggcctgccctctggggggacgcctttgagagagctatcaatgctcacgtgaacctcggatacaccaaggtggtcggggtgtttcatactgagtacggagagttgaatcgggtgcacgttctgtggtggaatgagagcgcggactctcgcgcagcgggtagacataaaagtcacgaagaccctcgcgtggttgctgcggtccgagaaagcgttaactacttagtgtctcagcagaacatgctcctgatacctgccagctttagcccacttaaatag

SEQ ID NO: 57845 - DNA, 1632 bp, Artificial Sequence
  Description of Artificial Sequence: Synthetic coding sequence
atgcgggacaacacaagcccaatttccgtgattctggtatcaagtggttcccgcggaaataaactgttattccgatacccctttcaaaggtcccaagaacaccccgcatcacagaccagtaagccacgttcgagatatgctgcatcaaatacgggcgatcacgccgacgagcaggacggagattctcgctttagtgacgtcatcctggctacaattctcgctaccaaaagcgagatgtgtggacagaagttcgaacttaaaatcgataatgtgagatttgtgggacacccaactctcttgcagcatgctctgggccaggcaaacgccgatcccagcgtgatcaactgcctacacaatctctcgaggcgcatcgctacagtcctccagcatgaggagagaagatgtcagtacctgactcgcgaagcgaagttgatcttggctttacaggacgaggtctctgccatggcagatggcaatgaaggccctcaaagccccttccaccatattctgcctaagtgcaaactggctcgggacttaaaagaggcttatgactcgttgtgtacctcaggcgtcgtcagattacacattaattcttggctggaggtaagcttttgcctgccccacaaaatccattatgccgcttcctccctgatcccccctgaggctatagagcgcagcctgaaagccattagaccttaccacgctctgcttcttctgagcgacgaaaaatcattactgggggagctccctatcgactgctctcccgctctcgtgagggtcatcaaaacgacctctgctgtgaaaaatctacagcagttagctcaggacgcagacttggctctgctccaggtgtttcaacttgccgctcatctggtctattggggcaaagctataatcatctacccactctgtgagaataacgtctatatgttgtcgccgaatgcttctgtttgtctatacagcccactggctgaacagttcagccatcagttcccaagtcacgatctccccagcgttctggcaaagttctcacttcccgtctctctgagcgaattcagaaatcctcttgctccggcagtgcaggaaacacagctgatccagatggtggtgtggatgttgcaaaggagactcctcattcagctgcacacctatgtgtgtctgatggcatcaccctcagaagaggaaccgcgacccagagaagatgacgtgccattcactgctcgtgtgggaggtaggagcttgagtaccccaaatgcattatcctttggatcacctacctcctcagacgatatgaccctgacgagcccatccatggataactcttccgccgaactcttaccgtctggcgacagccccctaaaccagcggatgaccgaaaatctgttagcttcctccgaacacgagagggccgctattctgagcgtccctgccgctcaaaatccagaggatttgaggatgttcgcacggctgctccactatttcagaggacgccaccaccttgaggagattatgtacaatgagaacactcggagatcacagctcctaatgctgtttgataagtttagaagcgtgctggtggtaactacacatgaggaccccgtgattgcagtgttccaagccctgttgccttag

SEQ ID NO: 57846 - DNA, 1170 bp, Artificial Sequence
  Description of Artificial Sequence: Synthetic coding sequence
atggcagatggaaacgaaggcccacaatcaccttttcaccacatcctcccaaaatgcaagctggccagggatctgaaagaagcctatgacagtttgtgtacctctggagtagtccgcctgcatattaactcctggctggaagtaagcttctgtctgccccataagatccattacgcagcctcctctctcatacctccagaggctatcgaaagatccctgaaggcaatcaggccctatcatgctctcctgcttctgtcagacgagaagtctctactcggcgaactgcctattgactgctcacccgcactcgttcgggttatcaagaccacctccgcagtgaaaaacttacagcagctggcccaggatgccgacttggccctgctccaggtgttccagctggccgcacacctggtctactggggtaaggcgatcatcatttaccccctctgcgaaaataacgtgtatatgttaagccccaatgcctctgtctgtctctactccccattagcagagcaatttagccaccaattcccaagccacgacctgccaagcgtactggcgaaattctccctacctgtctccctctccgagtttaggaatccactggcccctgcggtgcaggaaacacagctgatccagatggtagtctggatgttgcagcgccgtctgctgatacagctccacacttacgtgtgcttgatggcatcaccctccgaggaggaacctcgacccagagaagacgacgtgccttttactgcaagagtggggggtaggtccctttccacaccaaatgccctgagttttgggtctccgacctcaagtgatgatatgaccttgacatccccttccatggataactcgtctgccgaactcctgccctcaggagattcccccctgaaccaaagaatgaccgaaaacctaggccaactatcagaacacgagagagccgctatccttagtgtgcccgctgcccagaacccagaagaccttcgcatgttcgccagactcctccattacttccgcggtaggcatcaccttgaagaaataatgtacaacgagaatactagacggagccagctgctcatgttgttcgacaaatttagaagtgtactggtagtcaccactcatgaagatccagttatcgcagtgttccaagccctgctgccttag

SEQ ID NO: 57847 - DNA, 1707 bp, Artificial Sequence
  Description of Artificial Sequence: Synthetic coding sequence
atgcgcgacaacacctcccccataagcgtcatactcgtttcctccggctcaagaggtaacaagctgcttttccggtatcctttccagcgatcacaggagcatccagcctctcagacaagcaagccacgctccagatacgccgcttccaataccggagaccacgctgacgaacaggatggcgattctcgtttctctgacgtgattctcgctaccattctggcaaccaagagcgagatgtgcggacaaaagtttgagctgaagattgacaatgtgcgctttgtagggcacccgactcttttgcagcatgcactgggtcaaatttctaaaacagatcctagccctaagagagaagctccaacgatgattctgttcaatgtcgtttttgctctgcgggctaatgccgatcccagtgtgatcaattgtctccacaatctatcccgcaggatcgccaccgtgcttcaacatgaagaaagacgctgtcagtatctcacgagagaagcgaagttaatcctcgctctgcaggatgaagtcagtgcaatggctgacggcaatgaaggccctcagtcaccattccatcacatcctgccaaaatgtaagttggcccgagacctcaaagaggcttacgactctctgtgtacgtctggggtggtgagactccatattaacagctggttggaggtgagtttttgtcttcctcacaaaatccattacgctgctagctcactaatacctccagaagcaatcgagaggtctcttaaagctatcagaccgtaccacgccctccttctcttgtccgatgagaaaagcttgctgggagaactccctatcgactgttctccggcactggtgcgagtgataaaaaccacttctgcagtaaagaatcttcagcagctcgctcaggacgcagacctcgcgctgctgcaggtattccagctagccgctcacctggtgtactggggaaaggccattataatttatccactgtgcgagaataacgtgtacatgttgagtccgaacgcaagtgtgtgcttgtacagccccctagctgaacagttttctcatcagtttcccagtcacgatctcccctcagtgttggcaaagttctctctgcctgtcagtctctcagaatttcgaaatcctctggcccctgcggtgcaggaaactcagctcattcaaatggtagtctggatgttgcaaaggaggctgctgatacagcttcatacctacgtctgccttatggcctcgcctagtgaggaggagccacgtcctagggaagatgacgtccctttcaccgcacgggtcggcggacggagcttgagcactcccaacgccttgtcattcggctcaccaacttccagtgatgatatgacgctgacaagccctagcatggacaatagttccgccgagctactcccaagtggcgacagccccctgaatcagcggatgacagagaatcttctcgcctccagcgaacacgagagagccgcaatactcagtgtgcctgccgctcagaaccctgaggatctcaggatgtttgctaggctcctacattactttcggggacggcatcatctcgaagagataatgtacaacgaaaacacaaggcggtcccagctgctgatgctgttcgataagtttaggtcagtgttagtagttactacccacgaggaccctgtgattgccgtgtttcaggccctccttccatag

SEQ ID NO: 57848 - DNA, 210 bp, Artificial Sequence
  Description of Artificial Sequence: Synthetic coding sequence
atgagggacaatacatcaccaatcagcgtgatccttgtcagctccgggtcccggggaaataagctgctttttcggtatccttttcagaggtcgcaagaacatcccgcatctcaaacatccaaacccagatccaggtacgccgcaagtaacactggcgaccatgcagatgagcaggatggcgatagtagacccacccagacccgacagtag

SEQ ID NO: 57849 - DNA, 999 bp, Artificial Sequence
  Description of Artificial Sequence: Synthetic coding sequence
atgttggcatggcaggacgggggagctaaggctgccccatctcatcacaaaatttctttctctgttcttgacatactggatcctcagaaatttactagggctgcattacctgctgtcaggccagctcctcgcgaagctaggaaaagcttagctgaggttgaggctggaaaggatgcgtcttcgcgggatcctgtgcggcagctggaaaccccaggacaaggatttgccgcttcactgctgacacggcaggcccatccacatcacagcagcgacgcccgagatgccgctgggccaggagcaggtcaagcgagcccccttgaaggatctgaggctgaagaggaggaagatgccgaggatccccgtcggccacgattgagggagagggcggcacgcctcctgcctggcttggcaaggtctccagacgcacctgccggagcactcgcctctggcgagccttgtgaagacggaggtggaggccctgtgaggtctcctcctggaagcccaggatctcccagaccaaggcggcgtagactcgaaccaaattgtgccaagccgagaagggctaggacagcgttcacatacgagcaactggtggcactggaaaataagtttagggccactaggtacctgtccgtgtgcgaacggttaaacttagccctcagcttgagcctgacagaaacccaggtaaaaatatggttccagaatagacgtacaaagtggaagaagcagaaccccggtgccgacggggctgcccaggtgggcggtggcgcaccgcagccaggtgccgctggtggtggtgggggtggaggcagtggtggatctcctggaccacccggaacaggcgctctccactttcagacctttccatcctattccgccgctaacgttttgttccctagtgcagcttcgttccctctaactgctgccgcaccgggttccccctttgcacctttcctgggcccatcctacctcactccattctacgctccaagactgtag

SEQ ID NO: 57850 - DNA, 933 bp, Artificial Sequence
  Description of Artificial Sequence: Synthetic coding sequence
atgctcgcctggcaggacggaggtgcaaaggctgcgcctagtcaccataaaatctccttttcagtgctggatatcctggatccacagaagttcaccagagccgcattgccggcagtcaggcctgctcccagagaggcgcgtaagtccctcgcagaggtcgaggcaggcaaggacgcgagtagcagagatcctgtccggcagctcgaaaccccagacgctgcgggtccgggtgctggccaagcatctcctctggaggggtctgaggctgaggaagaagaggacgctgaagaccccagacggcctcgcctccgcgagcgggcagctcgcctgctgcctggtttagccagaagcccggacgcaccagccggtgcgttggctagcggggagccctgcgaggatggagggggtggacctgtgcggtcacctccaggcagtccaggatcccccaggcctaggcggcgaaggctggaacctaattgtgccaagcctcgcagagccaggaccgcattcacttacgagcagctggtggcactcgaaaacaaatttcgggctactaggtacctgagtgtttgcgaaagactgaatttggccctgagcctctcactcaccgaaacacaagtgaagatctggtttcaaaataggagaacaaagtggaaaaagcagaaccccggagccgatggggctgcacaggtgggcggtggggcaccgcagcccggtgcagccggtggcggaggtggaggtggttctggaggctccccaggaccgccaggtacgggcgcactgcactttcaaacgttcccctcttattcagccgctaacgtgctgtttccctcggccgcttctttccctctgactgctgcagcgccagggagccccttcgctccatttttagggcctagttatctcacaccattctatgcacccagattatag

SEQ ID NO: 57851 - DNA, 114 bp, Artificial Sequence
  Description of Artificial Sequence: Synthetic coding sequence
gaagagtggatcacctacagtaatagctgctattacattggtaaagagcgtagaacatgggaagaaagagtgtgctggccggttcttcggaggactctgatctgcttcctctag

SEQ ID NO: 57852 - DNA, 3123 bp, Artificial Sequence
  Description of Artificial Sequence: Synthetic coding sequence
atggtcagttccgcgcagatgggctttaatctgcaggcccttctagagcagctttcacaggacgagctatctaagtttaaatacctgattacaacgttttcactggcacatgaattgcaaaagataccgcacaaagaagtggataaggccgatggcaaacaattggtcgaaatcctgactacacattgtgattcctactgggtggaaatggcctcccttcaggtgtttgagaaaatgcaccggatggatctgtcagagagagccaaagatgaggtgagggaggccgcattgaagtctttcaataagcgtaagccactgtctctggggatcacgaggaaggagcgtccacctctcgacgttgatgagatgttagagcggttcaagaccgaagcccaggataaggacaatagatgcagatatatccttaaaactaagttccgggaaatgtggaaatcatggcccggagatagcaaggaggtgcaagtgatggccgaaagatataaaatgttaattcccttcagcaacccgagggtcctaccagggccattcagctataccgtcgtcctctatggccctgccggtcttggtaagaccacgctagctcaaaaactgatgcttgattgggctgaggataacctcatccacaaatttaaatacgcattctacctcagctgccgggagctgtcccggcttggtccatgttctttcgcagaactggtgttcagggattggccagagttgcaagatgatatccctcatatcctcgctcaggcccgtaagattctgttcgtcatcgacggatttgatgagctgggagccgctccaggtgctctcattgaagacatttgcggcgactgggaaaaaaagaagcctgtgcccgtactgctgggctctctgctcaacagagtgatgttgccaaaggctgccttactggtcaccactaggcctagagcactgcgcgacctgcgcatcctggccgaggaaccaatatatattagggtcgaggggttcctcgaggaagatagacgtgcttactttctgagacactttggcgatgaggaccaagccatgcgggcttttgagcttatgcggtccaacgcggcactcttccagctgggcagcgctcctgccgtttgttggatcgtttgcacaacgctgaaattgcagatggagaagggtgaagatcctgttcccacatgcctgacgcggaccggcctgtttctgcgctttctatgctctcgcttcccacagggcgctcagctgagaggagctttgagaactctgtcgcttctcgccgcacagggcctctgggcgcagacctctgtcctacatagggaggatcttgagaggcttggagtccaggagagtgacctacggctcttcctcgacggcgacattctccggcaggatcgggtgtcgaaaggatgctacagttttatacatttgagttttcagcagttccttactgccctgttctacacccttgaaaaagaagaggaagaagatcgggacggacacacctgggacataggcgatgtgcagaaactgctttcaggtgtcgagagactcagaaacccagatctcatacaggctggatattactcctttggtcttgcgaatgagaaacgcgctaaggaattagaagccacgtttgggtgtcgcatgagcccagatatcaagcaagagcttttaaggtgtgatatttcctgcaaaggaggacactctaccgtaaccgatcttcaggagcttctcgggtgcctgtacgagtcgcaagaggaggaattggtaaaggaggtgatggcccagttcaaggagatctctctgcacctcaatgcagtagatgtggtgccaagtagtttctgcgtaaagcactgtcggaacttgcagaaaatgtcactgcaagtaatcaaagaaaacctgcctgaaaatgtgacagcgagcgagtccgatgcagaggtcgagcggtcccaggacgaccagcacatgctcccattttggactgacctctgttccatttttggcagcaacaaagacctcatgggcctggctattaacgattcatttctgagtgccagccttgttcgaatcttgtgcgagcagatagccagtgacacttgtcaccttcaacgggtcgtgttcaagaacatctcccctgccgatgcccaccgtaacctttgtctggctctaagaggccacaaaactgtcacatatctgacgctgcagggcaacgatcaagatgacatgtttcctgcactgtgtgaggtactgcgccatcctgagtgcaatctccgttatctgggattagtttcatgtagcgccaccacgcagcagtgggctgacctttcattggcccttgaagtgaaccaatcactgacatgcgttaatctatccgacaacgagctgttggacgaaggcgctaagctgctctataccaccctgaggcaccctaaatgtttcctgcagaggttaagcttggagaactgccatctgacagaggccaactgcaaagatctggctgccgtcctggtggtctcacgggaactcacgcatctgtgtttggccaagaatcccatcggaaatactggggtgaagttcttgtgtgagggcttgcgatacccagagtgcaagcttcagacactcgttctgtggaactgcgacattactagcgatggatgctgcgacctgaccaaactcctacaagagaagtctagccttctgtgtctggatctgggattgaaccatattggtgttaaggggatgaagtttctgtgcgaggccctacggaaaccgctgtgcaaccttcgatgcctgtggttgtggggatgttctatccctccctttagctgtgaggacctgtgtagcgccctttcgtgcaaccaaagcttagtgacacttgacctgggccagaatcctctgggtagctctggggtaaaaatgctctttgagaccctcacctgctcctccggtaccctccggacactgaggctgaaaattgacgattttaacgacgagctgaataaactgttagaagaaatcgaagagaagaatccacagctcatcatcgacactgagaagcatcacccatgggccgaacgaccttcgagccatgattttatgatttag

SEQ ID NO: 57853 - DNA, 3189 bp, Artificial Sequence
  Description of Artificial Sequence: Synthetic coding sequence
atggttagcagcgcacagatgggattcaatctccaggctttactggaacagctatcccaagatgagttgtccaagtttaagtatctgatcacaacgttttcactggcccacgaactgcagaagatcccccataaggaggtggacaaagcggacgggaagcagttggtggagatactcaccacacattgcgattcctactgggtagaaatggcctccctgcaggtgttcgaaaagatgcatcgaatggatttatctgagcgagcgaaggacgaagtccgggaggcagccctgaagtcgtttaacaagcggaagcccctctccctgggaatcacacgcaaagagagacctccactggacgtggacgaaatgttggagagatttaagactgaggcccaggcctttaccgaaaccaaggggaatgttatatgcctgggtaaagaggtcttcaagggcaagaaaccagataaggataatcgatgcaggtatatcctcaaaactaagttcagagagatgtggaaatcttggcccggtgacagcaaagaggttcaggtgatggccgaacggtacaaaatgctcatcccattttcaaacccgagagtgcttcccggaccatttagctacaccgttgttctgtacggccctgcgggattagggaaaactaccctggcgcagaagctaatgcttgactgggccgaggataatttaatccataagttcaaatacgctttctatctctcctgtagagaactaagcaggttgggcccttgttcgtttgccgaactcgtgtttcgcgactggccagaattacaggacgacatcccgcacattcttgcccaggccagaaaaatcctattcgtcatcgacggctttgacgagctgggcgctgctcctggcgcattaattgaagacatatgtggtgactgggagaaaaagaagcccgtgcctgttctgcttgggagcctgcttaaccgggtgatgcttcctaaagccgctctgcttgttacaacccggccaagagcactaagggatctccggatcctcgctgaagaacctatatatatcagagttgagggcttcttagaagaggatcgaagggcctatttccttaggcacttcggcgatgaggatcaggccatgcgggcttttgagctgatgcgctcaaacgccgcactcttccagctcggctccgccccagccgtctgctggattgtttgtactactttgaagctgcagatggaaaaaggtgaagatcccgtgcctacctgtttaactcggaccggcctctttttacgattcctttgctcacggtttccacagggagcccagttgaggggggcacttcgaactttaagcctgctggccgctcaagggctctgggctcagacatcggtgctgcatcgggaggatttggagcgcctaggcgtgcaggaatccgatctgaggctgtttctggatggtgacatcctccgccaggacagggttagcaaagggtgctatagctttatacatcttagctttcaacaatttctcacggccctgttttacactctcgagaaggaggaagaagaggaccgagatggacacacgtgggatattggggacgtccagaaactgctaagcggcgtcgagaggcttagaaatccggacttgatacaggcgggttattactcctttgggttggccaatgagaagcgcgcaaaagaactggaagccacttttggctgtagaatgtcacctgacataaagcaggagctgctcagatgtgacattagttgcaagggcggtcactctaccgtgacagatctgcaggagctgctggggtgtctgtacgagtctcaagaggaagagctcgtgaaggaagttatggcgcagttcaaggaaatttccctgcatctcaatgctgttgacgttgtaccgtcaagcttctgtgtgaagcattgccgcaacctccagaaaatgtcactccaggtgatcaaggaaaacttgcctgaaaacgttaccgcctctgagtcagatgctgaggtcgagagaagccaggacgatcaacatatgcttcctttttggaccgacctttgtagcatcttcgggtcaaataaagatttaatgggactggcaatcaacgactcctttctgagcgcaagtctcgtgcgtatcctgtgtgagcagattgcgagtgatacatgccatttacaaagggttgtgttcaagaacatcagtccagccgacgcacaccgcaacctctgcctggctctgcggggacataagactgtgacttatctgaccttgcagggtaacgaccaggacgatatgtttcccgcactctgcgaagtcttgaggcatcccgagtgtaaccttagatacctgggtctagtcagttgctccgccaccactcaacagtgggctgacctgtcactggctttagaagtgaaccaatcgctcacatgtgtcaatctttcagacaatgaactcctggacgagggtgccaaacttctgtacaccacgttgcggcatcccaaatgtttcctccaacgcttgtcattggagaactgccaccttacagaggcgaattgtaaggatctggctgccgtgctcgtggtgagtcgcgagctaacccacctctgtttggctaaaaacccaatcggtaatactggagtcaaatttttatgtgagggcctgcggtatcccgagtgcaaactgcagacgctggttctgtggaattgcgatatcacttcagatggatgttgcgacttgactaaacttttacaggagaaatcttctctcctatgcctcgacctcggcctgaatcacatcggcgttaagggcatgaagttcctctgcgaggctctgaggaagcccctgtgcaatctgaggtgcctatggttgtggggctgtagcatccctccattctcctgtgaagacttgtgttccgcactaagctgcaatcagtcgctcgtgacactggacctgggtcaaaatcctctcgggtctagtggggtgaaaatgctctttgaaacactaacctgctcttcagggactctgaggaccctgcgcttgaaaattgacgacttcaatgacgaactgaacaaactgctggaagaaatcgaagaaaagaaccctcaacttatcatcgacacagagaagcaccatccctgggccgaaaggccatcctcgcacgacttcatgatttag

SEQ ID NO: 57854 - DNA, 3189 bp, Artificial Sequence
  Description of Artificial Sequence: Synthetic coding sequence
atggtatcgtctgcccaaatggggttcaatctccaagccctgctagagcagctgtcccaggatgagcttagtaaattcaagtaccttatcacaacattctcattggctcatgaactccagaaaattcctcataaagaggtggacaaagcagacggaaagcagctggtggaaatcctgacgacacattgtgattcctattgggtggaaatggcatccttgcaggtgttcgagaaaatgcataggatggacctttcggagagagctaaggatgaggtgagagaggccgctctgaaatcttttaataagaggaaaccattatctctgggaatcacacggaaagagaggcctccactggatgtagatgaaatgcttgaaagattcaagacagaggctcaggcattcaccgagactaaggggaatgttatatgcctgggcaaagaggtttttaaggggaagaaaccggataaggacaaccggtgtcgctacatactgaagacaaagttcagagagatgtggaaatcctggcctggtgactcaaaagaggtccaggttatggcagagcgctacaagatgctcatcccattttccaacccccgagtattaccagggcctttcagttacacagtggtactgtatggaccagcgggtctaggaaagaccactttggcacagaaattaatgctggactgggctgaggataatctcatacacaaattcaaatatgccttttacctctcgtgtagagagctcagtagacttggcccttgctcctttgctgagctcgtgttccgcgattggcctgagctgcaagatgatatcccacacatcctcgcacaggctagaaaaatcctctttgtgatcgatggttttgacgagctgggtgcagcccctggcgcactgatcgaggacatctgtggggattgggagaagaaaaagcccgtgcctgtcctgctgggatcacttttaaatcgtgtgatgctgcccaaagccgctctgctggtcactacacggcctcgtgctttgcgggatttgagaatcctggccgaggagccaatctatattagggtagaaggctttttagaggaagacagacgtgcttacttcttacggcactttggcgacgaagaccaggcaatgagagcctttgaactcatgagatcgaatgccgcactattccagctgggctccgcacccgcagtgtgctggattgtgtgtaccaccctgaaactgcagatggaaaagggcgaggatcctgtgcctacgtgccttactcggacggggcttttcctccgctttctgtgcagcagatttccgcagggagctcagctccgcggagccctgcgaactctgtctcttctagctgcccaaggcctgtgggctcagacctccgttctgcaccgagaggacctggagagactaggggtccaagaatctgacctaaggttgttcctcgatggggatattctccggcaggaccgcgtcagcaagggatgctattcttttatccatctgtcttttcagcagttcctgacagccttgttttatactctcgaaaaggaggaagaagaggatcgcgatggacatacttgggacatcggagatgtccagaaactgctatctggggttgagagactgcgtaatcctgacctgatccaggccggttactactccttcggcctggccaacgaaaagagggccaaagagttagaggccacctttggctgcagaatgagtccagatataaagcaggaattgctacgctgcgacataagctgcaaaggtggccattctaccgttaccgacctccaggagttgctgggatgcttatatgaatcccaggaggaggaattagtaaaagaagtgatggcacagttcaaagaaattagcctgcatctcaatgccgtcgacgtggtcccatcctcattttgcgtgaaacattgcaggaaccttcagaaaatgagcttacaggtgatcaaggaaaacctccctgaaaacgtgaccgctagcgaatcagacgccgaggtggagagaagccaggatgatcagcacatgctgcccttctggacagacctctgctcaattttcggtagtaacaaagatctgatgggactcgctattaacgacagctttctgagtgcctccctggttagaatcctgtgtgagcagatcgctagtgacacatgtcatctccagagggtagtgttcaagaacatttcccctgccgatgctcacagaaacctatgtttagccctgcggggtcacaaaactgttacataccttactttacaagggaatgatcaggacgacatgttccccgcactttgcgaagtccttcggcatcctgaatgtaaccttagatatctgggactggtgtcctgtagcgcaaccacccagcagtgggcagacctgagtctagctctggaggtgaaccagtccttaacatgtgtaaatctatccgataatgaactgcttgatgagggcgctaagctcctttacactactcttaggcatcccaagtgttttctccagaggttatcccttgaaaattgtcatttgacagaagcgaattgtaaagacctggcagccgttctagtcgtatcaagggaactcactcacttgtgtctcgccaagaatcccataggaaatactggtgtcaagttcctgtgcgagggcctgagataccccgagtgcaaactccaaaccctggtgctgtggaattgcgatataactagcgacggctgttgcgacttaacaaaattgctgcaggagaaaagttcattactgtgcctggacctagggctcaaccatattggggttaagggaatgaagttcctgtgcgaggccctgcggaaaccactctgcaatctccgatgtctgtggctctggggctgtagcattcctccgtttagttgcgaagatttatgtagtgctctttcctgtaaccaaagcttggtcactctcgatctgggccagaaccccttaggaagctctggcgtcaagatgctctttgagacccttacctgcagttcaggcacccttaggaccctgaggctgaagatcgacgacttcaacgatgaactcaacaaactgctggaggaaatcgaggaaaagaatcctcaattaatcattgacacagaaaagcaccacccctgggctgagagaccaagctcccatgatttcatgatatag

SEQ ID NO: 57855 - DNA, 3189 bp, Artificial Sequence
  Description of Artificial Sequence: Synthetic coding sequence
atggtgtcaagtgcacagatgggattcaatctccaagcgctacttgagcagctaagccaggacgaattgtccaaatttaaatacttaattaccacattttctcttgcccacgaattgcagaaaatcccccacaaggaggtcgacaaagccgacggtaagcagctagtggaaatcctcacaacccattgcgattcctactgggtcgagatggcaagcctgcaagtatttgaaaaaatgcaccgcatggacctgtctgagagagccaaggacgaggtaagggaagcagccttaaaatccttcaataaaagaaagcctctctctctcggaattacacggaaagaacggccacccctggatgtggacgaaatgttggagagattcaagaccgaggcccaggccttcactgagaccaaaggtaacgtcatctgtctgggtaaggaggtttttaaaggaaaaaagccagacaaggataaccggtgtagatatatcctgaaaacaaaattccgtgagatgtggaagagctggcccggtgatagcaaagaggttcaggtgatggccgagcggtataagatgctgattcccttctcaaaccccagggtgctgcctgggcctttctcctataccgtggtgctttacgggcctgcaggtctggggaagaccacactcgcccagaaactgatgctggattgggcagaggataatcttatacacaagttcaaatatgcattttacctcagctgtagggaactgtctcgcttgggcccatgtagctttgccgaacttgtattccgcgactggcccgagctgcaggacgacattccccacatcttagcacaggccagaaaaatcctgtttgttatcgacgggttcgatgaattgggagccgctcccggagccctgatcgaggacatctgtggtgactgggagaagaagaagccagttccagtgctattgggctcccttctgaatcgcgtgatgctcccaaaggccgcactcctagttactactcggccacgggcactaagagacctgaggatcctggccgaggagcccatatacattcgcgtcgagggatttcttgaggaagaccgaagggcatatttcctgcggcactttggtgacgaggaccaggcaatgcgggcttttgagttaatgcgaagcaacgccgctctgttccagctcggctcagcgccagctgtgtgctggatcgtttgcacgaccctgaagctgcagatggagaagggggaggacccggtcccaacgtgcctgacgaggacaggcttattcctgcggttcttgtgttcccgattcccgcagggggctcagttgagaggagcgctccgcaccctcagcctgctcgccgcacaagggctttgggctcagacgagtgtgctccacagggaggacttggaaaggctcggggtccaggaatccgatttgagactttttctggacggcgacatacttcggcaagatcgcgtgagtaaaggatgctacagctttattcatttgtctttccaacaattcctgacagcgctgttttacactctagaaaaagaggaggaagaagacagggacggccatacgtgggacatcggtgatgtgcagaagctactgagcggcgtggagcggctgaggaacccggatctgatccaggccggatattactcttttggtctcgcgaacgaaaaacgcgctaaggagttagaggcaacattcgggtgccgtatgtcccccgacattaagcaggagctgctccggtgcgacatctcctgcaaaggtggacattccacggtcacagacctccaggaactacttggctgcttgtatgagagccaggaggaagagttagtaaaggaggtgatggcccagttcaaggaaataagcctgcatcttaacgcggtcgatgtcgtgccttcgtcattctgcgtaaagcactgcaggaacctgcagaagatgtcactccaggtgataaaagagaatctaccagaaaatgtgacagcgtcggaatcagatgcagaagtcgagcgatcacaggacgatcagcatatgctgcccttttggacggatctgtgtagcatttttggcagcaataaggacctcatgggcctggctattaatgattcctttctgagtgccagcctggtcagaatactctgcgaacagatcgcgtctgatacctgtcacctccaacgggtcgtcttcaaaaacatcagtccggcagacgcccacaggaacctttgcctcgccctacgcggacacaagacagtgacctacctgactctgcaagggaacgaccaggacgatatgtttccagctttatgcgaggttttgcgacatcccgagtgtaacttacggtacctgggattggtgagttgctctgcaactacccagcagtgggcagatctgtcgctggctcttgaggtcaatcagtccctgacttgtgttaatttgtcagacaacgagttattggatgaaggcgcaaagttactctatactaccctccggcatccaaagtgcttcttacaacgcctctccctggagaactgtcacctcacagaagcaaactgcaaggacctcgccgctgtgctcgttgtgagtagggagcttacacacctctgcttggccaagaacccaattgggaataccggcgtgaaattcctttgcgagggtctccgatatcctgagtgtaagctgcagacgctggtgctctggaactgcgacattacaagtgacggttgctgcgacctgaccaagttgcttcaggaaaaaagttccctgctatgtctggatttgggcctgaaccatattggggtcaagggcatgaagttcctgtgtgaagctctccggaaaccactatgcaatctcagatgtttgtggctgtgggggtgtagtatacccccatttagttgcgaggatctatgttctgcactatcctgcaaccagagcctggtgaccctggacttaggacagaacccattgggcagcagcggagtgaaaatgctgttcgagacactgacatgttctagtggcaccctcagaaccctgcgcttgaaaatagacgactttaacgacgagctgaataagctactcgaagagatcgaggagaaaaacccacagctgatcatagataccgaaaaacatcacccctgggcggaacggccaagtagccacgatttcatgatctag

SEQ ID NO: 57856 - DNA, 3189 bp, Artificial Sequence
  Description of Artificial Sequence: Synthetic coding sequence
atggtgagctcagcacaaatgggcttcaatctgcaggcccttctggaacagctatcacaggacgagttatccaagtttaaatacctgattacgaccttttctctcgcgcacgagcttcagaagataccccacaaggaagtggacaaggcagatggtaaacagctggttgagatcctgacaactcactgtgattcttactgggtcgaaatggcttctcttcaggtttttgagaaaatgcatcgcatggatttaagcgaaagagccaaagacgaagtgcgggaggccgcactgaagagcttcaataagcggaaacccctctccctggggataacaaggaaagaacgtccacctctggacgtggatgagatgctggaacggttcaaaacagaggcccaggcttttaccgagactaaggggaacgttatctgccttggcaaggaggtgttcaaaggtaagaaacctgacaaagataacagatgtaggtacatcctgaagactaaatttcgagagatgtggaaaagttggccaggcgattctaaagaagtacaggttatggcggaacggtataagatgcttatccccttttcaaatccaagagtgctccctggacccttttcttatactgtggtcctctacgggcctgctggactgggcaagaccactctcgcgcaaaagcttatgctggactgggccgaggacaacctgatccataaatttaagtacgccttctatctaagctgccgggagctttccaggctgggaccctgttccttcgccgaactggtgttccgcgactggcctgagcttcaagatgatattccccatatcctggcacaggcgaggaaaattctttttgtgattgatggattcgacgaactgggcgctgcccctggcgctttgatcgaggacatctgcggcgactgggagaagaagaagcccgtccctgtgctgctgggctccttacttaaccgggtaatgctgcctaaggcagcattattagtaaccacccgacctcgagccctgagggatctgcgaatcttagccgaagagcccatttacatccgcgtggaaggattccttgaagaagaccgccgtgcatattttctacgtcactttggagacgaggaccaggctatgcgggctttcgaactgatgcgaagtaatgccgctctatttcagctgggctctgctccagctgtgtgttggatcgtgtgtacaaccttgaaattgcagatggagaagggcgaggatcccgtacccacctgcctcacgagaactgggctcttcctaagattcttgtgctcaaggtttccccagggagctcagctccggggagcattacgtacgctatctcttctcgctgcccagggcctgtgggcacagacctccgttcttcacagagaagatttggagaggttgggcgtacaggagagcgacctcagattatttttggatggggatatcttgcgccaggaccgagtctctaaaggttgttatagtttcatccacctcagcttccagcagttccttactgccctgttttacacactagagaaagaggaggaagaagaccgggacggacatacatgggatattggagatgtgcagaaactcctgtctggcgtcgagcgcctgcgaaatccagacctcatacaggcaggctactactcattcggcctggcaaacgagaaacgagcgaaggaactggaggccacatttggctgtagaatgagtccggacattaaacaagagctgctgagatgcgatatttcatgcaaggggggtcactctacagtcactgacctccaagaactactgggctgcctctatgagtcacaggaagaggagctggtgaaggaggtgatggctcagttcaaggagattagcctccaccttaacgccgtggatgtagtgccctccagtttctgcgtgaaacactgccgtaatctgcagaaaatgtcactgcaggtaataaaggaaaatctcccagagaatgtgacagcatccgagagcgacgctgaggtggagcgaagtcaagatgatcagcacatgcttcccttctggaccgacctttgtagtatatttggatctaacaaggacctgatggggctggctataaacgacagcttcctgagtgcatcccttgtgcggatcctgtgtgagcagattgccagtgatacatgccacttgcagcgggttgtgtttaagaacatctctcctgcagatgctcaccgaaatttgtgtctggccctccgaggacataaaacagtcacctacttaaccctgcagggcaacgatcaggatgatatgttccctgctctgtgtgaagtgttaaggcatccagagtgtaatctgcggtacctgggtctcgtgtcctgttctgctacgactcagcagtgggctgatctttctctggctttggaagtgaatcagtccctaacctgcgttaatctgagcgacaacgaactgctcgacgaaggagccaaattactgtataccaccctgcgccatccgaagtgctttctgcagcggctgagccttgagaattgccacctgactgaggccaactgtaaagacctagccgctgtgctggtcgtatcccgcgaactaacacacctctgccttgcgaaaaaccccatcggcaatacaggagtcaagtttctgtgtgaagggttacgatatcccgagtgtaagctgcaaaccttggtgctctggaactgtgacattacctcagatggctgttgtgacttgactaagctgctacaggagaaatccagcttgctgtgtctggatctagggctcaatcacattggtgttaaaggaatgaagtttctgtgcgaagccctgcgcaaacccctgtgcaacctgcggtgtctttggctctggggctgctccatccctccattctcctgtgaagatctatgctccgctttatcatgtaatcaatctttggtgacgcttgatctgggacaaaaccccctgggcagtagtggggtgaagatgctctttgagacacttacttgctcaagcgggactctgagaacccttcgtctgaagatcgatgattttaatgatgagttgaacaaattacttgaagagattgaagaaaaaaatccacagctgattattgacactgagaaacaccacccttgggcggagaggccatctagccacgattttatgatctag

SEQ ID NO: 57857 - DNA, 3189 bp, Artificial Sequence
  Description of Artificial Sequence: Synthetic coding sequence
atggtgagttctgcacagatggggtttaatctgcaggcccttctggagcagctgagtcaggatgaattgtcaaagtttaaatatctcattaccactttttccctcgctcacgaactgcagaaaattccgcacaaagaggtggacaaggctgatggtaagcaactggtggagatcctcactacacactgcgatagttactgggttgaaatggcctcactacaagtatttgaaaaaatgcatcggatggacctttctgagcgcgctaaggacgaagtgagagaggctgcccttaaatcattcaacaagcggaagcctctgagcctcgggataacacgcaaggagcgccctccattagacgtggatgaaatgctggaacgttttaaaaccgaggctcaagccttcacagaaaccaagggcaacgtgatttgtttgggcaaggaggtatttaaagggaagaaacccgacaaagacaaccgttgtcgctacattctgaagactaaatttcgagaaatgtggaagtcctggcctggcgactctaaagaggtccaggtgatggcagaaaggtacaagatgttgattccgtttagcaaccctagggtgcttcctggacccttctcgtacaccgtagtgctatatggccctgcgggtctcggaaaaactaccctcgctcaaaaacttatgttagactgggcagaggataatttgatacacaagtttaaatacgccttctacttgtcttgtagagagttatccaggctgggtccatgctcgtttgccgagcttgtctttagggactggcctgagcttcaggacgatattccgcacatcctcgcccaggctcgaaaaatccttttcgttatcgacggtttcgacgagctgggtgccgctcccggagccctgatcgaagacatttgcggtgattgggaaaaaaaaaagccggtacccgtgctgctgggctccctgctcaatagggtgatgctgccaaaggcagctttgcttgtcacgaccaggcctagggctcttcgggatcttaggatcttagcagaggagccaatctacatcagggtcgaggggttcctggaagaagatcgcagggcttattttctgcgccactttggcgatgaagaccaggcaatgcgagcctttgagctcatgagatccaacgctgctcttttccaattggggtctgccccagcggtctgctggattgtgtgcacaacgttgaagcttcagatggaaaaaggggaggacccagtgccaacctgcttgactcggaccgggctatttctgagattcctatgcagcagattccctcagggggcacagttgcgcggagccctacgcacactgtcacttttggccgctcagggactgtgggcccagacctccgtcttacacagggaagatcttgagaggctaggcgtccaggagtccgatcttcgactgtttctggacggcgacatcctaaggcaggatagagttagcaagggttgctatagcttcatacacttaagcttccagcagttcctgactgctctgttctacaccttagagaaggaggaggaggaggaccgggacggacacacctgggatatcggggacgttcagaaactactgtcgggtgtcgaacggctgcgtaaccctgatctaatccaggcaggctattactcgtttggattggcaaatgagaagagagctaaagaactggaagccaccttcggatgcaggatgtctcccgacatcaaacaagagctgctgcgttgcgatatatcctgcaagggcggtcactctactgtcaccgacttacaggagttactgggttgtttatacgaatcacaggaggaggaactagtcaaggaggtgatggcccagtttaaggagatatctctccacctgaacgccgtggatgtggttcccagctcattctgcgtcaagcactgtcgcaacctgcagaagatgtccctgcaggtcatcaaagaaaacttacccgagaatgttactgcctcagagtccgacgccgaggtagagaggtcccaggatgaccagcacatgctgcctttttggactgacctctgtagcatcttcggttccaataaggacctgatggggttggccatcaacgacagctttcttagcgccagtttagtgcgcattctgtgtgaacagatcgcatcagacacctgtcatctccagagggtggtcttcaagaacattagccctgccgatgcacaccgcaatctgtgtctggctcttcgaggacacaagaccgtgacctacctgactctccagggcaacgaccaggacgatatgtttcctgccctgtgcgaggtcctgcggcacccagaatgcaacttaaggtacctcggcttggtgagttgcagtgcgacaactcagcaatgggcagacctctccctagctttggaagtgaatcagtccctgacctgtgtgaatctgtctgataatgaattgctcgacgagggcgctaagcttctgtatactactctgagacacccaaagtgttttctccagcgactcagcctggaaaactgccacttgaccgaagccaactgcaaggacctggccgctgtgctggttgtgtctagggaacttacccatctttgcttggcgaagaatcccattggtaacactggagtgaagtttctttgcgagggcctgcgctaccccgaatgcaagttgcaaaccctcgtgctgtggaattgcgatatcacgtcagacggatgttgcgatctgacaaagctcttgcaggagaaaagttctctgctctgtcttgacttgggacttaaccacattggcgtcaaggggatgaagtttctttgcgaggcccttagaaagccgctgtgcaatttacggtgcctctggctgtgggggtgcagcatcccacctttcagttgcgaggacctgtgcagcgcgctgagttgcaaccagtcactcgttacgctggacctcggtcagaatcctctcggcagctccggggtgaaaatgctctttgaaacccttacatgttcttccggaaccctgcgcaccttgcgtctgaaaattgacgattttaatgacgaactgaacaaactcttagaggagattgaggaaaagaatccccagctgattattgacactgagaagcaccatccttgggccgagcggccttctagtcacgacttcatgatctag

SEQ ID NO: 57858 - DNA, 3123 bp, Artificial Sequence
  Description of Artificial Sequence: Synthetic coding sequence
atggtgagtagtgcccagatgggcttcaatttacaggccctcctggaacagctgtcccaggacgaactctccaagttcaagtacctgattacaacattctcccttgcccacgaacttcagaagatcccccacaaagaagtagataaggccgacgggaagcagttagttgagatactgaccacacattgtgactcatactgggtggagatggcaagcctgcaggtattcgaaaagatgcatcggatggatctgtctgagcgtgccaaggacgaggtgcgcgaagcagcgttgaaatcgtttaacaagcgcaagcctctgagcctgggaataacccgaaaggagagacccccactggacgtggatgaaatgctggaaaggtttaaaacagaagctcaagacaaggacaaccggtgccgctatatactgaagaccaagtttcgggagatgtggaagagttggcccggtgatagtaaagaagtccaggtgatggctgagcggtacaaaatgctgatcccctttagtaatccacgtgtgctgccaggcccttttagttacacagtagtgctgtatgggcctgcagggttaggtaagaccactctagcccagaaactgatgctcgattgggcagaggataatctgattcacaagttcaagtacgcattttacctgtcttgtcgtgagctatccaggctgggcccttgctcttttgcagaactggtgttccgggattggcccgaactgcaggatgatattccgcacatcctagcccaggctaggaagatcctgttcgtcattgacggtttcgacgaactgggagcagcaccaggtgccctgatcgaagatatttgtggggattgggaaaagaagaagcctgtccctgtcctgctcgggtccctgttaaatagagttatgctcccgaaagctgcgctgctcgtgacaaccaggccaagagcactgagggatctgcgcatcctcgccgaggagcccatctacattcgggttgagggatttctggaagaggaccgcagagcctatttcttacggcatttcggcgacgaagatcaagcgatgcgggcatttgaactcatgcggtcaaacgcagctctgtttcagctggggtccgcacccgcagtgtgttggatcgtgtgtaccaccctgaagctgcagatggaaaagggggaggatcccgttcccacttgtctgaccaggaccggtctgtttctgcggttcctgtgctctagatttcctcaaggggcacagcttcggggtgctctgcggactctgtcattgttggccgctcagggcctgtgggcacaaacttctgtcttacacagggaagacttagaaagactgggagtccaagagagtgatctgcgcctctttcttgacggcgacattctccggcaggaccgtgttagcaaggggtgctactcttttatccatctctcctttcaacagttcctcacggccctattctacacactcgagaaggaagaggaagaggatagggacgggcatacctgggatattggcgatgtccagaaactactttctggagtcgagaggctgcgaaaccctgatctaatccaggctggttattatagttttggattagctaacgagaaacgggcaaaagaactggaagctacattcggttgccgaatgagccctgacatcaagcaggaacttcttagatgtgatatcagctgcaaaggtggacactctacagtaactgatctgcaggagcttctcggctgtctgtacgagagccaggaggaggaacttgtgaaggaagtcatggcacagttcaaggaaatcagcctgcatctgaacgcggtggacgtggtaccaagctctttttgcgtgaaacattgccggaacctccagaagatgagcctgcaggtaataaaggagaaccttcccgaaaacgtaacagcatccgaaagcgatgccgaggtcgaaaggtcccaggacgatcagcacatgctgccattctggaccgacctttgttcaatctttggaagtaataaagacctgatgggcctagctataaatgacagctttctctcagcctcactcgtacgcatcttgtgcgaacaaatagcatccgacacatgtcaccttcagcgtgtggttttcaagaatatttcaccggctgatgcccatcgaaacctgtgcctggcactccgaggacacaaaacagttacttacctgacactgcaagggaacgatcaggacgacatgttcccagcgctctgcgaagtcctgaggcatccagagtgtaacctgcgatatctgggcctagtgagttgctctgccacaactcagcagtgggctgacctgtcgctcgcccttgaggtaaatcagtccttaacctgtgttaatctgagcgataacgagctccttgatgaaggtgccaagctgctgtatacaaccttgagacatcctaagtgcttcctacagaggcttagtcttgagaactgccatctcacggaagcaaattgtaaggatttagcagctgtgcttgtggtgagtcgtgagctgactcacctttgcctggcgaagaatcctatcgggaacacaggagtgaagttcctctgcgaaggtctccgttacccagaatgtaagctgcagactctggttctgtggaactgcgacataactagcgacggatgctgcgatttaaccaagttactccaggagaaaagttctctcctgtgcctcgacctcgggcttaatcatatcggagtaaagggaatgaagttcttatgcgaagccctccgaaagcctttgtgcaacttaaggtgtttatggctttggggctgcagcatacctcctttttcctgtgaggacctgtgcagtgcactttcctgtaaccagtcactggtgaccttagatctgggtcaaaacccacttgggagttctggagtgaaaatgctgttcgaaactctgacatgttcctctgggactctgcggactcttagactgaagattgatgatttcaatgatgagttgaataaactcttggaggagattgaagaaaaaaatcctcaacttatcattgacacggaaaaacaccatccttgggccgagcgcccttcgagtcacgattttatgatttag

SEQ ID NO: 57859 - DNA, 3189 bp, Artificial Sequence
  Description of Artificial Sequence: Synthetic coding sequence
atggtaagcagcgctcagatggggttcaacctccaggctctattagagcaattatcacaggatgagctgtcaaaatttaagtatcttattaccacgtttagcctggcgcatgagctccagaaaatccctcacaaagaggttgataaggccgacgggaagcagctggtcgaaatcctcacaacccattgcgactcatattgggtcgaaatggcctctctgcaggtgttcgagaaaatgcataggatggatctgagcgagagggccaaggatgaagttagagaagccgctctgaaatccttcaataaaaggaaacccctgagcctgggaattactcggaaggagagaccacctttagatgtagatgagatgttggagaggttcaagacagaggctcaggcattcacggaaactaagggcaatgttatctgtctgggcaaagaggtatttaaaggcaagaaaccggacaaagataacaggtgcagatacatccttaagaccaaatttagagagatgtggaagtcatggccgggagactcaaaggaggttcaggtgatggccgagcggtacaaaatgcttattccattttcaaatcccagggtcctcccagggcctttttcatacaccgtggtgctttacggacccgcagggctggggaagacgaccctggctcaaaagctaatgctcgactgggcagaggataaccttattcataaatttaaatacgcattctatcttagctgtcgagagctgtctcgtcttggcccttgttcatttgccgagctcgtttttcgagattggccggagctacaggacgatatcccacacattcttgctcaggcacgaaaaatccttttcgtcatcgatgggttcgacgagctgggggctgcgccaggcgcactgatcgaagatatttgtggcgattgggaaaagaaaaaaccggtgcccgttctgctgggcagtctgctcaacagagtaatgttgcctaaggctgcattactggtgacaactagaccaagagccttacgtgacctgcgtattttagctgaggagcccatttatatccgcgtagagggcttcctggaggaggataggcgtgcctatttcctcagacactttggggatgaagatcaggcaatgagggctttcgaactgatgagatctaatgccgctttgttccaactcggttctgctcccgcagtctgctggatagtttgcactacactcaaactgcagatggagaaaggagaagaccctgttcctacctgtctaacaagaaccgggctcttcctccgctttctttgcagtcgatttcctcagggcgcacagctgcgtggagcattgaggacgctgtctctgctagctgcccagggtctgtgggcccagacatccgtgctccatagggaagatttagaacgacttggcgtgcaagaatccgatttgcggcttttcctggacggcgatattttgcgacaagaccgcgtgtcaaagggttgttattcctttattcacttgtcctttcagcaatttctgactgctctcttttacacgttagaaaaggaggaggaagaggatcgggacgggcacacatgggacatcggagacgtgcagaagctgctttccggagtcgaaagacttcgcaatcctgatcttatccaagctggatactactcttttggcctagctaatgaaaagcgtgccaaggaattggaggctacgttcggatgtagaatgtccccagatattaagcaggagctcctccgctgtgacatctcatgtaaggggggacattccacagtcacagatttgcaggagctgctgggctgtttgtatgaatcccaggaggaagagctagtcaaggaggtcatggctcagtttaaagagattagcctacatctgaacgccgtcgacgtggtcccttctagcttctgcgtcaagcattgtcgtaatctgcagaaaatgtctctgcaggtgatcaaggagaatcttcctgaaaatgtgaccgcttcagagtccgatgctgaggtcgaacgttctcaggatgatcaacacatgctccccttctggacagatctgtgctcaatcttcggtagtaataaggatctcatggggctggccattaatgattcatttctatccgcgagcctggtgagaatactgtgcgaacagatcgctagtgatacatgccaccttcagcgagtggtttttaaaaatatcagtcccgctgatgcacaccgaaatttgtgcctagcgctgaggggtcataagacagtcacttacttgaccctgcagggcaatgatcaagatgatatgtttccagcgctgtgcgaggtcctaagacaccccgagtgtaatttgcggtatctcggactagtatcttgctcagccactacacagcagtgggcagacctgtctttggcccttgaagttaaccagagccttacctgcgtaaatctgagcgataacgagctcctggatgagggggcaaaactcttgtataccacacttcgacatcccaagtgtttcctacaacgactctccctggagaactgtcatctgacagaggctaactgcaaagatctcgccgctgtcctagtggtttccagagagcttacacacctgtgtctcgctaaaaatcctatcggtaacaccggtgtgaaattcctgtgtgagggtctccgatatcccgagtgcaagctgcagactttggttctttggaactgcgacatcactagtgacggctgctgcgacctgaccaaacttcttcaggagaaatcttcacttttgtgcttagatctaggcctaaatcatataggcgtgaaaggtatgaaatttttgtgcgaggctctgcgcaagccactatgcaatttacgttgcctctggctgtggggatgttccatccccccattcagctgtgaggacctttgttcagccctgagttgtaaccagtccctggtgacgctcgaccttggacagaacccactcggatcaagtggagtgaaaatgctattcgagacgctaacttgtagtagcggcactctgcgcacactgagactgaaaatcgacgactttaacgatgagttaaacaaactgctggaagagattgaggagaagaacccccaactcattatcgatacagagaaacaccacccttgggctgagcgacctagcagccatgacttcatgatctag

SEQ ID NO: 57860 - DNA, 3189 bp, Artificial Sequence
  Description of Artificial Sequence: Synthetic coding sequence
atggtaagtagcgcacagatggggttcaatctgcaagctctacttgagcagctgtcccaagatgagttatctaagtttaaataccttattacgacttttagcctggcccacgagttacaaaaaatcccacataaagaggttgacaaggcagatgggaaacaacttgtagaaatcctcactacccattgtgactcttattgggtcgagatggccagtctacaggtatttgaaaagatgcatcgaatggacttatccgaacgtgcgaaagacgaagttcgcgaagcagccctgaagtcatttaacaaacggaaacccctctcattgggcattacgcggaaagagaggccgccactggatgtggatgagatgctcgagagattcaagaccgaggctcaggcatttaccgagactaaggggaacgtgatctgtctggggaaggaagtgtttaaaggcaagaagcctgacaaggataaccgctgtcgctacatcctcaagacgaagtttagagagatgtggaaatcatggccaggagactccaaggaggttcaggtgatggctgaaaggtacaagatgctgattcccttttcaaacccacgggtgttgcctgggccattctcctatacagtcgtgctctacgggccagccggacttggaaaaacaacattggcacaaaaattaatgcttgactgggcagaagataatctgatccacaagtttaaatacgctttttacctctcctgtcgagagcttagccggctgggcccatgctcctttgcagaattggtgtttagggactggccggaacttcaggacgacatccctcatattctggcacaagctagaaagatcctgtttgtgatcgacggttttgacgaactgggcgctgctcctggagctcttatagaggacatttgcggcgactgggaaaagaagaagccagtacccgtcctgctgggatcacttctaaatcgggtcatgctgcccaaggcggctctcttggtgactaccagaccaagagccctccgcgacctcagaatcctggctgaggaacccatatacatcagagtcgagggattcttggaggaagatagaagagcttatttccttaggcatttcggtgacgaagaccaagccatgagagcctttgaattgatgagatccaatgccgcactcttccagcttggtagtgcaccggcagtgtgttggattgtatgcacaacgctgaagctgcagatggaaaaaggggaagatccagtgccaacatgtctgactcgtaccggcctgtttcttcgctttttatgctcccgcttccctcagggggctcagctgaggggagccttgagaacacttagtctgctggccgctcagggactgtgggctcagactagcgtcctgcaccgggaggatctagaaaggctcggggtgcaggagagtgatctgaggctgttcctagatggagacatcctccgccaggaccgcgtgagtaagggctgctactctttcatacacttgtctttccagcagtttctgaccgcactgttctacactctcgagaaagaggaggaagaggatcgtgacggtcatacatgggatattggtgatgtacagaagctcttgtccggcgtggagagactgcggaaccctgacctgattcaagcgggatattacagttttggcttggccaatgaaaagagggccaaagagctagaagcgaccttcggatgccgcatgagccctgatatcaagcaggaactgctccgctgtgacatcagttgcaagggcggtcattctactgtgacggatctgcaggagctgctcggctgcctctacgagagccaagaggaggagctggtgaaggaggtaatggcccagtttaaggaaatcagtttgcacttgaacgccgtcgatgtggttccctcttccttctgcgtgaaacattgccgcaatctccagaagatgagcctgcaggtaatcaaagaaaatctacccgaaaatgtcactgctagcgagtctgatgctgaggtggagagatcacaggacgaccagcacatgctccccttttggacagatctttgcagcatctttggctctaataaggatcttatgggacttgcaattaatgatagcttcctcagcgcgtccctggtgagaatcctttgcgagcagattgccagcgacacctgtcacctgcagcgcgtggtgtttaagaatatatcccccgctgatgctcatcggaacctgtgtcttgctctcagaggtcacaagacagtgacctatttaacactccagggaaacgaccaggatgacatgttccccgctctatgcgaggttttgcgacacccagaatgtaatttacggtacctaggcttggtatcttgttcagcgaccacccagcagtgggccgatttaagcctggccctggaagtcaaccaatcactgacttgtgtgaatctcagtgataacgagctacttgacgagggcgctaaacttctgtacacgacacttcggcaccccaagtgtttcctccaacgattgtctctggaaaactgtcacctgactgaagccaactgtaaggatcttgccgctgttctggtggtatctcgcgagcttacccatctttgcctggctaaaaacccaatcggtaacactggagtcaaatttttgtgcgagggactgagatatccagaatgcaaacttcagacgctggtgttatggaactgtgacattactagcgatgggtgctgcgacctgacaaagttgctgcaggagaagagtagtctcctttgcctcgacctgggcttgaatcacatcggcgtgaaggggatgaagttcttgtgcgaggcgttaaggaagccgctgtgcaatttgcggtgcctctggctgtggggttgctcaataccgcctttctcctgcgaggacctttgttctgcccttagctgcaaccaatccctggtaactcttgacctgggccagaatccattgggctcatctggtgtgaagatgctctttgaaacattaacctgttcgagtgggacactgcggaccttgcgccttaaaatcgacgatttcaatgacgagctaaacaaattactggaggagattgaagagaagaacccccagcttatcattgataccgagaaacatcacccctgggctgaacggccttcatcccatgatttcatgatctag

SEQ ID NO: 57861 - DNA, 3189 bp, Artificial Sequence
  Description of Artificial Sequence: Synthetic coding sequence
atggtgagcagcgcacaaatggggtttaacctgcaggccttgcttgagcagctgtctcaggatgagctgagcaaattcaagtacctgatcactaccttcagccttgctcacgaactgcagaagatccctcataaggaagtcgataaggcggacggaaaacagctggtcgagatcctgacaacccactgtgattcctactgggttgaaatggcatctctccaggtattcgagaaaatgcaccgcatggatctgagtgaacgggcaaaggacgaggtcagagaagctgcactcaagtcattcaacaagagaaaaccactctctctcggcatcaccaggaaggagaggccgccactggacgtggacgagatgctggagaggttcaaaaccgaggcacaagcctttactgagacgaagggcaatgtcatatgcctgggaaaggaggtctttaagggcaaaaagcctgataaggacaacaggtgtcgttacatcctcaagaccaagttccgcgaaatgtggaaatcttggcctggggactctaaggaggtccaggtgatggccgagagatacaaaatgctcatcccttttagtaacccccgagtgctgcctgggcctttcagttatactgttgtactctacgggccagccggtttgggtaagacgactttagcccagaagctgatgcttgattgggcagaggacaatttgattcacaaatttaaatacgctttctaccttagctgtcgggagctctcccgccttggcccatgttcctttgctgaattggtctttagggactggcctgaactgcaggacgacatccctcatatcctggcacaggccaggaaaatactgtttgtaatagatggtttcgatgaactgggggcagcgccaggagccctgatcgaagatatctgtggggactgggagaagaaaaaacccgtcccggtcctactgggatcgctgctgaacagagtgatgctgcccaaagctgccctcttggtgactacaaggcctcgtgccctaagagacttgcgcatattagctgaagaacctatctatattcgggttgaaggctttctcgaagaggaccgtcgagcttatttcttgcgccactttggggatgaggaccaggccatgagagcgttcgagctgatgcgctccaacgcagcccttttccagctgggttccgccccagctgtctgctggattgtgtgcactacattaaaacttcagatggaaaagggcgaggatccagtgcctacttgcctgacaagaacaggcctgtttcttcggttcctgtgctctcgatttccccagggcgctcaactgaggggagccctgaggaccctgtccttacttgcagcccagggtctgtgggcacagaccagcgtccttcaccgagaagatctagagcgccttggggttcaggaatccgaccttcgtctgtttttagacggggatatccttcgccaggaccgcgtctccaagggttgctattcctttatacacctgtcctttcagcagttcttaaccgcactgttctacaccctcgagaaggaagaggaggaagatagagatgggcacacatgggatataggcgatgtgcagaaattgttatcaggtgtggagcggctgcgcaaccctgatctcatacaggcaggctactattcattcgggttagctaatgagaagagagctaaagaacttgaagccacatttggctgtcgtatgagccccgatattaagcaggagctactgcggtgtgacatctcatgcaagggtggacattccacagttaccgatctgcaggaactgctcggatgcctatacgagagccaggaagaggagctggtgaaggaggttatggcgcaattcaaggagatatccctgcacttgaacgccgtggatgtggtacccagttctttctgcgtgaaacattgccggaacctacaaaaaatgagtctccaggtgatcaaggagaacctgccggaaaatgttactgcttccgagagtgatgccgaagtggagcgctcccaagatgatcagcatatgcttccgttttggacagacctttgttccatttttggatcgaataaggatcttatgggactagccatcaacgacagttttctgtccgcctccctggtgcgaatcctgtgtgagcagattgccagtgacacttgccatctacaacgagtggtgtttaagaacatatctcccgctgatgcccatagaaacctgtgccttgccttacgcggtcacaagaccgtgacctatctgactctgcaaggcaatgatcaggacgacatgtttcccgcactctgtgaagtcctcaggcatcctgaatgcaacctacggtacctgggcttggtgtcctgtagtgccaccacccaacagtgggctgacctcagcctggcactcgaggtgaaccagagcctaacctgtgtgaacttgtccgataacgaattattggacgaaggcgcaaagttactttacacaacactcagacatcccaagtgcttcctccaacggctgagcttggagaattgtcatctgaccgaagcgaattgcaaggatctggcagcagtcctcgtcgttagcagagagttgacacacctatgcttagcgaaaaaccctataggcaacactggggtgaagttcctgtgcgaaggactgcggtaccccgaatgcaagctgcagaccctggtgctgtggaattgcgacatcacctcggatgggtgctgcgacctgaccaagctgttacaggaaaagagttccctcctgtgtttggacttgggattgaaccatataggcgtaaagggaatgaaatttctctgcgaagctctcagaaagccattatgcaatctccgttgcctatggctgtggggctgctcaatccctcctttttcgtgcgaggatctgtgctcggcgctgtcctgcaaccagtcgctggtgacccttgacctcggacagaatcccctcgggtcgtctggcgtgaagatgctttttgaaaccctcacatgttcaagcggcactctaagaacactgcgcctgaagatcgacgacttcaatgatgagcttaacaagctgctggaggaaatcgaggaaaagaacccccagctgatcatcgataccgagaagcatcatccttgggctgagcgaccttcatcacatgactttatgatttag

SEQ ID NO: 57862 - DNA, 3189 bp, Artificial Sequence
  Description of Artificial Sequence: Synthetic coding sequence
atggtctcctctgcccagatgggatttaatcttcaggctttgttagaacagttatcccaggacgagctctccaagtttaaatacctgataaccactttcagcctggcccacgagctccagaagatcccacacaaggaggtggacaaagccgacggcaagcagttggtagaaattctgactacacactgtgatagctattgggtcgagatggcttcattgcaggtttttgaaaagatgcatcgcatggatttatctgagcgggcaaaagacgaggttcgagaggcagccttaaagagtttcaataaacgaaaacccctcagtctggggattacccgaaaggagcgtccacccctggatgtggatgaaatgctggaacggtttaagaccgaggcacaggccttcacagaaaccaaagggaacgtaatatgcctgggcaaagaagtgtttaaaggcaagaagccggacaaggataaccgctgccgctacattctcaagaccaaattcagggaaatgtggaaatcgtggccaggcgacagtaaggaggtgcaagtgatggcagaaagatataaaatgctcattccctttagcaaccccagggtcctgcctgggccattttcatacacagtcgtcctctacggcccagccggtctcggcaagactactctagctcagaaactgatgttggattgggccgaggataacttaattcacaagtttaaatatgccttctatttgagttgtcgagagctctctaggctgggtccctgctcctttgctgaactcgtttttagggactggcctgaacttcaggacgacattccacacatcctcgctcaggctcgcaagattcttttcgtgatcgacgggttcgacgagctcggcgctgctccaggagcactcattgaagacatttgtggagactgggaaaagaaaaagcctgttcctgtacttcttgggagccttctgaaccgggtgatgcttcctaaagccgctctcctagtaaccacacggcctagagccctccgagatttgcggattctcgcggaggagcccatctatattagggtcgaaggatttctcgaggaggatcgcagagcgtacttcttacggcacttcggtgatgaggaccaggccatgcgcgctttcgagctcatgcggtcgaacgcagctctgttccagttgggttctgcgccagccgtgtgttggattgtctgtacgactttgaaattgcaaatggaaaaaggggaagatcccgttccaacttgcctaaccaggacgggcctcttcctccggtttttatgcagccgcttcccccaaggggcacagttgcgcggtgcgcttcgcacattatcgctcctagctgctcaggggctttgggcgcagactagcgtgttacatcgcgaagacctggagagactgggcgtgcaagaaagcgatttacgcctattcttggatggcgacattttgcggcaggaccgggtgtcgaagggatgttattcgttcattcacctttcttttcaacaatttctgacagcccttttttacacacttgaaaaggaggaggaggaagatagagatggacatacctgggacatcggcgacgtgcagaaactgttgtctggagttgagcgcctacggaacccagatctcattcaggcaggctactactcattcgggctggcaaatgaaaaacgcgcaaaagagctggaagctacatttggctgtagaatgtcgcccgatataaagcaggagctactgcgctgtgatatctcctgcaaaggcggacatagtacagtgacggacctgcaggagcttctggggtgtctctacgaatctcaggaggaggagctggtcaaggaggtcatggcccagttcaaggagatttcgctgcacctaaacgcagtggatgtggtgcctagtagcttttgtgtcaaacactgccgaaacctgcaaaaaatgtctttgcaggttattaaagaaaaccttcccgaaaatgtgaccgcatccgaatctgacgctgaggtagagagatcacaggatgatcagcacatgcttccgttttggactgacctctgctccatcttcggctctaacaaggacctcatgggactggcgattaacgactcgtttctgtctgcctccctagtgcggattctctgtgaacaaatcgcatccgatacctgccacctgcaacgagtggtcttcaaaaatatttcccccgcagacgctcacaggaacctgtgccttgcacttcgtggacataaaaccgtgacctatctgacgttgcaaggaaatgaccaagacgatatgttccctgccctttgtgaggtactgagacaccctgagtgcaatctgcgctacctgggcctcgtgtcatgttctgcgacgacacagcaatgggccgacctgagcctggccctggaagttaaccaaagccttacgtgcgttaacctgtctgataatgagctgctcgacgagggcgcaaaactactctatactacattgcgccatccaaagtgcttcctgcagcgtctgtctctggagaattgccacctgacagaggctaattgtaaagacctcgctgctgtgctggtcgtctcacgggagttaacccatctctgcctcgcaaaaaaccctatcggaaacaccggtgtgaaattcttgtgcgaagggctgcgttaccccgagtgcaagctacagacactggtactctggaactgtgatatcactagtgatggatgctgcgacctcaccaagcttttgcaggagaagagctcgctactttgcctcgatttaggtctgaatcacatcggggtcaagggtatgaagtttctgtgcgaagcactcaggaagcctctgtgcaatctgcgatgtctctggttgtggggctgctctatcccgccattttcatgcgaggacctttgctccgctctttcatgcaaccaatccctggttacccttgacttgggtcagaaccccttaggaagcagcggcgtgaagatgctgttcgaaacattaacttgctcatctggcacacttaggacgttacgccttaagatcgacgatttcaatgacgagctgaacaaactcctcgaggaaattgaggagaagaaccctcagctgattattgacaccgagaagcaccacccatgggctgagcgtcctagcagccatgactttatgatatag

SEQ ID NO: 57863 - DNA, 3123 bp, Artificial Sequence
  Description of Artificial Sequence: Synthetic coding sequence
atggtgtctagcgctcagatgggtttcaatctccaggcactgctcgagcaactatcccaggacgaactgtcaaagttcaaatacctgattaccacctttagtcttgcacacgaactgcaaaagatcccgcacaaagaagtcgataaagccgatggaaagcagctcgtagagatcctgactactcattgcgactcatactgggttgagatggcttcactacaggttttcgaaaaaatgcacagaatggatctgtccgagagagctaaagatgaagtcagggaagctgcgctgaaaagcttcaacaaacggaaaccacttagccttggcataaccaggaaagaaaggccgccattagacgttgacgaaatgcttgagagatttaaaacagaagctcaggacaaagataaccgctgccgctacattctgaaaacaaaattcagggagatgtggaagtcatggccaggagactccaaggaggtacaggtcatggccgagaggtacaagatgttgatacccttcagcaacccgcgagtgctgccaggcccattcagctatactgtggttctgtacgggccagcgggattgggtaaaaccactctggcccagaagctgatgctagactgggcagaagacaacctgatccacaaatttaaatatgcattttacttatcttgtcgggagttgagccgcctaggcccttgcagtttcgctgagctcgtcttccgggactggccagagcttcaagatgatattccacacattctggcccaggctcgtaagattctgttcgtaatcgatgggttcgacgagttgggggcagctccgggtgcactgatcgaggacatttgtggtgactgggagaagaaaaaacccgtgccagtgcttctcgggtccctgctgaatagagtgatgctgccaaaggccgcactgctcgtcaccacaagaccccgtgcactgagagatctgcggatcctggctgaggaaccaatatatatccgcgtcgaggggtttttggaagaagatcgcagggcctactttcttagacacttcggggatgaagaccaggcaatgagggcttttgaattgatgcgcagtaacgccgctttgttccaactggggtcagctcccgcagtgtgttggattgtttgtaccaccctgaaactgcagatggaaaagggggaagatcccgtacctacgtgcttgactagaacagggctcttcctccggttcttatgcagcaggtttccccagggtgcgcagctgcgtggggctttgcgcaccctgagcttactggcggctcaaggcctatgggctcagacatccgtattgcatcgggaggatctggagcggttgggggttcaggaatctgatcttcgattgttcctggatggtgacatattgcgccaggaccgcgtgagcaaaggatgctattccttcattcacctgtcctttcagcaatttctaaccgcactgttctacacccttgaaaaggaggaggaggaagaccgtgacggacacacgtgggatattggcgacgtgcaaaagttacttagcggtgtggagcggctacgcaaccctgacctgattcaggccggttactatagcttcggcctggctaacgaaaagcgtgctaaggagctggaagctacctttggttgtcgtatgtcaccagacattaaacaggagttgctccgatgcgatattagctgcaagggcggacactccaccgttactgatctccaggagctgctggggtgcttgtatgagtctcaagaggaggagctcgtcaaggaagtcatggcccagtttaaggaaatcagccttcatctcaacgccgtggatgtggtcccttcatccttttgcgtgaaacactgtcggaacctgcagaagatgagtcttcaggtgattaaggagaatttgcccgaaaatgtcactgcaagcgaatcagatgccgaggtggaaagatcacaggacgatcagcacatgcttcctttctggactgatctgtgtagcatcttcggatcaaacaaagacttgatgggtctcgctataaacgattcctttttgagtgccagcctggtcaggattctctgcgagcagatcgcgtccgatacatgccacttgcaaagagttgtgttcaagaacatcagtcccgctgacgctcaccgtaacctctgcttggccctgcgcggacacaagactgttacttacctaacactgcaggggaacgatcaagatgatatgtttcctgcactatgtgaggtgttacgccaccccgagtgcaacctccggtacttgggactggtgagttgttcagccacaacccagcaatgggccgatcttagcctggccctggaggtgaatcaatcattgacctgcgtgaatctgtcagacaatgagctcctggacgaaggagccaaactcctgtacactaccttacgtcaccccaagtgtttcctacagcggctgtcactcgaaaactgccaccttacagaggccaattgtaaagatctggcagccgttctggtcgtcagccgcgagttgacacatctctgtttggccaagaatcccattggtaatactggcgttaagtttctctgcgaagggttgagatatcccgaatgcaagctgcagaccctcgtgctgtggaattgcgatattacttctgatgggtgctgtgatttgacaaagctcctgcaggagaagtcatctctattatgtctcgacttggggcttaaccatatcggagtcaagggcatgaagttcttgtgcgaggccctcagaaaacctctatgcaatctgcgctgcctttggctgtggggatgcagcattcccccatttagctgtgaagatttgtgctctgcactgagttgcaaccagagtctggtcacgctggatctcgggcaaaatccactgggatcgtccggagttaagatgttgtttgagacacttacatgtagctccggcacactgcgtacactgcgtcttaagatcgatgacttcaatgacgagctcaacaagctgttagaggagattgaggaaaagaaccctcagttgattatagatacagaaaaacatcacccctgggctgagcgaccctcatctcatgacttcatgatttag

SEQ ID NO: 57864 - DNA, 3123 bp, Artificial Sequence
  Description of Artificial Sequence: Synthetic coding sequence
atggtttcctcagctcagatgggctttaacctccaggcgttgttggagcaactgtctcaggacgagctcagtaaattcaaatacctgatcacaacgtttagcctcgcacatgagttacagaagattcctcacaaagaggtggacaaggccgatggcaaacagctcgttgagatattaaccacccactgtgattcatattgggtagaaatggcctcactgcaggtattcgaaaagatgcatagaatggatctgtccgagagggctaaagacgaagtgcgtgaagccgcactgaagtcatttaacaaaagaaagccactaagcctgggaatcacccggaaagagaggcccccactcgacgtggacgaaatgctcgaacgatttaagactgaagcccaggataaggataacagatgccggtacattctcaaaactaagttccgggagatgtggaaatcctggccaggggatagcaaagaagtgcaggtcatggctgagaggtacaaaatgctgatccccttttcaaatccacgcgtcctgcccggacccttttcatatacagttgtgctctacggtccagccggactcggcaagacgacactggcccagaaactgatgctagactgggctgaggataatctcattcacaaatttaaatatgctttctatctctcctgccgagagctgtcaagactgggcccatgttctttcgccgagctggtctttcgggattggccagaactgcaagacgacatacctcacattttggctcaggcacggaagatcttgttcgtaatcgacggtttcgacgagctaggagctgcccctggagctctgatagaggatatctgtggtgactgggagaagaagaagccggtaccggtgctactcggatccctattgaaccgagtgatgctgccgaaggcagctctgctggtgaccaccagacctagggctctgcgcgacctacggatcctcgccgaagagcctatctatatccgcgttgaggggttcttggaagaggaccggagggcgtattttttaagacacttcggcgacgaggatcaggcaatgcgggctttcgaactcatgagatctaatgcggcactgttccagctgggctcagcccctgctgtgtgctggattgtttgcactaccctcaaactccaaatggaaaagggagaagaccccgtcccaacttgtctcactcgcaccggattgttcctgagattcttatgctccagatttccacagggggcacagctgaggggggctctgagaaccttatcactgctggccgctcagggcctctgggctcagaccagcgttctacacagagaggatctggaaagactaggcgtccaggagtctgatcttcggctgtttctcgacggcgacattctccgccaggatagggtgtccaagggatgctactcattcatccacttgtcttttcaacagttcttaactgcactgttctacactttggaaaaggaggaagaggaagatcgcgacggacacacatgggatatcggtgatgttcaaaagctgctttccggcgtggagcgcttacgcaatcccgacttaatccaggccggatattacagcttcggtctggctaacgagaagcgggcaaaggaactggaagccactttcggctgtcgaatgtcgccagacatcaaacaggaactgcttcgctgcgacatttcatgtaagggcggtcatagcactgtcactgacctacaggaactcttaggctgtctgtatgagtcccaggaagaagaactcgtgaaggaggttatggctcagtttaaagagatctccttacacctgaacgctgtcgatgtggtacctagctctttctgcgttaaacactgcagaaatctgcagaaaatgtcccttcaggttatcaaggagaacctgcctgagaatgtgaccgcatctgaatccgacgccgaggtagagcggagtcaggatgaccaacacatgctgcctttttggacagacctatgctccatctttgggtctaataaagacttgatggggttagctattaatgactcctttttgagtgcatctctcgtgaggatcctgtgcgagcaaatcgcatccgatacatgtcatctgcaacgggtggttttcaagaacatttccccagcagacgctcataggaacctatgccttgccctcaggggccacaagacagtcacttatctaaccttgcagggcaatgatcaggacgatatgttcccagccctctgcgaggttctcagacacccggagtgcaacctgcgctaccttggcctggtttcatgctctgctaccacccagcaatgggcagatttgagcctcgcccttgaggtcaatcagtccctcacctgtgttaacctgagcgacaacgaactccttgacgagggggctaaactgctctatacaaccttacggcaccctaagtgttttttacagcggctcagcctggaaaattgccatctgaccgaagccaattgtaaggacctagccgcagtgctggtggtcagccgcgaattgacccacctctgccttgccaagaacccaattgggaacaccggagttaaattcctgtgtgagggactgcgctatcccgaatgtaaactgcagactttggtcctttggaactgtgatattacctctgacgggtgctgcgacctgactaaactcttgcaagaaaagagcagcctgctgtgtctggacctagggctcaatcacattggcgtcaaaggaatgaagtttctgtgcgaagctctgaggaaaccgctgtgtaatttgaggtgtttgtggctttggggatgcagcattccaccattttcatgtgaggacttatgctctgctttgtcctgcaatcagagcctggtcacacttgacctgggacaaaaccctttgggatccagtggcgtgaaaatgctgtttgagacactgacatgctccagtggcactctgcgcactctgaggctgaagatcgacgacttcaacgatgagctgaacaagctcctggaagagatcgaagaaaagaatccacaattaattattgacacggagaaacaccatccatgggccgagagaccctctagccacgatttcatgatctag

SEQ ID NO: 57865 - DNA, 3189 bp, Artificial Sequence
  Description of Artificial Sequence: Synthetic coding sequence
atggtaagctccgctcagatggggttcaatcttcaggcactgttggaacagttgagtcaggatgagctgagcaagtttaagtatttgatcactacgttcagtttagctcatgagttgcaaaagatccctcataaggaggtcgacaaggcagatgggaagcaacttgtggaaatactgacaacgcactgtgacagctactgggttgaaatggcctccctgcaggtgttcgagaaaatgcaccgcatggatcttagtgaacgagcaaaggatgaggtaagggaggccgctctgaagtcttttaacaaaaggaaaccactgtccctcggcattactcgtaaggaaaggcctcctctggatgtagacgaaatgctagaacggttcaaaaccgaggcccaagcattcacggagaccaaggggaatgtaatttgcctcggcaaggaggtgttcaagggcaaaaagcccgataaagataatcgatgtaggtacattctaaagactaagttccgcgaaatgtggaagagttggcctggcgacagcaaagaggtgcaggtgatggccgagcgatacaaaatgttgattcccttttcgaatcctcgggtgctgcccggacccttctcctacactgtggtgttgtatggtcccgcaggtctgggcaagactactcttgcccaaaagctgatgcttgattgggcagaggacaaccttattcataaattcaagtatgctttttatttgagctgccgagaactgagtcgacttggcccttgttctttcgccgaactggtgtttagggactggcccgaactacaggacgatataccacatattcttgcacaagccagaaagatcctgttcgttatagatggctttgacgagctgggtgcggcacctggggcattgatagaagacatttgcggcgattgggaaaagaagaaaccagtacctgtgttgttagggagcctgctcaatcgggtcatgttgcccaaagctgcgctgctcgttactacccgaccacgcgctttgcgagacctgagaattctggccgaagagccaatctatattcgagtggagggattcctagaggaggaccgtcgagcttacttccttaggcactttggagacgaagatcaggctatgagagcatttgagctcatgaggagtaatgccgctttgttccagcttggttcagctcctgccgtgtgttggatcgtctgcacaactttaaaactccagatggaaaagggagaagaccctgttccgacatgcttgactcggactggcctgttcctgcgttttctctgttcgagatttccccagggcgctcagttgcggggagctctgcggactctcagcttgctcgcggcacaggggctgtgggctcagacatccgtgctgcaccgggaggacttggaaagacttggcgtacaagagtccgatcttcggctgttcctggacggagacattttgagacaggatagggtgagcaagggatgctattcatttattcacctgagcttccagcagttcctgacagctctgttctacactttagaaaaagaggaggaggaggatagggacggccacacatgggatatcggtgacgttcagaagctacttagcggggttgaaagactgcgaaaccccgatctcatccaggccggatactactcattcgggctcgcaaacgagaaaagggccaaagaactggaggctacattcggttgcaggatgagtccagatatcaagcaggaactgctacggtgcgacatttcctgtaagggcggacattccacagtgactgatctgcaggagctacttggttgtctgtacgagagccaggaggaggagttggttaaggaggtgatggctcaattcaaggagatttccctgcatctgaacgctgtggacgtggtgccctcttctttctgtgtgaaacactgccgtaacttacagaagatgagcttgcaagtgatcaaggagaatctgcctgagaatgtgacagcgtcggagtctgatgcagaagtcgagagaagccaggatgaccagcacatgctgcctttctggacagacttatgttccatcttcggaagcaataaggatttgatgggactggccattaatgattctttcctgtcagccagtctcgtaagaatcctttgtgaacagatcgctagcgacacctgtcatctgcagcgcgtagtctttaaaaacatttcgcccgcagacgcccatcggaacctctgtctggccctgaggggacacaagactgtgacctatctaacactgcaggggaacgatcaggacgatatgtttccagcgctctgcgaggtcttaaggcatccagagtgtaacctaaggtaccttggactggtatcttgctcagcaaccactcagcaatgggcagatttatctctagctcttgaggtgaatcagtccttgacttgcgtgaacctgtccgataatgagttgctggatgaaggcgcaaaactcctgtatacaacattgcgacaccctaaatgctttttacagaggctctcactggaaaactgtcatttaaccgaagccaactgtaaggatctggctgcggtgctggtggtgagccgtgagctcacacacctctgtttagcaaagaaccccattggtaacactggggtgaagtttctgtgcgaaggcctccgttatcctgaatgcaagctgcagaccttggtgctctggaattgcgacatcacctcggatggatgctgcgatctgaccaagctgctgcaggagaagtcctcccttttatgtttggacttaggactcaaccacataggcgtaaaaggaatgaaattcctctgtgaggccttgcgcaaacctctctgcaatctgcgctgcctttggctgtggggatgtagtatacccccattctcttgcgaggacctgtgctcagccctgtcctgcaaccaaagcctcgtgacccttgatctggggcagaatcctctgggaagttccggggtgaagatgttgtttgaaaccctcacttgcagctccggtacacttcgcactctccgtttgaagattgacgacttcaacgacgaactcaataagctgctggaggagattgaggagaagaatccccagctgattatcgatacagaaaagcatcacccctgggcagaaagaccatctagccatgatttcatgatttag

SEQ ID NO: 57866 - DNA, 3123 bp, Artificial Sequence
  Description of Artificial Sequence: Synthetic coding sequence
atggtatcgtcggcacagatggggttcaatctccaggccctgcttgagcagctgagtcaggacgaactgtcaaagttcaagtacctgattacgactttttctctggctcacgagctccagaagattccgcacaaagaagtcgataaggctgatgggaagcagctggtggaaatcctgactacacactgcgacagctactgggtcgagatggcttccctccaagtgttcgagaagatgcataggatggacttaagcgaaagggccaaagacgaagttagagaggcagctctcaagtcctttaataaaagaaaacctctgagcctgggcatcactcggaaagaacgaccgcctctggatgtggacgaaatgctagaaaggtttaagacagaggctcaggataaagataatcggtgtcgctacatcctgaaaaccaagtttagggagatgtggaaaagttggcccggtgacagtaaggaagtgcaagtgatggcggaaagatataaaatgctcattccattttcaaaccccagagtgcttccagggcctttcagctacacagtagtattatatggacccgcaggtctgggcaaaacaaccctcgcccagaaactgatgctggattgggcagaggataatctgatacacaagtttaagtatgctttctacctaagttgcagagagttgtctcgccttggaccctgctcattcgctgaactagtgttcagggattggcctgagctccaggacgatatcccccacattctagcccaggctagaaagattctgttcgtcatcgatggattcgatgagctcggcgctgcccctggcgcactcatcgaggacatctgcggggactgggagaagaagaagcccgtcccagttctattagggtctttgctgaatcgtgtgatgctcccaaaggcggcactgctcgtcacaacacggcctagagcgctccgcgacctgcggatcctcgctgaggagcccatttatataagggtggagggatttctggaggaggatcggagagcttatttcctgaggcattttggggatgaggatcaagcgatgagagctttcgagctgatgcgctctaatgcagccctttttcagctgggttccgccccagctgtgtgctggatagtgtgcacaacactcaagctgcagatggagaagggagaggacccggtgcccacatgtttgacgcgaactggcctgtttttgcgcttcctgtgtagtagatttcctcagggggcacagctgcgtggagccctgcgcactctcagccttctagccgctcagggcctgtgggctcagacgtccgtcttgcatcgggaggacttggagcgcctgggcgtgcaggaaagcgacttgcggctgtttctggatggggacattctgaggcaagaccgcgtctcaaaaggctgttacagtttcatccatctgagctttcagcagttcctgacagcactgttttacacgttagaaaaagaagaagaggaggacagggacgggcacacctgggacatcggggatgtgcagaagcttctgtcaggcgttgagcgcctgcgaaaccctgacctgatccaggcaggatactatagttttggtcttgccaatgagaaacgggcaaaagaactcgaggctacattcggatgtcgcatgtcccctgacattaaacaggagctgctaaggtgcgatattagctgtaagggcggacattcaacagtgaccgacttacaggagcttctggggtgcctgtacgagagtcaggaggaagaactggtaaaagaggtcatggcacagtttaaagagatctctctccacctcaacgccgttgatgtcgtcccatcttcattttgcgttaagcactgcaggaacctgcagaagatgtcattacaggtcattaaagagaatctccctgagaacgtgaccgcctcagagagcgacgccgaagtcgagcggtctcaagacgaccagcacatgctccctttttggaccgacctttgtagcatttttgggtctaacaaagacctgatggggctagccatcaacgatagcttcctctcggccagtctggtgaggatcctttgcgagcaaattgcttcagatacctgccatctgcaaagggtggtgttcaagaacataagcccggctgatgcccatcgcaatctttgcctcgctttgagagggcacaaaaccgtaacctacctgacactgcagggcaacgaccaagacgacatgtttccagccttatgcgaggtcctgaggcacccggaatgtaacctcagatacctcgggttggtgagctgcagcgcgactacacaacagtgggctgatctgtctcttgctctggaagtgaaccagtcactgacatgcgtgaatctatccgataatgagttgctggatgaaggggctaaactcctctatactaccttgagacatccaaagtgcttcttgcagagactgtctctcgagaactgccacctgacagaagccaactgcaaagacctggccgcagttctggtggtctcccgggaactcacacatctctgccttgctaaaaatccaatcggcaacacaggcgtcaagttcctgtgcgaaggattgagataccccgagtgcaaactgcaaacgctcgtgctgtggaactgcgatattaccagtgacggctgttgtgatctaaccaagttgttacaggaaaagtccagcctcctgtgtctggatctgggacttaaccacatcggtgtaaagggcatgaagtttctatgcgaggccctccggaaacccctgtgcaacctgcggtgtctgtggctgtggggatgctccattcctcccttcagctgcgaagatttatgttcagctctgtcctgcaaccagagcctcgtgactctggatctcggacagaaccctctgggatcaagcggcgtgaagatgttgtttgagactctcacctgttcctctggcaccttgcgcactttaaggttgaagattgacgactttaacgacgagttaaacaagctgctggaagaaattgaggagaagaacccccagctgattatcgacactgaaaagcaccacccctgggccgagagaccatcctcacacgattttatgatctag

SEQ ID NO: 57867 - DNA, 3189 bp, Artificial Sequence
  Description of Artificial Sequence: Synthetic coding sequence
atggtgtcttctgctcagatgggcttcaacttgcaggccctgctggagcagttgtcccaggatgagttgagtaaatttaaatatctgattacgacattttccctcgctcacgaactgcagaagatcccccacaaggaagtcgacaaggccgacgggaagcagctcgtggagatactcaccacgcactgcgacagctattgggttgaaatggcctccctccaagtcttcgagaagatgcaccgaatggacctttccgagcgggctaaagacgaagtccgcgaggcagctcttaaaagcttcaacaaaagaaaacccttgagtctcggcattaccaggaaagagagaccaccattggacgtcgacgaaatgctggaaaggttcaaaacggaagcacaagcattcacagagaccaagggaaatgtgatctgtcttggtaaggaggtgttcaagggcaaaaagcctgacaaggataaccggtgtcgctacattctgaagactaagttcagggagatgtggaagagctggcccggagatagtaaagaagtacaggtcatggctgaaaggtataagatgcttattccattttccaaccctagggtcctgcctggaccattctcttacacggtcgtcttgtatgggccagccggtctggggaagacgactttggcgcagaagttgatgctggactgggctgaggataaccttattcacaaattcaagtacgcgttttacctgtcctgccgcgagcttagccggctcggcccatgttcctttgccgagctcgtattccgcgactggcccgagcttcaggatgacattcctcatatcctggcccaggccaggaagatattgttcgtaatagacggttttgacgaactgggcgctgctcctggtgccttaattgaagacatctgtggagactgggagaagaagaagcccgtccctgtgctgctgggctccctgttgaatagggtgatgctccccaaagccgctttactggtgacgacccgtccccgagccttgcgtgacctaaggatcctggcagaggaacccatatatattcgcgtcgaaggctttctggaggaagaccgcagagcgtactttctgcggcacttcggtgacgaggaccaagccatgcgtgcctttgaactaatgcggtctaacgccgcattattccagctgggcagtgccccagccgtttgctggattgtctgcaccaccctgaaactgcagatggagaagggagaagacccagtgccgacttgcttgacccggaccggtttattcttacgttttctgtgcagtagatttccccagggcgctcaactgaggggagccctgagaacgcttagtctcttggctgcccagggcctatgggcacaaaccagtgtcctacacagagaagacctcgagcgcctgggcgttcaggagtctgacctgagactgttcctggacggcgatattcttaggcaagacagggtgagtaaaggttgttatagcttcatacacctgagctttcaacagttcctaactgctttattttacaccttggaaaaagaggaggaagaagacagagatggacacacgtgggacatcggtgacgtgcaaaaattactaagtggcgtagaacggttaagaaaccccgatctaatccaagctggttactattctttcggcctagctaacgagaagcgggcaaaggaactggaagctacctttggatgcagaatgtctccggatatcaaacaggaattactgagatgcgatatctcatgcaaaggcggtcattccaccgtcactgatctgcaagaactcctggggtgcttgtacgaaagccaagaggaggaacttgtgaaagaggtcatggcccagtttaaggaaattagcttacacctgaacgccgtggatgttgtgccatcatcgttctgcgtgaagcactgccggaatctgcagaagatgtcactccaagttataaaggagaacctcccagagaacgtgacagccagcgaatccgacgcggaagtggagcggtctcaggacgaccaacacatgctgccgttttggacagatctatgctccatctttgggagtaataaagatctcatgggtcttgccattaacgatagcttcctaagcgctagtctggtgcggatcctgtgcgaacagatcgcttctgatacctgccacctccagcgggttgtgttcaaaaacatctcacccgctgatgctcaccgaaatctgtgtctggcactgcgaggacataaaaccgtgacatacctcacgttacagggaaacgatcaagatgacatgttccccgctctctgcgaagtgttgcgccaccccgaatgcaacttgcgctatctgggtctggtgagttgcagcgcaacaacgcagcaatgggctgatctgagcctagcactggaagttaatcaatccctgacatgcgtgaatctctcggataacgagctcttggacgaaggcgctaaacttctatacaccacactccggcacccaaaatgcttccttcaacgcttatccctagaaaattgtcatttgacagaggccaactgcaaggacctggctgcagtactggttgtgagcagagagctcactcacctttgtcttgctaagaatccaattgggaatactggggtcaaatttctatgtgagggccttaggtatccggaatgtaaactgcagaccctggtcctttggaactgtgatataacaagcgacgggtgttgtgacttgacaaaattgctacaagaaaagagctctctgctctgcctggatttgggtcttaaccacattggagtcaagggaatgaaattcctctgcgaggccctaagaaagcccttatgtaatcttcggtgtttatggctgtggggttgtagcatacctccgttctcctgcgaagacctgtgtagtgcacttagctgcaaccagagtctggtgaccctggacctcggtcagaatccattaggaagctctggggtgaaaatgctattcgagaccttaacctgtagctcaggaacactgcgtacactcagactcaaaatcgacgacttcaatgatgagcttaataagctgctggaggaaatagaggaaaagaatccccagttaattatcgatacagagaaacaccacccatgggccgagcgaccctcttcacatgattttatgatatag

SEQ ID NO: 57868 - DNA, 3189 bp, Artificial Sequence
  Description of Artificial Sequence: Synthetic coding sequence
atggtgtcatcagcgcagatggggttcaatcttcaggccctgttggagcagctgtcccaagacgaattgagtaaattcaagtacctgataactacgtttagccttgcacatgaattgcagaaaattcctcacaaagaagtggataaagcagatgggaaacaactggttgagattcttactacccattgtgactcgtactgggtggaaatggcgagcttgcaggttttcgagaaaatgcatagaatggatcttagtgagcgggcaaaagatgaggtgagggaagcagctctgaaatcatttaacaagcgcaagcctctgtcacttggtatcactcggaaagaacgaccacctcttgacgtcgacgagatgctagaacgctttaagactgaagctcaagcgttcacggaaaccaaaggcaatgttatctgtctgggtaaagaggtcttcaagggcaaaaagccagataaagacaaccggtgccgatacattctgaagacgaaatttcgtgagatgtggaagtcctggcccggagactctaaagaggttcaggtgatggccgaacgttacaaaatgttgatccccttttcaaacccccgagtgctgccgggacctttttcttataccgttgtgctctacggtccagccggattgggcaagaccacgttagcccagaaacttatgctcgattgggcagaggataatttgattcataaatttaagtatgctttttacctcagttgtagggaactgtcacgtctgggcccatgctctttcgctgagcttgtgtttcgagactggcctgagctgcaggacgatatcccccatatcctggcacaggccagaaaaattctgtttgtgatcgacggctttgacgaattgggggctgctcctggtgcgctcatagaggatatctgtggcgattgggaaaaaaagaaacccgtgccagtgctgctggggtcacttctgaatagggtcatgttgccaaaggctgccctattagtaacaacccggcctcgggcactgagagacctccgtattttagccgaggagccaatatatatcagagtagagggcttcctcgaggaagacagacgagcgtacttcctcaggcatttcggggatgaagaccaggctatgcgcgcattcgagctgatgagaagcaatgcagccctgtttcagctgggctctgcaccagcagtgtgctggatcgtgtgcaccacgctaaaacttcagatggaaaaaggcgaagatcctgtgccaacttgtctgactcggactgggctgttccttcgctttctctgcagtagatttcctcagggcgcacaactgaggggagcattacggaccctcagcctgttggctgctcagggcctctgggcacagacttccgtcctgcacagagaagacctggagcggctgggggtccaagaatctgatttacgcctatttctggatggtgatatcctgagacaggaccgagtgtccaaggggtgttactctttcatccatttaagctttcagcagttcctgaccgccctgttctatacacttgagaaggaagaggaggaagacagagacgggcacacttgggacattggagatgtccagaaactcctctcgggagtagaacgattgcgcaatcccgatctcatacaagcaggctactactctttcggtctggccaacgagaagcgtgctaaagagctcgaggcgacgttcggctgccgcatgtcccccgacatcaagcaggagctcctgagatgtgatatcagctgtaaggggggtcactcaaccgtgactgatctgcaagagctgctgggctgcttgtatgagtcgcaggaggaggagttggtcaaggaggtcatggcccaattcaaggagatctccttacatctgaatgctgtagacgtcgtcccttctagtttttgtgtaaagcactgtcgcaatctccaaaagatgtctctccaagtcattaaagagaatctcccagaaaatgtcacagctagtgagagtgatgctgaagtcgagaggtcccaggatgaccagcacatgctgcctttttggacagatttgtgcagcatatttggcagcaacaaggatctaatgggtttagctatcaacgatagcttcctttcagcttctttggttagaatcttatgtgagcagatcgcatctgatacgtgtcatttgcagagagttgtgttcaaaaatatcagtcccgctgatgcccaccgcaacctatgcttagcactaagaggccataagacagttacgtacctcacgttgcaggggaatgatcaggatgacatgttcccggctctctgtgaagtacttcgccatcccgagtgtaatctgagatatctgggcctggtctcttgttctgccaccacacagcagtgggcagatctgtctctcgccttggaggtgaaccaaagcctcacatgcgtcaacttgtcagacaacgagctactggacgagggggctaagctgctgtacaccactctgcgacaccctaaatgctttctgcagcgcctgtccctggaaaactgccatctgacagaagctaactgcaaggaccttgcagcagtcctggttgtcagtagagaactcacccatctctgcttggctaagaatccaatcgggaacacaggagtgaaatttttatgcgaaggtttgagatatcccgaatgtaaattacagactcttgtcctctggaattgcgacatcacctccgacggctgctgtgacctcacaaaactgctgcaggaaaagtcatctcttctgtgtctggatctcggcctaaatcacattggggttaagggaatgaaattcctctgtgaggccctgcgcaaacctctctgcaatctgaggtgcctctggctatggggctgctcaattccaccattctcttgcgaagacctttgcagtgccctttcctgtaaccaatctctagtgaccctcgacctcgggcagaaccctctgggttcctcaggtgtcaaaatgttgtttgagaccctcacctgcagctccgggacccttagaaccctgcgtctgaaaattgacgactttaatgacgaattaaacaagctgcttgaagagatcgaggagaaaaacccacagctgatcatcgataccgagaaacatcatccttgggctgaaagaccttcctcgcacgacttcatgatctag

SEQ ID NO: 57869 - DNA, 3189 bp, Artificial Sequence
  Description of Artificial Sequence: Synthetic coding sequence
atggtttcatcggcacagatgggctttaatctccaagctctcctggaacagttatctcaggacgaactgtctaaattcaagtatttgatcacaacctttagtcttgctcacgaactacagaagataccccataaagaggtcgataaagcagacggaaaacaactcgtggagattctcactacccattgcgacagctattgggttgaaatggccagtctgcaggttttcgagaaaatgcaccggatggatctgtcagaaagggctaaagacgaagtgagggaagccgctcttaagagctttaacaaacggaagcccctgtccttgggaatcactcggaaggaaagacctccactggatgtggatgagatgttagagagattcaaaacagaagcccaagccttcaccgagaccaaggggaatgttatttgtttggggaaagaagtgtttaaaggcaagaagcccgataaggacaatcggtgcaggtacattctgaaaacaaagttccgggaaatgtggaagagttggccaggggattccaaagaagtacaggtgatggccgaacgctataaaatgctgatcccatttagcaacccaagggttctgcctgggcctttcagctacaccgttgtcctatacggacctgcaggtctgggcaagacgaccctggcccagaaattgatgcttgactgggccgaagacaatctgattcacaagttcaagtacgccttttatctgagctgccgggagctaagccgactcggaccttgctcctttgccgagctggtgttccgcgactggcccgagctgcaggatgacattccccacatactggcccaggcaaggaagatactattcgtgatcgacggctttgatgaattgggggctgcccctggggcactgattgaggatatctgcggagattgggagaagaagaagcccgtgcccgtgttactgggatctctgctgaatcgtgtcatgttgcctaaagcagcgctgctggtgaccacccggccacgggctcttagagatctgaggatcctggctgaggagcccatatacatccgcgtggagggcttcttagaggaggaccgaagggcctacttccttcggcattttggggacgaggaccaagctatgagagccttcgagttgatgagatccaatgccgctctgtttcaactggggtccgcacccgctgtgtgctggattgtctgtactaccctgaaattacagatggaaaagggtgaggatccagtgcctacttgccttacgcgtacagggttgtttttgcgatttttgtgctctcgatttccccagggagcccaattaaggggcgctctgaggaccctctccttactggctgctcaggggttatgggcgcagacttctgtgctgcatcgcgaagacctagagcggctgggggtgcaggaatcagatttaaggctattcctggatggagatatcctgcggcaggatagagtctccaagggatgctatagcttcatccacctgagtttccagcagttcctaaccgccttattttatactttggagaaggaggaggaggaagatagggacggccacacatgggatatcggcgatgtccagaagctgttgagtggggttgagaggctccgcaaccctgaccttatccaggccggatactattctttcggtctcgcaaacgaaaagcgagcgaaggaactcgaggctacatttggttgcaggatgtcccccgacatcaaacaggagttgctgaggtgcgacatatcctgcaaggggggtcattccacagttacagacctccaggaactgctggggtgtttgtatgagtcgcaagaggaggagctggtcaaggaagtgatggcccagttcaaagaaataagtctgcatctgaacgcagtggacgttgttccgagttcattttgtgtcaaacattgtaggaacttgcagaaaatgtcattgcaggtcatcaaagaaaacctgccagagaatgtcacagcaagcgagtccgatgccgaggtggaaagatcccaagacgatcagcacatgttacctttttggaccgatctctgtagcattttcgggagcaataaggatctgatgggtcttgctatcaacgactcatttctgagtgcgtccctggttaggattttatgcgagcagatagctagcgacacgtgccacctccagagggtcgtgtttaaaaatatctcccccgcagatgcacacagaaacctgtgcttagcgcttagaggtcataagactgtgacatatctcacgctgcagggaaacgaccaggatgacatgtttcctgctttgtgtgaggtgctgaggcatcccgagtgcaatttaagatacctgggactggtctcttgcagcgccacaacacagcagtgggcagacctgagcctagctctggaagtgaaccaatccctgacatgtgttaacctgtccgataatgagttactggatgagggagccaaactgctctacacaacactgaggcaccccaaatgtttcctgcaacggctgtccctggaaaattgccaccttaccgaagcaaattgcaaggatctggccgctgttctggttgtgtctcgggagctgacacatttatgcctcgccaagaaccctataggcaatactggagtgaaattcttgtgcgagggacttcggtaccctgagtgcaagctgcagacccttgtgctgtggaattgtgatattactagcgacggctgctgcgacctcacaaaactgttacaggaaaagtcttccctcctgtgtctggatctgggacttaaccatatcggcgtgaagggcatgaagttcctatgcgaggccctgcggaagccactgtgcaacctaagatgcctctggctctggggctgttccatccccccattttcttgtgaggacctgtgctcagccctgagctgcaatcagagtctggtgaccctggacctcggccagaaccctcttggcagtagcggagtgaaaatgttgtttgagacgctcacatgttcttccggcactctccgtacgcttcgccttaaaattgatgattttaatgacgagcttaacaaattgctcgaagagatcgaggagaagaacccccaattgatcattgacaccgagaagcatcatccctgggccgagagaccttcctctcacgacttcatgatctag

SEQ ID NO: 57870 - DNA, 3123 bp, Artificial Sequence
  Description of Artificial Sequence: Synthetic coding sequence
atggtcagttccgctcagatgggttttaacctgcaggctctcctggaacagctttctcaagatgaattgagcaaattcaagtacctcattacaaccttttctctggcccacgaactgcagaagatcccccacaaagaggtcgataaagcagatggcaaacagctcgtggaaatcctgactacccactgtgactcctattgggtagaaatggcaagcctccaagtgtttgagaaaatgcacagaatggacctgtccgagagagcaaaggatgaagtgagagaagcggcactcaagtcatttaacaaacgcaaaccgctgtctctcggaatcactaggaaagaacgccctccgttggacgttgatgaaatgctggagaggtttaaaacagaggcacaggacaaagacaacaggtgccgctatattctcaagaccaaattcagggaaatgtggaaatcctggcctggcgactccaaggaagtgcaagtgatggccgagagatataagatgcttatcccttttagcaaccctagagtgttgcccggacctttttcttacacagtcgtcctgtatggacctgccggactcggtaaaacgaccttggcacagaaactaatgctcgactgggccgaggacaacctcatccataaattcaaatacgccttctatctgtcctgtcgtgagttaagtaggttaggcccttgttcctttgctgaactggtgtttcgggactggccagaactgcaggatgatattcctcatatcctggcccaggccaggaagattctctttgtgatcgacggcttcgacgagctgggagccgctcctggcgctctaattgaggacatttgtggcgactgggagaaaaaaaagcccgtgccagtattgcttggttcccttctcaaccgtgttatgctgcccaaggctgcgttgcttgtcaccacccggccacgggctctgagagacctgaggattctcgcagaggagcctatttatatccgggtcgagggtttcctggaggaggaccggagggcgtattttctgcggcactttggagacgaggatcaggcaatgcgcgcatttgagctgatgcgatctaatgcagccctgttccagctcggcagcgctcctgcggtctgctggatagtgtgcacaaccttgaaactccagatggaaaaaggcgaagaccccgtgcctacctgccttacgcggacaggactgttcctccgcttcctgtgcagcaggtttccccagggggctcagctgcggggagccctgcggacattgtccctccttgccgcacagggcctgtgggcccaaacgtcggtgctccatcgcgaggacctggaacgccttggagtgcaagaatccgatctccggctgtttttggacggcgacattttacgacaggaccgcgtatccaaaggatgctattctttcatacacctcagttttcagcagttcctcaccgctcttttttatacacttgaaaaggaggaggaagaggatcgcgacggccacacctgggatattggcgatgtgcagaagctgctgtccggagtggaacgactgcggaatccagacctgatccaggccggatactactcttttggcctcgcaaacgagaaacgagcaaaggagttggaggccacgtttggctgtagaatgtctccagatattaaacaagaactgctgcgatgtgacatcagctgcaaaggaggtcattccaccgtcactgatctccaagagctcctgggctgcctgtatgagtcccaggaagaggagctggtgaaagaagtcatggcacaatttaaagagatcagcttgcacctgaatgccgtggacgtggtgccgtcttctttttgcgtcaaacactgccggaacctgcagaagatgtccttacaagttattaaggaaaatctccccgagaatgtgaccgcatcagaatctgatgccgaagtcgagcgcagccaggatgatcagcacatgcttcctttttggactgacctgtgttccattttcggtagtaacaaagatctgatggggttggccatcaatgactcctttctgtctgcctctttggtacgcatcttatgtgagcagatcgcgagcgacacatgtcaccttcagcgtgtcgtttttaaaaacatctcaccagccgacgcccatagaaacctttgcttagccctgaggggacataagacagtgacctatctaacactgcagggaaacgaccaggatgacatgtttcccgcattgtgcgaggttctgcgtcaccctgagtgcaacttgaggtatctgggattagtttcttgttcggccactacacagcagtgggctgacctatcacttgctctagaggtcaatcagtccctgacttgcgtgaatctgagcgacaacgaattattggacgagggtgctaaattgctgtacacaaccctgaggcacccaaagtgcttcctgcagcggcttagcctggagaactgtcacctgactgaggcaaattgcaaggacctagctgcagtcctcgttgtcagtagggagttgacacacctctgtcttgcaaagaatcccatcggaaatactggggtcaaatttctgtgtgagggcttaaggtatcctgaatgcaaactgcaaacactggtgctctggaactgcgatatcaccagtgatgggtgttgtgacctcactaagctgctgcaggaaaagtcatccctgctgtgtctcgacctgggcctaaaccatataggcgtgaaaggtatgaaattcctgtgcgaagccctacgtaagcctctctgtaatctccgatgtctgtggttgtgggggtgttccatacctcctttcagctgtgaagatctttgctctgctctgtcatgcaatcagagcttagtcacactggacctgggtcagaatcccttgggcagcagcggggtgaagatgcttttcgagaccctgacctgttcaagcggtacattacggaccttacggttgaagattgacgacttcaacgatgaattgaataagttgttggaagaaattgaagagaaaaacccacaactgattattgacactgaaaagcaccatccttgggcagagcggccaagttctcatgactttatgatctag

SEQ ID NO: 57871 - DNA, 3123 bp, Artificial Sequence
  Description of Artificial Sequence: Synthetic coding sequence
atggtctcctcggcccagatggggtttaatctccaggccctcctggaacagctgtcacaggatgagctatccaagttcaagtatctgattacaacctttagtctggcccatgaactgcagaagatcccccacaaagaggtggataaggcagatggtaagcaattagtagagattctcactacccattgcgattcctattgggtggaaatggcaagcttgcaggtgtttgaaaaaatgcacagaatggacctttccgagagggcgaaagacgaggtgcgcgaagctgcactgaaatcttttaataaaaggaagccactgtctctgggcattactcgcaaagaacggccaccccttgacgttgatgagatgctggaacggttcaagaccgaagcccaggacaaggacaacagatgtcggtatatactcaaaactaaatttcgggagatgtggaagtcctggccgggagattctaaagaggtgcaggtcatggccgaaagatacaagatgctcatccccttctctaacccgagagtgcttcccggaccattctcctataccgttgtcctgtatggcccagccggactgggaaagacaaccctcgctcagaagctcatgttggattgggccgaagacaatttgatacacaaatttaagtacgcattttacctgtcctgcagggagctgtcacgactggggccttgttcattcgctgagcttgtgttcagagactggcccgagctgcaggatgatataccgcacatcttagcccaagcaaggaagatcctgtttgttatcgacggctttgacgagctcggggcagcccctggagcacttatcgaagatatatgcggtgattgggagaagaaaaagcctgtgcccgtactgctgggcagtctgctcaacagggtaatgcttcctaaggcggcactgctggttaccacccgccctcgcgcattgcgagatctacggattttagctgaagagccaatttatattagggtggagggttttttagaggaagaccggagggcctactttttacggcacttcggcgacgaggatcaggccatgcgagccttcgaactaatgaggtccaacgcagctcttttccagctgggaagcgctcccgctgtttgttggatcgtatgcacaaccctcaaactgcaaatggagaagggagaggacccagtgcctacctgcttgaccaggaccggtctgttcctgcgatttctgtgtagcagatttccgcaaggcgctcagctgcgcggtgccctaagaactctgagcctgctggcagcacaagggctgtgggcccagacatcggtcctgcatcgtgaagacttggagcggctgggtgtccaagagtccgatttacgtctctttttggacggggacatacttcgccaagatcgcgtgtccaagggttgctacagttttatccacctgagctttcaacaatttctaacagcccttttttacaccctggagaaggaggaggaggaggatcgagacggacatacatgggatatcggggacgtgcagaagctcctctcgggagttgaaaggctcaggaatccagacctgatacaggccggatactattcattcgggcttgccaatgaaaagagagccaaggagttagaggcaaccttcggttgtcgcatgagccccgacattaaacaggagttgctgaggtgcgatatctcttgcaaaggagggcattcgaccgttactgacctgcaggagctattggggtgtctatacgaatcacaggaggaggagctggtaaaggaagtcatggcccagttcaaagaaattagcctccatcttaacgccgtggacgtcgtgcccagctcattctgcgtgaaacactgccgcaacctccaaaagatgtcactgcaggtgatcaaggagaatctccctgagaatgtaactgccagcgaaagcgacgccgaggtggagcgaagccaagatgatcagcatatgcttcctttttggacggatctttgttccattttcggatctaacaaagacctaatggggctggccattaatgattcctttctcagtgcctccctggttaggattctctgtgagcagatagctagcgacacatgccatctccagcgggtagtgttcaagaatatctctccggctgacgctcacagaaatctttgtctcgctctgcgcggtcacaagacggtcacatatctgacgttgcaaggaaatgaccaggatgacatgttccctgccctgtgtgaggtgctgcggcacccagagtgcaacctcaggtaccttgggctggtgtcttgttccgcaacgacacaacaatgggcggatttgtcgctcgcattagaagttaaccaatccctcacgtgcgtcaatctctccgacaacgaattattggatgagggagcaaaacttctatatacaaccttacgacaccccaagtgctttttacagcggctgtctctggagaattgtcatctcacagaagctaattgtaaggacctggccgctgtgctggtggtgtctagagagttgacccacctttgtttagcaaagaaccccattgggaacacaggcgtgaaattcctgtgtgaaggccttagatatcctgagtgcaaactgcagaccctggtgttgtggaattgcgacattacttcagatggatgctgtgatctcacaaaactcctgcaggaaaaaagttctctgctgtgcctggatctcgggctgaaccacattggggttaaagggatgaaatttctgtgcgaagcgctcagaaagccgctgtgcaatctgcgctgtctttggctctggggatgttcaatcccgccattcagctgcgaggatctgtgttcggccctctcctgtaaccagagcctcgttaccctggacttgggacagaacccattggggtcgtccggggtgaagatgctctttgaaacgcttacttgttcctctggtaccctgcggacactccgcctgaaaattgacgatttcaacgacgagctgaacaaactgctggaagagatcgaagagaaaaatccccaactgatcatcgacacagagaaacatcacccttgggccgaaaggccttctagccacgattttatgatttag

SEQ ID NO: 57872 - DNA, 3189 bp, Artificial Sequence
  Description of Artificial Sequence: Synthetic coding sequence
atggtgagcagcgcccagatggggttcaatctccaggccctcctggaacagctgtcacaagacgagctctccaagtttaagtatttgataacgacattttccttggcgcacgaactgcagaaaatccctcacaaggaagtcgataaggccgacggtaaacagttagtggagatacttactacccactgcgacagctactgggtggaaatggcgagtctgcaagtctttgagaagatgcaccgcatggacctgagcgagcgggcaaaagatgaggtgagagaagcagcactaaagtccttcaacaagaggaagcctctctcccttgggattacacgcaaagaacggccacccctagacgtggacgagatgctggaacggttcaagactgaggcacaagccttcaccgagaccaagggcaacgtgatttgcctggggaaggaagtatttaaagggaagaaaccggataaggataacagatgcaggtatatactaaaaacaaaatttagggagatgtggaaaagttggccgggtgacagcaaggaagtgcaggtgatggctgaacgatacaaaatgctgattccgttttctaatccacgtgtgctgcccggtcccttcagttacacagtagtcctgtatggtccagctggtctgggcaaaactactctggctcagaaattaatgctggactgggctgaagataacctgattcataagtttaagtatgctttttacctctcatgtcgggaactatcaaggctcggcccttgcagttttgcggaactcgttttcagagattggccggagctacaggatgatatacctcacatcctggcccaggcccgtaagatcctgttcgtgatcgacggtttcgatgagctcggtgctgcaccaggggctctgattgaggatatctgcggggattgggagaagaagaagcctgtccctgttcttctgggcagtctgttgaatcgagtcatgctgcccaaggcggcacttctggtgaccaccagacccagagcgctgagagatctgaggattcttgcggaggaaccaatttacatacgggttgagggattcctagaagaggaccggagagcctacttcctacgacacttcggggatgaggatcaggccatgcgcgctttcgagctgatgagatcaaatgcggcacttttccagttaggcagcgcacctgcagtctgctggatagtgtgtacaactctgaaactccagatggagaaaggtgaagatcccgtgcccacatgtctgactaggacaggtcttttcttgaggtttttgtgcagcagattccctcagggcgctcaactgcgcggtgcattacgcaccctcagcctgttagctgctcagggcctgtgggcgcagactagcgtgttgcacagggaggacctcgaaagactcggggtgcaggaaagtgacctcaggctctttttagacggagatattctgagacaggacagagtgtctaaaggatgttatagttttattcatcttagctttcaacaattccttacagcactgttttatactttagagaaagaagaggaagaggatcgcgatgggcacacctgggacatcggtgatgtgcaaaagttgcttagcggggttgaaagattaaggaacccagacctgattcaggctggctattactcgtttggcttagccaatgagaagcgtgccaaagagcttgaagcaacatttgggtgtagaatgtcgcccgatattaagcaggagctcttacgctgtgatatttcctgcaagggaggccactcaaccgttaccgatctgcaggagctgttaggttgcctctatgagtcccaagaggaagaattagtgaaggaagtcatggcgcaatttaaggagattagcttgcacctcaacgccgtcgacgtcgttcccagcagcttctgcgtcaaacattgtaggaacttacagaaaatgagccttcaggtaatcaaggaaaatctccctgaaaacgttaccgcttccgagagtgatgctgaagtggagcgcagtcaagatgaccagcacatgctgcccttttggactgatttgtgcagcatcttcggcagcaacaaggatcttatggggctagcaataaatgattctttcttatccgcttcgttggtgcggatcttgtgcgagcagatcgcctcagacacgtgtcatctacaacgggtggtctttaaaaatatttcgcccgctgatgcccaccgtaacctctgtttggctctgcgcggtcacaagacagtaacctatcttacattacaaggaaacgaccaggacgatatgttccctgcgctgtgtgaagtgttgcgccatccagaatgcaatctgaggtacctcggactggtgtcatgctcagctaccacacagcaatgggcagatctgagcctggcactggaggtcaatcagtcgctgacatgcgtaaatttaagtgacaatgaactcctggatgaaggggctaagctgctgtacacaaccctccgccacccaaagtgtttcttgcaacggctcagcctcgagaactgccatcttacagaggccaattgtaaggacctggcagctgttctggtagtcagccgggaactgacgcacttgtgcctcgccaagaacccaattggcaataccggagtcaagtttctctgcgagggcttgcggtacccagaatgtaaattacagaccttagtgctctggaattgtgatatcaccagtgacggttgctgtgacctgacgaaactgctgcaggaaaaatcaagcctcttgtgcttggacctgggccttaaccacattggcgtgaagggcatgaagttcctctgcgaggctctgagaaagccactgtgcaacctgcgatgtttgtggctgtgggggtgctcaatccccccattttcctgcgaagatctttgctctgccctgagttgcaaccagtcactagtgacgctggaccttggtcagaaccctctaggatcctccggcgtgaagatgctgtttgagacattgacatgttcaagcggaactttgcgcacactgcgactgaagattgatgatttcaatgatgaacttaacaagctgctcgaggagattgaggaaaagaatccgcagctgataattgacactgagaagcaccatccttgggcagagcgtcccagttcacatgactttatgatctag

SEQ ID NO: 57873 - DNA, 2943 bp, Artificial Sequence
  Description of Artificial Sequence: Synthetic coding sequence
atgacctcaccccagctagaatggaccctgcagactctcctggaacagcttaatgaagatgagctcaaatcgttcaaaagcctgctgtgggcttttccactagaggacgttttgcagaaaactccatggtctgaggttgaagaggcagatggcaagaaattggccgaaatcttggtaaacacaagctcagagaactggattcgaaacgccactgtcaacattcttgaagagatgaacctaaccgaactatgcaagatggccaaggctgaaatgatggaggatggacaggttcaagaaatcgataacccagaattgggagacgctgaggaggacagtgagctcgcgaagcctggcgaaaaagaagggtggcggaattctatggaaaaacagtccttggtgtggaagaacaccttttggcagggagacatcgacaattttcacgatgatgtgacactgaggaaccagagattcatcccttttctcaatcccaggactcctcgaaagcttaccccgtacacagtagtgttacacggcccagccggagtcggtaaaacaacacttgccaagaagtgtatgctggattggaccgactgcaacctcagcccaaccctacgttatgcattctacctgtcatgcaaggagctgagtcggatgggcccttgtagctttgctgaacttatctccaaagactggccagagctccaggacgatattccatctatactggcacaggcgcagcgcatattattcgtggtggacggattggacgagttgaaggtcccacccggtgcactaatccaggacatctgcggagattgggaaaaaaagaaacctgtgcccgtgctcttaggaagtctgctaaagcgtaagatgctacccagagcagccctgctagtgaccacaagaccccgagcactgagagacttacaactcttggctcaacagccgatctacgtgagggttgagggattcttggaggaggacaggcgggcttactttcttcggcacttcggtgacgaggatcaggcaatgagggccttcgagctcatgaggtcaaatgccgctcttttccagctcggctccgcccctgcagtttgttggatcgtgtgcaccactctcaaactgcaaatggagaagggtgaggatccagtgccgacttgcctcacaagaaccggcctctttctaagattcctttgcagcaggttcccccaaggggctcagttgaggggcgcactgaggaccctgagcctgcttgctgcacaagggctctgggcccaaatgtctgtgttccaccgcgaagacctggaacgtctgggagtccaggagtcagacctcaggctgttcctcgacggtgacattttacgtcaggaccgggtcagtaaggggtgttacagttttatccacctatcatttcagcagtttctcaccgccctgttttatgccctagagaaagaagaaggagaagatcgtgacggtcatgcctgggatatcggcgacgttcagaagctcctctccggcgaagaaagactgaagaaccccgatctcattcaggtggggcacttccttttcggactggcaaatgaaaagcgcgctaaggagctcgaggctactttcggctgccggatgtctccagatatcaagcaggagctgttgcagtgtaaggcccacctgcatgccaataagccacttagcgtgaccgacctgaaggaagtcctcgggtgtctttatgagagccaagaagaggagctggctaaagttgtcgttgcccctttcaaagagatctcaattcatcttaccaacactagtgaagtgatgcattgctcattctcccttaaacactgccaggacctgcagaagctctctctccaggtagccaagggagtcttcctggagaactatatggactttgaactggacatcgaatttgagcgatgcacttacctgaccatacccaactgggctcggcaggatctgcgctctttgcggctgtggaccgatttttgctcacttttttcctcaaactctaacctcaagtttctagaagtgaagcagtcctttttgtcagactccagtgtgcggatcctctgtgatcacgtaaccaggagtacatgccatttacagaaggtggagattaaaaacgttacccctgatacagcataccgcgacttctgcctcgcctttatcgggaaaaagacactcacccatctgacgctcgccggacatatcgagtgggagcgaaccatgatgctgatgctttgcgacctcctgcgcaaccataagtgtaatctgcaatatctgagactggggggacactgtgcgacccccgaacagtgggccgagttcttctacgtgctgaaagccaaccagtccctgaagcaccttaggctcagcgcgaacgtgctccttgacgagggcgcaatgctcttgtacaagactatgacgcgcccaaaacatttccttcagatgcttagcctggagaattgtagattgaccgaggcatcttgtaaggacctcgcagcagtgcttgtcgtctctaaaaaacttacacatctgtgcctggccaaaaaccccattggagataccggggtgaagttcctgtgcgaaggtctttcctaccccgattgtaagctgcaaaccctggttctgcaacagtgtagcattaccaagctgggatgtcgatacctgtctgaggccctccaggaggcctgttcccttaccaatctagacttatccatcaatcagatagctcggggtttgtggatcctgtgtcaggcgcttgagaatccaaactgcaacctgaaacatctgaggctgaagacctacgagacaaacctggagatcaagaagctcttggaggaggtgaaggagaaaaacccgaagctgacaatcgactgtaacgcaagcggcgctacagcccctccctgctgcgacttcttctgttag

SEQ ID NO: 57874 - DNA, 3030 bp, Artificial Sequence
  Description of Artificial Sequence: Synthetic coding sequence
atgacctctccccagctggagtggacgttgcaaacactgctggagcaactgaacgaggacgagcttaagtccttcaagagtcttctatgggcgttcccgctagaagacgttctgcagaagaccccttggagcgaggtcgaggaggccgacggcaaaaagctagctgaaatcctggtgaatacttcgagcgaaaactggattcgaaacgccactgttaatatattggaggaaatgaatctcaccgagctgtgcaagatggccaaagccgagatgatggaggatggccaggtgcaagaaattgacaaccctgaactaggcgatgcagaagaggattccgaactagccaagcccggagagaaggagggctggcgaaattctatggagaagcaatcgttggtgtggaagaacacattttggcagggagatatcgataattttcacgatgacgtcaccctaaggaatcagaggttcatcccattcctgaatcccagaacaccccgtaaactgactccctatacggtggtactgcacggcccagcaggcgtagggaagacgacccttgctaagaagtgtatgttagattggacggattgcaacctatccccaactctaagatatgccttctacttatcctgcaaagaactgagccgaatgggaccctgtagttttgctgaactgatctcaaaggactggcccgagcttcaggacgatatcccctccattctggcccaggcccagcgcatactattcgtggtggatggactggatgagttgaaagtcccaccaggcgcattgatccaagacatttgcggcgactgggaaaagaagaagccagtccccgttctactcggatccttactgaagaggaagatgctgcctcgcgcagccctccttgtcactacgcggccacgagcactgagagatctgcagctgttggcacagcagcctatctatgtgcgggtcgagggcttcctggaagaggatcggagggcctacttcctgaggcacttcggagatgaagatcaagcgatgagggctttcgagcttatgcgttccaacgcggcactctttcaactggggagtgctcccgctgtgtgttggattgtgtgtactaccctaaaacttcaaatggagaagggcgaggaccctgtccctacctgtctgaccaggacaggactgttcctccggttcctctgctctcggttccctcagggcgcacagcttagaggggctcttaggactctgtccctgctagccgctcaaggactgtgggcgcagatgtcagtatttcacagagaggatttagagcgtctgggcgtgcaggagtctgacctcagattgtttctggacggcgacatactaaggcaggaccgggtgagcaagggatgttactcattcatccacctatctttccagcagtttctgactgcattgttttatgctctggaaaaggaggaaggggaggatcgcgatggacacgcgtgggatatcggagatgtccaaaagttactatcaggtgaggagcgcctgaagaatcccgacctgatacaggtgggccactttctgtttgggctggctaacgagaaacgggctaaagaactcgaggcaaccttcggctgccgaatgtcacctgacatcaagcaggaacttttgcaatgtaaggctcatctgcacgccaataaacccttgtcggtgaccgatctgaaagaagtgctagggtgtctatacgaaagccaggaagaggaactcgccaaggtggtggtggcccctttcaaagagatctctattcatctcaccaacacctctgaagtcatgcactgttcattttcgttaaagcactgtcaggacttgcagaagctgtctctacaggtcgccaagggtgtcttcctggagaactatatggactttgagctggatattgagttcgagagctcaaattcgaatctgaaattcctggaggtgaaacagtccttcttgagtgattcaagtgttaggatcctctgcgaccacgtcacgaggagcacctgccacctgcagaaagtggagataaagaatgtgacccctgacaccgcatatcgcgacttttgtctggcatttatcgggaagaagaccctgacacacttgacactcgcaggccatatcgaatgggagcggactatgatgctcatgctctgtgatttactaagaaatcacaagtgtaacttacagtatctgcgcctggggggtcactgcgccacacctgaacagtgggctgaatttttctatgttcttaaagccaatcaatcactgaagcacctaagactttccgctaacgtccttcttgatgaaggggctatgctgctgtacaaaacaatgacccggccaaagcatttcctgcagatgttgtccctggagaactgtaggctgaccgaagcaagttgtaaggatcttgccgcagtcctcgtggtttcaaaaaagctcacccatctatgtcttgctaagaatccaattggcgacactggggtaaaattcctgtgcgaaggcctgtcttaccccgactgtaagctccagacactggtccttcagcagtgctcaatcactaaattaggctgtagatatctgtctgaggcgttacaggaggcctgcagccttacgaacttggacctttctattaaccagatcgcaagagggctctggatcctttgccaggccttggagaatcctaattgcaatctaaaacatctacggctgtggtcatgctcgctaatgccattttactgtcagcacctcggctctgcacttttatctaaccagaagctggaaactcttgacttggggcaaaaccacctgtggaaatccggcattatcaagctgtttggagttctccggcagcgcactggttccctaaaaatcctgcgcctgaagacatacgaaactaatcttgagattaaaaaattgctggaagaagtgaaagagaaaaacccgaaactcacaatcgactgcaatgcttcaggtgctaccgcacccccatgctgcgacttcttttgttag

SEQ ID NO: 57875 - DNA, 3198 bp, Artificial Sequence
  Description of Artificial Sequence: Synthetic coding sequence
atgtcaaggaaacatcgcctcgaggctcgccctgacctgcgcgaatttttttctctgaacctcaggagccacacccggtctacaatgaccagtccacagcttgagtggacacttcagactctgctcgaacagctgaacgaggatgaattgaagagttttaaatcactgctatgggcttttcctttggaggatgtcctgcaaaagaccccttggtcagaagttgaggaagcggatggcaaaaaactggcggagatcctggtgaacacctcttccgagaactggatccgtaatgcaacggttaatattttggaagagatgaacctgacggagctgtgtaaaatggccaaagctgaaatgatggaagacggccaggttcaggaaattgacaaccccgagctcggagacgcagaggaagactccgagctggcaaagcctggagagaaggagggatggcgcaactccatggagaaacaatcccttgtgtggaagaacaccttttggcaaggcgacatcgacaacttccacgatgacgtgacactccgtaaccagaggttcatcccttttctgaacccacggaccccacggaagctcaccccatatactgtcgtattgcacgggccagctggagtggggaagaccactctggctaaaaagtgcatgctcgattggaccgactgtaacttgtctccaacattacgatacgcattttacctgtcttgtaaggaactgtccagaatgggaccatgctcattcgcagagctgatatccaaagactggcccgagctgcaggacgacattccatccattttggcgcaggcacagcgaatcctgttcgtcgtcgatgggcttgacgagcttaaagtacctcctggggctttaatacaagatatttgtggggattgggaaaaaaagaagccagttcctgtgctgctggggtccctcttgaaacgaaagatgttgcccagggctgctctgctagttactacgcgcccacgcgctttacgggatctgcagctgctggcacagcagcccatctacgtaagagtggagggctttttagaggaggatagacgcgcatactttttgcggcactttggagacgaggatcaagctatgagagcatttgagctgatgcggagtaacgctgcacttttccagttaggctccgccccagcagtgtgttggatcgtttgcaccaccctaaagctccagatggaaaagggcgaagatccagttccaacatgcctgaccagaactggcctgtttctgagattcctctgctctcgtttccctcaaggcgctcaactcaggggtgcattgaggactttatccctcctggcagcgcagggcctctgggcccagatgtcagtatttcacagggaagatctcgagagacttggcgttcaggaatctgaccttcggctgtttttggatggggatatactcaggcaagaccgggtttccaagggctgctacagttttatccacctgtcatttcagcagtttcttaccgctcttttttacgccctggagaaggaggaaggagaagacagggacggccacgcgtgggatataggcgatgtgcagaagctgctgagtggggaagagcgcctcaagaacccagacttgattcaggtgggccattttctgttcggtttggccaacgaaaagcgcgctaaggaactcgaggctacctttggttgccgaatgagtccagatataaaacaggaattactacagtgcaaggctcatctacacgccaacaagcccctctctgtgaccgacctcaaggaagttctaggctgcctttacgagtcccaggaggaagagcttgccaaagttgtcgtggctccctttaaggagattagtatacacctgaccaataccagtgaagtgatgcattgctccttttctctgaaacactgccaagacctgcagaaactctctctgcaggtggcaaaaggtgtctttcttgagaactatatggacttcgagttagatatcgaattcgaaaggtgcacctacttaaccatcccgaattgggccagacaggatttacgctcattgagattatggacagatttctgtagcctcttcagtagcaattcaaaccttaagtttctagaagtcaaacaatctttcctgtcagatagttcagtccgcatactctgcgatcatgtgaccaggtccacctgtcacttgcaaaaggttgaaatcaagaacgtgactcctgacactgcttacagggatttctgtctggccttcataggaaagaaaaccctcacccacctcactctggctggccacatcgaatgggagcgaacgatgatgctaatgctgtgtgacctcctgcggaaccacaaatgcaatctgcagtatttacggctgggagggcattgtgcgacacctgagcagtgggccgagttcttttatgtgttaaaggccaatcagtcgttgaagcaccttaggctctccgcgaatgtgctccttgacgaaggtgccatgttactatataaaacaatgacccggccaaaacattttttgcaaatgctatcgctcgagaattgcagactgactgaagcgtcttgcaaggaccttgccgctgttctcgtcgtttccaagaaactgactcatctctgcctagctaaaaatccgattggcgatacgggcgttaaattcctctgcgagggcttgtcttaccccgattgcaagttgcaaactctggtgctacaacagtgcagtatcaccaaattgggctgtagatacctctccgaagctctacaggaggcgtgctcccttactaacctggacctgtccatcaatcagatcgcacgtggactgtggatactgtgccaggctttggaaaatccaaattgtaatctgaaacacctccgcctttggtcttgctctctcatgcctttctattgtcagcacttgggctctgccctcctctcgaaccaaaagttggaaacactggacctcggccagaaccatctgtggaaaagcggcatcataaagctctttggggtcttgaggcagcggacgggcagtctgaaaattctcaggcttaaaacctatgagacaaacctggagatcaaaaaactgttggaagaggtcaaggaaaagaatccaaaactcaccatcgactgcaatgcgtcgggcgcaacggctcccccatgctgcgatttcttctgctag

SEQ ID NO: 57876 - DNA, 3030 bp, Artificial Sequence
  Description of Artificial Sequence: Synthetic coding sequence
atgacctcacctcagctggaatggaccctgcagactcttcttgaacaactgaacgaagatgagctgaagtcctttaagtctcttctgtgggcttttcctcttgaagatgtcctgcaaaagaccccatggtccgaagttgaggaagcagatggcaaaaagctggccgagatactcgtaaatacaagttcagaaaattggattcgcaacgcaaccgtgaacatactggaagagatgaatttaaccgaactctgcaagatggctaaagcagagatgatggaagatggccaggttcaagaaatcgacaatccagaacttggggatgccgaggaggactctgaactcgctaaaccgggtgagaaggaggggtggcgaaactccatggagaagcaatctttggtatggaaaaatacgttctggcagggcgacatcgacaattttcacgatgacgtgacacttagaaatcagaggtttatacccttcctgaacccaaggacccctcggaagcttacaccatacactgtggtgcttcatggccctgccggtgtcggcaagaccaccctcgcaaaaaaatgcatgctcgactggactgactgtaaccttagccctactctccgatatgccttttacttgtcatgcaaggaattatccagaatgggtccctgctcttttgccgaactgatttctaaggactggccagagcttcaggacgacatccccagcatcctggcgcaggcccagcggattttgtttgttgtagatggtctggacgagcttaaagtcccacccggtgccctcatacaggacatttgcggggactgggagaagaagaagcccgtgcctgtactgttaggatcgctgctgaaaagaaaaatgttgccccgtgccgcactactggtgacaacccggccacgcgcactgcgggatctccagttacttgcccaacaacccatctatgttcgggtggaaggattcctagaggaagacaggcgcgcttatttcctgcgtcactttggggatgaggaccaagcgatgcgggcatttgagctgatgcggagcaatgccgctctgtttcagttaggttcggcaccagccgtttgctggattgtgtgcactaccttgaaattacagatggaaaagggagaagatcctgtgcccacctgcctcactcgtaccgggttgttcctcaggttcctgtgttcaaggttcccacaaggagcccagttgcggggagccttaaggaccctgtcccttctagccgcacagggcttgtgggcgcagatgtccgtgtttcaccgtgaggatctcgagagacttggcgtccaggagagcgaccttagactgtttttagacggcgacatactgcgccaggaccgtgtatcgaaagggtgttactcattcatccatctgtcctttcagcagttcctcacagccttgttctatgcactcgagaaggaggaaggagaggaccgagatggccacgcctgggatattggtgatgtgcagaagcttctgtcaggcgaggaacggctgaagaacccggacctgatccaggtggggcatttcctgtttggcctggccaatgaaaaacgggctaaagaactcgaggcaacgttcggatgtcgtatgtcgccagatattaagcaggagctgctccagtgtaaagcccacctgcacgcaaataagcccctttccgtgaccgacctcaaggaggtgctcggttgtctctacgaaagtcaggaagaggaactggcaaaagtcgtcgtcgctccatttaaggagatttcaatccatctgaccaatacctccgaggtcatgcattgctcctttagtttgaagcattgccaagatctgcagaaactgtcattgcaggtggcaaagggtgtgtttctggagaattatatggactttgagctggacatcgagttcgagagctccaacagcaatcttaaattcttagaggtgaagcagtcattcctgtccgactcctctgtgaggattctgtgcgaccatgtcactcgctccacttgccacctgcagaaagtcgaaatcaagaatgtcaccccggacactgcctatagggatttctgccttgcctttattggtaagaagactctgacccatctcacgctggccggtcacattgaatgggagcgcacaatgatgcttatgctttgtgaccttttacgtaatcataaatgtaatctgcagtacctgcgactgggaggccactgtgctactccagaacagtgggccgaattcttttatgtgctcaaagcaaatcaaagcctgaaacacttaaggttgtccgcaaacgtgttgctcgacgagggggcaatgctgctgtacaaaacaatgacgaggcctaaacatttcctccaaatgttgagcctggagaattgtcggcttacggaagcatcctgtaaggatctggccgcagtactggtggtatcgaaaaagctgacacatctttgcctcgcgaagaatccaattggcgatacaggtgtgaaatttctctgcgaggggctctcgtatcctgactgtaaacttcagacacttgtgcttcaacagtgctcgatcacaaagttagggtgccgctacctctccgaggccctgcaggaagcttgcagcctcaccaacctggatctgtcaatcaatcagatagctagaggcctttggattttatgtcaagccttggaaaacccaaactgtaacctaaaacacctgcgcctttggtcttgttccctgatgcccttctactgccaacacctgggatctgccctcctatccaaccagaaactggagaccttggacttggggcaaaatcacctgtggaaatcaggcattataaaattgttcggcgtgttgcgccagcgaaccggctcactgaaaattctacggttaaagacttatgaaacaaatttggaaatcaagaagctgctggaggaggtcaaagagaaaaaccctaaacttaccattgactgcaacgcctctggtgcaacggccccaccatgttgcgacttcttttgttag

SEQ ID NO: 57877 - DNA, 3198 bp, Artificial Sequence
  Description of Artificial Sequence: Synthetic coding sequence
atgagtagaaaacacagactcgaggcgagaccagacctacgggaattcttcagtctgaacctccgatcacatacacgcagcacaatgacttcgccacaactggagtggaccttacagactctactcgagcagcttaacgaggacgaactcaaatcttttaaatctctgctgtgggctttccctctagaagacgtattgcagaagactccgtggtccgaagtggaagaggccgatggaaagaagctggcagagattcttgtaaacacctccagcgaaaattggatccggaatgccactgtgaatattttggaggaaatgaacctaaccgagctctgtaaaatggccaaggctgagatgatggaagacggacaggtgcaggagatagacaaccctgagctcggtgacgctgaagaagattcggagctggcaaagcccggtgaaaaagagggatggaggaatagtatggagaagcaaagtttggtgtggaagaacacgttctggcaaggggacatcgacaactttcatgacgacgtgacactccgtaaccagaggtttattccatttctgaaccctcggacaccacgcaagctgactccctacacagtcgttctgcatggtcccgctggggtcggaaagacaactttggccaaaaagtgtatgttggattggactgactgcaatctgagtccgaccctgagatacgccttctatctgagttgcaaagaacttagcagaatgggtccgtgctcctttgccgagttaatttctaaggattggcccgagctgcaggatgacattcctagcattctcgcacaggcccagcgcattctgtttgtggtcgatggactcgacgaacttaaagtccccccaggcgcactcatacaagatatctgcggcgactgggaaaagaagaaaccagtgccggttctcctgggatccctgcttaagagaaagatgttgcccagagccgcactgctggtcacaacccgcccaagggctttgagggatttacagttgcttgcacaacagccaatctacgtgcgggtcgaggggttcctagaagaggacaggcgggcttattttctacggcacttcggcgacgaggaccaggcaatgagagcgtttgagctgatgcgaagcaatgccgctctgttccaactgggctctgcacctgccgtgtgttggatcgtttgtaccacccttaagctgcaaatggagaagggggaagatcccgtgccaacatgtttaactcggaccggcctcttcctgcggttcctgtgctcccgttttccgcagggcgcacagctgcggggtgccctgaggacactgagtctgctggccgctcaggggctctgggcacagatgagcgtgttccaccgagaagatctcgagagactgggagtacaggaatccgatctgcgactttttctggatggggatatactgcggcaggatagagtgagtaagggctgctattcgtttatccacctatcattccagcagttcttgactgctctgttctatgcactggaaaaagaagaaggagaagaccgcgatggccacgcttgggacatcggtgacgtccagaaacttctgtctggtgaggagagactgaaaaatcccgatctgatccaggtcggtcactttctgtttggtctggccaacgaaaagagggcaaaggaattagaggctacatttggatgccggatgagccccgatataaaacaagaactgcttcagtgcaaggctcatctacacgcaaataagccacttagtgtaacagacctcaaggaggtgctcgggtgtttgtatgaatctcaagaagaagagctggcgaaagtggtggtcgccccattcaaggagatttctatacacctcacaaatacttccgaggtaatgcattgctcattttctctcaaacactgccaggacctgcagaaactgagccttcaagtggccaagggggtgttcctggagaactatatggattttgagctcgatatcgagttcgagcggtgtacttacctgaccataccaaattgggcccgacaggatctgcgatcactaagattatggacagatttttgtagcctgtttagctcaaatagcaatctcaaatttttggaggtgaaacagtcttttctctccgactccagcgtgcggatactgtgcgaccatgtcactcgatccacgtgccaccttcagaaagtcgagatcaagaatgtgaccccagataccgcgtatagggacttttgtttagcctttattgggaaaaaaactttgactcacctgactctggcaggccatatcgagtgggaaagaaccatgatgctaatgctgtgcgatttactgagaaaccacaagtgtaatctccagtatctgcggcttggcggacactgcgccacccctgagcaatgggctgaatttttttacgtgctgaaggccaatcagtcccttaagcacctccgcttgtccgccaacgtcttattggatgagggggctatgcttctgtacaagaccatgacgagacctaaacatttcttacagatgctcagtctcgagaattgtcgcttaaccgaggcctcttgcaaggatctagctgcagtgttagttgtgagcaagaagctgacacacctctgcttggccaaaaatcctataggggacaccggcgtgaaattcctgtgcgaaggactgtcttatcctgactgtaaattgcagaccctggtcctacagcagtgttcaattactaagctcggttgcagatacctatctgaggctctgcaggaagcatgtagcctgactaacttggacctgagcatcaaccagatcgctagagggctatggatcctatgccaagctcttgagaatccaaattgcaacctgaagcatttacgcctctggagttgcagcctgatgccattttattgtcagcatttgggctctgcactgctctccaaccagaagctcgagacgctcgaccttggtcagaatcacttgtggaaaagcgggatcataaagttgttcggggtgctccggcagaggaccggctccctcaaaattttaagactgaagacctacgaaactaacctggaaataaaaaaattgctcgaggaggtaaaggagaagaaccctaagttaacgattgattgcaatgccagtggtgcaaccgcacccccttgttgcgactttttttgctag

SEQ ID NO: 57878 - DNA, 3030 bp, Artificial Sequence
  Description of Artificial Sequence: Synthetic coding sequence
atgacctctcctcagttggagtggaccttacagaccctcctggagcagctgaacgaagacgagcttaaatccttcaagtccctgctgtgggcctttcccctcgaggacgtgctccagaaaacaccctggagcgaggttgaggaggcggatggaaaaaaacttgccgagattttagttaatacctcttccgaaaactggattcgaaatgccactgttaatattctggaggaaatgaatctgaccgagctttgcaagatggccaaggccgaaatgatggaggatggacaggttcaagaaattgacaatcccgagctgggagacgctgaagaagattctgagctggccaagcccggagaaaaagagggctggaggaactctatggagaagcagtcgctcgtctggaaaaacaccttttggcaaggcgatattgacaactttcacgatgacgtgaccttgcgcaatcagcggttcatcccttttctcaatccacggaccccgagaaagctgaccccttataccgtggtccttcatggacctgctggcgttggtaagaccaccctcgcaaaaaagtgtatgttagactggactgattgtaacttgagccccaccctccgctacgcattctacctgagctgcaaggagcttagccgcatggggccatgctcttttgccgagctgatatctaaggactggccggaattacaggatgatataccatctatcctggcccaggcccagcggattctgttcgttgtcgatggacttgacgagttgaaggtgccacccggagctctgattcaagatatttgcggggattgggagaagaaaaaacccgtcccagtgttattgggttccttactgaagaggaaaatgcttcctcgtgcggctcttctcgtcaccaccaggcctcgggcactgagagacttgcagctgctagcccagcaaccaatctatgttagagtagaagggttccttgaggaagaccgcagggcatacttcttgcggcacttcggggatgaggatcaggcaatgcgcgctttcgagttaatgcgatctaacgctgctctgtttcaactgggctctgctccagctgtatgctggatagtttgcaccactcttaaacttcagatggaaaagggagaggaccccgtgcctacctgccttacacgtacaggactattcctgagattcttatgttccagatttccgcagggggcacagttacggggagcactcaggaccctctccctgctcgccgctcaagggctctgggcccagatgagtgtgtttcacagagaagatcttgaaagactgggagtgcaggagagtgatctgaggctcttcctcgatggtgacatccttagacaagacagggtcagcaaagggtgttactcatttatccacttgtcttttcagcagtttctgaccgccctgttttatgcattggagaaggaagagggagaggatagggatggtcatgcttgggacattggagatgtgcagaagctcctctctggggaggagaggctcaagaatcctgaccttatacaggtcggacacttcctgtttggtctcgctaacgagaaaagagccaaagagctggaagcaacatttggatgtcgaatgtcccccgacatcaagcaagagctgctgcaatgcaaagcgcaccttcacgctaacaagcctctgagcgtgacggaccttaaagaggtgctcgggtgcctctacgaaagccaagaggaggagctggcaaaggtggtggtagccccatttaaagagatcagtatccatttgacgaatacatcagaggtgatgcattgttccttctcactaaagcactgtcaggacctacagaagttgtctcttcaggtggcaaaaggggtgttcctggagaactacatggactttgagcttgacatcgagttcgaaagtagcaactccaacctgaaattcctggaagttaagcagagctttttatcggactctagtgtgagaatcctttgtgatcatgttactcgatctacctgccacctacagaaagtggagattaagaatgtcactcccgataccgcctatcgggacttctgcctggccttcatcggcaagaaaacattgacccatttaaccctcgcgggtcatatcgaatgggaaaggaccatgatgttaatgctgtgcgatcttctccggaatcacaaatgcaacttgcagtatttaagactcggtggacattgcgctacgcccgagcagtgggcagaattcttttatgttctcaaagcgaaccagagcctgaaacacctccggctctcagccaatgtcctcctggacgagggcgctatgttgttgtataaaacaatgacccggccaaagcattttctccagatgttaagcctcgagaactgccgcctaactgaagcctcttgtaaggatctcgccgctgtcctcgtcgtgtctaagaagcttacacacttgtgtctcgcaaagaatccaattggagacacaggtgtaaagtttttatgcgaggggctttcttaccccgattgcaagctgcagaccctcgtactgcagcaatgctctataacaaaattagggtgtagatacctgagcgaggctctgcaggaggcatgctcattgaccaacctagacttgtctattaaccagattgctaggggcctgtggattctctgccaggccctggagaacccgaattgtaacctcaagcaccttagactgtggtcttgcagtcttatgcctttttactgccagcacctgggaagcgccctactaagtaaccagaagctcgagacgcttgacctgggacagaatcatttatggaagtctggcattatcaaactgttcggagtgctgcggcaaaggacaggaagtctgaagattctgaggctgaagacctacgaaacaaatctggaaattaagaagcttctggaggaggtcaaagagaaaaatcccaagctgaccattgactgtaacgcctccggggctaccgcgcctccttgttgcgatttcttctgttag

SEQ ID NO: 57879 - DNA, 3198 bp, Artificial Sequence
  Description of Artificial Sequence: Synthetic coding sequence
atgtctcggaagcacaggctcgaagctcgccctgatctcagagaatttttcagtctgaatctgcggtctcatacaaggagtactatgaccagcccccagctggagtggactttgcagacactcctagagcagctcaatgaggatgaactgaaatcattcaaaagtctgctgtgggcttttccattagaagatgttctgcaaaaaacgccctggtcagaagtcgaagaggccgatggtaagaagctggcagagattctagtaaacacatcgtcagagaattggatcagaaatgcaacagtaaatattctggaggagatgaatctgacagagctgtgcaaaatggccaaagccgagatgatggaggacggtcaggtccaggagatcgataaccccgaactaggggacgccgaggaggacagcgaactcgccaagccgggtgagaaagagggatggagaaactccatggaaaaacagtccctggtttggaagaatacattctggcaaggcgacattgacaacttccacgacgacgtcaccctgagaaaccagaggttcataccatttctgaatcctagaacaccgcgtaaactcactccttacactgtggtcctccatggacctgccggagtggggaaaacaacactggctaagaagtgcatgttagactggaccgattgtaacctgtctccaacattacgctatgccttctacctatcttgcaaagaattgtctaggatggggccttgtagttttgccgaactcatctccaaagattggcccgaattgcaggatgatattccgtcaattctagcgcaagcccagcggatactcttcgtcgttgatgggctggatgaacttaaggtcccaccaggtgcactgatccaagatatttgcggagactgggagaagaagaagcccgtcccggtcctgctcggtagcctgctcaaaaggaagatgctacccagagcagccttgctggtgacaactcgaccacgcgctcttcgtgatttgcagctcctcgctcagcagcctatttatgtgcgcgtggaggggtttcttgaagaagacagaagggcatacttcttacggcacttcggggacgaagaccaagcaatgagagccttcgaactaatgcgcagcaacgccgctttgtttcagctaggcagtgcgccagccgtctgttggattgtttgcaccactcttaaactccaaatggagaagggagaggacccagtgcctacttgcttaactagaacgggtctgtttctccggtttctgtgctccaggtttccacagggcgctcagcttcggggtgccttacgtaccctgtctttgctggccgcacagggcctgtgggcgcagatgtccgtcttccatagggaagatctggagcgcctgggcgtgcaagagagcgatctgcgcctcttcttggatggggacatattgcggcaggatcgagtaagtaaaggttgctactctttcatacacctcagctttcagcaattcctcacagcgttattctacgctcttgaaaaggaagagggagaagatagggacggacatgcctgggatattggagatgtgcagaagctgctgtctggggaggaacggctcaaaaacccagatttgatccaggttggccatttcttgtttggtctggcgaacgaaaaaagggcaaaggaattggaggccactttcggctgccggatgagtccagacataaaacaagagctcctgcaatgcaaggctcacctgcacgctaataagcccctgagcgtgaccgatctcaaggaggtgcttggctgtctctatgagtcacaagaagaagaactggccaaagtagttgtcgctccatttaaggaaatctctattcacctgaccaataccagtgaagtaatgcactgctcatttagcttgaaacactgccaggatctccagaagctgtccctccaagtggctaaaggggtgtttctggaaaattatatggatttcgaactggacattgagttcgagcgttgtacctatctaaccatcccgaactgggcccgacaggacctccgcagtcttagattgtggaccgatttttgcagtttattcagttctaacagcaatctgaagttcttggaggtaaagcagtcatttctgtccgattctagcgtaaggatattgtgcgatcacgtgacgagatcaacatgtcacctgcagaaggtcgagataaaaaacgtgaccccagacaccgcctatcgggatttctgcctggccttcatcggtaaaaagacacttacgcacctcacactagccggacatatagaatgggaaagaaccatgatgctgatgctatgcgacctcctgaggaatcacaaatgcaaccttcagtatctgagactgggcggacactgcgctacgccagagcaatgggctgagttcttttacgtgctcaaggcaaaccagagtctgaaacacctgaggcttagcgcaaacgtgctgctcgatgagggtgctatgctcctctacaaaacgatgacacgccctaagcattttcttcaaatgcttagtctggaaaactgtcgcctaactgaggcttcctgcaaagatcttgcagccgtcctcgtggtctctaaaaaactcacgcacctctgccttgcgaagaatcctatcggcgatactggagtcaagtttctgtgcgaaggactgagctaccctgattgtaaactgcagaccctagtgctccaacaatgtagcattaccaaattgggatgtcgatacctatccgaggccctccaggaggcctgctcgctgaccaacctcgatttgagtatcaatcagattgcccgtggactgtggattttgtgccaggccttggagaatcctaattgcaacttgaagcacctgagattgtggtcatgctccctcatgccattttactgccagcaccttgggtccgccttgctttctaaccagaagctggaaactttggacctgggccaaaaccacctgtggaaatcgggaatcattaagcttttcggagtcctgaggcagcgaaccggctcactgaagatcctgagacttaaaacctatgagaccaacttggagattaaaaagctgcttgaggaggttaaggaaaaaaatcctaaactaactattgattgcaatgcttcaggcgcaaccgcccctccttgctgcgacttcttctgctag

SEQ ID NO: 57880 - DNA, 2943 bp, Artificial Sequence
  Description of Artificial Sequence: Synthetic coding sequence
atgacatcccctcagcttgaatggaccctccagaccctcctggagcagctcaatgaagacgagctgaagtctttcaaaagcctgctctgggcctttccactggaagacgtgctgcagaaaaccccgtggtccgaagtcgaggaagcagacggaaagaaactagcagaaatcttagtaaacactagctctgagaattggatcaggaatgcaacagtgaatatcctggaagaaatgaacctgactgaattgtgtaagatggcaaaggcggagatgatggaagatggacaggttcaggaaatcgataaccccgaactgggcgacgctgaggaagactctgagctggctaaacctggtgagaaagagggttggaggaactcaatggagaaacaaagcctggtgtggaagaacaccttctggcaaggagacatagacaactttcacgatgatgttacgctgcgcaaccagagattcattccgtttctgaatcctcggactccgagaaaacttactccatataccgtggtgctgcatggtccagccggagtgggaaagactaccctcgccaagaaatgtatgttggactggaccgactgtaacctgtctccgacactgcgatatgccttttacctatcatgtaaagagctctctcggatgggtccttgtagtttcgccgaactgatttctaaggactggccagaactgcaagatgatatcccatccatcctcgcacaggctcaacgcattctctttgtcgttgacggattagatgagttaaaggtaccaccaggcgcattgatccaggacatctgtggagactgggagaaaaagaagcccgtgccagttctcctggggagcctcctgaagagaaagatgctgccacgggcagctttgctagtgacaacccggcctcgggcactgcgcgaccttcagctgttggcgcagcagcccatatatgttcgagtggagggatttcttgaagaagaccggagagcctattttttaagacattttggtgacgaagatcaggctatgcgcgcttttgagctcatgagatccaatgccgctttgtttcagctggggagcgccccagcagtttgctggatcgtttgcacgacactaaagctgcaaatggagaaaggcgaggatcccgtccccacttgccttacccggactggcctgttccttaggttcctttgctcccgctttccacagggcgcacagctacgtggcgctttacgaaccctgtctctgttagcggcacaagggctgtgggctcagatgtctgtcttccaccgggaagacctcgagagactgggcgtgcaggagtcagacctcagactctttctggacggagatattttgcgccaagatcgcgtatctaaaggatgctacagttttattcacctttctttccagcagtttctgaccgccttattctacgccctggagaaggaagagggagaggaccgggacggtcacgcctgggacattggagatgtgcagaagctattgtcgggcgaagagaggctgaagaatcccgatctgatccaggttgggcacttccttttcggcctagccaatgaaaagcgcgcaaaggaattagaagcaacgttcggttgtagaatgtcacctgatattaagcaggagctccttcagtgcaaggcccacttacatgccaataagcccttgagcgtcactgacttgaaggaggtactaggctgtctgtatgaatcccaggaggaagagctggccaaggttgttgtcgccccttttaaggaaatttcaatacatctaacaaacacttctgaggtcatgcattgcagttttagtctgaagcactgtcaggatttacagaaactcagcttacaggtggccaagggggtgtttctggaaaattatatggatttcgagctcgatatcgagttcgaacggtgtacatacttgacaatcccaaactgggcgaggcaggacctgcggagcctgcgcctctggaccgacttctgctcactttttagctccaatagcaacctgaagttcctggaagtgaagcagtccttcctgtcagatagcagcgtgaggattctatgtgaccatgttacaagaagcacttgccacctccagaaggttgaaatcaagaacgttacaccggacacggcctaccgggatttctgccttgcctttataggaaagaagactcttacccatttgacactggcgggtcacatcgagtgggaaaggactatgatgctgatgctgtgtgacctgctccgaaatcacaagtgcaatctacaatacctgcgcctcggagggcactgtgcgacaccagaacaatgggctgaatttttctacgtgctaaaggctaaccagagcctgaagcacctgcgactcagtgccaacgttctcttggacgagggtgccatgctgctgtataagactatgactaggcctaaacattttctacaaatgctgagtctcgaaaactgccgcctgactgaagccagctgcaaagatctcgccgctgttctagtggtgtccaagaaactaacccacctgtgtctggccaaaaatcccataggtgatactggagtgaaattcctttgtgagggcctttcttaccctgactgtaagctgcaaacactggtactgcagcagtgttcaatcaccaaactgggatgccgctatttatctgaggctcttcaggaggcatgcagcttgaccaatttagacctgagtattaatcagatcgctagggggttgtggatcctgtgtcaagcattggaaaacccaaattgtaacttaaagcatttgaggttgaagacatatgagactaacttggagatcaagaaacttctcgaagaggtgaaggagaagaaccccaagcttacgatcgattgcaacgcatccggcgctacagcccctccctgctgtgacttcttttgctag

SEQ ID NO: 57881 - DNA, 3030 bp, Artificial Sequence
  Description of Artificial Sequence: Synthetic coding sequence
atgacctcccctcagttagagtggacattgcagacactcttagagcaactgaacgaggacgagttaaagtcatttaaaagcctgctgtgggcatttcctttggaggacgtgctccagaagaccccatggtccgaggtggaagaggccgatggcaaaaagttggctgagatcctggtgaacacttcgtcagagaattggattcgcaatgccactgtcaacatactagaagagatgaacctgaccgagctttgtaagatggcgaaagccgagatgatggaggatggacaggtgcaggaaattgacaaccctgaactgggcgatgccgaggaagatagtgaattagcaaagccgggagaaaaggaagggtggagaaattccatggagaagcagagtttagtgtggaagaacaccttttggcagggtgacattgataacttccacgatgacgtgactttaagaaatcagaggtttataccattcttgaatccacgcacccctagaaagttaaccccttacaccgttgtcctccatggacctgctggtgttgggaagaccacgctcgccaagaaatgcatgctggattggacagactgcaacctgtcaccaacactccggtatgccttctacttgtcgtgtaaagagcttagtaggatgggcccttgctcctttgccgaacttatttctaaggactggccggaattgcaggatgacatcccttctatcctggcacaggctcaacgaatcctcttcgtagtggacggactggacgagctgaaggtcccacccggtgctttaatccaggatatctgtggggattgggagaagaagaagccagtccccgtgctgctggggtctcttctcaagagaaagatgctgccgagggccgctctgttggtgactactaggcccagagcattaagagacttgcagcttctggctcagcaaccaatatatgtccgagtggaggggtttttagaggaggataggagggcgtatttccttcggcacttcggcgacgaggaccaggcgatgcgtgcctttgagttgatgcgttcaaatgccgcattattccaactaggtagtgccccagctgtatgctggatagtgtgcactaccctcaaattgcaaatggagaagggggaagatcccgttcctacctgtctgacacggaccggacttttcttgagatttctgtgttcacggtttccccagggggctcagcttcggggagctctgcggactctgtctttactggctgcgcaggggttatgggcacaaatgtccgtgtttcacagagaggatctcgaaaggctgggtgttcaggaatctgacctccgccttttcctcgacggcgacatactcagacaggatcgagtgtctaagggatgctacagcttcattcacctatcattccagcagttcctcacagcacttttctacgccttggaaaaagaagaaggagaggatagggatgggcacgcatgggacattggcgacgtgcaaaagttgctatccggggaggaacgcctgaaaaatccggacctcatacaggtggggcatttcctattcggcctggcgaacgaaaagcgggctaaggagctggaagctaccttcggatgccgtatgtcccctgatatcaagcaagaattgctgcagtgcaaagcccacttgcacgccaacaaacctttgtcagttaccgatttaaaggaggtgctcggttgtctctacgaatcccaagaagaggagctcgctaaggtagtggtggcccctttcaaggaaatatcgattcacttgacaaatacgtccgaagtcatgcactgcagtttcagcttaaagcactgccaggacttacagaagcttagcctccaggtcgccaagggtgtgttcctcgagaactacatggattttgagcttgacatcgaatttgagtccagtaacagcaacctgaaattcttggaagtgaaacagtctttcctgtccgatagctctgtgagaattctgtgcgatcacgtgacccgaagcacctgccacttgcagaaggtggaaatcaaaaacgtcactccagacaccgcttaccgagacttttgtctcgcctttattggaaagaagactctcacacacctgacgctcgccggacacatcgaatgggaacgcacaatgatgctgatgctctgcgacctgttacgcaaccataaatgtaacctgcagtacctgagactgggcggacactgcgcgactcccgagcagtgggccgaattcttctacgtgctgaaagccaatcagagcctgaagcacctgagactttccgccaacgtcctgcttgatgagggcgctatgttgctgtataagacaatgactcgaccgaagcattttctgcagatgctgagtctggagaactgccgcctcacagaggctagctgtaaggacctcgccgctgtcctggtggtgtcaaagaaactaacgcacctgtgtctagctaaaaaccctattggggacactggagtgaaattcctgtgtgaaggcttgtcctaccccgactgtaaactgcagaccctggtgctgcagcagtgctccatcacgaagcttgggtgcagatacctcagtgaggctctgcaggaagcctgctcgttgacaaatctggatttatcaatcaaccagatcgccagaggcctatggatactgtgtcaggcccttgaaaatcccaactgcaatcttaagcacctgcggctgtggagttgctccctgatgcccttctactgccagcatctggggagcgccctgctgagtaatcagaaactggagaccttggatctggggcagaaccacctttggaaaagtggaataatcaagctctttggagtgcttcggcagcggaccggcagcctgaaaattttacggctcaagacctacgaaacaaatttggaaataaagaagctgctggaggaggtaaaggagaagaaccctaagctgaccattgattgtaatgccagcggggcaaccgctccaccatgctgcgattttttctgctag

SEQ ID NO: 57882 - DNA, 2943 bp, Artificial Sequence
  Description of Artificial Sequence: Synthetic coding sequence
atgacctccccccagttagaatggacccttcagactcttctggagcagctcaacgaagatgaattgaagagcttcaaaagcctcttatgggctttcccacttgaggatgttcttcaaaagacaccatggtctgaggtcgaagaggccgatggaaaaaaactggctgagatcctcgtgaacacatcttccgagaactggattagaaacgccactgtgaacatcctggaagagatgaacctgactgaactctgtaagatggcaaaagcagaaatgatggaagacgggcaagtccaagaaatcgataaccccgaactgggggacgccgaagaagactccgagttggcaaaaccaggcgagaaggaaggatggaggaattctatggagaaacagtccctagtgtggaagaataccttctggcaaggcgatattgacaacttccatgacgatgtcacactgcgtaatcagcgcttcatcccgttcctgaatcctagaacacccaggaagttgactccctataccgtggtgctacacggcccagcgggtgtgggaaaaacaaccctggccaagaaatgtatgctggactggaccgattgcaacttgtccccaaccttacgctacgcattttatctcagctgcaaagagctgagtcggatgggtccctgttcattcgccgagctaatttccaaagactggcccgagctgcaagatgacatcccgtcaatcctggcacaggcccagcgcattctgttcgtggtagatgggctggacgagctgaaggtgccgcctggggctttgatccaggacatttgcggcgactgggaaaaaaagaaaccagtaccagtcctactggggtctctgttgaagagaaagatgctgcccagggccgctctgctcgtcaccactcggcctagggccctacgggacctgcagttgctggcacagcagccaatctatgtccgcgtggaggggttcctggaggaagaccgcagggcatacttcttgcggcatttcggtgacgaggatcaggcaatgcgcgcattcgaattgatgcgaagtaatgccgcactgttccagctgggtagtgcacccgcagtgtgctggatcgtctgtaccaccctgaaattgcagatggaaaagggagaagacccagtccccacttgccttacgcgaaccggattgtttttacgtttcctctgcagtagattccctcagggcgctcagctgagaggcgctctgcgcacactcagcctgctcgcagcgcaggggctgtgggctcagatgagtgtctttcatagggaagacttggagcgactcggggttcaggagtctgatctccggctgttcctggacggcgatatactgcggcaagatcgagtgtcaaaggggtgttactcatttatccacctgtcattccagcagtttttaacagctcttttctacgccctggagaaagaggagggcgaagatagggatggccacgcctgggatataggtgacgtgcagaaactgctgtccggggaggaaagactaaaaaatcctgatctaatccaggtgggccactttctgttcggcctagcgaatgagaagcgggctaaggaactggaggcgacgtttggctgccggatgagcccagacatcaaacaggagctcctacaatgcaaggcccacctccacgcgaataagcctctgtctgtcactgatctgaaagaggtgcttggatgcctttacgagagtcaagaggaagaactagccaaggttgtcgtcgcccctttcaaagaaatcagcatccatctgacaaataccagtgaggttatgcattgttctttctccttaaaacactgccaggacctgcagaaactgtctttgcaagtcgccaagggagtgtttctagagaattacatggatttcgagcttgatattgaatttgagagatgtacatacctcacaataccaaactgggccagacaggatttgaggtctcttcgtctttggactgacttctgttcattgttctcttccaactcgaaccttaaattcctggaggttaaacagagcttcctcagcgatagcagcgttagaatcctctgtgaccatgttaccaggagcacatgccacctacagaaagttgagatcaaaaacgtgacacccgacacggcttaccgcgacttttgcctggcctttataggtaagaagactcttacccatctgacgttggccggtcatattgagtgggagaggacgatgatgctcatgctctgcgatctcctgcggaatcacaagtgtaatctgcagtatttgcgtctcggtgggcattgcgcaactcccgagcaatgggcagagtttttctatgtgctgaaagcaaatcagtccctgaagcatctacggttgtcggccaacgtgttgctcgacgaaggagctatgctgctctataagacaatgactagacccaagcactttttgcagatgctatctctagaaaactgccgcttgacagaggcctcctgtaaagatctggcagcagtccttgtcgttagtaaaaagctaacgcacctgtgtctggcaaagaacccaatcggagatacaggagttaagttcctttgtgaagggttgtcttatccagactgtaagctgcagactctggttctacaacagtgctccatcactaaactggggtgcagatacctctcggaagcccttcaggaggcttgctcactaaccaacctcgatcttagcattaatcagatcgcaagaggcctgtggatcctttgtcaggcactcgaaaatcctaattgtaaccttaagcatctgcggttaaagacatatgagacaaatctggagattaagaagttgcttgaggaagtgaaagagaagaatccaaaacttacaattgactgtaatgccagcggagctacagcgcctccatgttgtgatttcttctgttag

SEQ ID NO: 57883 - DNA, 2943 bp, Artificial Sequence
  Description of Artificial Sequence: Synthetic coding sequence
atgacctccccacagttggagtggacacttcagactctcctagaacagttaaacgaagatgagctcaaatccttcaagagtctgctatgggcatttccactcgaggatgtgctccagaaaacaccttggagcgaagtcgaggaggccgatggcaagaaactggctgagatcctggttaatacttcctcagagaattggatacgcaatgccactgttaatatcctggaagagatgaacctgactgaactgtgtaagatggctaaagcagagatgatggaagacgggcaagtacaggagatcgacaaccctgagctgggtgacgctgaggaagacagcgaactggcgaaaccgggtgagaaagagggatggaggaattctatggagaaacaatccttggtgtggaagaacactttttggcagggagacatcgacaactttcacgacgatgttaccctgcggaaccagcgctttatacccttcttgaaccccaggaccccgaggaagttgacaccgtataccgttgttctccacggcccagccggagttggcaagaccaccttagccaagaagtgtatgctcgactggaccgattgtaacctgtcccccactctgcggtacgctttctacttgtcctgtaaagaactatcacggatgggaccctgttcttttgctgagctgatttctaaggactggcccgaattgcaggatgacatcccatccatcctcgcccaggcgcagaggatcctcttcgtcgtagacggattggacgagctgaaggtgcctccaggagccctcatccaagatatttgtggggattgggaaaagaagaagccagtgccagtgttactcggctctctgcttaagcggaaaatgctccctagggccgctctcctggtgacgacgcggccaagggctcttagagatctgcagctcctcgcccagcagcctatttacgttcgggttgagggtttcctcgaggaagaccgtcgggcatacttcctgaggcactttggcgacgaagatcaggcgatgagagcctttgagctgatgaggagcaatgcagcccttttccaactgggcagtgccccagccgtctgctggattgtgtgtaccaccctgaagcttcagatggaaaagggggaagacccggtgcctacctgcctgactcgaactgggctgtttctgaggtttttgtgttcccgcttcccacaaggtgcccagttgagaggtgccctacgaacgttatctctgctcgccgcacaggggttgtgggcccagatgagtgttttccatcgggaagatctggagcgcctaggcgtgcaggagtcggacctccgcctgtttttggacggcgatattctgagacaagatagggtgagtaaggggtgttatagttttatccacttgtcattccagcagttcctgaccgctcttttttacgcacttgaaaaggaggaaggtgaagaccgcgacggccacgcctgggatattggggatgtccagaaactcttaagcggggaggaacgcctgaaaaatcccgacctgatccaggtcggacacttcttattcggtctggctaatgagaagagggcaaaagagctcgaggccacattcgggtgccggatgagtccggatatcaaacaggagctgctccagtgcaaggctcacctacatgctaataagccactttccgtgacagacctgaaggaagtgttaggctgcctttatgaatcccaagaagaggagcttgctaaagttgttgttgcacctttcaaagagataagtattcacctcactaacacttctgaggtcatgcactgtagttttagtctcaagcattgccaggatcttcagaaacttagtctgcaggtggccaagggagtcttcttagaaaattacatggattttgaactcgacattgagtttgagcgctgcacctatttgactatacccaactgggctaggcaggatctacgtagtctacgcctttggaccgacttctgttccttgttcagctctaattctaacttgaaatttctcgaggtgaagcagtcctttttgtcggatagtagcgttaggattctatgcgaccatgttaccagatccacatgtcatctgcaaaaggtcgagattaaaaatgtcacccccgacaccgcgtacagagacttttgtctcgcttttatcggaaaaaagacactgactcatctgaccctggctggccacatcgagtgggaacgcacaatgatgctcatgctgtgtgatctgctgaggaatcacaaatgtaacttacagtatttacggctgggcggacactgtgccaccccagagcagtgggccgagttcttctacgtcctgaaggctaaccagtccctcaagcacctgaggctcagcgccaatgtccttttagatgaaggcgcaatgcttctctataagacaatgaccagaccaaagcattttttgcagatgcttagcctggaaaactgcaggctcactgaggcgtcatgcaaagatctggcagccgtgctggtggttagcaaaaagctgacccatctttgccttgctaaaaacccaattggagacacaggcgtgaaatttctgtgcgagggattatcctaccctgactgtaagttacagacgctcgtgctgcaacagtgcagcatcacgaagcttggttgtagatacttgtccgaagccctgcaagaagcctgttcactgaccaacttggatttgagtatcaaccaaatcgccagagggttgtggattttgtgccaggctctggagaatcctaattgtaacttgaagcacttgcgacttaaaacgtacgagactaacctggagataaaaaaactgctggaggaagttaaggaaaagaatcccaagctcacaatagactgcaatgcatctggggcaacagccccaccttgttgcgactttttctgctag

SEQ ID NO: 57884 - DNA, 2943 bp, Artificial Sequence
  Description of Artificial Sequence: Synthetic coding sequence
atgacatctcctcaattggagtggactctgcagacacttctggagcagctgaacgaagacgaactgaagtctttcaagtccttgttatgggcttttccacttgaagacgtgttacagaagacgccatggtcagaagtggaggaggccgatggtaagaaactcgcggaaattctggttaatactagctcagagaactggattcggaatgccaccgtgaatatcctggaggagatgaatctcaccgaactgtgcaagatggctaaggctgaaatgatggaggacgggcaggtccaagagattgacaaccccgaactgggggatgccgaggaggattccgaactggccaaacctggagaaaaagaaggctggcgcaatagcatggagaagcagtctctcgtctggaaaaacacattctggcaaggcgatattgacaattttcacgatgacgtcaccctcaggaatcagcgctttatacctttcctcaacccaagaacacctcggaagctaaccccatatacagtggttcttcatggcccagcaggcgtgggcaaaacaactcttgcgaaaaagtgtatgctggattggaccgactgcaacttgtcacccacgttaaggtacgccttttatctttcatgcaaggagttgtcacgcatgggaccttgttcgttcgccgaactcatctctaaagattggccagagttacaggatgacataccttcaatcctggcacaggctcagcggattctctttgtagtggacggcctggacgagctgaaggtcccgcctggcgctttgattcaagatatctgtggagattgggagaagaaaaaacctgtcccagtcttgctcgggagcttactcaaacggaagatgctcccaagggccgctttactggttacgactcgtcctagggctctgcgagacttgcagctgctcgcccaacagccaatctacgttagggttgaaggtttcctggaggaagatcgacgcgcatattttctccgccactttggtgatgaggatcaggctatgagggctttcgagctcatgagaagcaacgccgcactcttccagttgggaagcgctccggcagtgtgctggattgtgtgcaccaccctgaagctgcagatggaaaaaggggaagaccccgttcctacatgcctgacacgaacaggcctcttcttgcgcttcctctgttcacggttccctcagggcgctcagctgcgaggcgcactgcgcaccttatcgctactggccgcacagggtctctgggcacagatgtccgtcttccaccgtgaggacctggagcgactgggcgtgcaggaaagtgatctcagattattcctggacggcgatatcctgagacaggatagggtctccaaaggttgctatagtttcatacatttgtccttccaacagttcctaaccgctttgttctacgcgctggagaaagaggaaggtgaggatagggatggacacgcctgggacatcggggacgttcagaagctactgtcgggcgaggagcggctcaagaaccctgatcttatccaagtgggtcacttcctatttggcctcgccaacgaaaaacgagcaaaagaattggaagccaccttcggctgtcggatgagccctgacatcaagcaggaactcctgcagtgtaaggcccacctgcatgcgaataagccccttagtgtaacagatctcaaggaggtgctcggctgcctttatgagtcccaagaagaggagcttgcgaaagtggtggtggctccttttaaggaaatctcaatacacttaacgaatacctccgaagttatgcactgcagcttctctcttaaacattgccaggaccttcagaaattgagtctacaagtagccaagggagtcttcctcgagaactatatggatttcgaactggatattgagttcgagcggtgtacctacttgacaatcccaaactgggccaggcaggacttgcgctctctgcgtttgtggacagatttttgttccctgttctcatctaattctaacctaaaattcctggaggtgaaacagtcctttttaagtgattcaagcgtgcggatcctgtgcgaccacgtgacacgatctacgtgccacttgcagaaggtagaaatcaaaaacgtcacgcctgacaccgcctatagggacttctgtcttgcttttatcggtaagaagaccctgacacacctgactcttgccggtcatatcgagtgggagagaacaatgatgctgatgctctgtgacttactccggaatcacaagtgtaatcttcagtatttaagattgggcggacattgcgcaactccagagcaatgggcagagttcttctatgttctcaaagccaaccagtctctgaaacatctgcggcttagcgctaacgttctgcttgatgaaggcgcaatgctgttatataaaacaatgacgagaccgaagcactttctccaaatgctgtctctcgaaaactgtagactgaccgaggcgtcgtgtaaagatttagccgcagtcctggtggtgagtaagaaactgactcacttgtgtctggctaagaaccctatcggagacaccggcgtgaagtttctctgtgagggcctgtcatatcccgactgtaagctccaaaccctggtcctgcagcaatgcagcatcaccaagctggggtgtcgatacttatccgaagccctccaagaagcatgctctctcaccaacctagatcttagcattaatcaaatcgccagaggtctgtggatcctctgccaagcgctggagaacccaaactgtaacctgaaacacctgaggctgaagacgtatgaaacaaacctggaaattaagaagctattagaggaggtcaaggagaagaaccccaaactaaccatcgactgtaatgcttcaggcgcaactgccccaccatgttgcgattttttctgttag

SEQ ID NO: 57885 - DNA, 3198 bp, Artificial Sequence
  Description of Artificial Sequence: Synthetic coding sequence
atgtctaggaagcatcgcctggaggcacgcccagacttacgcgaattcttttctctgaacttgcgttcgcatacaagatctaccatgacatccccacagttggaatggactcttcagactcttctcgaacaactgaacgaagatgagctgaagtcctttaagtcattattgtgggcatttccgttggaagacgtcctgcagaagacaccatggtccgaagtggaggaggctgatgggaaaaagctcgccgaaatcctggtgaatacaagcagcgaaaactggatacggaatgccaccgtgaacattttagaggagatgaacttaaccgaactttgcaaaatggctaaagccgagatgatggaagatggtcaggtacaggagatcgataatcctgaattgggagatgctgaagaagactcggagctggctaaaccaggggagaaggaaggatggcgaaatagtatggagaaacagtctctggtttggaaaaataccttttggcagggggacatcgacaatttccacgatgatgtgaccctccgcaatcagagatttattcctttcctgaatccaaggacccccaggaaactgactccttacacagtcgttctgcacggaccagctggggtgggaaaaaccacattagccaaaaaatgcatgcttgattggacagactgtaatctaagccctactctccgttacgccttttatctaagttgtaaagaactgagtaggatgggaccctgcagtttcgcagaactgatcagcaaggactggccagagcttcaggacgacattccctctatccttgcgcaggcacaaagaattttgttcgtggtcgacggcttggacgaattgaaggtgccgccaggggcactgatccaggacatctgcggagattgggagaagaagaagcctgtcccggtgctgctggggtctctgctcaagagaaaaatgttaccccgagcagcacttctggtgacgacccggccacgggcattgagggacctgcaactcctggcgcagcagccaatctacgtccgcgtcgaagggtttctcgaagaagatcggcgagcatacttcctaagacattttggagacgaggatcaggcaatgcgagcatttgagctgatgagaagtaacgccgctctgttccaacttgggtcggctcctgcggtctgctggatcgtgtgtactaccctgaaactgcaaatggagaaaggagaagatccagtacccacctgcctgacacgaactggtctgtttctgagatttctctgtagccgcttccctcagggagcccaactacgtggggcactccgtacactcagcctcctggctgcacagggcctctgggcacagatgagtgtgttccaccgggaggatcttgaacgtctcggagtacaggaaagtgacctacggctcttcttggatggagatattctccgccaggaccgcgttagcaaaggttgctattcgttcatacatctgtctttccagcaatttttgaccgcgttgttctacgctctcgagaaagaggagggtgaagatcgagacgggcatgcctgggacattggcgatgtccaaaaactcctgtccggggaagaacggctgaaaaaccccgatctcattcaggtggggcatttcctgttcggactggctaacgagaaacgggctaaagaactggaagccacctttgggtgtaggatgagcccggacattaagcaggagctgcttcagtgcaaagctcatctgcacgcaaacaagcctctgagcgtaaccgacctcaaggaggtcctgggttgcctatacgagagccaggaggaagaacttgccaaggtggtggtggctcctttcaaagaaatctcaatacacctcacaaacaccagcgaagttatgcattgctccttctctctcaaacattgccaggacttgcagaaattgagcctacaggtcgctaaaggagttttccttgagaactacatggattttgagctcgacattgagtttgaaagatgcacatacctcaccatcccaaattgggcccgtcaggatcttcgatctctccgtctatggaccgacttctgcagcttgtttagtagtaactctaacctgaagtttctcgaagtaaaacaatcctttctgtcagattcaagcgtgagaattctctgtgaccatgtgacaagatctacttgtcacctacagaaggtggagataaaaaacgtgaccccagatacagcctacagggacttctgcttggcgtttattggtaaaaagaccttgacacatctgacactagccggtcacatagagtgggaacgcactatgatgctaatgttgtgcgatttgcttagaaaccataaatgcaacttacagtacttaaggctgggagggcactgtgctactccagagcagtgggccgaattcttctacgtcctcaaggcgaaccagtctttgaagcacctgcggttatcagcaaatgtgctcctggatgagggtgccatgttgctttacaagaccatgacgcgccctaagcattttctccagatgttatcattggaaaattgcaggttgacagaagcaagctgtaaggacctggctgcggttcttgtggtgagcaagaaactgacccacctgtgtctggccaagaaccccataggtgataccggggtcaaatttctctgcgaaggattgtcatacccagactgtaaactgcagacgctggtcctccaacagtgctcaattacaaaactggggtgtagatacctaagcgaggccctgcaagaagcatgcagcctcacaaatcttgacctgagcattaatcagatcgcacgtggattgtggattctttgtcaggccctggagaaccctaactgcaatctgaagcacctgcgactctggagctgctctctcatgcctttctactgtcagcacctgggatccgccctactgtccaatcagaaattggaaacactggatctgggccagaaccatctgtggaagagcgggattataaaactcttcggtgtgctgcgacagagaaccgggtccctgaagattctgaggctgaaaacctatgagaccaacctggagatcaagaagctgcttgaagaggtgaaagaaaaaaacccaaaactaaccatcgattgtaatgcctcaggcgctactgccccaccatgctgtgactttttctgctag

SEQ ID NO: 57886 - DNA, 3198 bp, Artificial Sequence
  Description of Artificial Sequence: Synthetic coding sequence
atgagcaggaagcatcggctcgaggctcggccagatcttagggagttcttttccttaaacctgagaagccatacgaggtctaccatgacctcccctcagctggagtggaccctccagacacttttggagcagttgaatgaggacgagctgaaaagctttaagtctctgctgtgggcgtttcctctagaggacgtcttgcaaaagaccccatggtcggaggtagaagaagcggacggtaaaaagctggctgaaattctggttaacactagttccgaaaactggatccgtaacgctacggttaacattctggaagagatgaatctcacagaactgtgcaagatggccaaggctgaaatgatggaggatggccaggtgcaggaaattgataatccggagttgggtgatgccgaagaggactcagagctagctaagcccggagaaaaagagggttggaggaatagcatggagaaacagagtttggtgtggaagaatacgttctggcagggggacatcgacaatttccatgacgatgtgacgcttcgaaatcaaaggttcatcccgttcttgaatccacgcactcctcgcaagttaaccccctataccgtggtcctccacggaccagccggtgtcggcaagaccacactggccaagaaatgcatgctcgactggaccgattgcaacctgtcacctaccttgcgttatgccttttacttaagttgcaaggagttgtcaaggatgggaccctgcagctttgccgagttgatcagcaaggattggcctgagctgcaggatgatattccttcaatcctggcccaggcccagaggatactgttcgtggtggatgggctggacgagctgaaagtgccccctggagccctgattcaggacatttgcggcgactgggagaaaaaaaagccagttccagttctcctggggtctctgctgaagcgcaaaatgttacccagggccgcactcttagtcaccacccgcccaagggctctacgggacctacagttgttagcccaacaaccgatctacgtccgggtcgagggctttctagaagaggatcgcagagcatatttccttcggcattttggggacgaggatcaggcgatgagggcatttgagttaatgcgaagcaacgcagcccttttccagcttggatccgccccagccgtgtgctggatcgtgtgcaccactcttaagctacagatggagaagggcgaagaccccgtccctacctgcctcacacggactgggctgtttctcaggtttctctgtagtcgtttccctcagggtgcccaactgcggggagctctccgcaccctgtcactattggctgctcagggcctctgggctcagatgagcgtgttccatcgagaagatctcgagcggcttggtgtgcaggagtctgatctacgactgtttctggatggtgacatattgcgtcaggaccgtgtctctaagggttgctactctttcatccacctatccttccagcagtttttaacagctttattttacgcacttgagaaagaggaaggtgaggaccgtgacggccacgcatgggacatcggggacgttcagaagttgttgtcaggggaggaacggctgaagaatcctgaccttatccaggttggtcactttctgttcgggttggcaaatgagaaacgcgcaaaggagttggaagctacgtttggatgtcgcatgagccctgatataaagcaggaactcttgcaatgcaaggcccatctacatgctaacaaacctctatccgtgacagacttgaaagaagtgctcggctgcctttacgagtcccaagaggaggaacttgctaaggtagtagtagccccattcaaggagatttctatccacctaaccaacacgtcagaggtgatgcactgctctttttctctcaagcactgccaggatctgcaaaaactctcacttcaggtggccaagggtgtgttcctagaaaattacatggattttgagttggatatcgagtttgagagatgcacttacctgaccatacccaactgggccagacaagacttaaggagcctgaggttgtggaccgacttctgtagcctgttttcaagcaactctaatctgaagttccttgaggttaagcaatcattcctgtctgactcttctgtaaggattttgtgtgaccacgtgaccagaagcacatgtcaccttcaaaaagtggaaatcaagaatgtcactccggacactgcttatcgagatttctgccttgcctttatcggcaaaaagaccctgactcatctcaccctggctgggcacattgaatgggaaaggacaatgatgctgatgttgtgtgatctgttgagaaaccacaagtgcaacctacagtacctgagattaggcggacattgtgccactccggagcaatgggctgagttcttttacgttctgaaggccaatcagtccttaaagcatttgagactatccgcaaatgtccttctcgatgaaggcgcaatgttgttgtataaaactatgactcgaccgaagcactttctgcagatgctgtcccttgagaactgtagactaacagaagcctcatgtaaagaccttgccgctgtactcgtggttagcaaaaaactgacacacttgtgccttgccaagaaccctattggagacacaggagtgaaattcctgtgcgagggcttgtcttaccccgactgcaaacttcagaccctggtgctgcagcagtgcagcataaccaaattaggttgcagatatctgtctgaggcactgcaggaggcctgctctttaactaatctggatctaagcatcaaccagatcgcccgagggttgtggattctttgtcaagctttggagaatcctaactgtaacctcaaacatctgcggctgtggtcctgtagtctgatgccgttttactgccaacatctggggagtgccctgttgtctaaccagaaactggaaactcttgacctgggacagaaccacctctggaagtcaggcataattaaactattcggtgtgctgagacagcgcacaggctcgctcaaaattttgaggcttaagacatatgaaacgaacctagagattaaaaaactcctggaggaggtgaaggagaagaatccaaaattgacgatagactgcaacgcatctggtgctacggctccaccctgttgcgacttcttctgctag

SEQ ID NO: 57887 - DNA, 2943 bp, Artificial Sequence
  Description of Artificial Sequence: Synthetic coding sequence
atgacttcaccgcagttggaatggacactgcagaccctactcgagcagttgaacgaggatgagcttaagtcctttaaatcattgctttgggcctttccactggaggatgtgcttcagaaaaccccatggtctgaggtcgaagaggccgatggaaagaagcttgcagagatactagtgaacaccagttcagagaactggatcagaaacgccactgtcaatattctggaggaaatgaatctcaccgagctgtgcaagatggctaaggctgagatgatggaagatggtcaggtccaggagatagataatcctgaactcggggatgcagaggaggactccgagctggccaagccaggagaaaaagaagggtggcgcaatagcatggaaaagcagagcctcgtgtggaaaaacactttttggcagggggacatagacaattttcacgatgatgtgacactcagaaatcagcggttcataccctttctaaacccacgtacccctcgcaagcttactccgtatacagtggtcctgcacggcccagccggtgtgggaaaaacaacacttgctaaaaaatgcatgctggactggacagactgcaatcttagccccaccctgagatatgccttctacctcagctgcaaagagctttcaagaatgggaccatgctcattcgccgagctgatatcaaaagattggccagagttgcaagatgatatcccctccatcctagcgcaagcgcagcgcatcctattcgtggttgacgggctggatgaactgaaggtacccccaggggcactgatccaggatatttgcggtgattgggagaagaagaaaccagtacccgtgctgctgggttccctgctgaagcggaaaatgctgcccagagccgctcttctggtaaccactcgtccacgagcactgcgcgacttacagttacttgcgcagcaaccgatatacgtccgcgtggagggattcttggaagaagataggagagcctactttctcagacactttggagacgaggatcaggctatgagggccttcgagctgatgcggtccaacgcagcactgttccagctggggtctgcccctgctgtgtgctggatcgtctgcaccacccttaagttgcaaatggagaaaggcgaagaccctgtacccacctgtctgacaaggacagggttgtttctcaggtttctctgcagtagattcccccagggagctcagttgcgcggagctttgcggaccttatcccttctggcggctcaaggactctgggcccagatgtcagttttccaccgggaggatctggagcgcctgggcgtacaggagtcggacttaaggttgtttcttgacggtgacatcctccgccaggaccgggtgtcgaagggttgttatagctttatccacctcagttttcagcagttcctcacagctctgttttacgcactggaaaaggaggaaggagaagatcgggatggccatgcttgggacatcggagacgtccaaaagctcttgtccggcgaggagcgactgaagaatcctgatctgattcaggttgggcacttcctgtttggcctcgctaacgaaaagcgggctaaagagctcgaggctacgttcggctgccgaatgtcccctgacatcaagcaagagcttctccaatgcaaggcacaccttcacgccaataagcctctgagcgtcaccgatcttaaagaggttctcggctgtctgtacgaatcacaagaagaggagcttgctaaagtggtggtggctcccttcaaggagatatccatacatctgacaaatacttcagaggtcatgcactgtagcttctcactgaagcattgtcaggacctgcagaaactgagcctgcaagtggccaaaggcgtgttccttgagaactacatggattttgagctggatattgagttcgaacggtgtacttaccttaccattcccaactgggctcggcaggacctccgcagtctcagactgtggacggatttctgctcactcttctcttcgaattccaatctgaagtttctggaggtaaaacagagctttctttccgattcttctgtccgaatcctctgcgaccatgttacacggtctacctgtcatctccagaaggtggagattaagaatgtcactccagatacagcgtacagggacttctgtttagctttcattgggaaaaaaacactcacgcatcttactttagctggccacattgaatgggagaggactatgatgctcatgctgtgtgatctacttcggaatcataagtgtaaccttcagtacctgcgcctggggggacactgtgctacacccgagcagtgggcggaatttttctatgttcttaaggccaatcagtctttgaaacatctgcgtctgtcagccaacgtgttactggacgagggcgctatgctgctctacaagactatgactagaccgaaacactttctgcaaatgctctctctggagaattgcagactgactgaagcatcctgcaaggatctcgctgccgttcttgtcgtgagcaaaaaacttacgcacctttgtttggccaagaatccgataggggacaccggcgtcaagtttttgtgcgaggggttatcctatccggattgcaaactgcaaacactcgttctgcagcaatgttccattacaaaacttgggtgcaggtacttatccgaggctctccaggaggcgtgctcactaaccaacttggatctatctatcaaccagatcgcccgaggcctttggatactgtgccaggctttagagaacccgaattgtaatctaaagcatctgcgcctgaaaacctacgagaccaatcttgagattaagaaactgctggaggaggtgaaggagaagaatcctaaacttactatcgattgcaacgcttcaggggctaccgctcccccttgctgcgattttttttgctag

SEQ ID NO: 57888 - DNA, 3030 bp, Artificial Sequence
  Description of Artificial Sequence: Synthetic coding sequence
atgacgagcccccagctcgaatggactctacaaacactgttggaacagctgaatgaggatgagctgaagagctttaaatccttgctctgggcttttcctctggaggatgtgctgcagaaaaccccctggagcgaggttgaggaggccgacggcaagaaactcgccgagattcttgtgaatacctctagtgagaattggattaggaacgctacagtgaatatactagaggagatgaacctcacagagctctgcaaaatggcaaaagccgagatgatggaggacggccaggtccaggagattgataaccccgagctgggagatgcagaggaggactcggagctggccaagcctggagaaaaggaaggctggagaaactctatggaaaaacaatccctggtatggaagaatactttctggcaaggagacatcgacaactttcatgacgacgtcacactgagaaaccagaggttcattcccttcctgaatccgagaactccccgaaaactgaccccttacaccgtcgtcctgcatggtccagcaggggtgggcaaaaccaccctagccaaaaaatgtatgctcgactggaccgattgcaatctgtcacccacccttaggtacgctttttacctgtcatgtaaggagttatctcggatgggcccatgtagctttgccgagttaattagcaaggactggccggagctgcaggacgacattcctagcattctggcccaggcccagaggattctcttcgtggttgatggtcttgacgagctgaaggtaccccctggggctttaattcaggatatctgtggggactgggaaaaaaaaaagccagtccccgtcctcctgggttctcttttaaaacggaaaatgctgccccgtgctgccttactggttaccactagaccaagagcgctaagagacctgcagctgttagcacaacagcccatctacgtgagagtggagggcttcctagaggaagacagacgcgcttatttcctgagacacttcggggatgaagatcaggccatgcgagcctttgagctaatgcgctccaacgctgccctcttccaactgggtagcgcgccagcagtgtgctggatagtctgtaccacccttaagctgcagatggagaagggcgaagatcctgtgccaacctgcctgacccggaccggattgtttttaaggtttctgtgttcgaggtttccgcagggggcacagcttcgcggagccctgagaacgctatctctcctggctgcccaagggctgtgggcccagatgtcagttttccaccgagaggacttagaaagactcggggtgcaggaatctgatcttaggttgtttctggatggtgacattcttaggcaggatcgcgtatccaagggctgttacagttttatccacctcagttttcagcagttcctcaccgctctcttctatgcgttggagaaggaggagggggaagaccgtgatggtcacgcatgggatatcggcgacgtgcagaagctgctcagcggcgaagagcggctgaaaaatcccgatctgatacaggttggtcattttctgttcggactggcaaatgagaagagagcgaaagaacttgaagcgactttcggctgccgaatgagcccagacattaaacaggaacttctgcagtgtaaggcccatctccatgctaataagccgctcagcgtgaccgacctaaaagaggtgctgggctgcttatacgaaagtcaggaggaagagctggcaaaagttgtcgtcgcaccctttaaagagattagcatccacctcacaaatacctcggaggtcatgcactgtagcttttctctaaaacactgtcaagatctgcagaagttgtcactgcaagtggcaaagggagtctttctggaaaattatatggacttcgagctggacattgaatttgagagctccaattcaaatctgaagtttctggaggtgaaacaatcctttctttcggatagctctgtgaggatactgtgcgatcatgtgacgcgcagcacatgccacctgcagaaagtggagattaaaaacgttactccagacacggcttaccgggacttttgtctcgcctttatcggcaagaaaacacttacacacctgaccctcgccggtcacatcgaatgggagcggacgatgatgctgatgctctgtgacctcctgaggaatcataagtgcaatcttcaatacctccgcctggggggtcactgcgcaacaccggaacagtgggccgagttcttttacgtgctgaaggcaaatcagagtcttaagcatttgcgtctctcggcaaatgtactgcttgacgagggagccatgctgctgtacaagacaatgacacgccctaagcattttctgcagatgctctcgctggagaattgcagattgaccgaggcgtcatgcaaggatctggcggctgtgctggtggtcagcaagaagttgacacatctctgcctagccaaaaacccgatcggtgataccggagtaaaattcctttgtgaaggcctgtcctacccagattgcaagctccaaacgctggtcctgcagcagtgctccataacaaagctcggctgccgatatctgtctgaggcgctgcaagaagcatgttctctgaccaatctggacctgtccatcaaccaaatagctaggggtctatggattctatgccaagcactggaaaacccgaattgcaacttaaagcacctgcggctctggagctgttcgcttatgccattctactgccaacatcttggttcggcccttttaagtaatcaaaaacttgagaccttagacctggggcagaaccatctgtggaaaagcggcattataaagctgtttggcgttctacggcagaggactggttccttaaagattctgcgcttgaagacatacgaaaccaacctggagataaaaaagctcctggaggaggtcaaagagaagaatcctaagctgaccatagactgtaacgcgtctggagctacggcgcctccctgctgcgacttcttctgctag

SEQ ID NO: 57889 - DNA, 3030 bp, Artificial Sequence
  Description of Artificial Sequence: Synthetic coding sequence
atgacatccccccagcttgaatggacactgcagactctgctggagcaactgaacgaggatgaattgaaatcatttaagtctctactgtgggctttccctttagaggacgtattgcagaagacgccctggtcagaagtggaggaggccgacgggaaaaagcttgcggaaattctcgtgaacacttcgtctgagaattggattagaaatgccacagttaacatacttgaggagatgaacctgaccgagctgtgcaagatggccaaagctgagatgatggaggatggccaagtgcaggaaattgacaacccagaactcggcgatgctgaagaggacagcgagctggcaaaaccaggagagaaggaaggttggagaaactccatggagaagcagagcttagtatggaaaaatacgttctggcagggagatattgacaacttccacgacgatgtgactctgcggaaccagagattcatccccttcctgaaccccaggaccccgaggaagttgaccccgtacacggtggttctgcacggacccgcaggcgttggcaagaccacattggcaaagaaatgtatgctagactggactgactgtaatctaagtcctacattgagatacgccttctatctgtcatgcaaagaactgagtagaatggggccatgctcattcgccgaactgatcagcaaggactggcccgagctccaagacgatataccttctatcctggcgcaagcacaacggattttgtttgtggtcgatggcctggacgaacttaaagttcccccaggagccctgattcaggatatttgtggtgactgggagaagaagaaacctgttccagtcctgttgggctctttgctgaagagaaagatgctcccacgcgctgcgctgctggtcaccactcggccaagggcactccgtgacctgcagttgctggcccagcaaccgatttatgtgcgcgttgaaggcttcctagaagaagacagacgagcctatttcttgcgccactttggcgacgaagaccaggccatgcgggcttttgagctgatgcgttctaatgctgctcttttccaattgggtagcgcccctgccgtctgctggattgtgtgcacaacactgaaactgcaaatggaaaagggcgaagacccagttccgacctgtctgactcgaactgggcttttcctgcgctttttatgttctagattcccccagggtgctcagctgcgcggagccctccgaacacttagcctgttggccgcacaaggcctctgggctcagatgagtgttttccaccgcgaggatttagaaaggctcggagtgcaagagagcgatctgaggctgttccttgacggtgacatactgaggcaagacagggtgagtaaaggatgctactccttcatccacctctcattccaacaatttcttactgctctgttctatgcattggagaaagaggagggggaggatcgcgacgggcatgcttgggacattggcgacgtgcagaaattgctgtccggcgaagagagactgaagaaccctgatctaatccaagtgggacacttcctgttcggattagccaacgagaaacgtgctaaagagttggaagccactttcgggtgtagaatgagccctgatataaaacaggaactgctgcagtgcaaagcccacctgcacgccaacaagccactcagtgtgacggatctgaaagaagtcctggggtgcctgtacgagtcccaggaagaggagttggccaaggtcgtggtggccccattcaaagaaattagcatacacctcacaaatacaagcgaggtaatgcactgcagcttttccctgaagcattgccaggatcttcagaaactttccctgcaggttgcaaaaggagtgttcctggaaaattacatggactttgagctagatattgaattcgagtcatcaaattcgaatctgaagtttctcgaggtgaagcagagctttttgagtgattcttccgtgcgaatcctatgtgaccacgtcactcggagcacctgtcacctacagaaagtggagattaagaacgtgacccctgataccgcttacagggacttttgcctggccttcattgggaaaaaaacactcacacatctgacgctggctggtcatatcgagtgggaaaggactatgatgctgatgctttgcgacctactcaggaaccacaagtgtaacctgcagtacttacggttaggcggtcactgtgccactcccgagcagtgggcggagtttttttatgtgttaaaagccaatcagagcctgaagcatctgcgattatctgccaacgtcttgctggatgagggagcaatgcttttatacaagacaatgactcgcccaaaacactttttgcaaatgctgtctcttgagaattgccgccttacagaagccagctgtaaagatctggccgcagttttagttgtttctaaaaaattgactcatctgtgcctggctaaaaatccaattggcgacactggcgtgaagttcctgtgcgaaggcctctcttatccagactgcaagctgcaaaccctcgtgttgcagcagtgcagcataacaaaacttgggtgcaggtacctctctgaagccctccaggaagcctgctcacttaccaatctcgatctatcaataaatcagatagcccgtggactgtggattctgtgccaagccctggagaatcctaactgcaatctgaaacatcttcgtctatggagctgctcccttatgccattctactgccagcacctgggcagcgcactgctcagtaaccaaaaattggaaacgcttgacttgggccagaatcatttatggaagtccggcattattaaactatttggcgtcctcaggcagcgaacaggatccctaaagatactcaggctgaaaacttacgagacaaatcttgaaataaagaagttactggaagaggtcaaagagaagaatcccaagctgaccattgactgtaatgctagtggagccaccgctccaccctgttgcgacttcttttgctag

SEQ ID NO: 57890 - DNA, 3198 bp, Artificial Sequence
  Description of Artificial Sequence: Synthetic coding sequence
atgagcaggaagcaccgactggaggctagacccgacctcagagagttcttcagtctgaacctgagaagccacacacgctccaccatgacatctccacagctcgaatggactttacagacgttattggaacagctgaatgaagacgagctaaagtcctttaagtcactcctctgggcttttccccttgaagatgttctgcagaaaaccccatggtcagaggttgaggaagccgatggaaaaaagttggccgaaatactcgtgaacacctcctccgaaaactggatcagaaacgcaaccgtgaacatcctcgaagagatgaacttgacagaactttgcaagatggcaaaggctgagatgatggaggacgggcaggttcaagagatcgacaaccctgaactgggtgacgccgaggaagacagtgagctggccaagccgggagagaaggagggctggcgtaacagtatggaaaaacagtcactggtctggaaaaataccttttggcagggagatatcgacaacttccacgatgatgtgacactgcggaatcaacgctttatcccttttctgaatccgagaactccgaggaaattgacgccttataccgtggtacttcacggacctgctggggttggaaagacaacacttgccaagaaatgtatgttagactggactgactgtaacctgtcccccactctgcgatatgccttttacttgtcttgtaaggagttgtccaggatggggccatgttcatttgctgaattgatttctaaggactggccagagttgcaggacgatatacccagcattctcgcacaggcgcagcgcatcctctttgttgtagacggactagatgaactaaaagtgcctcccggagctctgattcaggacatttgcggagattgggagaaaaaaaaacctgttcccgttctgttaggatcacttctgaaaagaaaaatgcttccccgagccgcattactggtgactactcggcctagagccctgagagatctgcaacttctcgcacaacaacccatctatgtgcgagtcgaagggttcctggaagaagatcgacgtgcttattttctgcgccactttggggatgaagatcaagctatgagggctttcgagctcatgcgtagtaatgccgctttgttccaattgggctcagcacccgcagtttgttggatcgtatgcacaactcttaagctgcagatggagaagggcgaggacccagtccctacctgcctgacaaggacaggcctgtttctgcgatttctctgctcccggtttccacaaggcgctcagttacgcggagccctcagaactctatctctgctggcggctcagggactgtgggcccagatgagtgtcttccaccgggaggatctcgagaggttgggggtccaagaatctgacctgagactgttcctggatggcgacattctccgccaggatcgggtgtccaagggatgctactcgttcattcacctgtccttccaacagttcctgacagcccttttctatgctttggaaaaggaggaaggagaagatagagacgggcatgcctgggacatcggcgatgtgcagaaacttctgtccggagaagagaggctcaaaaaccctgatctgatccaagtggggcactttttgttcggcctggctaatgagaaacgggctaaggagttagaggcgactttcggctgtaggatgagcccagacattaaacaagagttactgcagtgcaaggcgcacttgcatgctaacaagccactgagtgtcacagaccttaaagaagtgctgggttgtctgtacgaaagccaggaagaggagttggctaaggtggtcgtggcacccttcaaggaaatctcaatccatctcacaaatacttcagaggtgatgcactgctctttctccctaaagcattgccaagacctgcagaaattgtctctgcaggttgcaaagggcgtttttcttgagaactacatggatttcgagctggacatcgagtttgagcggtgtacatacttaactattcccaactgggctcgccaggatttgcgatctctaagattgtggacagatttctgcagcctcttcagctcgaatagcaatctgaagtttctagaagttaagcagtcatttctttccgatagctctgtccgcatcctgtgcgatcatgtaactaggtctacttgtcatctacagaaggttgaaatcaagaacgttactcccgacacggcctaccgggatttctgtttagctttcattggcaagaagactttgacccatctgactctggctggccatatcgaatgggagagaactatgatgcttatgttatgcgatcttctgagaaatcataagtgcaatctccagtatttaaggctggggggtcattgtgccactcctgaacagtgggctgagttcttctatgttcttaaagccaatcagtccctgaagcatctcaggcttagcgcaaatgtgctcctcgatgaaggcgcaatgctgttgtacaagacaatgacgagacctaagcacttcctgcaaatgctgagtctggaaaattgccggctgacagaggcatcatgcaaagacctagcagcagtgttggtcgtcagcaaaaagctgacacatctgtgcctcgccaagaatcctattggggatacgggcgtgaagttcttgtgcgaaggtctgtcttatcctgattgtaagttgcaaaccttggtcttacaacagtgctctattactaaattgggatgccgttacctgtcagaggcgcttcaggaagcctgctccttaaccaatctggatctgagcattaatcagatcgctagaggactgtggatcttatgccaggcactcgagaatcctaattgtaaccttaaacatctgaggctgtggagttgctctctcatgccgttttattgtcagcacttgggatctgcccttctatccaaccaaaagcttgagacactggatctcgggcagaaccacttgtggaaatctggaattattaagctgtttggcgtgttaagacaaagaacgggctcacttaaaatacttcgtctgaaaacgtatgaaaccaatctcgagataaagaagctgctggaggaagtgaaggagaagaatccaaaactcactatcgactgcaatgctagtggtgcgacggcacccccttgttgtgattttttctgttag

SEQ ID NO: 57891 - DNA, 3114 bp, Artificial Sequence
  Description of Artificial Sequence: Synthetic coding sequence
atgacttcgccccagcttgagtggactctccaaaccttgctggagcagctgaatgaggatgaactgaagagcttcaaaagtcttctgtgggcattcccactggaggatgtcctccagaaaactccttggtccgaggtggaggaagcagacgggaagaagctcgcagagatcctggtcaacacgagctccgagaactggatcaggaatgctactgtgaatattttagaagagatgaacttgaccgagctgtgtaaaatggctaaagcagagatgatggaggacgggcaggttcaagagattgataaccctgaactgggggacgctgaggaagattcagagctcgctaaacccggagaaaaagaaggttggcgcaattcaatggagaagcagtcattggtatggaagaacactttctggcaaggtgacatcgataattttcatgacgatgtgaccctcagaaaccagcgattcatcccattcctgaaccctagaactccacgaaaactgacaccgtatactgtggtgctgcacgggcctgccggtgtggggaagacaacactggcgaaaaagtgcatgctagattggacagactgcaacctcagtcctacgctcaggtatgcattttacctgtcctgcaaggaactgtccaggatgggcccttgttctttcgcagagcttatctctaaagactggcccgagctccaggatgacattccttccattcttgcgcaggctcagcggatattatttgtggtagacggactggacgagctcaaggtgcctcccggagcgttgatccaggacatatgtggcgactgggagaaaaaaaaaccagtgccagtcctgttaggaagtctccttaagcgaaagatgttacctagggccgctttactggtgacaacgaggcccagggctctgagggacctgcaattattggcccaacaacccatttacgttagagttgaaggcttcctggaggaagataggcgtgcctatttcctgagacattttggcgatgaagaccaggccatgcgggctttcgagctgatgaggtccaatgccgcactgttccagctggggagtgcccctgcggtctgctggatcgtgtgcactacccttaaactccagatggagaaaggtgaggatcctgtaccaacctgcttgacccgaacgggcctcttccttaggtttctgtgttcgcgctttcctcaaggggctcagttacgcggagccctcagaactctttcattgcttgccgctcaggggctgtgggcccagatgtctgtgttccaccgggaggatctggaacgcctaggagtccaggagtccgatttaagactcttcctggacggcgatattttgcggcaggacagagtgagcaagggctgctatagctttatccacctgtctttccaacagtttctcaccgctctattctatgcactcgagaaggaggaaggcgaagatagagatggccatgcctgggacattggagatgtgcagaagcttctctctggggaggaaaggctgaagaacccagatctaattcaggtcggtcactttctgtttggcctagctaatgagaagcgagctaaagaactggaagcgacctttggatgtagaatgtccccagatattaaacaggagctcctccaatgtaaggctcacctgcacgctaacaagcccctgtctgtgactgacctgaaggaagtgctgggctgtctgtacgagtcacaggaggaagaactagcaaaagtggttgttgctcccttcaaagagatttcgatccaccttacaaacacctccgaagtcatgcactgcagcttctcactgaagcattgccaggacctacaaaagttatctctacaggtcgccaaaggggtcttcttagagaattacatggattttgagctggacatcgagttcgagaggtgcacatacctcaccattccaaattgggctcgccaggaccttagaagtcttagactctggaccgatttttgctccctgttctccagtaactccaatcttaaattcctggaggtgaaacagagctttctcagcgattccagcgtccgtatcctttgtgatcatgtgaccagatcaacctgtcacttgcagaaggtagagatcaagaacgtaacacctgataccgcatatcgagatttctgcctggcttttatcgggaagaaaaccttgacacacttgaccctggctggacatatcgagtgggagcggacgatgatgttgatgctgtgtgacctgctgcggaatcacaagtgcaacctgcaatacctgcggctgggcggacattgcgctaccccggagcagtgggctgagttcttctatgtgctgaaagccaatcagagcctcaagcatctgcgactctccgctaatgtgttactagacgagggtgccatgcttctctacaagactatgactcggcctaaacactttttacagatgctaagcctcgaaaattgccggctgacagaggccagctgtaaagacctcgcggcagtcctggtcgttagtaagaagctgactcatctctgcctggccaagaaccctattggtgacacgggcgtgaaattcttatgcgaagggctgagttatccagactgcaagctacagaccttggtactgcagcaatgcagcatcacaaagctggggtgtagataccttagcgaagccttgcaagaagcctgcagtcttacaaacctggatctgagcatcaatcagattgccaggggattgtggatactgtgtcaagctctcgagaatcccaattgtaatctcaagcacctccgtttgtggtcttgctcattaatgcccttctattgccagcacctgggcagtgccctcctgtctaaccaaaagctggaaacactggacctgggacaaaaccatttgtggaagtcagggataataaaattattcggcgttctccgccaaagaacaggttcactgaagatcctaagattaaagacctacgaaactaaccttgaaatcaaaaaactattggaagaggttaaggaaaaaaatcctaaactgacaatcgactgtaacgcatcaggtgcaacagctccgccatgctgcgacttcttctgctag

SEQ ID NO: 57892 - DNA, 3114 bp, Artificial Sequence
  Description of Artificial Sequence: Synthetic coding sequence
atgacatccccccagctcgaatggaccctccagacacttctcgagcagctgaacgaagatgagttaaaatcctttaaatcacttttgtgggccttccccctcgaggatgtgctccagaagacaccatggtcagaagtggaagaggctgacggaaagaagttggccgaaatcctggtgaacaccagttccgagaactggatcagaaacgccactgtcaacatccttgaggagatgaatctgacggaactctgcaagatggctaaagcagagatgatggaggacggtcaggtgcaggaaattgacaatcccgagctcggcgatgctgaggaagattctgaactcgccaagccaggggaaaaagaggggtggaggaattccatggagaagcagtctcttgtgtggaagaacacattctggcaaggcgacattgacaatttccatgatgacgtgaccctccgcaatcagaggttcatcccattcctgaacccccgaacaccccgaaaacttactccatatactgtggtgctgcacggacctgcaggagtgggcaagaccaccctcgcaaagaaatgcatgcttgactggaccgactgcaacctatcccctacgctgagatacgcgttctacctgtcttgtaaggagttgagcagaatgggcccttgtagttttgcagaactaatttcgaaggactggcccgagctgcaggatgacatcccttccattctggcacaggcccagaggatactctttgtcgtcgatggcctggacgagcttaaggtcccacctggcgctctgatccaagacatctgtggtgattgggagaaaaagaaacccgttccagtactacttggctccttacttaagcggaagatgctgccgagggctgctctccttgttaccacgaggcccagagccctccgggacctccaattgttagcacagcagcccatttacgtgcgcgtagagggatttctggaagaagacaggcgagcctactttttacggcactttggcgatgaagatcaagcaatgagggcctttgagctgatgaggagcaacgctgccctctttcagctgggcagcgctcccgctgtgtgctggattgtgtgtactaccttgaaactgcaaatggaaaagggcgaagatcctgtgccaacttgcttgactcgcacgggactgttcttacgttttctgtgtagccgcttccctcagggtgcgcagctcaggggagcccttcgcacgcttagtctgctcgctgctcagggattgtgggcccagatgtcagtgttccaccgcgaggaccttgagaggttgggcgtgcaggaatccgatctacgtctgttcctggacggagacattcttcgccaggatcgcgtgtccaaaggctgctattcattcatccatttatccttccagcagttcctgacagcacttttttacgccctggagaaggaggaaggggaggaccgagatggccacgcgtgggacataggggacgtacaaaaactgctgagcggagaagagaggttgaaaaaccccgacttaattcaggtgggtcacttcctcttcggcttggctaacgaaaagagagcgaaggaactggaggccacctttggttgtaggatgagcccagatattaagcaggaattgctgcagtgtaaggctcatctccacgcgaacaagccactgagtgtcactgaccttaaggaagtgttaggatgtctttacgagagccaagaggaagagctggccaaggtcgttgttgcccctttcaaagagatatctatccatcttactaatacctctgaggtgatgcattgctcattttcactcaaacattgtcaggatttacagaagctctctctccaggttgcaaagggcgtgttcctggagaattacatggactttgagcttgacatcgagtttgaaaggtgtacctacctaacaatccctaattgggcgaggcaggatttacgcagcctgcgactgtggacagacttctgttccctattcagctccaattccaatctcaagttcctggaggtaaaacagagctttctgagtgatagctcagtgcggattctatgcgaccacgtgactagatccacgtgccacctccagaaggtggaaataaaaaacgtgacccctgacactgcctacagggacttctgcctggcctttattggtaagaaaacactgacacacctcaccctggctggccatattgagtgggagcggactatgatgctgatgttgtgtgacctgttacgcaatcacaagtgtaacttacagtatctccgacttggagggcactgcgcaacacctgaacagtgggcagaattcttctacgtgcttaaagcaaaccagtcactcaagcacctgaggttgtcggccaatgtacttctcgacgagggagcaatgctgctatacaaaaccatgacaaggcccaagcactttcttcaaatgctttcattggaaaattgccgcctgaccgaggctagctgtaaggatctggcagctgtgctggtcgtgtccaagaagctgacacatctgtgtttggcaaaaaaccccataggagacacaggagttaagttcctgtgcgagggcctctcttaccccgactgtaagttacaaacactggtcctccaacagtgttccatcacaaaactggggtgtcggtatctctcggaggccctgcaagaggcctgttcgctgactaatttggatctgagcattaatcagattgctcgaggcctgtggattctctgtcaagctctggaaaatcctaattgtaacctgaaacacctacgtctgtggagttgctccctaatgcccttctactgccagcaccttggttccgctctgctatccaaccagaaattggagaccctggacctgggtcagaaccacctgtggaaatcaggcattattaagttgtttggagtgcttaggcaaaggaccggttcacttaaaattttgagactgaaaacatacgagacgaacctcgaaatcaaaaaactcctggaagaagttaaggagaagaatcctaagcttacaatagattgcaacgcctctggggctaccgctcctccctgctgcgacttcttttgctag

SEQ ID NO: 57893 - DNA, 3114 bp, Artificial Sequence
  Description of Artificial Sequence: Synthetic coding sequence
atgacttctccacagctcgagtggaccctgcagacgctacttgaacagctaaatgaggacgaactcaaatcatttaagtccctgctatgggcatttccactagaggatgtgctccagaaaactccttggtcggaggtggaggaggcggacgggaagaagttggcagaaatcttagtcaacacttcctcagaaaactggattcgtaacgccaccgtgaacatcctggaggaaatgaatctgacagaactgtgcaaaatggccaaggctgagatgatggaggacggccaggtgcaggagattgacaacccggagctcggcgatgcggaagaggatagcgagctggctaagcccggtgagaaagagggatggagaaattccatggagaaacagagcttggtatggaagaacactttctggcagggtgatattgacaactttcacgacgatgttacccttcggaaccagagatttatcccttttctcaatcctcgtacccccagaaaactgacaccctacaccgttgtactgcatgggcctgccggtgtgggcaagaccaccttggctaagaaatgcatgctggattggaccgactgtaatctcagccctaccctgagatacgccttttacttaagctgtaaagaattgagtagaatggggccttgctcattcgccgagctaatctctaaggattggcctgagcttcaggatgatattccatctatacttgctcaggctcagagaatcttattcgtcgtggacgggctggatgagttgaaagtgccacccggagcattgattcaggatatttgtggtgactgggaaaagaagaaacctgtgcctgtgctgctgggaagtctccttaagagaaagatgctgccccgagccgctctactcgtgaccacacgtccaagagcactcagggatcttcaactcctagcacagcagccaatttacgttcgggtggagggatttttggaagaagaccggagggcttacttcctgcgccactttggcgatgaggaccaggcaatgagagccttcgagctgatgagatcaaatgcggctctgtttcagctgggctctgcccctgccgtctgctggatagtgtgtactaccctgaagcttcaaatggagaaaggagaagaccccgtacccacgtgcctaacacgtaccggcctattcctccggttcttgtgctccaggtttccccagggtgctcaactgagaggcgcacttaggactctatctctgcttgcagcgcagggactgtgggcccagatgtctgtgtttcatcgggaagacctggagagacttggcgtacaagagtccgacttaaggctctttttagacggagacatccttcggcaggatagggtcagcaaaggctgctatagtttcattcacctctcattccagcagtttctgacagcgcttttctacgcactcgaaaaagaggagggcgaagaccgggacggtcacgcctgggatattggggacgtgcagaagctcctctcaggcgaagaacgtctgaaaaatccagatcttatccaagttggccattttctgttcgggttagccaatgagaaacgagcaaaggagttggaggccacatttgggtgtaggatgtcccctgacataaaacaagagctgctgcaatgcaaggctcatctgcatgctaataagccattgagcgttacggacttgaaggaagtgctcggctgtctctacgagtcgcaggaagaagaacttgccaaggtcgttgtggccccttttaaagaaatctcaattcacctcaccaatacatccgaagttatgcattgcagttttagcctgaagcactgtcaggatcttcagaagctctccttacaggtggccaagggtgtttttctggagaactatatggactttgagctcgacattgagttcgagcggtgtacatacttaacaatcccgaattgggctcgccaggacctgcgtagcctgcgtctctggacagatttttgtagtttgttctcgtcaaacagtaacctgaagttccttgaagtgaaacagagctttctgtctgacagttctgtgcggatcttatgcgaccacgtcacaagatcgacctgtcacctacagaaagtggaaataaagaatgtgaccccagatactgcatatcgcgatttctgcctcgccttcattgggaagaagaccctgacccacctcacactcgccggtcatattgagtgggagagaactatgatgctgatgctgtgcgacctgcttcgtaatcataaatgtaacttgcaatacttacggttggggggacactgtgccactcccgaacagtgggccgaattcttctacgttttaaaagccaatcagtccttgaagcatctccgtctaagcgccaacgtcctcctagatgaaggagccatgcttctttacaaaaccatgacacggcctaaacattttctgcagatgctgagtctggagaattgtcggctcacagaagcaagctgtaaagaccttgcagcagtgctagtcgtgagcaagaaacttacccatctctgtctcgcaaagaatcccatcggagacaccggtgtgaaatttctgtgtgaaggcctgtcatatcccgattgcaagctgcagactctggtgctgcagcagtgctctatcacgaagcttggatgtcggtacctgagcgaagctctacaggaagcctgctcccttaccaacctcgacctgagtatcaaccaaattgccaggggcctgtggattctttgtcaggcgctggaaaatccgaattgtaatcttaagcacctgcgcctctggagctgtagcctgatgcccttctattgccaacacctgggatcggcgctgcttagcaatcaaaagctggaaacgttggatctcgggcagaatcacttgtggaagtccggcataattaaattattcggcgtgctgagacagagaacaggatccctcaagatcttacgactgaaaacatatgagaccaacctcgagatcaagaagctgttggaggaagtaaaagagaagaatccaaaacttacgatagattgtaacgcatcaggcgctacagctcctccctgttgcgatttcttctgttag

SEQ ID NO: 57894 - DNA, 3114 bp, Artificial Sequence
  Description of Artificial Sequence: Synthetic coding sequence
atgacttccccccagctggagtggaccttacagacgctactcgaacagctgaatgaggatgaactgaaaagttttaaatcacttttatgggcctttccccttgaagatgtcctgcagaaaacgccctggtcagaggtggaggaagctgacggcaaaaaactggctgagatcctggtgaatacatcttccgaaaactggattcggaatgccaccgttaacattctagaagaaatgaacttgacagagctctgtaagatggcaaaggccgaaatgatggaggatggacaggttcaagagatcgataatcccgaactgggggatgctgaagaggattctgagctggccaaacccggagagaaagaggggtggcggaatagcatggagaaacagtcactggtgtggaaaaacaccttctggcagggagatatcgacaacttccatgacgacgtgacactgaggaatcagagatttattccattcctcaatccaagaacccctaggaaactgaccccatacaccgttgtattgcatggccctgcaggggtcgggaaaactaccctggcgaagaaatgcatgctagactggaccgactgcaacctctcccctaccctccgttacgccttttatctctcctgcaaagagttgagtagaatgggaccatgcagtttcgcagagctaatttccaaagattggcccgagcttcaagacgatatcccatccattctcgcccaggcacagcgaatcttgttcgtggtggacggtctggacgaattaaaggtgccgcctggtgccttgattcaagatatctgcggggattgggaaaagaagaagcctgttccagtgttactggggtctcttctcaagcgtaagatgcttccgagggcagcactcctcgtcacgacacgacctagggctttacgcgatttgcagctactggcccagcagccaatctacgttcgggtggagggcttcttggaagaagacaggagagcctactttctgagacattttggggatgaagaccaggctatgcgagctttcgagcttatgcggagtaacgctgcgctcttccagctgggatcagccccagccgtatgctggatcgtatgtactaccctgaagctccagatggagaaaggcgaggacccagtgcctacatgtctgaccagaactgggttattccttcgtttcctctgctcccggttcccacagggcgctcagctacgcggagccctgaggactctgtcactcctcgctgcgcagggcctgtgggctcagatgagcgtttttcatagagaagacctggaaaggctcggagtccaggaaagcgatctgagactgtttctcgacggagacatactgagacaggaccgcgtcagcaaaggctgctactccttcatccacctttctttccaacagttcctcactgccctattctacgctctggaaaaggaggaaggagaagacagggatggacatgcgtgggacattggtgacgtccagaagctactgagcggggaagagaggctaaagaatccagacttgattcaggtcgggcattttctcttcggcctcgccaatgaaaagcgagctaaggagctcgaagcaacctttggatgcagaatgtcgccagacatcaaacaggagttgctgcagtgcaaagcccacctgcatgcaaacaagcccttgagtgtgacggatcttaaggaagtactgggctgcctttacgaaagtcaggaagaagaacttgctaaggtagtcgtcgccccatttaaagagataagtattcacctgaccaacacttctgaggtcatgcactgcagctttagcctcaaacattgccaagatcttcagaaactctcactgcaggtagccaaaggcgtgttcctcgagaattacatggattttgagctagatatagaattcgagaggtgtacatacctgactattcccaactgggctcggcaggaccttcggtccctgcgactgtggactgacttctgctctctgtttagcagtaattctaaccttaaattcttagaggtcaagcagtccttcctctctgacagttccgttagaattttgtgcgaccatgtgacaaggagtacgtgtcacttgcagaaggtagagatcaaaaatgtgactcccgacaccgcctaccgcgatttctgtcttgccttcattggtaagaaaacacttacccacctgactctggccggacacatagaatgggagcgcacaatgatgctgatgctgtgcgaccttctgcgtaatcacaagtgcaatctgcaatatctgcgcctgggtggacattgcgcgactcccgaacaatgggctgaattcttttatgtcctgaaagccaaccagtctctgaaacacttacggctttcagctaatgtcctcctcgacgaaggtgcaatgcttttgtacaagacgatgacacgcccaaaacactttctgcagatgctctcactggagaattgtcgtcttacagaggcctcttgtaaagacctcgcagctgtactggttgtcagtaagaagctgacccatctctgccttgctaagaatcctattggcgacacaggggtgaagttcctttgcgagggattgtcctacccagactgcaagctgcagaccctggtactacagcaatgcagtatcactaaactgggctgcaggtacctcagtgaggctttacaggaggcatgttccctgactaaccttgacttatctattaatcagattgccagaggtctgtggattttgtgccaggctctcgaaaaccccaactgcaatctcaagcatcttaggctttggtcctgcagcctaatgcctttctattgccagcaccttgggagcgctctcctgtctaaccagaagctggagaccctggatttgggccagaaccacctctggaaatcaggaataatcaaactgttcggcgtgctgaggcagcgcaccggatctctcaaaattttgcgcctgaagacatacgaaacaaatctggagatcaaaaagctgctggaggaagtaaaggaaaagaatccaaagctcacaatcgactgtaatgcatctggcgctacggctcctccgtgttgtgatttcttttgttag

SEQ ID NO: 57895 - DNA, 3114 bp, Artificial Sequence
  Description of Artificial Sequence: Synthetic coding sequence
atgacctcgccacagctagaatggactctgcagacactgctagaacaactgaacgaggatgaactaaagtcttttaaatctctcctttgggcctttcccctcgaggacgtgctgcagaaaactccttggtctgaggtggaggaggccgacggaaagaagttggccgagattctggtgaacacgagcagtgaaaattggattaggaacgctactgtgaatatcctggaagaaatgaatctgacagaactatgtaagatggcgaaagcggaaatgatggaggatggtcaggtgcaagagatcgacaaccctgagcttggtgacgctgaagaggactccgaactggcaaagcccggtgaaaaggaaggctggagaaacagcatggaaaaacagagtcttgtctggaaaaatacgttttggcaaggcgacattgataactttcacgacgacgtcaccttaagaaatcagcggttcattccatttctcaatcccagaacccctcgcaagcttacgccgtacacggtcgtcctgcacggtccggcaggagtgggaaagaccacattggctaagaaatgcatgctcgattggacggattgcaacctgagccccacactgcggtacgcgttctacctgtcgtgtaaggaactctcgcggatgggtccatgttctttcgcagagttaatcagcaaggactggccggagctccaagatgacattccttccattctggcccaggcacagaggatcctgttcgtggtggatggactcgacgagctgaaggtgcccccaggagcccttatccaagacatctgcggcgactgggaaaagaaaaagcctgtgcccgtgcttttggggtctttattgaagcggaagatgctgcctcgcgctgccctactcgtaactactagacccagggctctcagagacttacagcttctcgctcagcagcccatttacgtgcgcgtggaaggctttctggaggaggaccgcagagcctatttcctgagacatttcggggatgaagaccaggcaatgagagccttcgaattgatgaggtccaacgctgcgttatttcagttagggtctgctcctgccgtgtgttggatcgtctgcactaccctcaaattacagatggaaaagggcgaggatcctgtccccacgtgcttgacacgcaccggcctgttccttagattcctctgtagtagatttccacagggggctcaactgagaggagccttgcgcacattgtcactgctggccgctcaggggctatgggcacagatgtctgttttccacagggaggatctcgaaagattgggtgtgcaagagtcagacctgcgactctttctggacggggatattcttaggcaggacagagtctcaaaagggtgttatagttttatacacctatcttttcagcagtttctgaccgcactgttttacgcgctagagaaagaagaaggtgaggaccgggacggccacgcgtgggacattggggatgttcagaaactgttgtcaggtgaagagaggctcaaaaaccccgatctgatacaggtaggccattttctttttggcctggctaacgagaagcgggcaaaagagttagaagcgacgttcggctgtaggatgtcccccgatatcaagcaggagcttttgcagtgcaaggcacatctgcacgccaataaaccgctttccgttactgatctgaaagaggtcctcggatgtctgtacgagtcacaagaggaggaactggcgaaggtcgttgttgccccttttaaagagatttctatccacctgaccaatacctctgaggtgatgcactgtagcttctctctgaaacattgtcaggacctccagaaattaagcctgcaggttgccaaaggcgtgttcctggaaaactatatggacttcgaactggacattgagttcgagcgatgcacctatcttacaatccctaactgggcgagacaagaccttaggtcactccgcctgtggacagatttttgctctctcttcagcagcaacagcaatctgaaatttctggaggttaagcagtcttttctatccgacagctccgtgcgcatactatgtgaccatgtaaccaggtccacttgccacctgcaaaaggtggaaatcaagaatgtcactcccgacacagcctatagagacttctgcctggcatttatcggcaagaagacgctgacacaccttactcttgctggacatatagagtgggaacgaacaatgatgctgatgctttgcgatttattacggaaccacaagtgcaatctgcagtacctcaggctggggggacattgtgccacccccgaacagtgggccgaattcttttatgtcttgaaagccaatcagtctctcaaacatctgcgcttgtctgcaaacgtgctgttagatgagggtgccatgctgttgtataagaccatgaccaggccgaagcacttcctgcagatgctaagtctggagaactgtcgtttgaccgaagcctcctgtaaggacctggccgctgtgcttgtagtgagcaagaaattaacacacttatgcctagcaaagaaccctattggcgatactggcgtgaagtttctctgcgaaggcctttcctaccctgattgtaagttgcagacattggtcctgcagcaatgctccatcaccaagctcggttgtcgatatctttccgaagcattgcaggaggcatgtagcctaaccaacttagacctgtctatcaaccagatcgctcgcggactgtggatcctgtgccaggcactggagaacccaaattgcaatctgaagcatcttcggctgtggtcatgtagcctaatgcccttctattgtcagcaccttggtagcgccttactctcaaatcagaagttggaaactctggatctaggacagaatcacctgtggaaaagtggtatcataaaattgttcggagttctccggcagcggactggttcattgaagattctgaggttgaagacctacgagaccaatctcgaaattaagaagctgctggaagaagtgaaggagaagaatcccaaactcacaatcgactgcaacgcctctggggcaaccgcacccccatgctgcgatttcttctgttag

SEQ ID NO: 57896 - DNA, 3114 bp, Artificial Sequence
  Description of Artificial Sequence: Synthetic coding sequence
atgacgtccccccagctcgagtggactctgcagacattactcgagcagctgaacgaggatgaactcaaaagctttaagtcactcctttgggcattccccttggaggacgtactgcagaagacaccctggtccgaagtggaggaggctgacggaaaaaaactggctgagatcttagtgaatacaagctccgaaaactggataaggaatgccacagtgaacattctcgaggaaatgaaccttacagagctttgtaagatggcgaaagcagaaatgatggaggacgggcaggttcaagaaatcgacaaccctgaattgggcgacgccgaggaagattcagaactggcaaagcctggagagaaggagggctggcgtaattccatggagaaacagtctctcgtgtggaagaatactttctggcaaggcgacatcgacaactttcacgacgacgtcaccttacgtaatcagagatttatccccttcctaaaccccaggacccctcggaagctgaccccgtacactgtcgtgcttcatgggccagctggggtgggcaagactaccctggccaaaaagtgtatgttggattggacagactgcaatttatcacctaccctgcgttatgctttctacctgagctgcaaagagctgtctcggatgggaccctgtagcttcgctgagctaatctcaaaggattggccagaactgcaggacgacataccgagcatccttgctcaggcccagcgcatcctgttcgttgttgatgggcttgacgaattgaaagtacccccaggcgcactcatccaggacatctgtggagattgggagaaaaagaagcctgtgcctgtcctcctgggatccctgctcaagcgaaagatgctaccccgtgccgctctactcgtcaccacacggcctcgcgcactccgggacctgcagctgctcgcgcaacagcccatttacgttagagttgaagggttcctggaggaagatcgaagagcctatttcctgcggcacttcggcgatgaggaccaggccatgcgcgctttcgaacttatgcgcagcaacgcagctcttttccagttagggtctgccccagccgtgtgttggattgtctgcactacgctgaaactccagatggagaagggtgaagatcccgtccccacctgtctgaccaggactggcttgtttctgaggtttttatgttcccgattcccacagggggctcaactgcgaggggctttgagaacccttagccttcttgcagcgcaggggttatgggcccagatgagtgtgttccaccgggaggaccttgaaagactgggtgtgcaagaatcagatctcaggttgttcctcgacggggacattctgcggcaagaccgcgtcagcaaaggttgctattctttcatccacctgagttttcagcaatttctgaccgctttgttctacgccctcgagaaggaggagggcgaagaccgggatggccatgcctgggacattggcgacgttcagaaactactgagtggggaagagcgactgaaaaaccctgacctcattcaagttggccactttctctttggtttagccaacgaaaaacgagctaaggagcttgaggctaccttcggctgccggatgagcccagacattaagcaggagctgttacagtgtaaagctcatctgcacgccaataagccccttagcgttacagacctgaaagaagtattggggtgcctgtatgaatcccaagaggaggaattggcaaaggttgtcgtggcaccgtttaaggagatttccattcacctgactaatacatctgaggttatgcactgttcttttagcctcaagcactgccaggacctccagaagctatctttgcaggtggccaagggtgtgtttttggagaactacatggactttgaactcgacatcgagtttgagaggtgcacctacttaactattcccaactgggcgcgacaggacctccggtccctgcggctctggactgacttctgtagccttttctcatcgaatagtaatctcaagttcttagaagttaaacagagtttcctcagtgacagctccgtccgtattctgtgtgaccacgtgacccggtcaacctgccacttgcaaaaggtggagatcaaaaacgtgaccccagacaccgcataccgcgatttctgtctggcgttcattgggaagaagacccttacacatctgactctcgctggtcacatcgaatgggagcgcacaatgatgctgatgctctgcgacctcctccgaaaccacaagtgcaatcttcaataccttagactggggggacactgcgccaccccggagcagtgggcggagttcttttacgtgctgaaggcaaaccagtctctgaagcacttgcgtctgagcgcaaacgtgctgctagatgaaggtgccatgctgctctataaaacaatgacgcggcctaaacacttcttgcagatgctcagccttgagaattgccgactgaccgaggcatcttgcaaagacctagctgcggtcctcgtcgtttcgaaaaagcttacacatctctgcctggccaagaacccaatcggcgatacgggcgtgaagttcttgtgtgagggactcagctatcctgattgtaaacttcagacccttgttctgcagcagtgctctattactaagttaggctgccggtaccttagtgaagcactgcaggaagcctgttctctgaccaacctagacctgtcaattaaccagatcgccaggggcctgtggatcttatgtcaggctcttgagaatcccaattgcaacttgaaacatctgagattgtggtcctgtagcctcatgccattttactgccagcacctgggcagtgctcttctaagcaaccagaagctcgagacactggacctgggccagaatcacttatggaaatctggaattattaaacttttcggcgttttgcgacagaggaccggttcactgaagattctgagacttaaaacatacgaaaccaacctggaaatcaaaaaacttctggaggaggtgaaggagaaaaatcccaaactcacaatagattgtaacgccagcggcgcaacggctcctccatgttgcgacttcttttgctag

SEQ ID NO: 57897 - DNA, 3114 bp, Artificial Sequence
  Description of Artificial Sequence: Synthetic coding sequence
atgacctctccgcagttagagtggacccttcagactctgctggaacagcttaatgaagatgaactaaagagcttcaagagcttactgtgggcttttcccctagaggatgtcctgcagaagactccatggagcgaggtggaggaggccgacggaaaaaaattggccgagatcctggtcaatacgtctagcgaaaattggattcgaaacgctaccgtgaatatcctggaagagatgaatctgacagaattgtgtaagatggccaaagctgagatgatggaggatggacaagttcaggagattgacaaccctgagcttggcgatgccgaggaagacagcgagctcgctaagccgggtgaaaaggagggctggcggaattccatggagaaacaatctttggtgtggaaaaatacattttggcagggtgatatagacaactttcacgatgatgtgaccttacgaaaccagcgcttcatcccttttctgaatccgagaacaccacggaaattaaccccctacaccgtcgtcctgcacggcccagcaggggtgggaaagacgaccctggccaaaaaatgcatgctggactggaccgattgtaacctatcgcccacactccgctacgccttctacctgtcctgcaaagaactgtccagaatggggccttgtagcttcgctgaactgatcagcaaagactggcctgagcttcaggacgacattccctccattctcgctcaagcccaacgcattctgtttgtagtcgatggacttgacgagctgaaggtgccacccggagccctcatccaagatatatgcggcgattgggagaaaaagaagccagtgcccgtactgctggggtcactactgaaacggaagatgttgccaagggctgccctccttgtcacaaccagaccaagggcgctgagggatctgcaactgttagcccagcagccaatctacgtgcgagtggaaggtttcctagaagaagatcggcgagcatacttcctaaggcatttcggcgacgaggaccaagccatgagagccttcgagcttatgcgaagcaacgccgctttgttccagctgggcagtgcgcctgccgtgtgctggatcgtctgcaccaccttgaaactgcagatggagaagggcgaggaccctgttccaacttgcctcacacgcactgggctttttttgcggttcttgtgcagtcgttttccccagggtgcacagttgcggggtgctttgcgtacactcagccttttggccgcacaaggcttgtgggcccaaatgtctgtttttcatcgggaagacttggagcgcttgggcgttcaggaaagtgaccttcgcctgttcctggacggcgatattcttcgccaggaccgggtgagcaaaggttgctattcttttatccacctctccttccagcagttcttgaccgcgctcttttatgccctagaaaaggaagagggagaagaccgagacggccacgcctgggacataggcgatgtccagaagttgcttagcggtgaggagaggttgaagaatccagatctgatccaagtgggacacttcctgttcggtctcgctaacgaaaagcgcgcaaaggagttagaggcaacgtttggatgtagaatgagcccagatatcaagcaggaactgctgcagtgtaaggcccatctccatgcaaacaaaccactgtcggtcaccgacctgaaagaggtactgggctgcctttatgaaagtcaggaggaggagttggctaaggttgtcgttgcccctttcaaggaaatctctatacatctaactaatacatccgaagttatgcactgtagtttctccttaaagcattgccaagacctccaaaagttaagccttcaagtggcaaaaggtgtgtttcttgagaactacatggacttcgagttagacatagaattcgagcggtgcacctacctgaccattcccaactgggcccgacaggatctgcggagcctcagactgtggaccgatttttgttcactcttcagttctaactccaaccttaagtttctggaggtgaagcaatcttttttgtcagattcatctgtgagaatactttgtgatcacgtgactcgctcaacatgccacctccagaaagtcgagatcaagaacgttaccccagataccgcatatagggatttctgtctcgcgttcattggcaaaaaaacactgacccatctgaccctcgcgggtcatattgagtgggaacgtacgatgatgttgatgctgtgcgaccttttgcgcaatcacaagtgcaatctgcagtatctgcgcctgggtggccattgtgcaactcccgaacagtgggccgaattcttctacgtcctgaaggccaatcagtcattgaaacacctgcgcttgagcgctaacgtgctgctggacgaaggtgccatgctgctgtacaagacgatgactcggccaaagcatttcctgcagatgctgagtctcgagaattgtcggttaaccgaggcttcatgcaaggacctcgccgcagtgctggtcgtgtctaaaaaattaactcatctatgcttggccaaaaaccctatcggcgatacgggagttaagtttctgtgtgagggcctgtcttatcccgactgtaaactccaaaccttggttctgcaacagtgttcaattaccaagttaggatgtagatacctgtcagaagctctccaagaggcatgttccctaacgaacctggatctcagcataaaccagatcgccagaggactgtggatcctttgtcaagcattggagaatcctaattgtaatctgaagcatctccgcctctggtcttgtagtctgatgccgttctactgccagcacctgggtagcgccctgctgagcaatcagaagctggagacactcgatctggggcaaaaccatctttggaaatccggcatcattaagttattcggggtcctaagacaacggacgggctcgctcaagatcctgagactgaaaacctacgagaccaaccttgagatcaagaagctgttggaagaggtcaaggagaaaaatcctaaactgaccattgattgtaatgccagtggagcgacggccccaccttgctgcgattttttttgttag

SEQ ID NO: 57898 - DNA, 1080 bp, Artificial Sequence
  Description of Artificial Sequence: Synthetic coding sequence
atgaacttcattaaagacaatagtcgagcccttatccagagaatggggatgaccgtgattaagcagattaccgacgacctgtttgtgtggaacgttttaaaccgcgaagaggtcaatataatctgttgtgagaaggtggaacaggacgcagctcggggaatcattcatatgatactcaaaaaaggctctgaatcctgtaatctgttcctgaaatcattgaaagagtggaactatcccctcttccaggatcttaacggccagtcagggttgactgatagcctcggaaatcttaaaaacttaacaaagttgatcatggataatataaaaatgaatgaggaagatgccattaagcttgcagaaggcttaaaaaacttaaagaagatgtgcctcttccatttaactcatctgagtgacattggagagggcatggactacatcgtaaaaagtctgtcgtccgagccttgtgacttggaagagattcagctagtctcctgctgcctgagtgcgaacgccgtcaaaattttggctcaaaacctgcacaatttagtgaagctgtccatcctcgatctgagcgaaaactaccttgaaaaagatggaaacgaggccttgcacgagttaattgataggatgaacgtattggaacagctgactgctcttatgctaccttgggggtgcgacgtgcagggcagcctatctagtctgctgaaacacctggaggaggtcccccagctggtgaagttgggattgaaaaactggagactgacggacaccgaaatccgcatactgggagctttcttcgggaagaaccctctgaagaacttccagcagctcaatctggctggtaaccgcgtgtcgagtgacggatggctggcctttatgggcgtgtttgagaacctgaaacagttagtcttcttcgatttcagcaccaaagaatttttacctgaccccgcactggtcaggaagctatcccaggtgctgtccaaactcactttcctgcaggaagcccgtctggttggctggcagttcgacgatgatgatctatctgtgattactggcgcattcaagctggtcacggcctag

SEQ ID NO: 57899 - DNA, 5513 bp, Artificial Sequence
  Description of Artificial Sequence: Synthetic coding sequence
atggatcctgtcggtctgcagctgggcaataagaacctctggtcatgtctcgtgcggttgctgaccaaggacccggagtggctgaatgccaaaatgaaattctttctcccaaacactgacctggattctaggaacgaaaccctggaccccgaacagcgggttattctgcagctaaacaaacttcacgtgcagggctctgatacctggcagagcttcattcattgcgtctgtatgcagctggaagtgcctctcgacctcgaggtgctgcttttgagtacattcggctatgatgacgggtttacttctcagcttggcgcagaagggaaatcgcagccagagagccagctacaccatggactgaaaagaccccaccagtcatgtggatcaagccctaggcgtaagcaatgcaagaaacagcaactggagttggcgaagaagtatcttcagctcttacgcactagcgcacagcagaggtatcgttcccagattccaggttcaggacagccacatgccttccatcaggtgtatgtcccgccaatcctcaggcgggcaactgcaagtctcgataccccagagggcgcaattatgggagacgtgaaggtcgaggacggcgctgatgtctccataagcgatctgtttaacacacgcgtgaacaagggccctcgcgtgaccgtgcttctgggcaaagctggcatgggcaagaccactctagcgcaccgcctctgtcaaaagtgggccgaggggcatttgaactgcttccaggccttgtttttgtttgagtttagacagcttaatctgatcacacggttcctgacaccatccgaactgctgttcgatctatacttatccccagagtctgaccatgacactgtgtttcaatatctggaaaagaacgcggaccaggttctcctgatttttgatggcttggacgaagctttacaaccgatgggcccagacgggcctggtcctgtactgacgttattttcccatctgtgtaatggtaccctgctgcctggatgtagagtgatggcgacaagccggccagggaagctgccagcctgtctcccagctgaggctgctatggtccatatgctcgggttcgatggtcccagggtggaggaatatgtgaaccatttctttagtgcccagcctagccgggaaggagcactcgttgaactgcagaccaacggacgcttacggtccctttgcgccgtccctgcgctgtgccaggtggcatgcctttgcctgcatcacctgctgcctgaccatgctcctggccagtccgttgccctgctgcccaatatgacccagctgtacatgcaaatggtgctggccctcagcccacccggtcatctgcctacatcttccctccttgatcttggcgaggtggccctacggggtctcgaaaccgggaaagtgattttctatgccaaagatatcgccccacccctgatcgcgtttggagctacacatagtctactgacaagcttctgtgtgtgtactgggcctggacatcagcagaccgggtatgcgttcacacatctgtcccttcaagagttcttagccgctctccacttaatggccagccccaaggtgaacaaagacaccttaacacagtatgtaacactgcatagcaggtgggttcagcggaccaaagcacgtctcggcctgtcggaccaccttcctacctttcttgccggtctggcctcttgcacttgccgaccttttctgtctcatctcgcccaggggaacgaggattgcgttggcgctaagcaggctgctgtcgtgcaagtgctaaaaaagctagcaactaggaaactgacaggcccaaaggtcgtcgagctgtgccactgtgtggatgagactcaggagcctgaactggccagtttgacggcccagtcactaccctaccaattaccgtttcataatttccccttgacctgtactgaccttgccacgctgacaaacattctggagcacagagaggcaccaattcatctagacttcgacggttgtccactggagccgcattgtcctgaggcacttgtcggatgtggtcagatcgaaaatctgagctttaagagcaggaaatgcggggacgcctttgctgaggctctcagtcgcagcttgcctacaatgggccgtctccagatgcttggcctggccggtagtaagattacagctcggggaatctctcatttggttaaggcgctgccattatgccctcaactgaaggaggtatccttccgagacaaccagctctcagatcaggtcgtgttgaacatcgtagaagtgctgcctcaccttcctcgcctccggaagctagaccttagctctaactcgatctgcgtctccaccttgctgtgcctggccagagtggccgtcacttgcccgacggtcaggatgctgcaggcgagagaggcggatctcatcttcctgttgagccctcctactgagactacagccgagctgcagagagcaccagacctgcaggagtccgatggacaacggaagggtgctcagagcagaagtcttaccttgaggctccagaagtgccaactccaggtgcacgatgccgaggccttgattgcgctcctgcaagaggggccacatctggaagaagtggacctttctgggaatcagcttgaggatgagggctgtagactgatggccgaggctgctagtcagctgcatatcgccaggaagctggacttatctaacaacggcctatccgtggcgggtgtgcattgcgtcctgagggcggtatccgcttgttggacactcgcggagctgcacataagcctgcagcacaagaccgtcatatttatgtttgcgcaggaaccagaggagcagaaagggccacaggaacgcgcagcgttcctggacagcctgatgctgcagatgcctagcgaactccccctgagttcccgacggatgagactaacgcattgcggcctccaggagaaacatcttgagcagctatgcaaggccctgggcggaagttgccacctgggacatctccaccttgactttagtggcaatgccctaggtgatgaaggcgcagctaggctggcgcagctgttgcccggactcggtgccttacagtccctcaatttaagcgagaacggattatctcttgatgcagttctgggcctcgtccggtgcttttccaccctgcagtggctgtttcggctggatatttcgttcgagagccagcacatcctgcttaggggagataaaacctctagggacatgtgggcaactgggtctttgccagacttccccgctgcagccaagttcctcggtttcagacagcgatgtatacctcgaagcctgtgtttgtccgaatgtcctctggaacctccgtcactgacccgcctatgcgctacactgaaagattgcccagggccactcgagctacagctgtcatgcgagttcctgtctgaccaaagtctcgaaacactcttggactgtctgccccaactgccgcagctcagcctgttacaactcagccagactggtctctccccaaagtctccctttcttctggctaacactctgagtctgtgcccccgtgtgaaaaaggtcgacttgaggagtctgcaccacgctacactacatttcaggagtaacgaagaggaagagggtgtgtgctgtggcttgtcagcaaatctcctaggcgactcaggtttaaggtgtctgctggaatgcctgccccaggtccctatctccggactcctcgacctgagccataatagcatatcacaggaatccgctctgtatctgctggagaccttgccaagctgccccagggtgagagaagctagtgttaacctgggcagtgaacagtcgttcagaattcatttctctcgcgaagatcaagccggaaagacactgcgcctgtctgagtgctcattccgcccagaacacgtttcgcggctcgccaccgggctatccaagtccttacaactaactgaactgactttgacccagtgctgtcttggacaaaaacaactggccattctccttagcttggttggcaggcctgccggtctcttctctttgagagtacaggagccctgggcggacagggcccgtgtgttaagcctgcttgaggtctgcgctcaagccagcggctcagttaccgagatttcaatcagcgaaactcagcaacagctgtgtgtgcagctggagtttccaagacaggaagaaaatcccgaagctgtcgctttgagattggctcactgtgaccttggtgctcaccactcactactggtgggtcagctaatggagacgtgcgcaagacttcagcagctgagcctgtcccaggtgaacctgtgcgaagacgatgacgcttccagcctcctactgcagtccctccttctgtcactgtctgaattaaagaccttccgtcttacttcatcgtgcgttagtacagaaggtctagcacatctcgccagcggacttgggcactgtcatcacctggaagaactcgacctatcaaataatcagttcgatgaggaaggcactaaggcgctaatgagggcgcttgaggggaagtggatgctgaaaagactcgacctgtcccacctgctcttaaactccagcaccttagcgctgttgacacatagattatctcagatgacatgcctgcagagcctgcgactcaatagaaacagcattggcgacgtcggatgttgccacttgagcgaggcattgagagcagccacaagtctcgaagaacttgatctgtcacacaaccagatcggagacgctggcgtccagcacctagccaccatattacctggactgccggaactacgaaaaatcgatcttagcggcaattctatctctagcgcagggggtgtgcagttggctgaatcgcttgtgctgtgccgcagactggaggaattgatgctcggctgcaatgcgttgggggatcctactgcactcggcctagcccaagaactacctcagcatttgcgcgtcctacacctgccttttagtcaccttggacccggaggagcattaagcctggcccaggctctcgacggatcacctcatctcgaagagatctccctggccgagaacaacttggccggtggcgtgctgagattctgcatggagctgcccctcttgaggcagattgatctggtttcatgtaagattgacaatcagacggcaaaactcctcacatcttcatttacttcgtgcccagccttagaggtcatccttctatcatggaatctcttaggggacgaagccgcagctgagctagcccaggttctgccgcagatgggacgacttaagcgcgtggacctggaaaagaaccagattactgcactgggggcttggctgctcgcagaaggattggcccaagggagcagcatacaagtcattcggctgtggaataatccaattccctgtgatatggctcagcacttgaaatctcaagaaccgaggctcgattttgccttcttcgacaatcagcctcaggctccttggggaaccta

SEQ ID NO: 57900 - DNA, 2553 bp, Artificial Sequence
  Description of Artificial Sequence: Synthetic coding sequence
atggccagccccaaagtcaacaaagacactctgacccagtatgttacactacactcccggtgggtgcaacgaaccaaggcaaggctgggcttgtccgatcaccttccaacgtttctggccggacttgctagctgcacctgccgcccatttctcagccacctggctcagggcaacgaggattgtgtgggcgctaaacaggctgccgtagtccaggttttgaaaaagctggcaaccaggaaactgactgggcctaaggtggtggagttgtgtcattgcgtggacgagacccaagaaccagagctggcctctctgaccgcccagagcctaccataccaattacctttccacaacttcccacttacctgcacagatcttgcaaccctaactaatatattggagcatagagaggcccctattcacctagatttcgacgggtgtcctctggagccacactgcccggaagctctggtcggctgcgggcagattgagaatctgtcctttaaatcgcgcaaatgtggcgacgccttcgccgaagcactctctcggtcgctgcctacaatgggaagactgcagatgctggggctcgctgggagcaagattactgcgaggggcatctcacaccttgttaaggcgttgcccctctgcccccaactgaaagaagtttcttttcgcgataaccagctctctgatcaggtggtcctgaacattgtggaagttctgccgcacctgccgaggcttcgcaaactggatctctcctccaactccatttgtgtgagtaccttactttgcctcgctcgagtggctgtcacatgtccaacggtccggatgctgcaagcccgtgaggcggatctgatttttcttttgagccccccaaccgagactacagccgagttacagagggctcctgacctccaagagagtgatggccagcgcaagggagctcagagccgctcactgactcttaggctacaaaagtgtcagctgcaggtgcacgacgcggaagccctcatagcactgctgcaagaagggcctcacctggaggaggtggacctgtcaggaaatcagttggaggacgaggggtgccgtctaatggcagaagctgccagtcagctccatatcgcacggaagctagaccttagtaacaatggcctgtcagtggccggtgttcattgtgtcctccgtgccgtatcggcatgttggactctggccgaacttcacatatcattgcagcacaagactgtgatattcatgtttgctcaggagcccgaggagcagaaaggcccacaggaacgggctgcattcctagactccctcatgttacaaatgccttcggagctgccattgtcctcacggagaatgcgattgacccattgcggcttacaggagaaacacttggaacagctgtgtaaggcacttggagggtcctgccacttgggccaccttcaccttgattttagcgggaatgctctgggggatgagggtgccgcaaggctcgcacagcttctcccagggttgggtgctctgcaatccctcaatctcagtgagaacggacttagcctggatgcagtgttgggcctagtgcggtgcttctcaactctccagtggctttttagactggatatttccttcgaatcacagcacattctcctgagaggcgacaaaacttctagtttatcagaatgtcccctggagcccccttccttgaccaggctgtgcgcaaccctcaaggactgccctggtcctcttgagctgcagctatcttgcgaattcctgagcgatcagtccctcgagactttgctggattgcctgcctcaactcccccagctctccctgctccagctctctcagacagggctgagcccaaaatcacctttcctattggcaaatactctctctctgtgtccaagagttaagaaagtggatctgagatccctgcaccatgcaacactgcattttcggagcaacgaggaggaggagggtgtatgctgtggattcaccggctgctctctgtctcaggaacacgtggagagtctctgctggctcctgagtaaatgcaaggacctgtcacaggtggacctcagcgcaaatttacttggggacagtggcctgcgatgcttgcttgagtgcctcccccaggtgccaattagcggtttgctggatctttcgcataattcaatcagccaggaaagcgctctatatttactcgaaactttgccctcctgtccacgggtgagggaggcctctgtcaacctcggctccgagcagagctttcgcattcactttagcagggaagatcaggccggtaagacactgaggctttcggagtgctcgtttcgacctgagcacgttagccggctggctactgggttatccaagagcctccaattgaccgagctgaccttgacgcagtgttgcctgggtcagaagcaattagcaatcctgctgagtctggtgggtagacctgccggattattttccttgcgtgactctacaagacatactgagaaactgtcctttccaacactggaagcttgcgccctcggttttaaatag

SEQ ID NO: 57901 - DNA, 4656 bp, Artificial Sequence
  Description of Artificial Sequence: Synthetic coding sequence
atggaccctgtcggcttgcaactggggaataagaacctgtggtcatgccttgtgcggcttctcaccaaagatcccgagtggctgaacgccaaaatgaagttttttctgccaaacacagacctggactcaaggaacgagacacttgatcctgagcagcgcgtgatcctgcagttgaacaaactgcatgtgcagggcagcgatacctggcaaagttttatccattgcgtctgcatgcaactcgaggtccccttggacctcgaagtccttctcctcagcaccttcggctacgatgatgggttcacctctcagcttggcgcagagggcaaaagccaacccgaaagtcagctacaccacggattgaagcgtccccaccagagctgtggctctagtccgaggaggaagcagtgcaagaagcagcagttggaactggccaagaaatatctgcagctccttagaacgtctgcccagcaaaggtatcgatcccagatccccggttcaggccaaccccacgcattccaccaggtgtacgtgccacctatcctcaggcgcgctaccgcttccctcgataccccagagggggcaatcatgggtgatgttaaagtggaagacggtgctgatgttagcatctcagatctctttaacaccagggtcaataaaggaccccgagtgacagtgctcctggggaaggccggaatgggcaagacgactcttgctcatcgcctttgccagaaatgggctgagggccaccttaattgtttccaagccctctttcttttcgagtttaggcaactcaacctgataaccagattcctgactcctagcgagcttctgttcgatctctaccttagccccgaatcagatcatgacaccgtgttccaatatttggagaagaatgccgatcaggtcctgctgatctttgacggtttagacgaagcgctccagcctatgggtcccgacggacccggtccagttcttaccctgttttctcacctatgtaatggaaccctactgcccggatgcagagttatggccacgagccgcccaggtaagcttcctgcgtgccttcccgctgaagcagccatggttcacatgctagggtttgacggcccacgcgtcgaagagtacgtaaaccatttcttcagcgcccaacctagccgggagggggcacttgtcgaactgcagaccaacggtaggctgcggagcctttgtgcagtgcctgccctgtgccaggtggcgtgcctgtgtctgcatcacttgctgcccgatcatgctcccggtcaatctgtggcgctgctgccgaacatgacacagctgtatatgcaaatggtgctggcactttcgcccccaggacacctgcccacatcctctctattggatctgggggaggttgctctgcggggtttggaaacaggtaaggtaattttctatgcgaaggatatcgctcccccactgatagcctttggggcaactcatagtttgctcaccagtttctgcgtgtgcaccgggccaggacatcagcaaacaggatacgcctttacacacctgagcttgcaggagttccttgcagcgctccacctcatggcttcgcctaaagtcaataaggacacgctgactcagtacgtgactctacactcaaggtgggtacaaaggactaaggctagactgggcctttctgatcatctcccgactttcctggccggacttgcctcatgcacctgcagacccttcctttcccacctggctcagggcaacgaagactgtgtaggcgctaaacaggctgcggtcgtacaggtcctgaaaaagctggcgacaaggaagcttaccggacccaaggtggtggaactgtgtcactgcgtcgacgagacccaggagccagaattagcctccctaaccgctcaatcactgccatatcagctgcccttccacaactttccattaacctgtactgacttagctacactgacgaatattcttgagcacagagaggcccctattcatctggacttcgatggatgccctctagaaccccactgcccagaagccctggttggctgcggacaaatagagaacctgagctttaagagcaggaagtgtggagatgccttcgcagaggccttgtcacggagcttgccaaccatgggaagattacaaatgctgggtttggcagggagcaagatcaccgcgagaggcatcagtcacctagtgaaggcacttcctctttgtccccagttgaaggaggtgtcttttcgcgataaccagttgtccgaccaggtcgtactgaatatcgtggaggtcctgccccacctccctcgccttagaaaattagaccttagttcgaattctatctgtgtgtccacccttctgtgtctggccagggtggccgtaacgtgcccaacagtgcgaatgctgcaggccagggaggcagacttgattttcttgttgagtccgcctacagagaccacagccgaactgcagagagccccagatctccaggagagtgatgggcagcggaagggcgcacagtccaggtccttaactctgcggcttcagaagtgccagttgcaggttcatgacgctgaggctctgatagccctactacaagaagggcctcatctcgaggaagttgacctttctggaaaccagttggaggacgaaggctgccgactcatggccgaggccgcttcccagctgcacattgcacgcaaactcgaccttagtaacaatggcctgagcgttgctggagtgcattgcgtcctgagagctgtaagtgcatgctggacattggccgagctgcacatttctttgcagcacaagaccgttatctttatgtttgcccaagaaccagaggagcaaaagggtccacaggagcgcgctgcctttctggatagcctcatgctgcagatgccatctgagctgccgctgagctctcgtagaatgcgcctcacccactgcggcttacaggaaaagcacctggaacagttgtgcaaagctcttggcggttcctgccacctgggacacctacatcttgacttttcaggtaacgcccttggcgacgaaggtgcggcacgtctggctcagctcctaccaggcctgggagccttacaatccctgaacctaagcgagaacggcttatccctagacgcagtgctcggcttagtaagatgctttagcaccctccaatggctgttcaggctggacattagtttcgaatcgcagcacatacttttacggggtgacaagactagccgagacatgtgggcaaccggaagcctgcctgattttccagcggctgctaaatttttgggttttaggcaaagatgtattccgcgaagcctgtgtctgagtgaatgcccccttgagccaccatcactgacaaggctctgtgcaacgctgaaggactgtccaggtcccctggagttacaactgtcttgtgagtttctcagtgaccagtctctggaaacacttcttgattgtctaccacagctgccgcagctctctcttctgcagctgagccaaaccggcctgtcacccaagagccccttcttgctcgcaaacaccctctcactgtgtcctcgcgtcaaaaaggtggacctccggagcttgcatcacgcaacactacattttaggtcaaacgaagaggaagagggagtctgttgtgggcgtttcacagggtgtagcctgtcccaggagcacgtggaatcattatgttggttgctgagcaagtgcaaagatctctcccaggtagacctgagcgcaaatttgctgggtgactccggactccgctgcctcctggaatgcctcccgcaggtacctattagcggactcctggacttatctcacaactccatttctcaggagagtgcactgtacctgctggagacactccctagctgcccgagagttcgggaggctagcgtcaacctcggcagtgagcagtcctttaggatacatttttctagggaagaccaggctggcaaaaccttgagattgtcggaatgtagctttaggccggagcacgtttctcgcttagccaccgggttatctaaatcactgcagctgaccgagctgaccctcacgcaatgctgtctggggcaaaaacagctggctattcttctgtcactggttggcagaccggctgggttattctcactcagggtgcaggagccctgggccgatcgcgcaagggtcctatccctgttggaggtgtgcgcccaggcatctgggtcagtcaccgaaatctcaatctctgagacccaacagcagttgtgtgtgcagctggagttccctcgccaggaagagaacccggaggccgtcgctctacgattggcccactgcgacctcggcgctcaccatagtctcctggtcggacagctcatggaaacatgcgccaggcttcagcagttgtccctgagtcaggtgaatctctgcgaggacgacgatgcatcctcactactgctccaaagcctgttgttgagcctgagcgagctgaaaacattccggattcagagctcacaggatccaggtcgactgctgcccgatttactgccattcgatccacaccaggccgaccttcaactgtgcgagcatagaggtcccagaccacctggcatctggtctggtcccttgccgcctctggggggagcagggttggtgtag

SEQ ID NO: 57902 - DNA, 60 bp, Artificial Sequence
  Description of Artificial Sequence: Synthetic coding sequence
atggatcctgtgggattacaattgggcaataaaaacctttggtcttgcctggtgcggtag

SEQ ID NO: 57903 - DNA, 225 bp, Artificial Sequence
  Description of Artificial Sequence: Synthetic coding sequence
atggatcccgtaggcctgcagctcggtaataagaatttatggagttgtctagtcaggttgttgacaaaggacccagagtggcttaatgccaagatgaagttttttttgcccaacaccgacttagatagcaggaatgagaccctggatcctgagcagagagtgattttgcagttgaataaacttcacgtgcagggtagcgatacatggcagtctttcatacactag

SEQ ID NO: 57904 - DNA, 1968 bp, Artificial Sequence
  Description of Artificial Sequence: Synthetic coding sequence
atggcaatggccaaagcacgcaaaccaagggaggccctcctgtgggccctttcggacctggaagaaaacgacttcaagaagctcaaattctatctgcgggatatgaccctgagcgagggacaacccccactcgccaggggcgagctggaggggctgatcccagtggacctcgccgaactcctgatcagcaagtacggcgagaaagaagccgtgaaggtggtcctgaaaggcctgaaagtgatgaacttgttggaactggtggaccagctctcccacatctgtctccacgactaccgggaggtctaccgagagcacgtgaggtgtttagaggaatggcaggaagcaggagtcaatggccgttataatcaggtcctcctcgtagccaagccttcatccgaatcgccggaatctctggcttgtccctttcctgagcaggaactggagagcgtcaccgtcgaagctttgttcgatagcggggaaaagcctagcctggctccaagcctcgtggtcttgcagggatctgctggaacagggaagacaacacttgctcggaagatggtgctggattgggccacggggactctttatccagggagattcgattacgtcttctatgtgtcatgtaaagaggtggtattactccttgaatccaaactagagcagctgttgttctggtgttgcggggacaaccaggctcctgtgacagagatcctgcgtcaacctgaacggctcctgtttattctagatggattcgatgaattgcagcgccctttcgaggagaaattgaagaagcgaggcctgagtccgaaggagagcctgttgcatcttctcattcgtaggcatacattaccaacgtgttcccttctcattaccaccagaccgctcgctctacgtaatttggagccattactcaagcaagcccgtcatgtacatatcttgggattctcagaggaagagagggccaggtatttctcatcatattttacagacgaaaagcaggcggaccgcgcttttgatattgtccaaaaaaatgacattctgtataaggcatgtcaggttcctggtatatgctgggttgtctgtagctggctgcagggtcagatggagcgcggaaaggtggttctggaaacaccaaggaattcaacagacatcttcatggcctacgtgagtacatttttacctccggacgacgatggtggatgcagtgaactgagccggcacagggtcctgcgctctctgtgcagcctcgccgcagagggaatccaacaccaaagattcctttttgaagaagccgaactacgcaaacacaatctcgatgggcctagactggccgctttcctgagttccaacgattatcagttaggcctggctataaagaagttctactcttttaggcatattagtttccaggactttttccacgcaatgagttatttggtgaaggaggaccaatcgcgcctgggaaaagaaagccgtcgggaagtgcagcggctgttagaagtaaaagaacaagagggcaatgacgagatgacgctgactatgcagttcctgctggatatcagcaaaaaggattccttttccaacctagaactgaagttttgcttcaggatctccccctgtttagcacaggatctaaagcacttcaaggaacagatggaaagtatgaaacacaacaggacatgggatctcgaattctccctgtacgaggcaaaaatcaagaacctggtgaagggaatccagatgaacaatgtcagtttcaagattaaacacagtaacgagaagaaatcccaaagccagaatctgttttcagtgaagtcatccctcagccacggaccaaaggaggaacagaaatgcccctccgttcatggccagaaggaaggtaaggacaatattgcgggtactcagaaggaagcgtccaccgggaagggacgaggtactgaagaaacccctaaaaatacttacatttag

SEQ ID NO: 57905 - DNA, 201 bp, Artificial Sequence
  Description of Artificial Sequence: Synthetic coding sequence
atggctatggcaaaggctcgcaagccaagggaggcactactgtgggccctctccgatctggaagagaatgacttcaagaaacttaagttttacctgcgggatatgactctgtctgaggggcaaccgcctctcgcaaggggcgagctggaaggtttaatccccgtcgatctggccgagctgctgattagcaaatacggctag

SEQ ID NO: 57906 - DNA, 2940 bp, Artificial Sequence
  Description of Artificial Sequence: Synthetic coding sequence
atggcagagtctgattcgaccgatttcgacctgctatggtatctcgagaacctgagcgataaggaattccagagtttcaaaaaatatttagcacgcaagattctggactttaagcttccccagttcccgctcatccagatgacgaaagaggagttggccaatgtgttgccaattagctacgagggccaatacatctggaatatgctgttcagcatcttttctatgatgaggaaagaagatctgtgccgcaagataatcggcagacgcaaccgcaaccaagaggcctgtaaggcagtgatgcgccgaaaatttatgttgcagtgggaaagccatacttttggaaaatttcactacaaattttttagggatgtttccagcgatgttttttatattctgcagcttgcttatgattccacaagctattacagtgctaacaacctgaatgttttcctgatgggggagagggcctctgggaaaaccatagtgatcaacctggccgtactacgctggatcaagggagaaatgtggcagaacatgatctcctatgtcgtgcacctcactgcacacgagattaatcagatgactaactcttccttagcagagctcatcgctaaggattggccagacggacaggcccctatagccgatatcctgagcgatcctaagaaactactcttcatcttggaagatctggacaatataaggtttgagcttaacgtgaatgagtcggccttgtgttcaaatagcactcagaaggtgccaattccagtcctactggtttcactgctcaagcgcaaaatggccccagggtgctggttcttaatctcatctaggcccactcgcggtaataatgtgaaaacttttcttaaagaggtcgattgctgtacgacactacagttatctaacgggaaacgtgaaatttacttcaactcgtttttcaaggacagacagcgtgcttcagcagccctgcagctggtacacgaggacgagattctggtcggactatgtagagttgcaattctatgctggatcacatgtactgttctcaaacgccaaatggataagggcagagactttcaactgtgttgccaaactccaacggacttgcacgcccacttcctggctgacgcgctcacatcagaagccggtctaacagctaatcagtaccacctgggactactcaagagactctgcctactggctgccggagggctgtttctgagcaccttgaatttcagtggcgaagatctccggtgcgtcggtttcactgaggcagacgttagtgtgctgcaagcggcaaatatcctacttccttcgaacacccacaaagaccgctacaagttcatacatctaaatgtccaggaattttgcaccgccattgcattcctgatggctgtgcccaactatctcatcccgtcaggatcaagagagtataaggaaaagagagaacagtattccgacttcaaccaggtgttcacctttatattcggcctcctcaatgcgaaccgcagaaaaattctggaaacatcttttgggtaccagctccctatggtggactcattcaagtggtactccgtggggtacatgaaacaccttgatagggatcccgaaaagctgacccatcatatgcccctcttctactgcctgtatgagaacagagaggaagaattcgtcaagaccatcgttgatgccttaatggaggtcaccgtgtacttgcagagcgataaggacatgatggtgtcactgtactgtttggactattgctgccacctaaggactctcaaactaagtgtgcagaggatcttccagaacaaggagccattgattaggccgacagccagactctcctatgtcagtaccgctagcggctttgaagacctgctgaaagcacttgcaagaaatagaagcctgacctacctgtcaatcaactgtaccagcatatcactgaatatgttttctttgctgcacgacattttgcatgagccaacatgccagatctctcacttgagtctgatgaagtgcgaccttagagcatcagaatgcgaggagatagcctcattgttgatctctggaggctctcttcgaaaactcacattgagctcaaatccgttgcggagcgacggtatgaacatcctgtgtgatgccctgctccaccccaactgcaccttgataagcctggtattagttttttgctgtttgacagagaactgctgcagcgcactgggacgcgtactgctgtttagccctacactgcgacagctggatctttgcgttaaccgtcttaagaactatggggtgctgcacgtcactttccccctgctgttccctacatgccagctggaagagctgcatctctccggctgtttcttttctagcgatatatgccaatacatcgcgattgtgatcgcaactaacgaaaaactgcgttcactggaaatcgggtctaacaaaatagaagacgcagggatgcagctactctgtgggggtctgcggcacccaaactgcatgttagtgaacattggtctggaggaatgtatgctgacttcagcatgctgtaggagcctagcctctgtacttaccacaaataaaacactcgaaagactgaacttgttgcaaaaccacctgggtaacgacggggtggccaaactcctagagtctcttatttctcccgactgcgtgctgaaggtggttggcctgcctctgacagggctgaacacccaaacgcagcaacttctgatgaccgtaaaggagaggaagccatcccttatctttctgtccgaaacttggtccttaaaagaaggacgcgagataggggtgaccccagcctctcagcccggatctataattccaaacagtaatctcgactatatgtttttcaagttcccaagaatgagcgctgccatgagaacaagtaatactgcctcaaggcaacctctgtag

SEQ ID NO: 57907 - DNA, 3102 bp, Artificial Sequence
  Description of Artificial Sequence: Synthetic coding sequence
atggctgagagcgactcaactgatttcgacctgctgtggtacctcgaaaacctgtctgataaggaattccagtcctttaaaaagtacctcgccaggaaaatccttgactttaaactgccacaattcccactgatccagatgaccaaagaggaactcgcgaatgttttacccatatcatacgaaggtcaatacatttggaacatgttgttcagcatcttctctatgatgcgaaaagaggatctgtgccgcaagatcattggcaggagaaaccgtaatcaggaggcttgcaaggccgtaatgagacgcaaattcatgttgcaatgggaatcacacactttcggcaagttccactataaattctttcgggatgtgtccagcgacgtcttctacatccttcagctggcatacgacagcacctcttactactcagcgaacaacctgaacgtgttcctgatgggagaacgtgctagtggtaaaacaatcgtaataaacctggcagtgctcaggtggattaagggagaaatgtggcagaatatgatctcctacgttgtacacttaacagctcatgaaattaatcagatgaccaattctagtcttgcggagctaatcgctaaagattggcccgacggccaggccccaatcgccgacatactgtccgatccaaagaaattactcttcatcctggaagaccttgataatatccgctttgaattgaatgtcaacgagagcgcactgtgctctaatagtactcagaaggttcccattccagtgctgctggtgagtttgcttaagcgcaaaatggctccaggatgctggttcctcatttcttcacggccaactaggggaaataatgtcaaaacattcctgaaagaagtggactgttgcacaacactccagttatcaaacggcaagcgggagatatactttaatagttttttcaaggataggcagagggcaagtgcagcacttcagctggtgcacgaggacgaaatcctggtcggattgtgccgagtggctatcctgtgctggattacctgcactgtgttaaaaagacagatggataagggcagagatttccaattatgctgccagacaccaactgacttacatgcccattttctggcagacgctcttactagtgaagccggactgacagccaaccagtaccatcttggcctgctaaagcgtctgtgcttgctcgccgctggaggcctgtttctcagcactctcaatttctctggtgaagacctgcgctgtgttggctttacagaagcagatgtatcggtgcttcaagctgccaatatcctcctgccatcgaacactcataaagatcggtataagttcatccatctcaatgtccaggagttctgcaccgctatcgctttcctgatggctgttccaaattatttgatccccagtgggtcacgcgaatacaaggaaaagcgggaacagtacagcgacttcaaccaggtatttaccttcattttcggactgttgaatgctaaccgaagaaaaattctggaaacgtcttttggctaccagctgcccatggttgactccttcaaatggtattcagtcggatacatgaagcatttggaccgcgacccagaaaagttgacccaccacatgccactcttctactgtctttacgaaaatagagaagaggagttcgtgaaaaccattgtggatgccctgatggaggtgacggtctatcttcagagtgacaaggacatgatggtatcactgtactgtctggattactgttgccacctgcggaccctcaagttgtccgtacagcggatttttcaaaataaggagcccctgattagacccaccgcgtctcagatgaaatccttggtgtattggcgagaaatttgtagtttgttctacactatggagtcactgagggagctgcacattttcgacaacgatctgaacggtataagtgagcggatcctgagcaaagcccttgagcattcctcttgtaagctgcggaccttaaaactgagctatgtgagcacagcgtccggcttcgaggatctcctgaaggcactggctaggaaccggtccctgacttacctctctatcaattgcacttccatttctctgaacatgttctccctgctgcacgatattcttcacgagcctacttgccagattagtcacctgagtcttatgaagtgcgacttacgtgcctcggagtgcgaagagattgctagtctattaatctctggcggatccctccgcaagctaactctctcatcgaaccccctcaggagtgacggcatgaacattttatgcgacgcactcttgcaccctaactgtaccttgatctctctggtgctcgttttttgttgtctcacagaaaactgctgttctgccctgggcagggtgttacttttcagccctactctgaggcagctcgatctgtgcgtcaacagactgaagaattacggggtgctgcatgttacctttcccctcctattccccacatgccaactggaggagctccatctgtcaggctgtttcttttcgagcgatatctgccagtacattgccattgttatagctaccaatgagaaactgcgcagtctcgagattggaagcaacaaaattgaagatgctggtatgcagctgttgtgcggaggcctgaggcatccaaactgcatgcttgtgaacattggcctggaggagtgtatgcttacaagcgcgtgttgtcggtcgctggcgtccgtgctcaccaccaacaaaacactcgagcgcttgaatttgcttcagaaccaccttggcaacgatggggtagctaagctcctggaatctctcatctctcctgattgtgtgctgaaggtggtaggcctgcccctgacagggctcaacacccaaacacagcagctgcttatgacagtaaaggagcgcaagccctccctgatctttctctccgaaacttggtcccttaaagagggtagggaaataggtgtcacgccagcttcccagcctggcagcattattcccaacagcaacctggactatatgttctttaagttcccccgaatgtcggccgcaatgcggacctccaataccgctagcaggcagcctctgtag

SEQ ID NO: 57908 - DNA, 3132 bp, Artificial Sequence
  Description of Artificial Sequence: Synthetic coding sequence
atgaacttctctgttattacatgccctaacggtggaaccaatcaaggcctgctgccctaccttatggcacttgaccaataccagttagaagagttcaaactgtgcttggagccgcagcagctgatggatttttggagcgcgcctcaagggcatttccctaggattccttgggccaacttaagagctgcagacccattgaatctctctttcctgctggatgaacacttccctaaggggcaggcttggaaggttgtgttgggaatattccaaaccatgaacctaaccagcttgtgcgagaaggttcgcgcagaaatgaaggagaacgttcaaacccaggagttacaggaccctacccaagaagacctcgaaatgcttgaagccgctgctgggaacatgcagacccagggctgtcaggatcccaaccaggaggagttagatgaactcgaagaggagactgggaatgtgcaggcccaggggtgtcaggacccaaatcaggaagagccagaaatgttggaggaagcagatcataggcggaaatacagagaaaatatgaaagccgaactactggaaacttgggacaacatatcttggcctaaggaccacgtctatataaggaacacaagtaaagatgaacatgaggaactgcagcgcctgcttgaccccaaccgaactcgggcacaggctcagacaatcgtactggtgggaagggcgggagtgggaaagactacactggctatgcaagctatgctgcactgggcaaatggggttctttttcagcagcggttttcttatgtgttttatctcagctgccacaagatccgctacatgaaggaaactacatttgctgaactgatttctttagattggccagacttcgatgccccaatcgaggaattcatgtctcaaccagagaagctcctttttattatagacggatttgaggagataatcatctctgaaagccgtagtgagtcactcgacgatggcagtccatgcaccgattggtaccaggagctcccagtcactaaaatcctgcattctcttctcaaaaaagaactcgtcccacttgctaccctgctcatcaccattaaaacctggttcgtcagggatctcaaggctagcctagtgaacccgtgttttgtgcagatcaccggtttcaccggggatgacctgagggtgtacttcatgcggcatttcgacgacagctctgaagtcgagaagatcctgcaacaacttcgaaagaacgagaccttattccattcatgctcagctccaatggtgtgctggaccgtgtgctcttgtctcaaacagccaaaggtaagatattacgacctccagagcatcactcagacgaccacctctctgtatgcctattttttctcgaatctgttttctaccgccgaagttgatctggccgatgattcctggcctgggcagtggcgggcactatgttccctggccatcgagggactgtggtcgatgaacttcaccttcaacaaggaagatacagagatagaggggttagaggtgccatttatcgactctctatatgaattcaacattctccagaagattaatgactgcggcggatgcactacgtttacccatctgtcattccaggaattcttcgccgctatgagcttcgtattggaggagcctcgggagtttcctccccattctactaagcctcaggagatgaaaatgctgctgcagcacgtgcttctcgacaaggaagcctactggacacccgtcgtgctcttcttctttgggctcctgaacaagaatatcgctcgcgagttagaggatactttgcactgtaagatcagccccagggtgatggaagagctcctgaagtggggcgaagagctgggcaaagctgagtcagccagcttgcagtttcatatccttagactctttcattgcctgcacgagtcccaggaggaggattttacaaagaaaatgcttggacgcatctttgaagtggatctgaacatcctcgaggacgaagagctacaagcatcctccttctgcttgaagcactgcaagagactgaacaaactgagacttagcgtcagttctcatatcctggagagggatctggaaatacttgagacttcgaagtttgactcgcggatgcacgcttggaactctatttgttctactctcgtcaccaacgaaaaccttcatgaacttgatttgagcaatagtaagctgcacgcttcaagcgtgaaaggcttgtgtttggcattgaagaaccctagatgtaaggtgcagaaactgacatgcaaaagcgtcacccctgaatgggtccttcaggatctgatcatcgcattgcagggaaattccaagctgactcatctaaatttctctagcaataaactcggcatgactgtcccattgatactgaaggcactgcggcactctgcttgcaatctgaagtatctgtgtctggaaaaatgcaacctgtctgctgcctcatgccaggatctggctctgttcctgacctctatccaacacgtcactcgtctttgtctgggattcaatcgtctccaagatgacggaattaagcttctctgcgccgctcttacccatcctaagtgcgccttggagcggcttgaactctggttctgccaattagctgcaccagcgtgtaagcacctatctgacgcactgctgcagaataggtctctgacacacctgaatctgagcaaaaattcactgcgcgatgaaggcgtgaagttcctatgtgaggcactggggagaccggatggtaatttgcaatccctgaatctctcaggttgtagcttcacacgggaaggctgcggcgaattagcgaacgcattgtctcacaatcacaatgtgaaaattttagaccttggggaaaacgacttacaagatgatggtgtgaagctgctgtgtgaggcattgaagccccacagggcgctccatactttagggctagcgaagtgtaatctgactacagcatgttgccaacatttattcagcgtcctgtcatcatcaaagagcctagtgaatctgaacctcctcggtaatgagctggataccgatggagtgaagatgctatgcaaagcactgaagaagtcaacttgccggcttcaaaaactgggctag

SEQ ID NO: 57909 - DNA, 3282 bp, Artificial Sequence
  Description of Artificial Sequence: Synthetic coding sequence
atggcagactcctctagtagctccttctttcctgactttgggctcctgttatatctggaggagcttaacaaggaggagctgaatacatttaaactgttcctaaaagagaccatggagcccgaacatggcctgacaccctggaacgaggtgaagaaggccagacgcgaggatttggcaaatctaatgaaaaagtactatcccggagagaaagcgtggagtgtgtccttgaaaatttttggaaagatgaacctgaaggacctgtgtgaacgagcaaaagaggaaattaactggtccgcacagaccattggacctgacgacgcaaaagctggagagacccaggaggaccaagaagccgtgctcggcgacgggacagagtacagaaaccgcattaaggagaaattttgtatcacatgggacaaaaagagtctcgcgggtaagcctgaagactttcaccatggaatagcggaaaaagatcgcaaactactggaacacctttttgatgtggatgtgaaaacaggtgcacagccacagatagtggtgctgcaaggcgctgccggagtcggtaaaaccacgctcgtcagaaaagctatgctggattgggcggaaggctccttgtaccaacagcgatttaagtatgttttctatttaaacgggagagaaattaatcagttaaaagaacgttctttcgcccagcttatctcaaaggactggccatctacagaaggacccatcgaagagataatgtatcagccgtcgagtttactcttcattatcgattcctttgatgagctgaactttgcctttgaggaacccgaatttgccctttgcgaagattggacgcaagaacaccctgtctcttttctgatgtcctctctgctgaggaaggttatgctgccagaggcttctctcctggtcaccactagactcacaacatcaaagcgactcaagcagctgttgaagaaccaccattatgtggagctcctaggaatgtctgaggacgcaagagaagagtacatctatcagtttttcgaagacaaacgttgggccatgaaggtgtttagtagtctgaagagcaacgagatgctcttttccatgtgccaggtgccattggtgtgctgggccgcttgcacatgtctgaagcagcagatggaaaaagggggtgacgttactttgacatgccaaacgactactgcactctttacatgctacatcagttctttatttacccctgtggacggcggttctccaagcctcccaaaccaggcccagcttcggcgattatgccaggttgctgcgaagggcatttggactatgacatatgtattttaccgagagaacctacgccgattaggactcacgcagtcggacgtaagctctttcatggacagcaatatcattcagaaggacgctgaatatgagaattgttatgtgtttactcatctgcatgtccaggagttctttgcagccatgttttacatgttgaaaggctcgtgggaagcaggaaatccctcttgtcagccctttgaggatctgaagtctctcctacagagtacaagctataaagaccctcatttgactcaaatgaagtgttttcttttcggtttgctcaatgaggatagggttaaacagcttgagcggacctttaattgtaaaatgagtcttaagatcaagtcaaaattgttacagtgtatggaagtcttgggcaatagcgactactcccctagtcaactcggcttcctggagctctttcactgcttgtacgagacccaagataaagcctttattagtcaagcgatgcgttgctttcctaaggtagctattaatatatgtgagaagatccatcttttggtgtcatccttttgtctcaaacattgtagatgcctgcgtaccattagattatccgtgaccgtggtttttgaaaaaaagatcctcaagacaagccttcccacaaacacctgggatggtgaccgcattactcactgctggcaagacctctgcagcgtgttgcacacgaatgaacaccttcgagagctggatctgtatcatagcaacctggacaaatctgcgatgaatatcctgcaccacgagttgagacatcctaattgcaagctccaaaagcttcttctgaagtttattacctttcccgatgggtgtcaagatatctcaacttcccttatccacaacaagaatctgatgcatctggacttgaagggatctgacatcggggacaatggcgtcaaatccctttgtgaagccctcaaacacccagagtgcaagctgcagactctccggcttgagtcgtgtaatttaaccgtgttctgctgcctgaatatttcaaacgcgctgattcgctcccaatcattaatttttctgaatctgtccacaaataacctgctggatgatggcgtgcaattgctctgtgaggctttgagacatcccaaatgttatttagaacgccttagtttggagtcatgcggtctcacagaagctggatgcgaatatctgagcttggctctgatatccaataagcgcttaacacacctctgcctggctgataacgtcctcggcgacggcggagtgaagttaatgtccgacgccctgcagcacgcccaatgcactctgaaatcgctcgtattgaggcggtgtcatttcacgtctttaagcagcgaatatctttctacaagcctgcttcataacaaatctctaactcatctcgatttgggttccaactggctgcaggataatggggttaaactactctgtgatgtttttagacacccttcttgtaacctgcaggatctggaactgatggggtgtgtgctcacaaatgcttgctgcctcgacctggccagcgttattctgaataaccccaacttgcggagcctagacctggggaataacgacctacaggatgatggcgtcaaaattctctgcgatgccctgagatacccaaactgcaacatacaacgcctgggcctggaatattgcggtcttacgtccctttgttgtcaggatctgagctccgcattaatctgcaataagcgccttatcaaaatgaacctgacccaaaacactctggggtatgaggggattgttaagctctacaaggtcctcaagagccctaagtgcaaacttcaggtcttggggctctgcaaggaggcattcgatgaggaggcccaaaaactgctcgaggccgttggggtttctaacccccacctgatcatcaagccagattgcaactaccacaatgaggaggatgtttcctggtggtggtgcttctag

SEQ ID NO: 57910 - DNA, 2985 bp, Artificial Sequence
  Description of Artificial Sequence: Synthetic coding sequence
atggccgcttcgttttttagcgattttggtcttatgtggtacctcgaggagctgaagaaagaagagttccggaagttcaaagagcatcttaaacaaatgacattacagctagagctgaagcagatcccctggacagaggtcaaaaaggcaagccgagaggaactggctaacctgctcattaagcattacgaagaacagcaggcctggaatatcacactcagaatttttcaaaagatggatcgaaaggacctgtgcatgaaggtgatgcgagagagaacaggttatacaaaaacctatcaggcgcacgccaagcagaagtttagccgactgtggagctcaaagagtgtgacagaaattcacctgtatttcgaggaggaggtgaagcaggaagagtgcgaccacttagataggctctttgcccctaaagaggccggtaagcagccacggactgtgatcattcaggggcctcagggaattggcaagactacgctccttatgaagttgatgatggcttggtctgacaacaaaattttcagggatcggttcctgtataccttttacttctgttgtcgggagcttcgggagctcccgccaacaagcttggccgatttaatctcgcgagaatggcccgatcccgctgccccaatcaccgagatagtgagtcaaccagagcgtcttctctttgtgatcgactcatttgaagaactgcagggaggcctaaacgagcccgactccgacctgtgcggcgacctaatggagaagcgacccgtgcaggttctgctgtcctccctgctgcgaaaaaaaatgctccctgaagcgtcactgctgatagccatcaagcccgtgtgcccaaaggaactgagagaccaggtgactataagtgaaatttatcagccaagaggtttcaacgaaagtgatcggttggtttacttttgttgcttcttcaaggacccaaaaagggccatggaagcattcaacctcgtccgggagagtgagcaactcttcagcatttgtcagattcctctgttgtgctggatcctttgtacgagccttaaacaggaaatgcagaaaggaaaggacctggccttgacatgccaaagcacaacaagcgtgtactctagttttgtgtttaatctgtttactcctgagggtgccgaaggaccaactccacagactcagcaccagcttaaagccctgtgctctctcgcggctgaagggatgtggactgacacctttgagttttgtgaggatgatttgcggagaaatggtgttgttgacgctgatatacctgcgctcctgggcacaaaaatcctgctgaagtacggagagcgtgaatcgtcttacgtgtttttgcatgtgtgcatacaggagttttgcgcggctttattttacctccttaagagtcatctcgatcatcctcaccccgctgtgagatgtgtacaggaactgcttgtggccaactttgagaaagctagaagagcgcactggattttccttggctgttttctgacgggattgttaaataaaaaagagcaggaaaagttggacgcctttttcggctttcagttgagccaggaaatcaaacagcaaatccaccaatgtcttaaaagccttggcgaacggggtaatccacagggccaagtcgattcactggctatcttctattgcctgtttgaaatgcaggaccctgctttcgttaagcaggcagtgaatttgctccaggaggccaattttcatataattgataatgtcgacctggtggtgtctgcctattgcctaaagtattgctcatccctccggaaactctgcttttccgtccaaaacgtcttcaagaaagaagacgagcatagctccacttcagactattctctcatatgctggcaccacatctgttccgtgctcaccacgtcaggtcatctgcgagagctacaggtgcaggacagtaccctcagtgagagtaccttcgttacatggtgtaatcagctccgtcaccctagttgccgtctccagaaattgggcatcaacaacgtcagtttctccggtcaaagtgtgctgctgtttgaagtgctgttttatcagcccgatctgaaatatttgagcttcaccttgacaaaactttccagagatgatattcgatcactgtgtgatgccctaaattaccccgcaggaaacgtgaaggagctggctctagtcaactgtcacttgagtcctattgattgcgaggtcctggctggacttctcacaaataacaagaaattgacatacctgaacgtgtcctgcaatcaactggataccggagttcctcttttgtgtgaagccctgtgctctcccgatacggtcctggtatacctgatgctggcattttgccatctatctgagcaatgttgcgaatatatcagtgagatgctacttcggaacaaaagcgttcgttatttggacctctccgcgaacgtgttgaaagatgaaggccttaaaacgctgtgcgaggctctgaaacaccccgattgttgtttggatagtctctgtctggtgaaatgtttcattaccgccgctggctgtgaagatcttgccagcgccttaatcagtaatcagaatctgaagatcctccagataggttgtaacgagattggggatgttggggtgcaactgctgtgcagggcgctgacacacaccgactgcagactcgaaatactgggattagaggaatgcggacttaccagcacttgttgtaaggatctggcaagcgtgctgacatgttctaaaaccctgcagcaactgaacctgaccctgaacactttagatcacaccggagtggtggtgctgtgtgaagctctacgacatcctgaatgcgcactccaggtgcttggattgcgcaagacagactttgatgaggaaacgcaggctctgcttacggccgaggaggaacgaaatcccaacctcacgatcaccgatgactgtgatactatcacaagagtggaaatttag

SEQ ID NO: 57911 - DNA, 2817 bp, Artificial Sequence
  Description of Artificial Sequence: Synthetic coding sequence
atggcagcctccttcttctctgattttggactaatgtggtacttggaagagctgaagaaggaggaatttcggaagttcaaggagcaccttaagcaaatgacactgcaactagagctgaaacagatcccatggacagaagtcaagaaagccagcagagaggaactggccaatctgttgatcaaacattacgaggagcagcaggcgtggaacataacactgcggatctttcagaaaatggataggaaagacctgtgcatgaaagtaatgagagaaaggacgggctataccaaaacctaccaggcccacgctaaacaaaagttctcacgcctgtggtctagcaagagtgtcactgagattcacctttatttcgaagaagaggttaaacaggaggaatgcgatcatctcgatcgcctcttcgcaccaaaggaagcaggcaaacaaccacgaacagtgatcattcaaggcccacagggtattggtaagacaacgctgcttatgaagctgatgatggcctggtcagacaacaagattttcagggatcggtttctctacacattttacttttgctgccgcgaactgagggaactgcctcccacatcgctagcggatctgatctcacgggaatggccagacccagccgctccaatcactgaaatagtgtcacagccagagcgcctcctgtttgtcatagacagtttcgaggaattgcaaggcggactcaatgagcctgattctgacctctgtggagacctgatggagaaacggcctgtccaagtcctactgtcttctctcctgcggaaaaagatgctgccagaggctagtctcctaatcgccatcaagcccgtctgcccaaaagagcttcgggatcaagtgacgatcagtgaaatttaccagcctaggggctttaatgagtcagatcggctggtgtacttctgctgctttttcaaggaccccaagcgagcaatggaggctttcaatttggtgagggaaagcgaacaacttttttccatatgtcagatcccactcctctgctggattctgtgtacatctctgaaacaagaaatgcagaagggtaaggacctcgctctgacttgtcagtctactaccagtgtctatagttccttcgtgttcaatctcttcacacccgaaggggctgagggtcccacgccgcaaactcagcatcagctcaaagctctgtgctctctcgccgctgaaggaatgtggaccgatactttcgagttctgtgaagatgacctccggcgaaacggagtcgtggatgctgacatccccgctctcttaggcaccaagatcctcctcaaatatggggaaagagaaagcagctacgtgttcttgcatgtgtgcattcaggagttctgtgccgctctcttttatttactcaagagccatctggatcaccctcatcccgcagttcgctgcgtacaggagctgttggtggctaacttcgagaaagcacggagggctcactggattttcttgggttgttttcttactggactgctgaataagaaagagcaagaaaagttggatgcattctttggatttcagctcagccaggagattaagcagcagatccaccagtgtcttaaatccctcggagagcgtggcaatccccagggacaagtcgactctctggcgatcttttactgtctttttgagatgcaggatcccgcatttgttaaacaggccgtcaatcttctccaggaggctaacttccatattatcgataacgtggatctcgtggtttccgcctactgcttgaaatattgctcgtccctccgcaaactgtgcttcagcgtgcaaaatgtttttaagaaagaggatgagcactcctccacttcggactattccctgatctgttggcatcacatctgctccgtgctgacaacctccggccacttgcgcgagctccaggttcaggactctacgctgtccgagagtacctttgtcacctggtgcaaccaactcagacatccctcatgtaggctgcaaaagctcggtattaacaatgtgtcctttagtgggcagtctgtgctgcttttcgaagttctcttctatcaaccggacctaaaatatctcagcttcaccctgaccaaactgtcccgcgatgacatccggagtctctgcgatgccctgaactatccagctgggaacgtgaaggagctagccctggcattctgccacctaagtgagcagtgctgcgaatacatctccgagatgctactgcggaacaaaagcgtgcgttatctcgatctgtctgccaatgtcttgaaggacgaaggtctcaagacgctctgcgaggcactcaaacatcctgactgttgccttgattctctgtgtctggtgaagtgctttatcaccgcagcaggctgcgaagacctggcatctgctttgattagcaatcagaacctgaaaatactccaaatcgggtgcaacgaaattggtgatgttggcgtgcagctcctttgccgcgctctgactcacacagactgcaggctggagatcctgggcctggaggaatgcggactgacatcgacttgctgcaaggacctggccagcgtattgacttgtagcaaaacgttgcaacaactcaatcttacactaaacacgctggatcacaccggtgttgtggtgctgtgcgaggccctgcgccacccagagtgtgcgctgcaggtgctaggactgagaaaaaccgattttgacgaggagacccaggcacttctgactgcagaagaagagagaaatcccaatctgaccataacagatgactgcgacactatcactcgggtggaaatttag

SEQ ID NO: 57912 - DNA, 3114 bp, Artificial Sequence
  Description of Artificial Sequence: Synthetic coding sequence
atgacaagccctcagttggagtggacgcttcaaactttacttgaacaattaaatgaagacgagcttaaatctttcaagtccctcctgtgggccttccccctcgaggacgttctgcagaaaaccccatggtcagaagttgaagaagcggacggaaaaaaactggccgagatccttgtcaacacctcgagcgagaactggattcggaacgccacagtcaatatactggaggagatgaatctgacagagctgtgtaagatggctaaggctgaaatgatggaagatggacaggttcaggaaatcgacaaccccgagcttggcgacgctgaagaggatagtgagctggccaaacccggtgaaaaggagggatggcgcaactccatggaaaagcagtcgcttgtctggaagaacaccttttggcagggtgacatagacaattttcacgatgacgtaacactgaggaatcagagattcatccctttcctgaaccccaggacaccccgtaaacttaccccttatacagtggtactgcacggccctgccggtgtgggcaagaccactttggctaagaagtgcatgcttgactggaccgactgcaacctgtcgccaacgcttcgttatgccttctatctaagttgcaaggagctgtcaaggatgggaccgtgctcctttgccgagctcatctccaaagactggccagagctccaagatgacataccgagtattctggctcaggcccagcggattttgttcgtagtcgacgggctcgatgagctgaaggtgcctccgggtgccttgatccaggacatttgcggggattgggagaagaagaagccagtgcctgtactgttaggatccctgttaaaacgcaagatgctacccagagcagctttgctggtaaccacccggccacgagcactgagggaccttcaacttctagcacagcagccaatttacgtacgggtggaggggtttctagaagaagatagacgcgcttacttcctgcgccactttggcgacgaggaccaggctatgcgcgcttttgagctgatgaggagcaacgcggcactttttcagctcggatccgctcctgccgtctgttggattgtgtgcacaactctgaagctacagatggaaaaaggagaagatccagtgcccacttgcttgaccaggactggcctgtttctccggtttttatgttcacgcttcccccagggcgcacagttgcggggtgcgctgaggaccttgagcctgttggcagcccaaggcctgtgggctcagatgtctgtttttcatcgggaagaccttgaacgcctgggcgtgcaggagtcagacctaagattgttcttggatggtgacattttgcgccaggatcgcgtgtcgaagggatgttactcctttatccaccttagttttcaacagtttcttacggccctcttctacgctttggagaaggaagaaggtgaggacagggacgggcatgcgtgggatatcggagatgtgcagaaactgctctccggtgaagagagattgaaaaaccccgatctgatccaggtcggccattttctgttcggcctggccaacgagaagcgggctaaggaacttgaggcaacgttcgggtgtagaatgtcccccgacatcaaacaagaactgcttcagtgcaaagcccacctgcatgccaacaagcccctctctgtcacagatctcaaggaagtccttggctgtttatatgagagccaggaggaagagctcgcaaaagtggttgtggccccttttaaagagatctctatccatctgactaacacgagcgaggtcatgcactgtagctttagtttaaaacactgccaggacctccagaagctgagccttcaggtcgccaagggtgtttttctggaaaattatatggactttgaattggacattgaatttgagcgctgcacctacctgactatccccaattgggctaggcaggatcttcgatccttgcggctgtggaccgacttctgctctctgtttagcagcaactccaatctgaaattcttagaggtcaaacagtcttttttgagtgactcaagtgtgcgaattctgtgcgaccacgttactcgaagcacttgtcatctccagaaggtggaaatcaaaaatgtcacccctgacacagcctaccgcgacttttgtctggccttcattggcaaaaagaccttgacgcacctcaccctggcgggacacattgaatgggaacgaactatgatgctgatgctctgcgacttgttacgaaaccataagtgtaatctccagtatctgcggctcggcggacactgtgccactccagaacagtgggccgaatttttttatgtattgaaggccaatcagtcactaaagcatctgcggctgagtgccaacgtcctcttagatgagggcgcaatgctcctgtacaagactatgactaggcccaagcacttcctacagatgttgagcctggagaattgtagactgactgaggcctcctgtaaagacctggctgccgtgttagtggtttccaagaaactgacccatttgtgtcttgcaaagaaccccataggtgacacaggcgtcaaatttttgtgcgagggccttagctatccagattgcaagctgcagaccctggtccttcagcagtgcagcatcacaaagttaggttgtcgttacttgagtgaggccctccaggaagcctgctctttgacaaatctagatttgtccattaaccagattgccaggggactctggatcctgtgccaggcattggaaaatcctaactgcaacctgaagcatctgagactttggtcgtgttcccttatgcccttttattgtcagcacctcgggtccgcactactctcaaaccagaagctggagacattggacctgggacaaaatcacctatggaaatccggcattattaaacttttcggcgtcttgcgtcagagaacaggatcactgaagatcctgcgactgaaaacctatgagacgaacttggaaatcaaaaaactgctggaggaggtgaaggagaagaatccgaaactgaccatcgactgcaatgccagcggagccacggcaccaccctgttgcgatttcttctgttag

SEQ ID NO: 57913 - DNA, 2943 bp, Artificial Sequence
  Description of Artificial Sequence: Synthetic coding sequence
atgacctccccgcagcttgaatggacattgcagaccctgctcgaacagcttaacgaagatgaacttaagtctttcaagtccttgttgtgggcattccctctggaggatgtcttacagaaaacaccatggagtgaggtggaggaggcagatggaaaaaaactggcggagatcctggtgaacaccagctctgagaactggatccgaaacgcaaccgtcaatattctggaagaaatgaacttgacggaactgtgcaaaatggccaaggcagagatgatggaggatggacaagtgcaggaaatcgacaaccctgaacttggggatgcagaggaagattctgagctggccaaaccaggagaaaaggaggggtggcggaacagcatggaaaagcagtccctggtctggaagaatacgttttggcaaggagacattgacaacttccatgacgacgtgacactccggaatcagcggtttatccctttcctcaacccaagaacacctcggaagctcacgccatacaccgtggtgcttcatggccctgctggcgtaggtaaaaccaccttagccaagaaatgtatgctggactggaccgattgcaacctgtctcccactctgcgctatgctttctacttgtcctgtaaggaacttagtaggatgggcccttgttcctttgcagaacttatcagcaaggactggccagaactgcaggatgatattccctcgatcctggcacaggcccaacggatcctctttgttgtcgatggcctcgacgaactaaaggtgccccctggagccctgattcaggatatctgtggggattgggagaaaaaaaagcctgttccagtgctgctgggctccctattgaagcgcaagatgctccctagggccgctttgctggttactacgagaccgagagcacttagagacttgcagctcttggcccagcaaccaatctacgtgcgggtggaagggtttctggaagaggaccgcagagcctacttcttacggcatttcggggatgaggaccaggcaatgcgggcattcgagctgatgaggtccaatgctgctctgttccagctgggctctgctcctgcggtatgttggatcgtttgtacgacgcttaagctgcagatggagaagggcgaagatcccgtccctacctgcctgacccggacggggttgttcctaaggtttctgtgctcaaggttccctcaaggtgcccagctgcggggagctctgcggacactctctctgctggcggcacagggcctctgggctcagatgagtgtatttcacagggaagatcttgaacggctaggagtgcaagaatctgacctgagactctttctggatggagatatcctgcgacaagacagggtgtcgaaggggtgctattccttcatacatctatctttccagcagtttcttacagctctcttctacgccctagaaaaggaagaaggagaagaccgggacggacatgcctgggacatcggcgatgtgcaaaaacttctcagcggggaagaaaggctaaaaaatccggacctgatccaggtcggccattttttgtttgggctggcaaacgagaagagagctaaggaactggaagctacttttgggtgccgcatgtccccagacatcaagcaagaactcttacagtgcaaggcgcacctccatgcgaacaagcctttgtccgtgacggatttgaaagaagtccttggctgtctgtatgagtctcaggaagaagagctagccaaagtggtggtcgctccatttaaagaaatttctatccacctgaccaacacttccgaagttatgcattgttccttttctctgaagcactgccaggatctgcaaaagctgtctctccaggtcgctaagggcgtctttctggagaattatatggattttgaactcgacatcgaattcgagagatgtacttacttaacaatcccaaactgggcgcgtcaggacctcagaagccttcgactttggacagatttctgttcattgttttcgtccaattctaacttaaaatttctagaggtcaagcagtcttttctgtcagactccagcgtgagaatcctttgtgaccacgttacgagaagcacatgccacctgcagaaagtcgagatcaaaaatgtaacaccggataccgcataccgggatttttgccttgcctttatcggtaagaagaccttgactcacctgaccttggccggtcacatcgaatgggaaagaaccatgatgctgatgctatgtgacttactgagaaatcataagtgtaacctgcagtacctgaggcttggaggacattgcgccacccctgagcaatgggccgaatttttttatgttctcaaggctaaccaatcactgaaacatctgaggctgtctgcgaacgtgctgctggacgaaggcgcaatgctgctgtataagacgatgacccgcccaaaacactttttacagatgctgtctttggagaattgcaggctgaccgaggcctcttgtaaggatctggcagctgtgctggtcgtctcaaagaaactgactcatctgtgcttggcgaaaaaccccatcggagacacaggcgtcaagttcctgtgcgaaggtctgtcttaccccgactgcaagcttcaaacactggtgcttcagcaatgctcaataaccaagcttggatgtaggtacctgtctgaagcgctccaggaggcatgctccttgacaaacctggacctatcaatcaaccagatcgcaagaggtttatggatcctctgccaggcattggaaaaccccaactgcaatctgaagcacctgaggctgaagacctatgaaacaaatttggaaataaaaaagttgctggaggaggttaaagagaaaaacccgaagttgacaattgactgtaatgcttcaggcgctacagctccaccttgctgtgatttcttctgctag

SEQ ID NO: 57914 - DNA, 2019 bp, Artificial Sequence
  Description of Artificial Sequence: Synthetic coding sequence
atgactagcccccagctagaatggacactccagaccctactcgagcagttgaacgaagacgaactgaagtcattcaaatcattactgtgggcttttcctctcgaagatgtgctgcagaaaaccccatggtctgaggttgaagaggccgatggcaagaagctcgcagagatcctggtaaatacctcgagcgaaaactggattcgaaacgcaaccgtaaacattctggaagagatgaatctcaccgagctctgtaaaatggccaaggccgagatgatggaggaggaccgaagagcttactttctaagacacttcggtgatgaggaccaggccatgcgtgctttcgaactgatgcgaagcaacgcggctttattccaactaggtagcgcacctgcagtatgttggatcgtgtgtacgactcttaagttgcaaatggagaaaggagaagacccagtgcccacatgcctaaccaggacgggactgttcttgaggtttctgtgttctaggttcccacagggtgcccagctacgtggcgctctgagaacactgtctttgcttgcggctcaagggctgtgggcccaaatgtctgtcttccatcgagaggacctggaaagactcggggtgcaggaatcagacctgcggctgttcctggacggagacattcttcgccaggaccgggtcagcaagggctgctactcctttatccacctgtcattccagcagttcctcaccgcactgttttacgccctcgaaaaggaggagggagaggaccgggacgggcatgcctgggacataggcgacgttcagaagcttctgtccggagaggaacgcctgaaaaaccccgatctgattcaagtcgggcacttccttttcggtctagcaaacgagaagagagccaaggaattagaggctacattcggctgtcgcatgtcccctgatatcaaacaggagttgctgcaatgcaaagcccacctccatgcaaacaagcccttaagcgtgaccgatctcaaggaagtccttggatgcctatacgagtctcaggaggaggagctagcaaaagtagtggtagcaccattcaaggagattagcatccatctaactaacacctccgaggtgatgcattgttccttttccctgaaacattgtcaagacctccaaaagctctcactgcaggtggccaagggagtttttctggaaaactacatggactttgagctcgatattgagttcgagcgctgtacttatctcaccatccccaattgggcccgtcaagacttaagatctctaagactgtggaccgacttttgcagcctcttcagctctaattcgaatttgaaattcctggaggtaaagcagagcttcctgtccgactcaagcgtgcggattctctgtgatcacgtgacaagatctacctgtcatttacagaaagtggaaatcaagaacgtcaccccggataccgcgtacagggacttctgcctggcctttatcggcaaaaagacactcactcacttgaccttagctggtcatattgagtgggaacgaaccatgatgctgatgttgtgcgatctgttgcggaaccacaagtgtaacctccagtacctgaggctcggaggccattgtgctacccctgaacagtgggctgaatttttctacgtgctaaaggccaaccagtcccttaaacatcttcgtctaagtgcaaacgttttgttggatgaaggggcaatgttattgtacaagacgatgacccgacccaagcattttttacagatgttgagtctcgagaactgtagactgacggaggcctcctgcaaagatctggccgctgtcttggtggtctccaaaaagcttactcacctgtgtttagctaaaaacccaatcggtgatactggcgttaagttcctgtgtgaaggcctttcgtatccagactgtaaactgcagccacataagccgggacttgagtatcagccagactcctcttggattgtggactctctatccgggatccgtgagagtaaactgtag

SEQ ID NO: 57915 - DNA, 3198 bp, Artificial Sequence
  Description of Artificial Sequence: Synthetic coding sequence
atgagcaggaagcatcgactggaggccaggcctgacctgcgagagtttttttccctgaatcttcgatctcacacaagatcgactatgacttcaccacaactcgagtggacccttcagactctactggaacaattaaatgaagatgagcttaaaagctttaagtccctgctctgggcctttcccttggaagacgtgctgcaaaagacgccttggtctgaagtggaagaagcggacggaaaaaagctggccgagatcttggttaacacttcttccgaaaattggatacggaatgcaactgtgaatattctggaagagatgaatctgacagagctgtgcaagatggctaaggccgaaatgatggaggacggtcaggttcaagaaattgacaaccctgagcttggcgatgccgaggaagactcagaacttgccaaaccaggggaaaaagagggctggaggaactccatggaaaagcagagcctagtgtggaaaaatacattttggcagggagacatcgacaattttcacgatgacgtcaccctgcgaaaccagagatttatcccatttcttaatcctcggactcctcggaagctaaccccttatacagtggtgctgcatggcccagccggagttgggaaaaccaccctcgctaaaaagtgtatgctggattggacagactgcaatctctctccaactctacgctacgccttctatctgtcatgtaaagagttgtctagaatgggaccctgttcttttgctgaactcatcagcaaggactggcccgaattgcaagatgacatcccctcaatcctggcgcaggcacagagaattctttttgtcgttgatgggttggacgaactaaaggtacccccaggtgcactgatacaagacatttgcggagactgggaaaagaagaagccagtgccggtactattggggagcttgctcaagcgaaaaatgctgcctcgagctgccctgctggttactactcggcctagggctctgcgagatctccagttgctggcccagcagcccatttatgtgcgcgtggagggcttccttgaggaagatcgaagagcgtattttctccgtcattttggtgacgaggaccaagctatgagggcttttgaactgatgcgatccaacgcagccctattccagctgggcagcgcaccagccgtatgctggattgtctgtactacgctgaaactgcagatggaaaaaggcgaggatcccgtaccaacatgcttgacgaggacagggctcttcctccgctttctctgcagcagatttccccagggggcacaactgcggggtgccctccggaccctgagcctccttgctgcacagggcttatgggcccagatgtcagtgttccatagggaagacctcgaaagactcggggtgcaggagtccgatctgcggctcttcctggacggcgacattttacgtcaagatcgcgtctccaagggttgttactcgtttatccacctgtcgttccaacaatttctgacagcccttttttacgcgctagagaaagaagaaggagaggatcgggacggacacgcatgggatattggcgacgtgcagaagttactttccggcgaggagaggctgaagaacccggatctcatccaggttggccactttctcttcgggttggccaatgagaaaagagccaaagaactcgaggccacgttcggctgtcgcatgtctcccgatatcaaacaggagttactccagtgcaaagcacatctacacgcgaacaaaccattgtctgtgaccgacctgaaagaggtattagggtgcctgtacgaatctcaggaggaggaactggccaaagttgttgttgccccatttaaggagatcagtattcacctcactaacacctccgaggtcatgcattgtagcttctcgctcaagcattgtcaggatttacaaaaactctctctccaggtcgctaagggagtgttcctggaaaattacatggacttcgagctggacatagagttcgaacggtgtacttacttaacgattccaaattgggcaagacaggatctgaggtccctccggctatggacggacttctgttcattgttcagctctaactcgaatctcaaattcttggaagtgaagcagtcattcctgtccgactcatctgtcagaattttgtgcgaccatgtgacgcgtagtacgtgccacctgcaaaaagtcgagattaagaatgtcacacccgatactgcttaccgggacttttgcctggccttcattggaaagaagactctgacacacctaacactagccggtcatatagagtgggaaaggacaatgatgttgatgctgtgcgatttgctccgaaaccataagtgcaatctccaatatctgcggctggggggacactgtgcaacgcctgagcagtgggctgaatttttttatgttctcaaagcaaaccagtctctaaagcatctgagactatctgctaacgtgctgctggacgagggagcaatgctcctgtataagacaatgactaggcctaagcacttccttcagatgctctcactggaaaattgtcgtctgacagaggcaagctgtaaggacctcgctgctgtgctcgtcgtctcaaaaaaactgacccacctctgcctggccaagaatccaatcggggatactggcgttaagttcttatgtgagggtctgagctaccccgattgcaaactgcagaccctggttttgcaacagtgctccatcactaaactgggatgtcgatatctgtccgaagccctccaagaggcatgctcactgacaaatttagacctaagtatcaatcagatagctaggggcctttggatcctgtgccaggccctggagaacccaaattgtaaccttaaacacttgcgcctgtggtcctgtagtctcatgcctttttattgtcagcacctcggtagtgccttactgagtaaccagaagctggagaccctggatcttggacagaaccacctttggaaaagtggcattatcaagctcttcggcgtcctgcgtcagcggaccggatctttaaaaatcctgagactgaaaacctatgaaactaacctggaaataaaaaagctgctcgaggaagtgaaggagaagaatcctaaactaaccattgactgtaacgcctcaggtgcgactgcccctccttgttgtgattttttttgctag

SEQ ID NO: 57916 - DNA, 3030 bp, Artificial Sequence
  Description of Artificial Sequence: Synthetic coding sequence
atgaccagccctcagctagaatggactcttcagacattactcgagcagctgaacgaggatgagctcaaatcattcaagagtcttctgtgggcttttcccttggaggacgttttacagaagacgccatggagtgaagtcgaagaagcagatgggaagaaattggccgagattttggtgaacacaagttcagagaattggatccggaatgctactgttaacatactggaagaaatgaatctcacagagctctgcaagatggcaaaagccgagatgatggaggatggccaagtacaggagatcgataacccagaacttggagacgctgaggaggatagtgagctggcaaaaccaggagaaaaagaaggctggcgcaactcaatggagaaacagtccttggtttggaagaacacattttggcagggcgacatcgacaatttccatgatgatgtcacactgcgcaaccagcggttcattccttttctgaatccgaggactccgcgaaaactgaccccttacacagtggtgctacatggacccgctggcgttggcaagacaaccctggctaaaaagtgcatgctagactggaccgactgtaatctgagcccaactctgagatatgcattttacctcagctgtaaagagctctccaggatgggaccctgctctttcgctgagttaataagcaaagactggcccgaattacaggatgacatcccttccatcctcgcccaggcacaacggatcctgtttgttgtcgatggcctggacgaactcaaggtaccccctggtgccctgatccaggatatttgcggagattgggagaagaaaaaacctgttcccgtgctcctaggttcgttgctgaagaggaagatgttgccccgtgctgccctgcttgtgactacacgtcccagggccctgagagacctgcaattactggctcaacagccaatttatgtgcgggtggaaggctttctggaagaggataggagagcatatttcttgagacactttggggatgaggatcaggcaatgcgggcatttgagctcatgcgttccaatgccgcactgtttcagttggggtccgccccagctgtgtgttggatagtgtgtacaaccctgaagttacagatggaaaaaggagaggaccctgtgccaacatgtctcaccaggaccgggctttttctgaggtttctttgtagcagattcccacaaggggctcagttgcgaggagccttgcgaacgctgtctctgctggctgcccagggtctttgggcacagatgagcgtgtttcaccgggaagatcttgagaggctgggcgtacaagagtctgacctgcggctgttcctcgatggcgacatactaaggcaggaccgcgtcagtaagggatgctactctttcattcatctttccttccagcagttcctgaccgccctcttttatgcactggagaaagaggagggcgaggaccgagacggtcatgcgtgggatattggcgatgtccagaaactgctgtccggcgaggagagactcaagaatcctgatctgatccaagtggggcacttcctttttggcctggcaaacgagaagcgggcaaaagagttggaggcaactttcgggtgccggatgagcccagatatcaaacaggagctcctgcagtgcaaggctcacctgcatgcaaacaagccattgtcagtgacggacctgaaggaggttttaggctgtctgtatgaaagccaggaggaggagctggctaaggtggtagttgcaccgttcaaggagatttccattcaccttacaaacacatccgaggttatgcactgctcttttagcctaaagcattgccaggatctgcaaaagctgtcgctacaagtagccaaaggtgtttttctagaaaattacatggactttgagctggacatcgagttcgagtcctccaatagtaatctcaaatttctcgaggtcaaacagtcctttctgagcgacagctccgtccgaattttgtgcgatcacgtgacccgttccacttgccatctgcagaaggtggagatcaagaacgtcacaccagacacagcttaccgagacttctgtttagccttcattgggaagaagacattgacccacttgactctggccggacacatcgaatgggagcgaactatgatgctcatgttgtgtgatctactcaggaaccataagtgcaacctgcagtacttgcgacttggaggacattgtgccaccccagagcagtgggcggaattcttttatgtcttaaaagccaaccagtccctaaaacatctgagactgtccgccaacgtcttgctggacgagggtgcaatgttgctgtacaaaaccatgaccaggccaaaacatttcttacagatgctgtctcttgagaattgtaggttgacagaggcttcatgtaaggatttagcagcggtgctggtggtttccaaaaagcttacacatctgtgtctggccaaaaatcccattggcgacacaggagttaaatttctgtgtgaaggtctgtcctatccggactgtaagctgcagacactggtcctgcaacaatgctcaataaccaagctcggttgtcgttacctgtctgaggccctgcaggaggcttgttctctgaccaacctggacctgtctataaaccagatagcacggggactatggatcctgtgccaagccttggaaaatcctaattgcaacttgaagcacctgagattgtggagttgttccctgatgccattctactgccagcacctcggctccgccttactgagcaaccagaagctggagacacttgacctggggcaaaaccacctctggaagagcggcattattaagctctttggggtacttcgacagcgcactggttctctgaaaatcctgcgtctgaaaacgtacgaaaccaacttggaaataaagaaactgttggaggaagtgaaagaaaagaatccaaagcttaccatcgattgcaatgctagcggggcaaccgctccaccctgctgtgatttcttctgttag

SEQ ID NO: 57917 - DNA, 828 bp, Artificial Sequence
  Description of Artificial Sequence: Synthetic coding sequence
atggaggaggtgagggagggccacgctctggggggaggcatggaggctgatgggcctgcctcactgcaggaactgccaccttctccacggagcccatccccccctccgtctcctccgccactcccttctcccccatccctccccagccctgccgcacccgaggctcctgagctgcccgaacccgctcaaccatccgaagctcatgcgaggcagctccttttggaggaatgggggccattgagcggtggcttggagctccctcaaagactcacttggaaactccttcttctgcggcgacccttatacagaaatttgctgcgctccccgaaccctgaagggataaatatctacgagcctgcgcctcccacgggccctacccagcggccactggaaactctgggtaattttcgcggatggtatattaggacagagaagctgcagcaaaaccagtcctggaccgtgaagcagcagtgcgttgatctgctggctgaggggctttgggaggaactgctggacgacgaacagccggcaataaccgtcatggactggtttgaggatagcaggttggacgcctgcgtctacgaacttcatgtctggctgctggctgctgaccgcaggaccgtgatcgctcagcatcatgttgcccctagaaccagcggcagggggccacccggaaggtgggtgcaggtgagccacgtgttccgccattacggcccaggggtgcgtttcatccattttctccacaaagcaaaaaatcgaatggaacctggtgggctcaggcgcaccagggtcaccgacagttccgttagcgtgcagctccgcgagtag

SEQ ID NO: 57918 - DNA, 1413 bp, Artificial Sequence
  Description of Artificial Sequence: Synthetic coding sequence
atgggcctgtacgccgctgctgccggagtccttgcaggtgtggaaagcagacaggggtccatcaaaggtctggtgtatagttcaaattttcaaaatgtgaaacagctgtacgcacttgtgtgtgagacgcagcggtacagtgctgtgctggatgccgtcatcgcctctgccggactgctcagagcagagaagaagttgcgtccacacctagccaaagtccttgtatatgagcttctgttaggcaagggctttcgcggaggcggtggtcgctggaaagctctcctgggtagacatcaggccaggctgaaggctgaactggccaggctgaaggtccatcgaggcgtttcaaggaacgaggacctgctggaggtgggctccagacctgggcctgcatctcagctccctaggttcgtgagagtgaacaccctaaaaacttgtagtgatgacgttgtggactattttaaacgccaggggtttagctatcagggcagagcaagtagcctcgacgacttgagagcgctcaagggcaagcactttctgcttgatccactgatgcccgagcttttagtgttcccagcccagacagatctccacgagcatcccctgtaccgggctgggcacctcattctgcaagatagggcctcatgcctcccagccatgttgctcgatcctccaccaggctctcatgtaattgacgcctgtgccgcacccggaaacaagacttctcatctggccgcactcctgaagaaccagggcaaaatttttgcctttgacctggacgcgaaacgactagccagtatggcaaccctgctggctagagcaggggtgtcttgctgcgaactcgcagaagaggatttcttagctgtttctccctcagacccccgttaccatgaagtgcactacatcttgttagacccatcttgcagcggtagcggcatgccgtctaggcagttggaagagcccggagctggcacccccagtcctgtccgattgcacgccctggccggattccaacaaagagccctatgtcatgcactgactttcccgagtctccagaggctggtttacagtacttgcagtctctgccaagaggaaaacgaggatgtcgtgcgggacgccctgcagcagaatccaggagcatttaggctggctcctgccttacccgcttggcctcaccggggattaagcacattccccggtgccgaacattgtctgagagcctctcctgagacaacacttagctcgggcttctttgtggcagtgattgaaagagttgaagtaccttcactgacagggcagtcaatcagtactcgaactcacacacagccctctccaaaagaaaaggaggagaccgctaaaagcagatctcgatgcttgcatacggccctgcacattgctgaagccccaggctag

SEQ ID NO: 57919 - DNA, 1176 bp, Artificial Sequence
  Description of Artificial Sequence: Synthetic coding sequence
atgggcctatacgcggctgcggcaggtgtgctggcgggagtcgagtcccggcaggggtctattaagggacttgtttactcttcaaatttccagaatgtaaagcagttatacgcccttgtgtgcgaaacacagcgctactctgccgtgctagatgctgtgatagctagtgccggactgctgcgtgctgagaaaaaactcagacctcacctggctaaagttcaccggggagtgagccgcaatgaggatctgctcgaggtgggcagtcggcctggacctgcgtcccagcttccaagattcgtgagggtgaatacgctcaagacctgttcagatgatgtggtggactacttcaagcgccaaggattctcctatcaggggagagcctcctctctggacgatctgagagccctcaagggaaagcacttcctgctggaccctctgatgcctgaactcctggtcttcccagcacagacagacctacatgagcaccccctgtatcgtgccggtcacttgattcttcaagaccgagcctcctgcttgccggcaatgctattggaccctccgcctggctcccacgtaattgacgcatgtgccgcaccagggaataagaccagccacctggctgccctgctaaagaaccaaggaaagatctttgcattcgatctggatgctaaaaggctcgcttcgatggccactctgcttgcacgagcaggagtgtcctgttgcgaactcgccgaggaagattttctcgccgtcagtccttctgatcctaggtatcatgaggtgcattacatcctgctcgatccaagctgttccggatcgggaatgcccagcaggcaactcgaagaacccggtgcaggaactccatcacctgtacgactgcatgcccttgcgggatttcagcagagagctctgtgccatgctctcacatttccaagcttgcagcggctggtatacagtacttgctccctgtgccaagaagagaacgaggatgtggttcgggacgcgctgcagcaaaacccaggtgcattccggctcgcccctgctctgcctgcttggcctcatcgaggtctgagcacctttccaggtgcagagcattgtctccgtgccagccccgagacaacgctttcaagcggattctttgtggcagtgatcgaacgagtggaggtcccacgatag

SEQ ID NO: 57920 - DNA, 1023 bp, Artificial Sequence
  Description of Artificial Sequence: Synthetic coding sequence
atgctaacccagctgaaggctaaaagcgagggaaaactggccaagcagatttgtaaagtagttttggaccactttgaaaagcagtatagcaaagagttgggcgacgcctggaacactgtgcgcgaaattttgacttctccatcttgctggcagtacgctgtgctgctcaatcgctttaactatcccttcgagctggaaaaggacctacacctgaaaggttaccacactctatcacagggaagcctccccaattatcccaagtctgtgaagtgctatctgtctcgaacaccgggtagaattccctcagagcgccaccagatcggcaacctgaaaaagtattacctgcttaatgccgcttcactgctgcctgtccttgcccttgagctgcgcgacggcgaaaaggttttggatctgtgcgctgcacctgggggaaagtctatagcgctcctgcagtgtgcctgccccggttacctgcactgcaatgaatacgactccctgcggctgaggtggttgagacaaactctcgagtctttcatcccccagccactaatcaacgtgattaaggtcagcgagcttgacgggcgtaagatgggagatgcacaaccggaaatgtttgacaaggtgctggttgatgctccgtgttctaacgacagatcatggctgttttccagtgattcccagaaggctagttgtcgcatttcccagaggaggaacctgcctctgttgcagatagaactgctgcgatcagctatcaaagccctccgcccaggcggaatcctagtttattcgacgtgcaccctgtcaaaggctgaaaatcaggatgtaatcagcgagatcttaaattcacatggaaatatcatgcccatggatatcaagggcatcgctcgaacttgttcacatgattttacttttgctcctactggacaggagtgtggactgcttgtgatccccgacaagggtaaggcttggggcccaatgtacgtagcgaagctgaaaaaaagttggagcacaggaaaatggtag

SEQ ID NO: 57921 - DNA, 1155 bp, Artificial Sequence
  Description of Artificial Sequence: Synthetic coding sequence
atggcagcactcactttgaggggcgtccgagaactgctgaagcgcgtggacctcgcaaccgtaccacgtcgccacaggtacaaaaagaagtgggctgcgacagaaccaaagtttcctgctgttaggctggccctgcagaacttcgatatgacgtattctgttcagtttggcgatttgtggccatccataagggtcagcctgctcagcgagcaaaagtatggagccttggtgaacaattttgctgcttgggaccatgtctcagcaaagctggagcagcttagcgcgaaagatttcgtcaatgaggccataagccactgggaactgcaatctgaggggggtcagtccgcagccccatctcctgcttcgtgggcatgttctccaaatctccggtgctttacattcgacaggggtgacattagtcgttttcctcccgcacgcccaggctccctgggcgttatggaatattacctcatggacgccgcatcccttcttcctgtgcttgccctgggacttcaaccgggtgatatcgtcctcgatttgtgcgccgcaccaggaggtaaaaccctggcactgctgcagaccggatgctgtcgaaatctcgcagcaaatgacctgtctcctagcaggatcgcgagactgcagaaaatcctgcacagttacgtgccagaggagatcagggacggcaatcaggtgagagtaacgagctgggacgggcgtaagtggggtgaactagaaggggatacctacgaccgggttttagtcgatgtcccttgtaccactgaccgtcattctttacatgaggaagagaataatatcttcaagcgctctagaaagaaggaacgacaaatcttacccgtcttgcaggtgcagctactagcggctgggcttttggctacaaaacccggaggacatgtggtttattctacttgctccctctcacatctccagaatgagtatgtcgtgcagggcgcaatagagctcctggccaatcagtactcaatccaggtacaggtagaagacttgacacatttcaggcgggtttttatggacactttctgcttcttctcttcatgtcaggttggcgagttggtgatccccaatcttatggcaaattttggcccaatgtacttttgcaaaatgaggcggcttacttag

SEQ ID NO: 57922 - DNA, 1008 bp, Artificial Sequence
  Description of Artificial Sequence: Synthetic coding sequence
atgacttacagtgtgcagttcggagacctgtggccttccatcagggtctctctactgtctgaacagaaatacggagcactcgttaacaatttcgcagcatgggaccatgtgagcgctaagctggagcagttgagcgcaaaggacttcgtgaacgaggctatctctcattgggagttacaatcagaagggggacagtctgcagcgccttcaccagccagctgggcatgttctccaaacctgaggtgcttcacttttgaccgaggagacatctcacgattccctcctgccagacctggatctctgggcgtcatggagtattaccttatggacgcagcaagtttactaccagtcctggccttaggtctgcagccgggagacatcgtactggatctgtgtgccgcaccgggaggaaaaaccttggcgctgctccaaaccggctgctgtaggaacctggctgctaacgacttgtcaccgtctaggatagcccgactgcagaagatacttcattcttacgtaccagaggagatcagggacggaaaccaggtgagggtaactagctgggacggcaggaagtggggcgagctggagggcgacacctacgacagagtactcgtggacgtgccatgcactaccgaccggcatagccttcacgaagaagagaacaatattttcaaacgatccagaaagaaagagcggcagatactgccagtccttcaggtgcagctgcttgcagccggactccttgcaacaaagcctgggggtcatgttgtctacagtacttgtagcctgtcccacttacagaacgagtacgtggtgcaaggagccatcgaactgctcgctaaccaatattcaatccaagtgcaggttgaagatctgacccacttccggagggttttcatggacacattctgcttcttcagcagctgtcaggtaggcgaactcgtgatccctaatctcatggctaattttgggccaatgtatttctgcaagatgcggagattaacctag

SEQ ID NO: 57923 - DNA, 1008 bp, Artificial Sequence
  Description of Artificial Sequence: Synthetic coding sequence
atgacctatagtgttcaatttggggacctgtggccttctattagggtgtcgctgctgtcagagcaaaaatacggcgctctggtaaacaattttgctgcttgggatcatgtcagtgcaaagctggagcaactgtccgcgaaagacttcgtcaacgaagctataagccattgggagctgcagtccgaggggggacagtctgccgcaccctccccggcatcttgggcctgcagtcctaatttgcgttgtttcactttcgatcggggtgatatcagcaggtttccccctgccagaccagggtccctgggtgtgatggagtactacctgatggacgctgccagcctgttgcctgtgctggcactgggtctccagcctggtgatattgttctggatctttgcgctgcacccggagggaaaaccctagccctcctgcaaacgggctgctgtcgcaacctggccgcaaatgacctttctccaagtcggatagctagactccagaagatcctgcactcttatgtacccgaggaaatcagggatgggaaccaggttcgcgtgacctcttgggacggaagaaaatggggggagctagagggagatacgtacgatcgggtcttggtggatgtgccctgcacaacagatcggcattctctccacgaggaggagaacaatatttttaagcgtagtcgaaagaaggagagacaaatcctcccagtcttgcaggtgcagctccttgcagctgggctgctggctacaaaacccggtggtcatgtggtttattcaacatgtagtctcagccacctgcaaaacgagtatgtggtacagggtgcgattgaactgttagctaaccaatactcaatccaggtgcaggtggaggatctgacccacttccgcagagtgtttatggacactttctgcttcttctcctcatgccaggttggcgagctagtgatccccaacctgatggccaacttcggtccgatgtacttctgcaagatgaggagattaacttag

SEQ ID NO: 57924 - DNA, 1290 bp, Artificial Sequence
  Description of Artificial Sequence: Synthetic coding sequence
atgggactttatgccgctgctgcaggcgttctcgccggtgtggaatccaggcagggctcaattaaagggctagtgtacagtagtaattttcagaacgtgaagcagctctatgctttagtgtgtgaaacacagaggtactccgcagtgctggacgccgttatcgcaagcgcaggactgctccgggctgaaaagaaactgcgcccacatctcgcaaaggtgctcgtgtatgaattgttgttgggaaaaggttttcggggtgggggaggacgatggaaggctctcctgggcagacatcaagctagactcaaagccgagctggccagactgaaggtgcaccgcggtgtttctagaaatgaggatctgctggaggtgggctcaagacctggccctgcgagccagctgcccaggtttgtgcgagtgaatacgctcaaaacctgcagcgatgatgtggtggattatttcaaaagacagggcttctcctatcaggggagagcaagttctttggacgatctgcgggcactgaaggggaaacattttctgttagacccgcttatgcccgaactccttgtgtttccagctcaaactgatctgcacgaacaccccttgtacagagccggtcaccttatcctgcaggaccgggcaagttgcttacctgccatgctgctcgaccctcctcctggatctcacgttatcgatgcctgtgcagcccctggaaacaagacatctcatctcgctgcgttgttaaaaaatcaggggaagatattcgcctttgacctggacgccaaacgcctcgccagtatggcgaccttgctggccagagccggtgtttcttgctgcgagctggctgaagaggacttcttagccgtatccccctcagatccccgttaccacgaggttcattatatcctgctcgatcccagctgctcagggtccggtatgccatctcggcaactggaagaacccggtgccggaaccccatcgccagttcgactccacgcgcttgcaggctttcagcagagagctctttgccatgctcttaccttcccatccctgcaacgactagtgtactcaacttgcagtctgtgtcaggaggaaaatgaagacgtggtccgggacgcactacagcaaaatccaggggctttccggcttgcccctgcgttgccagcttggccacaccgaggattgtctacattccccggagcagaacattgccttcgggcatctcccgagactacattgtctagtggatttttcgtggctgtgattgaaagagttgaagtgcccaggtag

SEQ ID NO: 57925 - DNA, 1401 bp, Artificial Sequence
  Description of Artificial Sequence: Synthetic coding sequence
atggggctctacgcagccgctgcgggagtgctggccggagtggagtcgagacagggatctattaaaggactagtgtatagctctaatttccagaacgtgaagcagttgtacgccctggtgtgcgagactcagagatattccgccgtgcttgacgccgtgatcgcaagcgccggtctgctgcgcgcagagaaaaaacttcggccacacctcgccaaggtgttggtgtacgagctgctattgggcaagggctttaggggcggtggcggaagatggaaggctctattgggcagacaccaggcccgtctaaaggcggagctagctcgactcaaggtgcaccgcggtgtaagccgcaatgaggacttgcttgaggtcgggagccgtccaggacccgcttcacaactgccaaggttcgtgagggtcaacactcttaagacctgttcagatgacgttgtcgattatttcaagcgccagggctttagttaccaaggtcgcgcatcctcgctggacgatctgcgcgcactgaaaggaaagcatttcctgctggatccgcttatgccagaactgcttgtgtttcctgcacaaacagatcttcatgagcatcctctgtatagggccggacacctgatcctccaggacagagcttcttgcttacctgccatgctgctcgaccctcctccgggaagccatgtgatcgacgcgtgtgctgcccctggaaacaaaaccagccatctggccgctcttctaaaaaatcagggcaagatttttgcctttgacttagatgcaaaacggcttgccagcatggccactctactggcacgggcaggagtctcatgttgtgaattggccgaggaggacttccttgccgtgtcgcccagcgatcccagataccacgaggtgcattatatactgctggacccatcctgcagcggatcgggcatgccttctcggcagctggaagagcctggagcagggacgcccagcccagtcaggctgcacgctctcgccggattccagcaacgggctctctgccacgcactcactttcccctcactccagcgacttgtatattctacatgctctctgtgccaggaggaaaatgaggatgtcgttagggatgctctccagcagaaccccggtgcctttcggctcgcacctgcccttccggcttggccacaccggggtctctcaacattcccaggagccgaacattgcttaagagccagtccagagactactctctccagcggattctttgttgccgtgatagaaagagtcgaggtcccatcctctgcctcacaggccaaagcatcagcacccgagcgaacgccatcacctgcacccaaacggaagaagaggcaacagcgagcagctgccggtgcatgcacgcccccttgcacatag

SEQ ID NO: 57926 - DNA, 1410 bp, Artificial Sequence
  Description of Artificial Sequence: Synthetic coding sequence
atgtccattttccctaagattagtctccgtccagaagtagagaattacctgaaagagggattcatgaataaggagatcgtcactgcgctaggaaagcaggaggccgagcggaagtttgagacactgctaaagcacctgtcccaccccccatccttcacaaccgtgcgggttaatacccacctcgcctccgtccaacatgttaagaaccttctgctggatgagctgcagaagcaattcaacggattatccgtgccgatcttacagcacccagacctccaggacgtgttacttattccagtcatcggaccacgcaagaatattaagaaacagcagtgtgaggccatcgtcggggctcagtgcggcaacgccgtgttacggggagcacacgtctatgcccctggcattgtctcagctagtcagtttatgaaagccggagacgtgatctcagtttattctgacataaaagggaagtgtaagaagggtgctaaagaatttgatggtacaaaagtgtttctgggcaacggaatttcagagctaagcaggaaagagattttctcaggtctccccgagctcaaaggcatggggataaggatgacggaacccgtgtacctgtcacccagttttgactccgtccttccacgttatctgtttctgcaaaatctgcccagtgccctggtatcacacgtcctcaacccccagccgggagagaagatcctagatctgtgcgccgctccaggcggaaaaacaacccacatcgccgcactgatgcacgaccagggggaagtgatcgctttagacaagatctttaacaaggtggagaagatcaagcagaatgctttgctgctgggcttaaacagcatacgcgctttctgtttcgacggaaccaaagctgtgaagctggacatggtggaagacaccgaaggtgagccaccattcctgccagagtcttttgatcgaattctcctcgacgcaccttgttcaggaatgggacaacgtcccaatatggcgtgtacatggagcgtcaaagaagttgcttcatatcagcctcttcagcggaagctctttacggcagcggttcagctacttaagccagagggggtgctcgtctactccacgtgcacaattactctggccgagaacgaagagcaggtggcctgggcccttacaaaattcccgtgcctccagctacagcctcaggagccgcagataggtggcgagggcatgaggggtgccggactgtcatgcgagcagttgaagcagctgcagagattcgacccgagcgcagttccactgcccgatacggatatggattcgctgcgcgaagcaaggagggaggatatgttgaggctggcaaacaaagatagtattggcttctttatcgccaagttcgtgaagtgcaagtctacttag

SEQ ID NO: 57927 - DNA, 2157 bp, Artificial Sequence
  Description of Artificial Sequence: Synthetic coding sequence
atgctaaacagtaccggagaacttgagttctctaacgaagaggatcccgagatcatttctcagctcacctccctgccgttgagcggcggaaaatctagcgccggagttccagagaaaacgggctacccagactcagtttacgtcatggcagctaatattttccaggggatccgcatagagaagagcgcacagaaggtgctgattaagtatggcaatgagcctctccgctctctcagcgaatcagaagaccaatcattccagcggctgagctatgagttagcttttagtgcactgaagtaccaggatatcctcgaaaccatcctgatcgattcatgtatctttccctccaccactatcccggaccatctcagttctctcataattgtgatgctgtatgatttccaggatcgcaaatttcaaactagagttctgtctgataacgaggagcccatcagtgaggttcaggaggtggagaacctcctgaacagcttcaagattaagttggctgccgctctggccagatgccgcatcaagcacgatgccctgtcaatctaccacattctgcccgagacagtgagaaaacaagagctgagggcctccaccctgcctctatacgcgtggatcaatacctgtaagatcagccctgaggaagtttataacaatctgaaacgaaggggctacaataaagtcaaatccgtccttcatatcgacgacaaagtatttgcggtggaccagcactgctacgacgttcttattttcccaagtcatttgaagaacgacctgatcaatatcgatttgttcaaggactataaactgatttttcaagataagtcccgctccttggccgttcactcagttaaggctcttcttaacatggatgacgacgtgctgatggtgaacacagggtcttggtacaccgtgtcgcacatgagtatcctgaccaacaacaacacttctaaagtgtttgtgtgcggggtgcagtcccaggcaaaggatccagacttgaagaccctttttacaaagatcggctgcaagaatattgaaattctgcacgaaaaattcattaacattgaatccaaggatcataggcttcagaaggttaaagtcattctgcttttgccccgttgtagtggcctgggcgtgtctaatcccgtggagtttattttaaacgagcatgaagacaccgaattcctaaaagaccactcgcaggggggaatcagcgttgacaagctgcacgtgctggctcaacagcaatatgaacagcttacccacgccatgaagttcactaaagcacaggccgtcgtgtactgcacctgttccgtcttcccagaagaaaacgaggccgtcgtgaagaaggccttggagtttcaggatttgggcaacaaaggccagccttacaggctgtctcccccagtgttacctctgtgcagcttaaaggaaattcagttaagcaccgataaattctttcggatggaacccagcgaaattacaaacggttgttttcttagcattcttaccagagaacgcgacccgtctgaaaccgtttcagttaatgacgttctggcgagagctgctgccaaaggactactggacggcatcgaactgggaaagtcaagtaagagagagaagaaaaaaaagaaaagcaagacaagtctcacaaaaggagcaacaaccgacaatggaatacaaatgaaaattgcagagttcctgaacagagagactaaggcctctgccaatctgtccgagaccgttaccaagcccccactgccacagaagaacactgcgcaggtcggggcatcttcccaaaccaggaagcccaacaagctcgctccccatccggctgtgcctgccttcgtgaaaaatacctgcccgtcccggcctcgggagaggcagacgcactttctgagaccgagacccgaagatcgtatggtggcattgaaaccgattaagattgtgctcccgccagtctttatgccattctcgtcccctcaagggattaggagtaggatgccaacgcagcatctgtactgtcgctgggttgctccaaaagccctcgtgccaacatgtctcccaactcattccctgagtcggaaggaggaaaaaccaaaggacgataccccctcatcattactgaggcctccccgacgctggctgtag

SEQ ID NO: 57928 - DNA, 711 bp, Artificial Sequence
  Description of Artificial Sequence: Synthetic coding sequence
atgtgtgtcacttaccacaacggtaccgggtattgcaagtgcccagagggtttcttaggcgaatattgtcaacacagggatccttgcgaaaaaaacagatgtcagaatggagggacctgtgtcgctcaggccatgctcggtaaggccacctgtagatgtgcatccggcttcacaggcgaagactgccagtactccactagtcacccctgctttgtcagccgaccctgtctgaatggtggcacttgtcacatgctgagccgtgatacttacgaatgcacctgtcaggtggggtttaccgggaaggaatgtcagtggaccgatgcctgcctgtcacacccatgtgccaatggctccacctgcaccacggtcgcaaaccaattcagctgtaagtgtctgacaggcttcaccggccagaagtgcgagacagatgtgaatgagtgcgatatccccggacattgtcagcacggaggcacgtgtcttaatctcccagggtcctatcaatgtcagtgtctgcagggcttcacaggtcagtattgcgacagcctgtatgtgccttgtgcgcctagtccatgcgttaatgggggtacctgccgtcaaaccggagactttacgttcgagtgtaattgcctgccagaaaccgtacgtagaggaaccgaactttgggaaagggatcgcgaggtctggaacgggaaggaacacgatgagaattag

SEQ ID NO: 57929 - DNA, 345 bp, Artificial Sequence
  Description of Artificial Sequence: Synthetic coding sequence
atgtcccaagcggagttatccacttgttctgctccacagacccagcgcattttccaagaagcagttcggaagggtaacacacaggaactgcagtccctgttgcagaacatgacaaattgtgaattcaatgtgaatagctttgggcctgaggggcagacagctcttcatcaatcagtcatcgatggaaatcttgagctggtaaagctgctggtcaaattcggcgcagatatccgactcgctaaccgagatggatggtctgccctgcacatcgccgcatttggcggacaccaggatatcgtgctgtatctcatcactaaagctaaatacgccgcttccgggaggtag

SEQ ID NO: 57930 - DNA, 423 bp, Artificial Sequence
  Description of Artificial Sequence: Synthetic coding sequence
atgctaacgatcatgtgtggcttccaaatgcaatcccacctggccgcaggtgatatgaaacgactggggtatgatttcgaccatctgcttagcccagcgctgcctataagcacctccgttgccagagagggcccatctctgatcactctgcgcgctacccgggacgccgaatgcgccctgagcagcggagccggtcaaggagctggacggggagagaaaactcccgctagtcctactaaccaacacccaggcctggaggagttgcagcaggccgctgatcgcgagtttcacccacagcccgacagccggaactcagaggtgcaagacagggcttcatgccggtgggagcctgggatggtgggcgctgcttcatctgctgccggagagtcggtgtgtgtgcagggctgtcgtgtagcttgttag

SEQ ID NO: 57931 - DNA, 1602 bp, Artificial Sequence
  Description of Artificial Sequence: Synthetic coding sequence
atgatcagctctagttcagtccattctaggacttttaatacctccaacgctctcggcccagtctgtaaacacaagaagcccctgtctgccgcaaaagcatgcatctccgagatcctcccctcaaaattcaagccaagactgtctgccccttcagcactgctccaggagcagaaaagcattcttctgccatctgaaaaagcccaaagctgcgagaacctatgtgtgtccggttcactaaacgatagcaagcgtggcttacccttgcaggtggggggtagtattgaaaatctgctgatgcgcagccgcagagactatgacagcaaatcctcttccaccatgtcactacaggaatactctacatccgggagaagaccctgccctctttcccgaaaggcgggaatgcagttcaccatgctgtatagagacatgcaccaaattaatcgttcaggactttttttgggatcaatctcttcctctagttctgtccgggaccttgccagccatttcgaaaaatccagcttggcactttcgcgtggggaactgggaccttcccaggaggggagcgagcatatccctaagcataccgtctcctcaagaataaccgcctttgagcaactgatccaacgctcccggagcatgccatcactcgatttatccggtcggctgtcgaagagccctacccctgtcctgtctaggggcagccttactagtgccagatcagctgaatcacttttggaaagcaccaagctacaccctaaagaaatggatggaatgaacagcagcggagtgtacgccagtccaacctgcagtaacatggcgcatcacgcactttcatttaggggcctggtgccatctgagcctttgagcacttgctctgacgacgtggatcgatgctctaatatttcaacagattcccgcgaaggcagtggaggatccgtgcatggtgatttcccaaagcataggttaaataagtgcaaggggacctgccccgctagttatacaaggtttaccacaatcaggaagcacgagcaacaacagaccagcagacagcccgagtggcggttggatgccaggggagacaaaagtactttgctgcggaatatttatctgatgagtcccctgcccttccgtctgaagaaacctcttcaccaccacccccgtcaaccctctcctggggacagttccggcctattggtgggacagaaacctgacctgccatcgcagccccatcaagatcagcccccttcaggcggtaagcctgtggtaccgacacgcttgtcatcaagacacacaatggccagactgtctagatccagcgagccatctcaggagcggcctaccgccctggaggattacccaagagcaataaataatggcaattcagtaccctattctgatcactccttggacagaaacaataatcctcaatctgagctggcccctagcaggggaggcggaatcctgtgcgtatgtctggtgtcccccgcacggccatcaacattgctggcgcttagccgaccccctctctgcccctggtgctctttctctgggttgagtttcgttttctgtctattttgtctggcaattaatcacgggagctag

SEQ ID NO: 57932 - DNA, 4533 bp, Artificial Sequence
  Description of Artificial Sequence: Synthetic coding sequence
atggcgacacgggtggaggtaggctctatcacacccttgacagcagttccgggactgggcgaaatgggtaaggaagagactctcactcggacatatttcctccaggctggggaggcctctggagcgccacccgctcgcatcctggaagccaagtcccccctgcgatcccctgctagactgctcccgttaccgagactcgcccctaagcccttcagcaaggagcaggacgtcaaatcccctgtaccctctctgcgcccttcttcaacagggccttcaccatcaggtggcctttctgaagagcctgcggctaaggacctggataacagaatgcctgggcttgttggccaagaggtggggtccggtgaggggcctcgtaccagctctccgctttttaacaaagccgtgttcttaagacccagtagcagtacgatgattctttttgaaactactaagagcgggcctgctctgggaaaggccgtgtcagagggtgctgaggaggccaaactgggggtgtcaggctccaggcccgaggtggccgcaaaaccagccctcccaacccaaaagcccgctgggacactacctcggtccgcccctctcagtcaggataccaaacccccagtgccccaggaggaggctgggcaggatcatcccccttctaaagcctccagtgtggaggatacagccaggccgctcgtggaacctcgcccaagactcaagcgccgtcctgtgtcagccatattcactgagagtattcaaccgcaaaagcccggaccaggggctgccgctaccgtcggtaaggtcccacccaccccgcctgagaagacctgggtgagaaaacctcgaccgctgtcaatggatctcaccgcgaggtttgaaaacaaagaggccctcttgcgtaaggtggcggacgagggaagtgggcctaccgctggcgacatggctgggcttgaacgcccaagggcggcttctaaactggacagagattgtctggttaaagcagaggcgcctctccatgaccctgacttagacttccttgaggtggccaaaaaaatccgcgagaggaaggaaaaaatgctgagtaagccagagatggggtctcccagggccctggtggggggttcaagcggcgttacgccctcaaacgaccagagcccctgggaagaaaaagccaagctcgatccagagcccgagaaggccgctgagagtcctagtccacgcctggggcgtggccttgaactcgctgaagtcaagagtcgcgtggcggatggggaagccgcagcaggcggtgaatgggccagcagacggtctgtccgaaaatgcatttcactgttcagagaggactccacactggccctggccgtcggatctgagagccccttggctacacccgcatccccatccgcggctcccgagcccgaaaagggggtggtgtcggtccaggaaagaattcgagggtggaccgccgagtcatcagaggcaaaacccgaagttaggcgcaggacttttcaagcccgacctctgagcgccgacctcacaaagttattctcctcctcagcctcatcaaatgaagtgaagtacgagaagtctgccgaactaagtggcgaattccccaaagagcctcgcgaaaaacagaaagagggccactccctggatggcgcatgtattcctaggtcgccctggaaacccggaaccctgagagataagtcacggcagaccgagcagaaagtgtcttccaaccaggatcccgattcctgccggggagggtccagtgtggaagcaccatgcccgagcgacgttacccctgaggacgacagatcgttccagactgtgtgggccacagtttttgagcatcacgtcgagcgacacaccgtggctgaccaaagcgggcgatgtctgtcgaccacccccccaggagatatggcccacgcacgcgtgtccgaacccagaccaagaccggagatgggctcctggctgggacgcgaccccccagacatgaccaaactgaagaaagagaatagcaggggctttgacaatcccgagactgagaagctaggtcctacaactctgctgaacggcgaactgcggccttaccacactcccctaagggataaatacccactgtcggaaaatcacaacaacaacacctttctcaagcaccttgaaaatccacctaccagccagagaatcgagcctaggtacgatatagtgcatgccgtgggcgagcgcgtgcactctgaagcaatctcccccgctcccgaagaaaaggctgtgaccttgagaagtctcaggtcatggttgagtctcaaggataggcagctgagtcaggaggtgacaccagccgatctggagtgcggccttgagggacaggctggaagcgtccaacgggctagcctgatatgggaagcacggggaatgcccgaggctagcggaccaaagtttggcggtaactgtcccttccccaagtggaccggcggagccgtggtaagtagccataaagcaactgtagctgtgtccgaggaacactgcgcaccaggggcaacatccgtccgggctatcaaggccgcaatctgggagtcccagcacgaaggccctgagggagcacggtccaagccaggcgtgggagccagaggtccccctcaggggtgccccctagaccctctctctagagcgacaaacggaccaagcgacagccaggcacgcacacatcctgatgcgttcgccgtgcagaagggtcccttcatagtcgccgcaagggaaggcgaccctggcccagcgcaggtcccccagccagccgtgagaatgcgcaaggccggtgccatggaccagcgcatggacaggtggcgcaggcgaacacttccaccgaacgtcaagtttgataccttttcatccctggtgcctgaagattcaccacatgtcggacatagacggaccgactatgtttccccaaccgctagtgccttgcgtaagccacaactgagtcactaccgcgtggagacgcaggaggtgaacccaggagctagtcgcgatcaaaccagcccagcggtgaagcaaggttctccagttgagccaaaggctacttttttcgccgttacctatcagatccccaatacccagaaggccaagggggtggtcctgtccggtgctgaatcccttctcgagcatagtaggaagatcacacctccatcctctccacactctttgacctctaccttggtgtcacttgggcacgaggaagctcttgaaatggccggatctaaaaactggatgaaggggagggaacatgagaatgcatctattcttaaaaccctgaagcctactgaccgcccaagttctctgggtgcttggagcctggatccattcaatggcagaattattgatgtcgacgcactatggtcccacagaggttcagaggatggcccaagacctcaaagcaactggaaagagtctgctaacaagatgagcccctccggcggtgcccctcagacaaccccgactctgaggtcccggcctaaggaccttccagtgagacgcaaaacagacgtaatctctgacacattcccaggaaagatccgggacggttatcgctcaagcgtcctggatattgatgctctcatggccgagtaccaggagctcagcttaaaagtgcctggcgaagctcaggaacgtaggtctcctacagtcgaaccgtcaactcttccccgagaacggccagtccagctcggcggagtcgagcagaggcggaggagcctgaaagaaatgccggacacaggtggcctctggaaacccgcatctagcgccgagataaaccacagcttcactcccggtcttggaaaacaattggctgagacccttgagaccgcaatggggaccaaatccagtccacccttctgggcgttacctcctagcgctccttccgagagatatcccggagggagccctattccagccgatcccaggaaaaagactggattcgccgaagatgaccgaaaagcctttgcaagtaaacatcatgtcgctaagtgtcagaactatctggccgagagcaaacccagcggtcgcgaggaccccggatctggagtcagggttagcccaaaatcacccccaacagaccagaagaaaggtacccctagaaagtccaccggaagaggagaggaggatagcgtggcccaatggggagatcaccctcgggactgtgggagagtcccactggacatcaagagggcctatagcgaaaaaggacccccagctaacatcagggagggcttaagcatcatgcacgaggctcgtgagaggagacgcgagcaaccaaaaggccgtccctccctcaccggtgagaacctggaggcaaagatgggcccttgctggtgggagtcgggaaccggagattcccataaggtccttccgagagaccttgagaaagaagacgccccacaggaaaaggagagaccactccaacaagtcagtcctgttgcttctgtcccatggaggtcccatagtttctgcaaggatcgccgatcaggtccctttgtgtag

SEQ ID NO: 57933 - DNA, 390 bp, Artificial Sequence
  Description of Artificial Sequence: Synthetic coding sequence
taaattagcgcctattttgctaccgggtcttccatgacgtaccattttcaggagcattacaccttgagtgaaaatagctcaagccttgtgtcgtcacttcacagggatgtgacattgactcgagaaatgatcacactaagctttaggaccacccgcacaccctcacttctgctctatgtgtcttccttctatgaggaatacttaagcgtgatcctcgcgaataatggctccctacaaattaggtacaaactggatagacatcagaatcctgacgccttcacatttgatttcaagaatatggcggatggacaactgcatcaggtgaagataaaccgggaagaggctgtggtgatggtggaagtcattcctcaaatgcagaaaagcaattag

SEQ ID NO: 57934 - DNA, 543 bp, Artificial Sequence
  Description of Artificial Sequence: Synthetic coding sequence
tgaagagatgtaactctgacccgggagatgatcacactttcattcaggacaactagaactccctctctgctcctgtacgtctccagcttctacgaggaatacctttccgttatccttgccaataatggcagtctccaaatacgatataaattggatagacaccagaaccccgacgcattcacatttgattttaagaacatggctgacggccagctgcaccaggtcaagataaatagggaagaggctgtcgttatggtggaagtgaaccagagcgcgaaaaaacaggtcatactcagttccggtacggagtttaacgctgtgaaatctctgatccttgggaaggtgctcggacgaagtggcccagtggacgagggtgagccactcgtgaatgctgaccgtcgtgacagcgctgtgatcggtggggtgattgctgtggaaatatttatcctgctgtgcataaccgccatcgcaattcgtatttaccaacagcgaaagctcagaaaggagaatgaatcaaaagtcagcaagaaagaggaatgttag

SEQ ID NO: 57935 - DNA, 873 bp, Artificial Sequence
  Description of Artificial Sequence: Synthetic coding sequence
tgaatctctgcctattttgcaacaggtagcagtatgacgtatcactttcaggagcactatactttatcagaaaacagtagcagcttggtttcttcactgcaccgggacgttactctgaccagggagatgataacactgtctttccggaccacccgtaccccttctcttttgctgtatgtgagttctttttacgaagaatacctgtccgtgattctggccaacaatggcagtctccagatccggtataagcttgatagacatcaaaaccctgatgcgttcacctttgatttcaagaacatggcggacgggcaactccaccaggtgaagatcaatcgggaagaggcagtagtgatggtggaggtgaaccaatccgcgaagaaacaagtgatactaagttcaggaaccgaattcaatgctgtcaagtctctgatcttagggaaggtcctcgaagcggcaggagctgatccggacacaaggcgggcagcaactagtggtttcactggctgtctgagcgctgtccgattcggctgcgccgctccactcaaagccgctctgcggcctagcgggcctagccgcgtgactgttaggggtcatgtagctcccatggctcgttgcgctgctggagctgcttctggctcacctgccagagagctggcgccacgcctcgcagggggagcaggcaggagcggcccagtggacgagggtgaaccgctcgtcaatgcggacagacgggattccgcggttatcggcggtgtcatcgctgtggagatcttcatactgttgtgtatcaccgcgattgccatacggatatatcaacaacggaagctgcgaaaggagaacgagtccaaggtctctaagaaagaggaatgttag

SEQ ID NO: 57936 - DNA, 273 bp, Artificial Sequence
  Description of Artificial Sequence: Synthetic coding sequence
atgtggcactatattggggcagccgaatgcccgtatctccaactgcccaggtgccgaggttctagtacacggtattggcacaaaaagagcaggggtaggttaacttggccatggttactgatgtcccaattgaggacatgtcatattaattcacctttccctctggcggttacttgcggagtgaaattctctgaggctgctgtgcccgtccatctttctgggtgtgttcagaaaatgaacatctgtcttcaactacagtttagtaacgactag

SEQ ID NO: 57937 - DNA, 312 bp, Artificial Sequence
  Description of Artificial Sequence: Synthetic coding sequence
atgcccctggagaaattcgtcgatatggaattcctggaccagatgatccttcgcggtacttgccttgaggccgacctatgcccccagtacacaaattccccttttaatgctcacacagatcaaattacacagactcatctgccacctcagcacttggacagctctcattctacccatacctgtctgcctgttcaccgacacatacaaaggcacaccgacaagcaccactctaaaaaaatgtttccacgaacccacggtcatccaaacccaaggattatcagactctcacaaagacacgtctgcaccgcttag

SEQ ID NO: 57938 - DNA, 186 bp, Artificial Sequence
  Description of Artificial Sequence: Synthetic coding sequence
atggaagcatcgttaggcggtcccgagcccaatggggtgatcaacgaagaagccaaagccggtgcgacaggaaagcggaggggaagagcgccagccaacggcggaagggcttccggcgaaaacagggccttccctgttctgcagctgccgggaaattggcactgtcggcgacgtcaagggtgttag

SEQ ID NO: 57939 - DNA, 342 bp, Artificial Sequence
  Description of Artificial Sequence: Synthetic coding sequence
atgggttcacccttttactgtaacggcggttactggctccagaggacggaatgctggcggacgatgaatgaatttcatttcaggtctgcccagctggcagtccccggacgccagccccaggagttgtttagaaggcaccgcgcaacaagcgcctggagttcccgcagaaggagcgcgctggtagtgggcacaatcggacccggtcatggacgattgcaggacccttcctgtactaagctgccttctcctccggcatggttcccatttttcatgaaccggtctatggggcattctcaggtaggtatgcatgtctttcacagaatgggaaccacatcttcttag

SEQ ID NO: 57940 - DNA, 780 bp, Artificial Sequence
  Description of Artificial Sequence: Synthetic coding sequence
atgacaataaatatgctgaatgttttcggcaatgaagatttcgattgccacggcgacctgaagacagaccagctgaaaatggatatcctcattaagaaattaaaacagaaatttgacgacctgaccgcagaaaaagaagctctgtcctctaaatgtgtaaatctcgcgaaggataatcaagtgcttcagcaggaatttttgtctatgaaaaaggtacaacagcaatgcgaaaagctcgaagaagacaagaaaatgttgaaagaagagatcttaaacctcaagacgcatatggaaaacaacagagtggagttatccaagctgcaggagtacaaactcgagctcgacgaaaaagcgatgcaggctgtggaaaaactggaggaaatccacttgcaggagcaggctcagtacgaaaagcagctggagcagctttcgaaggacaatatggctagcctgaacaaaaaagaactcactcttaaggatgtggagtgtaaatttagtgagatgaaaacggcgtatgaggaggttacaacagaactcgaggagtataaggaagcttttgcagcagctctgaaagctaataacagtatgtctaaaaagttgacaaaatctaacaagaagatcgcggtaattagcatgaagctattaatggaaaaagagcaaatgaaatatttcctgtcagctctgccaacaaggcgggatcctgagtcaccctgcgtcgagaacctgacgagcatcggtctaaatcggaagtatattccacagactccaatacgcatatag

SEQ ID NO: 57941 - DNA, 519 bp, Artificial Sequence
  Description of Artificial Sequence: Synthetic coding sequence
tgatacaaaaaactactggagatgacaatcaatatgcttaacgtatttggcaatgaggatttcgattgtcatggagatctgaaaacagaccagctcaaaatggatatactgattaagaagttgaaacagaaagaacaggctcaatacgaaaagcagttggagcagttgtcaaaagacaacatggctagtctgaataaaaaggaattaacacttaaggatgttgagtgtaaattttcagagatgaaaactgcatacgaagaggtgacaacagagctagaagagtataaggaggccttcgccgctgcactcaaagccaacaactccatgagcaaaaaattgacaaaaagcaataagaaaatcgccgttatatctatgaaactgctgatggaaaaagagcagatgaaatacttcctctccgcgctgcccacaaggcgtgacccagagagtccatgcgttgagaacttgaccagcattgggctgaaccgaaagtatatcccccagaccccgatacggatctag

SEQ ID NO: 57942 - DNA, 1602 bp, Artificial Sequence
  Description of Artificial Sequence: Synthetic coding sequence
atgagtcagacttctctgaaacaaaagaaaaacgagcctggcatgagaagcagcaaggaatctctggaagctgaaaagcgcaaggaaagtgataagacgggcgtgagattatccaaccagggatcacaggaaagttcactgcgcaagactgatagtagggggtacctggtgcgttcccagtggagtcgcatcagtaggtcccccagcaccaaagctccgtcgattgacgagcccagaagccggaatacttccgccaaagtggaactgcctagttctagcaccagcagtcgcaccccctccaccagcccaagtctacacgatagttctcctcccccacttagtggccagccctcactgcagccccctgcgtccccacaattaccccgatcactggactcaaggccacccaccccgccagaaccagatcccggatctcgacgctccaccaaaatgcaagagaaccccgaggcatgggcccagggcattgtgcgggaaattagacagacaagggactcccagccactcgagtactctcgaacttctccgaccgagtggaaaagctccagccagagacgcggaatctacccagcgtccacgcagttagacaggaattccctgtctgagcaacagcagcaacagcgggaagatgaagacgactacgaggccgcatattgggcgtctatgagatcattctacgagaagaacccctcttgctcaaggccctggccgcctaagcccaaaaatgccatcaccatcgcattgtccagctgtgcgctgttcaatatggtggatggccgaaaaatttatgagcaggagggactggaaaagtacatggaatatcagctgaccaatgagaacgtgattctaacgcctgggccagccttccggtttgttaaagcattacagtacgtgaacgcaagattaagggacttgtatccggatgagcaggacctgtttgacattgtgcttatgaccaacaaccatgcccaggtaggcgtgaggctgatcaatagcgttaaccattatggcttattgattgaccggttctgtctcacgggcggaaaggacccgatcggttatctgaaggcttacctgaccaatttatatatcgccgctgactccgagaaggtgcaggaggctattcaggagggcattgcatcagccaccatgtttgatggcgcaaaggatatggcttactgcgacacccagctccgagtggccttcgacggcgatgccgtgttatttagcgatgagtcggaacattttactaaagagcatggcctggacaaattcttccagtatgatactctgtgtgagtcaaaaccattggcgcaggaggaaccgaggcttgatgtgttgatcaataatgctgggattttccagtgcccatatatgaagaccgaagacgggttcgaaatgcagtttggcgtgaaccacttgggacactttttactgactaatttgctgctcgggctacttaagtcatctgctccttcccgtattgtcgttgtttccagcaaactgtacaagtatggcgatattaattttgatgacttaaactcagagcagagctacaacaagagcttctgttattctaggtag

SEQ ID NO: 57943 - DNA, 1809 bp, Artificial Sequence
  Description of Artificial Sequence: Synthetic coding sequence
atgagccaaacatctctgaagcagaaaaaaaatgagccgggaatgcggagttctaaagaatccttagaggccgaaaagcgaaaggagtcggacaaaaccggcgttcgtctgagcaatcagatgcggcgtgctgtcaatcctaaccactccctccggtgttgtccgttccagggtcattcaagctgccgcaggtgcctgtgcgcagccgagggaacagccctaggtccctgccatactatacggatttacattcatatgtgcctgctctgggaacaggggcagcagatcaccatgatgcgtggctctcaggaatcctccctacgcaagacagactccagagggtacttagttcgcagtcagtggtctagaatctcacggagtccatccaccaaggccccttccatcgacgagcctcgctctcggaacactagcgccaagcttcccagctcaagtacttctagcaggaccccctcaacctcccctagtttgcacgatagcagtcctccgccactgtctgggcagccttctctgcaaccacccgcttcaccccagctgccaagaagtcttgactcaagaccaccaacgcctcccgagcctgaccctggctcccgcagaagcacaaaaatgcaagaaaaccctgaggcctgggctcagggcatcgtgagagagattaggcagactcgcgacagccagccattggagtactcccggactagccctacggagtggaagtcaagctcccagaggcggggaatctatcccgcttcaacacagcttgaccgcaatagcttgtctgaacagcagcagcaacagcgggaagatgaggacgattacgaagccgcatactgggcatcaatgcgcagcttttacgagaaaaacccctcgtgctctaggccgtggcctcctaaaccgaaaaatgccattactattgcattatcctcctgtgcactgttcaatatggtggacggccgaaagatctacgaacaggagggcttagagaaatacatggaatatcagctgactaacgagaatgttatattaacccccggaccagcctttcgcttcgtgaaagctcttcagtatgtgaacgcacgccttcgggatctgtacccggacgagcaggacctattcgacatcgtcctcatgactaataaccacgcccaagtcggggttcgcctgataaattcagtgaaccattacggattgctcatcgacagattctgcctcaccggcggaaaggatcctatcgggtacctgaaggcatacctgacaaatctttatatcgctgctgactcagaaaaggtgcaggaggccattcaggagggcattgccagtgcaaccatgtttgacggcgctaaggacatggcgtactgtgacacccagcttagagttgcgttcgatggcgatgcagtgttattctctgatgagtccgagcacttcacaaaagagcatggactcgacaaatttttccagtacgataccttgtgtgaaagcaagcccctggctcagggccctttgaaaggattcctggaagatctcggtagacttcagaagaagttttacgcaaagaacgaaaggctgctctgccctatacggacctacctcgtaaccgccaggtccgccgctagttccggagctagagtactgaaaacactgagacggtggggtttggaaatcgacgaggcacttttcctggctggggctcccaagtcgccaattctcgtgaagatcaggccacacatattctttgatgaccacatgttccatatcgagggagcccagcgaaagtccttgggttggatgagctag

SEQ ID NO: 57944 - DNA, 1887 bp, Artificial Sequence
  Description of Artificial Sequence: Synthetic coding sequence
atggagtccttagtattcgccaggcgcagcgggcctacacctagtgctgctgaactcgcccgacctctggcggagggtttgataaagtctcccaagcctctgatgaaaaagcaggcagtgaagcgccaccaccataagcataatttacggcacagatacgagttcctcgagactctaggaaaaggcacatatggcaaagtgaagaaggcacgggaaagcagcggaagacttgttgctatcaagagcatcaggaaggataagataaaggacgaacaggacctgatgcacatccggagagagatcgagatcatgtccagcctcaaccatcctcacatcattgctatacacgaggtgtttgaaaattcgtccaaaatcgttatcgtgatggagtatgcttcacggggagacctctacgactacatctccgaaaggcagcagcttagtgaaagggaagccagacacttttttaggcaaatcgtgtccgcggtccattactgtcatcagaatcgagtggtccaccgcgatcttaagctcgagaacatattgcttgacgcaaatgggaatataaaaatcgctgatttcgggctgtctaacttgtatcaccagggaaagttccttcagacattttgtggatctcccctatacgcttctcctgagatagtgaacggtaagccctacaccgggccagaagtagattcttggtctctgggggtccttctgtacatcttggtgcatgggaccatgcctttcgacggtcatgaccacaaaatcctggtgaaacagatctcaaacggagcctatagggagcctcctaagccttcagacgcgtgtggactgatccgatggctgctgatggttaatcccacccgaagggccacgcttgaggacgtagctagccactggtgggtgaactgggggtatgctacgcgagtgggtgaacaagaagctccacacgaggggggacacccgggatccgactctgctagggcttccatggctgactggcttagacggtcatcaaggcctctcctagaaaacggagccaaggtgtgctcgttcttcaagcagcacgcaccagggggaggttctaccacacctggtcttgagcggcagcacagtttgaagaagtctcgaaaggagaatgacatggcccagagcctccattctgataccgctgacgacactgctcatcggcctggaaaatccaacctaaagctgcctaaaggaatcctcaaaaagaaagtgtccgcctcagctgagggcgtgcaggaagatccgcctgagctctcaccgataccggcaagtcccggtcaagctgcacctctgctccctaaaaagggaattctcaagaagccccgacagagagaaagtggttattacagctcacccgagccctcagagtccggggaattactggatgccggagacgtgttcgtgagcggtgatcccaaagagcagaagccaccccaagcttctggacttcttctgcatagaaaggggatcttgaagctcaatggaaagttttcacagaccgccctagaactggcagctcctaccacattcggtagcctagacgagcttgccccacccagacctctggcgagagcgtcacggccaagtggcgcagtgtctgaagatagcattttgagctccgagtccttcgatcagctcgacctgcccgagcgcctgcccgagccacccctgcgaggatgcgtcagcgtcgacaacctcaccggcctggaggaaccacccagtgaaggccctgggtcctgtctccgaagatggcgacaagacccactgggcgatagttgtttttctctgaccgattgccaagaagtaacggctacttaccgtcaggccctcagagtctgctccaaacttacatag

SEQ ID NO: 57945 - DNA, 462 bp, Artificial Sequence
  Description of Artificial Sequence: Synthetic coding sequence
atgtccaaggacctgaaaatcttgtgcaaggaccctgccctggagctgtcttgttatagggatcaccagttctctggccgaaaatttcaacaggaaaagttactcaaagagtcttctacattgaacatgggcaatctgtccttctacactaccgaagagaagatccatgaactgttcagcagaagtgatatccggaacatctttatgggcctcgacaaaatcaaaaaaactgcgtgtggcttttgctttgtcgagtgccataaccgcgcagacgctgaaaacgctatgaggttcctcaccggaacctgcttagatgagtggataatatgtacagactgggacgtgggcttccgtgaaggacagcagtacgggaggggcaagtccggcggtcaagttcgcgacgagtttagagaagactttcatagcggacgaggcggttttgggagacagacacaaatctag

SEQ ID NO: 57946 - DNA, 831 bp, Artificial Sequence
  Description of Artificial Sequence: Synthetic coding sequence
atgcccaaaacctgccagtgttacgtaggcaccaaaacaactaatccaagcgcctggccatctagagagatgaagaagaaaaagctcccatcagactcaggggatctcgaagccctcgagggaaaggacaaggagaaggagtccacggtccacattgaaacgcaccaaaatacatctaagaacgtggctgctgtgcaacccatgaagcgtggccaaaaatctaagatgaagaagatgaaagagaaatacaaggatcaagacgaggaggatagagagttgatcatgaagcttttagggtctgccggtagcaataaagaggagaaaggaaaaaagggaaagaaaggaaagaccaaggacgaaccggtcaaaaagcaaccccaaaagcctcgtggcggacaaagagtcagcgataatataaaaaaggaaaccccattcctggaggtaatcacccatgagcttcaggactttgcagtcgatgacccgcacgacgacaaagaagaacaagacttggatcagcaaggcaacgaagagaatttattcgactctctgactggacagccacatccagaggacgtcctgcttttcgccattcccatttgcgctccctatacaactatgaccaattacaagtacaaggttaaattgactcctggggtccagaagaaaggaaaggccgctaaaacagcattaaattctttcatgcactcaaaagaggctaccgccagggagaaggacctgtttcgctccgtgaaagacacagacttgagtcgcaatatccccggaaaagtcaaggtgtcagccccaaacttattgaatgtgaagaggaaatag

SEQ ID NO: 57947 - DNA, 2349 bp, Artificial Sequence
  Description of Artificial Sequence: Synthetic coding sequence
atggacagcagagtgatgtcaaagtggatgaaaaacctgaagctcaaaggttacataatccagaagcgcgagattaaaccatcactggaggccgataaacctgtggaagatatcctgacgtacgaagagttccatcctttcttattctcgcagcacagtcagtgcccatatatcgagttcgaatcattcgataaggcagttgatgaattttattcaaagatagagggacagaaaatcgatcttaaagcactacagcaggaaaaacaggcactcaagaagcttgataatgtcagaaaagatcatgagaatcggcttgaagccctgcaacaggcccaggaaatcgacaagctgaaaggcgagcttatcgaaatgaacctccagatcgtcgaccgagcgattcaggtggtgaggtcagcactggccaaccagatcgattggaccgaaatcggcctgatcgtgaaggaggcacaggcccagggcgaccctgttgcaagcgctataaaagaactcaaactccagaccaatcacgtgaccatgcttctgcggaacccctacttactttccgaagaggaagacgacgacgtggatggggacgtgaatgtggaaaaaaacgagacagaacccccaaaggggaagaagaaaaaacagaagaacaagcagctccaaaagccacaaaagaataagcctttgctagtcgatgtcgacctgagcctgtcagcttacgcaaatgcgaagaagtactacgatcacaaacgctatgccgcaaagaagacgcagaagacagtcgaggccgctgaaaaggcgtttaaaagtgccgagaagaagacaaagcagactctgaaagaggtgcagactgtcacgtctattcaaaaggcccgaaaagtgtactggttcgaaaaattcctgtggtttatcagtagcgaaaattatctgataatcggaggacgcgatcagcagcagaatgagataattgtcaagagataccttacccccgaaggcgatatctacgtgcacgcagacctgcatggggcaaccagttgcgtgattaagaatccgaccggcgaacccatcccacctaggactctgactgaggccggaacaatggccctctgctacagcgcagcatgggacgctagggttataaccagcgcctggtgggtgtatcaccaccaggtgtccaagacagcacccaccggagagtatctaaccaccggcagcttcatgattcggggtaagaagaactttctgccccctagctacttgatgatggggttttcctttctgtttaaggtggatgaatcctgcgtctggagacatcaaggagagaggaaggtgcgcgtgcaagacgaggacatggaaactttggcctcatgcacgtcagagctcatatctgaggaaatggaacaactggacggaggagacacttctagcgacgaggataaggaggagcatgaaacccctgtggaggtcgagcttatgacgcaggtcgatcaggaggatatcactctgcaatctgggagagacgaattgaacgaagaactcatacaggaggagtcttctgaggacgagggtgaatatgaggaggtgcggaaagatcaggactcagtgggagaaatgaaggacgagggggaggaaacccttaactatcccgacaccacaatcgatctgtcccatttacaacctcagcggtccattcagaagctggcaagcaaggaggaaagtagtaactcaagcgacagtaagtcacagtcacgtaggcacctgagcgccaaggaacgcagggagatgaagaaaaagaagctgccatctgattctggggatctggaagcgctggaaggcaaggacaaggagaaggaatctactgttcacatagagacacatcagaacacatctaaaaatgtcgccgcagttcagcccatgaagagagggcagaagtctaaaatgaagaagatgaaggaaaaatataaagatcaggacgaggaagatcgggagttaataatgaagttgctgggttccgccggttcaaataaggaggagaaggggaagaaagggaaaaaaggaaaaactaaagacgaaccagttaagaagcaaccacagaagcctcgtggaggacaacgcgtatcagataacattaagaaggagacccctttcttggaggttattactcacgagctccaggattttgccgtagacgacccccacgacgataaagaagagcaggatttggaccagcagggcaacgaagagaacttgtttgactctcttaccgggcaaccgcaccccgaggacgtgctgctgtttgcaattcccatatgtgcaccatacactaccatgacaaattacaagtag

SEQ ID NO: 57948 - DNA, 3105 bp, Artificial Sequence
  Description of Artificial Sequence: Synthetic coding sequence
atgaaatcccgcttcagtaccattgatcttcgcgcagtgctggcggagctgaacgcctccctgctgggtatgagagtgaataacgtgtatgacgtggacaacaagacctacctcatccggctccagaagcctgacttcaaggcaacgcttttgcttgagagcggcatcagaatccacacaaccgaattcgaatggcccaaaaatatgatgccttctagttttgcaatgaagggtaatattgtcttaacagactacgagtacgttatactgaatatcctgcgctttagaaccgacgaagccgatgatgtaaagttcgcggtgcgcgagaggtatccactcgaccacgcacgggcagcagaaccacttctcaccctggagcgactcaccgaaatcgtggcgagcgcccctaaaggggagctgcttaagagggtgcttaaccccctgcttccatacgggccagcactgatcgagcactgtttgctggaaaacgggttttcaggtaacgtgaaagtggatgaaaaactcgagactaaagacatcgagaaggtgctggtctcactgcagaaagcagaggattatatgaaaactacctctaacttctcaggcaagggctacattatccagaagagagagattaagccctcactcgaggccgacaaacccgttgaagatatcttaacttatgaagagttccaccccttcctctttagccagcatagccagtgcccctatatagagttcgaatcattcgataaagcagttgatgagttttattcaaagatcgaggggcagaagatcgatcttaaagccctacaacaggaaaaacaggcccttaagaaactggataacgtccgcaaggatcatgagaatcggcttgaggcactacagcaggcccaggaaatcgataagctaaaaggtgagctgatagaaatgaatcttcagatcgtggatagagcaatccaggtcgtgcgctcggccctggcaaatcagattgattggaccgaaattgggttgatcgttaaggaagcccaagcgcagggtgatcccgtcgcctcggccatcaaggagctgaagctccaaaccaaccacgtgaccatgttgctcagaaacccctacctgttaagtgaggaagaagatgacgacgtcgatggcgacgttaatgtggaaaagaacgaaacggaacctcctaagggaaagaagaagaagcaaaagaataaacagctgcagaaacctcagaaaaataaaccactgctggtcgacgttgatttgtcactgtctgcttacgctaatgccaagaaatattatgatcacaaacgctacgcagcaaagaagactcagaagacagttgaggccgctgagaaggccttcaaatcagccgagaaaaagacaaaacagaccctgaaggaagtacagaccgtcacctccattcagaaagctcggaaggtttattggttcgaaaagttcttatggtttatctcatcagagaactacctgattataggaggcagggaccagcagcagaatgaaattatcgtgaaacggtacctcacccctggggacatttacgtgcacgcagatctgcacggagctacttcctgtgtgattaagaaccctaccggcgaacctatcccccctaggaccttgacagaggcgggtaccatggccctctgctactccgctgcatgggacgcaagggtcatcaccagtgcctggtgggtttatcaccaccaggtcagtaaaaccgctcccaccggcgaatatctgacgacaggcagctttatgatcagagggaagaaaaactttttaccaccaagctacttgatgatggggttcagttttcttttcaaggtagatgaatcctgcgtctggcgacaccaaggcgagcgcaaagtacgcgtacaggacgaggacatggaaaccctagcttcttgcacatcagagctgatctctgaggagatggagcagcttgatggcggagatacatcctctgacgaagataaggaagaacacgagacacctgtggaggtggagctgatgacccaagttgaccaggaggacattactctgcagagtggtcgcgacgagctgaacgaggagctcatccaggaggagtcaagcgaagacgagggcgaatatgaggaagtgcggaaggaccaagatagcgtgggagagatgaaggacgagggagaagagaccctgaactatcctgatactactatcgatctctcccacttgcagccccagagaagcatacaaaagctagcatccaaggaggaatcctccaattccagtgactctaagtctcagtccagaaggcatctatccgcaaaggagcgtagggaaatgaagaagaagaagcttcccagtgactctggagatcttgaagcgctagaaggcaaggacaaagaaaaggagtcaactgtccacatcgaaacccaccaaaacacctcgaaaaacgttgccgcagtgcagccaatgaagcgcggacagaagagcaaaatgaaaaagatgaaggaaaagtataaagaccaagacgaggaagaccgtgagcttataatgaaactgttaggctccgcaggctcgaacaaggaggaaaaaggaaagaagggcaaaaaaggcaagactaaagacgagcccgtgaaaaagcagcctcagaagcccagaggcggacagcgggtctccgacaatatcaagaaagagactccgttcctggaagttatcactcacgagcttcaggattttgccgtcgacgacccacacgatgacaaagaagagcaggatttggaccagcagggaaacgaagagaacctttttgactcgctgaccgggcagccccatccagaggatgtgcttctattcgccatccccatttgtgctccttatacaacgatgactaactataagtacaaggtgaagttaacccctggtgtacagaagaaaggaaaggcagcaaaaactgccttgaattccttcatgcattctaaggaggcaacagccagggagaaggatctgtttcggtccgtcaaggacacagacctctcacggaatatcccaggcaaagtgaaggtgtctgccccaaacctactgaacgtaaagaggaaatag

SEQ ID NO: 57949 - DNA, 3168 bp, Artificial Sequence
  Description of Artificial Sequence: Synthetic coding sequence
atgaaaagcagattctctacgattgacctccgcgcagtgctggcagagctgaatgcctcccttcttgggatgagagtgaacaacgtctacgacgttgataacaagacttatctaatccgactccagaagccagactttaaggccaccctgttactggaatcgggaatccgcatccacactactgagttcgaatggcctaaaaatatgatgccgagtagtttcgctatgaagtgccgaaagcatctgaaatctagacggttagtgtccgctaaacagctcggagtcgacaggattgttgatttccagttcggctcagacgaggccgcttaccacctaataatcgagttgtacgaccgtggcaacatcgtcttgaccgactacgagtacgtcatactgaacatcctgcgcttccgcaccgatgaagccgacgacgtgaaatttgcggtcagggagcggtaccctctcgatcatgcgagagccgcagagccgttgttgacccttgagagacttacagagatcgtggcaagcgctccaaaaggagaacttctgaaaagagtcctgaacccactgctcccttatggacctgccttaatagaacattgcctgctcgagaacggcttcagtggtaacgtcaaggtagacgagaaactggaaaccaaggacattgagaaagtgctggtctccctgcaaaaggccgaggactatatgaagactacttctaatttttctgggaaggggtatattatacaaaaaagagagattaaacccagcctcgaggccgacaagcccgtggaagacatactgacttatgaggagtttcaccctttcctgttttctcaacacagtcagtgtccatatattgagttcgagtcattcgacaaggcagtggatgaattttattccaagattgaaggccagaagatcgatctgaaggctctgcagcaggaaaagcaggctctcaagaagctggacaatgtgcggaaggatcacgagaacagactggaggccttgcagcaggctcaggaaatcgacaagctgaagggtgaactaatcgagatgaatctacagatcgtagatagggcaatacaggtggtccggtccgccctggctaaccagatcgattggacggagatcggactgattgtaaaggaggctcaagcccagggcgacccagtcgcgtcggcaattaaggagctgaagctgcagactaaccacgttacaatgctcctgcgtaacccgtacctcctgtctgaagaagaagacgacgacgtcgatggcgatgtgaacgtcgaaaagaatgaaacagaacctccaaagggcaagaaaaagaaacagaagaacaagcaactgcagaaacctcagaaaaacaaacctctgctggtggacgtcgacttgagtctgtccgcctacgctaacgcgaagaaatactatgaccataagagatatgccgctaaaaaaacccagaagaccgtcgaggccgcagagaaagccttcaaaagcgccgagaagaaaaccaagcagacgctgaaagaagtccaaactgtgacaagcattcagaaggcccgaaaggtgtattggttcgagaagtttctctggtttatcagtagcgagaactacctgattattggcggaagggaccagcagcagaatgagattatcgtaaagagatacctgacacccggtgagcccattcctcctcggaccctgactgaggctggaactatggctctctgttactctgctgcctgggatgcacgcgtcataacctctgcatggtgggtctaccatcaccaggtaagtaaaaccgcacctaccggcgagtacctcacgaccggatccttcatgatccgcggtaaaaaaaattttctgccaccttcatatttaatgatgggattctctttcctctttaaggtcgatgaatcgtgcgtctggagacatcagggggaacggaaggtcagagtccaggacgaggacatggagaccctagctagctgtacttcggaattaatatccgaagagatggagcagctcgatggaggggatactagctcggatgaagataaagaggagcacgagaccccagtggaagtagagttgatgacgcaagtcgatcaggaggacataaccctacaatcaggaagagacgaactaaatgaggaactgatccaggaagaatccagtgaagatgaaggagagtacgaggaggttagaaaagatcaggattcagtgggcgagatgaaggacgaaggggaggagaccttgaattaccccgatacaaccattgatctatcacacctgcagcctcagcgctcgattcagaagcttgcttctaaagaagaaagctctaactcctcggacagcaagagccagtcccgcagacacctgagcgcaaaggagaggcgcgagatgaagaaaaagaaactcccctcagactccggggatctggaggccttggagggaaaggacaaggaaaaagaatccacagtgcatattgagacccatcaaaatacaagcaaaaacgtggcagccgtgcagcccatgaagagaggacaaaaaagcaaaatgaaaaagatgaaggagaagtacaaggaccaggatgaagaagacagagagctcatcatgaagttacttggttctgctgggtctaataaggaggaaaaaggcaaaaagggcaaaaagggaaagacaaaggatgagccagtgaaaaagcagccccagaagcctcggggtgggcagcgtgtgagcgacaacataaagaaagagacaccctttctggaggtgatcacacatgaactgcaggactttgcagttgacgatccacacgatgacaaggaagagcaggatctcgatcagcagggcaacgaggagaacttgtttgacagcctgacgggtcaaccccaccctgaggatgtgcttctgttcgccatacctatttgcgctccctacacaactatgaccaattataaatataaagttaagctgacccccggagtgcaaaagaagggaaaggcagctaagaccgctctgaactcttttatgcactccaaagaggcgacagcacgagagaaggacctgttcaggtcagtcaaggacaccgatctgtcccggaacatcccgggtaaggtcaaagtcagcgcacccaatctcctgaacgtaaagcggaaatag

SEQ ID NO: 57950 - DNA, 1383 bp, Artificial Sequence
  Description of Artificial Sequence: Synthetic coding sequence
atggcgtttcagacccaagccggtgcccagatacccattgagagactcgcaagcgaaagggcgatcacagtgaaagtgcctaacaattcagattgggccgctcgcggtcaccgaagctctgcgaattccgtcgtggttcagccccaggctagtgtgggagccgtggtcacccttgacagctccaaccccgctgctgtcctgcacctgcagttgaattatactctgttggatggacgttacttatccgaggagcccgaaccctatctggctgtttatctgcatagcgagccacgccctaatgagcacaactgttctgcttctaggaggattaggccagaatccctccagggagccgaccatagaccttacacttttttcatctcaccaggaacccgggaccccgtaggctcctatcggctgaatctgtcctctcatttccgtctgtccgcgctggaggtttctgtcgggctgtacacctcactgtgccagtatttttcagaggaagatgttgtgtggcgcaccgaaggtctactgccgctagaggagacctcccctaggcaggccgtgtgtctgacccggcatctgacggctttcggggcaagtctctttgtgccacctagccacgttcggttcgtgttcccagaacccaccgccgatgtgaactacattgttatgttgacttgcgccgtttgtctggtgacatacatggttatggccgctattctgcataaactcgaccagctggatgctagtcgcggtcgggctatacccttctgtggacagcggggtcggtttaagtatgagagctcttcacggcaggccggtgccggagcccaggttccacggccaacatgggcttcgtgctgtatgggctggaccgctggagcggcaacaggcacttggatggcaactgaaccatcaaccgcaactgcctggacatcttcaggtagtccccctagaaccgcttgggtcgcctgtggcaggagcgaatgcgggaccaccaaggggtctgcccttccaggctcctgttcaaccagcagcagcggaacctgtaggagacatacagccccaagtagttggagtatgacaggctttcgctggcgcagacggccaactggggcttggtggcgtagaaggtgttggcccagggtaacccagccatgctgtgcttccggcgcttgttggtggctgtcctgctctgcagcctccctgacctccaccagcggatctccctatgggaccggccgactcgtagctgtgtctctagccagccgcggtccgccagctgcatttagctccagtgcgtcttcctgggcacctacaccgtgtggaaccggtctactcgtgactttgcccaccgctcggggtatgtgtcctggctag

SEQ ID NO: 57951 - DNA, 1332 bp, Artificial Sequence
  Description of Artificial Sequence: Synthetic coding sequence
atgagactgaggttctggctgcttatctggctgctcctcggtttcatctcccaccaacccacccccgtcatcaacagccttgcggtatatcggcatcgagaaacggacttcggagtgggagtgagggaccacccaggacagcacgggaagactccctctccacagaaacttgacaatctgataattatcattattggtttcttaaggagagacacattcactattttgttttgtacaagttacttgtgtgtgtcgtttctcaaaaccatattctggtctagaaatggccacgatggttccacagacgtgcaacaaagggcctggcgctcaaataggagtagacagaaaggcttgcgctctatttgcatgcacacaaagaaacgggtgtccagcttcaggggaaataagatcggcctgaaggatgtcatcaccctcagaaggcatgtagagactaaagtgcgcgctaaaattcggaagaggaaggtcacaacaaagattaataggcacgacaaaataaacggaaaaaggaagacggctagaaaacagaaaatgttccagagagcacaggagctcaggcgtcgggcagaagattaccacaagtgcaaaattcccccttcagcaagaaagccactttgcaactgggtcagaatggctgcagctgaacacagacactcttccggtcttccatgctggccttatctgaccgcggaagcactgaaaaatcgcatgggcagacagcctcccccaccaacccagcagcacagcatcaccgacaactccttgtcgttaaaaactcctcccgagtgcctgctgcatcctctgccacccagcgtggatgataacatcaaggagtgccctctggccccactgccccctagtgtggacgataatctgaaagaatacttattagtccctcttccgcctagcccactgccgccatccgtagatgataacttgaaggactgcctattcgtgccccttcctccatctcccttaccaccttcagtggatgacaacctcaagactccacctttagcaacgcaggaggcagaagccgagaagccccctaaacctaaaagatggcgtgtcgacgaagtggagcaatcacctaagcccaaaaggcggcgtgctgatgaagtggagcaatctccaaagcccaaacgccagcgtgaggctgaggcacaacaactccccaaaccaaaacgccgtagactttcaaaactgagaaccaggcactgtactcaggcctgggcgattcgaatcaacccttgggttgagaaaaaaaagaaaatcaagaaacagaataagacccacgcacccaagactaactag

SEQ ID NO: 57952 - DNA, 1983 bp, Artificial Sequence
  Description of Artificial Sequence: Synthetic coding sequence
atgtttcagcgcgctcaggaacttcgacgcagggcggaagattaccacaagtgtaagatcccacctagcgcccgaaaagccctctgcaattgggttcgcatggccgcagctgagcaccggcatagtagtgggctaccgtactggccctacctaaccgccgagactttgaaaaataggatgggtcaccagccaccaccacctactcagcagcacagcattactgataacagcctgtccttaaagactccaccggaatgtcttttgaccccgcttcccccatctgcagatgacaatcttaagactccacccgaatgcgtcttgacccccctgccaccgagtgctgacgacaacctgaagacccctcctgaatgtgttctgacacccctgcctccgagtgcagacgataacctaaaaaccccgccagagtgcctcctgacaccgctacccccatccgccgacgacaatctcaaaacgcccccagagtgtctgctcacacccctgcctcctagcgcccttccatcagcacctccttcggcagatgataacctgaaaacgcgagccgaatgccttctgcatcctctgcctcccagcgctgacgataatttgaagactcccagcgaaaggcagctgacccccctgccgccatccgcccctccttcggcagacgacaacataaagacgcccgcttttcatccacagcggatgatatcccggcacctgcctagtgttagttctctcccctttcacccgcagctacatccccagcagatgataatcagccggtacctgctgtccgtctgtggcttccggttccatcatcagcccatgatcatatctcgccacctgccaagtgtaagttcattgccgttccacccacagctccacccccagcagatgatcattagcagacacctgctatctgtgtgcggcggtaggttccaccccgagcggatgatcatcagcagacatttgccaagtgtgtcatcccttcccttccacccacagctgcatcctcagcagatgattatcagcagacatcttccttccgtgtgtggtggacggttccatcctcagcggatgattattagccgccaccttccctccgtgagctcacttcctttccatccacagcttcatccacagcagatgatcatttcaagacatcttcccagtgtatgtggcggacgcttccaccctcagcagatgataatctctaggcatctgcctagtgttagcagcctgccattccacccgcagcttcatcctcaacagatgatcatttcccgtcaccttccaagcgtttgtggcggacgcttccatccccagaggatgattatctcaaggcatttaccaagcgtgtcatccctgccattccatccccaactgcatcctcagcagatgattatttcgcggcacctgcctagtgtgtgcggcgagcggctgcggggacctttgccccctagcgccgacgacaacctgaagactccttccgaaagacaactgaccccacttccgccttctgctcctcctagtgcggatgacaacataaagacccctgcagagcgtctgagggggcctttaccccctagcgctgacgacaacctgaagacacctcccttagctactcaggaggcggaggcagagaagccacggaagcctaaaaggcagcgcgcagctgaaatggagcctccaccagaacccaaacggagaagggtgggggacgtcgagccctcccggaagcctaaaaggcggagagccgctgacgtggaaccgtcatcacccgaacctaaacggcgaagagtaggcgacgtggaaccgtcaagaaaacccaaacggagacgtgccgctgacgtcgagcctagcagccctgagcccaagaggaggagagtgggggatgtagaaccttctagaaagcccaagcggagacgcgcagccgacgttgagccatccctgccggaacccaagagaagacgtctaagttag

SEQ ID NO: 57953 - DNA, 3189 bp, Artificial Sequence
  Description of Artificial Sequence: Synthetic coding sequence
atgcatacgaaaaaacgcgtcagctcctttaggggcaacaagattggactgaaggatgtgataaccttgagacggcatgtagagacaaaagttcgcgctaaaattcggaaaagaaaagtgactacaaaaatcaatcaccacgacaaaataaatggtaagcgaaaaaccgcaagaaaacaaaaaatgttccagcgggctcaggagctgaggagaagggctgaggactatcacaagtgcaaaattccccctagcgcgagaaaggccctctgcaactgggtcaggatggccgctgcagagcaccggcacagcagtggtttaccctattggccatacctgactgcagagacactcaaaaatcgcatgggccaccagcccccaccaccgactcagcagcattcaataaccgataactcactgtcactcaagaccccgcctgagtgtctcctgaccccgctgccaccgtccgcagatgacaatttgaaaacacctcccgagtgcgttctcaccccactccctcccagcgctgatgataacctgaagacaccaccagagtgtgtgctgaccccccttccgcctagcgctgatgataatctgaaaactcctcccgaatgcctcctgacccccctgccgccatcggctgatgataatttgaagacacctcccgagtgtctactgacccccctccccccttctgcccttcctagtgcgcctcccagcgccgatgacaaccttaagactagagctgagtgcctgctccacccactgcccccatcagccgacgataacctgaaaactccctcagagaggcaactgacaccactgcctccttccgcccctcctagtgccgacgataatattaagactcctgccgagcgactcagaggaccactgccgcctagcgctgatgacaacctaaaaactccctcagagaggcagctcacccctctgcctccctcggccccaccgtcagctgacgataacatcaaaacaccagcagaacggttgaggggtcccctcccccctagtgccgatgacaacctcaagacgcccagtgaacgcccactgccaccgagcgcgcctccatccgcagacgataacataaaaacccccgctgagcggctgcggggtccactgccacctagcgctgatgacaatctgaaaacaccctctgaacggcacatcatgccattcccttctgcagatgataacatcaacactccggctgaacgcctaaggggcccattgcccccatccgcggatgataacctaaaaaccccctcagagcgccaattgaccccgttgccccctagcgctcccccatcagccgacgataatattaagacacctgctgagcgcttaagagggcctctgccacctagcgccgacgataacctgaagactccttctgagagacagctgacgcctctccccccaagcgcgcctccatctgcagacgacaacattaagaccccggctttccatccccagcgcatgatcagtagacatttgccttccgtatctagcttgccatttcaccctcaactgcacccacaacagatgatcatctcccggtatctgctgtccgtgtgtgggttccggttccaccaccagcctatgataatttcccgccatctgccctcagtgtcttctttaccatttcatccccagcttcaccctcagcagatgatcatctcaagacaccttctgagcgtgtgtggaggtcgatttcatcccgagagaatgataatcagtcgtcacctgccttctgtgagctccctgcctttccacccccagttacacccacaacagatgattatcagtcgccatctgcctagcgtctgcggtgggaggttccacccacagaggatgattatctccaggcacctcccatccgtgtccagcctgcccttccaccctcagctccatccccagcaaatgattatctcccggcatctgccctccgtctgtggcggtcggttccacccccaacaaatgatcattagtcgccatctcccttctgtctcatccctgccgtttcacccccagcttcacccgcaacaaatgatcatcagccggcacttgccgtccgtgtgtggaggaagatttcacccacagaggatgattatcagcagacacctaccttctgttagtagtctgccatttcatcctcagctgcacccacaacagatgataattagtaggcacctgcctagcgtgtgcggggagcggctgagaggccctctgcctcccagcgcggacgacaacctaaaaacgccaagcgagcggcagctgacaccattgccaccgtcagcacccccatctgctgatgacaatataaagactccggctgagagattgcgcggaccactgcccccaagcgcggatgataatctgaagaccccatctgagcgacagttgacgcctctcccaccttcagcacccccttccgcagacgacaatatcaaaaccccagcagaacgattaaggggaccacttccccctagtgcagacgacaatctgaaaacaccgtctgaaaggcagctgacgcctctgcctccttcagccccaccaagcgctgatgataacattaaaactcccgctgagcgtctgagaggcccactgcccccatctgccgatgacaacttgaaaactccctccgaaagacagctgaccccgctgcccccaagtgctcccccatccgcagatgataacatcaagacacccgcagagaggctgagaggaccactcccccctagcgccgacgacaatttaaaaacgcctagcgagcggcagctgacccctcttccgccatcggcacctccctcagccgacgacaatatcaaaacacctgctgagagactgcgcggtccactgccccctagcgccgacgacaacctgaagacccctcctctggctacccaagaggcggaggcagaaaagccacgaaagcccaaaaggcagcgcgcagccgaaatggaaccaccaccggagccaaaacgaagaagggtaggggatgtggaacctagcaggaagcctaagagacggagagcggcagacgtcgaacccagctcacctgaacctaagcgcagacgggtcggcgacgtggagccgtctaggaaaccaaaacggaggagagccgcagatgtggagcctagcttgcctgagcccaagagacgacgtctcagctag

SEQ ID NO: 57954 - DNA, 2547 bp, Artificial Sequence
  Description of Artificial Sequence: Synthetic coding sequence
atggtgaagctgtcaattgtgctgacaccgcagttcttgagccacgaccagggccagctcacaaaggagctgcagcagcacgtgaagtcagtgacgtgcccatgtgagtatctcaggaaggtgatcaatacactcgctgatcaccaccacaggggtacagatttcggaggatccccctggttacatgtcatcatagcctttcccaccagctataaggtggttatcaccctgtggatcgtatatctgtgggtctcactactcaagacaatattctggagtcgcaatggccacgacggatcgacggatgtccaacagcgcgcttggcgatccaacaggcgcaggcaggagggtctgagaagcatttgcatgcatactaaaaaacgagtaagttcctttcgcggtaataagattggtctgaaggacgttatcacgcttagacgtcacgtggagaccaaggtcagagccaaaataaggaaaagaaaggtgactaccaagattaaccatcacgataagatcaacgggaagcggaagaccgcaaggaagcagaagatgttccaaagggcacaggaacttaggcgcagggcagaagattaccacaagtgtaagatccccccatctgctcgaaaggctctgtgcaactgggtacggatggcggcagccgaacaccgacactcttcgggcttgccctattggccttacctgaccgccgaaaccctgaaaaatcggatggggcaccagccacctcctcctactcagcaacacagcatcactgacaattctctgtctttgaagaccccgcctgaatgcttattaactcctttgccaccgtctgctgatgacaaccttaagaccccacctgagtgtgttctcaccccactgcctccctccgcagatgacaacttaaagaccccccctgagtgcctgcttactcccttgcctccatccgctcttccctcagctcccccatcagcagacgataacctgaagacgcgcgcagagtgcttgctccacccactgcctccaagcgccgatgacaacctgaagactccctctgagagacagctgacccccttacccccttcagctccaccaagcgcagacgataacatcaaaacccccgcttttcaccctcagaggatgatcatctctaggcatctgcctagcgtgtcatctctgcccttccaccctcagttgcacccacagcaaatgatcattagcaggcacctgcccagtgtgtgcgggggtcggttccaccctcaacccatgatcatcagcagacatctcccttcggtttcctctctgccatttcacccacaactacatccacagcagatgatcatctctcgacacctgctttcagtatgtggtggacggttccatcccgagaggatgattatctcccgccatctcccgtccgtgtctagccttcccttccatcctcagttgcatccacagcagatgatcatcagcagacatctgcccagtgtctgcgggggacgcttccacccccaacgcatgataatctccaggcatctgccctcggtttctagcttgccatttcatccacagctgcatccgcaacagatgattatctctaggcatctcccatcagtctgcggcggtagattccatccccagcagatgattattagtcgacatctgcctagtgttagctcattgccttttcacccgcagctgcatccccagcaaatgatcatttcccgccacctgcccagcgtgtgtggcggtagatttcacccccagcgcatgatcatatccagacatctgccttccgtgtcgtccctacctttccatccacagctgcacccacaacagatgattatctcccgccacctgccgagtgtgtgtggagaaaggctccgaggccctctcccaccctctgccgacgataatctcaagaccccttcagaacgccaacttaccccattaccaccttccgcccctccaagtgctgacgacaatatcaagaccccagccgaaagactgagaggccctctgccacccagcgcggacgataatttgaagactccctctgagcgccaactcacgcccctgcctccatcagctcctccctctgctgacgataacatcaagacccccgctgagaggctccggggtccgctgccgccttcagctgacgataatctgaagacccctcctctcgctacacaggaggccgaagcagagaaaccccgaaaacccaagcgccagagagccgcagaaatggaacctcctcccgagccaaagaggagaagggttggtgacgtggagccctctcgaaagccaaagcgtagaagggcagcggacgtcgagccaagcagccccgagcctaaacgccgacgggtgggagatgtcgaacctagtcgtaagcccaaaaggcgtcgggctgccgacgttgagcccagttccccggagccaaagaggcgcagggttggggatgtggagccctcccgcaagccgaagcgtcggagagcagcagacgtggagcccagtctgcctgagcccaagagaaggcgcctgagctag

SEQ ID NO: 57955 - DNA, 2949 bp, Artificial Sequence
  Description of Artificial Sequence: Synthetic coding sequence
atgttccagcgcgctcaggagttaagaagaagagctgaggactatcataaatgcaaaattccgccatcagctcgaaaggctctctgtaattgggtgagaatggcagctgctgagcatcggcatagctctgggctcccttattggccgtacctaaccgccgagaccctcaagaataggatgggccaccagccaccacctccgacgcagcagcatagcattaccgacaacagcttgagtctgaaaaccccaccagaatgccttcttacccccctgccaccatccgccgacgacaatcttaagactccacctgagtgcgtgctgacgccactgccgcctagcgctgatgataacctgaaaacaccccctgagtgcgtactgacaccacttccgccttccgcagatgataatctgaagacccccccagaatgtctcctcactcccctcccgccttcggcagatgacaaccttaagaccccgcctgagtgcttgctcacacctctgcctccatctgctcttccaagtgcacctcccagtgctgacgacaacctgaagactcgagctgagtgcctgttacaccctttgcccccatctgcagacgacaacctcaaaactcccagcgagcgccagctgaccccgctccctcccagcgcacctccatctgcggacgataacattaaaacacctgccgaacgcttacgcggaccgctgcccccatcagccgatgataatctgaaaacacctagtgagaggcagctcactcccctgccaccttccgcccctccgagtgcagacgataacataaagacacctgcagagaggttacgaggcccactgcctccctctgccgacgataacctaaagactccatcagagaggcgcaccccactgcctccttcagcgccaccatccgcagatgataatataaaaactcccgcagaacgcctgagaggcccacttccaccttcggcagatgacaatcttaagaccccatccgagcggcacataatgccgcctccctccgccgatgataacatcaatacaccagcagagagactgcgaggcccactgccgccaagtgccgacgacaatcttaaaaccccgtctgagaggcagctgactcccctgcccccatccgctgatgacaatataaaaacccccgcagagagactgcgaggccctttgccgcctagtgccgacgacaacttgaagactccctcggaacgacagctgaccccgcttccgccaagcgctccgccttccgcagatgacaatatcaagatccccgcagagagattgcgcatcccgctgccaccgtctgccgatgataatctgaaaacaccaagcgagcgtcagctgacaccgcttcctcctagcgcccctcctagcgccgatgacaacatcaagacacctggatttcaccccgagcggatgataatatcacgccacctcccctctgtttcttccctgccctttcatccacagctccatccccaacagatgatcatctcgagacacctgccctcagtatgcggtggtcggttccaccctcagaggatgatcatatcacgtcacctcccatccgtgtcaagtttgccatttcatccacaattgcatcctcagcagatgattatctctagacacctgccttccgtctgcggcggacgatttcaccctcagcagatgatcatctccagacatttgccaagtgtcagctccctgccattccacccacaattacacccacagcagatgattataagcagacatttgcctagcgtgtgcggcggtcggttccaccctcagcggatgatcattagtcggcacctgcccagtgtcagctccctgccatttcacccacaattacacccacagcagatgattatctctagacacttaccctcagtgtgcgggggtcgttttcacccccagagaatgatcatttcgagacatctcccgagcgtctcctctctcccatttcacccacaactgcacccacagcagatgatcatctctaggcacctccctagcgtgtgcgggcctcttccccctagcgcagacgataatttgaaaacacctagtgagcgccagctcacacctctcccacccagcgcgccaccttccgccgatgataatattaagacgcctgccgagcggctaagaggtccattgcctccaagcgccgatgacaacctgaagactccgtcagagaggcagctcactcctctgcccccaagcgctccacccagcgccgatgataatataaagacccctgctgagagactgaggggccctctccccccttctgctgatgataatctgaagacaccatccgaaagacagctgacgccgctccccccaagcgcccctccgtccgctgacgacaatattaaaactccagccgagcgcctcagaggcccactgcctccttcggctgacgacaacttgaaaacaccctccgaaaggcagcttacaccacttccgccatcggcgccaccatccgctgacgacaatatcaaaactcccgctgagaggctgagaggcccactgccacctagcgcagacgataatcttaagacaccacctctggctacgcaggaagccgaggccgagaaaccacgcaaaccgaagagacagcgggcagctgagatggaaccacctccagagcccaaaagacgacgggtgggagacgttgagccatctaggaagccaaagcgtaggcgggcagccgatgtggaaccctcgagccctgagccaaagagacggcgagtaggcgatgtagagccctcccggaagcccaagcggcgtagggccgctgacgtcgagcccagctcccctgagcctaagcggcgtcgagtaggcgacgtcgagcctagcaggaagccaaagagacgcagagcggcagatgtggagccgtcgttacctgaacctaagagacgcagactcagttag

SEQ ID NO: 57956 - DNA, 1263 bp, Artificial Sequence
  Description of Artificial Sequence: Synthetic coding sequence
atggctgctgccgagcaccggcattctagtggactgccatattggccttatctaacggccgagacccttaagaatcgcatgggacaccagcctcccccaccaacgcagcagcattccatcacggacaatagcctgtcgctgaagactccacctgagtgtctgctaacaccgcttccccctagcgccgacgacaacttgaagacccccccagagtgtgtcttgaccccattgccaccatccgctgacgataatctgaagactccacctgagtgcgtgcttacaccactgcctccatccgcggatgacaacctgaagacacctcccgagtgcctgctgacacccctacctccttcagctgatgacaacctgaagacccctcccgagtgtttactcacgccacttccaccctctgctctgcctagcgcgcctccgtccgctgacgacaacctcaagacgagagccgagtgtttgcttcacccacttcctcccagtgcagacgataatttaaagaccccctctgagcggcagcttacccccctgccgcctagtgctcccccaagcgccgacgataacatcaaaacgcccgctgagcggttgaggggacccctgccccctagtgcagatgacaacttaaaaacccctagtgaacgtcagttaaccccactgcctccgtctgcccctccatctgccgatgacaacattaagactcccgcagagcgcctgcgtggaccattgccaccaagcgcggatgataacctgaagactccctcagaaagacagctgacgccccttccaccaagtgccccacctagcgcagacgataacatcaaaacgcctgccgaacgtcttcgagggcctctaccgccatctgctgacgataacttaaagacgcctcctctggcaactcaggaagccgaggcggagaaacctcggaagccaaaaagacagcgcgctgctgagatggaacctcctcccgagcccaaacgcagaagagttggggacgtggagccgagccgcaagcccaaaaggagacgggctgccgatgtcgagccatcttcccccgagcctaagcgacgcagagtgggtgacgttgaaccctctagaaagccaaagaggcggagggccgcagacgtggaaccaagctcgcccgaacccaaacgccgaagggtcggtgacgtggagccaagccgcaagcccaagaggcggagagctgccgatgtggagccaagccttccggaaccgaaacgaagaagactctcctag

SEQ ID NO: 57957 - DNA, 462 bp, Artificial Sequence
  Description of Artificial Sequence: Synthetic coding sequence
atggccgcagttgagcaccgccacagttcaggcctgccatactggccttaccttacagctgagactctgaagaacaggatggggcaccagcccccacccccaacccagcagcactccatcatcgacaatagcctgagcttaaaaacaccgtccgaatgtgtgctctatcccctgcctccaagtgctgacgacaatctcaagacccccccagagtgcctgctcactccacttcccccttccgctcttcccagcgctgacgacaatttaaaaactccagccgagtgcctgctctatccattgcctccatctgctgacgataacctgaaaaccccacctgagtgcctgctgactcccttaccacccagcgccccaccctcagccgacgacaacctgaaaacacctcccgaatgcgtatgctccttacctttccacccacagagaatgataatttctcgcaattag

SEQ ID NO: 57958 - DNA, 528 bp, Artificial Sequence
  Description of Artificial Sequence: Synthetic coding sequence
atgaaggtgaccactaaggtaaaccgacatgataagatcaatggtaagagaaaaactgccaaagagcacttaagaaagctttctatgaaggaacgggagcaccgggaagaggagcgacaggtctccgaagctgaggagaatgggaaattggatatgaaggaaatccatacatacatggagatgttccagagggctcaggcgctgcggcgaagagccgaggattattatagatgtaagataaccccaagcgctcgaaaaccactttgcaatagggtgtcactactcgtttttctggcatttgggcacagcctgcctggacaggacatggataccttttttagcttacgcctttgtgcacaggccctgcagagggaaatggccgagaggaaggcagcatacaagcaccattctcccataccagtggggaattgcgtcgcccaaaagcatctgcatccacaccccgtgggacccccttctaatatccttagcgtaagggggagcgtgtttgtcatcgcgaacggaccttag

SEQ ID NO: 57959 - DNA, 1062 bp, Artificial Sequence
  Description of Artificial Sequence: Synthetic coding sequence
atgcgcctgaggttttggctgctgatttggctgctcctggggtttatttcccaccaacctaccccagtgtccttcctgaagaccatcttctggagccgaaacggacacgatggctccatggacgtacagcaacgtgcctggcgctctaaccggtccaggcaaaagggcttgcggtccatctgtatgcacaccaaaaaaagagtgtccagctttcgcggtaataagattggcctgaaagacgtgatcaccctccggaggcatgttgaaacgaaagtccgcgcaaagattcggaagaggaaggtgactaccaagatcaatagacacgataaaatcaatggtaagagaaagacagctagaaaacagaagatgtttcagcgcgctcaggagttgaggcggagggccgaggattaccacaagtgcaagataccgccttctgctaggaaaccactgtgtaactgggtacgcatggcagccgcagagcaccgacattcgagtgggttaccctactggctgtacctcacagcggaaactctgaagaaccggatgggtcgccagccacctcccccaacccaacagcacagtatcacagacaactctctcagtctgaagaccccacccgagtgcttattaaccccgctgcctccctcagtggacgacaacattaaagagtgcccacttgctcctctgccgccttctcctctcccgccatctgtcgatgacaacctcaaggaatgcctatttgtgccactgcctcctagtcctctcccaccaagtgtcgatgataatttaaaggagtgccttttcgtgccactaccaccatctcccctgcccccaagtgttgacgacaatcttaagacccctcctctggccacacaggaagccgaagtagagaagccgcctaaaccgaaacgatggcgggtggatgaggtggaacaaagcccgaagccaaaaaggcagcgcgaggccgaggcacaacagttgcctaagcctaagagacgtaggttgtcaaaattgagaactcgccattgtacgcaggcctgggccattaggataaacccttag

SEQ ID NO: 57960 - DNA, 294 bp, Artificial Sequence
  Description of Artificial Sequence: Synthetic coding sequence
atggaggcaccggctgaaagagcattgcctcgactccaggccttagcccgtccccctccccctatttcatatgaggaggagctgtacgactgcctggactattattatcttcgggactttcctgcctgtggagccggacgctcgaagggccgaactcgaagggagcaagccctccggactaattggcccgctcctggaggacatgagcgcaaagtcgcccagaagttactgaacggccagagaaaacgcagacaaagacagcttcatcccaaaatgcgcaccagattgacttag

SEQ ID NO: 57961 - DNA, 1845 bp, Artificial Sequence
  Description of Artificial Sequence: Synthetic coding sequence
atgaacacgttccaagatcagagcggcagctcttctaaccgggaacccctgttgcgatgtagcgacgcaaggcgggatctcgagttggccatcgggggtgttctgcgggctgagcagcagatcaaggataatctgagggaagtgaaggctcaaattcacagctgcatcagcaggcatcttgagtgcctccgatcccgcgaagtttggctctacgaacaggtcgatctgatctaccaactgaaggaagagactctccaacaacaagcccaacaactatactcccttctgggccagttcaattgccttacgcatcaactggagtgtacacagaataaggacctcgccaaccaggtgtccgtttgcttggaacggctgggctctctgacattaaagcccgaagactcaactgttttgctgtttgaggccgataccattacccttaggcaaacgattactacatttgggtctttaaagacgattcagatccctgagcatcttatggcccacgctagctccgccaacatcggtccctttctagagaagcgtggatgcatcagtatgccagagcagaagtctgcctccggcatcgtcgccgtccccttctccgagtggctgcttggctctaagccggcttccggataccaggccccatatatccctagcactgaccctcaagattggttgacacagaagcagacgctggaaaacagccagactagctccagagcgtgcaacttttttaacaacgtcggtggaaacctgaaggggctcgaaaattggcttctgaaatctgagaagagctcctatcagaagtgtaactcacattccaccacatcaagctttagtattgagatggaaaaggtgggcgaccaagagctgccagatcaggacgagatggacctgagcgactggttagtcacccctcaggaaagtcataaactcaggaagcccgaaaatggctcaagggaaacgtcagagaaattcaagctcctgtttcagagctacaacgtcaacgactggctagtcaaaacggacagctgcacaaattgtcaggggaaccagccaaagggcgttgaaatcgaaaatctgggcaacctgaagtgcctgaacgaccacttggaggctaagaagcccctgtccacaccgtctatggtgacagaggattggttggttcagaatcaccaggatccgtgcaaggtggaagaagtgtgtcgggcaaacgagccctgtacctcttttgccgagtgtgtgtgcgatgaaaactgcgaaaaggaagcattgtacaaatggctgctcaaaaaggaaggcaaagacaagaacggaatgcccgttgaacccaaaccggagcccgagaagcacaaggatagcctgaacatgtggctgtgtcccaggaaagaggtgatagagcaaactaaggcgccaaaagccatgactccatcacgcatcgcggattcattccaggtgattaagaacagtcccctttccgagtggctcatcaggcctccctacaaggagggcagtcccaaagaggtgcctggaaccgaagatcgggcaggcaagcagaagttcaaaagtccaatgaacactagttggtgcagtttcaatacagccgactgggtattgccgggaaaaaagatggggaacctgtcacagctgtcttctggagaagacaagtggttgctgaggaaaaaggcacaagaggtcctccttaactcccctcttcaggaagagcacaactttccaccagatcactatgggctgccagctgtgtgtgatctgtttgcttgcatgcagctgaaagttgataaggaaaagtggctgtatcgaactcccctgcagatgtag

SEQ ID NO: 57962 - DNA, 1845 bp, Artificial Sequence
  Description of Artificial Sequence: Synthetic coding sequence
atgaacactttccaagatcaatccggcagcagcagtaaccgtgaaccgttacttcgctgtagtgacgcccgtcgtgacttggaactggccatcggcggagtactcagagcggagcaacagattaaagacaacctccgggaagttaaggctcagatccattcatgcatctctaggcacctggagtgtctccgctcccgcgaggtgtggctgtacgaacaggtggacctgatctaccagctgaaggaggaaaccttgcaacaacaggctcagcagctttattccctcctaggtcagttcaattgtctgactcaccaactggagtgcactcagaataaggatctcgcaaatcaggtgtcagtctgtctcgaaaggttaggcagcctgaccttgaagcctgaagactctacggttttgctctttgaggccgatactatcacactgcgccaaacaatcaccacgttcggcagcttaaagaccatccagatccctgaacacctcatggcccatgcgagttcagctaacatagggccattcttggaaaagagagggtgcatttccatgccagaacagaagagtgcctctggaatcgtcgcagtgccattcagtgaatggctgctgggttcaaaacctgcaagtggatatcaggcgccatacattcctagtacagatccacaggactggttaacccagaaacaaaccctggaaaattcccagactagcagccgtgcctgcaacttctttaacaatgtcggcggtaacctgaagggcctggagaactggctgttgaaaagtgagaagtcttcttatcaaaagtgcaacagccacagcacgaccagctccttttccatcgaaatggagaaggtgggtgaccaggagctgcccgaccaggatgagatggacttgtcagattggctcgtgacaccacaggagtcccacaagctgaggaagcccgagaacggctcgagagagacatccgaaaaatttaagctcctgtttcagtcatataacgttaatgactggctggttaaaaccgactcctgcaccaactgccagggaaaccagccgaagggagtcgagattgagaatctgggaaacctgaagtgtctgaatgaccatctggaggccaagaaaccgctgtccactccgtcgatggtgactgaggactggctggttcaaaatcaccaagacccttgcaaggtggaggaagtgtgcagagccaacgagccgtgcacaagcttcgccgagtgtgtttgtgacgagaactgtgaaaaagaagccctgtataaatggcttctgaaaaaggagggcaaggataagaacggaatgcccgtcgaaccaaagcccgaaccggagaagcacaaggactcactaaacatgtggctgtgccctaggaaggaagtcatcgagcagacaaaagccccaaaagctatgacacccagccggattgctgattcattccaagtgatcaagaacagcccattgtccgaatggctgatcaggcccccatacaaggagggaagcccgaaagaggtgcccggtaccgaagatcgcgctggcaagcagaaatttaagtctcccatgaatacatcttggtgcagtttcaacaccgcagactgggtgcttccaggcaagaaaatggggaatctgagtcagctcagctccggggaggacaagtggctgctgcgcaaaaaggcccaggaggtacttctgaactcccctcttcaggaggagcataattttccacccgatcattatggactgcctgcagtctgcgaccttttcgcatgtatgcagctgaaggttgataaggaaaagtggttgtacagaacgcccctgcagatgtag

SEQ ID NO: 57963 - DNA, 1845 bp, Artificial Sequence
  Description of Artificial Sequence: Synthetic coding sequence
atgaacacctttcaggaccagtccggatcaagctcaaatcgcgagcccttacttcgctgtagtgacgcacgccgtgacctcgaacttgccatagggggagtgctacgagccgaacaacagatcaaggacaacctgagggaagtaaaggcgcagatccactcatgtattagccggcatttagaatgcttgcggtccagggaggtgtggttatatgagcaagttgatctcatatatcagttgaaggaggaaactctacagcaacaggcacagcaattgtatagcctgcttgggcaattcaactgtctgacccatcagctggaatgcacacagaacaaggacctcgctaaccaggttagtgtttgcttggaacgtttagggtctctcactctgaaaccagaggattcaaccgtgttgttgtttgaggccgataccatcaccttgaggcagaccataacaacctttgggtcgctaaaaaccattcagatccctgaacatttgatggcacatgcatcctcagctaatatcggtcccttcctggagaaaaggggctgcatatcaatgcccgagcagaaaagtgcttctggaattgtggctgtgccgttcagcgagtggctcttgggctctaagcctgcttctggctaccaggccccatatattccttcgacagatcctcaagattggcttacgcaaaaacaaacacttgagaacagtcagacctcatcccgtgcctgtaactttttcaacaatgtggggggtaacctgaaaggccttgagaattggctgcttaagtccgaaaaaagtagctaccagaagtgcaattcccattccaccacaagctcattctcaatagagatggagaaagtaggcgatcaggaactcccagatcaggacgagatggacctatctgattggctggtgaccccacaagagtcccacaaacttcgtaagccagagaacggcagcagagagacaagcgagaagtttaaacttctattccaatcctataatgtcaatgactggctcgtcaaaacagattcatgtacaaattgccaaggaaaccagccaaaaggggtggagatcgaaaatttgggcaacctaaagtgtttgaacgatcatcttgaggcaaaaaagcctctaagcacgccatctatggttaccgaagattggttggttcaaaaccatcaggatccatgtaaagtggaggaggtgtgtcgggcaaacgaaccttgtaccagtttcgctgaatgtgtgtgtgacgagaattgcgaaaaagaagctctgtacaaatggctgcttaagaaggaaggcaaggacaagaacggaatgcccgtggagcccaagcccgagcccgaaaaacacaaagacagcttaaacatgtggctttgcccccgaaaagaggtgattgagcagaccaaggcgccaaaggccatgacacctagcaggatcgcagattcctttcaagtgattaagaactctcccctgagtgaatggctgatccgcccaccatacaaagaggggtcacctaaggaagtgccaggcactgaagaccgggctgggaagcagaaattcaaaagtccaatgaatactagctggtgctcctttaacactgccgactgggtgttaccaggaaagaaaatgggtaacctgagtcagctaagttccggggaggacaaatggctcctccgcaagaaggcgcaagaggtcctcctgaattcaccactccaggaggagcacaatttccctccagatcactatggactgccagctgtgtgtgacctcttcgcctgtatgcaactgaaggtggataaagagaagtggctgtacagaacccccctgcagatgtag

SEQ ID NO: 57964 - DNA, 1209 bp, Artificial Sequence
  Description of Artificial Sequence: Synthetic coding sequence
atgcctcacagtgccggtggcacggccggagtgggcctagaggccgctgagcccaccgccttgctgacccgtgccgagcctcctagtgagccgaccgaaattagacctcaaaaacgtaagaaagggcctgcccctaaaatgctgggaaatgagctgtgctccgtctgtggagacaaggctagcgggttccattataatgtgctgtcatgcgagggatgtaaaggtttcttcagacgatcagtgataaagggcgcacactatatatgccattcaggaggacactgtcccatggatacttacatgaggcgaaagtgtcaggaatgtagattaagaaagtgccggcaagccggtatgcgggaagagtgtgtgcttagcgaggagcagattaggctgaaaaagttgaaacgacaagaggaggagcaagcccacgccaccagcctccctcctagggcctccagcccccctcagatcttgccacaactctcccccgagcagctgggaatgattgaaaaactggtagcagcccagcagcagtgcaatcgtcggtctttctctgacagactgagagttacaccttggcccatggcacccgacccgcactcgagggaggctagacagcagcgattcgcacattttaccgagctggccatcgtgagcgtccaagagatcgttgactttgccaaacaactgcctggattcctccagctgtctcgcgaagatcagatcgccctattgaagacatcagccatagaggtgatgcttctcgaaacatcacgacggtataaccctggctccgagtcgatcaccttcctgaaagactttagctacaatcgcgaggacttcgccaaggccggactgcaggtagagtttattaatcctatctttgaattttcacgcgcaatgaatgagcttcagctaaacgacgccgagtttgccctgttgattgcaattagtatcttttctgcggacagaccaaacgttcaggaccagctgcaggtggagagactgcagcacacctacgtggaggctctgcatgcttacgtttccatccaccatccgcatgatcgtttgatgtttccccgaatgctgatgaaactggtgtcgctccggaccctctcaagcgtgcattcagaacaggtgttcgctctgcggctccaagataagaagctgccccctctgctctctgaaatctgggatgtgcacgaatag

SEQ ID NO: 57965 - DNA, 1164 bp, Artificial Sequence
  Description of Artificial Sequence: Synthetic coding sequence
atgtcactgtggctgggtgcccctgtgcctgacatccctcccgatagtgccgtggagttgtggaaaccaggggctcaagacgcctcttcacaggctcagggcggatcctcttgcatcctccgggaagaagcaaggatgccccatagtgcaggaggtaccgcaggcgtggggctggaagccgcagaacccaccgctctgctgacccgagcagagccaccctccgaacctactgagatccgccctcagaaaagaaaaaaggggcctgctcccaaaatgctgggaaatgagctgtgttccgtttgcggggacaaggcctctgggttccactataacgtgttaagttgtgagggctgcaagggtttctttcgcagatctgttattaagggggctcactatatatgtcactcgggcggtcactgcccaatggacacatatatgcgaagaaaatgccaggagtgccgacttcggaaatgtaggcaggccggtatgagagaggaatgcgttctgtccgaagaacagatcagacttaagaagcttaaaagacaggaggaggagcaagcccatgctacgtccctgcctcccagggcgagttccccccctcagattttgccccagttgagtccagaacaactaggcatgatcgagaagctcgtagctgcccagcagcagtgcaataggaggtcgttttcagataggttacgagtgaccgtcatgctgttagaaacaagtcggaggtacaatcctggtagcgaatctatcaccttcctgaaggacttttcgtataatcgggaggactttgcaaaagcaggtctgcaggtggagtttattaatcccatattcgagttctctagggccatgaatgagctccaacttaacgacgcggagtttgctctgttgatcgccatctctattttttctgccgatcgaccgaatgtgcaggatcagctgcaggtggaacgcctgcagcatacttatgttgaagctctccatgcttacgtcagcatccatcacccacatgatcgcctcatgttccccaggatgctgatgaagctggtctcccttaggaccttgtccagtgtgcacagcgagcaggtgtttgccctgaggctccaggacaaaaaactgcccccactgctgagtgagatttgggacgtccatgaatag

SEQ ID NO: 57966 - DNA, 1164 bp, Artificial Sequence
  Description of Artificial Sequence: Synthetic coding sequence
atgagcctatggctgggggctccagtacccgatattccacccgatagcgccgtggagttgtggaagcccggtgcccaggacgcttcttctcaggcccagggcggatcctcttgcatcttgagggaggaggccaggatgcctcacagcgctgggggaacagcgggtgtgggattagaggccgcagaacccacagcactcttaacgcgggctgagccacctagcgaaccgacggagattaggccgcagaaacggaaaaaaggccctgctccaaagatgctcggcaatgaactctgttccgtatgcggcgataaagcatccggtttccactataatgtgttaagctgcgaggggtgcaaagggttcttccggagaagtgtgataaagggggctcactatatctgccactctggtgggcattgtcccatggatacatatatgcgaaggaagtgccaggagtgtaggcttcgcaaatgccggcaggccggaatgcgtgaggagtgcgtcctctctgaagagcaaattcgactgaaaaagctgaagagacaggaggaggaacaagctcatgctacctccctaccccctagagcctcctccccaccgcaaatcctgccgcagctgagtcctgaacagctgggcatgatcgagaaacttgttgccgctcaacaacagtgcaaccgcagatccttcagtgatcgtctccgggtcactgtgatgctcctcgagaccagtcgtagatacaacccgggtagcgagtcaataaccttcctgaaagacttctcctacaaccgggaagatttcgcgaaagcaggtctgcaagtcgagttcataaaccccatattcgagttttccagagccatgaatgaactgcagctgaacgatgctgaattcgcccttcttatagcaatctctattttctcagccgaccggccaaatgtccaagaccagctccaggtggagaggctgcagcatacatatgtggaggctcttcacgcttacgtaagtatacaccaccctcacgacaggctgatgttccctcgcatgcttatgaagctggttagtctacgtactttatccagcgttcattccgaacaagtatttgccctccgactacaggacaaaaagctgccacctttgctctcagaaatctgggatgtgcatgaatag

SEQ ID NO: 57967 - DNA, 609 bp, Artificial Sequence
  Description of Artificial Sequence: Synthetic coding sequence
atgtctctgtggctcggcgcaccagtgcctgacattccacccgactctgctgtagaattatggaagcctggcgctcaggatgcaagtagtcaagctcaggggggatcaagttgtattctgagggaagaagccaggatgcctcactctgccggtggaactgctggagttggcctggaagcggcagagccaactgccctgctgactagagccgaaccgccatccgaacccacagagataaggccacagaagaggaagaagggcccagcccctaagatgttagggaacgaactatgctctgtgtgcggtgataaggcctctggcttccactacaacgtgctgtcatgcgaaggctgtaaaggcttttttcgcaggtcggtgatcaagggagctcattatatatgtcatagcggtggtcattgtcccatggacacttatatgcgcagaaaatgccaggagtgcagattgagaaagtgtcggcaggctggtatgagagaagaatgtgttctgagcgaggagcagattcggcttaaaaagcttaaacgccaagaggaggaacaggcccacgccacatctctgcccccaagagcaagctccccccctcagatctag

SEQ ID NO: 57968 - DNA, 207 bp, Artificial Sequence
  Description of Artificial Sequence: Synthetic coding sequence
atgtccctgtggctaggtgcacctgtccctgatatccctcccgattcagccgtagagctctggaagcctggggctcaagatgcaagcagtcaggcccagggagggtcatcgtgtatccttcgggaggaagcccgaatgccacattccgccggaggtactgcaggcgtgggactcgaagctgccgagccaactgcattacttacttag

SEQ ID NO: 57969 - DNA, 1344 bp, Artificial Sequence
  Description of Artificial Sequence: Synthetic coding sequence
atgtccctgtggctgggtgctcccgtgccagacattcctccagacagcgcagtcgaattatggaaacccggtgctcaggacgcgtctagccaggcccagggaggctcgtcatgtattcttcgcgaggaagcccgaatgcctcatagcgcgggaggtactgccggagtcggattggaggcagcggagccaaccgccctgttgactcgagctgagccccctagtgagcccactgagatcaggcctcagaaacggaagaagggcccagcaccgaagatgctcggcaacgagctttgcagcgtgtgcggcgataaagctagcgggttccactacaacgtcctgtcctgcgagggctgtaagggattctttcgcaggagcgtgattaaaggggcacactacatctgccactcaggcggacattgtcccatggatacatatatgcggaggaagtgccaggagtgcagactgcggaagtgtcggcaggccggaatgagggaagaatgcgtgttgagcgaagaacagattcggctgaagaagttgaagaggcaggaagaggagcaggcacatgcaacatccctgccccctcgagcgtcttctcctcctcaaatcttgcctcagctgtcgccagaacaactgggcatgatcgagaagctggttgccgcacaacagcagtgcaataggcggagcttttcagaccgcctcagggtgacaccgtggcccatggctccagacccccactcccgtgaggccaggcagcagaggtttgcacatttcacggaattggcaattgtgtccgtccaggaaatcgttgatttcgcaaagcaactgcccggattcttgcagctctcaagggaggatcagattgctttactcaagacctccgcaatcgaggtcatgttactcgagacaagccgcagatataaccccggatcagagagcatcacctttctaaaagacttcagctacaatcgtgaagacttcgccaaagctgggctgcaagtggaattcataaaccccatttttgagttttcaagagccatgaacgaactgcaactgaacgacgccgagttcgcactactgatcgcaatttcgatcttcagtgcggatcgcccaaatgtgcaggatcaactccaggtggagaggctgcagcacacctatgtggaggccttgcatgcctacgtctccattcatcaccctcatgaccgactgatgttccccagaatgctcatgaaactggtgtcccttagaactctgtcctccgtgcatagcgagcaagtgtttgcattgcgacttcaggacaaaaaactgccacccctgctgtcagagatctgggacgtacatgagtag

SEQ ID NO: 57970 - DNA, 585 bp, Artificial Sequence
  Description of Artificial Sequence: Synthetic coding sequence
atgtccctgtggttgggagctccagtccccgacattcctccagattccgctgttgagctgtggaagcccggtgcgcaggatgcaagctctcaggcacagggagggtcctcctgtattctccgggaagaagcacgaatgccccatagcgccggaggaactgcaggcgttgggctggaagccgcagagcctacagccctgttaactcgcgctgagccacctagtgagccaactgaaattcgcccacagaagcggaaaaagggacccgctcctaagatgctgggcaacgagctgtgctccgtctgtggagataaagcatcagggttccactacaacgttttgagctgcgagggttgtaaggggttttttcggcgttctgtgatcaaaggcgctcactatatatgccatagcggcggtcattgtcctatggacacctacatgagaaggaagtgtcaagaatgtcgtctcaggaagtgccgccaagccggaatgagggaagagtgcgtattgtcagaagagcaaatacggctcaagaagctcaaaaggcaagaggaggaacaggcacatgcaacctctctgccgccttag

SEQ ID NO: 57971 - DNA, 618 bp, Artificial Sequence
  Description of Artificial Sequence: Synthetic coding sequence
atgagtctgtggttgggggctcccgtcccggacatccccccagactccgccgtggaactttggaaaccaggtgctcaggatgcctccagtcaggctcagggaggcagtagttgcattttgagagaggaggcacgcatgcctcactctgccggagggaccgccggagtcgggctggaagcggctgagccgaccgcactgctgacaagagcagagccaccctcagagcccactgagataagaccccagaaaaggaagaaaggtcccgcacccaaaatgcttggaaacgaactgtgtagcgtctgcggtgacaaggcctccgggtttcactacaacgttctgtcgtgtgaaggatgcaaaggcttctttcggcgtagtgttatcaagggcgctcactatatctgccactccggagggcattgtcccatggacacatatatgaggcgcaagtgccaggaatgccgcctccgaaaatgtcgccaagccggtatgagagaggaatgtgttctttccgaagagcagataagactcaaaaagctgaagcggcaggaggaagaacaggcccacgctacatcactgcctcccagagcctcctcacctccacagatccttccacagtag

SEQ ID NO: 57972 - DNA, 234 bp, Artificial Sequence
  Description of Artificial Sequence: Synthetic coding sequence
atgagtttgtggctgggggcacccgtaccagatatacctccagacagcgcagtggagctgtggaagcccggagctcaggatgcttccagtcaggcgcagggcggaagctcgtgcatcctgcgcgaagaggccagaatgccacatagtgcaggcggtaccgccggtgttggactagaagccgctgaacccacggctctactgaccagagccgagcctcctagcgagccgacctag

SEQ ID NO: 57973 - DNA, 1344 bp, Artificial Sequence
  Description of Artificial Sequence: Synthetic coding sequence
atgtcgctgtggttaggagctcccgtgcccgatattcccccagactcggccgtggagctgtggaagcccggagctcaggatgcgtcctcacaggcccagggaggatcttcttgtattctgcgagaggaagcacgcatgcctcactccgccggaggaactgctggggtcggcctggaagctgctgagcccacagccctgctgacaagagctgagcctcctagcgagcccacggagataaggccccaaaagagaaaaaaaggacctgctcctaagatgctggggaacgagttgtgcagtgtgtgcggggacaaagctagtggcttccactacaacgtcttgtcttgcgaaggttgtaaaggcttttttcggcgatccgtgattaagggggcacattatatttgtcattctggcggtcactgcccaatggatacctacatgagacggaagtgtcaggaatgccgtttgaggaagtgtcgccaggcgggtatgagagaagagtgcgtgctaagcgaggaacagatccgcctaaaaaaacttaaacggcaggaggaggagcaggcccatgccacctcactacccccacgagccagctcacctccccagatcctcccacagctttccccggaacagttagggatgatagagaagctcgtggccgctcagcaacagtgcaataggagatcattcagcgaccgactgcgggttacaccctggcccatggctccagatcctcattccagagaggcaagacagcagagatttgcacactttactgagttggccatagtgtctgtacaggaaatcgtagatttcgcaaaacagctccccggatttctgcagctgtctagggaggatcagatcgccctgcttaaaacgtccgccatagaggtcatgcttctggaaaccagtcggagatacaaccccggaagtgaatctatcaccttcttgaaagacttttcatataatcgggaggacttcgctaaggcagggttacaagtggaattcataaaccccatttttgagtttagccgggctatgaatgagcttcagctgaacgacgctgaattcgctttattgattgcaatttccattttttccgccgatagaccaaatgtgcaggaccagctgcaagtggaaaggcttcagcacacttacgtcgaggcactccatgcatatgtaagcattcaccaccctcacgaccgactgatgttcccacggatgctgatgaagctcgtctccctaagaacgttatctagtgtgcactccgagcaagtttttgcattgcgactccaagataaaaagctaccccctctcctgtccgaaatatgggatgtgcacgagtag

SEQ ID NO: 57974 - DNA, 1881 bp, Artificial Sequence
  Description of Artificial Sequence: Synthetic coding sequence
atgtgttcgacactgaagaaatgtgggacatatcgcactgaggtggcagagtgccacgatcacgggagcacattccagggtagaaagaaaggcggatcttcctttcgcgacaactttgacaagcggagctgccactatgagcatgggggatatgagcggccaccctcccattgccaagaaaatgatgggtccgtggagatgcgagatgttcacaaagatcagcagctgaggcacactccctattcaattcgttgtgaacggaggatgaaatggcacagcgaagacgagatccggattactacttggaggaatcgcaagcccccagagcgcaagatgtcacaaaacacccaggatggctacacacgaaattggttcaaagttacgattccttacgggataaaatatgacaaggcctggctgatgaacagtatacaaagccattgttcagacaggtttacgcctgtcgacttccactacgttagaaacagggcatgtttctttgtccaggatgccagtgccgcatctgcactgaaggacgtatcgtacaaaatctatgacgatgaaaaccagaaaatctgcatcttcgtgaaccactccaccgctccctactctgtgaaaaataaactcaaacccggacagatggaaatgttgaaactgaccatgaataagcggtacaatgtaagtcaacaggcccttgatttgcaaaacctccggtttgatcccgatctgatgggcagagacatagacatcatcctcaaccgccgtaactgtatggcagctactctcaagattattgagcgcaacttccctgaattgctgtctttgaacttgtgcaacaacaagctttaccagctggacggactgtctgacatcaccgaaaaagctcccaaagtcaagacccttaacttgtccaagaacaaactcgaatcagcttgggaattgggcaaggtcaagggcctcaaactggaggaactttggctggagggcaaccctctgtgctccacttttagcgaccagagcgcatatgttagcgctatcagagattgctttccaaaactgctgcgactggacgggagggagttgagcgcccctgtgatcgtggatatcgattctagtgagactatgaaaccatgcaaagagaactttaccggaagtgaaacacttaaacacctggtgctgcagtttttgcagcagtactacagcatctacgattcgggcgaccgacaggggctcctgggcgcataccatgacgaggcatgctttagccttgctatccctttcgaccccaaggactccgcgcctagttcactgtgtaaatacttcgaggactctcggaacatgaagaccctcaaagatccttacttgaagggcgagctgctgaggcgcaccaaacgcgatatcgtagacagcctgtcagcgttgccgaagacccaacacgacctttcctcaatcctggtcgacgtgtggtgccagactgaaagaatgctttgcttttccgttaatggggttttcaaggaggtagagggacagtctcagggaagcgtactggcctttaccagaacattcattgcgaccccaggttcaagctcgtctctgtgcatcgtgaacgacgagctcttcgtgcgcgacgcaagcccgcaggaaacccagagcgccttcagcataccggtatctacgttgagtagttcatccgagcccagcctgtctcaagaacagcaggagatggtgcaggcattttcagcacaatcaggcatgaaacttgaatggtcccagaagtgtctgcaggacaatgaatggaattatactcgagcgggtcaggcatttactatgctgcagacagaggggaaaatcccggcagaggctttcaagcagattagctag

SEQ ID NO: 57975 - DNA, 1881 bp, Artificial Sequence
  Description of Artificial Sequence: Synthetic coding sequence
atgtgttctacgctgaaaaaatgtggtacttaccggaccgaagtagctgagtgccatgatcacggcagcacctttcagggcagaaaaaaggggggatcctccttccgcgacaattttgataagaggagctgccactacgagcatggaggttatgagagacctccttcccactgtcaggagaacgacggctctgtggaaatgagagatgtgcacaaggatcaacagctccgtcacactccctatagcattaggtgcgaacggagaatgaagtggcactctgaagatgagattaggatcactacttggcggaaccgtaaaccaccagagagaaagatgtcacagaacacgcaggacggatatacaaggaactggtttaaagttactattccatatggaattaagtacgataaggcctggcttatgaatagtatccagtcacattgcagcgatcgattcacgcccgtcgactttcactatgtgcgtaaccgtgcctgttttttcgtgcaggacgcatctgctgcgtccgctttgaaggacgtgtcatacaaaatttatgatgatgagaaccagaagatatgcatattcgttaatcactctactgccccttactcggtaaaaaataaactgaagccgggacagatggaaatgctgaagctgacaatgaataagcgatataatgtctctcagcaagcgctggatttgcagaatctgcgctttgaccctgatctgatggggcgtgatatcgacataattctcaatcgtcgcaattgcatggctgccacactgaaaatcattgagcgcaactttccagagctgctgtctctgaacctgtgcaataacaagctgtaccagctggacggtctctccgacattacagaaaaggccccaaaggtaaagacgctgaatctgtctaagaacaagctcgaatccgcttgggaactggggaaagtgaaaggactgaagctggaggaactttggctggaaggcaatcccctgtgctccacattctcagaccagagtgcatacgtgtctgccataagagattgctttccaaaactccttagattagacggacgtgagctcagtgcccctgtaattgtggacattgatagctctgaaaccatgaaaccttgtaaggagaattttacgggttctgagaccctgaagcacctcgtcctgcagtttctgcagcagtactactccatatatgatagcggagacagacaaggcctcctcggagcctaccatgatgaagcgtgctttagcctggcaattcccttcgaccctaaagatagcgctccgagcagcctctgtaagtactttgaggatagtcgcaatatgaagacgctgaaagacccctatctgaaaggagaactgctccggagaacaaagagggacattgtggattctctgtcagcgctcccgaagacccagcatgacctttcctctatactggtggatgtctggtgccagactgaacgcatgttatgttttagtgtgaacggagtgttcaaagaggtggagggtcagagccaaggcagcgtcttggcctttacccgcacttttattgctacccctgggtccagctctagcctgtgtatcgtcaatgacgagctctttgtgcgggacgcgagcccccaggagacacagagtgctttctctatccccgtgtcaactctctcctcatcaagtgaaccctctctgtcccaggagcagcaggaaatggtgcaggcctttagcgcccagagcggcatgaaactagaatggtctcaaaagtgtcttcaggataacgagtggaattatactcgcgcaggccaggctttcacgatgttgcagacagaaggaaaaattcccgctgaagcttttaagcagataagctag

SEQ ID NO: 57976 - DNA, 471 bp, Artificial Sequence
  Description of Artificial Sequence: Synthetic coding sequence
atggttgacatactgggtgaacgccacctggtgacctgcaagggcgcaacagtggaggctgaggcggctctgcaaaataaagtagtggcgctgtatttcgcagctgctcggtgcgcaccatcccgcgacttcacccctttgctttgcgacttttatactgctttggtagcagaagccagacggcctgctcccttcgaagtagttttcgttagtgcagacggttcatcccaagagatgctcgattttatgcgcgagctccatggcgcatggttagccctgccattccacgacccctatagacacgaactccgcaaaaggtacaatgttaccgcaatcccaaagctggtaattgtgaagcaaaatggggaagttatcaccaataaaggacggaagcagattcgggaacgtggcctggcctgtttccaggactgggttgaggctgccgacatctttcagaatttcagcgtctag

SEQ ID NO: 57977 - DNA, 408 bp, Artificial Sequence
  Description of Artificial Sequence: Synthetic coding sequence
atggtcgatatcttgggggaacgccatctcgttacatgcaagggtgctactgtcgaggccgaagcagccctgcagaacaaagtggtggccctgtatttcgctgccgctaggtgcgctcctagccgggactttaccccactgctgtgtgacttctatacagctttagtggccgaggcgcgtcgtcccgctccattcgaggtggtgttcgtcagcgccgacggaagttctcaagaaatgctcgactttatgagagagttgcacggcgcttggctcgctttgccatttcacgatccatacaggcagcggtcactggcactgttgcctagactggagtgttctggcgtcatattagcccactgcaacttatgccttctgggctcttccgactcgctcgctctggccagctag

SEQ ID NO: 57978 - DNA, 687 bp, Artificial Sequence
  Description of Artificial Sequence: Synthetic coding sequence
atggcccgacacgtgttcctgacagggccacctggagtgggtaagacaaccctgattcacaaggctagcgaagtattgaaatcctccggggtgcctgtggatggcttttatacagaggaagtccggcaagggggaagacgcattggctttgatgtcgtgacgctcagcggcacccggggacccctgtcgcgggtggggctggagcctccccctggcaagcgcgagtgcagagtgggccagtacgttgtcgacctcacctcgttcgaacaactggccctgccggtgcttaggaacgccgattgcagctccgggcctgggcagagagtgtgtgtgatcgacgagattgggaagatggagctcttctcgcagctgttcatccaggcagtccggcaaaccctgagtactccaggaacaattattttgggcaccattccggtgcccaagggcaagcctttggcgctggtggaggagatccggaacaggaaagatgttaaagtgtttaattcaccatactgcgttatagaggatcagagcaagttctcatcgtgtgtgtctcagtccaccctgaccgagccgggatggcgacaaaagctcctacaatccctactgaatagcgaatggaaaaaacgtgcccctgtggtgccaacaagcgtctcacccccattttacttaaggtggataccgtag

SEQ ID NO: 57979 - DNA, 573 bp, Artificial Sequence
  Description of Artificial Sequence: Synthetic coding sequence
atggcgaggcacgtgtttcttacaggtcctccaggggtgggtaagaccaccttgatccataaggcctcagaggtgctcaagtcgtctggcgtccccgtcgacggtttctacacggaggaggtcagacagggcggtagacgcattgggttcgacgtggtgacattatcaggtacgcggggtcccctatcccgcgtcgggttggaaccccctcctggtaagagggagtgtcgcgtgggacaatacgttgtggacctcacctcgtttgaacaactagcattacctgtcctgcggaatgctgactgcagctcagggcctggccaacgagtctgtgtaatcgatgaaattgggaaaatggagttattctcacagttgttcattcaggcagtgcggcagacactctctactcccggaacaatcatactgggcacgatacccgtgcccaaagggaaaccgttagcactggtagaagagatccgaaatcgcaaagacgtgaaagtcttcaacgtgacaaaagagaatcgtaatcacttactacccgacattgtcacctgtgtccagagtagccggaagtag

SEQ ID NO: 57980 - DNA, 324 bp, Artificial Sequence
  Description of Artificial Sequence: Synthetic coding sequence
atgatggagggcctgggcgagcatagcaccgcgggtgagatgggacctcttcttggtgcagtggccgcaactgcctcacctcagagtctgatggagtacagctccgacgctgatttcatcgaatcactgccattggtggtgaagtaccgcgtgtatacgctgaagaaattgcaggccaagtgcgccgtgctggaggctaagtacctgagggaatttcatagcgtcgaacgcaaatttgcaacaatttacggtccgctcctcgagaagagaaggcagatcacaaacgccctatacgagcccacgaaggaagagtgcgagcgctag

SEQ ID NO: 57981 - DNA, 3042 bp, Artificial Sequence
  Description of Artificial Sequence: Synthetic coding sequence
atgtgtagccaggaggcatttcaggctcaacgctcacagttagttgaactgctcgtgtctggatctctggagggttttgagtccgtactcgactggctgctcagttgggaagttctgtcatgggaagactacgagggctttcaccttcttggtcagcccctgtcccacctggcccgaagattgttggatacggtgtggaacaaaggaacctgggcctgccagaaactgattgctgctgcccaggaagcacaggccgacagtcagtcgccgaagctgcatggatgctgggaccctcacagccttcaccccgctcgggatttacagtcacacagaccagccatagtgagaagattacactcccatgtggagaacatgcttgatctcgcctgggagaggggctttgtgagccagtacgagtgcgacgagatcagactccctatcttcactccatcccagcgagccaggagactattagatctggcgacggtcaaggcgaatgggctggcagccttcttgctgcagcatgttcaggagctgccagttcccctggctctgccgctggaagcggctacctgtaagaaatatatggcgaaactgcggactactgtatctgcccaatcaagattcctgtccacatatgacggcgctgaaacactgtgcctcgaagatatttacacggaaaacgttctggaagtttgggcggacgtgggaatggccggaccgccacagaagtccccagctacgctgggcctggaagagctcttcagtacgcctgggcatctgaacgatgatgcggataccgtgctggtcgttggcgaggcaggttctggcaagagtactttgttgcagcgcctgcacctactttgggctgcaggacaggactttcaagagttcctgtttgttttccctttttcctgtaggcagttgcagtgcatggccaaacccctctcagttcgcaccttgctgtttgaacactgttgctggcctgacgtggggcaagaagatatcttccagctgttgcttgatcaccctgaccgggttctcttgacatttgatgggttcgatgaattcaaatttagattcacagatagggagagacactgcagccctacagatcccaccagcgtgcaaacgctcttatttaatttgttgcagggcaacctccttaagaatgccagaaaggtagtgacttcaaggccggcagccgtgagcgctttccttaggaagtacatcagaacagaatttaacttaaagggattctccgagcaaggaattgaactctacctgaggaagcggcaccacgagcctggggttgcagaccgcctcatccggcttctgcaagaaacctcagctcttcacggcctgtgtcacctgccagtgttctcatggatggtctcgaaatgtcaccaggaacttctcctccaggaggggggttcccccaagaccacgaccgatatgtaccttttgatcctgcagcactttctgctgcacgcgactcccccagattccgccagtcagggcctgggaccaagcctccttaggggtcggctccccacactgcttcatcttgggcgacttgcactgtggggcctgggaatgtgttgttacgtgtttagtgcccaacagttgcaggcagctcaggtgagtcccgacgatatctctctgggcttcttggtgcgcgctaaaggagtcgtgcccggatcaacagcccctttggagtttctgcacattactttccagtgtttttttgccgcattttatctggccctgtccgccgatgttccccctgctttgttacggcaccttttcaattgtggaaggcccggaaattctccgatggcacgactgcttccaaccatgtgtatacaggcatccgagggcaaagacagcagcgtcgccgcactactgcagaaagcagagcctcacaacctccagattactgccgcatttctcgccggactcctatcaagggagcactgggggctgctcgcggagtgccaaacgagcgaaaaggcccttttgcggcgtcaagcctgtgccagatggtgcctcgctcgcagcctgcggaaacatttccactctatccctccagcagcacccggagaagctaagagcgtgcatgcgatgcctggctttatatggctaattagatccctctacgagatgcaggaggaaaggctggctagaaaggccgctaggggtttgaacgtgggccatctgaagctcactttttgctcggtaggtccaactgagtgcgccgcactcgctttcgttttgcaacacctgcggaggccagtcgccctgcagctagactacaatagcgtaggcgacataggagtcgaacaacttctgccctgcctgggggtatgtaaggccctctacctaagagacaataatattagtgatcgcggaatctgcaagctgatcgagtgtgcacttcattgcgagcagcttcagaaactggcactttttaataacaaacttaccgacggctgcgcacactcgatggccaaactgctggcctgcagacaaaattttctggcactccgcctcggaaataattacataactgccgctggggcacaggtgctggcggagggactgagggggaacacgtctcttcagtttctggggttctgggggaaccgtgttggcgatgagggtgcccaagctctcgcagaggccttgggggaccaccagtccttacgatggttgtctctcgtgggtaacaacattgggtcagtgggggcacaggcccttgctctgatgctagccaaaaatgtgatgttggaggagctgtgccttgaggaaaatcatctgcaggatgagggcgtatgttccctcgcagagggtttgaaaaagaacagcagtttaaagattcttaagctgtcaaataactgtatcacttatctgggggcagaggctttactgcaggctctggaaagaaatgataccatcttggaggtgtggcttcggggtaacacattttcactcgaggaggtcgataaattgggttgcagggatacaaggttgctactgtag

SEQ ID NO: 57982 - DNA, 441 bp, Artificial Sequence
  Description of Artificial Sequence: Synthetic coding sequence
atgtgctcccaggaggcattccaggcacaaaggagtcagctggtggaactattagtatccggaagcctcgagggattcgagtcagtcctggattggcttctaagctgggaggttctgtcctgggaggactatgagggtttccacctattagggcaaccactgtctcatcttgcacgaagacttttggatactgtgtggaataagggaacatgggcctgccagaaactgattgccgctgcacaggaggcacaggccgatagccagagcccgaagctgcacgggtgttgggatccacacagcttgcaccctgctagagatttgcagagccacagacccgcaatcgttagacggttgcactcacatgtggagaatatgctagatctggcttgggagcgcggatttgtttcacagtatgagtgcgacgaaattcgactcccctag

SEQ ID NO: 57983 - DNA, 1752 bp, Artificial Sequence
  Description of Artificial Sequence: Synthetic coding sequence
atggaggtggcagcgaactgtagcctgcgagttaagcggccattgctggatccacggtttgaggggtacaagctctcgcttgaacccctgccatgctatcagctagaacttgatgctgcggtagcagaagtaaaattgcgggacgatcagtacaccttagagcacatgcacgctttcggcatgtataactatcttcactgtgattcgtggtaccaggacagcgtgtattacatcgacactttgggcagaattatgaacctgactgttatgctggataccgccttgggaaagcctcgcgaggtttttcgactccctaccgaccttacagcctgcgacaaccggctgtgtgcctccatccatttctctagttccacttgggtgacattgagcgatggtaccggcaggttgtatgtcatcggaaccggcgagagagggaacagtgcatctgaaaaatgggagatcatgttcaacgaggagctaggggatccattcatcatcatccattcgattagcttgttaaacgccgaagagcactctattgctaccttgctgctccgcatcgaaaaagaagagctcgatatgaagggaagtggcttctatgtttcactggaatgggtgaccattagcaagaaaaatcaggacaacaagaagtacgaaatcatcaagagagatatcttgcgcggaaagtcagtgccacattatgccgctattgagccggatggcaacgggctgatgatagtgagttacaaatcactgacattcgtgcaggccggacaggatctagaagaaaacatggacgaggatatttccgaaaaaatcaaggagccgctgtattactggcagcaaactgaggatgaccttacagttactatacggctgcctgaggattccaccaaagaggatattcagatacagttcctccccgatcacattaatatcgtgctcaaggaccaccagtttctagaagggaagctgtattcaagcattgaccatgagagttctacttggatcatcaaggaatctaactcgctggaaattagtcttattaagaagaacgagggtctgacctggcccgagctcgtcattggagataaacagggcgaactgattagagattctgcgcagtgcgccgcaattgcggaaaggctaatgcatctgacttctgaagaacttaatcccaatcctgataaggaaaaacctccttgcaatgcccaggagctggaggagtgtgatatctttttcgaggaaagcagctctctgtgtcgcttcgatggcaacacgctgaagacgacccatgtcgtgaacctgggtagtaaccagtacctgttctctgtcatcgtcgatccaaaagaaatgccttgtttctgccttcggcacgacgtggatgctctgctgtggcaaccgcattcaagtaagcaagatgacatgtgggaacatattgcaactttcaacgctctgggctatgtgcaggcttccaaaagagacaagaagttttttgcctgcgcacccaactatagctacgcagctttgtgcgagtgcctgagacgcgtgttcatttaccgacaaccagcacccatgtcaaccgtgctctacaacagaaaagaaggcagacaagtgggtcaggtggcaaagcagcaggtagcatctctggaaaccaacgacccaatcctgggtttccaggccacaaacgaaaggctatttgttctcaccaccaaaaatctgttcctcattaaggttaacaccgaaaactag

SEQ ID NO: 57984 - DNA, 1665 bp, Artificial Sequence
  Description of Artificial Sequence: Synthetic coding sequence
atgttgtacctccaaggctggagtatgcccgctgtcgcagaagtgaaactccgggatgaccaatacactctggaacacatgcatgctttcggaatgtataactatttgcactgtgattcttggtaccaggattcggtgtactatatcgatacgcttggcaggataatgaacttaactgtaatgctggataccgctttagggaagccgcgagaagtctttagactcccaacagatttaacagcctgcgataaccggttatgcgcttccattcatttttcctcatccacctgggtgacgctgtccgatggcacggggagactgtacgtgattggaaccggggagaggggaaactcagcctcagagaagtgggagatcatgttcaacgaggagctcggtgatccatttattataattcatagcataagtttgctcaatgcggaagaacactccatcgctactttactgctgcggattgagaaggaggagctcgatatgaaaggaagcggtttctacgtgagtctagagtgggtaacgataagtaaaaagaatcaagataacaagaaatacgagatcatcaagcgcgacatactcagagggaagtccgtacctcactacgctgcaattgaacctgacggcaacggattgatgattgtaagctataaatccttaacttttgtccaggccggacaagacctggaggaaaacatggacgaagatatcagtgagaaaatcaaggagcccctgtactattggcagcagacagaagacgacctgacagtgactatccgactaccagaggactcaaccaaagaagatatccagatccagtttttgcccgatcatatcaatatcgtgttaaaagatcatcaattcctggaaggaaaactttatagcagtattgatcacgagtcgtccacttggatcatcaaggaatcaaattcgctggaaatcagcctcataaagaagaacgaagggctgacctggcccgaactcgtgataggggacaaacaaggggaactcattcgggactctgctcagtgcgcggctatcgctgagcggctgatgcacctaacctctgaggaactaaatccgaatcctgataaagaaaagcccccttgcaacgcgcaggagctggaggagtgcgacatcttcttcgaagagtccagttcgctctgtaggtttgatggaaatacactgaaaaccactcatgtggtaaatttgggttcaaaccaatacctgttctcagttattgtggatccaaaagagatgccctgtttctgcctgaggcacgatgtagacgcactgctttggcagccccactcaagcaaacaagatgacatgtgggagcacatcgcgacatttaatgcacttggctacgtccaggcatccaaacgggacaagaaattcttcgcttgcgcccctaattattcatatgccgctctgtgtgagtgccttcgacgcgtctttatctaccggcagcctgcacctatgtcaaccgtgctgtacaatcgtaaagagggcaggcaggttggccaagtcgccaaacaacaagtggcttctctagagacgaatgacccaatcttgggcttccaggccacaaatgaacggctcttcgtgctgacgacaaaaaacctgttccttattaaggtgaataccgaaaattag

SEQ ID NO: 57985 - DNA, 474 bp, Artificial Sequence
  Description of Artificial Sequence: Synthetic coding sequence
atgtcagcccctttcgaagaacggtccggtgtggtcccttgcggtaccccctggggccagtggtatcagacgttggaagaggtatttattgaggtgcaggtgcccccaggaacccgtgcccaggatattcagtgcgggctgcagtctcgacatgtggctttgagtgtgggtgggagggagatcctgaaaggaaaactgtttgatagcacaattgctgacgagggtacatggacgctcgaggatcggaaaatggtgagaattgtcctgacaaagacaaaaagagacgccgcaaactgctggacaagcctgcttgaaagtgaatatgctgcagatccttgggttcaggaccagatgcagagaaaacttaccctggagagattccagaaagaaaatcccggattcgatttctccggtgccgagatctcaggtaattataccaaagggggtccagacttttcaaatttggagaaatag

SEQ ID NO: 57986 - DNA, 1086 bp, Artificial Sequence
  Description of Artificial Sequence: Synthetic coding sequence
atggagaccggcgcagctgaactctacgaccaagcactgttaggtatcctccagcacgttggaaacgtgcaggactttctccgggtgctgtttggtttcctttacagaaagacggacttctataggctcctgcggcatccttccgatcgaatgggatttcccccaggggcagcccaggccctggtgctgcaagtgttcaaaactttcgatcatatggccagacaggatgatgagaaacgaagacaagagctggaggaaaaaattcgcagaaaagaagaagaggaagctaaaaccgtgtcggcagccgctgccgagaaagaacctgtccccgtgcccgtgcaggaaattgagattgacagtaccaccgaactagatggccaccaggaggtagagaaggtgcagcctccgggacctgtaaaagaaatggcacacggtagccaggaagctgaagctcccggagctgttgcaggagccgcagaagttccgagagagcccccaattctgcccagaatccaggaacagtttcaaaaaaatcctgattcttataacggagccgttcgcgagaattatacctggtctcaggattacaccgatcttgaagtgcgcgtacccgttccgaagcacgtggttaagggcaagcaggtgtctgttgccttaagtagtagcagcatcagagtcgcaatgttggaggaaaatggcgagagggtcttgatggaggggaaactaacccacaagatcaacacggagtctagtttgtggtctcttgagcctggcaagtgcgtcctggttaacttgtcaaaggtcggagagtattggtggaatgcaatcctggagggggaagagcctatcgacatagacaagataaataaagaaagaagtatggcaaccgttgatgaggaagaacaggcagtcctcgaccgcctgactttcgactatcatcagaagctccaagggaagcctcagagccacgagctgaaggtgcatgagatgctaaagaaaggctgggatgcagaagggtcccctttccggggacagaggtttgaccccgcaatgtttaatattagtcccggagcagttcagttttag

SEQ ID NO: 57987 - DNA, 495 bp, Artificial Sequence
  Description of Artificial Sequence: Synthetic coding sequence
atgaagtgcaagccaaaccagacaaggacttatgaccctgaaggcttcaaaaaacgtgctgcttgtctctgctttagaagtgaacgcgaagacgaggtgcttttggtgtccagctcacgataccccgatcgctggattgtgcctggagggggtatggagccagaagaggaacccggaggggcagctgtcagagaggtttacgaggaagcgggagtgaagggtaaactgggtcgtctgctcggagttttcgaacaaaatcaggaccccaaacatagaacctacgtatacgtgctgacagtgacggaacttctcgaggattgggaagacagtgtgagcataggcaggaaacgggaatggtttaaagtggaagatgcgatcaaagtactccagtgtcataaaccagtccacgcagaatacctcgagaaactgaagctgggcggtagcccaaccaacggaaacagcatggccccttcaagccccgattccgatccctag

SEQ ID NO: 57988 - DNA, 495 bp, Artificial Sequence
  Description of Artificial Sequence: Synthetic coding sequence
atgacagccagcgcccaacctagaggccgacggcctggagtgggtgtgggagtcgtggttaccagttgtaaacatccaagatgtgtacttctgggcaaacggaaagggtcagtcggcgcaggaagcttccaactgccagggggacacctggagtttggcgagacatgggaggagtgcgcccagagagagacttgggaagaggccgctctgcatctgaagaatgtacacttcgcgtccgtggtgaatagtttcattgagaaagaaaactatcattacgtgaccatcttgatgaagggtgaggtggatgtcacacatgactcagagccgaaaaatgttgaacccgagaaaaacgagagctgggagtgggtgccatgggaagagcttcctcccttggatcagctgttttggggactgagatgtctgaaggaacagggctacgatcctttcaaggaggatcttaatcatctggtggggtataaaggtaaccatttgtag

SEQ ID NO: 57989 - DNA, 987 bp, Artificial Sequence
  Description of Artificial Sequence: Synthetic coding sequence
atggctgaagttagagtccagctgcttctttcgcgcaggcccgaatccgtcagcttcgctcgctccgtttgcgggctgttaggcgcaggtccaggactcggcacatggcctattcactgctcactgaagagggggaggctggttctttcatctcgaccttttcctggcgcttcggccaggctccctttgcaaagacctcccttctgtccatttgcggctctcgaggagagaccaagggtgccaggcgcagagctacccaccgatcggggtgtggatcttggcgtggccgtcattctgcaatcctccgataagactgtgctgcttaccagacgtgcacgaacactcagtgtctctccgaacctctgggtgccaccaggcggacatgttgaactggaggaggagctcctagacggcggacttcgcgagctttgggaagagagtggcttgcatctgccccaaggccagttttcttgggtccccttgggactctgggaaagcgcgtatcctccacggttgagctggggtctgccaaagtatcatcatattgtgctgtatcttctagttatctcacaggagtctcagcagcagctgcaggcccgaatacagccaaacccgaatgaggtttccgctctcatgtggttgactcctgacgtcgcagctgccgtagccgcagcagaggacgggacggagacccctggactactgcctcaggatttacctcccagcgtattggctgtcgagttggaggaggatggaagagcccgacctttggtattacatatgagcactttactgcgcatgattcccacgatggctgaggataaagaacgggtgtctaccggtaccaaattcgctctaaagttgtggctccagcacctcggaagaaccccccctccttgcaaaagcgcagcttacctggatcccggacccgcaaaagaggagtggaacatggacccccttcctcctaatcaagggtccggaaagtag

SEQ ID NO: 57990 - DNA, 555 bp, Artificial Sequence
  Description of Artificial Sequence: Synthetic coding sequence
taggctgtgattctgcaatcgtcagacaagactgtactgttgactagacgcgctcggactctttccgtgagtccaaatctgtgggtgcccccaggagggctccgagagctgtgggaggaaagcggactgcatctcccccagggccagttctcttgggtgcccctgggtctctgggagtctgcttaccctcctaggctctcctggggactgcctaaatatcatcacatcgtcttatatcttctggtgatttctcaggaaagccaacagcagcttcaggccagaattcaacctaatcctaatgaagtgtctgccttgatgtggttgacccccgacgtggctgccgctgttgcggcagccgaggatggaaccgaaaccccaggcttgctgcccagaactagaggcggttggaagtctcccacaagcgggccagctcacgtacacccacctgctgacgacccaaatcacgggagaggtcagcgggagtcgcagcattggaatcaagtctgtccacaagcccttgccgctacctctggacagaacaccccaacagtgtag

SEQ ID NO: 57991 - DNA, 972 bp, Artificial Sequence
  Description of Artificial Sequence: Synthetic coding sequence
atggctagcgaggggctcgcaggggcactggccagtgtgctggccggtcaaggatcgtccgtgcactcttgcgactctgcccctgctggcgagccacccgctccggttcgcctaagaaagaatgtgtgctacgtcgttcttgcggtttttctgtctgagcaggatgaggtgctgctcatacaggaggccaagagggagtgtcggggatcatggtatctgcccgctggacgaatggaacctggagagacgatagtggaagccctgcagcgggaggtgaaggaggaggcaggcctccactgtgaacccgagacacttttgagcgtggaggaaagaggtcccagctgggtgcgattcgtgttcttggctaggcctacaggcggtatcctgaagactagcaaggaggcggatgccgaaagtctgcaagcagcatggtatcccagaacctcgttgccgactcccctccgagctcacgatatcctccacctcgtggaacttgccgctcagtatcgacaacaagcacgtcatcccttgatactgccccaggaactgccctgtgacctggtctgccaacgcctggttgcgacatttacctctgctcagaccgtgtgggtgctggtggggaccgtcggcatgccacacctgcccgttacggcatgcgggctggaccccatggagcaaagaggagggatgaagatggccgtcctcaggcttctacaggaatgtctgacactacaccacttggttgtggagataaaagggttgctggggttacagcacctagggagggaccattcagacggcatctgtctgaacgtattggtgacagtcgccttcagatcacctggcatacaggatgagccccctaaagttcggggtgagaacttctcctggtggaaggtgatggaggaagatcttcaaagccagctcctgcaaagactacaggggtctagcgtggtgcccgtgaaccgttag

SEQ ID NO: 57992 - DNA, 180 bp, Artificial Sequence
  Description of Artificial Sequence: Synthetic coding sequence
atggcgtctgagggactggctggagcactggctagcgtgctggccggtcaaggcagttctgtccactcatgcgactcagccccagccggtgaaccaccggcaccgagggcgggttgtggaaggacctgcgcaacctggtgctggccttgttcatccgccagtcgcatgcggtgctattag

SEQ ID NO: 57993 - DNA, 741 bp, Artificial Sequence
  Description of Artificial Sequence: Synthetic coding sequence
atggagcccggtgaaacaatagtagaggctctccaacgcgaagtgaaggaggaagccggtttacattgcgagccggagaccctcctttctgttgaggagaggggtccatcatgggtccgtttcgtctttctggccaggccaacaggaggcattttgaagacgtctaaggaggccgacgccgaatcattgcaagccgcatggtacccacggaccagtttaccaacaccactccgggctcacgacatcctgcaccttgtcgagttggcagctcagtaccgccagcaggccaggcacccattgatcttaccgcaggaactcccctgtgaccttgtgtgtcagcggcttgtggccaccttcacctcggcgcagacagtgtgggtgctggtcgggaccgtagggatgccccatctgccagtgacagcttgcggtctcgatcccatggaacagcgcggtggcatgaaaatggccgttctgcgtctcctgcaggaatgtctcacactccatcacctcgtcgtggaaattaagggtctcctagggctgcagcatctcggtcgagaccatagtgacggaatctgtctaaacgtactcgttacagtggcttttcggtctcctggcatacaggacgaaccccctaaagtgagaggcgaaaatttttcttggtggaaggtcatggaggaggacctacagagtcagctgctgcagcgactgcaggggagcagcgtagtaccggtgaaccgctag

SEQ ID NO: 57994 - DNA, 1128 bp, Artificial Sequence
  Description of Artificial Sequence: Synthetic coding sequence
atgtcctcttcgctgcgaccagggccaagcaggtggcggagggccgcttcaatagtcctggccgctggatggtcaagaccggagaccgctacaccgccttctcgccctccccctgctgagggatttcgcttattgctgctgcagagatcaccgcaccaagggttcatgccaggagctcatgtcttttctggaggagtgctggacgcagccgatcgctcagccgattggctgggcctgtttgctccacatcacggcccacccaggtttggactcggcccagccccattttcgcgcacagccttcccgtcacttcccgatacagatgatcataaaactgataacacaggcacactgcctgaagacgttgccttccgtatctgtgctgtacgagaagcattcgaggaggccggagtccttctgctgcgaccccgtacatcccccccaggtcccgcaccaggccctggcctggccctcgagcccccacctgggttggcctcctggcgtgacagagttcgccaggacccccgacacttccttaggctctgtgcacatctggattgcaccccagatatctgggcgctccataactggtcagcctggttaacaccctttctgaggggcacaactagaaggttcgatactgcatttttcctgtgttgtttaagggaacccccaccggtgtacccagacctggctgaagtggtgggataccaatggagttcaccgagcgaagcgacagagtcgtttctctccaaggagatttggctacctcctccgcagttttatgaggttaggagacttgcgaacttcgcgagcctgagcgatctgcataaattttgtctgggacgggctctggaaggcttggagagatggttaccgataatactgttaactgccgacggcatggtgcacctcctgcctggagacgagctttatctggaagactccgactttcttgagaacctgatgtcaacagagaaaaaaaccgaagagatcatgaaggaaggcaaacaatttcacaggatagtgacctaccataggcacctttacgacattcacgtcacagtgcaaccgaagtataagcacgtgtaccctaagaactcagtcgtccgcaagtcccatctctag

SEQ ID NO: 57995 - DNA, 912 bp, Artificial Sequence
  Description of Artificial Sequence: Synthetic coding sequence
atggatccagaagttactcttctgctccagtgtcccggaggaggccttccgcaggagcagattcaggctgaactgagccccgctcacgacaggcgccctctgcctgggggagacgaagctatcaccgctatatgggagacccggctcaaggctcagccctggctgttcgatgcccctaaattccggctgcactcagcaactttagccccaattggctcccgcggtccccagctcctgctacgtctgggcctgacatcttatagagatttcctggggaccaattggtcatctagcgcagcatggcttcggcagcagggtgccactgattggggtgacacccaagcctacctggccgatccgttgggcgtgggggcagccctggccacagctgacgacttcttagtgtttctacgtcgatcccgccaagtcgctgaagctcctgggcttgtggatgtcccgggaggccaccccgaaccccaagccctgtgcccaggcggttctccgcagcatcaagatcttgccggacagctggtcgtgcacgaacttttctcctccgtgctgcaggagatttgtgacgaagtgaacctgcctcttctcactctttcccagcccctgctgctcggtatcgctaggaacgaaacatcagccggaagagctagcgccgaattctacgtgcagtgtagcttgacttccgagcaggtgagaaagcactacctgagcgggggacccgaggcccacgagtccaccgggatcttctttgtagaaacccagaatgttcaacgcctcctggagacagaaatgtgggcggaattatgccccagcgctaaaggagccattatcctgtacaatcgggtccagggcagtcccaccggcgctgccctgggctctcccgctctccttccacctctgtag

SEQ ID NO: 57996 - DNA, 813 bp, Artificial Sequence
  Description of Artificial Sequence: Synthetic coding sequence
atggacccggaagttactctgcttttgcaatgtcctggaggagggttgccccaggagcagatccaggccgagctgagccctgcccacgacagacgccctctgcccggaggtgacgaggccatcacggccatctgggagacgcggttgaaggcccagccttggttgtttgacgcccctaaattccggctgcactccgcaacattagcacccatcggcagccgcggtccgcaactgttgcttcgtctgggtctgacttcttaccgggattttttggggactaattggtctagctcagcggcatggcttcgccaacaaggagccacagattggggggatacacaggcctacctagctgatccgctgggagtgggcgcagctctcgccaccgctgacgactttctcgtgtttttgcgcagatcaaggcaggtggccgaagccccagggctggtggacgtgcccggtggtcatcctgagccacaggtcaatcttccactgctaacgttgtctcagccactactcctgggcatcgctcgcaatgagaccagcgccggtagggccagtgctgagttctatgtacagtgttctctgacgagcgaacaagttaggaaacactacctgtccgggggtcccgaggcccacgagtcgactggtatctttttcgtagaaacccagaatgtgcagcgtcttctagagacggagatgtgggcagagttatgtccctccgctaagggagcaatcattctgtacaatagagtccagggtagtcctacgggggcagccctcggatctcctgccctgctcccgcctctgtag

SEQ ID NO: 57997 - DNA, 639 bp, Artificial Sequence
  Description of Artificial Sequence: Synthetic coding sequence
atggatcccgaagtaactctgttgctgcagtgtcccggaggaggtctcccacaggaacagatccaggctgagctgagcccagcacacgaccggcgtccattgcccggaggtgatgaggccattaccgccatatgggaaacacgactgaaggctcagccctggctgtttgatgcccctaagttccggctgcattcagcaacactcgctcctattggcagccgtggcccacaactgttgttgcgcctggggctgacctcctaccgtgactttctgggtacgaattggagctcttctgccgcatggctgcgccagcagggggctacagattggggggatacacaggcctacctcgcagatcctttaggtgtgggcgctgccttggccaccgccgacgatttcctcgtgttcctcagaaggtcaaggcaagtggctgaggcccctggactggttgacgtgcccggtgggcaccctgaaccacaggtgcggtttcaggccggtcacaaggatcctgattcctctcgcgagctgcaactgagtacattacccattctgcctgcactggtttccagtctcaaaggtaaattagcttggtatttcagcggctccctgctccgggctgtccatctgccaccacattag

SEQ ID NO: 57998 - DNA, 375 bp, Artificial Sequence
  Description of Artificial Sequence: Synthetic coding sequence
atggatcccgaggtcacattgctgctgcagtgcccaggaggcggactaccgcaggagcagatccaagcagaactatcaccagctcacgaccggagaccgttgcccggaggcgatgaggcaataacggcgatttgggagactcggcttaaagcgcagccatggttgttcgacgcccctaagttcaggctccacagtgccacattggctccaataggcagtaggggccctcagctactgctcagattgggcctgacctcctacagagactttctcggaaccaactggtcatcttctgctgcatggcttcggcagcagggtgctactgattggggcgacacccaggcttacctggcagatccactcggcgtcgggtag

SEQ ID NO: 57999 - DNA, 546 bp, Artificial Sequence
  Description of Artificial Sequence: Synthetic coding sequence
atgatgaaatttaaacctaatcagacaaggacttatgatcgggaaggatttaagaaaagagctgcctgcctctgtttcaggtccgaacaggaggatgaggtgttgctggtgtcatctagtcgttatcccgatcaatggatcgttccagggggaggaatggaacctgaggaagaacctggcggtgctgctgtgcgcgaggtgtacgaagaagctggtgtaaagggcaagctggggagattgctgggcatatttgagcagaaccaagatcgaaagcatcggacatacgtgtatgtgttgaccgtgacagagatccttgaggattgggaagattccgtgaacatcggacggaagagagagtggtttaaagtcgaggacgctattaaagtgctacagtgtcataaacccgtccacgcggagtacctggaaaaactaaaattaggatgtagccccgctaacggcaatagcactgtgccaagtctccccgataataatgccctattcgtcacagccgctcagacgtccggactgcccagctcggtacggtag

SEQ ID NO: 58000 - DNA, 543 bp, Artificial Sequence
  Description of Artificial Sequence: Synthetic coding sequence
atgatgaaattcaagccaaatcagactcgcacatacgatcgcgaggggttcaagaaaagggccgcttgtttgtgcttcaggtcagagcaggaagatgaagtgcttttggtatcctcctcccggtaccctgatcaatggattgtgcccggtggaggtatggagcccgaggaggagcccggaggcgctgccgtgcgggaggtttacgaggaggcgggagtaaaaggcaagctgggcaggttattgggcatttttgagaaccaggaccggaagcaccgcacttacgtatacgtgctgactgtaaccgaaatccttgaggattgggaggatagcgtgaatatcggccgaaagagagagtggttcaaggtcgaggacgccatcaaggtccttcagtgccacaaacctgtgcatgccgagtatctggagaagttaaaactcgggtgcagcccagcaaacggaaacagtacggtgccaagcctgcctgataacaatgctctgtttgtgaccgctgcacagacttctggattaccgtcttccgtgcgctag

SEQ ID NO: 58001 - DNA, 390 bp, Artificial Sequence
  Description of Artificial Sequence: Synthetic coding sequence
atggagcctgaggaggagcccggtggagccgctgtccgggaagtgtacgaagaggcaggtgttaagggtaagctgggacgcctgttaggcatttttgagcagaatcaagataggaagcaccgtacatacgtgtatgtcttaacggttacagagattctggaagattgggaggatagcgtgaacattggcaggaagcgggagtggttcaaagttgaggacgccataaaagtgctccagtgccacaagccggtgcacgccgagtacctggagaagttgaaactcggctgtagtccagccaatgggaatagcacggtgccatccctgccagataacaatgcgctgttcgtgacggccgctcagacaagcggactccccagcagcgtacgatag

SEQ ID NO: 58002 - DNA, 543 bp, Artificial Sequence
  Description of Artificial Sequence: Synthetic coding sequence
atggaatctcaggaaccaacagagtctagccagaacgggaagcagtacattatatcggaggagctcatatccgagggtaaatgggtcaaacttgagaaaactacatacatggaccccaccggaaagacccgaacatgggagtcagtgaaacgaaccacccggaaagaacagacagcagatggcgtggcagtaattcctgtgttgcagcgcactctgcattatgagtgtatagtgctcgttaaacaattccgtccccctatgggcggatattgcattgagtttccagctggcttgatagacgatggagaaaccccagaagctgccgctctgcgggagctcgaggaagagacagggtacaagggggatattgccgagtgtagtcccgctgtgtgcatggatccaggcctcagtaattgcacgattcatattgtgaccgtaaccatcaacggtgacgacgctgagaacgcccgtcctaagcccaagccaggagatggcggaatgttctgcaattcatggtggccttccgtctatgacctggtctag

SEQ ID NO: 58003 - DNA, 699 bp, Artificial Sequence
  Description of Artificial Sequence: Synthetic coding sequence
atggagtctcaggaacccactgagtccagccaaaacggcaagcagtacattattagtgaagagttaatttctgaggggaaatgggtgaagctcgagaaaactacatacatggaccccactggcaagacccgacggaacaaggaaaagacaactacccttctgattctgcggacttgggagtctgtaaagagaaccacgaggaaggagcagaccgctgatggagtcgcagtgattccagtgctgcagcgtacactacactacgaatgtattgtactggttaagcagtttcgcccacctatgggcggatattgtattgaattcccagctggcctgatcgacgatggtgagacccctgaagccgcagcacttcgcgaactcgaggaagagacaggttacaaaggcgatatcgcagagtgctcacccgctgtctgtatggatccaggactcagcaactgtacaattcatattgtgacagtaaccatcaatggcgacgacgcagagaatgcccgaccgaagccgaagccgggtgacggcgaatttgtcgaagtgatcagtctgcccaagaatgatttgttacaaagactggatgcgctggttgccgaggagcacctgacagtggatgcgcgtgtgtattcttacgcacttgcacttaaacatgcgaacgctaagccctttgaagtgccattcttgaagttttag

SEQ ID NO: 58004 - DNA, 561 bp, Artificial Sequence
  Description of Artificial Sequence: Synthetic coding sequence
atggagtcacaggagccgacggagtctagccagaacgggaagcaatacatcatctccgaggagctgatctctgaaggcaagtgggtcaaactcgaaaagaccacatacatggaccccaccggtaaaaccagaacatgggagagcgttaaaagaactacgcggaaagagcagacggccgatggcgtggcggtgatcccagtgctccagagaacgctgcactacgaatgcattgtgctcgtgaagcagtttcgccctccaatgggcggatactgcattgaatttccggcaggactgatcgatgacggcgaaacgcctgaagccgctgcgctccgcgaactcgaggaagaaacaggatataagggggatattgctgaatgcagtccagcagtgtgcatggatcctggcctttcaaactgcaccatccacatcgtgaccgtgacaattaacggtgatgatgctgagaacgctcgtcccaaaccgaaaccaggtgatggcgagttcgtcgaggtgatttccctcccaaagaatgacctgcttcaacgactggatgagacactttag

SEQ ID NO: 58005 - DNA, 297 bp, Artificial Sequence
  Description of Artificial Sequence: Synthetic coding sequence
atggaatcgcaggagccaaccgagtccagccaaaacgggaaacagtacatcatatccgaagagttaatttctgaaggaaaatgggtcaagctggaaaagaccacttacatggatccaaccggcaagactcgaacctgggagtctgtgaagaggacaactcggaaggagcagactgccgacgggagatctgccaatcttttccagcctttccgcaaagaagtcagcacctgtgaccgggttgccgtcatccccgtcttgcaaagaaccctgcactacgaatgcattgtcctcgtatag

SEQ ID NO: 58006 - DNA, 660 bp, Artificial Sequence
  Description of Artificial Sequence: Synthetic coding sequence
atggagtctcaggagccgactgaatcttctcagaacggcaaacagtacatcatttctgaagaattaattagtgagggcaaatgggtgaagctggagaagactacttatatggaccctactgggaaaactagaacctgggagtcagtgaagcggaccaccaggaaggaacagacagcagacggagtggccgtgatcccagtgcttcagagaactttacactacgagtgtattgtgttggtcaaacagtttaggccccctatgggcggatactgcattgaattccctgccggtctgatcgacgacggagagaccccagaagctgccgcattacgagagttggaagaggaaaccggatacaagggcgatatcgcagagtgctcacctgccgtctgtatggaccccggtctgagtaattgcaccatccacatagtaaccgtgaccattaatggcgacgacgctgagaacgcacggccaaaacccaaaccaggagacggcgagttcgttgaggtgattagcctgcctaaaaatgatctgcttcagcggctggatgcgctcgtggcagaggagcatctgactgtggatgctagggtctatagctacgcgctcgccctcaagcacgctaatgccaagccattcgaggtgcctttcttgaaattctag

SEQ ID NO: 58007 - DNA, 660 bp, Artificial Sequence
  Description of Artificial Sequence: Synthetic coding sequence
atggaatctcaggagcctaccgaaagttcgcagaatggaaaacagtatataatttctgaggagttaatttccgagggaaagtgggtgaagctcgagaagaccacttatatggaccccacgggaaaaacaagaacatgggagtctgttaaaaggaccacccgcaaggaacagaccgctgatggcgtagccgtaatccccgttctgcagagaacacttcattacgagtgtattgtcctcgtgaaacagttccgtcccccaatgggaggatactgcatcgaattccctgccggtctgattgatgatggcgagacgcctgaggcggcagctttgcgcgaactggaggaggaaactgggtacaaaggggacatagccgaatgttcacccgcagtgtgcatggaccctggtctgagcaattgcacgatccacatcgtcacagttacaattaatggcgatgacgccgagaacgcaagaccaaaacccaaacccggagacggtgagtttgttgaggtgataagtctgcccaaaaatgacctgctgcagcggttggatgccttagtggcagaagaacacttaacagtcgacgccagggtgtactcctacgccctggcgcttaagcatgccaatgctaaaccattcgaagttcctttcttgaaattttag

SEQ ID NO: 58008 - DNA, 717 bp, Artificial Sequence
  Description of Artificial Sequence: Synthetic coding sequence
atgagcaggctaggattgccagaggagcccgtcagaaattccctgttggacgatgcaaaagctcggctccggaaatacgacatcggcggaaagtatagccatttaccctacaacaagtactcagttctgctccccctcgtggcgaaagaaggcaagctgcatctgctcttcacggtcagatcagaaaagctgaggcgcgctcctggcgaagtgtgttttccagggggaaagcgcgaccctactgacatggatgacgccgctacggcgcttagggaagcacaggaggaggtaggactcaggcctcatcaggtggaggtggtttgctgtctggtaccttgtctaatcgataccgatacactcataactcccttcgttggactcatcgatcacaatttccaagcccaaccaaatccagctgaagttaaggacgtgttcttggttccgctcgcttactttctgcacccccaggtgcacgaccagcactacgttacacggctgggccaccgcttcattaaccatatcttcgaatacacgaatccagaagatggcgtgacctaccaaataaaaggcatgaccgccaacctggcggtgctggtggcctttattatactcgagaagaagccaaccttcgaagttcagtttaacctaaatgacgtgttggctagttctgaggagttgttcttgaaagtgcataaaaaagctacaagccgactgtag

SEQ ID NO: 58009 - DNA, 558 bp, Artificial Sequence
  Description of Artificial Sequence: Synthetic coding sequence
atgtcaaggctaggattaccagaggagccggttcgaaactcccttctggacgacgcgaaggcgaggctgcgcaaatacgacattggtggtaaatacagccatcttccttacaataaatatagcgtgctcctgccgttggtagcaaaggaggggaaactgcatctccttttcacagtgaggagcgagaagacggacactctgattactcccttcgtgggactgatagatcacaatttccaggcccagccaaatcccgcagaagtcaaggatgttttcctcgtgcccctggcctatttcctgcaccctcaggtacacgaccagcactatgtgactaggctcggacacagatttatcaaccacatttttgagtacacaaaccccgaggacggagtcacttaccagataaagggcatgaccgctaacctggccgtgctggtggccttcattatactggaaaaaaaacctacattcgaagtgcagtttaatctgaatgacgttctagctagcagcgaagaactgttcctcaaagtccacaagaaagcgacatcccggctgtag

SEQ ID NO: 58010 - DNA, 513 bp, Artificial Sequence
  Description of Artificial Sequence: Synthetic coding sequence
atgtcccggctgggcttgcctgaagaaccagtcagaaactcattactagatgatgcaaaggctcgcctacgcaaatacgatatcgggggtaagtattcacaccttccgtataacaaatatagtgtcctgttgccacttgttgcgaaggagggcaagctccatctgctgttcaccgttcgctccgaaaaactgagacgcgctccaggagaggtatgcttccccggtggcaaacgggacccaacagatatggatgatgctgcaaccgccctgcgcgaagcgcaggaggaggttggcttacgacctcatcaagttgaggtggtatgttgtttggtcccctgcctgatcgaccggtggggttcaaggtatgtggacgaagcaggattggagttgttggctagctccgaccctcctacctcagctagtcagtctgccggaatcactgataggtatattgacaactcaatatgtggtttcaaccggcctcagctacccggacccgctgagtcgtgctag

SEQ ID NO: 58011 - DNA, 822 bp, Artificial Sequence
  Description of Artificial Sequence: Synthetic coding sequence
atgagattgccaggcgtgcccttggccaggcctgcgctcctgctgttactcccactgttagcacccctgctggggactggcgctccagcagaactgagggtgcgggttcgcctgcctgatggtcaggtgactgaagagtcccttcaagccgattccgacgcagactctatatcactggaactgcggaaacctgacggtacgctggtctcctttacagccgatttcaaaaaagatgtgaaggtcttccgagctctgattctgggggaactggagaaaggtcaaagccagttccaagcactttgtttcgtgacacaactccagcacaatgagataatcccaagtgaggcaatggctaaactgcgccaaaaaaaccctagggcggtgcgccaggctgaggaggtgagaggtctcgagcatctccacatggatgtcgccgtcaacttttcccagggtgcccttttgtcacctcacctccacaatgtctgcgccgaggcagtagatgccatctacacccggcaggaggacgtgcggttttggcttgagcagggagtggatagcagcgttttcgaggccctcccaaaggcatcagagcaagcagaactgcctaggtgtcgccaggttggcgaccacgggaagccatgtgtttgtcgatatggcctgagtcttgcatggtacccctgcatgctgaaatactgccactcacgggaccgccctactccatataaatgcggcattaggtcgtgccagaaatcctattcttttgatttttacgtgccccaaaggcagctgtgtctgtgggacgaggacccctaccctggctag

SEQ ID NO: 58012 - DNA, 2205 bp, Artificial Sequence
  Description of Artificial Sequence: Synthetic coding sequence
atgcgacccgcagtgctaggctcccccgatagagccccaccagaagatgaagggccagttatggtgaaactggaagattctgaagaggaaggggaggccgctctgtgggatccgggaccagaggcagcacgcctcagatttagatgtttcaggtacgaggaggcaactggacctcaagaagctcttgctcagctgcgagaactgtgtaggcagtggcttagacccgaggtacgaagtaaagaacagatgctggagctcctggtactggagcaatttcttggcgcattgccacctgagatacaggccagggtgcaaggccaaaggccgggttccccagaggaagcggctgctcttgtcgatggattgagacgcgaaccaggtggcccaaggcgttgggtcaccgtccaggttcaggggcaggaagttttgagtgagaaaatggagccttcttccttccagcctctgcccgagactgaaccacccacccccgagcctggccctaaaactccccctagaactatgcaggaaagccctcttggtctgcaggtgaaagaagaatcagaagttacagaagactcagattttctcgaaagtggtcctttagctgctacccaagaatcggttcctacgctgctgcccgaggaggcccagcggtgcggcacggtcctcgaccagatattcccgcactcaaagacagggccagaagggcctagctggcgcgagcatcctagagccctctggcacgaggaagcaggaggcatattttcaccaggttttgccctgcagttaggcagcatcagcgctggaccaggttccgtttccccccatttgcacgtgccttgggatctaggaatggctggccttagtggccagatccagtccccttcacgcgaggggggttttgctcacgctctcttgttgcccagcgacttgcgatcagaacaggatcctactgacgaggatccctgcagaggcgtgggtccggcattgattaccactaggtggagatccccaagaggcaggtcccgcggtagaccctctaccggtggaggcgtggtgaggggcggtcgctgtgacgtctgtgggaaagtcttttctcagcggtctaacttgttgagacaccagaaaatccatacaggcgaaagaccttttgtgtgttcagagtgcggcaggtcattttctcgatccagccatctgctcagacatcaactgacgcacaccgaagagcgtcccttcgtatgtggtgattgtggtcaggggttcgtacggtccgccaggttagaagaacatcgccgagtacatactggagagcagccctttagatgcgccgagtgtggacagagcttccggcagcgctccaacctcctgcagcaccagaggatacacggcgacccaccaggtccaggtgctaaaccacctgctcccccaggggcacctgaacctcccggaccttttccttgtagcgaatgtagagagagcttcgctcgaagggcagtgctcctcgagcatcaagccgtccacaccggagataagtccttcggatgtgtagagtgcggcgagcgttttggtcgacgctctgtcctcctccaacaccggagagtgcacagcggggagcggccattcgcctgcgctgagtgtggtcagtcatttcgacagcgctcaaatctcactcagcatcggagaattcacactggagagaggccgttcgcctgcgctgaatgcggcaaagcttttaggcagcggccaactttgacgcaacatctcagggtgcacaccggagaaaaaccattcgcctgtcccgagtgtggtcagagattcagtcagaggctcaaactgacacggcaccagagaactcataccggtgagaaaccataccactgcggggaatgtggccttggtttcacacaggtaagtcgattgacagaacatcagcgaatacacactggcgaacgtccattcgcgtgtcctgaatgtggtcaatctttccggcagcacgctaatctcacccaacaccgacgaatccatacaggcgaacgaccgtacgcatgccctgagtgcggtaaggccttccgccagaggcccaccttaactcaacacctgcggacacacaggcgcgagaaaccattcgcctgccaggattgcggtaggaggtttcaccagtcaactaaactgatccagcaccaaagagtgcacagcgcagaatag

SEQ ID NO: 58013 - DNA, 135 bp, Artificial Sequence
  Description of Artificial Sequence: Synthetic coding sequence
atgggcatgtaccctccactgctattaaaaatctatttgtctcggcatatatctatcctgttctacctgaaaattctatataagagtggtatcatctggctgagttggtacagttttatccttcttgtgttatag

SEQ ID NO: 58014 - DNA, 957 bp, Artificial Sequence
  Description of Artificial Sequence: Synthetic coding sequence
atggagagaggagaccaaccaaagagaacccgcaatgaaaacattttcaattgtctctacaaaaaccctgaggccactttcaagctgatatgctttccgtggatggggggaggttccacgcacttcgccaagtggggacaggatacccatgatcttctggaggaaacggcatcacaccatgtggcaaaggctgggctcaaattacgacgctcctccgatcctcccgcatcagcctacccatgtgccggagtgtctcacagacgacgagagccaccatgcctcgccaagattctcgggctgttctggatcctcatcttcttcatgcactccctcagactgcctggaagggaatcacgagttgaggaaccactggagaatgatatttcacagctggttgacgaggtggtctgcgccctacagcctgtcatccaggacaaaccgttcgcgttcttcgggcattccatgggcagttatatcgccttccggacagctctcgggctaaaggaaaacaaccagcctgaaccccttcacctgttcctctcctccgcaactcctgtccattcaaaggcttggcacagaatccctaaagatgacgagctgtccgaggagcagatctcccattacttgatggagtttgggggaacacctaaacactttgccgaagccaaagaattcgtgaaacaatgcagtcccattatccgagccgatctcaatattgttaggtcttgcacatctaacgtgccaagcaaagctgtcctgagttgcgaccttacatgctttgtggggtctgaagatatagcgaaggacatggaggcctggaaggacgtaactagcggcaacgcaaaaatctaccagttgccaggcggacatttctacctgctcgaccccgctaacgaaaagctcatcaagaattacattataaagtgtttggaggtgtcttccatttctaatttctag

SEQ ID NO: 58015 - DNA, 414 bp, Artificial Sequence
  Description of Artificial Sequence: Synthetic coding sequence
atggaaagaggcgaccagcccaagaggaccagacaggccaccccctgtgccactcgcctcttcctgcaccctcgcggtagcgataccctgcccctcaacgagaatattttcaattgtctttataagaatcctgaagcaaccttcaagcttatctgctttccgtggatgggcggtggctccacacattttgcaaaatggggccaggacactcacgacttgttggaagtgcacagtctgcggctgcccggaagggaaagtcgcgtggaggaacctttggagaacgatatctctcagctggtagatgaggttgtgtgtgccctccagccagtgatccaggataagccgtttgccttcttcggtcatcggtatttaatctccgtgttaaaggacttccgcggtgtatcatctatctag

SEQ ID NO: 58016 - DNA, 798 bp, Artificial Sequence
  Description of Artificial Sequence: Synthetic coding sequence
atggagaggggggaccagccgaaaagaacaaggaacgaaaatatatttaactgtctatataagaaccctgaggcaacctttaagctgatctgctttccttggatgggagggggatccactcatttcgccaagtgggggcaggatacacacgatcttttggaggtacattccctgagactgcccggtagggaatcccgggtggaggaacccctcgagaacgatatttcccagttggtggatgaagttgtctgcgctctgcagccagtgatccaggacaagcccttcgcatttttcggacacagcatgggcagctacatcgcgttccgcacggcgctgggccttaaagagaataaccaaccggaacctttgcacctgtttttgtcctctgccactcccgtccattccaaggcttggcaccggattccaaaagacgacgaactttctgaagaacagatttcccattacctgatggaatttggtggaacaccaaaacacttcgcggaagcaaaggaatttgtgaagcagtgttcacctataatccgcgctgatttgaacatcgtcagatcttgcaccagtaatgtgccctcaaaggccgtgttatcctgcgacttgacctgcttcgtaggctcagaggatatagccaaagacatggaggcatggaaagatgtgacaagcggaaacgccaaaatttatcagctgccgggaggacatttctacctgctggaccccgcaaatgagaagctgattaagaattacataatcaaatgtttggaagtgtcttccatttccaacttttag

SEQ ID NO: 58017 - DNA, 291 bp, Artificial Sequence
  Description of Artificial Sequence: Synthetic coding sequence
atggagcgtggtgaccagcctaagaggaccaggaatgaaaacatctttaactgtctgtacaagaatccggaagcaacttttaagctgatttgttttccctggatggggggtggctccacacatttcgccaaatggggtcaggatacacacgacctgcttgaggagactgcgtcgcatcacgtggcgaaagccggtttgaagctgagacgttctagtgatcctccagcttccgcctatccatgtgccggtgtgagccacagaagaagagaaccaccgtgcctcgctaaatag

SEQ ID NO: 58018 - DNA, 432 bp, Artificial Sequence
  Description of Artificial Sequence: Synthetic coding sequence
atggagcggggtgatcaaccaaaacggacacgcaatgaaaacatctttaactgcttgtacaaaaatccagaagcaacattcaaattgatctgttttccttggatgggcggtggcagtacacatttcgctaaatggggacaggacactcacgacctccttgaggtccacagccttaggctacctggcagggaatctcgtgtcgaagaaccactggaaaatgacatctcacagttagtggatgaggtggtgtgcgccctccaaccggtcatccaagataaacccttcgcctttttcgggcattcaatgggttcatatattgcctttcgcaccgctctcggcttgaaggagaataaccagcccgagccactccacctcttcctgtcaagtgcaacccctgtgcactctaaagcatggcaccgcattccgaagtag

SEQ ID NO: 58019 - DNA, 546 bp, Artificial Sequence
  Description of Artificial Sequence: Synthetic coding sequence
atggagcgaggagatcaaccaaaacgtacacggaacgagaacatctttaactgcttatataagaatcctgaggctacattcaagctgatatgttttccgtggatgggaggaggaagtacacacttcgcgaaatggggacaggatacgcacgacctgctggaggtgcactctctgcgcctgcctggcagggaatctcgtgtcgaagaacctctggagaacgacatctcccagctggtcgatgaggttgtttgcgccttgcaaccagtgattcaggataaacccttcgccttttttggacattctatggggagctacattgcgttccgtacggctctgggcctgaaggaaaataatcagcccgagcctctgcatctgtttctgagttccgcaaccccagttcactccaaagcatggcaccgcatccccaaggatgacgagttgtcagaagagcagatctcacactatttgatggagtttggcggaacaccgaagcattttgccgaggctaaagagtttgtcaaacagtgctctccaattatcaggtag

SEQ ID NO: 58020 - DNA, 957 bp, Artificial Sequence
  Description of Artificial Sequence: Synthetic coding sequence
atggccgcagcggcattgcccccacgccctctgctgctgctacccctggtgctgcttctgagcggtagaccgacaagagctgacagcaaggtgttcggcgacctggatcaagttagaatgacatccgaaggaagcgattgcagatgtaaatgcatcatgagaccactctctaaggatgcctgctctcgcgtgcggtcaggcagggcgcgagtcgaggacttctacactgtggagactgtatcttcagggacggactgcagatgcagctgtactgcacctccctcctctctgaatccgtgcgaaaacgagtggaagatggagaagctaaaaaaacaagcacccgagctactaaaatctataaaggcaaacttaagcagggaaaatgaggtggtgaaggatagtgttagacacctgtctgagcagctgcggcactatgaaaaccactctgccatcatgctaggaattaagaaggagctgagcagactgggcttacagctgctccagaaggacgccgctgcagccccagctacaccggctaccggaacgggctctaaggcacaagacaccgctagaggaaaggggaaggacataagtaagtacgggtctgtgcagaaatcattcgctgaccggggtctgcctaaaccaccgaaggagaaactgctccaggtggagaaactacgcaaagaatctggcaagggctcatttttacaacctactgctaaaccacgagctctggcccaacagcaggccgtcatcaggggcttcacgtactataaagcaggcaagcaggaggtcacagaggccgtcgccgacaacaccttacagggcacgtcttggctagaacagctgccacctaaggtggagggccgaagcaattccgccgagcccaactccgccgagcaggacgaagctgagccacgttcttcagaaagagtggacctcgcaagcgggacatag

SEQ ID NO: 58021 - DNA, 987 bp, Artificial Sequence
  Description of Artificial Sequence: Synthetic coding sequence
atgaaactgtggatggaaagccacctcattgtccctgagacccggcctagcccgagaatgatgtccaaccagaccttagttaccgaatttatcctgcagggattttccgaacatcctgagtatagagtatttctcttcagctgcttcctgttcctgtattccggggcactaactggcaatgtgctgattacactcgcgatcacctttaatcctgggctgcatgctccgatgtacttttttctcctcaacctcgccaccatggatattatctgtaccagcagcatcatgcccaaggccctagctagcttagtgagtgaggaaagttccatatcttacggagggtgtatggcccagctgtacttcctgacatgggctgccagttctgaattactgcttctgaccgtcatggcttacgaccgatacgccgcaatctgtcaccccctccattactcctctatgatgagtaaagttttctgcagcggactggccaccgccgtctggctgctctgtgctgttaatacggcaatccacacggggttgatgctcaggctcgacttttgtggcccaaatgttattatccacttcttctgtgaggtaccccctctccttctgctgtcatgctcatcaacctatgttaacggtgtcatgatcgtgttagcagacgcattctacggcattgtcaacttcttgatgactattgctagctatggattcattgtctcttccattctgaaggtgaaaaccgcctggggacgtcagaaggcgtttagcacgtgctcaagccacctgaccgtggtgtgtatgtactacactgcagtattttatgcctacatttctccagttagcggatacagcgcgggaaagtcaaagctggctggcctcctgtacactgtccttagtccaacactcaaccctttaatctacactctgcgcaacaaggaagtgaaagcagccctgcggaaactctttcctttcttccggaattag

SEQ ID NO: 58022 - DNA, 903 bp, Artificial Sequence
  Description of Artificial Sequence: Synthetic coding sequence
atggggcaaaaccaaaccagtatttctgactttctgttactaggcctgcctatccagcccgaacagcagaatctgtgttacgctctttttctcgcaatgtacctgaccaccttgttaggtaatcttttaattattgtcttgattcggctcgactcacacctgcacacccccgtgtacctctttctgtccaacctaagtttctcagacctgtgcttttcatccgttaccatgcccaaattgttgcagaatatgcaaaatcaggatcctagcatcccgtacgctgactgcttaacccagatgtactttttcctatactttagcgatctcgagtcttttcttctggtggcaatggcatatgatcggtacgttgctatctgcttccccatgcattacaccgccatcatgtccccaatgctgtgcctgtccgtcgtggcactctcatgggtcctgaccaccttccacgccatgctccacactctgctgatggccagactctgtttttgcgcggataacgtgattccacactttttctgcgacatgagtgccctgcttaaacttgcctgttcagacactcgcgtaaacgagtgggtaatattcattatgggtggcctgattctggtgatccccttcctcctcatactgggctcctatgcacgcattgtgagctctattctgaaagtgccctcttctaaaggcatttgtaaagctttttctacttgcggcagtcacctaagtgtggtgtcactgttttacggcacagtgatcgggttgtacctctgtcctagcgcgaactcgtccacactgaaagataccgtaatggcgatgatgtacactgtcgtgactccaatgctgacacccttcatatactctctcaggaacagagatatgaaaggagccctgtag

SEQ ID NO: 58023 - DNA, 948 bp, Artificial Sequence
  Description of Artificial Sequence: Synthetic coding sequence
atggagatagtctcaacaggtaacgagacaatcactgagttcgtgctccttgggttttatgacattcccgagttgcacttcctgttcttcattgtgtttacagcagtgtatgtgtttataatcataggcaatatgttaatcattgtagcagtagtctcgagccagaggctccacaaacccatgtacattttccttgccaacctatcctttctggatatcctgtacactagcgccgtgatgcctaagatgttagagggatttctgcaggaggcaacgataagcgtggcagggtgcttgctacagttctttatttttggctcgcttgcaaccgctgagtgtctgctcctggccgtaatggcctacgaccgatacttagccatttgttatcccctgcattatcctcttctaatgggcccacgaagatacatgggtctggtggttaccacctggttaagcggatttgtggtggatggactcgtggtggccctggtgacacagctaagattctgcggacctaaccatatcgatcagttctattgcgatttcatgctattcgtgggtctcgcctgcagcgaccctcgtgtcgcccaggtgacgactctgatcctatcggtgttctgtctcacgatacctttcggactgatcctgacatcctacgcaaggattgttgtcgcagttcttagagtgcccgctggagctagtcggcgtagagcctttagtacatgctccagccacctcgcagttgtgactacattttatggcacgctaatgatattttatgtggccccatcagctgtgcattcacagcttttaagcaaagttttcagccttctctatacagtggtaactcccctttttaaccctgtgatttacactatgcggaacaaggaagtgcatcaggctctcaggaagattctgtgcattaaacagacagaaacccttgactag

SEQ ID NO: 58024 - DNA, 948 bp, Artificial Sequence
  Description of Artificial Sequence: Synthetic coding sequence
atggagatagtatctacagggaacgagaccatcactgagttcgtgctcctgggcttctatgacatccccgagctccattttctgttttttatagtgttcacagccgtgtacgtcttcattataatcggcaacatgttaatcatagtggcagtcgtatcatctcaaaggctgcacaagcccatgtatatatttttggctaacctgagtttcctggacatcctgtatactagcgccgtgatgcccaagatgctggagggattcctacaggaagccaccatatccgtcgcaggatgcctcttacagttctttatctttggctctctggccaccgccgagtgtctactcttggccgtgatggcatatgacagatacctggccatttgctaccctctgcattaccccctacttatgggcccacgtcgctacatgggcctggttgtgaccacatggctatcggggtttgtggtggatgggctagttgtcgctttagtgacccaactcagattctgcggcccaaaccatatcgaccagttttattgcgacttcatgctctttgtaggcctggcctgctctgaccccagagtcgcccaggtgaccaccttaattctgagtgtgttctgcctgaccattccctttgggttaattctcacctcttatgcgaggattgttgtcgccgtgttaagggtaccggctggcgcatcacggaggcgggctttttctacgtgttcatctcatctggcagtggtcacgacattttacggcacactgatgattttttatgtggcccctagcgcagtccactcgcagctgctttctaaagtgttcagcttgctttatactgtggtcactccactgtttaatccagtcatctacaccatgaggaacaaagaggtccatcaagcattgaggaagatcctctgtattaaacaaacagagaccctcgactag

SEQ ID NO: 58025 - DNA, 948 bp, Artificial Sequence
  Description of Artificial Sequence: Synthetic coding sequence
atggagatcgtctcgactggcaatgagaccatcacagagttcgtgctgctgggtttttatgatattcccgaactccattttctgttctttattgtgttcacagccgtttacgtgtttatcatcatcgggaatatgttgattatagtcgccgtggtaagtagtcaacgactccataagccaatgtatatatttctggctaacctatccttcttggacattctttatacctcagcagtcatgcctaaaatgctcgaagggttcctgcaggaggcaacaatctccgtggcaggctgcctgctgcaatttttcatcttcggttctttggctactgctgagtgcttgttattggcggtcatggcgtatgacaggtacctcgctatatgttaccctttacattatccactgctgatggggcctagacgctacatgggactggtggtcaccacctggttgagcgggttcgtggtggacggcttggtggttgccttggtaacccaattgcgattctgcggccctaatcatatcgaccaattctattgtgacttcatgttgtttgtaggattagcctgctctgatccacgggtcgcccaggtgaccactcttatcttgagcgtgttctgcctgacgatccctttcggtctgatcctgacttcatatgcccgaatcgtcgtggccgtcctacgcgtgccagcgggagcctcgcgtaggcgcgcttttagcacgtgctcaagccacctcgctgtggtgacaacattttatggaacccttatgatcttttacgtagcaccatccgccgtccattcacagttgctgagcaaggttttctctctcctgtataccgtggtaacgcccctctttaaccctgttatctacacaatgagaaacaaggaagtgcaccaggcactcaggaaaatcctctgcattaagcaaaccgaaacgctggactag

SEQ ID NO: 58026 - DNA, 924 bp, Artificial Sequence
  Description of Artificial Sequence: Synthetic coding sequence
atgctgaataccaccagcgtgacggagtttctgctgctgggggtcacagacatccaggaactacagccattcctcttcgtagtattcctgaccatctacttcatatctgtaactggtaacggtgcagtcctcatgattgtgataagcgatcctcggctccattcccttatgtactttttcctgggaaacttgtcctatttggatatttgttactctactgtgaccctgccaaagatgctgcaaaacttcctctctacgcataaggctatttcattcctggggtgcattagccaactgcacttcttccactttctagggagtaccgagtctatgctgttcgccgtcatggcattcgatctgtcagtagccatctgcaagcctctgcgctatacggttatcatgaaccctcaactctgcacacagatggccattactatctgggtgatcgggttctttcacgccctactccattccgttatgacaagccgtcttaatttttgtggctcgaatcgaatccaccacttcctctgcgacatcaaacctcttttgaagctggcctgtgggaatactgagctgaaccagtggttactgagtacagtcaccggcacgatcgccatgggtccattttttttgaccctgctcagttatttctacattattacctacttattttttaagaccaggagttgttctatgctatgtaaggcactctctacatgcgccagtcacttcatggtagttattctcttctatgcccctgttctgttcacctacatacaccctgccctggagagctttatggatcaggatcgtatcgtagccattatgtacaccgtggtcactccggtgctgaatcccctcatttacacactccgtaacaaagaggtaaaaggagccttgggcagagtcattcggagattgtag

SEQ ID NO: 58027 - DNA, 924 bp, Artificial Sequence
  Description of Artificial Sequence: Synthetic coding sequence
atgctaaacacaacaagcgttacagagtttctactgctgggggtgaccgacattcaagaacttcagcccttcctattcgttgtgtttctgacaatctacttcataagcgtcacaggcaacggggcagtgctaatgatcgttattagcgaccctcggctccactcccttatgtatttttttctcgggaatctgtcatacctggacatctgttatagcacagttacgctccccaaaatgctgcagaacttccttagcacccataaggccattagctttttagggtgcatttcacagttgcacttcttccacttcttagggtcgactgagtcgatgctgtttgcagttatggctttcgatctgtcggttgctatttgtaagcccctcagatacaccgtgatcatgaacccccaactgtgtacgcagatggccatcaccatatgggtcattggcttttttcatgccctcttgcattctgttatgacttcgaggctgaacttctgtggctccaatcgtatacatcattttctatgcgatatcaagccacttctgaaactcgcctgcggtaataccgaactcaaccaatggctcctgtctactgtgacaggcacaattgcaatgggaccattctttctgacattgttaagctacttttacataataacttatctgttctttaagactcgctcatgctctatgctttgcaaagccttatccacttgtgcctctcattttatggtcgtgatcctgttctacgcccctgtgctgttcacttatatccatccagccctggagagctttatggaccaagatagaatagtggctatcatgtatacagttgtcacaccagtgctgaaccctcttatctacactctacggaacaaggaggtgaagggagcacttggcagagttattcggaggctctag

SEQ ID NO: 58028 - DNA, 924 bp, Artificial Sequence
  Description of Artificial Sequence: Synthetic coding sequence
atgctaaacactacatcagtaaccgaattcttgctcctgggggtaacagacatccaggagttgcaaccttttctgttcgttgtattccttaccatttacttcatttccgttactgggaacggcgctgtactcatgatagtcatctcagatccacgcttgcacagcctgatgtattttttcttagggaacttatcatatctcgacatctgttacagtacggtcacattgccaaagatgcttcagaatttcctgagtacccataaagccatcagtttcctgggatgcatctcccaactccattttttccacttcctggggtcgaccgaatctatgctgttcgcagtgatggcctttgacctgtcagtagcgatatgtaaacccctgaggtatactgttatcatgaaccctcagctgtgtacccagatggcaatcacaatctgggtgatcggtttttttcatgccctgctgcactccgtgatgactagcagattgaacttttgcgggtctaatcgcatccaccacttcctgtgtgatatcaaacccctcctgaagttagcttgcggcaacacagagttgaaccagtggcttctgtcgacagtgaccggaacaatcgccatgggaccattctttttgaccctgctttcttatttctatattatcacctacctgttcttcaagacccggtcctgctccatgctatgtaaggcactttcaacctgcgcaagccacttcatggtggttatcctgttttatgctcccgttctgttcacatacattcatcctgcgttggaatcctttatggaccaggacagaattgtagcaataatgtacaccgtcgtgacacccgttctcaacccactgatttacacgctccgcaacaaggaggtaaagggcgctctcggcagggtgattcgccgtctctag

SEQ ID NO: 58029 - DNA, 951 bp, Artificial Sequence
  Description of Artificial Sequence: Synthetic coding sequence
atggaaaacgtcactaccatgaacgaattcctgctcctgggcctcactggcgttcaagaattacagccctttttctttggcattttcttgattatttacctcattaacttaattggaaatggctctattctcgtcatggtggttctggagcctcagctacatagccctatgtacttctttctgggcaacctgtcatgtctggacatctcctattcgtccgtaaccctgcctaagctgcttgttaatctggtgtgttcacgtagggcaattagctttctggggtgcattatccagttgcatttcttccatttccttggatcaaccgaggcaattttgttagcgattatggcttttgataggttcgtggctatatgtaacccacttagatataccgtcattatgaacccccaggtttgtatacttctggcggctgccgcttggctcatctcattcttctacgccctgatgcactcggtcatgacagcccatctaagcttttgcggaagccagaaactcaaccatttcttttacgatgtaaagccgctgttagaactcgcctgctcagacacccttctgaaccagtggttactttccatcgttacgggcagcatcagtatgggtgcattcttcttaacactgctctcctgtttttacgtgatcgggttccttctgttcaagaatcgaagttgcagaatcctccacaaggctttgtcaacgtgtgcctctcacttcatggttgtctgcctgttttatggcccagtcggatttacctatatcagacctgccagtgcaacttccatgatccaggaccggattatggctattatgtacagcgctgtgacaccggttctaaatccattgatttatactctgaggaataaggaagtgatgatggccctcaaaaagattttcgggcgaaagttatttaaggactggcagcaacaccattag

SEQ ID NO: 58030 - DNA, 951 bp, Artificial Sequence
  Description of Artificial Sequence: Synthetic coding sequence
atggagaatgtcacaactatgaacgagttcctcctactgggcctgacgggtgtgcaagaactgcagccatttttctttggcattttcctgatcatctaccttattaatttaatcggcaatgggtccatccttgtgatggtcgttctggaacctcagcttcatagtcccatgtattttttcctcggaaatctgagctgcctggatattagctattccagcgtgaccttgccaaagttgttagtgaatctcgtatgctctcgcagggccatctcttttctggggtgtattatccagctgcattttttccattttctgggctccaccgaagctatcttacttgcaattatggcgtttgaccgcttcgtggcaatttgcaatcctctgcgatacactgtcataatgaatcctcaggtgtgtatcctattagccgctgctgcctggctgatctcattcttctacgctttaatgcatagtgtgatgactgcccacctgtcgttttgcggcagccaaaagttgaaccacttcttttacgacgtcaagccacttcttgagctggcttgttcagataccctgctgaatcagtggctgctgtcaatcgtaacaggttctatttctatgggagctttttttctgacactgttgagttgcttctatgtgattggtttcctgctgtttaagaatcgcagctgccgtatactccacaaggctttaagcacatgcgctagccacttcatggttgtgtgtctgttctacgggccagtgggattcacttatatccgtcccgcaagcgccacaagcatgatacaagatagaatcatggctataatgtactccgccgttacacctgtgctaaacccgctcatttacaccttgcggaataaggaggttatgatggccctgaaaaagatcttcggtcgaaaactgttcaaggactggcagcaacatcattag

SEQ ID NO: 58031 - DNA, 951 bp, Artificial Sequence
  Description of Artificial Sequence: Synthetic coding sequence
atggagaatgtgaccaccatgaatgaatttttgctgttggggctaaccggcgtgcaggagttgcaacccttcttttttgggatattcctgatcatttacctgatcaatctgattgggaacggatccatcctggttatggtcgtgttagagccacagctccactctccaatgtacttcttcctggggaacctcagttgtctcgacatatcctactcatctgtgacactccccaaactccttgtcaacctggtgtgctctcgcagagccatttcttttctgggttgtatcattcagctccacttttttcactttctcgggtcaaccgaggccatcttgctagctatcatggctttcgacagattcgttgctatctgcaacccactgaggtacaccgtgattatgaatcctcaggtctgcatcttgttagctgcggcagcctggcttatctcatttttctatgcacttatgcacagcgtcatgactgcccatctatcgttttgcgggagtcagaagcttaaccattttttctacgacgtgaaacccctcctcgagctggcctgtagtgatacactgttgaaccaatggctactgtccattgtgactggctctatctctatgggagcctttttcctgaccttactcagctgcttctatgtgattggttttctcctattcaaaaatcgctcttgtcgaatcctgcacaaagccctaagcacatgtgcttcccatttcatggtggtctgccttttctatggacctgtgggcttcacgtacataagacccgcttctgccacctctatgatccaagatcggataatggcaattatgtatagcgccgtgacaccagtgctgaatccattgatttacaccttgagaaataaagaagtgatgatggccttgaaaaaaatcttcgggcgaaagttgttcaaagattggcagcagcatcattag

SEQ ID NO: 58032 - DNA, 951 bp, Artificial Sequence
  Description of Artificial Sequence: Synthetic coding sequence
atggagaacgtgaccacaatgaatgagttcctgttgctgggcctgaccggcgtccaggagctgcagccctttttttttggcatttttctcattatttacctcattaacctgattggtaatggcagtatcctggtaatggtcgtgctggaaccccaactgcattctccaatgtattttttcctcgggaacttatcctgtctggacatcagctatagttcggtcaccctgccaaagctgctagtaaatctcgtttgttcccggagggccatcagcttcctgggctgcattatccagctgcattttttccattttctgggatccaccgaagctattctgcttgctatcatggcttttgataggtttgtggcaatctgtaacccactccgatacaccgtcatcatgaacccacaagtctgcatcctcttggcggcagcagcctggcttatcagttttttttacgctctgatgcactccgtcatgactgctcatctgtccttttgtggtagccaaaagctgaaccactttttctacgacgtcaaacctttgctggagctcgcttgtagcgatactctgcttaatcagtggttgctgtctatcgttaccggcagcatttcgatgggtgccttctttttgacactgctgtcctgtttttatgtgattggcttcttgctcttcaagaaccgctcttgccggatactccacaaagccctcagcacgtgcgcaagccacttcatggtggtctgcctattttacggcccagttggctttacttatattcgccctgcaagtgccacttcaatgatccaggaccggatcatggccatcatgtacagtgccgtaactcctgtgcttaaccctctgatctatacactgcgcaacaaggaggtgatgatggcactaaagaagattttcggacgcaagctatttaaggattggcagcagcatcactag

SEQ ID NO: 58033 - DNA, 936 bp, Artificial Sequence
  Description of Artificial Sequence: Synthetic coding sequence
atggacaacctgaccaaggtgactgagttccttcttatggagtttagcggtatatgggagcttcaggtgctacacgccggtctctttctgctgatctaccttgcagtgttggtaggaaacctgctgataatagccgtgataaccctagaccagcatttacacactcctatgtactttttcctcaagaatctgtcagttctagatctatgttacataagtgtgaccgtccctaagtccatacggaactctttaacacgccgtagctccatttcctatttgggctgcgttgctcaggtgtattttttcagtgcatttgctagcgcagagctggctttccttacagtgatgagttacgatagatatgtcgcaatttgtcaccccctgcagtacagggccgtcatgacgagcgggggatgctaccagatggctgtgacaacttggctaagctgcttttcctacgcagcagtgcacaccgggaacatgtttagagaacacgtgtgtcgcagttccgtgatccatcagttcttccgggacatccctcacgtgcttgctcttgtgtcgtgcgaagtctttttcgtggaatttttgacactcgctttatcttcatgcttggtcttgggatgctttatactcatgatgatctcctattttcagatcttcagcacagtcctcaggatcccatctgggcaatctcgggcaaaagctttcagcacatgctcgccccaactcatagtgatcatgttgtttctcacaaccggattatttgctgcccttgggccaatcgctaaggccttgtctatccaggatctcgtgattgcacttacgtatacagtcctgcccccatttcttaatcctatcatttactctctcaggaataaggagatcaagactgccatgtggcgcttatttgtgaagatatactttctgcaaaagtag

SEQ ID NO: 58034 - DNA, 966 bp, Artificial Sequence
  Description of Artificial Sequence: Synthetic coding sequence
atggtcaatctgacctctacctccgggtttctcctgatgggattttcggacgaacggaagctgcagatactgcacgccttggtgttcctggtaacatacctcttggcgctgacaggaaacctgctgatcattacaattatcacagttgaccggagattacattcacccatgtattatttcttgaagcatctgtctctccttgatctttgcttcatcagcgtaaccgtccctcagtcaatcgccaactctctgatgggtaacggatacatctctctcgtgcagtgcatcctgcaggtttttttctttatcgccttggcgagcagcgaagtagccatcctgaccgtcatgagttatgacaggtacgcggctatctgtcagccattacattacgaaactataatggatcccagggcatgccgccatgctgtgattgctgtctggatagcaggcggtctaagtgggttaatgcatgccgctattaacttttctatccccctgtgcggcaagcgagtaatccatcagttcttttgtgatgtgccgcagatgctcaaattggcatgtagttacgagtttattaacgaaattgcgttagccgcatttactacatcagcagcattcatctgcctgataagcattgtgctgagttacatccggatttttagcacagtgctccgcataccatccgccgaaggcagaacaaaggttttttccacatgcctgccacatctgttcgtggctactttctttctgtccgccgcaggatttgagtttctgagactcccctcagactcttccagcacagtcgatttagtgttcagcgtcttctatactgttatccctcccactttaaaccctgttatatattctcttcgcaacgactctatgaaggctgctctgagaaaaatgttgtccaaagaggaacttccacagagaaagatgtgcctcaaagccatgtttaaactatag

SEQ ID NO: 58035 - DNA, 966 bp, Artificial Sequence
  Description of Artificial Sequence: Synthetic coding sequence
atggtgaacttgaccagtaccagtggattcctcctcatgggctttagcgacgaaagaaagctccagattttgcatgcattggtctttttggtgacctatctcctggccctcaccggcaatttgttaataatcacaattataacggttgatagaagactccacagtccaatgtactatttcctgaaacatctgtctctgctcgatctgtgtttcatatccgtgaccgtgccgcaatctatcgccaattccctcatggggaacggctatatctcactggtgcagtgcattctacaggtctttttcttcattgccctggcttcttctgaggtggccattctgaccgtgatgtcctatgataggtatgcagctatctgtcagcccttgcattatgagaccatcatggacccaagggcctgccggcatgcagtgatcgctgtctggatcgctggagggctgtcaggacttatgcacgcggctatcaattttagcatcccactctgtggtaaaagggttattcaccaatttttttgcgacgtgcctcaaatgctcaagcttgcctgcagctacgagttcattaacgaaattgctctggctgctttcactacttcagctgcgtttatttgtcttatctctatcgtgctgagctacatccggatctttagtacagtgctcaggattcctagcgccgaaggcaggacaaaggtattcagtacgtgcctgccacatctctttgttgcgacattctttttgtcagctgccggtttcgagttcctcagattgccatccgactcgagtagcacagtcgacctggtgttctcagtgttctacacagtgattccaccaacgctaaatcccgtgatttacagcttgcgcaatgatagcatgaaggctgcgcttcgcaaaatgttatcaaaggaggaactgccccaacgaaagatgtgtctgaaggctatgttcaagctgtag

SEQ ID NO: 58036 - DNA, 966 bp, Artificial Sequence
  Description of Artificial Sequence: Synthetic coding sequence
atggttaaccttacctctaccagtgggttcttgcttatgggtttctcggatgagcggaagttgcagattctgcatgctctggtcttcttggtgacgtacctgctcgccctgactggtaaccttctgataattaccatcattaccgtggaccggcgactccattctcctatgtactatttcctgaaacatctgagcctgctcgatttgtgttttatttctgtcaccgtgccacagtccatcgctaactcactgatgggaaacggctacatctccttggtccagtgtatcctacaggtatttttcttcattgccttggcttcctcagaggtagcaattttgacagtgatgtcttacgataggtatgccgctatatgccagccactacattatgagactattatggatcccagagcctgcaggcacgcagtaattgctgtctggatcgcaggtgggctctccggtctgatgcacgctgccatcaatttttcaattcccctctgtggaaaacgcgtgatccatcagtttttttgcgatgtgccgcagatgttaaagctcgcctgctcctatgaattcatcaacgaaattgcccttgctgccttcaccacctccgcagcgtttatctgcctgatctcaattgtgctaagctacatcagaattttcagcactgtgctccgcatcccgtcagccgagggacgtacaaaggtatttagcacctgcctgccacacttgttcgttgcaacatttttcctgtccgccgctggatttgagttcctgcggctaccaagcgactcttcctccaccgttgacctggtgtttagtgtattctatacagtgatccccccaaccctcaaccccgtgatatacagccttcggaacgactcgatgaaggctgccctcagaaaaatgctctcgaaggaggaacttccgcagagaaagatgtgcctcaaagcaatgttcaagttatag

SEQ ID NO: 58037 - DNA, 966 bp, Artificial Sequence
  Description of Artificial Sequence: Synthetic coding sequence
atggttaacctgacgtcgacatccgggttcttacttatgggattctccgatgagcgaaaattacaaatactgcacgcactggtcttcctcgtcacctaccttctcgcactgacgggcaatctgttaattatcactatcataaccgtggatcggcgtctccatagtccaatgtactatttcctgaaacatttatctctgctagacctgtgtttcatctctgtcactgtgccgcagtcaattgcgaacagtctgatggggaatggctacatctcactagtgcaatgcatcctgcaggtctttttttttatagctcttgcttccagcgaagttgctatactcacggttatgtcctatgatagatacgctgctatctgtcaacccctgcactacgaaacaatcatggatccacgagcctgtcgccacgctgtgattgctgtgtggattgcgggagggttgagcggtctcatgcatgccgcaattaatttctccatccctctgtgtggaaagagggttatccaccagttcttctgtgatgtgcctcagatgctgaagttagcctgctcgtacgagttcatcaacgaaatagccttggcggctttcacaacttcagcggctttcatctgcctgattagtatcgtgctgtcatacatccgcatcttctctaccgtgctgcgcattccttcagccgaggggagaacaaaggtgtttagcacatgtctaccccatctgtttgttgcaacattcttcctgtctgcggctgggtttgaattcctcagactgccctctgattcctcatccacagtcgatctggttttttctgtgttctatacagtcatcccacctaccctaaatcccgtgatttactccctgcggaacgacagcatgaaggctgccctacgtaagatgctgagtaaggaagaactgccacaacggaaaatgtgtctcaaggccatgtttaaactgtag

SEQ ID NO: 58038 - DNA, 939 bp, Artificial Sequence
  Description of Artificial Sequence: Synthetic coding sequence
atggttaatcagagctctacaccaggcttcttgctgctgggattcagcgaacatcccggactcgaaagaacactgttcgttgtcgtttttacgtcgtatctgttgaccctggtgggaaacacactcatcattctactgtctgtactggaccccaagctccacagtccaatgtacttctttctgagtaacctgtcttttctggatctctgctttaccacaagctgtgtaccccagatgctcgtcaatctgtggggtcctaagaaaacaatcagcttcctggactgttccgtgcagatatttattttcctttccctgggaacaaccgaatgtatcttgctgacagttatggcttttgatcgctacgtggccgtgtgtcagcccctgcattacgctactatcatccatccccgactgtgttggcagttggccagtgtggcatgggtcatcgggctggttgaaagtgttgtccaaactccctctactttgcatctgcctttctgtcccgacaggcaggtggatgatttcgtgtgcgaggtgccggcactgatccggctttcttgtgaggacaccagctacaacgagatccaggtcgctgttgccagcgttttcatacttgtggtgccactgagtctgattctggttagctacggcgctattacatgggccgtactaagaataaacagcgcgaaaggtcgcagaaaagctttcggtacctgctcatcgcatttgaccgtcgtgacactattttatagttcggttattgccgtctatctccagcccaagaacccttatgcccaagagcgcggaaagttttttggactcttttatgccgttggcactccaagcctgaacccactcatctataccctcaggaataaggaggtcacgagagcctttcgacggctcctcggcaaggaaatgggcctgacccagagctag

SEQ ID NO: 58039 - DNA, 939 bp, Artificial Sequence
  Description of Artificial Sequence: Synthetic coding sequence
atggtgaaccagtcgtcaacaccgggattcctacttctgggattttccgaacatccagggctagaacgcactctattcgtggtggtctttaccagttaccttctgacactcgttgggaataccttgattattttgctatctgcactggatccaaagctgcatagcccgatgtacttttttttatccaacctgtcgtttctggatctctgtttcacaacctcttgcgtgccccaaatgttagtcaacctgtggggcccaaagaagacaatatccttcctggattgctctgtgcaaatcttcatcttcctgtcattgggaaccacagaatgtattcttcttaccgttatggctttcgaccgctatgtggccgtgtgccagcccttgcactacgctactataattcaccccagactatgctggcaattagccagcgtggcttgggttatcggcctagttgaatccgttgtacagaccccatcaactttgcatctgcccttctgccccgaccgacaggtggatgatttcgtatgcgaggtgccagcactgatccggctgagttgtgaagacactagttacaatgagatccaagtcgctgtggcctcagtgtttatcctcgtcgtgcccctgtcactaatcttagtcagttacggcgcaataacatgggctgtcctacggatcaatagcgccaagggtcgcagaaaagcattcggcacctgtagcagccaccttaccgtggttacccttttttatagtagtgtgatagcagtgtacctgcagcctaagaatccatacgctcaagaaagagggaaattcttcggcctcttctatgccgtcggcaccccaagcctaaaccctctgatttatacattgagaaataaagaggttactcgggcatttcggcgtctcctcggcaaggaaatgggcctaactcaaagttag

SEQ ID NO: 58040 - DNA, 939 bp, Artificial Sequence
  Description of Artificial Sequence: Synthetic coding sequence
atggtaaaccagtcaagtacccctggcttcctcctacttggcttctccgagcacccaggcttggagcggactctgtttgtagtggtgttcacaagttaccttttgaccctcgtgggaaacacacttattatactcctgagcgttttggaccctaagctgcactcgcctatgtatttctttctgagtaatctttccttcctcgacttatgtttcacaacttcttgcgtgccacaaatgctggttaacctttggggtccaaagaagacgatatcttttctagattgcagtgttcagatatttatctttctaagtcttggtacaaccgaatgcattctgctcactgtaatggcttttgaccgctatgtcgctgtctgtcagcccttgcactacgcaacaatcattcacccacgactgtgttggcagttggcctctgtcgcctgggtgatcggcctggttgagtcagtggtgcagactccttccaccttgcacctcccgttctgtcctgataggcaagttgatgatttcgtgtgtgaagtgcctgctctcatcaggctgagctgcgaggacacatcctataatgagatccaggtggctgtagcctctgtgttcatactggtggtgcctctctctctcatcctggtgtcctatggtgctatcacttgggctgtgctgaggatcaattctgctaagggtagaagaaaggcgttcgggacatgctcttcccatctgacagttgttacgctgttttattctagcgtgattgctgtctacttacagcctaagaacccatacgcccaggaaagaggaaagttcttcggtctcttttatgccgtcggcactccaagtctcaatccgctgatctatactttgcgtaataaagaggtcacaagagcctttcggcgtcttcttggcaaggaaatgggactcactcagagttag

SEQ ID NO: 58041 - DNA, 939 bp, Artificial Sequence
  Description of Artificial Sequence: Synthetic coding sequence
atggtgaaccagagtagcacgcctggcttcctgttattaggcttttctgaacaccccggattggagcgtactttattcgttgtggtgtttacctcctatctgttaactctggttggcaatacactcataatacttctgagcgtgctagacccaaagctgcactcacccatgtacttttttctttccaacctgtcctttctggatctgtgtttcaccacttcctgcgtgccgcagatgttggtaaacctgtgggggccaaaaaagaccatctcatttcttgattgttctgtgcaaatcttcatcttcctctcactcggaaccaccgaatgtatcctactgactgtaatggcttttgaccggtacgtggcagtgtgccagccactgcactacgccaccatcatccacccccgtctgtgttggcagctggcttccgttgcctgggttataggcctggtcgagtcagtcgttcagacccccagtactctgcacctcccattctgccctgatcgacaggtggatgacttcgtgtgtgaggtccctgccttgattcgcctctcctgcgaggacacctcatataatgagatccaggtcgctgttgcctcagtctttatcttagtggttccactaagcttgatcttggtgtcttacggtgccattacatgggctgtgctgaggatcaattctgccaaaggaaggagaaaagcgttcggtacctgtagtagtcacctcaccgtagtaacacttttctactctagcgttattgccgtgtacttgcagcctaagaatccctacgcccaggaacgtggaaagttcttcggactcttttatgctgttggaacaccaagtctcaaccctctgatctacacactgaggaacaaagaggtgactcgcgcttttcgtcgtttgcttggaaaagagatggggctcacccagagctag

SEQ ID NO: 58042 - DNA, 939 bp, Artificial Sequence
  Description of Artificial Sequence: Synthetic coding sequence
atgctgatgaaaaagaatgcttcattcgaagacttcttcatcctcctcggattctccaactggccacatctggaagtcgtcctattcgtggtgattctgattttctatttgataacccttattggcaatctgttcatcatcattctttcatatctagattcccacctgcacacgcctatgtatttcttcctctccaacctgtcttttctggacctctgctatactacttcctctatccctcagctccttgtgaacttgtggggtcccgaaaagacaattagttatgcagggtgcaccgtacagctgtattttgtgctcgctctggggaccgcagagtgtgtcttgcttgtggtgatgtcatatgataggtacgccgcagtgtgccggcctctgcattacacagtccttatgcaccctaggttttgccggttgttagcggctgcctcgtgggtttccgggtttaccacatctgctcttcacagcagctttactttttggataccgctctgccgacaccgcttggtggaccacttcttctgtgaggtgccggcactgttacgcttgagctgtgttgacactcaggcaaatgaattgaccttgatggtaatgtcctctatcttcgttcttatccccctgatactgatcttgacctcttacggcgcaattgccagggctgtgcttagtatgcagagcaccaccggccttcagaaggtgctgcggacgtgtggcgctcatttaatggtcgtgtctctatttttcattccggtaatgtgcatgtacttacagcccccatccgagaactcccaggaccaggggaaatttattgctctgttttacacagtggttacgccgagcctaaaccccctcatctacacattcagaaacaaggacgtgcggggagcagtaaagagactgatgggctgggaatggggaatgtag

SEQ ID NO: 58043 - DNA, 939 bp, Artificial Sequence
  Description of Artificial Sequence: Synthetic coding sequence
atgatgattaagaagaatgcgtcctcagaagacttttttatattgctgggcttctccaattggcctcaactggaggttgttctgttcgttgtaatcctaatcttctacctgatgacgcttactggcaacctgtttatcatcatcttgtcttatgtagactcacatctgcatactcctatgtattttttcttatccaatttgagcttcctggatctctgctataccacaagttctattccgcagctgttggtaaaccttcgcggaccggagaaaacaataagctacgctggctgtatggttcaactgtattttgttctggcactgggcatagcagaatgtgttctgctggtggtcatgagctacgacagatacgtcgccgtctgccggcctctccactacaccgtgctgatgcacccgaggttctgccatctgcttgttgctgccagctgggtgatcggctttacaatcagcgccctccatagtagctttactttctgggtcccgctatgtggacaccggctggtggatcatttcttctgtgaggtgccggctctgttgaggctgagttgcgtggatacacacgctaatgaactcactctgatggtgatgagtagtatcttcgtgctaataccgctgatcttaatcctgactacctacggcgctatcgcaagggctgttctgagcatgcagagtacaaccggtctccagaaagtgttccgcacatgcggcgcacaccttatggtggttagcttattctttattccagtcatgtgcatgtaccttcagcctccaagcgagaattcgcccgatcaggggaagtttattgccttattctataccgtggttacaccttctttgaatccacttatctataccttaaggaataaacatgtgaagggagctgctaaaaggctactgggctgggaatggggaaaatag

SEQ ID NO: 58044 - DNA, 939 bp, Artificial Sequence
  Description of Artificial Sequence: Synthetic coding sequence
atgatgattaagaaaaatgcctcgtcagaagacttttttattctcctggggttcagcaactggcctcaactggaggtcgtgctttttgtagtgatcctcatcttctacctcatgaccctgacggggaatctgtttatcataatattgagttatgtcgactcacatctgcacacacccatgtacttcttcctgtcaaacctgagtttcctggacctctgctatacaacgagtagcatccctcaactcctagtgaacttacgcggaccggagaaaacaataagctatgcaggctgtatggtccagctgtacttcgttcttgctctaggtatcaccgagtgcgtgttgttggtcgttatgtcctacgacagatacgttgcagtgtgtagaccccttcactacaccgtgcttatgcaccctcgtttttgccatctgctcgtcgctgcatcttgggtaattggtttcaccatcagtgcgctccatagcagcttcactttttgggttccgctgtgtggccatcggttggtcgatcattttttctgcgaggtccctgcactgcttcgactgtcttgtgtggacactcacgcaaacgagctcacactcatggtgatgtcctctatttttgtcctcataccactgatcctgattctcaccacctacggtgctatagccagagctgttttgtctatgcagtcaactactgggttacagaaagtgtttcgtacttgtggcgctcacctgatggtggtgagtctattctttatcccagtgatgtgtatgtacctgcagccacctagtgagaacagcccagaccaggggaagttcatcgcgctcttttacactgtagttaccccctccctgaatccacttatctacaccctcagaaacaagcacgtcaagggtgcagccaagcgactgcttggctgggaatggggaaagtag

SEQ ID NO: 58045 - DNA, 939 bp, Artificial Sequence
  Description of Artificial Sequence: Synthetic coding sequence
atgatgattaagaaaaacgcatccagtgaagacttcttcatcctcctcggattctccaactggccacaattagaagtggtgctctttgtggtgatactgatcttctacctgatgaccttgactgggaatctcttcattatcatcctgtcttacgtcgacagccacctccacacaccaatgtacttctttctgtctaacttaagttttttagacctctgctacaccacctcctctattcctcagcttcttgtcaatttgcgcggaccagaaaaaaccatcagttacgctggatgcatggtgcagttatatttcgtcttggctctgggaatcgcagagtgtgtcctattggtcgtgatgtcctatgatcgctatgtagctgtgtgtcggcctctacactacactgtgcttatgcaccctagattttgccacctgttggtcgccgcttcctgggttattgggtttacgatctccgccctgcacagctcgttcaccttttgggtgcctttgtgcgggcacagactagtggatcatttcttttgcgaagttcctgccctgttgagattatcttgcgtggacacccatgcaaatgagttaacgctgatggtgatgagctcaatcttcgttctcatacccctcatcctgattttaacaacttacggcgcaatcgcaagggccgtcctcagcatgcagagtaccactggccttcagaaagtattcaggacctgtggagctcacttaatggtggtcagtctgttctttatccccgtcatgtgcatgtacctgcagcctcctagtgagaactcccccgatcagggtaaatttattgccttgttctacaccgttgtgactccttcgctgaaccctctcatttacacattaaggaataaacacgtgaagggggctgcgaaaaggctgctcggatgggagtgggggaagtag

SEQ ID NO: 58046 - DNA, 936 bp, Artificial Sequence
  Description of Artificial Sequence: Synthetic coding sequence
atgaacgacgacgggaaggtcaacgcctcctcagagggttactttattctggtcgggttttctaattggcctcatctggaagtcgtgatatttgtggtcgtgctaattttttaccttatgaccctgattggcaatttattcattatcatcttgagctaccttgactcacacctccatacacctatgtacttcttccttagcaacctatctttcctggatctttgctatacgacctcgtccatcccccagctgctggtaaatctttggggccctgaaaagactatttcttatgccggatgtatgattcagctctactttgtgctagccttgggcaccaccgagtgcgttcttctggtcgtgatgtcgtacgatagatatgcagcagtgtgtagaccccttcattataccgtgctgatgcacccccgattttgccatcttctggccgtggcgagttgggtgtccggctttactaatagcgcccttcactcatcatttactttttgggtgccgttgtgcggccacagacaggtcgatcacttcttttgcgaggttcctgcactgcttcgtctctcctgcgtggacacacatgtgaatgagctgaccttgatgataaccagctcgatctttgtgctgatcccgttgatattgatcttaacaagttacggggctattgtacgcgcaattttacgaatgcaaagtacaaccggtctacagaaggtgttcggaacctgtggagctcaccttatggccgtcagcctgttctttatccctgcaatgtgtatgtatctgcaacccccatcagggaacagccaggatcaaggtaagtttatcgccctgttctacaccgtggtaactcctagcttgaatcccctgatttataccctccgaaacaaggttgtgagaggggctgtaaaacgcttgatgggctgggagtag

SEQ ID NO: 58047 - DNA, 939 bp, Artificial Sequence
  Description of Artificial Sequence: Synthetic coding sequence
atggaaaatggcagttacacttcttacttcatcctgctaggcttgtttaaccacacgcgagctcaccaggtgctgtttatgatggttctgtccatcgtgctgacgtcactgtttggtaattcacttatgattctgttgattcattgggaccacaggctccacacgccaatgtatttcctactcagccagctatctcttatggatgttatgctcgtgagcacgaccgtgccaaaaatggcagccgactatctgacaggctcaaaggctattagtcgagctggctgcggagcccaaattttttttctgcctacgctgggaggcggtgagtgtttcctcctggctgcaatggcctatgatcggtatgcagccgtgtgtcatcccttaaggtatcctacacttatgtcctggcagctgtgcttgcgtatgaatctgagctgctggcttctcggcgctgccgatgggctgctccaggccgtcgcaacactgtcctttccatattgcggcgctcacgagattgaccatttcttttgcgaaactcccgtgttagtgaggcttgcgtgcgctgacacaagtgtgtttgagaatgccatgtacatttgctgcgttttgatgctgctggtgcccttctccctgattttgtcctcctacggcctgatcctggccgcagtcctccacatgcgttctacagaagctcggaagaaagccttcgcaacgtgctcatcccacgtggccgttgttggcctattttacggcgcagctatctttacctatatgaggccaaagtcccatagaagtactaaccatgacaaggtagtcagtgcattctacaccatgttcaccccgctcctgaatcctcttatctactctgttaaaaattcagaagtcaagggggctcttaccagatgcatgggccgttgcgtagctctttcccgggaatag

SEQ ID NO: 58048 - DNA, 930 bp, Artificial Sequence
  Description of Artificial Sequence: Synthetic coding sequence
atggagaattctaccgaggtaacagagtttattcttctggggctcactgatgatcccaacctccaaatccctctcctgttagcctttcttttcatataccttatcacgttactaggcaacggaggaatgatggtgatcattcacagcgactcacatctacacacaccaatgtacttctttctctccaatctcagcttggtcgatctgggctattcatcagcagtggctccaaaaaccgtcgctgccctgaggagtggggacaaggctatatcttacgacggctgtgccgcacagtttttcttctttgtagggttcgctaccgtggagtgctacctgttagctagcatggcctatgacaggcatgccgctgtgtgtcggccactgcactacacaacgaccatgaccgcgggagtgtgtgctttgctagcaactggtagctacgtgagcggctttctaaacgcctccatccacgccgcagggaccttccggcttagcttctgtgggtcaaatgaaatcaatcattttttctgcgacatccccccactgttagccctcagttgttccgacacacgcatttctaagctggtggtttttgttgctggtttcaacgtattcttcacactcctggtcattcttatcagttatttcttcatttgcataaccatacagcgaatgcatagtgctgaagggcaaaagaaggtgttttccacctgcgccagccatttgacggcgctcagcattttttacggaacaatcatcttcatgtatttgcaacctaacagttcccagtctgtggatactgacaaaatagctagcgtgttttacaccgtggttataccaatgcttaatccactgatctattcacttcgtaacaaggaggtgaaaagcgctctgtggaagatcctgaataagctttacccgcagtattag

SEQ ID NO: 58049 - DNA, 942 bp, Artificial Sequence
  Description of Artificial Sequence: Synthetic coding sequence
atggaggaagaaaatgctaccctgctcaccgaattcgtcctcactggcttcctctaccagccacagtggaaaattcccttgttcttagcttttttggtgatctacctgatcactataatggggaatcttgggttaattgccgtcatctggaaggatccccacctgcacatacccatgtatctactgcttggaaatctagcctttgtcgacgcctggatttccagtaccgttaccccgaaaatgctgaataacttcctggccaagagcaagatgattagcctcagcgagtgcaagattcagttctttagcttcgcaatctcagtgacaacggagtgtttcctactggccaccatggcctatgacaggtatgtagccatatgtaagccattactttatcccgcaatcatgacaaatggcttgtgtattcgtcttttgattttgagctacgtcgggggaatcttgcacgctcttattcacgagggtttcctctttaggctcaccttctgcaacagtaacattgtgcaccacatatactgtgataccattccattaagcaagattagttgcactgactcctctatcaacttccttatggtgtttatcttcagcgggagcatccaggtattttctattgtaacaatcctagtctcttacacttttgtgctgttcgcaattctcaagaaaaagtccgacaagggtgtccgtaaagcgttcagcacttgcggcgcacatctgttcagcgtcagtttatactatggccctctcttgttcatttacgtaggcccagcctcacctcaggctgatgaccaagatatggtagaaccccttttttacacagtaatcatccccttgctcaaccccataatatacagtcttcgcaacaaacaagtgacagtcagcttcactaagatgcttaagaagcatgtaaaagtttcttactag

SEQ ID NO: 58050 - DNA, 942 bp, Artificial Sequence
  Description of Artificial Sequence: Synthetic coding sequence
atggaggaagagaacgccactctgctaaccgagtttgtgctcaccggattcctataccagccccagtggaaaataccgctgtttctggcctttcttgtgatctatctgattacaatcatgggaaatctgggactcatcgccgtcatatggaaggaccctcacttgcacattcctatgtacctgctgttggggaatttagcctttgtggacgcgtggattagttcaactgtgactcccaagatgctgaataatttccttgccaagtccaagatgatctctctctcggagtgcaaaatccagtttttctctattgcaattggggtcactacagagtgttttctcttagccactatggcctacgacaggtacgtcgccatttgcaagcccctgctgtatcctgcaattatgaccaacggcttatgcattcgcttactcattctatcgtacatcgcagggatactgcacgctcttatacacgagggatttctgttccgattgactttttgtaactccaacattgtgcaccatatctactgcgatacgataccactcagcaagatctcatgcacagatagttcaatcaatttcctcatggtgttcattttcagtggttctatccaggtgttctccatagtgacaatactgatctcttatacgtttgtgctctttactgtgctggagaagaagagtgacaagggtgtgcgcaaggctttttccacctgtggcgcacatctgttctcagtctgtctgtactatggccctctactcctgatgtacgttgggccagcctccccccaggccgacggacagaatatggtagagccattgttctacaccgtcatcattcccttattaaacccaattatctactctttacggaacaagcaggttattgtatcattcatcaagatgctcaaaaggaatgttaaggtctcatactag

SEQ ID NO: 58051 - DNA, 933 bp, Artificial Sequence
  Description of Artificial Sequence: Synthetic coding sequence
atggaggaggaaaacgccactctcctcactgagtttgtactcacgggattcttgtaccagccccagtggaagataccactgtttcttgcctttctcgtgatttacttgatcacaataatggggaatctagggctgattgccgtcatctggaaggaccctcacttacacattcccatgtatctgctcttgggaaatttagcattcgtcgacgcctggataagcagtaccgtcactcccaagatgctcaacaattttttggcaaagtctaaaatgatatccctgtcggaatgcaagattcagttcttctctatcgccatcggagttaccacggaatgcttcttgctggccactatggcctacgacaggtacgtcgcaatctgcaaaccattactatatccggcaataatgactaacgggctgtgcatcagattactgatcctctcctacatcgccggaattctgcacgctcttatccatgaggggttcctttttcgtctcaccttctgtaactcaaacatagttcaccacatatattgtgatacaattcctttaagcaagatctcttgcaccgattcttcaatcaatttcctcatggtgttcattttcagtggcagcatacaggtgttctcaatcgtgacaatcctgatctcttatacctttgtcctgttcactgttctcgagaaaaaaagcgacaaaggtgttagaaaagctttctctacctgcggggcacacttgttctccgtatgtctatactatggccctctcttgctgatgtatgtgggccctgcatctcctcaagctgacgggcagaacatggtggaaccgttgttctatactgtcattataccactcctcaaccccatcatctattccttgaggaataaacaggttatcgtcagtttcattaaaatgctgaagaggaacgggatatag

SEQ ID NO: 58052 - DNA, 966 bp, Artificial Sequence
  Description of Artificial Sequence: Synthetic coding sequence
atgaataaggagaatcattcgctgattgctgagtttatactgaccggctttacctaccacccaaagttaaaaactgtcctcttcgtagtgtttttcgccatctacctgattaccatggtgggcaacattggattggtggctttaatctatattgagcagcggttgcacacacctatgtacatcttccttggtaacttagtgctgatggactcatgttgcagcagtgccatcacaccaaagatgcttgagaacttcttttcagaggacaagcgtattaccctgtacgagtgcatggcccagttttattttttgtgcttagccgagactaccgattgcttcctcttagccgcaatggcctatgattgttacgtcgccatctgcaacccccttcaataccataccatgatgagtaaaaccctgtgtatccaaatgacggccggagcttacttagccggtaacctgcatcctatgatagaggttgaattcctattgaggctcacgttttgtggcagccaccagatcaaccattttttctgtgacgtgttgccactgtacagactttcctgtatcaatccttacatcaatgaactggtcctgttcatcttggctgggtcgattcagatctttactatcgttctggtgtcctacttttatattctatttacaattttcaccatgaaatccaaagaaggtagaggtaaggctctgtccacatgtgctagccattttttgtccgtaagcatcttctgtgactcccttctgttcatgtacgctcggcctggcgctgttaatgagggggacaaggacatacccgtcgcgatcttctataccctggtgattcccctgctcaaccctttcatatatagcctgaggaataaagaagtgattaatatcatgaaaaagatcatgaagaagagaaagttctgtcatatcctcaagcagatgtcttcaccattggccacctag

SEQ ID NO: 58053 - DNA, 966 bp, Artificial Sequence
  Description of Artificial Sequence: Synthetic coding sequence
atggttaacctcactagtatgagtggttttctgttgatgggtttcagtgacgagagaaagctgcagattctccacgcgctggtgtttttggtgacctacctcttggctctgaccggaaacttgctgattatcactatcataactgtagaccgcaggctgcatagtccgatgtactattttcttaaacacctgagtctgctcgacttatgcttcattagcgttaccgttccccagtcgatcgccaactctctcatggggaacggttatatctctctggtgcagtgcattctgcaggtattctttttcatcgccttagccagttctgaagtggctattcttactgtgatgtcctatgaccgctacgcagccatctgccagcccctacactatgagacgattatggacccacgggcatgccgacacgccgtaattgccgtctggatcgccggagggctgtcaggtctgatgcacgccgctatcaacttttctatccccctttgtgggaagcgtgtcatccaccagtttttttgtgatgttcctcagatgctgaagctggcgtgttcttatgaattcatcaacgagatcgccctggccgcttttacaacatccgctgcatttatttgcctaatctctattgtgctgtcttacattaggatcttttcaaccgtactgaggatccccagcgccgaaggccgaactaaggttttttcaacatgtctgcctcatctcttcgtcgctactttctttctgtcggctgctgggttcgagttcctcaggttgccaagcgactcatctagcactgtggatctagtctttagtgtgttttatactgtgattcccccaaccctcaaccccgtgatctatagtctgagaaacgattcaatgaaagcagccctccgcaagatgctcagtaaggaagagctccctcaaagaaagatgtgcctcaaggcaatgttcaagttgtag

SEQ ID NO: 58054 - DNA, 966 bp, Artificial Sequence
  Description of Artificial Sequence: Synthetic coding sequence
atggaacgaaaaaatcaaactgccataactgagtttattatactcggcttctcaaacctgaacgagtggcagtttctcctgtttacaattttctttctgacatacttttgtaccctgggcggaaatattctgattatacttactactgttaccgatccacacctacacacccctatgtattactttctaggtaacctcgcattcattgatatttgctatactacctcgaatgttccacagatgatggttcacctgttgtccaaaaagaaatccattagttatgtaggatgcgttgtgcagctgttcgcttttgtgtttttcgttggatcagaatgtctgctgcttgctgccatggcctatgaccgctatatcgccatatgtaatcccctgagatacagcgtgattctgtccaaggtactgtgcaatcaactggccgctagttgctgggccgctgggtttcttaactctgtcgtgcacaccgtcctgacgttctgtcttcccttttgcggtaacaatcaaataaattattttttctgcgacattcccccactccttatcctcagctgcggcaacactagcgtgaacgaactggcccttctgtctacaggtgttttcattggatggacgccttttctctgcatcgtgctgagctacatctgtattatatcaactattttgcggatacagagttccgaagggagaaggaaggctttctccacctgcgcttcgcatctggcgatcgtatttctcttctacggttccgccattttcacatacgtgcggcctatcagcacatatagcctgaaaaaggatcggcttgtctccgtcctatatagcgtcgtgacacccatgctaaacccgatcatttacacactaaggaacaaagatatcaaagaggccgtgaagaccattggcagtaagtggcagccaccaatttctagtctggactccaaactgacgtactag

SEQ ID NO: 58055 - DNA, 966 bp, Artificial Sequence
  Description of Artificial Sequence: Synthetic coding sequence
atggaacggaagaaccagactgccatcacggaatttatcatattgggatttagcaacttgaatgaactccagtttctgctcttcacaatcttctttctcacctacttctgcacactgggaggcaacatattgatgatcctgacaacagtcaccgatccgcacttgcatacacccatgtactactttctgggcaacctggcctttatcgacatctgttacacaaccagcaacgtcccccaaatgatggtacatcttctgtccaaaaagaagagcattagctacgttggatgcgtcgtacagctgtttgcctttgtcttcttcgtagggtccgagtgcttattgcttgccgctatggcatacgaccggtatattgccatctgtaatccgcttaggtactccgtgattctttcaaaagtgctctgcaatcaactcgccgcttcttgctgggctgccggtttcctgaattccgtggttcacactgtattgaccttttgcctgccgttctgtggcaacaatcagatcaactatttcttttgtgatatcccaccgcttcttattctgtcttgcgggaatacgtctgtcaacgagttggctctgctgagcacaggcgtctttatcgggtggactccttttttgtgtatagtactgagctacatctgcatcatttcaactattctgcggattcagtcctctgaagggcgtcggaaggcttttagcacgtgtgctagccatctcgccattgtgttcttgttttatgggagcgcaatatttacctacgttaggcccatttccacctactccctgaagaaggatagactggtctcagtgttatactctgtggtgacccccatgctgaatcccattatctacaccttgcggaataaagacataaaggaagctgtcaagaccatagggtctaagtggcagccacccatctcatcgctggactctaaattgacgtattag

SEQ ID NO: 58056 - DNA, 966 bp, Artificial Sequence
  Description of Artificial Sequence: Synthetic coding sequence
atggaaagaaagaatcagacggccattaccgagttcataattctggggtttagtaacctgaacgagttgcagtttctgctcttcactattttttttctgacctacttctgcacgctgggaggcaatatactgatgatcctgacaaccgtaacagaccctcatctccacacaccaatgtactactttctcgggaacctggctttcattgatatatgctataccacttctaacgttcctcagatgatggtccacctcctctctaaaaaaaaaagcatctcatatgttggatgcgtagtccagctgttcgcctttgttttctttgtcggttccgaatgcctgctattggcggctatggcatacgatcgttatatcgctatttgtaacccgctccgctactcagttatcttaagcaaggtcctctgtaaccagttggccgcatcttgttgggccgcaggattcctcaattcagtggtccacactgtcctgacgttctgtctccctttctgcgggaacaatcagattaattattttttctgtgacattccaccacttctgattctgagttgtggcaatacgagtgttaacgagttagccctcctcagcacaggagtgttcattggctggactccttttttatgtatagtactctcatatatttgcataatcagcactatcctcaggatccaatcttcggagggtcgcaggaaggccttctcaacgtgcgcgtctcacctggcaatcgtgtttctgttctacggcagcgcaatttttacctacgtgcgtcctatctctacttactctctgaaaaaggatagattggtttcagtcctctactcagtggtaaccccaatgctaaaccctatcatttacacgttgcggaataaggacattaaagaggctgttaaaaccatcggttctaagtggcaacctcccatatctagccttgacagtaagttgacctattag

SEQ ID NO: 58057 - DNA, 966 bp, Artificial Sequence
  Description of Artificial Sequence: Synthetic coding sequence
atggagaggaaaaaccagactgcaattactgagttcattatcctggggttcagcaatcttaacgagcttcaattcctcctatttacaatcttctttctgacctatttttgtacacttggaggaaatattctgatgatactcacgaccgtcaccgaccctcacttacacactccaatgtactattttctaggtaatctggccttcatcgatatctgttacaccacctccaacgtaccacagatgatggtgcaccttctctctaaaaaaaagagcatcagctacgtggggtgtgttgttcagctgtttgcctttgtcttcttcgtgggctcagagtgtttactgttggccgctatggcatatgatcgttatattgcaatttgtaatccacttagatattcagtgatactctcaaaagttctttgcaaccagctggccgcatcatgctgggcagccggtttcttaaactcagtggtgcacaccgtcctcaccttttgcctgccgttttgtgggaataatcaaattaattactttttttgcgatatccctcctctgttgatactctcatgcggcaatacctcagttaatgagctggccctgttgagcaccggagtcttcatcggttggacccctttcctttgcatagtgctgtcatatatctgcatcatctctactatcttgaggatacagtcaagcgagggacgtaggaaggcattctctacctgtgcctctcatcttgctatcgtgttcctgttctatggatctgccattttcacatacgtacgcccaatctcgacctactcactgaaaaaagacagattggtgtctgttctctattctgtggtgacacccatgttgaatcctattatttatacattacgaaacaaagacatcaaagaggcggtcaagaccatcggctccaaatggcagccacctattagttctcttgactcgaagctcacctactag

SEQ ID NO: 58058 - DNA, 939 bp, Artificial Sequence
  Description of Artificial Sequence: Synthetic coding sequence
atggagattctgtccaactccacatccaagttcccaacatttctgctgacagggataccaggcctggagtcggcccacgtatggattagtattcccttttgttgcttctatgctatcgcgctgtcggggaatagcgtcatcctgttcgtcatcatcacccagcagtccttgcatgaaccgatgtactactttctgtttagattgtctgcgacagatttaggactgactgtgagctccctaagcactactctgggaatactgtggttcgaagcacgtgaaatcagcctttatagttgcatcgtacaaatgttctttctgcatggttttacattcatggagtccggagttctggtggccaccgcctttgacagatatgttgctatctgtgatcctctccgctataccaccatactcaccaattccagaatcatccagatgggtctcctgatgataactagagccattgtgcttatcttgccgctcctgttgctcctgaaacctttgtacttctgccggatgaatgctctctcgcacagctactgctatcatcctgatgtcatacagttagcctgcagcgacattagagcgaatagtatttgcgggctgatcgatcttattcttacgactgggattgacacaccttgtatcgtactctcctacatcttaatcatccattccgtccttcgcatcgcatctcccgaggagtggcacaaggtgttttcaacttgtgtgtcacatgtgggcgctgtggcgtttttttacattcacatgttgtctttgagtctcgtctataggtacggacggtcagcccctcgcgtagtacactcagtgatggccaatgtgtatctcctgcttccgccagtcctgaacccgataatcgattctgtgaagaccaagcaaatccggaaggctatgctgtcgctgctcctgaccaaatag

SEQ ID NO: 58059 - DNA, 960 bp, Artificial Sequence
  Description of Artificial Sequence: Synthetic coding sequence
atgctgcaaaaccaggataccatggagattctgtctaactctacatcaaagtttcctacattcctcctgacagggatccctggccttgagtccgcacacgtgtggataagcattccattctgctgcttctacgcgatagcactgagtggcaattcagtaattttatttgtgataataacccaacagtccctgcacgagcccatgtactactttctgtttagactgtctgcaacagatctcggccttactgtgagctcccttagtaccacactcgggattctatggttcgaggcaagagaaataagtttgtattcttgtatcgttcagatgttcttcttacatgggttcacctttatggagtctggtgtgttggtggcaaccgccttcgataggtacgtagctatctgcgaccctttgagatacaccaccatcctgacaaatagcagaatcatccagatgggtctgctgatgattactagagccatcgtgctcatcttacccttgctattactcctgaagcccctgtatttctgtcggatgaatgccctaagccacagctactgttatcaccccgacgttatccagctggcctgttcagatatcagggccaatagtatctgcggactgatagatctgatccttacaacaggtatagacaccccttgcatcgtgctgtcttacatcctgatcatacactccgtgttaagaatcgccagccctgaagaatggcataaagtcttttctacgtgcgtgagtcacgttggggcagtggcttttttttacatccacatgctgtcgctatccctggtgtatcgttacggcagaagcgcgcctcgcgttgtccattctgtgatggctaacgtctatctgttactgcccccagttctgaatcccatcatagattctgtaaagacgaagcaaattaggaaggcaatgttatctctgcttctgaccaaatag

SEQ ID NO: 58060 - DNA, 981 bp, Artificial Sequence
  Description of Artificial Sequence: Synthetic coding sequence
atgtcagttcaatactctctgtcaccccagttcatgctgctttcaaacatcacccaattttctcccatattttatctgacttcatttcctggcctagaaggcattaagcattggatattcatccccttcttctttatgtatatggtggctatctccggaaattgcttcatcttgatcattatcaagacaaacccaaggctgcatacaccaatgtattatcttctatctttactggcactaacagatctaggcctgtgcgtcagcacactccccactacgatgggcattttttggtttaattcccactctatatattttggggcatgtcagatccagatgttctgcatacatagcttctctttcatggaaagcagtgtgctgctgatgatgtccttcgaccggctggtggctatctgtcacccactgcggtacagcgtgattattacgggccagcaagtcgtcagggccggtctaattgttatcttccgcggtccagtagcaactatccccatcgtactgctgctaaaggctttcccttattgcggctcagtggtactatcccactctttctgtttgcatcaggaggtgatccagttggcctgcactgatattaccttcaataacctctatggtctgatggtggttgtttttacggtgatgctcgacttggtgctcatagcattgagctatggcctaatattgcacacggtggccggactggcaagccaggaagagcagcgtagggcttttcaaacgtgcacagcaccgctttgtgccgtgctagtttttttcgtgccaatgatgggtttgagcttagttcaccgcttcggaaagcacgctccgcctgccattcacctcctgatggcaaatgtgtacctattcgtgcctcctatgctgaatcccattatctattccataaagaccaaggagattcatcgggcaatcatcaaattccttgggctcaaaaaggcctctaagtag

SEQ ID NO: 58061 - DNA, 945 bp, Artificial Sequence
  Description of Artificial Sequence: Synthetic coding sequence
atgaagaacaagagcatggaaatcgaatttatccttttaggcctcacggatgacccacagctgcaaatcgtaatctttctgtttctgtttctgaattatacactgagtttgatgggcaacctgatcattatcatactgacactgctagacccaaggctgaagacacccatgtactttttcctccgcaatttttcattcctggaggtaatcttcacaactgtctgcatccctcgttttctgatcaccatcgtcacaagagacaagaccatatcttacaataattgcgcgacccagctgttcttcattctgctaccaggagtgactgagttctacctcttggcagctatgagttatgataggtacgtcgcaatttgtaagcctctccactaccctataatcatgtcctcaaaagtatgctaccagctggtgctgtcttcctgggtcaccggctttcttatcatattccctcccctggtgatggggctgaaactcgatttctgcgcatctaaaaccatcgaccacttcatgtgcgagacctccccgatacttcagatcagctgtactgacacacacgttttggaactgatgagcttcaccctcgctgtggttaccttagtagtgaccctagtcttagtgatactatcctacacctgtattatcaagacaattctgaagttttccagtgcccagcagcggaacaaagcgttcagtacctgcaccagccatatgatcgtggtcagcatgacttacggtagttgcatattcatgtatattaaaccctcagcaaaggagcgagtaaccgtgtctaaaggagtggctctattgtacacctcaattgcccctctgttaaaccctttcatttacacgctgaggaaccagcaggtaaaggaggtgttctgggacgtgcttcagaagaacctctgcttcagcaaaaggcccttctag

SEQ ID NO: 58062 - DNA, 939 bp, Artificial Sequence
  Description of Artificial Sequence: Synthetic coding sequence
atgaagaacaggacttctgttacagacttcatcctgctgggattgaccgacaacccccagctacaagttgtgattttctccttcctttttctgacgtacgtgctgagtgttaccggcaatttaaccattatttcactgaccctgctagacagccatctgaagactccgatgtatttcttccttagaaacttcagtctggaaatctcctttacatcagtctgtaaccccagattcctgattagtatcttaacaggagataaatcaattagctacaacgcctgtgccgcacagttattttttttcattttcttgggctccaccgagtttttcctactggccagcatgagctacgactgttatgttgcaatttgtaagcctcttcattataccactatcatgagtgataggatttgctaccagctgattataagctcttggctggctggattcttagtgattttcccacccctggctatgggcctccagcttgacttctgcgattccaacgtgatcgatcacttcacctgcgactccgcccctctgctgcagatcagctgtaccgacaccagtacgttggaactgatgagttttattcttgccttgtttaccctcattagcaccttaatcctggtgatcctaagttacacatatatcatccgcacaatccttcgcatccctagcgcccagcagcgcaagaaagccttctccacctgcagctcgcacgttatcgttgtgtccatatcctacgggtcatgcattttcatgtatgtgaagacttccgccaaggaaggggtagctctgacaaagggggtggcaatactgaacacatccgttgccccaatgctgaatccttttatctataccctccgcaaccagcaagtgaaacaggccttcaaggatgtgcttcgtaagatcagccataagaagaagaaacattag

SEQ ID NO: 58063 - DNA, 114 bp, Artificial Sequence
  Description of Artificial Sequence: Synthetic coding sequence
atgatcacagacgttcaattagcgattttcgccaatatgctaggcgtgtcattgttcctcttagtcgtgctttaccattacgtggccgtgaataatccgaaaaagcaggagtag

SEQ ID NO: 58064 - DNA, 330 bp, Artificial Sequence
  Description of Artificial Sequence: Synthetic coding sequence
atgagtatcacagacgtgttatcagctgatgatatcgccgcagccctccaggaatgccaggacccggacacctttgaaccccagaaattctttcagacatctgggttgtcgaaaatgtccgcgtcgcaggtaaaggacgtgttcaggtttatcgataacgatcagagcggttacttagatgaggaagaactgaaattttttctacagaaatttgagagcggcgcaagagaattaacagagtccgaaacaaagagcctaatggctgctgccgacaacgatggagacgggaagatcggggctgaagaattccaggagatggtgcacagttag

SEQ ID NO: 58065 - DNA, 372 bp, Artificial Sequence
  Description of Artificial Sequence: Synthetic coding sequence
atgaagacaatcttgggattcaagggactgttttatctgcactccctcatctggacctgtgcaggcgattggtccgccattcaggttcactgcacacaattttggttttttgcgcgaatcaagcctaccatcttctataatttgtacgtgaacccggacgaggtgtttctcggtgacggatgtcacgtgactcatgttctgcccaacgtctactatgagttcttttaccatcctcacgactgtggcatcgtgacgcagcccttgcaggaagtcctgctactgaagaccaaaatcaggtacatcagtcgagattcgacggtcagaagcgagatgccactctcgtgtgtcgttcacaaacagaagtgccaatag

SEQ ID NO: 58066 - DNA, 1356 bp, Artificial Sequence
  Description of Artificial Sequence: Synthetic coding sequence
atgggcaacttgctcggtggagtgtcttttagggagcccaccacggtcgaggactgcgactctacctggcaaactgactctgagcctgagccagaagagccaggccctgggggaggcagcgaaggccctggacaagaaagcgagcagcctgcacagcccccagagcaggctggcggacgccctggagcctccccagcccctgacgaggatgcagaggcagcgggtgcagaacaaggaggcgactctacagaggccactgctaagcccaagaggagcttttatgcggctcgcgacctctacaaatacagacaccaatatcccaattttaaggatatacgataccagaacgacctctctaacctgaggttttataagaacaagatcccgtttaagcccgacggggtttatatcgaggaggtcctgtccaagtggaagggcgactacgagaagctggagcacaatcatacgtacattcagtggctgttcccccttcgcgagcaggggctgaatttctacgcaaaggagctcacaacctatgaaatcgaggaattcaagaagaccaaagaagcaatccgcaggtttttattggcatataagatgatgctggaattcttcggaatcaaattaactgataagacaggtaatgtcgctcgggcagttaattggcaggaacggtttcagcacctcaacgagagccagcacaattacctcaggatcacccgcatcttaaaaagcctgggcgaactcggatacgaatccttcaagtccccattggtgaagttcattctgcatgaggctctggtcgagaatacgattccaaacatcaagcagagcgccttagagtactttgtttacacgatacgcgacagaagagaacgacggaaacttctgcgctttgcccagaagcattacactccatccgagaactttatttgggggcctccacgtaaggaacagtctgaaggttccaaggcccaaaagatgtcaagtcccctggcctcgtctcataacagccagacttccatgcacaaaaaggccaaagactcaaagaactcatcgagtgccgtgcatctgaattcaaaaactgcagaggacaagaaggtggctcccaaggagcctgtcgaagaaaccgataggcctagtccagagcccagtaatgaggcagccaagcccaggaatacagagaaggatagcaacgcagagaatatgaattcccagcccgaaaaaaccgtgaccacccccacagaaaagaaggagagcgtttctcctgagaataacgaagagggagggaatgacaatcaggacaatgagaatccaggaaatacgaactgtcatgatgtggtcctagttcagtag

SEQ ID NO: 58067 - DNA, 570 bp, Artificial Sequence
  Description of Artificial Sequence: Synthetic coding sequence
atgatcaatacacaagactcttctattcttccactgtctaattgcccccaacttcagtgctgtaggcacatagtacccggacctctgtggtgtagcgatgccccacaccccctctccaagataccaggaggcagagggggagggcgagatccaagcttgtccgcactaatttacaaggatgagaagctgaccgttacccaggacctgcccgtaaacgatggcaagccacacatagtacacttccagtacgaggttacagaggttaaggtttcttcctgggacgccgtactctcatctcagagccttttcgtggagataccagacgggctcttggctgacgggtctaaggaaggactgctggccctgctggagttcgccgaagagaagatgaaggtgaattatgtatttatctgtttccggaagggccgagaagatagggcccctttgctcaagacgttcagctttttgggctttgagatcgttcgcccaggtcacccttgcgtccccagcagaccagacgtgatgttcatggtgtatcctttagatcagaatctttctgacgaggactag

SEQ ID NO: 58068 - DNA, 7034 bp, Artificial Sequence
  Description of Artificial Sequence: Synthetic coding sequence
atgatcccttggagcatcttcctgctgcacgtgctgctgttctcacttcaagagtatatctgtgccagtagcattctcatggggacttcaaagaacggattcaacgagaacagacagaagcgcgctttgctcgccgcacagtttgaggctactagcccgcgatatttcttccatgacgctattaactggggagaaagcaaaatcaaaggaagttgcccctatgaatgtctgaacggtgccttctgttctaaaacagggacttgcgactgccagatcttccaagctttaggaacaaggtgccagatcattccgaatatgggtaatggtcgtgacggtatctgcaaaacctgggggcagtatcacttcgagactttcgatggcatttattattactttccagggaactgttcctacatttttgccaaggactgcggagatctcgagccaagatacaccgtgtgggtgcacaactcccccaaatgtttggggtctgtgtattcttgctaccggtccatcagtctcttcttcagcaaccaggaggaaataagaatctacggtcacgaaatcaagaagaatggaatctctctgaccttgcctcagactatcggacagatttttatcgaaaagctggcagattacatactggttaaaacaacctttggtttctcactcgcgtgggacggcattagtgggatctatctgaaactctctgaagaccacaagggcaaatcctgcggactctgcggcaactataacgacattcagtcggacgactttattattctccaggaagactacacagaggacatcgccatgttcgccaattcatggagcgttcagactcctgatgacacaaaatgcgtgttgactccgtctgatttccctaacccatgtagctcaggcatgcctgcttttgaggccatcttctttaaatgtcagatcctgttgcaattcccgttcctcagctgtcatgagtacatcgacccatacttgtacatcgcatcctgtgttaatgacttgtgcaagactgacgacgacgagacctattgtcgagcagcaactgaatacgctagggcttgttctcacgctggataccctatccaggattggcgcgatgactttccggcatgtacggacaagtgcgatgacagttttgtacacagagattgcattagttgttgtcccccaacttgcacttttgagaaacaatgtctcggaagtaacctgcactgtttggatggctgctactgcccggatggactggttatggataatggcacctgtatctctctggagaactgtccctgcgggtttcatggactagcatattccgtcggttctaagattgaacaggaatgtaccgaatgcgtttgtgtaggaggcgtgtggaattgtacggaacaggattgtcctgtgcagtgcagtgtggtaggagattcccacttcaccaccttcgacgggagacactactcctttatcggcatgtgccagtacatcttggtgaagggaactggcaaggataagttcacaatcaccctgcagaaggccccttgcgagcaaaatctgggcttggtctgcttgcaatcgatcaccttgattctggaagatgattttaataagcaggttacgctcggccgaggagggcaaattttgacatctccgaaccagggattcaacctgaacgggatcgtggaaatacagacactgagttctttgttcatcctcttgaagactaccttcgggcttaagatcctgttcgctattgacggtgagcgaatctatatacaactgacatctgcttggaaacgcaggacactgggcttgtgcggtacttttaatgggaacatccgggacgactttctgtcaccctctggaatgatcgaggggaccccccagctccacgcaaacgcttggcgcgtgagttctacctgtttcgcaccagtgcacgtccctgttgtggacccatgcaatataaatcagcagaacatcggatatgccgctcactgtgatgtgattcatcaggaactgtttgccccttgtcacatatatatcagccctgggctgtactaccagctgtgtcggcacgacgcgtgcaagtgtgggagtagttgcctctgcaacgcactcgctcactatgcttacctgtgcgggcagcatggtgtgccgattgatttcaggacgcagatctcattctgtgccgttgtatgccaaaaaggaatgctttatcatcactgttcgagcttttgcctccattcttgtatatcccttagctcccctgagcagtgtagcgatgattgcgcggagggttgcaattgtccagagggcaagttttatgaagacacgctgaacttctgcgtccccatttttcactgcaggtgccattatcggggatccgtctaccaaccgggagaattgatccctacaccaagcggtctctgccagtgttcgaatggaacggtgaaatgcgacgagctcgccaccccaagcgctgtccacatctgccccgaagggaaggaatattttgattgtcggtttccagaccctgagttgccagctggcggtgtaaattgtgaaaccacgtgcgccaatctcgccatgaattttacctgcacgccaagcagcccttgcatctccggctgcgtctgtgctcctgggatggccgagcaccgagggaaatgctacgtaccggagtcatgcccttgcatctggaaagactgggagtacctctcaggcgaagttatcgccacgccttgctacacttgcgtctgcaggcgcggtatgtttaactgcacctactacccatgcccagctgtttgtacgatatatggcgataggcactattattctttcgatggtcttgagtacgattacatatctgactgtcaggtctttttaattaagtcagccgacgacagcgacatctccgtaattgctcaaaacaagaaatgtttcgacaacgatatcgtgtgctcaaagtccgtgctcatctctgtgggggataccgaaatttacctgaatgacactccatataagcagaaacagtctggtttcttcctggagaataagtccacctaccagctttggaaggctgggtattatatcgtagtttattttccggagaaagacatcactatcctttgggatcggaaaaccacaattcatatcaaagttggacctcagtggaaaaataaactaagcggactgtgtgggaactttgacaagtgcacgtctaatgatatgactaccagcaacaatctggaggtaaggaacgccagggttttcggtgattcttgggccttaggccagtgtgagtctcccgatgaaacaatcaagccttgcgaagcccaccagaacaagttcccctatgctaaaaaggagtgctcaattctgtactctgacatcttcgccagctgcagaaacgtgattgacgtgacatcatttgccaagaactgccacgaagatacttgcaattgcaatctgggtggggattgcgagtgcctatgcacttcaatcgcagcctatgcctacaaatgctgccaggaaggaatttcaattcactggcggagctccaccgtgtgttcccttgattgcgaatactataacgagggactgggggaaggaccctacatgttagcctcatacgggcaaagcgggttagtgctgggagccaatatgacaagccgctccgtgttttgcctgccacggtctagcgtccacactagcttattcttctacttcatgatcaccccaggactgtttaaggagaaggtaagttccctggccctggtatccctggagagcgcagaaagaccgaactattttctgtatgttcatgataatgacacactttcgctggaactgtgggaggccaattcagccttccatagaagggcgactttttttcatcatcaggggttatggataccgggttactccgcatttgaactgtattctaaaaagggtttctttattatctttacggattcaagcgtgaaggcatctaaatacgacgattctgaagaattcaagcactcgtcttctttcagcatcgaggaaatccaggctgctgtgccataccggaagatgtgcgaatggagatacgaaccttgtgccactccttgtttcaaaacatgcagcgatccagaggccctcgcttgcaaatttctccctcccgtcgagggatgcctcccctactgtcctaagaacatgatactcgatgaagtgacccttaaatgcgtatatcctcgtgactgtattcctgtgattcctaccgagccgaccttgatgcctcccgcaaaacctacagtgccaatgttcaccgtttgggagatgattactccctcggatattactgtgtttgacatgctcaccccaacaaccgggttggagtgtgaaccccaaaaattcgatcccgtatacgactgtagtcagtatatatgtttgaatatggaatggcaactgtataattggagcctgaactgcccgaaggacgtggaaatgcccgactgtggattcagaggacggcctgtgcaagtgaactctgatatatgctgtccagaatgggagtgtccttgtagatgtagcatgttgtccgaactctcaattataacattcgatggcaataacgctgcgctatattctatggcatcctacatactcgtgcgtatacccggagagatcattgtcgctcacattgagaagtgctccatgaatcagaatggcaacagtctgaaaaaattggcccctagcggcagaataagtggtttgtgcttcaagaagctgaacgtgacaacgccaatacacaagatcatcgtgaaccgattagcgagaaaagtcgaagtggactcaatcgtagttcccctaccgttttcttcccaggagctcagcattgaagattcggggagcatgtacgtgattaccacccctgcaggactcataatcaaatggtctcacctgaccgggatcatcgacatacactttggcttccgcttcaatctctcctcttataccgaggggctgtgtggtatctgcaacgaagaccctgatgatgatctgcgaatgcagaacggcactattataacaaatatggaagacattggactcttcattgaaagttgggagatagaaaagagcttcgaagtgacaatgcgacgccctgtcagaaactgcactgaacatgactgtagtcagtgcatcgaccttctgaaccgcagaattttcataccctgtcacgataaggtcagccctgaggacttctgcgagaagatgtggataaactacacgtacttctggaactatgaatgcgatgccctgagcgcctacgtggccctgtgtaataaattcgatatctgtattcagtggaggacgccagattattgtagcctatcgtgccctgaaggcaaagagtaccagccttgtgtgaggccctgtgaggctagaacctgcctcaatcagtggttttatgggcacacctcgtgtttaaatctgcgcgaggattgcgtgtgcaaggtcggcacaatactgcaccgtcctcattctgcgcagtgtatccctgagaaggagtgtgcatgcaccgactctgaggaccagcctcgaaccgccggtgagatttggaacggcggaatcgatgaatgcaccctatataaatgtctggaaaacggttcaattatcccgatcgagcccgattgcgacgaggaacccaccccggtgtgtgaacgggaggctgaagtggtcatgggaattatagataagtggacatgttgttcaaaagaggtttgtgggtgcgacaccacactgtgcgagacctcaatccctacctgtacaaactcgcaaaagctgattgtggggcattctccattgtcctgctgcccacaatataaatgcgaatgcgatccactcaagtgtccatccatttccacaccagagtgccgggaagaccaattcatgatccaggttcggcaggaggaaccttgctgcttttcacccttttgtgtgtgcgagagctgtactaagcccgtaccactgtgccacgatggagaatttttaaccgttgatcttaattcaacccacttctgttgtccgcagtattactgcgtatgtgagccaaacctgtgtccaatgccactcctgaactgcgccgaggacatgaaccttgtgaaggaaaacgtctccggacagtgttgccccacgtggcactgcgagtgtaattgtgagaaccttatcatgccgacctgtgaagttggagaattcaccgctattgatcacaactttcagtctgactgtggttgcattcagtacctgtgtgaaaaggacgacgtctgcgtcttccaggaggtgtctgtgctgaaccccggtcaaagtatgattaagtacctagaagaggatttctgttatgccatcgagtgtctggaggaaaaagacaatcacactgggttccacaccttgaattttacactggtgaactgtagcaagaagtgcgacgtgcatcaggtctacactccatctccaagcgattacgggtgttgcggtacctgtaagaacgttagctgtaagtttcatatggagaatggaacatcggtggtgtacgccgtggggagtacctggcattacaattgtacaacttatgagtgcgtcaaaaccgacgagggagcgattatcctgaactatacgatggtctgccctccttttaacgagacagaatgtaagatgaatgagggcatcgtgaaactctacaatgaaggctgctgtaagatctgtaaaagagaagagcgcatttgccaaaaggtaataatcaaatcggtgataagaaagcaggactgtatgagccagagccctataaacgttgcaagttgtgatggcaaatgtccctcggctaccatctacaatattaacatcgagtcacacttgaggttttgcaaatgctgtcgcgagaatggcgtcaggaatcttagcgttcctctttactgcagcgggaacggaacggaaatcatgtatacactgcaggaacctatagactgtacgtgccagtggaacta

SEQ ID NO: 58069 - DNA, 1434 bp, Artificial Sequence
  Description of Artificial Sequence: Synthetic coding sequence
atgtggatgttcagctggctttgcgcaatcctgatcattttagcaatcgccggaatgaacacaattgctaagacgaccccccatacaaagtttacaaaaaagagcgaggagcgggaaatgcctaagggactcaaaccatcaagcggaccaccacctgaggaagaagaaactctctttaccgaaatggccgagatggcggagcctataacaaagccctcagctctggactctgttttcggcacagccaccctgtctcccttcgaaaacttcaccctcgatccggctgacttctttttaaactgttgtgattgctgttctcctgtgcctggccagaaaggcgagccaggagagaccggccaacccggaccaaagggggaagccggaaacctcggtatacccggtccccctggggtcgtggggcctcaaggccctcgaggatacaagggggagaaaggcctgaagggagaaaggggcgaccaaggggtaccgggatacccaggaaagcccggtgcgcagggcgagcccggtccaaaaggtgacaaggggaacattggactggggggagtgaaaggccaaaaggggtccaagggcgatacctgtggcaactgcacaaagggtgaaaaaggtgaccagggtgcaatgggatctcccggactacacggtgggcctggagccaaaggagagaaaggcgagatgggggaaaagggcgaaatgggtgacaaagggtgctgtggtgattcaggcgagagaggcggaaaaggccagaaaggagagggcggaatgaagggagagaaggggtccaaaggtgactctggcatggaaggcaaatctggaaggaacggcttacctggggcaaagggtgacccaggtattaaaggggaaaaaggcgaactgggtcctcccggacttctgggacccaccggccctaaaggggatataggaaataagggagtccgtggaccgactggaaagaagggcagtcgaggtttcaaggggtcgaagggagagctggcaagggttcctcgctccgctttcagtgcaggtctcagtaagccattcccccctcctaatatccctattaagtttgagaagattctgtacaacgatcagggtaactacagccctgtcaccggtaagttcaattgttccatccctgggacttatgtatttagctaccatatcaccgtcaggggtcgtcctgcaagaatctccctggtagcccaaaacaagaaacagttcaaatcgagggagaccctatacggccaagagattgaccaggcgtcacttctagtgatcctcaagctcagcgctggggaccaggtgtggttagaggtctcaaaagattggaacggcgtgtatgtttctgccgaagacgactccatctttactggcttcctgctctaccctgaagagactagtggcatctccccctag

SEQ ID NO: 58070 - DNA, 1716 bp, Artificial Sequence
  Description of Artificial Sequence: Synthetic coding sequence
atgacgatccttccaaaaaaaaaacctccacctccggatgctgaccccgctaatgagccgccacccccaggcccaatgccacccgctcccaggcggggaggaggggtgggcgtaggcggtggcggaaccggagtgggcggtggcgacagggaccgcgactccggggtggtgggcgctaggccgcgagcctccccccctccacaggggcctctccccggtcctcccggagctctgcacaggtgggccctggcggtgcctcccggagccgtcgctggcccacgtccacagcaggccagtccacctccatgcggaggacccggaggcccagggggaggtccaggcgatgcgctgggtgccgcagcggctggcgtgggagctgcaggcgtcgtggtaggggtggggggagccgtcggtgttggaggctgttgctctgggcctggacacagtaagaggaggcgccaggccccaggggtgggggctgtgggcggaggctctccagaacgggaggaagtgggggctggctataattctgaggatgagtatgaggcagcagccgcacggatagaggccatggatcctgcaaccgtggaacaacaggagcactggtttgagaaagcattacgcgacaagaaaggcttcatcataaagcaaatgaaagaggatggcgcatgcctcttcagagctgttgccgaccaggtatatggagaccaagatatgcacgaggtcgttagaaagcactgcatggactacctcatgaagaatgccgattacttctcaaactatgtgactgaggatttcactacgtacattaaccggaaaagaaaaaacaactgtcacggcaatcatatcgagatgcaggctatggcggagatgtacaaccggcctgtcgaagtgtaccaatactcaacaggaacatctgctgtagaacctattaatacttttcacggcatccatcagaacgaagatgagccaatccgagtgagctaccacaggaacatccattataacagtgtcgtaaaccctaataaagccacgattggggtcggcttgggtttgccctctttcaaacctggcttcgcagagcagtcactgatgaaaaacgccattaagactagcgaagagtcgtggatcgaacagcagatgctcgaagacaagaaacgcgctactgattgggaagcgaccaacgaggccatagaggagcaagtggctcgggaatcttaccttcagtggctgagagaccaggagaaacaggcccgacaagtacgagggcctagccagccaagaaaagcatctgcaacctgtagctccgccaccgctgccgcaagcagtggactagaagagtggacttctaggtctccccgacagcggtcttctgccagtagcccggaacaccctgaactgcatgcagagttggggatgaaaccaccgagccccggtacagttctcgccttggctaagcctccatccccatgcgctccaggtacatcctcccagttttcagcaggcgcagaccgggcaacatccccgctggtaagcctgtatccagccctggagtgccgtgctctcatccagcagatgtcacctagcgcctttggactaaacgattgggacgacgatgaaatcttggcatccgtgctcgcagtgtcccagcaagagtatcttgacagcatgaaaaaaaacaaagtccacagggacccacctcccgacaaaagctag

SEQ ID NO: 58071 - DNA, 1701 bp, Artificial Sequence
  Description of Artificial Sequence: Synthetic coding sequence
atgaccatattaccgaaaaagaagccaccacctcctgacgctgatcctgccaacgagccgccacctccaggtcctatgccgccagccccaaggaggggcggtggtgtgggagtaggagggggaggcactggtgtaggcggtggtgatagggacagagattcgggtgtggtgggcgcaaggcccagagcctcccccccaccccagggcccattacctggtcctccgggagccttgcaccgatgggctctagctgttcctccaggcgctgtggcgggacccaggccacagcaggccagcccccctccatgtgggggacccggaggcccaggaggaggacccggtgacgctctgggtgcggctgctgccggtgtgggagctgctggagtggtggtgggggtgggaggggctgtgggggtcggaggctgttgttctggacccggtcatagcaaacggaggaggcaagccccaggtgttggcgctgtgggcggtggaagtccggaacgcgaagaagtaggcgctggctataattccgaagacgagtatgaagcagctgctgccagaatcgaggcaatggatccagccacggtggagcagcaggagcactggttcgagaaggccctgcgggataaaaagggctttatcattaagcagatgaaagaggatggagcctgtctgttccgggcagtggccgatcaggtttacggggatcaggatatgcacgaggtcgtgcgcaagcactgtatggattatttaatgaaaaacgcagattatttttccaactacgtcacagaggattttacaacctacattaatcgcaagcggaagaataactgtcacggtaatcatattgagatgcaggcgatggctgagatgtataataggcccgtagaggtataccagtattccacagagcccatcaataccttccatggcatccaccagaacgaggacgaaccaatccgcgtttcttatcaccgtaatattcactataatagtgttgtgaatcccaataaagccacaattggtgtcggtcttggactcccctcattcaagcccggttttgccgagcagtctttgatgaaaaatgcgattaagaccagtgaggaaagctggatagaacaacaaatgttagaggacaaaaaacgtgcaacagactgggaggcaactaatgaagcgatcgaggagcaagtagccagggaatcttacttacagtggctgcgggaccaggagaagcaggcgagacaggtgcggggaccttctcagccacggaaggctagcgcgacatgctcatccgctacagccgctgcaagctccgggctggaggagtggacctcccgatctccaaggcagcgcagctctgccagctctcctgagcaccccgagttgcacgctgagctgggcatgaagcccccaagccccggaactgtgctcgccctggccaaacctccttcgccctgtgcacccggaacgtccagccagttctccgcaggggctgatagagctacctcacccctggtctcactctaccccgctctcgaatgtcgcgcactgattcagcagatgtcgccgtcagcctttggtcttaacgattgggatgatgatgaaattctcgcatcggtgttagcggtttcccagcaagagtacctggattcaatgaaaaagaataaggtccaccgagacccaccgcctgataagtcatag

SEQ ID NO: 58072 - DNA, 762 bp, Artificial Sequence
  Description of Artificial Sequence: Synthetic coding sequence
atgggatcagacgcctgggtgggcctgtggcggcctcaccggcctaggggtcctatagcagcgcactatgggggaccgggaccaaagtacaagttgccacccaatacaggctacgcgctgcacgatccttctagaccacgggcaccagcctttacatttggggctcgcttccccacccagcagaccacatgtggccctggcccaggtcatctcgttccagctcgaatgacagtaagagggacggacggtgccccagcgtacagcatctatgggaggcccaggcgatcggctccttttcttaccccgggtcccggtcggtattttcctgagagggcaggaaatgcgacctaccccagcgccccaaggcacacaatagcacctcgaaattggggagtgcaagcagaacagcagtcaccaggaccagctgcctatacagtgcccagcttgctgggacccagagtcatcgggaaagtatctgctcccacatgcagcatatacgggaggcgagctgctgggagtttcttcgaggacctctccaagaccccaggcccatgcgcatatcaagtggtctcccccggtgtgtacaaatcaagggcaccccagtttacgatactggccagaacctcacttcctcaggacaacactcggaaacctggacccgctgcttataatgtggaccaacatcgcaaaccacgtgggtggtcatttggtatccgacatagcgactacctcgcaccgttggtgaccgatgctgataactag

SEQ ID NO: 58073 - DNA, 762 bp, Artificial Sequence
  Description of Artificial Sequence: Synthetic coding sequence
atgggatctgatgcatgggttgggctctggaggccacacagacctcgcggacccatcgcagcccactacggcggacccggtcccaaatacaaactcccccctaacaccgggtatgccctgcacgacccgagcaggccacgcgcaccagccttcacgtttggcgctaggtttccaacccagcagactacatgtggcccaggccctggccacctggtgcccgctcggatgaccgtgagggggacagacggggcacccgcttactccatctatggccgaccaaggaggtctgcgcctttcctgaccccagggcctggtcggtacttcccagagcgggcaggtaacgcaacctacccctctgccccacggcacaccatcgcaccacgaaattggggcgtccaagctgagcagcagtctcccggacctgcagcatatactgtgccctccctactgggtcctcgtgtaatcggtaaggttagcgccccaacctgctccatctacggtaggagggctgccggaagcttcttcgaggaccttagtaaaacccccggaccgtgtgcttaccaggtggtgtcaccaggtgtctacaagtctcgcgcacctcagttcacaattctcgctcgaactagcttacctcaggacaacacgcggaagcctggcccagccgcttacaatgtggaccagcatcggaagccacggggatggagtttcggtattcgccactctgactatttggccccacttgtcaccgacgcggacaactag

SEQ ID NO: 58074 - DNA, 465 bp, Artificial Sequence
  Description of Artificial Sequence: Synthetic coding sequence
atgctccccggttatgctttgcatccagtggccgctgctaggccgaggctacacctaaggcgcgctctccctcatgctgccgacgatgtcagacctcgcgctagaccacctggagcgaggtctcacgacagagcacggcaccgccgtcgacccaggttgctgcacctgcggcctccaacccctttgagcgctcttccacactccggcacatggtctggaccacctgggccttggcctccacaacgccgaacagcttcgagggaggcgcatttggggactcctgacctgaacccggagtcgccttctgacacgttgacatattccgtgccaccatatccagacctgaaaagccagacaccgccaaggggcttcgataaatcatggctccggcttccaactagtcctcgcacccccagtagagtgccaaccagacttccacggagctcttctccaccccatccctag

SEQ ID NO: 58075 - DNA, 825 bp, Artificial Sequence
  Description of Artificial Sequence: Synthetic coding sequence
atgaaattgccaaagggcaccagaagctctgtgtattttgcccagcacccagagaaggaacccctaccatccagacaggaggttaagcagacccctgtaatcatggccaagatcaaaggacccggtcccgctaaatatcttcggccaagctgtaccggttatatcgatcatgacatctccatgtttaaagctccggcttataccctccactctcggcactccgaaaaaagaatggtgtgtcactcctcccctgggccttgttacctgctagatcctaagataaccaggtttgggatgtcatcttgcccacaagttccgatggaggagaggatttctaatctgaggctgaacccgactctggcgagttgccaatattatttcgagaagatccaccctcccggtgagaggcgagcaccccagtacactttcgggtaccgcaggccatatcgggtgatggacctgaatccggcacctaaccagtatcagatgcctttgttgctgggcccaaacacacctgtgtctcgcgcagccccttgctattcacttgcatcgagagacaagaactggttctacaaggaggacgttgccggagggccaggtcccacgacctacgcccgacccgagccctcaatataccaaaaccggtcgccgacatatagcatggctaagcgttttgcgtatcctctggacctgacaccacggcctggtcccggatcacatgaagttcaacaggtgacagttcacaaaccacacatcccagcattcacaatgggtatcaagcattctctccatctctgccccctagttatcgacatccgggattag

SEQ ID NO: 58076 - DNA, 870 bp, Artificial Sequence
  Description of Artificial Sequence: Synthetic coding sequence
atgggcacactgtcgtgtgattccacaccgaggctagcgactgctcctctcgggcgtagggtgacagaaggacagattcctgagacaggactgagaaagtcctgtgggacagccacccttgagaacgggagcggccctgggctttacgtgctgccatctaccgttggtttcatcaaccacgattgcaccagggttgcatctcccgcatatagtctagtgcgccgtccatctgaggctccccctcaggacaccagtccaggtcccatttacttcctggacccaaaggttactcggttcgggagatcttgtacacctgcgtactctatgcagggcagggctaagagccgcggacccgaggtcacccccggacccggtgcctatagcccggagaaggtgcctcctgtgcgtcaccgtaccccacccgcttttaccctgggttgtcggttgcctctaaaaccgctcgacacgagtgcgccagccccaaacgcttataccatgccccctctttggggttcacaaatttttactaagccatctagcccatcatacactgtcgttggaagaaccccacctgcacggccaccacaagatcctgccgagatcccagggccaggtcagtatgattctcccgacgccaatacatatagacagcggcttccagcctttaccatgctgggacgcccaagggcccctcgcccattggaggagaccccaggaccaggtgcacactgcccagagcaagtgaccgtaaataaggcccgtgcccctgcctttagcatgggtatacggcactcgaagcgcgcttccactatggcagcaaccactcccagccgccctgccggacacagattgcccggtcgctgctgttag

SEQ ID NO: 58077 - DNA, 762 bp, Artificial Sequence
  Description of Artificial Sequence: Synthetic coding sequence
atgggcactctgtcatgtgactccactcctaggttggcaaccgctccactcgggcgtagagtgacagagggccaaatccctgagaccggcttgaggaaatcctgtggtaccgcgactctggaaaatgcacctccgcaggacacatccccaggtcctatctatttcttggatcccaaggtcacccgttttggtaggtcttgtacacccgcatattccatgcaagggagggccaagtctagaggtccggaagtgacacctggacctggagcctatagtccagagaaggtgcccccagtacgccacaggacgccccctgctttcacacttggttgcagactgcccctgaagccactggacacctctgccccagcccctaatgcgtacacaatgccgccattatgggggtcccagatctttacgaaaccctcctctccaagttatactgtcgttggtagaactccaccagcgagaccccctcaggacccagccgagattccaggacccggacagtatgacagccccgacgcaaacacgtataggcaacggctcccggcattcacgatgctggggagaccgagagcacctcgtcctcttgaagaaacccctggccctggggcacattgcccagaacaggttacagtcaataaagcccgagcacctgctttctctatgggaatccgccattctaaaagagcatcgacgatggccgctacaactccaagcaggccagctggccatagactgcctggcaggtgctgttag

SEQ ID NO: 58078 - DNA, 3405 bp, Artificial Sequence
  Description of Artificial Sequence: Synthetic coding sequence
atgggtttactcgcaagcgccggactgctactattactggtcatcggccatcccaggagcctgggactcaagtgtggcataaggatggtcaacatgaaaagcaaggagccagccgtcgggagtcgtttcttctctaggatatcatcctggcgtaattccaccgttactggacacccatggcaagtctccctcaaatctgacgaacaccacttttgtgggggatcactgattcaggaagaccgagtggtcactgcagcgcactgtttggatagcctttctgagaagcagttgaaaaatattaccgtcacaagtggagagtacagtctgttccaaaaggataagcaggagcagaacatccccgtgagcaaaatcattacccaccccgagtacaattctcgagagtacatgtctcccgacatcgctctgttgtacctgaaacataaggtgaagtttggaaacgccgtccagcctatctgcctccctgactctgatgacaaggtagagcccggaatcctctgtctgagttctggttgggggaagatctcaaaaacttccgaatattccaacgtgttgcaggagatggagctccccatcatggatgatcgcgcttgtaataccgtcctgaaatctatgaacttgcccccattgggacgaaccatgctgtgtgccggttttcccgattggggtatggacgcctgtcagggagacagtggcggtccgctggtatgccgcagggggggaggtatatggatcctagccggaataacttcttgggtggcaggctgcgctggaggctcagtccccgtgcgtaataatcatgtgaaagccagcctgggcatcttctccaaagtatctgagttgatggactttatcacacagaacctgtttacaggcctcgaccgcggacagcccctgtctaaagttgggagtcgctacatcacaaaggcactgtcctccgtacaggaagtgaatggaagccaaaggggtaaaggcattctggatatggaaaagcaggtgggctgcgaccatgattatgtgtccctgagaagcagtagtggcgttctgtttaatcagagatcgctcatggaggacgacggaaaacagaataagcgggtgtgcggtaaaatcttaccaagtcctctgctggccgaaacctcagaagcgatggtgcccttcgtgagtgacaccgaagattcaggttcaggctttgagcttacagtgaccgccgtgcagaagagcgaggctggctccggatgcggttccttagcgattttggttgaagaagggacaaaccactctgccaagtaccccgacctgtacccctccaacacccggtgccactggtttatttgtgccccagagaagcatattatcaaacttacattcgaggattttgccgtaaaattctctccgaactgtatctacgacgccgtggtcatctacggggactcagaagagaaacataagctcgccaaactttgcgggatgctgaccatcacttccattttttccagttctaatatgaccgtgatttatttcaagagcgacgggaagaaccgcttgcagggattcaaggctaggtttactattctgcccagcgagtcacttaacaaatttgaacctaagctgccaccccagaacaatcctgtctccaccgtgaaagcgatcttgcacgatgtgtgtggcataccgccattctcgccacagtggttgtcccggaggatcgccggaggagaggaggcctgcccacattgctggccatggcaggtcggactgaggttcctcggcgattaccagtgtggcggtgcaatcattaatcccgtgtggattctaacggccgctcactgcgtccagctcaagaataacccactgagctggactattatcgccggtgaccatgacaggaacttgaaggaatccaccgagcaggtccggagggcgaaacacatcattgtgcacgaggactttaacaccttgtcctacgatagcgatatcgccctgattcagctgagcagtcccttggagtacaactctgtagtacgaccggtctgcctgcctcatagtgccgaaccactcttcagttccgaaatatgcgctgtcaccggatggggaagcatttctgccgacggcggactggccagccgcctccagcaaatccaggtacacgtgctggagagagaggtgtgtgagcacacctattatagcgcccatcccggtgggataactgaaaaaatgatctgtgccggatttgctgccagtggggaaaaggacttttgtcagggcgactctggcggaccactggtctgccgccacgaaaacggcccatttgtactgtacggcatcgtgtcctggggagcaggctgcgtgcagccttggaaacccggagtctttgcaagagtgatgatcttcttagattggatccagtccaaaataaacggtcctgcatctctccagaccaacaataaatgtaagacactcaaacagcagcttccccctcctacaccttccccggacagtgcatcctggccaggttgctgctctgaagccgagctggaaaaacctcgcggtttcttcccgacaccccgatacctactggactaccggggacgtctagagtgtagttgggttcttcgtgtgtctgccagctcgatggcgaaatttaccattgagtatctgtcacttttagggtcaccagtgtgccaggacagtgtgctgataatttacgaggagcgccacagcaagcgaaaaactgcaggaggcttacacggcaggcgcctgtatagcatgacctttatgtcccctgggccactcgtaagggttacttttcatgctctcgtgagaggcgcttttgggatctcgtatatcgtcctcaaagtgctcggcccaaaggactccaaaatcacacgactctctcagtctagtaaccgcgagcacctagtcccctgcgaggacgtcctgttgactaaacccgaaggcatcatgcagattccacggaattcccataggacaacgatgggatgtcagtggcgcctggtcgcaccgctgaatcacatcatccaacttaatattatcaattttcccatgaaaccaaccacttttgtttgtcacggtcacttgcgcgtgtacgagggctttggccctggcaagaagctgattgcctctttcgctggtactctggccatgattttgacaaaagacattctgaagagagagaaactaaattttataaatacttacatcatgcatatctgggaaaactcagtgtatgacaacgtgagatcggtaggcaaaaggaaacagaaaaagttcgctagtaaccttagctactctatggaggccgagaaaagccgaatccaggttccggcagacctggtgccggcaaagggttccttgtctggctcatag

SEQ ID NO: 58079 - DNA, 1695 bp, Artificial Sequence
  Description of Artificial Sequence: Synthetic coding sequence
atgctcattagcaggaataaacttattcttctcttgggtatagtgttttttgaaaggggtaaaagcgccactctctcccttcctaaggctccttcatgcggtcaaagcttggtgaaagtgcagccctggaattacttcaatatcttctcgagaatcctagggggaagccaagtcgagaaagggtcctatccttggcaggtctccctgaagcagaggcagaaacatatctgcggtggatcgattgtgtccccccagtgggtgattaccgcggcacactgcatcgccaacaggaatatcgtgtctacccttaacgtgactgcaggcgagtacgatctgagccaaaccgacccaggagaacagacactcaccatagaaaccgtgattattcatcctcactttagcacaaaaaagcccatggactatgacatcgcattgctgaaaatggcaggagccttccagttcgggcatttcgtcggcccaatctgtctccctgagctccgcgagcagttcgaggccggattcatttgcacaaccgccggatggggcagactaacagaaggaggcgtgctcagccaggtgctgcaggaagtgaacctgcctatcttaacctgggaagagtgtgtggctgctctacttaccctcaagcgccctatcagcggaaagactttcttatgcacgggctttcctgacggtggcagggatgcttgtcagggtgacagcggaggctctcttatgtgcagaaacaagaaaggagcctggaccctggcgggtgttacctcctggggtctcgggtgtgggcgaggctggagaaacaacgtgaggaagtccgaccagggatcaccgggtatcttcacagatatatccaaagtgctgccctggattcacgagcacattcagactggaaatcgccgaaagagctcacgcgcatggtgctctgagcaggacgtgattgtgagcggagcagagggaaaattacatttccctgaatccctgcatctctattacgaatccaagcagaggtgtgtgtggacattgctggtccccgaggagatgcacgtgcttttgagtttttcacatctggatgtggagagttgccatcactcatatctgtccatgtacagtttagaggatcggcctatcgggaaattctgcggggagtcactgccgagcagcattctgatcggcagtaatagcctgaggcttaagttcgtaagcgatgctacggacaacgcagccggatttaatttgacctacaaagcactgaagccaaattatataccagattccggctgtagttaccttactgtactcttcgaagagggtctgattcagtccctgaactatccagagaattatagtgacaaggccaactgcgattggatatttcaggcatccaaacatcaccttatcaaactgagcttccagagcttagagattgaggaatctggagactgcaccagcgactatgtgaccgtccatagcgatgtggagaggaagaaggagatcgcgaggctatgcggctacgacgtgccaaccccggtgctttccccttcttcgataatgctgatctcctttcaatctgatgagaatggaacgtgccgcggatttcaggccacagtgagtttcatacccaaagccggtaagaagatcgagctacccacgctatggttcccagtactgatactggtgatgtag

SEQ ID NO: 58080 - DNA, 756 bp, Artificial Sequence
  Description of Artificial Sequence: Synthetic coding sequence
atgcccagggccttcctggtgagatcgcgacgaccccaaccacccaactgggggcacttgccagatcagctgcggggagacgcctacattccggactgtagttctctggggggacctcctgcccagcaatcatcttctgtccgagatccttggactgcggttagtgtgttagggacatgcccgcctctcctgctttgcgtggggaacgcatcccccttcctggttgcccctgggcctgccgcaacgggtatcagctcatcaggggctcaggactcttcgccacacgtcgacgaccccctatacttgtgcatgcactggcgaaaggagtctgcttcacgaaaccagcccacacagggcaacctgacatcggcccctagaggtcccggtactttgggttgtcccctctgccccaaggccttcccactgcaacgcatgctaacgaggcatttgaagtgtcacagcccggtccgaaggcatctttgcaggtgctgcggaaaagggttccacgatgccttcgatttgaagcgtcatatgcgaacccatacgggcatcagacctttcagatgtagcgcctgtgggaaggcctttacgcagcgctgtagcctggaggcccatctcgcgaaggtccatggccagcccgcaagctatgcttatcgggagcgccgtgagaaactccacgtttgcgaggactgtggattcacctcttctaggccggacacgtacgctcagcatagagcactccatcgggctgcttag

SEQ ID NO: 58081 - DNA, 1683 bp, Artificial Sequence
  Description of Artificial Sequence: Synthetic coding sequence
atgggcaagtggcgaccacgcggatgttgtaggggcaacatgcagtgccgacaggaggtgcccgctaccctcacatccagtgagctgttctcaactagaaaccagccccagcctcaaccacaaccactattggctgacgcgccagttccatgggctgtggcctcccggatgtgtctgacccctggtcagggatgcggacatcaagggcaggacgaaggccctctgcctgccccatcaccacctcctgcaatgagctctagtaggaaggaccatctgggcgcatcctcatctgaaccacttccagtgattatcgttggtaacggaccctccggaatatgcttgtcttacctgctgagcgggtacacaccgtataccaaaccggacgcaattcatcctcaccctctgctgcagcggaagctgacggaggcccctggcgtgagcattcttgatcaggatctggactatctttcagagggactggaaggcagaagccagtcccctgttgcactcctgtttgatgccctgctgagaccagacaccgatttcggtgggaatatgaaaagcgttctgacatggaagcacaggaaggagcacgcgatacctcatgtcgtgctggggaggaacttgccagggggtgcttggcatagtatcgagggctccatggtcattttgtctcaagggcagtggatgggcttacccgacctggaggtcaaagactggatgcagaagaagcggcgaggactaaggaatagccgtgctaccgcaggagatattgcccactattaccgggactatgttgtcaagaaggggcttgggcacaacttcgtcagtggcgctgtggtcaccgccgttgaatggggcactcccgatccctcatcctgtggcgcacaggattcatcaccactgttccaggtatcgggtttcttgacaagaaatcaggctcaacagccattctcactgtgggcacggaacgtcgtgctggcaactgggaccttcgactctcctgccagactgggaattcccggagaggcactgccctttattcatcacgaactcagtgctctggaagccgctacaagggtcggcgctgtcactccagcctcagatcccgtgctgattatcggcgcaggtcttagtgctgccgacgctgtgctgtatgccagacactacaatatcccagtgattcatgcgtttcgcagagccgtggacgacccaggcctggtgttcaaccagcttcccaaaatgctgtacccagaatatcacaaggtgcaccagatgatgagggaacaatcaatcttgtcccccagtccctacgagggctaccgcagtctgcctcgccatcaacttctatgctttaaagaagactgccaggccgtgttccaggatctcgagggagtggagaaagtcttcggggtgtctctggtgcttgtcctcattggctcccatccagacctgagtttcctgcccggagctggtgcggattttgctgtggaccctgaccagccactgtcagccaaacggaatcccatcgatgtggatcccttcacctaccaatctacacgccaggaaggcttatacgcaatgggcccactggccggagataatttcgtaagattcgtccaggggggtgctctagccgtggccagttccttgctcaggaaagagaccaggaagcccccatag

SEQ ID NO: 58082 - DNA, 1434 bp, Artificial Sequence
  Description of Artificial Sequence: Synthetic coding sequence
atgtcatcaagtcggaaagaccacctaggagcctcctcttccgagcccctgcctgtgattattgtgggcaacgggccatccggcatctgtctgtcttacctactgagcggatataccccgtatactaaaccagatgccattcacccacatccactgctgcagagaaagctgacagaagcacctggagtgtccatcctcgaccaggatttggactacttatctgaaggcctggaaggtcggtcacagtctcccgtggccttgcttttcgacgccctgcttagacccgatactgacttcggaggcaatatgaaaagcgttctaacgtggaagcatcgcaaagaacatgccatcccccatgtggtcctcgggaggaacctcccaggaggtgcatggcactccatcgaggggtcgatggtgatcctgtcccaaggccagtggatgggcctgccagacctcgaagtgaaagactggatgcagaaaaaaagacggggactgcgcaactctcgagcgaccgctggggacattgcccactattatagggactatgtggtcaagaagggactagggcataacttcgtgagtggggcagtcgtgaccgcagtagagtggggaacacccgacccctcttcctgcggggcacaggatagctcacccttatttcaggtgagtggctttctaactaggaaccaggcccaacaacctttctctctctgggctcggaatgtagtgctggcgactggaactttcgattcccccgctaggctcgggatccctggagaggctctgcctttcatacaccacgaattatctgccttggaagctgctactagggtcggggctgtgactccagcttccgacccagttctcatcatcggcgcagggctgtccgccgcagatgcagttttatacgcacggcattataacatccctgtaattcatgcattcaggagggcagtggatgacccgggtttggtgtttaaccagctccctaagatgttgtaccctgagtaccataaggtccaccaaatgatgcgggagcagtccatcctgagtccctccccttacgagggatataggtctctgcctagacatcaattactgtgctttaaagaagattgtcaggccgtgtttcaggacttagagggggtcgagaaggtttttggtgtgtctctggtgcttgtacttatcggctctcaccctgacctttcctttctgcccggagccggagccgattttgcagtggaccctgaccagcccctgagcgcaaagcgaaatccaattgatgtagaccccttcacctatcaaagcacccgccaagagggcctctacgctatgggccctctggccggagacaattttgtaaggttcgtccaaggaggcgcattagccgtggcgagctccctgttgaggaaagaaacccgcaagccaccatag

SEQ ID NO: 58083 - DNA, 1434 bp, Artificial Sequence
  Description of Artificial Sequence: Synthetic coding sequence
atgtctagcagcagaaaagatcatctgggtgcaagcagctcggaacctctcccggtgatcattgtggggaatggcccaagcggcatttgtttgtcataccttctctctggctacaccccctatacaaaaccagatgctattcaccctcatcccctgctccagaggaaattgactgaggctccgggagttagtattctggatcaggacttagactacctgagcgagggcttagaaggacggtcccagtctccagtggcacttttatttgacgctcttctgcgacccgacacagattttggcggaaacatgaagtcagtgctcacctggaaacacaggaaggagcatgctatcccccacgtcgtcttgggtagaaatctccctgggggtgcatggcacagtatagaagggtctatggtcattctgagccaaggacaatggatgggcctgcccgatctcgaggtcaaggactggatgcagaagaagcggagggggctgcgaaatagtagagcaaccgctggcgatatcgcccactattatcgcgattatgttgtcaaaaaaggcctgggccataacttcgtgtctggggctgtagtcacagcggtcgaatgggggacccctgaccccagctcctgcggggctcaggactctagtccactatttcaagtttccggctttctcaccaggaatcaggctcagcagcctttcagtttgtgggcaaggaatgttgtgttagccactggtacattcgactcccccgctcgcttgggcatccctggtgaagccctgccttttatccaccatgagttgtctgcgctggaagccgcaacgcgggtgggagccgttaccccggcatcagatcctgtgttaataatcggggcaggactttccgccgcagatgccgtcctgtacgctaggcactataatattccagtgatccatgcctttcgcagagctgtcgacgatcctggcctggtattcaaccaactcccaaagatgctctatccagagtaccataaagtgcaccagatgatgcgggaacagtctatcttaagcccttccccatacgagggatatcgcagtctaccgaggcaccagctgctgtgttttaaggaagattgccaggccgtcttccaggatctggaaggcgttgagaaggtgtttggcgtgtcactcgtcctcgtacttataggtagccacccagacttgtcgtttctgcccggagccggtgcagactttgccgtggatccagaccagccacttagtgcgaagaggaaccccatagatgtagacccattcacttaccagtccacacgccaggaaggactgtatgccatggggcctctggccggtgataattttgttcgtttcgtgcagggaggagccctggccgtcgccagcagcctgctgaggaaagaaacgcgcaaaccaccttag

SEQ ID NO: 58084 - DNA, 1518 bp, Artificial Sequence
  Description of Artificial Sequence: Synthetic coding sequence
atgccccttgttgaagagacatctctgttagaagactccagtgtgactttccccgtcgtcattatcggaaatggcccaagtggaatctgcctgtcttatatgttgtctggataccggccttacctgtccagcgaggccatacaccccaatacaatccttaactccaaactcgaagaggctagacatttgtccattgtggatcaagatcttgagtatttgtcagagggattggagggcagaagtagtaacccagtggcagttttgtttgatacacttctgcacccagatgccgacttcggatatgattaccccagtgtgctacactggaagctggagcagcatcactatatcccccatgtggtcctgggcaaaggacctcctgggggagcctggcacaacatggaagggtcaatgctgactattagcttcggaagctggatggagctgccgggacttaagttcaaggattgggtgtcgagtaagagacgatccctgaagggggatcgcgttatgcctgaagaaattgctagatattacaaacactatgtcaaggtgatgggccttcagaagaattttcgggagaacacttatatcacaagtgtgagccgactatatagggaccaggatgatgacgatatacaggatagagatatctcaacaaaacacctgcagatcgaaaaatcaaatttcattaagaggaactgggaaattcggggatatcagagaatcgctgatggctctcacgttccgttttgcctctttgcagaaaacgtcgcactggccacagggaccttggattcccctgcgcacttagagatcgagggggaggacttcccatttgtgttccacagtatgccagagttcggtgcagccataaacaaaggaaagctgcgcggaaaggtcgacccagtgctgatcgttgggtctggacttactgccgctgacgcagttctctgtgcctataatagcaatatccccgtgatccacgttttccggaggcgtgtcaccgatccctctctcatctttaaacagttacccaaaaaactgtatccagaatatcacaaggtgtaccacatgatgtgcacacaatcctattccgtcgactctaacctccttagcgactatacttcattccccgagcaccgggtgttgtccttcaagtctgacatgaagtgcgtcctccagtctgtctctggactcaaaaagatcttcaagttaagcgctgctgtcgtcctcatcggcagtcatcccaacttaagcttcctcaaggatcagggatgttatttaggccataagtcatctcaacctattacatgtaaaggaaatcctgttgaaatagatacttatacctacgagtgcatcaaagaggccaatctgttcgccctgggacccttggttggcgataattttgtgcgattcttgaagggaggggcactcggggtgaccagatgtctggccacaaggcaaaaaaaaaaacacctgttcgtcgaaagaggaggtggcgacgggattgcttag

SEQ ID NO: 58085 - DNA, 1650 bp, Artificial Sequence
  Description of Artificial Sequence: Synthetic coding sequence
atgccggtgtggtgctgccgctgttctctagctggacacttccgtaactatagcgacacagaaactgaaggcgaaatctttaacagtctggtgcagtacttcggcgataatcttggtagaaaggttaaggcaatgcctctagtggaggagacctcgctgttagaagacagcagcgtgaccttccctgtggtgattatcgggaacggcccttccggcatctgtctctcttatatgctgagcggctaccgcccttacttgtcgtctgaggccattcatcctaacacaattctaaacagtaaattggaagaagcccgacacctgagcattgtggaccaggacctcgagtatctgagtgaaggcctggagggaagatcttcgaacccagtggctgtactgttcgacaccctgctacatcctgatgccgactttggctacgactacccttcagtcctgcactggaagctcgaacagcaccactatatcccccacgtggtgctgggtaagggaccacccggaggggcttggcacaatatggagggtagcatgctgacaatttcattcgggagctggatggaactgcccggtctgaaatttaaagattgggtctcttctaaacggagatcactgaagggcgaccgcgtgatgccggaagaaatcgccaggtattataaacactacgtaaaggtgatgggcctgcaaaaaaacttccgcgagaacacctatatcaccagcgtctctcgactgtatcgagatcaggacgatgatgacatacaggatcgggacatctccaccaagcaccttcagatcgagaagtctaatttcatcaagcggaactgggagattagggggtaccagagaatcgccgacggttcacacgtgcccttctgtctatttgcggagaacgtggctctcgcaacggggacgctcgactctccagcacatttggagattgaaggtgaggattttccttttgtttttcacagtatgccagagttcggtgccgctatcaacaagggcaaactgcgaggcaaggtggacccagtgttgatcgtcggatccggcctcacggctgccgacgccgtcttgtgtgcatataatagcaatattcctgtgatacacgtcttcaggagacgtgtcacggacccatccctgattttcaagcagctgcctaagaagctttaccctgaataccataaggtgtaccacatgatgtgtacgcagagctacagcgtggatagtaacttactgtcagactacacctctttccctgaacacagggtgctgtcatttaaaagcgacatgaagtgcgtcttgcaatctgtatctggcttaaagaaaatttttaagctgagtgctgccgtggtgctgatcggctctcatcccaatctctctttcttgaaggatcaaggctgctacttaggtcacaaaagctcccagccgatcacgtgcaaaggtaaccccgtggaaatcgatacttacacatatgagtgcattaaagaggccaatctgttcgccctagggcctttggttggggacaacttcgtgaggtttctgaaaggcggagcacttggagtgactaggtgtctcgctacaaggcagaagaagaagcatctgtttgtggagcgcggaggaggagatggaattgcgtag

SEQ ID NO: 58086 - DNA, 1584 bp, Artificial Sequence
  Description of Artificial Sequence: Synthetic coding sequence
atgtctgaagatagcagtgccctgccgtggtcaatcaatagggacgattatgagctgcaggaagtaattggcagcggggctacagccgtggtacaggcggcatactgtgctcccaagaaggaaaaggttgcaattaagaggattaatttggaaaagtgccagacttccatggacgagctcctcaaagaaatccaagcaatgtctcagtgccatcatccaaacattgtcagttattacacaagtttcgtggtgaaggacgagctctggctggtgatgaaattgctaagcggagggagcgtgctcgacataatcaagcacatcgtggctaagggcgaacacaaatccggcgtactggatgaatcgaccattgccactatactgagagaggtgctcgaggggctggagtacctgcataagaatggccaaatacacagggatgttaaggctgggaatatcctactcggcgaagacggaagcgtccagatcgcagatttcggggtttccgcgttccttgctacaggaggcgatatcacaagaaacaaagttaggaagacgtttgttggcactccctgttggatggcccctgaagtgatggaacaggtgcggggttatgactttaaggcagacatctggagttttggcatcaccgccatcgaattggcaaccggggcagctccttaccacaaatatcctccaatgaaggtcttgatgctgacactgcagaatgacccaccgtcgctagaaacaggagtccaagacaaggagatgttgaagaaatacggcaagtcattcaggaaaatgatctccctgtgcttacagaaggaccccgagaagcggccaacagccgcagagctcctgcgccacaaattttttcagaaagctaagaataaggaatttctgcaggagaagaccctgcagcgcgctcctactatcagcgagcgcgcaaagaaggtcagacgggttcccggaagcagtgggcgtcttcacaagaccgaggatgggggttgggagtggagcgacgacgagttcgatgaggagtccgaggagggcaaagccgcaatatcacaactccggtcccccagagtaaaggaatccatcagtaattccgaactcttccccaccaccgatccagtcggcacacttcttcaggtcccggaacaaatcagcgcccatctcccacaaccagcgggacaaattgcaacccagccaacccaggtgagcctgcctccgacagccgaacctgccaaaaccgcccaagcgctctcatctgggtccggttcccaagaaaccaaaatccccatctctcttgtgcttcgtctcaggaacagcaaaaaagaacttaatgacatcaggttcgaatttacccctggaagagatactgccgagggagtttcccaggagctaatttccgctggtttggtggatgggagagatctggtcattgtggccgcaaacctccagaagatcgtggaagagcctcagtctaaccgatctgtgacctttaagttagcgagcggggtcgaggggagtgatatacccgacgatggaaagcttattgggttcgcacagctttcgattagttag

SEQ ID NO: 58087 - DNA, 309 bp, Artificial Sequence
  Description of Artificial Sequence: Synthetic coding sequence
atgtccgctcgagtgagatccaggtcacggggtcgaggagatgggcaggaggcacccgacgtggtggcgtttgtcgctcctggcgaaagccagcaagaagaaccaccgaccgataaccaagacatagaacccggacaggagagggaaggcaccccacccattgaggagcggaaggtcgagggcgactgtcaagaaatggatttggagaagacccgtagcgagcgcggagacggcagcgacgtgaaagaaaagacgcctcccaatcctaagcacgctaaaactaaggaagctggtgatggccagccatag

SEQ ID NO: 58088 - DNA, 336 bp, Artificial Sequence
  Description of Artificial Sequence: Synthetic coding sequence
atgtcagagcatgtgcggactaggagccaatcttctgaacgaggaaatgaccaggaatcttcacagcctgtagggtcagtgatcgtccaggaacctacagaggagaagcgacaggaagaggagccacccactgacaatcagggaattgcccctagcggagagatcgagaatgagggcgctccggctgtccaaggtcctgatatggaggcattccagcaggagttggccttgcttaagattgaagatgagcccggtgacggcccagacgttagagagggaattatgcccacattcgatctgacgaaagtgttagaagcgggtgacgctcaaccttag

SEQ ID NO: 58089 - DNA, 285 bp, Artificial Sequence
  Description of Artificial Sequence: Synthetic coding sequence
atgtctgaacatgtgaggactcgctcccaatcatccgaaaggggcaatgatcaggagagttctcagcccgtgggcagtgtgattgtgcaggagcccacagaagagaaacgccaagaggaagagccccctacagacaatcaggggcctgacatggaggcgtttcagcaggaactggcccttctgaaaatagaagatgagccaggcgacgggccagatgtgcgggaagggatcatgccgacttttgatctaacaaaggtactcgaagccggtgatgctcagccatag

SEQ ID NO: 58090 - DNA, 393 bp, Artificial Sequence
  Description of Artificial Sequence: Synthetic coding sequence
atgcaagccccttgggcaggcaatcggggttgggccggaactcgggaagaagtaagggatatgagcgaacacgtcactcgatcccagtcatccgagcgagggaatgaccaggaatccagccagccagtcgggccagtcattgttcagcaacctacagaggaaaaacgccaggaggaggagccaccgaccgacaatcaggggattgcgccaagcggcgaaatcaagaatgaaggcgctcccgctgtccaggggaccgatgtggaggcgttccagcaggagctggctctgttgaagattgaggacgcccctggcgacggtcccgacgttcgcgagggtacactgcctacattcgatcctaccaaggtgcttgaggcaggcgaaggacagctgtag

SEQ ID NO: 58091 - DNA, 282 bp, Artificial Sequence
  Description of Artificial Sequence: Synthetic coding sequence
atgtcagagcacgtgacaaggagccagagctctgagcggggaaacgaccaggagtcatcccagccagtaggccctgtgatcgtgcagcaacccacagaagaaaaaagacaggaggaggagccgccaactgacaatcaggggaccgacgtggaagccttccagcaggagctagccctcctgaagatcgaggatgcgcctggggacgggccagacgtccgagaaggtacactacccacattcgaccctactaaggtgctggaggcaggcgaaggtcagctctag

SEQ ID NO: 58092 - DNA, 333 bp, Artificial Sequence
  Description of Artificial Sequence: Synthetic coding sequence
atgagcgagcacgttacgcgcagtcagagtagcgagcgaggaaacgatcaagagtcatcccaacccgtgggccctgttattgtgcagcaaccaaccgaggaaaagcggcaggaggaagagcctccaaccgacaaccagggaattgctcccagcggagagatcaagaatgaaggcgctccggctgtgcagggcaccgatgtcgaagcctttcaacaggaactggccctgcttaagattgaggatgcacccggagacggtcccgatgtgcgggagggcactttgcccaccttcgacccaacgaaagttttagaggcgggtgaagggcagctgtag

SEQ ID NO: 58093 - DNA, 3273 bp, Artificial Sequence
  Description of Artificial Sequence: Synthetic coding sequence
atggctgaagcagagctgcacaaagagcgcctgcaggcaattgccgagaaacgaaagcgtcagacagagatcgaaggaaaacgccaacagttggatgagcagattctacttctgcaacattctaagtcaaaggtactgcgagagaaatggttgctccaagggataccagctggcaccgccgaagaggaggaagcaagacggagacagagcgaggaagacgagttccgggtcaagcagctggaggacaacatacaaaggttggaacaggagattcagacgctggagtcggaagaatcccagataagcgctaaggagcagataatcctggagaaacttaaagaaaccgaaaaatctttcaaagatttccagaagggcttttcgtctacggatggcgacgctgtgaattacatatccagtcagcttccggacctcccgattctgtgcagccgcacagcagagcccagcccaggacaggacggaacctccagggccgcaggcgtcggatgggaaaacgtgctactcaaagaaggtgaaagcgctagcaacgctactgaaacttcaggacctgatatgaccattaagaagccccctcagttgagtgaggacgacatctggctgaagtcagaaggcgataactactctgctaccctgctcgaaccagctgcatcttcactgagtccggaccataagaatatggaaatcgaagtctccgtcgccgagtgcaagtccgtgccaggaattacatctacccctcaccctatggaccaccccagtgctttttactcccccccacataacggtctgctaacagaccaccacgagagccttgacaatgatgtggctcgagaaatccggtacctggacgaagtgctcgaggccaactgttgcgactctgccgtggatggaacatacaatgggacatcatcgccagagcccggagccgtcgtgctcgtcggtggcctctccccccctgtccatgaggctacgcagcctgaacccacagagcggactgcatcacgccaggctcctccccatattgaactgtcaaactcatcccccgaccccatggcggaagcagagagaaccaacggccattctcccagccagcctcgagacgcacttggagattctttgcaggttcccgtcagccctagcagcacaaccagtagcagatgttccagcagagatggggagttcacgctgacgaccctaaaaaaggaggctaaatttgagctccgggctttccatgaggataagaagcctagtaagttattcgaagatgatgaacacgagaaagagcagtattgtatacgcaaggttagaccatcagaggagatgttggagcttgaaaaagagagaagggagctgattcgctcgcaagccgtcaagaaaaatcccggtatcgccgcaaagtggtggaacccgccacaggagaagaccatcgaagagcaactcgacgaggagcacttagagagccataagaagtataaagaacgaaaagagcggagggcccagcaagaacagctccttctgcagaaacagctgcaacaacagcagcagcagcctccctctcaactgtgcacagctccagcgtcttcccacgagcgggcttcaatgattgacaaagcgaaggaagacatagtgacagagcagattgacttttcggctgcccgaaagcagttccagctaatggaaaattcaagacaggcagtggctaaaggccagtccaccccaagactgttttcaattaagccattctaccgccctttaggaagtgtgaattccgataagccattgacaaatccacgcccaccttctgttggcggacctcctgaggattccggcgcttcggccgcaaagggacagaagtctcccggtgctctcgagactccttcggccgctggcagccaggggaataccgcctctcaggggaaagaaggaccctacagcgaaccatccaagcgcggtccattgagtaaactgtgggcagaggatggggaattcacatcagcaagggcggtgctgacagttgttaaggacgacgaccatgggatccttgaccagttctctcggagcgtgaatgtctccttaacacaggaggaactcgactctggattggacgaattgagcgtgcgctcacaggacaccacagtgcttgaaaccctcagcaacgatttcagtatggacaatatctctgacagtggggcaagcaacgaaactactaacgcactgcaggagaacagtctggctgacttttctctgcctcagactccacaaacggataacccatccgaaggaaggggagagggcgtcagtaaaagcttcagtgaccacggcttttactcgccttcctccaccctaggtgattcgcccttagttgatgatccactggagtatcaggctggactgttggtgcaaaatgccattcagcaggctatcgctgagcaggtagataaggcggtgtccaagacatcgcgcgacggggctgagcagcagggtcccgaggccacagtggaggaggccgaggccgctgctttcggttcagagaaacctcagagtatgtttgaaccccctcaggttagtagccccgttcaggaaaagcgggacgtgctgccaaaaattctgccagctgaagatagagctctcagggagcgtgggccaccccagccgcttcccgctgtgcagcccagcggaccaattaatatggaggagacgagaccagagggaagctattttagcaagtactcagaggctgccgagttacggtctactgccagcctgctggcaacgcaggagtctgacgtgatggtggggccatttaaacttcgttcacggaagcagcgcaccctctccatgatcgaagaggaaatccgggctgctcaagagagagaggaggagttaaagaggcaacgccaagtgttgcagtctacccagtcgcccagaaccaagaacgcaccttccctgcccagccgcacgtgttataaaaccgcaccgggaaagatcgagaaagtgaagccccctccatcacctaccaccgagggcccttctctgcagcccgacctggcccctgaggaggctgcaggaacccagcgacctaaaaacctgatgcagactttgatggaagactatgagacacacaagtcgaagcgcagagagaggatggacgactcgtctgtgcttgaagcaacccgcgtcaatcgtcgcaaatcggctttagcactgaggtgggaggctggtatatatgctaaccaggaagaagaggataacgaatag

SEQ ID NO: 58094 - DNA, 3312 bp, Artificial Sequence
  Description of Artificial Sequence: Synthetic coding sequence
atggccgaggccgaactccacaaggagcgattgcaggccattgcagagaaaagaaaacgccaaaccgaaattgagggcaagaggcagcagctcgatgaacagatcctcctgctacagcatagcaagtccaaggttctacgtgaaaagtggctactgcaggggatcccagcgggaactgccgaagaggaagaagcacggagacgccagagcgaggaggacgagtttcgggtgaaacagctggaggacaacatacagcggctggaacaggaaattcagacattagagtccgaagagagccagatatcggctaaggagcagatcatcctagaaaagctcaaagagaccgagaagtctttcaaggactttcagaaggggttttccagcaccgacggggatgcagttaattatatctcgagccagctgcctgatctcccaatactctgctcccgtacagcagaacctagtcccggacaggacggaacgagccgggctgctggagtaggttgggaaaatgtgcttctcaaggagggcgagagcgcatcaaacgcaaccgaaacatccggacctgacatgactattaagaagcctccccagctgagcgaggacgatatttggttgaagtctgaaggggataactacagcgcgactttattagaacccgcagcgtctagcctaagtccggaccataagaatatggagatcgaagtttcagtggccgaatgcaaaagtgtgcctggcattacctccaccccccatcccatggaccacccttccgcattttattcaccgccacacaatggactcctcacagaccaccacgagtccctagataacgatgtggcacgcgagattaggtatctcgatgaggtgctcgaggccaactgctgcgattctgcagttgacggcacatataacggcacatcatcacccgaacccggagctgtggttttggttggtggtctgagccctccagtgcacgaagcaactcagcctgagcccacggaacggacagcttcacggcaggctccccctcacatcgagttgtctaactctagtcctgatcctatggctgaagccgaaaggacgaacgggcactcaccgtcgcaaccccgagacgccctcggcgactcccttcaggttcccgtctcaccatcgtccacgaccagctcacgatgctcaagtcgggacggtgagttcactttgacgaccctaaaaaaagaggcgaagttcgaactacgggctttccacgaggacaagaaaccgagtaagttattcgaagatgacgaacacgaaaaagaacagtactgtattcgcaaggtgagacctagcgaggaaatgctagagctggagaaggagaggagagagctaatacggtcccaggccgtgaagaagaaccctggcatcgctgcgaagtggtggaaccctccgcaagagaaaaccatcgaggagcagctggacgaagagcacctggaaagccataagaaatataaagagcgaaaggaacgtcgagcgcagcaggagcagctgcttctacagaaacaactgcagcagcagcagcagcaaccaccttctcaactgtgcacagccccagccagttcccacgaaagagcctcgatgattgacaaggctaaagaggacatcgtgactgagcagattgacttcagcgcagccagaaagcagttccagctgatggagaatagtagacaggcagtagccaaaggtcagtcaacaccccgattatttagtattaaacctttttaccgtcccctgggttccgttaactccgacaagcccctgacaaatccgaggcccccaagcgtgggaggccctcctgaagactcaggagcatccgctgctaaaggacaaaagtccccaggggctctggaaactccctcagctgctggctcccagggaaacacagctagtcagggcaaagaaggtccatattctgagccttccaaacggggacctttgtccaagctgtgggcagaggacggtgaattcactagtgctagagccgtgttgaccgtcgtcaaggatgacgaccatggcatacttgaccagttcagcagatcggtgaatgtgtctctcacccaagaagagttagactcgggccttgatgagctgtctgtacgctcacaggacacgaccgtcttagaaacactgagcaatgacttctcaatggacaacatctctgactctggtgcatccaacgagacaactaacgccctccaggagaatagtctggctgacttctctctgcctcagacgccccagacggacaacccgtctgaggggagaggggaaggcgttagcaagtctttcagcgaccacggcttttactcacccagttccactctgggagactctcccctagttgatgaccctttggaataccaggctggacttctagtgcagaatgctatccaacaggctatcgccgagcaggtagataaggcggtgagtaagactagcagagacggcgctgagcaacagggacccgaggccaccgtcgaggaagctgaggccgcagcctttgggtctgaaaaacctcagtcaatgttcgaacccccacaggtgtcttcccctgtgcaggagaaacgcgacgtgctgccaaaaatacttcccgctgaagaccgcgcattgagagagaggggtccccctcaacctttaccagccgtgcagccatcggggccaattaatatggaagagaccaggcccgaggggtcatatttctcgaaatatagcgaagctgcggaactgagaagtaccgcctcattactagctacccaggaaagcgatgtgatggtgggtccatttaagctgcgatcacgaaagcaacggaccttgtccatgatcgaggaagaaatccgcgcagcacaagagcgcgaggaggaattgaagcggcagcgtcaggttcttcagagtacacagagtccccgtacaaaaaacgccccttccctgcctagccggacttgctacaagaccgctcctggaaagattgaaaaagttaaaccaccacccagtccaaccaccgagggaccttcattgcagcctgacttggctcccgaggaggccgcagggacacaaaggcccaaaaacctcatgcagaccctcatggaggactatgaaacacacaagtcaaagcgccgtgaacgtatggacgacagcagttacacctcgaaactgttgtcatgtaaggtcacatccgaggtgctcgaagccactagagtcaacagacgcaaaagcgcattggctctccgatgggaagcaggcatatacgctaaccaggaagaggaagacaacgaatag

SEQ ID NO: 58095 - DNA, 1302 bp, Artificial Sequence
  Description of Artificial Sequence: Synthetic coding sequence
atggcagaggctgaactgcacaaggagcgactccaagccatcgccgaaaaaagaaagagacagacagaaattgagggcaagagacagcagctcgacgagcagattctattactccaacactctaagtctaaagttttgcgagagaagtggctgctccaaggcatccctgctggcactgctgaggaagaggaggctcggaggaggcagtctgaagaggatgagttcagagtgaaacaactcgaggataatatacagcggctggaacaagaaatccagaccctggagagcgaagaaagccagatctccgccaaagaacagatcattcttgaaaaactcaaagaaacggaaaaatcatttaaggattttcagaaagggttctcctcaaccgacggggatgccgtaaactatatatcttcccaattaccggacctgcctatcctttgtagccgcacagctgagccaagtcccggacaagacggaacgtcccgcgcagcagccgtttacgcaatggagattaatgtggaaaaggacaagcaaacaggagagacaaagattctgtccacttcaacaataggacctgaaggagtgcaccagaagggggtcaaagtctatgacgatgggacaaaggtagtgtacgaggtccgaagcggtggcacagtagtggagaatggtgtgcataaactatcaaccaaggatgtggaggagctaatccagaaggccggacagtcgtccctcggcggaggccatgtatcggagaggacggtcattgccgacggcagcttgagtcatcccaaagaacacatgctgtgtaaagaagctaagctggagatggtacacaaaagcaggaaagatcactcgtccggtaatccaggtcagcaggctcaggcaccttcagccgctggccctgaggccaacttggatcaacccgttacgatgatcttcatggggtaccagaatattgaggacgaagaggagaccaagaaagtgctaggctacgatgaaactatcaaggctgaattagttttgattgatgaagacgatgaaaaaagtctccgagaaaaaaccgtgaccgatgtgagcacaatcgatggcaacgccgcagagctcgtgtcgggccgaccagtttctgataccaccgaaccaagctctcccgaaggaaaagaggaaagcctggccacagagccggctccaggcgtgggctgggagaatgtgctgttgaaggagggagagtcggctagtaatgccactgaaacgtcggggccagacatgactataaagaaaccacctcagctcagcgagtag

SEQ ID NO: 58096 - DNA, 1404 bp, Artificial Sequence
  Description of Artificial Sequence: Synthetic coding sequence
atgctgattttttggactatcaccctcttcctgttgggggctgctaaaggcaaggaagtgtgctacgaggaccttggctgctttagcgacacagagccctgggggggtaccgccatcagaccactgaagattctgccttggtctcccgaaaaaattggaacccgatttctgctgtacacaaatgagaatccgaataacttccagattttgctgttgtccgacccctctacgattgaagcatctaactttcagatggaccgcaaaacccgctttatcattcacggcttcattgacaagggtgatgagtcatgggtgacagatatgtgcaagaagctctttgaagtcgaggaagtgaattgtatctgcgtcgactggaagaaggggagccaggccacttatacccaagcagccaacaatgtgagggtagtcggcgctcaggttgcacagatgttggacatcttgttaactgagtatagctaccctccttcaaaggttcatttgattggtcactccctgggagctcacgtggctggcgaagcaggatctaaaactccaggcctgagccgtatcacggggctggatccagtggaagcctccttcgaatcaacaccagaggaggtgcgcctcgatcctagcgatgctgacttcgtggacgtgatacatacagacgccgcacctcttatcccgttcctcggcttcggcacaaatcagcaaatgggccacctcgatttcttccccaatggcggagagtcgatgccgggatgcaagaagaatgccctttctcagatcgtggacctggacggaatctgggctggaacccgcgacttcgtcgcctgtaatcatctgcggagttacaagtactacttggaaagcattctgaacccagatggatttgccgcttacccgtgtacgagttacaagagtttcgagagtgacaagtgcttcccctgcccagaccaaggctgcccacagatgggacactatgccgataaattcgccggacggacaagcgaagagcagcagaagttttttttgaacacgggagaggctagtaacttcgccaggtggcgctatggcgtaagtataacactgagcgggagaactgccactggacaaattaaggttgcattgttcggcaacaagggcaatactcatcagtattccatctttagaggtatcctcaaacccggttcaacccactcttatgagtttgatgccaagctcgatgtggggaccattgagaaggttaagttcctgtggaataataacgtgattaatcctaccctgccgaaggtaggggctaccaaaatcaccgtccagaagggtgaagagaagacagtctataacttctgctctgaggatactgtgcgggaggacacgctgctcacgctgaccccatgctag

SEQ ID NO: 58097 - DNA, 1407 bp, Artificial Sequence
  Description of Artificial Sequence: Synthetic coding sequence
atgctccctccatggacgcttggactgctgctgctagcaacagttcgcggaaggaaagtgtgctatggacagctgggctgcttttctgatgagaagccttgggcgggtactcttcaacgtcccgtaaaactcctgccttggtcgcccgaggacatagacacccggttcctgctgtataccaatgagaaccccaataacttccagcttatcacagggaccgagcctgacactatcgaggcctccaactttcagctcgatagaaagacacgatttattatccacggcttcctggacaaggctgaggattcatggccaagtgatatgtgcaagaaaatgttcgaagtggaaaaagttaactgtatttgcgtggactggagacacggaagcagggctatgtatacccaggctgtccagaacattagagttgtcggcgctgaaactgccttcctcatccaggccttatcgacccaactgggatacagtctagaggacgtccacgttatagggcattcgcttggagctcatacagcagcggaagctggtagacgccttggcggtcgagtgggcaggataaccggcctggaccccgctggtccatgtttccaggacgagccagaagaggtcaggctggatccatctgatgccgtgtttgttgacgtcattcacaccgattctagtccaattgtgccatcattaggttttggtatgtcacagaaagtgggacatctcgacttttttccaaacgggggaaaagagatgcccggttgtaagaaaaacgtcctatccaccatcactgatatagacgggatatgggaggggatcggcggatttgtgagctgcaatcacctccgttcctttgaatattattcctcatctgtgctgaaccccgatggcttcttgggatatccctgcgcatcctatgacgagtttcaggagagcaagtgcttcccctgccctgccgagggctgtcctaagatgggccactatgctgatcaatttaagggaaagacaagcgccgtggagcagaccttttttttgaacactggggaaagcggcaacttcacatccaagtacaagatttccgttacattgtctgggaaggagaaggtgaatgggtatattcggattgcactttatggaagtaacgaaaattccaagcagtatgagatttttaaaggatcgctcaaaccagacgccagtcatacttgcgccatcgatgtggatttcaacgtcggtaagatacagaaggtcaagttcctttggaacaagcgaggaatcaacctcagcgaaccaaagctgggtgcttctcagatcactgttcagtctggagaagatggcacagagtataacttctgctcctcagataccgtggaagagaacgtgctgcaatcgttatacccatgctag

SEQ ID NO: 58098 - DNA, 423 bp, Artificial Sequence
  Description of Artificial Sequence: Synthetic coding sequence
atggcagcgatcccttcctccggtagtctggtagccacgcatgattactaccgaagaagactggggagtaccagttccaactcttcctgtagcagcacggaatgtcccggtgaagcgatcccacatcctccaggagagtgccgcatagctcccttttccccaaggagtagcaggagctggcagcatcaggatccaaccagcctgctctcaggcctgccaaaggctgatcctggtcactggtgggcttccttcttcttcgggaagtctaccctgcctttcatggccaccgtcctagagagtgctgaacactcagaaccaccacaggcttcctcttccatgactgcatgcggtttggcgagagatgctcctcgcaaacagccagggggtcaatcttcaacagcaagtgctgggcctcctagttag

SEQ ID NO: 58099 - DNA, 213 bp, Artificial Sequence
  Description of Artificial Sequence: Synthetic coding sequence
atggcagcgatcccctccagtgggtcattagtggcaacccatgactattatcgaagaaggttaggctctacatcctccaactcctcctgcagttccacggaatgccctggggaggctatcccacatcctcccggattgccgaaagcagaccccggacactggtgggcctcatttttttttggaaaatccaccttgcctcctcccaccctctag

SEQ ID NO: 58100 - DNA, 345 bp, Artificial Sequence
  Description of Artificial Sequence: Synthetic coding sequence
atggccgcaattcccagctctgggagcctggtcgccacccatgattattaccgcaggagattgggctcgacaagcagtaattccagctgcagttctaccgaatgccccggtgaagcaattccgcatccaccaggattacccaaggctgacccagggcattggtgggcaagttttttctttggtaaatcaacattgccgttcatggctacagtgctggagagcgctgaacacagtgagcctccacaagcaagctcatctatgaccgcttgcggactagccagggacgctccaaggaagcagccaggtgggcagtcgtctacagcctcagcgggacctccatcctag

SEQ ID NO: 58101 - DNA, 1860 bp, Artificial Sequence
  Description of Artificial Sequence: Synthetic coding sequence
atgtataggagcggggagcgcctgttaggctcccatgctttgccagccgaacagcgagacttcctgccactggaaaccaccaacaataataataaccaccaccagcccggagcctgggctcgccgagccggaagctcagcctcgagccccccatcggcctccagcagtccccacccatcagcagccgtgccagccgcagatccggctgatagcgcctcaggttccagcaacaagagaaagagagacaataagccatcaggaggcagggcagctggcggaggaagagcagacggaggtggcgtagtgtattcaggcaccccctggaaaaggagaaactacaatcagggcgtggtgggcctgcacgaagaaattagtgatttttatgagtacatgtcgcccagaccagaggaagagaaaatgcggatggaggtggtcaacagaattgagtctgtcatcaaggaattgtggcctagtgctgacgtgcagatctttggctcattcaaaaccggattgtacctacccacatcagacatagatttggttgtcttcgggaaatgggagaacctgcccctttggacactggaggaagcactgagaaaacataaggtggctgacgaggactcagtgaaagtgcttgacaaggcaacagtgccaataattaagctgactgacagttttacagaagtcaaagtcgacatcagctttaatgtgcagaacggggtgagggcagctgaccttatcaaagattttaccaagaagtaccctgttttaccctatcttgtcttggtattaaagcaatttcttctgcagagggatctaaacgaggtctttactggcggtatcgggtcatactctctgtttctcatggccgtctctttcctgcagcttcatccaagagaagacgcctgcatccccaacaccaattatggagtcctcttaattgagttcttcgaattgtatggaaggcacttcaactatctgaaaacgggaataagaattaaggacggtggttcctacgtcgccaaggacgaggtgcaaaaaaacatgcttgacgggtataggccatccatgctgtacatcgaagaccctctccagccaggaaacgacgtgggcagatcttcatacggcgctatgcaagtcaagcaggctttcgactatgcatacgtggtgctgagtcatgcagtgtccccaatcgccaaatattaccccaataacgaaaccgaaagtattctgggtcgaatcattcgtgtgacagatgaagtagccacctaccgcgactggatttcgaaacaatggggactgaagaatcgccctgagccctcttgcaatgggaacggtgtcaccctgatcgttgacacccagcagctggacaaatgcaataacaacctcagcgaggagaatgaagctctggggaaatgccgttccaaaacatccgaatccctgagtaagcacagttctaattcctcgtctggcccagtaagcagctcctccgctactcagagcagcagctctgatgtcgactcggacgcaaccccctgtaaaacgcctaaacagctcttatgccgcccatctacagggaatagagttggttcccaggacgtaagcctcgagagctcccaggccgtcggcaagatgcagagcacacaaaccactaacacttccaactccacaaataagagccagcacggcagtgctagactcttcaggtcgtcttcaaaggggttccaagggacaacacagactagccacggcagccttatgactaacaagcagcatcagggtaagtctaacaatcagtactatcacggcaaaaagcgtaagcacaagagagatgctccactgtcagatctgtgtaggtag

SEQ ID NO: 58102 - DNA, 2097 bp, Artificial Sequence
  Description of Artificial Sequence: Synthetic coding sequence
atgagacctcggccaagatcagcccctggcaagccacgcagacgaagtagggctaggctgaggtcatctaggacaccctctggaggagcaagcggtggaggagggtccagcagttcaagcagcactgcgacagggggttccgggtccagcactggcagcccgggaggtgctgcgagcgccccagcaccagcgccagcaggcatgtaccgaagcggcgaacgactgttaggaagccacgcccttccggcagagcagagagactttctgcctctcgaaaccacaaataacaataataatcatcaccaacctggtgcttgggctcgcagggcaggctccagtgccagctcccccccatccgcatcttcatcgccccatccctctgctgccgtcccagccgctgacccggcagactcagcaagcggtagttctaataagcgcaagagagataacaaggcttctacctatggtcttaactattccctcctgcagccatccggtggcagagcggcaggcggaggaagagccgacggcggaggcgtggtttactccggaactccctggaagcgccgaaattataaccagggtgtggtcggcctgcatgaggaaatctctgatttctacgaatacatgagcccacgccctgaggaggagaaaatgcgaatggaagtcgttaatagaattgagtccgtgataaaggagctatggccctcagccgatgtgcagatctttgggtccttcaaaaccggtctctatcttcccacatctgacatcgacctcgtcgtgtttggcaaatgggagaatctgccgctgtggactctggaggaagccctcaggaaacataaggtggctgacgaagatagcgttaaagttttggacaaagctacggtaccaattatcaagctaacggattcatttacggaggtgaaggtggatattagttttaacgtccagaacggtgtgcgggcagcggaccttatcaaggattttactaaaaagtatcccgtcctgccttacctggttctggtgctgaagcaattccttctgcagcgcgatctaaacgaggtgtttactggaggaattggaagctactcgttgttcttaatggccgtgagtttcctgcaactgcaccctcgggaagatgcatgcattccaaacaccaattacggagttctgctaatcgagtttttcgagctgtacgggagacactttaactaccttaaaaccggcatcaggataaaagacggtgggtcctacgtagcgaaggacgaggttcaaaaaaatatgctggatggctatagaccctccatgttgtacattgaggatccacttcagcccggaaatgacgtcggtaggtcttcctatggtgcgatgcaggtgaagcaggcattcgattacgcttacgtggttttgtcgcacgccgtgtccccaattgcaaaatactatcctaacaatgaaacagaatcaattctcggtcggatcattcgagtgacggacgaagtggcgacctatagggattggatatcaaaacaatggggactcaaaaacaggcccgagccttcttgcaatggtaatggcgtgaccctcatagttgatactcagcaactagataaatgcaacaataatttatcagaggagaacgaggcgctcggtaaatgcagaagtaagacctcagagtctctgtcaaagcattcatctaactcaagttccgggccagtgagctcctcctcagcaacccaaagcagcagctcagacgtagattctgatgctacaccatgcaaaacaccaaagcaattgttatgccggcctagcacgggcaaccgtgtgggcagtcaggatgtgagcttagagtctagccaggccgtcgggaaaatgcagagcacacaaaccacaaacacctccaattccaccaacaaatcccaacacggatccgctcggctattccggagctcgagtaaggggttccaggggacaacacagacgagccatggtagtttgatgacaaataaacagcaccagggaaaaagcaacaaccaatactaccacggcaaaaaacggaagcacaaacgggacgcacctttgtcggatctgtgtaggtag

SEQ ID NO: 58103 - DNA, 522 bp, Artificial Sequence
  Description of Artificial Sequence: Synthetic coding sequence
atggatatcgagaaggtcaactctatggacctaggggaatttgtagatgtctttggaaacgctacggagagatgtccactaatagctgcagccgtttggtctcaaagacccttttctgacctcgaggacctggaaaagcatttcttcgcattcattgacgctttagctcagagtggccaggaggggattttacgatgtcatcctgatctggctggctctgaacttcagcgcggaaccctgacagctgaaagtcagagggagcagtccggagctgggctgcggtctttaggtgcagatgagaggcttcgcttagcagaactaaatgcacaataccgggcacggtttggcttcccgtttgtgctggccgctagattcagcgaccgcacggctgtgccacgtgagttagcccgaaggttgctgtgcccttcagcgcaggagttaaggacagctctaggtgaggttaagaagattggtagcctgagactggcagacctcctcagggctgacccagccaagctatag

SEQ ID NO: 58104 - DNA, 2022 bp, Artificial Sequence
  Description of Artificial Sequence: Synthetic coding sequence
atggctgagtcttctctgtaccggcagagactggaggtcatagccgaaaagagacgactccaggaagaaatccgggcagcccgtcgcgaagtggaggaggaaaaattacgcgtggaacgtctgaagaggaagtcgttgcgagaaaggtggttgatggatggcgcagccgctgtacctgagcccagcgaggaccctacatccaaggatccacagagccccgagggacaggcccaggctcgaatccgcaaccttgaggatagcctctttacgttgcaaagccaactgcaacttctgcagtcagcaagcacgggtgcacaacacaagccttctggacgcccttcctggcgtagacagggacatcgaccactgtcccagtctattgtagaggccggttcagtagggcagacggatttgaacaagagagctagtctgcctgccggtctggtggggacaccgccagaaagcccctccgagccgagggaagacgtattgggctttctgccaggaccaaggcaggtgcccggtgccgcaggggatagctccgaggccaacggcccttgcccttctcctatccctactcccgagcaggggttgtctcaacgagccgttccaagtgaaggacgcgtaggggaggcaaagggtggcggtgtcgtctcagtagtgtgggaggggctgcgagccacagaagactgtgcgaccggagccacagggccagagctcgaggctaaagttgaggaggttgtgctcgaggcaattggagaccggaagggggctgggtcgctggaactccctgcttgggtgaaagaggatagaggcattgtggaggtagtctgggagggtgttggaggttctgatgccgaggccatgggagaaataggaagagtgcctgaggtggtccagaccagtagccctagactgcaggagaggctggaagctgccgcttccatcgaaggcgaggatgtgcctcagggcagcccggaaggcgatggacaggggggatccgggggagaagaaggttcgtttatttgggtcgagcgagtcaccctgtcggaagaatgggaggaactccttgtagaagggctagagggccctgaagtggccggtcgagagcggggtgatgaaagccccctaggggcagagggagccaagactggcggtggagaggagacctgggaggccgaaaagcgcaaggccgaagagtcaatgggcatcggctcagaggaaaagcctggtactggtagggatgaggcagaaatgagtccagtcgtcgagcgtaagggaggggaaaagaagctggaacttgagagccgtgggtcggctgagaaacttggaaccgaacgcgagggaggggaggagccactgggtatcgaacggaaggtcgaaggtcacctcagggccgagaaggaaggggacgaagaaaagaggggggctgaagaggaagaggtggaagaaccgctcggcgttgagaagaagggcggagaggaggagcctgaagctacaaaagagcctttggaagcagagcggaagggaggggaggaaactttagaggcggaaaaacgcggaggtgaagagtccttggagacggaaaaaacacaaggcactgaaggggatctgaatttggagcagggaagcagagaaggcagcgagagccaggcggaagaaatgaatgaggcaggacctccccttgaggccaacacagagacgcgtcctgaaaaagagggcccacagcctcaggagaagccagttggtgccctagaggaggaaggagttaaaccacagaccgccgcagaaggacaaggccctctgggcgatgcaacgcccctccttgcagaaacaccggctccagaacagcccgcagagtgtcagcctttacttcagggagagggcccaagtgcaaatccttcagcccacccagttcccacctacgcccctgcccgacagcccgagccctctgctcccaccgagggcgaggaagcctcggggccaaaacagaaaacctgtcagtgctgcgccgtgatgtag

SEQ ID NO: 58105 - DNA, 1347 bp, Artificial Sequence
  Description of Artificial Sequence: Synthetic coding sequence
atggctctgacactgcttgaggattggtgcaaaggtatggacatggatcctcgcaaggccctgctgattgtagggattcccatggagtgttctgaagtggaaatccaggacactgtgaaagccggtttacagccactgtgcgcttaccgtgtactaggtaggatgttccgacgcgaggataacgcgaaagccgtcttcatcgaactggcggatacggttaactatacaaccttgccatctcacatcccaggcaaaggtgggtcctgggaggtcgtggtcaagcctcgaaacccagacgacgaattcctgagcaggttaaactatttcttaaaagacgagggcaggagcatgacagatgtggcacgggcattgggttgttgtagcctgcctgccgaatccctcgacgccgaggtgatgccccaggtgcggtccccaccgttggaacccccaaaggagagcatgtggtataggaagctgaaggtgttttcgggaacagcgtcaccttctccaggcgaagagacctttgaggattggttagagcaagtgactgagataatgcctatctggcaagtttccgaggtggaaaaacgcagaaggctgctggaatccctcaggggccctgctctcagcatcatgcgggtcctccaggcgaacaatgattcaatcacggttgaacaatgtttggatgcgctgaagcagatcttcggggataaagaggattttcgggcatcacagtttcgattcctacagacgtctcccaagataggcgagaaagtttccacctttctactccgcctcgagccacttttgcagaaggccgtgcacaagtcccctctgtccgtcaggagcactgacatgattcgactgaaacacttgttggccagagttgctatgacccctgccttgaggggtaagctagagctgctcgatcagcggggatgtcctccgaattttttagagctcatgaaacttattcgagacgaggaagaatgggaaaatactgaagcagttatgaagaacaaggagaagccatcaggtagaggaaggggggctagcggcagacaggccagagcggaggcttccgtaagtgccccacaggccaccgtacaagcacggtctttttctgattctagcccacagacgatccagggcggacttcctccccttgtgaaaaggcgccgacttctcggttctgagagcacacgtggcgaagatcacggtcaggccacatatcccaaggccgaaaatcagactcccggacgcgaggggccacaggcagccggagaggagctggggaatgaggccggagcgggtgcaatgtcacaccccaagccctgggaaacatag

SEQ ID NO: 58106 - DNA, 423 bp, Artificial Sequence
  Description of Artificial Sequence: Synthetic coding sequence
atggcacttacgctgcttgaggactggtgtaagggcatggatatggatccacgtaaggccctgctaatagtagggattcccatggaatgttccgaggtggagattcaggacactgtgaaagccggtctgcaacctctttgcgcctatcgtgtgctcggtaggatgttccgtagagaggataatgctaaggccgttttcatcgagctggccgacaccgtcaattacactacccttccttcccacattccgggaaaggggggaagttgggaagtcgtcgttaagcccaggaatcctgacgacgagttcctttctaggcttaattactttctcaaggatgaaggacgatctatgactgatgtggcacgggctttaggctgctgctcactacctgctgaaagcctggacgcagaggtgatgccttag

SEQ ID NO: 58107 - DNA, 1347 bp, Artificial Sequence
  Description of Artificial Sequence: Synthetic coding sequence
atggccttgacactgcttgaggactggtgcaaagggatggacatggatcccaggaaagctttattaatagttggaatacccatggaatgctcggaagtcgagatccaagatacagtgaaagcgggactccagccgctttgcgcataccgagttctgggcaggatgtttagacgtgaggataacgcaaaagctgtattcatcgagcttgcagatacagtcaattataccactctcccttcccacatccccggaaagggaggatcatgggaggttgtggtgaagcccagaaacccagatgatgagttcctgtcccgtctgaattacttcttaaaggacgagggccgatccatgactgatgtagccagagccttggggtgctgttctctgcccgctgaatccctggatgctgaggttatgccacaggtccgcagtcccccactagaaccccctaaagagagcatgtggtatcggaagctgaaggtgttctctgggacagcctctccatctccaggcgaagagaccttcgaggattggcttgagcaggtgactgaaatcatgccaatctggcaggtgtctgaggtggagaagcgccgtcgcctacttgaatcactgcgcggtccggctctcagtattatgagagttctacaggcgaataacgactctattaccgttgagcaatgtttggacgcgcttaagcaaatatttggggacaaagaggactttcgcgctagccagttccggtttctccagacttcacctaagatcggggagaaggtttctacgtttttactgcgcctggagccgcttctccagaaggctgtgcacaaaagcccactgagcgtgaggtcaactgatatgataaggcttaaacacctcctggcacgcgtcgccatgacacctgccctcaggggtaaactggagctgttagatcagcgcggttgcccccctaactttctggagttgatgaagcttattcgggatgaggaggaatgggagaacacagaggcagtgatgaagaataaggagaagccatcaggcaggggcagaggggcaagtggaagacaggccagagcggaggcgagcgtgagtgcaccccaggccaccgtgcaggctagatcttttagtgattccagtccccagaccatacagggcggactgccgcctttagttaaaagacgcagactgctgggcagcgaatcaacccggggagaagatcacggccaggccacctaccctaaagctgaaaaccaaacgccgggaagagaaggtccccaggctgctggagaagaattgggaaatgaggctggcgcaggcgcaatgagccacccaaagccctgggagacctag

SEQ ID NO: 58108 - DNA, 1347 bp, Artificial Sequence
  Description of Artificial Sequence: Synthetic coding sequence
atggcacttacgctccttgaagactggtgtaaaggtatggacatggatccccgtaaggcactgctaatcgtcggcattcccatggaatgttcagaagtggagatacaagacacagttaaagccggtttgcagccactatgcgcctacagagtgctcggtcgcatgttcaggcgggaggacaatgccaaggctgttttcatcgagctggccgatacggttaactatacaactctcccctctcatattccaggtaaggggggatcttgggaagtggtcgttaagccacgcaaccccgacgacgagtttctgtcccgcttaaattactttctgaaagacgagggtaggagcatgactgacgtggcccgagccctgggctgttgctcccttccggcagaaagcctcgacgccgaggtcatgcctcaggtgagaagtccccctctggagcctccaaaggagtcaatgtggtacaggaagctgaaggtattttccggcacagccagcccctctcccggagaggagacatttgaagattggctggagcaggtaactgagataatgcccatttggcaggtgagcgaagtcgaaaaacggagacggctcctggagagtcttcgcggtccagccctgtccataatgcgagtgttgcaagccaacaacgatagcattacagtggagcagtgtctggacgctttgaagcagatctttggagacaaagaggactttagagcatctcaattccgctttctgcaaaccagtcccaaaataggagagaaagtttcgacgttcctgctgcgcctagagccactgttgcagaaagccgttcacaagtcgcccttatctgtgcgctccacggatatgatccgcctgaagcaccttctggctcgggtcgcgatgacgccagcattgcgcggaaagcttgaactcctcgatcagcggggatgccccccaaattttctcgagctgatgaaactgattcgggacgaagaagaatgggaaaacactgaggccgtgatgaagaataaagagaagccctctggccgtggaagaggcgctagtgggagacaggcaagagccgaagcctccgtctctgcccctcaggctactgttcaggcccgatcattctccgactcttcaccgcaaacaatccagggtggtctgcctccactcgtgaaaagaaggcggctcctggggtccgaaagcactaggggcgaagaccatggtcaggcgacctatcccaaagccgaaaatcagaccccaggcagagagggaccccaggccgctggcgaagagcttgggaacgaggcaggggctggcgcaatgagtcaccccaaaccttgggagacatag

SEQ ID NO: 58109 - DNA, 1347 bp, Artificial Sequence
  Description of Artificial Sequence: Synthetic coding sequence
atggctctaacacttctggaagattggtgtaagggaatggacatggacccaaggaaagctctgcttattgtgggaatccccatggagtgctcagaagtcgagattcaggatactgtgaaggccggtcttcaacccctttgcgcctaccgtgtgcttggaaggatgttcaggcgcgaagataacgcaaaggccgttttcatagagctcgctgacacagtcaattataccaccctcccaagccatattcccggaaaagggggtagttgggaggtcgtggtcaaacccaggaacccggatgacgagttccttagtcggttgaattactttttgaaggatgaaggtaggtctatgactgacgtggcacgcgctctgggctgctgctctttgcccgctgagagtctggatgcggaagtcatgccgcaggttcgctccccacctctggaaccgccaaaggagtcaatgtggtacaggaagctgaaagtttttagtgggactgccagtccatcccccggagaagagacctttgaagactggctggagcaagttaccgaaattatgccaatctggcaggtaagtgaagtggagaaacgcagaagacttttagagagcctcaggggccctgccctgtcaatcatgcgagtgcttcaagcaaataacgactctatcactgtggagcagtgcctcgatgccctaaaacagatttttggggacaaggaggactttcgcgcaagccagtttagattcttacaaacctcccccaaaattggcgaaaaggtttccacctttcttctgcgtttggaaccgctgctgcagaaggcagtgcataaaagtcctttatctgtaaggtcaaccgacatgattagattaaagcacctacttgccagagtggccatgacaccggcactgcgcggtaagctcgagttactagatcagcgcggatgtccacctaatttcctggagttaatgaagctcatacgggacgaggaagaatgggagaataccgaggctgtgatgaaaaacaaggagaaaccatccggaagggggcgaggggcatcgggcagacaggcaagagccgaggcctccgtcagtgcgcctcaggccaccgtgcaggcccgatctttcagtgacagctcgccacagaccatccagggcggactgcctcctcttgtaaaacgacgaaggctgctgggaagcgagagcacccggggagaagaccacggccaggccacctaccccaaagccgaaaaccaaaccccgggacgggagggcccacaggccgctggcgaagagctcggcaacgaggctggggctggtgctatgagtcacccaaagccctgggaaacatag

SEQ ID NO: 58110 - DNA, 1200 bp, Artificial Sequence
  Description of Artificial Sequence: Synthetic coding sequence
atggccgttaccatgttgcaagactggtgtcgctggatgggagttaacgcaagacgagggctcctgattttgggtattcccgaggattgcgatgacgctgagttccaagagtctctggaggcggctctccggcctatggggcattttacagtcctgggtaaagtgttccgagaggaggataatgctaccgctgcattggtcgagctcgaccgagaggttaactacgccctcgtcccgagggagatcccaggtaccggcggaccttggaacgtggtgttcgtgcccaggtgctcaggggaagagtttctcggtctcgggagagttttccacttccctgaacaggaaggacagatggtggagagtgtggccggagcgcttggagtgggtctgagaagggtctgctggctccggagcataggccaggccgttcagccctgggtcgaggcggtcagataccaaagtctcggggtgttttccggacgcgaccagccggctcccggagaggagtcattcgaagtgtggctggaccacacaacagagatgctgcatgtctggcagggtgtgagcgaaagggaacgacgcaggcgtttgctggaagggctgcgcggaacagccctgcagctggtgcatgccctactggctgagaaccccgctaggaccgcccaggactgtctcgccgcactggcgcaagtgttcggtgacaacgaatcccaggccaccatcagggtgaagtgcctgactgcacagcagcagtcgggagaaaggctgtctgcttttgtgttgagactagaggtcctactgcagaaggcaatggagaaggaggcactcgccagagcctcagcagatcgggtgcgacttagacaaatgctcactagggcacaccttacagagcctcttgacgaagctcttcgaaaactgagaatggcaggaaggtctccatcttttctcgaaatgctcggcctcgtgagggagagcgaagcttgggaggccagcttagccaggtctgttagagctcagacccaggaaggggctggcgctagggctggcgcacaggcagtggccagagcatccacaaaagttgaagcagtgccaggaggcccaggcagagaacctgaaggattacgtcaagccggaggccaggaagccgaggaactgctgcaggaaggattaaagcctgtgttagaagagtgcgacaactag

SEQ ID NO: 58111 - DNA, 1200 bp, Artificial Sequence
  Description of Artificial Sequence: Synthetic coding sequence
atggcagtcactatgctgcaagattggtgcagatggatgggagtaaacgctcgcaggggtctgttgatcctcggtattccagaggattgtgatgatgctgagttccaagaatcgctggaggccgctctccgacctatgggccacttcaccgtcctgggtaaagtgtttcgtgaagaagacaatgctacggccgctctagttgagttggacagagaggtaaattacgcgttggtgccacgtgagattccaggcactggcggaccgtggaacgtggtgtttgtcccacggtgttcaggtgaagaattcctgggcttaggacgtgtctttcattttcctgagcaagaggggcaaatggtcgaaagtgtagcaggcgctctaggagtcgggctgcggcgtgtctgctggctgcgttctattgggcaggccgtccagccgtgggtggaagctgttagatatcagagccttggtgtcttctctggcagggaccaaccagctcccggtgaggagagcttcgaggtgtggctggatcacactacagagatgcttcatgtgtggcaaggcgtgtcagagagagaaaggcgacggagactcctggagggtctccgaggtactgccctgcaactggtgcacgccttacttgcagaaaacccggctcggacagcccaggattgcttggctgcccttgcccaggtgtttggggacaatgagagccaggcaactattcgcgtgaagtgtttaactgcgcagcagcagtctggcgaaagactgtccgcgttcgtcctgagattagaagtcttgctgcagaaagctatggagaaggaggctctggcaagggcctctgctgatagagttcggctgcggcagatgctgactcgagcccatcttacggagccgctggacgaggctctccgaaaactgaggatggcagggagaagcccttcctttcttgagatgctggggctggtgagagagtccgaggcttgggaggccagtttggccaggtcagtgagggctcagacgcaagagggggctggtgccagagcaggagcccaggccgtggctcgagcatccacgaaggtggaggctgtacctggaggccctggaagagagcccgaaggactcagacaagccggaggccaggaagctgaggagctgttgcaggagggacttaagcccgtcctggaggagtgcgataactag

SEQ ID NO: 58112 - DNA, 1200 bp, Artificial Sequence
  Description of Artificial Sequence: Synthetic coding sequence
atggccgtgactatgctgcaagactggtgcaggtggatgggtgtgaatgcacggcgaggcctgctgattctgggaatccccgaggattgcgacgatgcagaatttcaggaatcgctcgaggctgccctaaggcctatgggacactttactgtgctggggaaggtattcagggaggaggacaatgccacagccgctctcgtcgaacttgatcgggaggtgaactatgccctggtgccgagggagatcccaggcaccggcggtccatggaatgttgtttttgtacctaggtgctcaggcgaagaatttctaggactaggaagggtcttccactttccagagcaagaaggacagatggtggaaagcgtcgctggcgctttaggtgttggcctcaggagagtttgttggctgagatccatcggccaggcggtgcagccctgggtagaagccgtgcggtaccagagcctgggtgtgttctccggcagggaccagcccgctccaggggaggagtcgtttgaggtctggctcgaccataccaccgagatgttgcacgtatggcagggcgtgtcagaaagagaacgtagaagaaggctgctggaaggcttacgcggaaccgccttacagttagttcatgctcttcttgccgagaaccctgcacggaccgcacaggactgtctagccgctttggcccaggtgtttggggacaatgagagtcaggccacgatcagagttaaatgtcttactgcccagcaacagtcgggggagcgcctcagtgcttttgtgcttcgactggaggtactcctgcaaaaagccatggaaaaagaggctctcgctagggcatctgcagatagggttagacttcggcaaatgttgaccagggctcacctgaccgagcccctggacgaagccttacgcaagctgcgtatggccggaagaagcccaagtttcctggagatgctgggacttgtccgggagtctgaggcgtgggaagcatctttggcgagaagtgtaagggcgcagacacaggaaggcgcaggagcgagagcaggcgctcaagcggttgctagggcctctacgaaggtcgaggccgtccctggaggccctggaagggagccagaagggctaagacaggccggaggccaagaggccgaggagctgctgcaggaaggattgaagccggtcctggaagaatgtgataattag

SEQ ID NO: 58113 - DNA, 1200 bp, Artificial Sequence
  Description of Artificial Sequence: Synthetic coding sequence
atggcggtcacaatgctgcaggattggtgcagatggatgggagttaacgctaggaggggactcttaatcctgggcatcccagaagactgtgatgacgccgagtttcaggagtcccttgaggcagcacttcgaccgatgggccattttacagtcctgggcaaagcttttcgagaggaggacaacgcaaccgccgctctggttgagctcgatagggaggtgaactatgccttggtgccaagagagatacctggtactggaggaccatggaacgtagttttcgttccacgttgcagtggggaggaattcctgggtttgggcagagtgtttcattttccagagcaagaaggccagatggtggagtctgtcgcgggagcgcttggtgtgggcctgagaagggtgtgctggttgcgaagcatcggccaggccgtccagccatgggtggaagcagtgcgatgccagtcgctcggtgtattctcagggagggaccagcctgctcccggagaggagagcttcgaggtttggctggatcataccaccgagatgttgcatgtgtggcaaggcgtctctgaaagagagagacggcgacgtttgctggaggggctgcgcggtacagcactccagctggttcacgcgctcctcgctgagaacccagcccgaaccgcccaggactgcttggccgcacttgcgcaggtctttggtgataacgagtcccaggcaactattcgagttaaatgtctcaccgctcagcaacaatccggggagaggttgtcggcttttgtcctcagactggaggtcctgctccaaaaagcaatggaaaaagaggctctggcccgagcgtctgctgaccgagtgcgtctccgacagatgctgactcgtgctcacttaacggagccgttagacgaagctctgagaaaattgagaatggcaggaagaagtccttcctttttagaaatgttagggttggttcgcgagtcagaggcttgggaagcctccctcgctcggagcgtacgcgcacagacccaggagggagccggagcaagagccggagcccaagctgtagcccgtgctagcaccaaagttgaagccgtgccaggcggtccagggagggagccagaggggctgcttcaggcgggaggacaggaggctgaggagctgctgcaggagggactcaaacccgtgcttgaagagtgtgacaattag

SEQ ID NO: 58114 - DNA, 1200 bp, Artificial Sequence
  Description of Artificial Sequence: Synthetic coding sequence
atggctgttacaatgctccaggattggtgccgatggatgggagtcaatgccaggcggggactcctaatcctaggaatccctgaggattgcgatgacgcagagttccaggagagcctggaggctgcactgcggccaatggggcacttcacagtcctagggaaggccttcagggaggaagacaacgccacggcggctctggtggagcttgaccgggaagtcaactacgcattggtcccacgggagattcctggtactgggggaccatggaatgtggtgttcgtccccaggtgctccggagaggagttcttgggactgggtagagtgttccatttcccagaacaggagggtcagatggtggagagtgtggcgggagcactcggggtaggcctgcggcgtgtttgctggctgcgtagcattgggcaggcagtgcaaccctgggtggaagcggtgagatgtcagtcgttgggggttttcagcgggagagaccagccggcaccaggagaggaatcttttgaagtctggctggatcacacgaccgaaatgctgcacgtctggcaaggggtcagcgagcgcgaaagacgtcgacgactgcttgaaggtcttagagggaccgcgctgcagctggtccacgccctgctagcagaaaatcccgctaggactgcccaggattgcctggccgctttggcccaggtctttggggataacgaatcccaagccacaatccgagtgaaatgcctgaccgcccaacaacagagcggtgaacggctcagtgcgtttgtgcttcgtctagaagtcctgctgcagaaagccatggagaaagaggcattggcccgagcaagcgccgatcgggttcggctccgccagatgcttacccgggctcatctgacggaaccactagatgaggccttgcgcaaactgaggatggctggaaggagcccaagtttcctggaaatgttaggcttggtgagagagtcggaagcctgggaggcttcattggcacgcagtgttcgtgcacagactcaagaaggagccggagcacgggcaggtgcccaggctgtggcccgagcttctaccaaagtggaggccgtgcctggagggcctggcagagaacccgaagggcttctgcaagccggaggacaggaagccgaggaattgttgcaggagggcctcaaaccagttctggaggagtgcgacaattag

SEQ ID NO: 58115 - DNA, 1347 bp, Artificial Sequence
  Description of Artificial Sequence: Synthetic coding sequence
atggcacttacactgctggaggactggtgtaaaggtatggacatggatccgaggaaggctctgctgatcgttgggataccaatggaatgctccgaggtggagatccaagatacggtgaaggccggtctccagcctctgtgcgcatacagagtgctagggcgtatgtttaggagggaagataacgcaaaggcggtcttcattgagctggctgataccgtgaactatacgacgttaccgagtcacattccaggcaaaggcggtagttgggaggtcgtggtgaaaccgagaaatcctgacgacgaattcctgtctaggctcaactatttcttgaaggacgagggtagatccatgacggacgtggccagggcactgggatgttgttcccttcctgcagagagcttagacgcagaggtgatgccccaagtcagatctcctcccctggagcctccgaaggagagtatgtggtatcgtaaactgaaggtcttctcaggcacagcttccccgtctcccggtgaggaaaccttcgaggattggctcgagcaggtaactgagataatgcccatctggcaggtttcggaggttgagaaaagacgacggctactagaaagcctgaggggacctgctctttctatcatgcgagtgctgcaagctaacaacgactcgatcacggtagaacagtgtctggatgcacttaaacagatatttggagacaaggaagacttcagggcctcacagttcaggtttctgcagaccagcccaaagatcggggaaaaagttagtactttcctgctacgcctggagcccctgctgcagaaagccgttcacaaatcaccactctccgtccggagcaccgatatgattagacttaagcacttgctcgctagggtggccatgacaccagcactgcggggaaaattggagctccttgaccagaggggttgtcccccaaattttcttgagcttatgaaactgattagagatgaggaagaatgggagaacacggaggcagtgatgaagaacaaggaaaagccatcagggagggggcgtggtgcttcagggagacaagctcgcgcagaggctagcgtgtcagccccacaggcaaccgtacaggcgcgtagcttcagtgatagtagtccacaaaccatacaaggaggcctccctcccctggtgaagagacgaaggctattgggatctgagagtacccgcggtgaagatcacggccaggcaacttacccaaaggctgaaaaccagacacctggaagggagggtcctcaagccgcaggcgaagagttaggcaacgaagccggagctggagctatgtcacatcccaaaccgtgggagacctag

SEQ ID NO: 58116 - DNA, 1347 bp, Artificial Sequence
  Description of Artificial Sequence: Synthetic coding sequence
atggccttgaccctcctggaggactggtgtaagggaatggatatggacccacgtaaggccctcctgatcgtggggatccctatggagtgttcggaggttgagatccaggacacagtgaaggcgggacttcagcccctatgtgcctatagagtcctagggcgtatgtttagacgcgaggataacgccaaggctgtgtttattgaattggccgacactgtgaattacactacactgccctcccacattccgggtaaaggaggaagctgggaagttgtggtgaagcctagaaacccggacgatgagtttctgagccgccttaattattttttgaaagatgaaggaaggtccatgaccgatgttgctcgagccttgggttgttgctctctccccgctgaaagcctggatgcagaagtcatgcctcaggtgaggagccctccactggaaccacctaaagaaagcatgtggtaccgtaaactgaaagtgttttctggaactgccagcccttccccgggagaggaaaccttcgaagattggctggaacaggtcaccgaaatcatgcccatttggcaggtgtctgaggtagagaaacggagaagacttctggaatctctgcgtggtcccgcactgtccataatgagggtgttacaggcgaataatgattctattaccgttgaacagtgcctcgatgcactgaagcagatatttggcgataaggaggacttccgagcctcccaattccggttcctccagacgagtcccaagattggtgaaaaggtgagcaccttccttctaaggctcgagcccctgctgcagaaggcagtacacaagtcccccctgagcgtacgaagcacagatatgatacggctgaagcatctcctggcacgcgtcgccatgaccccagccttgaggggcaagctcgagctccttgatcagcgaggttgtcctcccaatttcttggaactgatgaagctaatcagggatgaggaggagtgggagaacacggaagccgtcatgaaaaataaggagaagcctagcggacggggaaggggcgcatccggaagacaagccagagctgaagccagcgtcagcgctccccaggcaaccgtccaggctcgctcattttcagattcttcccctcagaccatccagggcggattacctcctcttgtgaaacgtagacgcctcttggggtccgagtcaactcgcggagaagaccatggccaggcaacctaccccaaggccgagaatcagacccctggccgagagggaccgcaggcagctggagaggaactcggtaacgaagccggagctggcgcaatgagtcacccaaagccctgggaaacatag

SEQ ID NO: 58117 - DNA, 1347 bp, Artificial Sequence
  Description of Artificial Sequence: Synthetic coding sequence
atggctttgaccctgctcgaggattggtgcaaaggcatggatatggatcccaggaaagccctgcttatagtgggcatcccaatggaatgctctgaggtggagatccaggatactgtgaaagcaggtctgcagccactgtgtgcctatcgagtcttgggcaggatgtttcgtcgggaggataacgctaaggcagtctttattgagctggccgacacggtcaactacactacattacctagtcacataccagggaagggtggctcttgggaagtggtagtgaaacccagaaaccccgacgacgaattcttgtcacggcttaactacttcctaaaggatgagggacgatcaatgaccgacgtagccagagccctgggatgctgttcgcttccagcagaatccctggatgcagaggtaatgccacaggtgcggtcacctcccctcgagccacccaaggaatccatgtggtaccggaaactgaaagttttcagtggcacagcgtctccttcaccaggagaagaaaccttcgaggactggctcgaacaggtgaccgaaatcatgcctatctggcaggtttccgaggtcgaaaagcggcgaaggctcctggagtcacttagggggccagctctttccatcatgagagtgctgcaggccaacaatgattccatcacggtcgaacagtgcttagatgctctgaaacagattttcggagacaaagaggactttcgggcttctcagttccgattcctccaaacttcccccaagattggcgagaaggtctctaccttcttgctgcgtctggagcctctgctgcagaaggcggtacacaagtcgcccctctcagtgagatctacagatatgattagactgaaacatttgctggctagagtggcaatgacgcctgcattaagaggcaaactcgagctgctcgatcagcgcggatgtccgccaaactttctcgaacttatgaagctaatcagggacgaggaagaatgggagaacacagaagccgtcatgaagaacaaagaaaagcccagtggtcggggacgcggagcatcaggccgacaagcacgggctgaggcttctgtgagcgctccccaggcgaccgttcaggctcggagttttagcgacagctctccccaaactatccaaggcggtctgccacccctggtcaagcgcaggcggctccttgggtctgagagtacgcggggagaagaccatggacaggcaacgtacccgaaagccgagaatcagacaccgggaagagagggtccgcaggccgctggggaggagttgggtaatgaagccggagccggtgcgatgtctcatcccaaaccctgggaaacatag

SEQ ID NO: 58118 - DNA, 1347 bp, Artificial Sequence
  Description of Artificial Sequence: Synthetic coding sequence
atggccttaactctcctggaggattggtgcaagggtatggacatggacccccgtaaggctttactcattgtggggattcctatggaatgctctgaagtggagatccaagatactgtgaaggcagggcttcagccactctgcgcctacagggtgctcggcagaatgttccgcagggaggataacgctaaagctgttttcatagaactcgctgacactgtaaattatacaacattgccctcacatattccgggaaaggggggaagttgggaggtggtggtaaaacctcggaaccctgacgatgaattcctgagccggttaaactacttcctgaaagacgaggggcgaagtatgacggacgtggctagggcactaggctgttgcagtctgccagcagaatccctggatgcagaggtcatgcctcaggtgcgctcaccacctttagaaccccctaaggagtccatgtggtatcggaagctcaaggtgtttagcggaactgcatcacctagtcccggagaggagactttcgaagactggctcgagcaggtgaccgagatcatgccaatctggcaggtgagtgaggttgagaagagacgacgcctcttggaatctctgcggggtcccgctctgagtatcatgcgggtgctgcaggcaaataatgacagcattaccgtggagcagtgcctggacgctcttaaacaaatttttggggataaggaggattttcgggcatctcagttcagatttctgcagacctcaccgaagatcggagagaaggtgagtacctttttgctaaggctggagcccctgctgcaaaaggcagtgcacaagtctccgttgtccgtgagaagcaccgatatgattcggctgaagcacctgcttgcacgggtggctatgacacccgcactgaggggcaagctggagttgctggaccagaggggctgcccacccaacttcctcgagctgatgaagctgattcgagatgaggaggagtgggagaatacagaagcggtcatgaaaaataaggaaaaaccatctggaaggggacgcggagcctctggacggcaggctcgagctgaggctagcgtctctgctccacaggctacagtgcaggcgcgaagtttcagcgactcatccccccagaccattcagggaggcctccccccactggtaaagcgacggaggctgttgggctccgagagtacccgaggcgaggaccacggacaggctacgtaccccaaggccgaaaatcagacgcctgggagagagggaccacaggcagccggagaggagcttggcaacgaggctggagcaggcgctatgtcacacccaaagccatgggaaacatag

SEQ ID NO: 58119 - DNA, 1908 bp, Artificial Sequence
  Description of Artificial Sequence: Synthetic coding sequence
atggcaatgtcgttattgcaggactggtgtaggtccctggacgtcgatgcccatcgcgcattgctggtaactggtataccagaagggttagagcaagccgacgtggaggccgtcctgcagcccaccctgctccctctgggtacatttaggttaagacacatgaaggcacttatgaacgaaaaggctcaggccgctttggttgagttcgtggaggacgtaaaccacgccgctattccccgagaaatacccggtaaggacggcgtttggcgagtgctctggaaagacagagctcaggatactagagtgctccgtcagatgagaaggctcctcctcgacgacggtccaacacaagcagctgaggcaggcacccctggcgaagcacctacgccacccgcttcggagacccaagcccaagactcaggagaggtgacaggccaggcgggatctcttcttggagctgctcggaaccctcgcaggggcagacgcggacgcaggaatcggacccgacgaaataggcttacacaaaaagggaagaagcgcagccgcggtggtcggccttctgcccctgcccgaagcgaggcagaggactctagtgacgaaagtctgggtattgtcattgaggaaatagatcagggagatctcagcggggaagaagaccagtcagccctgtacgctacactgcaggctgccgctagggaactcgtacgccagtgggcgccatgtaacagtgaaggcgaagaagacggtcctcgagaatttttagccctggtgacggttactgacaagtctaagaaggaagaggctgaaaaggaacccgcaggggcagaaagtatcagacttaacaccaaggaggataaaaacggcgtccctgacctggtagctctgctcgctgtccgcgacacccccgacgaggagcccgtcgactccgacaccagcgagtctgattcacaggaatccggggatcaggaaaccgaggaactggataacccagagttcgttgccatagtcgcctatacggacccctccgatccgtgggctcgtgaggaaatgcttaaaatagcatctgtcatcgaatcactgggatggtcggacgagaaggacaaacgggatccgctccggcaagtcctgtccgtgatgtcgaaggacactaacggtacccgcgtgaaggtggaggaggcaggaagggaggtggatgctgtcgtccttcgcaaagccggagatgacggtgatctacgggaatgcataagtactttggcccagcccgatctgccaccccaggctaaaaaggctggaagaggcctgttcgggggatggagcgagcacagggaggatgagggagggctcctcgagctagtcgccctgctggccgctcaggacatggccgaggtgatgaaggaagagaaggagaacgcctgggaggggggaaaatacaaatatccgaagggaaagttgggagaagtgctcgcgctgctggccgctcgcgagaacatgggaagcaatgaaggcagcgaggaagccagcgatgagcagtccgaggaggagtccgaagacacagagtctgaagcctccgagccggaggatagagcctcaaggaagcctcgcgcaaagcgagcccgtactgcgcctagaggactaacacctgctggagctccgccaaccgcctccggcgcacgtaagaccagagcagggggacggggacggggtagaggagtgacacctgaaaaaaaggcaggaagcagagggtcggcacaggacgatgctgccggttctcggaagaagaaaggtagcgctggcgctggggctcacgctcgtgccggtgaggcaaagggccaggccccaaccggaagtaaagcggctcggggaaaaaaagccaggaggggtaggaggctgccccctaagtgtaggtag

SEQ ID NO: 58120 - DNA, 666 bp, Artificial Sequence
  Description of Artificial Sequence: Synthetic coding sequence
atgcagaaatccgaggggtcaggaggaacacaactgaagaatcgggcaactgggaactacgatcagcggactagttccagtacacagcttaagcaccgcaatgccgtgcaaggatcaaagagcagcctgtcaaccagttcgcctgaaagcgcaagaaagctccatccaaggccttccgacaagctgaacccaaagaccataaatccgttcggagagcagtcccgcgtgccatccgcatttgcagctatatattctaaaggtggcattccttgcaggctagtgcatggatctgttaagcacagactccagtgggaatgtccacccgaaagcctgtcgttcgacccattactcattaccctagcagaaggtctgcgtgaaacgaaacatccttacacatttgtgtccaaggaaggttttagagagttgctcctcgtgaaaggagcacccgaaaaagcaattccactgctgcctaggctcattcctgtgctaaaggccgctctagtgcattctgacgacgaggtcttcgaacggggattaaacgctttggtgcagttgtctgtcgtggtcggcccatcgcttaatgaccacctcaaacatctgttaacaagcggatcactctctattatcaagtctaaaatcccaacgtattgtagcatctgttgttag

SEQ ID NO: 58121 - DNA, 666 bp, Artificial Sequence
  Description of Artificial Sequence: Synthetic coding sequence
atgcaaaagtctgagggaagcggaggaacccagctaaagaaccgggcaacgggcaactacgaccaacgcactagttctagcacacaactcaagcaccggaacgctgttcagggatctaagtcgagcttgtctacctcaagcccagaatccgccaggaagctccatccacgaccatctgataaactgaatcccaaaactatcaatccttttggcgagcagagccgcgtcccttctgccttcgcggctatctactccaaggggggtattccctgtcggctcgtccacgggtccgttaaacatcggctgcagtgggagtgccctccagagtcgttgagcttcgatcctctgctgattactctcgccgaagggcttcgagagaccaagcatccttatacgtttgtctccaaggaggggtttagggaattactgttagtgaaaggcgcaccagagaaagcaattcccctgctccccagactgattcctgtcctgaaggctgcactggttcactctgatgacgaggtgtttgaacgcggattgaatgcactcgttcagttaagcgtagtagtgggaccatccctaaacgatcaccttaagcatctgctgacatccggctctctgtctattatcaaatccaagatcccgacttattgcagtatttgttgctag

SEQ ID NO: 58122 - DNA, 747 bp, Artificial Sequence
  Description of Artificial Sequence: Synthetic coding sequence
atgcagaagtctgagggatctggaggcacgcagctcaaaaacagagctactggaaactacgatcagcgcacctcatccagcacgcaactgaagcacaggaatgctgtccagggaagcaaatcttctctgtcaacctccagcccagagtccgcccgaaaattgcatccacgcccaagcgacaaactgaatcctaaaacaatcaatcctttcggggaacagagccgtgttccaagcgcttttgccgctatatatagtaaaggcggaattccctgtcggttggtgcatggtagtgtgaagcacaggctccagtgggaatgcccaccagaatccttgtcttttgatcctctcctgattaccctggctgagggactcagggagaccaagcacccttacacctttgtctcaaaagagggctttagagaactcctgctcgtaaagggggctcctgaaaaggctataccacttctgcctaggctcatccccgtgttgaaagctgcacttgtacatagcgatgatgaggtgttcgagaggggcctgaacgcacttgttcagttaagcgtggtcgtcggcccttccttgaacgatcatctcaagcacctgcttactagtttgagcaagcgcctgatggacaaaaaatttaaagagccgatcacaagcgccctgcagaaacttgagcagcacggagggagcgggtcactctccataattaaatccaaaattcctacgtattgtagtatatgttgctag

SEQ ID NO: 58123 - DNA, 276 bp, Artificial Sequence
  Description of Artificial Sequence: Synthetic coding sequence
atgcaaaaatccgaaggcagtgggggtacccagttgaagaacagggccaccgggaattacgatcagcgcacaagttctagcacccagctcaaacacaggaatgccgtgcaaggatctaaaagcagtttgtccacttcctcccctgagtctgcccgaaagcttcaccctcgtccaagcgataagctgaaccctaaaaccattaatccctttggggagcaaagccgggtgccatctgcgtttgctgccatctactctaagggaggaatcccctgttag

SEQ ID NO: 58124 - DNA, 258 bp, Artificial Sequence
  Description of Artificial Sequence: Synthetic coding sequence
atgcagaaatccgaagggtccgggggaacccagctcaagaaccgcgctacagggaattacgaccagagaacatcctcctcaacccagctcaaacatcggaacgcagtgcagggcagtaagagttccctgagcacaagcagtccagagtctgccaggaaactgcatccgcgaccatcagacaaactgaatcccaaaacaataaatccatttggggaacagagcagggtcccaagcgcatttgctgctatctactcctag

SEQ ID NO: 58125 - DNA, 666 bp, Artificial Sequence
  Description of Artificial Sequence: Synthetic coding sequence
atgcagaagagcgaagggagtggagggacccagctaaaaaatcgtgccactggcaattacgaccagcgaaccagctcaagtactcagcttaaacatagaaacgcagtccaggggtcaaagtcctctctctctacttcctcaccagagagcgccaggaaattgcaccccagacctagtgataagctgaatccgaaaacaattaacccttttggcgaacagtctcgtgtcccatccgcattcgccgcaatatacagcaagggcggaattccatgccggctagtgcacgggtcggtcaaacaccgcttgcagtgggagtgcccaccagagtcactaagttttgaccctctgctcattacacttgctgaaggcttgcgagaaaccaaacatccatacaccttcgtttcaaaagaaggtttcagagaactccttctcgtaaagggcgctcctgagaaggccattcctctgctgccaaggctgattccggtactgaaggccgctctcgtccactctgatgacgaagtctttgagcggggactgaatgcattggtgcagttatcagttgtggtgggcccttctcttaacgaccacctgaaacacctcctgacatctggatctctatccattattaaatccaaaattccaacctattgctcgatctgctgttag

SEQ ID NO: 58126 - DNA, 411 bp, Artificial Sequence
  Description of Artificial Sequence: Synthetic coding sequence
atgcagaagagcgagggtagcggcggtacacagctgaagaaccgggcaaccggcaactatgatcagagaacgtcctccagtactcagctaaaacataggaacgccgtccaaggaagcaagtctagcctcagtaccagttcgcctgagtctgctcggaagctgcaccctaggccatcggataagctcaaccccaaaactatcaacccctttggcgagcaaagccgagtgccatccgctttcgcagctatttactcaaaaggcggtatcccttgtcggttggttcacggtagcgttaagcatcggctacagtgggaatgccctcctgaatccctcagcttcgaccctctgctcattacgttggccgagggtctgagagagaccaaacacccatacaccttcgtgagcaagtag

SEQ ID NO: 58127 - DNA, 612 bp, Artificial Sequence
  Description of Artificial Sequence: Synthetic coding sequence
atgcaaaagtccgaaggctccggtggtacacagctgaaaaaccgggcaacaggtaactacgaccaaagaacgagctcctctacacagctcaagcaccgaaacgcagtccaaggatctaagtccagcctcagcaccagtagtccagagtcggccaggaagctgcaccctcgacccagcgacaagttaaatcctaagacaatcaatcccttcggtgaacagtccagagtgccgtcagcgtttgcagcaatctactcaaaagggggaattccgtgcaggctagtacatggcagtgtcaagcatcgtctgcagtgggagtgcccccctgaatccctgtcctttgatccactcctgattacactcgctgaggggcttcgggaaacgaagcacccctataccttcgtcagcaaagaaggtttccgcgaacttctgctggtcaaaggggctcctgaaaaagccattcctttgttaccaagactgatacccgtgctgaaggcagccctggtccattccgacgatgaagtgtttgagcgaggacttaatgcattggtgcagcttagcgtggtagtcggaccctccctcaacgatcatctgaagcacctgctgacttcttag

SEQ ID NO: 58128 - DNA, 369 bp, Artificial Sequence
  Description of Artificial Sequence: Synthetic coding sequence
atgcagaaaagtgagggtagtggaggcacacaacttaaaaatcgggctacagggaactacgatcagcgcaccagttcttccacccagcttaaacacaggaacgcggttcagggctccaagtcctctctgagcaccagttcccccgaatccgctcggaaactgcatcctagacccagcgataagctaaacccaaagactatcaacccgtttggagagcaatccagggttccttccgccttcgcggcaatttattcaaagggcggtatcccctgcagactggtccatggaagcgtgaaacaccgattgcagtgggagtgtccgcctgaaagtctgtcttttgacccattactgataacacttgctgaatag

SEQ ID NO: 58129 - DNA, 309 bp, Artificial Sequence
  Description of Artificial Sequence: Synthetic coding sequence
atgcagaaatcagaaggctcaggaggcacccagctgaagaacagggccaccggaaactacgaccagcgaacgtcgtcttccactcagttaaaacaccgaaacgcagtccagggaagcaaaagtagtttatccacttcaagtccagagtcggccagaaagctgcaccctcgcccttccgataaactgaacccaaagaccattaatccttttggtgagcagtcccgcgtcccttcagcttttgcggctatatattcaaaaggcggaatcccttgtcgactggtccatggctcagtaaagcacaggctttag

SEQ ID NO: 58130 - DNA, 372 bp, Artificial Sequence
  Description of Artificial Sequence: Synthetic coding sequence
atgcagaagtccgaaggatctggcggaacccaacttaagaaccgagctaccggcaattacgatcagcgcactagcagttctacccagctgaagcaccggaatgccgtgcaaggtagcaagtcctctctgagcacttccagccctgagtctgctcgaaagctccacccaaggcctagcgacaaactaaatccgaagactatcaatccagttcacagcgatgatgaagtttttgagaggggtctgaacgctctagtccagctttccgttgttgtcgggcctagcctcaatgatcatctgaagcatctactgacaagcgggtcactatccattatcaaatccaaaatcccaacttattgcagtatctgttgttag

SEQ ID NO: 58131 - DNA, 372 bp, Artificial Sequence
  Description of Artificial Sequence: Synthetic coding sequence
atgcagaagtccgagggcagcgggggaacccaactcaagaatagagcaaccggcaattacgatcaacgaacttcatcttctacccaactgaagcaccgcaatgccgtccagggaagcaagagctctttgtcaactagcagcccagagagcgcgaggaaactgcacccccgaccctccgacaaacttaatcctaaaacgattaacccagtccacagtgatgacgaagtatttgaaaggggcctaaacgcgcttgtgcagctttctgtggtagtggggcctagcttgaatgaccacctcaagcacctgttgactagcggtagcttgtctataatcaagtcaaagataccgacctattgtagcatatgctgctag

SEQ ID NO: 58132 - DNA, 762 bp, Artificial Sequence
  Description of Artificial Sequence: Synthetic coding sequence
atgaagcacataaatctatctttcgccgcttgcggcttcttgggcatctatcatctgggcgctgcctctgctctgtgtcggcacgggaaaaaactggtgaaggatgtcaaggccttcgccggtgccagcgccggatctcttgtggccagcgtgttactgaccgctcctgagaaaatcgaagagtgcaatcagttcacatataagttcgctgaagagattaggcggcagtcttttggcgctgtgacacctggttacgattttatggccagactgcgctcgggcatggaaagtattctcccacccagtgcacacgagttggcccagaacaggctacacgtgtctatcaccaacgctaaaactcgggagaatcacctggtttccacatttagctcccgggaggatctcatcaaggtgctgctcgccagctcattcgtcccgatatacgcaggcttaaaacttgtggaatacaaagggcagaagtgggtggatgggggattaacaaatgctttaccaattctaccagtgggacgcacagtaactatttccccatttagtgggagactcgatatatccccccaggacaaggggcagctcgacctgtacgtgaacattgccaagcaggacatcatgttatccctggctaatttggtgcggctgaaccaagccctcttcccacctagcaagcgaaaaatggaaagtctgtaccaatgtggctttgacgatactgtgaaatttctgctcaaggagaattggtttgaatag

SEQ ID NO: 58133 - DNA, 573 bp, Artificial Sequence
  Description of Artificial Sequence: Synthetic coding sequence
atgaaacacatcaatttgagtttcgcagcatgtggcttcttggggatctatcacctgggggctgctagcgctctttgtcgccatggaaaaaaactggtcaaagacgtgaaagcattcgcaggtgctagcgccggatcccttgtggcctccgttctcttgacagcgccagaaaaaattgaggagtgtaaccaattcacttacaaatttgccgaggagattcggaggcagagtttcggcgcagtgactcccggatacgacttcatggccaggctgaggtctggcatggagtccatactcccgcctagtgctcacgagctggcccagaatcgcctgcacgtgagtattaccaacgcgaagacgcgcgagaaccacctcgtctctaccttctcttctagggaggatctgatcaaagttctactggccagctcattcgtccctatctatgccggtctgaaactggtcgaatacaagggccaaaaatgggtggacggcggtttgacgaacgctttgcccatactccctgttggaaggactgtcaccattagtcccttttccggcagacttgatatttag

SEQ ID NO: 58134 - DNA, 762 bp, Artificial Sequence
  Description of Artificial Sequence: Synthetic coding sequence
atgaagcatatcaatctttcctttgcagcctgtggttttctcggcatatatcatctgggtgccgctagcgctttatgcagacacggcaagaagctggtcaaggacgtcaaggcattcgccggtgcatccgcaggaagcctggtggccagtgtcctgctgaccgccccagaaaaaattgaagagtgcaatcagtttacttacaaattcgctgaagaaatcaggagacaatccttcggagcggtaacccccggatacgatttcatggcgcgactgcgctccggaatggagtctatcctacctccgagcgctcacgaactcgcacagaacagacttcacgtcagcattacaaacgcaaaaacccgagaaaaccacctcgtgtccacattcagtagtcgggaagacctaatcaaagtgctccttgctagtagtttcgtgccaatctatgcaggtcttaaattggtcgaatataaaggccagaaatgggtggatggaggattgacgaatgcactgccaattctacctgtcggacgaactgtcactatcagccctttcagcggaaggttggatatctccccccaggataagggacaacttgatctgtacgtgaatattgcgaaacaggacatcatgctgagtctcgcaaatctcgtgaggctgaaccaagcactgtttccgccatcgaagcggaagatggagagtttatatcagtgcggatttgacgacacagtaaaattcctgttgaaggagaactggtttgagtag

SEQ ID NO: 58135 - DNA, 501 bp, Artificial Sequence
  Description of Artificial Sequence: Synthetic coding sequence
atggccaggctcaggtcgggcatggagtccatcctccccccttccgcccatgagctggcccaaaatagactccatgtcagtattacgaacgcaaagacacgtgagaatcatttggtatcaacattcagttccagagaggatcttatcaaagttctgttagcaagctccttcgtacctatctatgcaggcctgaaactggtcgagtacaaaggacagaaatgggtggatggaggcttgacaaacgccctgccaatacttcctgtgggcagaactgtgaccatttctcccttcagtggtaggctggacatatccccacaagacaaggggcaattggacctttatgtgaatatagccaagcaagacataatgctgtctctggcgaacttggtgcgtctcaaccaggcactattcccaccttctaaacggaaaatggagagcctctatcagtgtgggtttgacgacactgtgaaatttttgctgaaagaaaactggtttgagtag

SEQ ID NO: 58136 - DNA, 969 bp, Artificial Sequence
  Description of Artificial Sequence: Synthetic coding sequence
atggagggcatatccaattttaaaacgccgagcaaattaagtgaaaagaagaaatcagtgctgtgttccacaccgacgattaatatccctgccagtccattcatgcagaaactcgggtttggcacaggcgtgaacgtctatctgatgaagcggtcaccccgaggcttgtcccattccccatgggcagttaagaaaataaatcctatctgcaatgaccattacagatccgtgtatcagaagcgcttaatggatgaagccaagattctgaagagtcttcatcatccaaacatcgtcgggtacagggctttcactgaggccaacgatggtagtctctgtttagctatggagtatgggggagagaagagtctgaatgatctaatcgaagagaggtataaggccagccaggaccccttccccgctgcgattatcctgaaagtggctctaaatatggcgagaggtctaaaataccttcaccaagagaagaagctgctgcacggagacatcaagtcttccaatgtagtcatcaaaggcgacttcgagactatcaagatttgtgacgttggtgttagcctgcccttagacgagaatatgactgttacagatcccgaagcctgttacattggtaccgaaccttggaagcctaaggaggcagttgaggagaatggagtgatcacggataaagcggatattttcgctttcggactaactctctgggagatgatgactctcagtatcccgcacatcaacctcagcaacgatgacgatgatgaggacaagacgttcgacgagtctgactttgatgacgaagcctactacgccgcactcggcaccagacccccaatcaacatggaagaactcgacgagagttaccaaaaagtaatcgagcttttttctgtctgtaccaacgaagaccccaaagatcgtccaagcgctgcacacatagtggaagcgctcgaaacggacgtgtag

SEQ ID NO: 58137 - DNA, 1560 bp, Artificial Sequence
  Description of Artificial Sequence: Synthetic coding sequence
atgaccagcacgttcaacccccgtgagtgcaagcttagtaaacaggaggggcagaattacggcttctttctgcggatcgagaaggacacagagggtcacctcgttagagttgtcgaaaagtgctcgccggcagagaaggctggcctccaggacggcgatcgcgtgctgagaatcaatggcgtttttgtggacaaagaggaacacatgcaagtcgtcgacctcgtgaggaaatctggcaatagcgtgacgcttcttgtgctggatggagacagctatgaaaaggcagtaaagaccagggtcgacctgaaagaacttggacaatcccagaaggagcagggattatctgataatatactttcacccgttatgaatggaggggtgcaaacttggacacagcccagactgtgctacctggtaaaagaaggaggctcatacggcttctccctcaaaaccgtacaaggcaagaagggggtgtatatgaccgatatcacgcctcagggagtggctatgcgggctggtgtgctagctgacgaccacctcatcgaagtcaatggggaaaacgtggaggacgcaagtcatgaagaagtcgtagagaaagttaaaaaatctgggtcccgcgtaatgtttctgctggtagacaaggaaacggataaacgtcacgtggagcagaagattcagttcaaacgcgaaaccgccagccttaagcttcttcctcatcagcccagaatagtggagatgaagaagggcagtaacggttacgggttttatttgagagcaggtagcgagcagaaaggacaaataatcaaggacatcgacagcggtagtcccgcagaagaggccggattaaagaataatgatttggtagttgctgtgaacggtgaatccgtggaaaccctggatcacgacagcgtggttgagatgattcgtaaggggggagatcagaccagcttactcgttgtggataaggagaccgataatatgtaccgcctcgcccatttcagcccgtttctctattaccagtcgcaggaattaccgaatggctcagttaaggaggccccagcccctacaccaaccagtctggaagtgagctctcccccagacactactgaggaggtcgatcataaacctaagctgtgcagattagcaaagggagaaaatggctacggcttccatttgaacgccatccgaggattgcccggatccttcatcaaggaggtacagaagggagggccagccgatctggccggattggaggacgaagacgttattatagaggttaacggggtgaacgtgctggacgagccttatgagaaggtcgtggatcgtattcagagctccggcaaaaatgtgacattgctcgtgtgcgggaagaaggcgtacgactattttcaggccaagaagatccctatcgtgagttctctcgctgaccccctggacacccctccggactcaaaagaaggcatcgtcgtggaatccaatcacgactcgcacatggcgaaagaacgcgctcactccacagcttcccactcatcgtccaactcagaggacacagagatgtag

SEQ ID NO: 58138 - DNA, 1560 bp, Artificial Sequence
  Description of Artificial Sequence: Synthetic coding sequence
atgacatccacgtttaatcctcgggagtgtaaactgtctaaacaagaggggcagaattatggattttttctgcgaatcgagaaggacacagagggccacctagtgcgcgttgttgagaagtgttcaccggctgaaaaagcaggattgcaggacggagaccgtgtgctgagaatcaacggcgtcttcgtcgataaagaggagcacatgcaggtcgtggatctggtgcgaaaatcagggaacagcgtaaccctgctcgttctagatggagacagttatgaaaaagctgtgaagaccagggtagacctcaaagagctcggccaatcacagaaggaacaggggctgtccgacaatatcttgagccccgtaatgaacggaggtgtgcaaacctggactcagccaaggctctgttacctcgtgaaagaagggggatcctacggctttagcttaaagacagtgcagggaaaaaagggggtgtatatgactgatatcacaccacaaggcgtggccatgagggcaggcgtcctggcagatgaccacctgatagaggtcaacggggagaacgttgaagatgcgtctcacgaagaggtagtggaaaaggttaaaaagtctgggtcacgcgtgatgttcctgctggtcgataaggaaaccgacaaaagacatgttgagcagaagattcaatttaagcgcgagactgcgagtctcaagctccttccacatcagccacgaatcgttgagatgaaaaaggggtctaatggatatggcttttacctgagagccggatctgaacagaagggccagataattaaggatatcgactccggttccccggcagaagaggccggtcttaagaacaatgatctcgtggttgccgtgaatggcgagtctgttgagaccttggatcacgatagcgtggtcgagatgattcgcaagggcggagaccagaccagcctgcttgtcgtcgacaaagagaccgacaatatgtacaggctcgcccactttagcccctttttgtattaccagagccaggaacttcctaacggatctgtgaaagaagccccagcccctactccaacaagtctggaggtgtcgtctccacctgatacaactgaggaggtggaccacaaacctaaattgtgccggttggccaagggcgagaatgggtacggctttcacctgaatgccataaggggactcccaggtagctttataaaggaggtacagaaaggaggcccagccgacctggccggactggaggatgaagatgtgatcatcgaagtaaacggtgtgaatgttctcgatgaaccgtatgaaaaagttgtcgatcgcattcagagctccggcaagaacgtgacacttcttgtgtgtggcaagaaggcctatgactatttccaggctaaaaaaataccgatagtatcttctctggccgatccgctcgatacgcccccagactctaaggaaggaatcgtcgtggagtccaatcatgacagccatatggccaaagaaagagcccatagcacagcttctcattcttccagcaactcagaggatacggaaatgtag

SEQ ID NO: 58139 - DNA, 609 bp, Artificial Sequence
  Description of Artificial Sequence: Synthetic coding sequence
atggccgagggcgaagaggaaggcggagatgttctgatttctgttggccacgcaaacgtcctggggtatacacttagggagttcttacagttgctccagcacataacgatcggaaccgtcctgcagattaaggtgtacagggactttatcaacattcccgaagaatggcaggaaatctacgatctgataccggaggctaagtttcctgtaacaagcacgcccaaaaaaattgagcttgctaaggacgagtcttttaccagcagtgatgataatgagaacgtcgacctggacaaaagacttcaatattatcgctatccttggtcaaccgtgcaccatcccgctcgcaggcccattagtattagccgcgattggcacggatacaagaaaaaaaatcacactatatccgtggggaaggatataaattgcgacgtaatgatccatcgcgatgacaaaaaggaggttcgggctcctagtccatactggattatggttaagcaggacaatgaatccagtagttctagtactagcagtacaagcgatgccttttggctggaggactgcgcgcaggtggaggagggcaaagcacaactggtgagtaaggttggctag

SEQ ID NO: 58140 - DNA, 795 bp, Artificial Sequence
  Description of Artificial Sequence: Synthetic coding sequence
atgcaaaaagcaagtcacaagaataagaaagagagaggggtatcaaacaaagtcaagacctcggtccacaatcttagtaagacacaacaaaccaagctgaccgtgggatccctggggttagggttgattattatacaacacggaccctacttgcagatcacacatcttattcgtaagggtgcagccgcaaacgatggcaagctccaaccgggagatgtgcttatcagcgtgggacatgccaacgtgctgggctatactctccgtgagtttctccagctccttcagcacattactatcggcaccgttttacagattaaagtgtacagggactttatcaacattcccgaggagtggcaagagatttatgacctgatccctgaggccaagtttcccgtgaccagtacgcccaaaaagatcgagttggccaaggacgagtctttcacctcctccgacgataacgaaaatgtggatttggataaaaggttacaatattaccgctacccctggagcacagtgcaccaccccgcacgcagacctattagtatctcacgggactggcatgggtataaaaagaagaaccacacgatatcagtcggaaaagacattaactgcgacgtaatgattcatcgcgatgacaaaaaagaagtaagggctcctagtccctattggattatggtgaagcaggacaacgaaagctcatcctcctctaccagttccacttcagacgcattttggctagaggattgtgcccaggtagaggaaggtaaggcacagctcgtgtcaaaagtaggctag

SEQ ID NO: 58141 - DNA, 615 bp, Artificial Sequence
  Description of Artificial Sequence: Synthetic coding sequence
atgcagaaggctagtcataaaaacaaaaaaggagacgtgctcatttccgtcgggcatgcaaacgtgctgggttacactctgagagagtttttgcaactacttcaacacataactattggcaccgtgcttcagattaaagtttaccgcgacttcatcaatattcctgaagagtggcaggaaatctacgacctcatccctgaagctaaatttcctgtcacgtcgactcccaaaaaaattgaattggcaaaggatgagtcctttacaagctccgacgataatgagaatgttgacctcgataagcgcctgcagtattatcgctacccctggagcactgtgcatcacccggcaagaagaccaatttctattagcagagactggcacggctacaaaaaaaagaaccacacaattagcgtcggaaaggacattaattgcgatgttatgattcacagggacgataagaaggaggtgcgagccccatctccctactggatcatggtgaagcaggacaacgaaagtagctctagtagtactagctctacaagcgacgccttctggttggaggattgtgcacaggtagaagaaggcaaggcacagctcgtgtcaaaggtcgggtag

SEQ ID NO: 58142 - DNA, 2103 bp, Artificial Sequence
  Description of Artificial Sequence: Synthetic coding sequence
atggatttcgttcggctggcccgtcttttcgccagagcaagacctatgggtctcttcatactgcagcacctcgatccctgcagggcgcgatgggctggagggagagaaggcctgatgcgccctatgtgggcgccattctccagcagcagcagccagctccccctgggccaggaaagacaggaaaacacaggatccctcggatccgatccttcccatagcaactctacagcaacccaagaagaagacgaagaggaagaggagagttttggtactctttccgataaatactcctcccgtagattattccgaaagtccgcagctcagttccacaacttgaggtttggcgagagaagagacgagcagatggaacctgagccaaaactctggcgcggaaggcgtaacactccttactggtattttcttcaatgcaagcacctcattaaggagggaaaattagtggaagctctagacttgtttgaaagacagatgttaaaggaagaacggctgcaacccatggagtccaactacaccgttctcattggaggttgcggtcgagtcggctacttgaaaaaagcgtttaatctttataaccaaatgaaaaagagagatctggaaccctccgatgctacctacacagcattgttcaatgtgtgtgccgaatccccgtggaaagacagcgctttacagagcgccctgaagttgcggcaacagctccaggccaagaatttcgaattgaatctaaagacctaccacgccctgttgaaaatggcagctaagtgtgccgacctccggatgtgcctggatgtttttaaggaaattatacacaaggggcacgtggtgacagaagaaacttttagcttcctgttgatgggatgcatccaggacaaaaagaccgggttccgatatgccctccaggtctggcggctgatgctttccctcgggctgcaaccatcacgagattcctataatctcctccttgtggccgctagagactgtggattaggcgaccctcaggtcgcttcagagttgctcctgaagccgagggaagaggctaccgtgctgcaaccacccgtcagcaggcagcgcccaagacggactgcccaggcaaaggcaggcaatctgatgagcgctatgctgcacgtagaagccctggaacgccagctgtttctggagccaagtcaggcactgggaccacccgagcctcccgaggcccgagttccgggtaaagcacagcccgaagtcgatacaaaggcggaaccaagccatacggccgcactgaccgccgtggccctaaaaccccctcctgtggaactggaagtcaacctgctgactccaggggctgttccacctactgttgtgtctttcggtaccgtcaccacccctgccgatcggttggccttgataggcggattggagggattcctgagcaaaatggcagaacatagacaacagccggacatcaggacccttactctcctcgcagaagtggtcgagtctggaagccccgcagagagcctactgctggccctgctcgacgaacaccaagtagaggctgacctcacattcttcaacacactggtccgcaaaaagtctaaactgggcgacctggaaggtgcaaaagctctcctgcctgtgctggcaaagcgaggactcgtgcccaacttgcagacattttgtaatctggccattggctgtcacaggccaaaagacggtttacagcttctaacggatatgaagaagagtcaggtcactcccaacacacatatttattccgcgctgatcaatgctgcaattcggaaactgaattacacatatctaataagtattctgaaagacatgaaacagaacagagttcctgtcaatgaagtggtgattcgccagttggagtttgccgctcaatatccacccacgttcgatagataccaaggaaagaacacctacctggagaagatcgatggctttcgtgcatactacaagcagtggctaaccgtgatgcccgctgaggagacgccccatccgtggcagaagttcagaacgaaaccccagggcgatcaggacaccgggaaggaggctgatgatgggtgcgccctgggtggcagatag

SEQ ID NO: 58143 - DNA, 321 bp, Artificial Sequence
  Description of Artificial Sequence: Synthetic coding sequence
atggattttgtcagactggctcgcttgttcgctagagctagacccatgggtctcttcatcctgcagcaccttgacccgtgccgggcacggtgggctggtggaagagagggcctgatgcggcctatgtgggcccctttctcgtcctcctcctcccagctgcccctaggtcaggaacgccaggagaatactggctcacttggctccgacccctcccactccaactccaccgcgactcaggaggaagatgaagaagaggaagaaagcttcgggacattgtctgataaatactctagccggagactgttccgaaagtccgcatag

SEQ ID NO: 58144 - DNA, 435 bp, Artificial Sequence
  Description of Artificial Sequence: Synthetic coding sequence
atggactttgttcgcctggcacggctttttgctcgtgccagacccatggggcttttcatattgcagcaccttgatccctgtcgagcacgctgggctggaggtcgggagggcctgatgagacccatgtgggcccctttttcctcaagttcctctcaattgccacttggacaagagaggcaggagaacaccggcagcctaggatccgatccttcccattccaactccaccgcgactcaggaagaagacgaagaagaggaagagagttttggtaccctgagcgacaagtatagcagccggcgtctcttccgaaagagtgctgcccagttccataacctcagattcggcgagagacgggatgagcagatggagccggaacctaagttgtggcgcggacggagaaacaccccctattggtactttttacagtgcaagtag

SEQ ID NO: 58145 - DNA, 495 bp, Artificial Sequence
  Description of Artificial Sequence: Synthetic coding sequence
atggatttcgttaggctggcacgactctttgctcgggctcgcccaatggggctgttcatcctccagcatctggatccatgccgcgcaagatgggccggaggtagagaaggtctcatgcgacctatgtgggcacccttctccagttcctcttcacagctaccccttggccaggagagacaagaaaatactgggtcgctgggctccgatccaagccactccaattcaacggccacccaggaggaggatgaggaagaagaggaatccttcggaacgctttccgataagtactcgagccggagattgttccgaaagtcagccgctcagtttcacaacttacggtttggcgagcgcagggacgagcagatggagcccgagcccaaactttggagaggcaggcgcaatactccatattggtatttcttgcaatgcaagcacctaatcaaagaaggcaaactggtagaggcccttgatttgtttgagcgccagatgctctag

SEQ ID NO: 58146 - DNA, 213 bp, Artificial Sequence
  Description of Artificial Sequence: Synthetic coding sequence
atggatttcgtccgattggccagactgtttgctcgcgctcgaccgatggggctattcatacttcagcaccttgatccctgtcgagctcgatgggccggtggcagagaaggccttatgcgccctatgtgggctcctttctcctcgtcttcttcacagctgcccttggggcaggagagacaagaaaataccgggtctctgggcagcgatccctag

SEQ ID NO: 58147 - DNA, 1449 bp, Artificial Sequence
  Description of Artificial Sequence: Synthetic coding sequence
cgaaagcgcctggtgagaaggggtgaccgggcaggactgccggtcggggtgcaccagttacaggcaaaaaatttcgaacttaacctcaagacttaccacgcgctactcaaaatggccgcaaaatgtgcagatttgcgaatgtgcctcgacgtgtttaaggaaatcattcataagggtcacgtggttaccgaggagaccttcagcttcctgttaatgggatgcatacaggataaaaagactgggtttagatacgcactgcaggtctggcgcctgatgctatctttgggcctgcagcctagccgagacagctacaacctgctcttggtcgcggcacgagactgtggactgggggatcctcaggtcgctagcgaactccttctgaaaccacgggaagaggcaaccgttttgcagccgccagtgagtcggcaacgaccacgtcgtacagcccaggccaaagcgggaaatctaatgtcagcgatgctccatgttgaggccctggaacgtcagctttttctcgaaccttctcaggcccttggtccgcctgagccacctgaggccagagtgcccggtaaagctcagccagaggtggataccaaggcagaaccttcacacaccgccgctctgacagcagttgccttaaagcccccaccagtggaactggaggtgaacctactgacccccggagctgtgcctccgactgtggtctctttcggaacagtaacaacacctgccgacagactggcgctcatcggcggtttagagggcttcttaagtaagatggccgaacacagacagcagccagacattcgcactctaactcttcttgctgaggtcgtggagagcggatccccggctgagtctctgctgctcgcactattagacgagcaccaggtggaggccgatctcacattttttaacactctggttaggaagaagtcaaaactgggcgacctcgaaggcgcaaaggcacttctgcctgtgctagccaaaaggggattggtcccaaacctccagactttctgcaatctggctatagggtgccacaggccaaaggatggacttcagttactgaccgacatgaagaaatcgcaggtgacaccaaacacgcacatatattctgcgttgattaacgccgcaatacggaagctcaactacacgtatctgatttctattctcaaggacatgaaacagaatagagtgccagtgaatgaggttgtgattcggcagctcgagtttgcagctcagtaccccccaacctttgatagatatcaaggaaaaaacacctacctcgagaagatagatggatttagggcctactacaagcaatggctcacagtaatgcccgcagaggagacaccgcatccgtggcagaaatttagaacaaagcctcagggcgatcaggatactggcaaggaggccgacgacggttgcgccctaggcggaaggtag

SEQ ID NO: 58148 - DNA, 2250 bp, Artificial Sequence
  Description of Artificial Sequence: Synthetic coding sequence
atggcaagcgttgtgcctgttaaagataaaaagctattggaggtcaaactgggcgaacttccgtcttggatcctgatgagagactttagcccaagcgggatatttggagcatttcagcgcggacccggtgggaccgggaagccggagatggacttcgtgcgactcgcacgcctgtttgctagagcgagacctatgggactgtttatactccagcacttggacccgtgccgggcacggtgggccggaggtcgcgagggacttatgcggcctatgtgggctcccttctctagctcctccagccagctgcccctagggcaggagcgacaagagaatacaggctctctcggaagcgaccccagccattccaactcaacagcaactcaggaggaagacgaagaggaagaggagagcttcgggacactgtcagacaagtactcaagcaggcggctgttccgcaaaagcgcagcccagttccacaatctcagatttggagagcgacgtgacgaacagatggaacccgagccgaagctttggaggggcagaaggaacaccccctactggtacttcttgcagtgtaaacatcttataaaggaggggaagctggtggaagccctggatctttttgaacgtcagatgctgaaagaagaaagactgcagcccatggagtcgaattacactgtcttgattggcggatgtggccgagttggttacctaaaaaaagctttcaacctgtataaccaaatgaagaaacgtgacctggagccttcagatgcgacttacaccgccctgttcaatgtttgtgctgaaagcccatggaaggacagtgcactccagtctgcactcaaattgcggcagcagcttcaggcaaaaaattttgagctgaacctgaaaacatatcacgcgctactaaaaatggctgctaagtgcgcagacctccgcatgtgcctcgatgtctttaaagagatcatccataagggccatgtagttaccgaggaaacctttagcttcctactgatgggttgcatccaggacaagaagaccggatttagatatgctttacaggtgtggaggctcatgctgtctctgggcctgcagccaagcagggacagttataacctgttgctggtggccgctcgggactgcggcttaggtgatccccaggtggcctctgaactactgctcaaaccgagagaagaggctacagtcttacagccgcctgttagtcgacagcgacccaggcggaccgcgcaagctaaagctggcaatctaatgtcggctatgcttcacgtggaggccctggaacgtcaactgtttcttgagccttctcaggcactggggccacccgaacctccagaggcaagagtccccggaaaagcacaacccgaagtggacaccaaagctgaaccttcccacactgccgctctaaccgctgttgcacttaaaccgccacctgtggaacttgaagtgaatctcctaacgccaggggctgtacccccaacagtggttagctttggcaccgtgactacacctgcagatcgactcgccctcatcgggggactcgagggctttctgtccaagatggcggaacacaggcagcagcctgacatcagaaccttaaccttgctagctgaggttgtggaaagtggtagcccagcagaatccctgttgctcgcccttcttgacgaacaccaggtcgaggccgatctcaccttttttaacacgcttgtgaggaagaaaagcaaactgggggatctggagggagcgaaagcacttctacctgtgcttgctaaaagggggttggtgccgaatctgcaaaccttctgtaacctcgcaattggctgccacaggcccaaggacggcttgcagctcttgactgatatgaagaaaagtcaggtcactcctaatacacatatttactctgctctgatcaacgccgctatccgaaaactgaattatacttatcttatctctatccttaaggacatgaagcagaatcgggttcctgttaatgaagtggtgattagacagctggagttcgccgcacagtacccacctactttcgatcgctatcaaggcaagaatacttaccttgagaagatcgatggcttcagggcttactacaagcagtggctgacagtcatgccagccgaagaaactcctcacccatggcagaaattccggactaaaccacagggagaccaggacacagggaaggaggcagacgacggctgtgctcttggcggaagatag

SEQ ID NO: 58149 - DNA, 1311 bp, Artificial Sequence
  Description of Artificial Sequence: Synthetic coding sequence
atgcggcctggcggagaaaggcccgtggagggaggagcgtgtaacgggagatcggagctggaactcttgaaactgaggagcgccgaatgcattgatgaagctgctgagcggctgggcgctctgagtcgtgccatttggtcacagccagaactcgcatatgaagaacaccacgctcaccgtgttctgactcactttttcgagcgtgaaccccctgctgcaagctgggctgttcaacctcattaccaattgccaacggcatttcgcgctgaatgggaacctcccgaggcacgcgcaccatctgcaacacccaggcctctgcacttgggatttctttgcgaatacgacgctctgccagggatcggccatgcctgtggccacaacctgatcgcggaggtcggcgctgctgcagcgctcggagtccgaggcgctctagaaggactgcctagacccccaccccctgtcaaagtcgtggtcctgggtacgcccgcagaggaagatggcggaggcaaaattgacctgatcgaagcaggcgctttcaccaacttagatgtcgtctttatggcccatccatcacaggaaaacgccgcatacctgcccgatatggctgaacatgatgttacagtcaaatattatggaaaggcttcacattctgcttcttatccatgggaggggctgaatgccttggatgcagcagtcttggcctataacaacttgtcggtatttcggcagcagatgaagccgacctggcgggtacacggcatcattaagaacgggggagtgaagccaaacatcataccctcctatagcgaattgatttactacttccgggctccgtctatgaaagaattacaagtgttgacaaagaaggccgaggattgttttagggccgctgcgctagcatctggctgcactgtcgaaatcaaaggcggtgcccacgattactacaacgtcctgccaaacaagtccctgtggaaagcctacatggagaacggtcgcaagcttggcatcgaattcatatcagaggatactatgcttaacgggccatcagggagtactgacttcgggaacgtttcatttgtggtgcctggcattcacccctactttcacatcgggagcaacgctctgaatcacaccgaacagtacacggaggccgcaggaagccaggaagcgcagttttacacactgcgcacagctaaggcactggccatgaccgcactggatgtaatcttcaagccagaactgttagaggggatacgtgaggactttaagctgaaactgcaggaagagcagttcgtcaatgctgtcgaatag

SEQ ID NO: 58150 - DNA, 840 bp, Artificial Sequence
  Description of Artificial Sequence: Synthetic coding sequence
atggccagaccgcagccatgtggtcctccacacgctcggtgcggctccccaagcctccccgagcgtcctttacaggtgaaagtggtggggttgttcagctgccccaacttccagattgccaagagcgctgccgaagaacttaagaatgagacttgggagtactcaagcagcgtgattagctttgtcaacgggcagtttttaggcgatgcgctggatctgcaaaaatgggcacatgaggtgtgggacatagtggacatcaaaccctccgcactgtacgatgctctgacagaagacttctctgcgaaatttcttcgggatacgaagcatgattttgtctttctggatatttgcatcgattcttcgcctatcggacggctgatattcgagttatactgcgacgtttgtccgaagacatgtaagaattttcaggtgctgtgtactggaaaggccggattcagtcaacgcggaataagactgcattataagaacagcatttttcaccggattgtgcaaaatggatggatccagggaggcgacatcgtgtatgggaagggagacaacggggaatcgatctacggcccaacctttgaagacgagaacttttccgttccacacaacaagaggggcgtgctggggatggcaaataagggtcgtcactccaacggaagccagttctacatcactttgcaggctacgccataccttgacaggaaatttgtggcatttgggcagcttatagaaggcacggaggtgctgaagcagctcgagctggtccccacacagaacgagagaccaatccatatgtgtcgaataactgatagtggcgatccctacgcttag

SEQ ID NO: 58151 - DNA, 936 bp, Artificial Sequence
  Description of Artificial Sequence: Synthetic coding sequence
atggccaggcctcaaccctgcggccctccgcacgccaggtgcggatcacctagtctacctgaaagacccttacaagttaaagtagtcggactttttagttgtcctaattttcagatcgccaagagtgccgctgagaaccttaagaacaaccacccctcaaaatttgaagatcctattctggtgccccttcaggaattcgcttggcaccagtatctgcaggagaagaagcgcgaattaaagaatgagacttgggagtattcatcttccgtaatttcgtttgtgaacggtcagtttctaggcgatgcactggacttgcagaagtgggcccatgaagtgtgggacattgtggatattaagccatcagccctgtacgacgccttgaccgaggatttcagtgctaagtttctgagggacacaaagcatgattttgtttttttggatatttgtatcgattcatccccgattggccgattaattttcgaactttattgcgatgtgtgcccaaaaacttgcaagaattttcaagtgctgtgcactggaaaggcaggcttcagccaacgagggattcgtcttcattataagaattccatctttcataggattgtgcagaacggctggatccaaggtggggatattgtgtatgggaagggtgacaatggtgaatctatttatggccctaccttcgaagacgaaaacttttccgtgccgcacaacaaaagaggagtattggggatggccaacaagggccgacactctaacggatcacaattttacatcacattacaggccacaccctacctggacagaaagtttgtggcattcggccagttgatagagggaacggaggtgctgaagcagcttgaactggtcccaacccagaacgaaaggccaatccacatgtgtcgaatcacggattccggagacccgtacgcctag

SEQ ID NO: 58152 - DNA, 1014 bp, Artificial Sequence
  Description of Artificial Sequence: Synthetic coding sequence
atggcgagaccacagccttgtggcccaccacacgcaagatgcggatctccttcactccctgagagacccttgcaggttaaagttgtgggactgtttagttgcccaaacttccaaatagccaaatccgccgcagagaatctgaaaaacaatcacccaagcaagttcgaggatccgattcttgtgcccctgcaggagtttgcttggcaccagtatctgcaagagaaaaagcgcgaactcaaaaacgagacttgggaatatagtagctccgttattagctttgtcaacgggcagtttctgggcgatgccttggacttgcagaaatgggctcacgaggtatgggatatagtggacatcaaacctagcgcactgtacgatgccctgactgaagatttctctgctaaattcttacgcgataccaagcacgacttcgtcttcctggatatctgcattgattccagtcctatcggacgtctcatctttgagctgtactgtgacgtgtgccccaaaacatgtaagaactttcaggtcctttgcacaggaaaagccggattcagccagaggggaattcgcctacattacaagaacagtattttccaccggatcgtccaaaatggctggatccaggggggtgatatagtctatggcaagggagataacggagagtccatctatggccctaccttcgaggagttgtacggcagcttgaagcggagtgttaagcgacaaaaagaatctagaggggtgggaaagattgagaaatatcgggatgagaacttcagcgtcccccacaataaaaggggtgtgctgggtatggccaataaaggacggcacagtaatggaagtcaattctatatcactttgcaagctacaccctacctcgatcgcaagtttgttgccttcggacagctgatagaggggaccgaagttctaaagcagctcgagttggtgccaactcaaaacgaacggccaattcacatgtgtagaatcacagattcaggcgacccttacgcctag

SEQ ID NO: 58153 - DNA, 495 bp, Artificial Sequence
  Description of Artificial Sequence: Synthetic coding sequence
atggtcaacagcgtggtattttttgaaatcacacgggacggtaaaccactggggcgaatctccattaagctgttcgccgataagatcccaaagacagcagagaattttcgcgcattgtcgacaggtgaaaagggcttcaggtataaagggtcctgctttcaccggatcatacctggttttatgtgtcagggcggagatttcactcgcccaaatggaacaggagataagtcgatctatggtgagaagttcgacgacgaaaacctcatccgaaagcacactggatcgggcattctgtctatggccaatgctgggccaaatactaacggcagccagttttttatctgcgctgccaagacggaatggctcgacggtaagcatgtcgcgttcggtaaggtgaaggaaagggttaatattgtggaagctactgagcatttcggctacaggaactccaaaaccagtaaaaagatcacaatcgctgattgtgggcaattttag

SEQ ID NO: 58154 - DNA, 495 bp, Artificial Sequence
  Description of Artificial Sequence: Synthetic coding sequence
atggtcaatagcgttgtgtttttcgaaatcacaagggacggcaagcccttaggccgaatttccatcaagctattcgccgacaagatccctaaaactgccgaaaactttcgcgctctctcaaccggtgaaaagggatttagatataaggggtcttgtttccaccggattatccccggattcatgtgtcagggaggtgactttacacggccaaacgggactggcgacaagtccatttacggcgagaagtttgatgatgaaaatctcatccgcaagcacactggcagcggcatcctgtctatggctaacgccggacctaatactaatggctcgcagttcttcatatgcgcagccaaaacagagtggttggacgggaagcacgtggccttcggtaaggtgaaggaaagggtgaacatcgtggaagctaccgaacacttcggctatagaaattccaaaacctccaagaaaattacaatagcggactgcggacagttctag

SEQ ID NO: 58155 - DNA, 423 bp, Artificial Sequence
  Description of Artificial Sequence: Synthetic coding sequence
atgcaccgcggagtaggtcctgccttccgtgtggtcaggaaaatggcggcttcaggggcagagccccaagtgttagtccagtacctcgtgttgcggaaggacctctcacaggctccgttcagctggccggcaggagcgctcgtggcacaggcttgccatgccgcaactgccgcactgcacacccacagggatcatccacatacagctgcatacttgcaggaattggggagaatgcgcaaagtggtgctcgaagcccctgacgagactaccctgaaggagttggccgaaacactacagcaaaagaatattgaccatatgctttggctggagcagcctgagaacatcgctacttgtatcgctctccgcccataccctaaagaagaagtgggccaatatctgaaaaaattccgattgttcaagtag

SEQ ID NO: 58156 - DNA, 393 bp, Artificial Sequence
  Description of Artificial Sequence: Synthetic coding sequence
atggccgacggtaaggctggggacgaaaagccagagaaatctcagagagcgggagccgctggcggaccagaagaagaagccgaaaaacccgtcaaaacaaagacagtctcaagttctaacggaggggagagctctagccgctcagccgaaaaaagatccgcagaagaagaggcagccgacttacccaccaagcccaccaagattagcaaattcggctttgcaattggatcgcaaactactaaaaaggcctctgctatttcgatcaagttgggttcatccaaaccgaaagagaccgtgcctaccctcgcgcctaagaccctgagcgtggccgcagccttcaatgaggacgaggacggctataccaacatttcatggaccaaattgctccaatag

SEQ ID NO: 58157 - DNA, 222 bp, Artificial Sequence
  Description of Artificial Sequence: Synthetic coding sequence
atgggagtgaaactggagatcttccggatgatcatttacctgacattccccgtggcaatgttctgggtgtctaaccaagctgagtggtttgaggacgatgtcatacagcgcaagagggaactctggcctcccgaaaagctgcaggaaatcgaggagttcaaggagcggcttcgcaagcggagagaagagaaactgctcagagacgcccagcagaatagctag

SEQ ID NO: 58158 - DNA, 2667 bp, Artificial Sequence
  Description of Artificial Sequence: Synthetic coding sequence
atggatcggagttccaaacgtcgccaagtcaaacctctggcagcgagtcttctggaagccttagactatgatagtagcgacgactctgactttaaagtgggagatgcgtctgattccgaaggaagtgggaacggttccgaagacgccagcaaagattcaggagaaggatcctgttccgactcggaagagaacatattggaggaggaactgaatgaagacattaaggtgaaagaagagcagcttaaaaactccgccgaagaggaggtgctttcctccgagaaacagctgatcaagatggaaaagaaagaggaggaggagaacggtgaaagaccgaggaagaagaaggaaaaagaaaaggaaaaggagaaggaaaaagagaaggagaaggagcgggagaaggagaaggaaaaagcaacggtgtcagaaaatgttgctgctagcgcggctgctacaactcctgcaacgtcccccccagccgtgaatacatcccccagcgttcccaccacgacaaccgcgaccgaagagcaggttagcgagccgaaaaagtggaacctgagaagaaaccgcccactcttggatttcgtcagtatggaggagttgaatgatatggacgattatgacagtgaggacgataacgactggaggcccaccgtggtcaaaagaaagggacggagtgcctcccaaaaggaggggagtgatggggacaacgaggatgacgaagatgagggctcgggatccgatgaggacgagaatgacgaagggaacgacgaggaccactcgtccccagccagcgaggggggatgcaagaagaaaaagtcgaaggtcctaagtagaaactccgccgatgacgaggaactgaccaacgatagcttgactttaagccagtccaagagcaatgaagacagcctcattctggaaaaatctcaaaattggtctagccagaaaatggatcacatattgatctgctgtgtatgcctcggggacaatagcgaagatgcagacgagataatccagtgtgacaattgtggaatcactgtgcacgagggctgctatggggtagatggggagagtgattcgattatgtctagcgccagcgagaattcaaccgagccatggttctgtgatgcctgcaagtgtggtgtgtccccttcatgtgaactatgccctaaccaggacggcatttttaaggagacagacgctggtagatgggtacatatcgtgtgcgcactgtacgtgccaggcgtcgcatttggcgacatagataaactccggcctgtcacactgaccgagatgaattattccaaatacggggcaaaggagtgtagcttctgtgaggatcctcgcttcgcccgaacaggggtatgcatcagctgtgatgccggaatgtgtcgggcttactttcacgtcacctgcgcccaaaaggagggacttctctccgaagctgctgccgaagaggatatcgctgatccattcttcgcttattgtaagcaacacgcagatcgtttggatcggaagtggaagcggaagaattacctggcactccagtcttattgtaagatgagcctgcaggagcgtgagaaacagctttcccccgaggcacaggctagaattaacgcaaggcttcaacaataccgtgcaaaggcagaactcgccaggagcacccgtcctcaggcttgggtgcctagggaaaagctgccgaggcccctaacaagtagtgcttctgcaattcggaagttaatgcgcaaagccgaacttatggggattagcacagacatttttcccgttgacaactctgacacctcctcaagcgtcgacggccgtcgaaagcataagcagcctgcattgaccgcagatttcgtcaactattacttcgagagaaacatgcgcatgatccagatacaggaaaatatggcagagcaaaaaaacatcaaggacaagctcgaaaacgagcaggagaagttacatgtagagtacaacaagctttgcgagagtctcgaggagttgcagaatctcaacgggaaactgcgatcggaagggcaagggatctgggccctgctgggtcgcataacggggcagaaactgaacattccagcaattctgagggcgccaaaagaaagaaaaccttctaaaaaggaagggggtacacagaagacatcaacactgcctgcagtgctttacagttgtggaatttgtaagaaaaaccacgatcaacacctgctgctactgtgcgacacttgtaagctgcactatcacttaggttgcctggacccccctcttactagaatgcctcgtaaaactaagaacagttattggcagtgttcagaatgcgatcaggctggaagtagcgacatggaggctgacatggccatggagaccctacccgacggcaccaagcgttctaggaggcagataaaagagcccgtgaagtttgtgccgcaggacgtgccccctgagcctaagaagattcccattcggaatacaagaacaaggggccgtaaacggtcgttcgttccagaagaggagaagcatgaggagagagtaccaagggagcgacggcaaagacagtccgtccttcaaaaaaaaccaaaggcagaggacttacgcacagaatgtgcaacatgcaaaggaactggggacaacgagaacctcgtcagatatccaagctag

SEQ ID NO: 58159 - DNA, 1992 bp, Artificial Sequence
  Description of Artificial Sequence: Synthetic coding sequence
atgattgtacagatgaccgtgattctgaagctcgaaatgccccaggactctctcattttggagaagagtcaaaactggagctcccaaaagatggaccatatactcatatgttgcgtctgtctaggggacaactccgaggatgcagacgagattatccagtgcgataattgcggcattactgtccatgagggatgttacggagtggacggtgagagcgactcaattatgtcctctgccagcgagaactcaactgaaccttggttctgtgacgcctgcaagtgcggcgtaagtccgtcctgtgaattgtgcccaaatcaggatggtatctttaaggaaaccgatgctggacgttgggtccatatcgtttgtgccttatacgtgcctggtgtggcattcggtgacatcgataagctgagaccagtgactctgaccgagatgaattatagcaaatatggggctaaggagtgtagcttttgcgaagatcccagatttgctcgtacaggagtctgcatttcctgcgacgctgggatgtgtcgggcttattttcatgttacttgcgcacaaaaggaggggctattgagcgaggccgcagctgaagaggatatcgcagatcccttctttgcgtactgtaagcagcacgcagaccggttggaccgtaagtggaagcggaagaactacctggcgctgcagtcttactgtaagatgtccctgcaggaacgggagaagcagctgtcccctgaggcgcaggccaggatcaatgcacgactgcagcagtaccgcgcaaaagccgagcttgcccgaagtactagaccccaggcatgggtgccgagagagaagctgcctcgacccctaacaagctcagcttccgctatcaggaagttaatgcgcaaagctgaactgatggggatctctaccgacatcttcccagtcgacaatagcgatacttccagttcagtagacggtaggcgtaagcataaacagcccgcattgacagccgacttcgtgaattactatttcgaacggaatatgcggatgatccagattcaggagaacatggccgaacagaaaaacattaaggacaagttggagaatgaacaggagaagctccatgtggagtataataaactctgtgaaagtttggaagaattgcagaatctgaacggaaaactgcggtccgagggacagggaatttgggccctcctggggaggatcaccgggcagaagcttaatattcctgcaattctaagggccccaaaggaaaggaagccaagcaaaaaggagggcggtactcagaaaacctcaacgctacctgccgtgctgtactcctgcggaatctgcaaaaagaatcatgatcagcacttgctgctcctgtgtgacacttgcaagctccactatcacctggggtgccttgatcccccactaacgagaatgccccgtaaaacaaagaatagctattggcaatgctcagaatgtgaccaagccggatcttccgatatggaggctgatatggcaatggagacgttgccggacgggacaaagagatccagacgacagatcaaagaaccagtaaagttcgtccctcaggatgtcccccctgaaccaaagaagatccctatcagaaataccagaactcggggacggaagcgctcgttcgttccagaggaggagaagcatgaggagagggtgcccagggaacgcaggcagagacagagcgtgctgcagaagaagcctaaggcagaggacctgcgtaccgagtgtgccacttgcaagggcacaggagacaatgaaaatttggtacggtgtgacgaatgtcgcttgtgttaccactttggctgcttggatccacctttgaagaaatcccctaaacagactggctacgggtggatctgccaggaatgtgatagctcatcatccaaagaagacgagaacgaggccgagcgtaaaaatatatcgcaggagctgaacatggagcagaaaaatcctaaaaagtag

SEQ ID NO: 58160 - DNA, 1077 bp, Artificial Sequence
  Description of Artificial Sequence: Synthetic coding sequence
atggccgagagacaggaagaacagcgaggctctccccctttgagagccgaaggaaaggccgacgcagaagtgaaacttattttgtaccattggacacattccttttcatctcagaaggtgagactggttatcgcggaaaaggcactgaagtgcgaggaacacgacgtctccctgccgttgtcagaacataatgagccgtggttcatgagactcaattctactggggaggtgcctgttctgatccacggagagaatattatctgtgaggcaacccagatcatcgactatctggagcagacgttcctcgatgaacgtacacctagactgatgccagacaaagagagcatgtactaccctagagtgcagcactacagagaattattggattcattgcctatggacgcttacacccacggttgcatattgcacccggaactcacggtggatagtatgatacccgcttacgcaacgacacggatccgtagccagattggtaatactgagagcgagctcaaaaagttggcggaggagaatcctgaccttcaagaggcttacatagccaaacagaagaggttgaagagtaaactgctcgatcatgataacgtgaagtacctcaaaaaaatcttggacgaactggagaaggtcctcgatcaggtagaaaccgaactacagaggcgcaatgaggaaaccccagaggaggggcaacagccgtggctgtgcggggagtctttcacactggcagacgtttcactggctgtaacactccaccgtctgaaattccttggctttgccaggaggaactggggtaatggtaagaggcctaatctcgaaacatactacgaacgcgtcctgaagagaaagacattcaacaaagtgctaggccacgtgaacaatatcttgattagtgcagtgcttcccaccgcgtttcgcgtcgctaagaagcgggctccgaaggtgctaggtacgaccttagtggtgggcctgttggctggcgtcggatactttgcatttatgcttttcagaaaaaggctgggatccatgatcttggccttcagaccccgacctaattatttttag

SEQ ID NO: 58161 - DNA, 1722 bp, Artificial Sequence
  Description of Artificial Sequence: Synthetic coding sequence
atgagtaagaagcccccaaatagacccggaatcacatttgagatcggtgccaggttggaagcgctggactatctacagaaatggtatccctcacgtatcgaaaagattgattacgaagaagggaagatgctggttcattttgagcgatggtctcaccgctatgatgagtggatttattgggattctaacagactccgtccactggaacgcccagcactgaggaaggagggtctcaaggatgaggaggattttttcgatttcaaggcgggagaagaagttttggcaagatggaccgattgtcgctattaccccgctaaaatagaggcaatcaataaggagggaacatttaccgtccagttttacgacggagtaatcaggtgtctgaagaggatgcacatcaaggccatgccagaggacgccaaggggcaggtgaaaagccagcaccctctgtcctggtgttgtcctatcgatcctgccggttcttgtaatcaaagcatgggaagtgaggactggatagctctagtaaaagccgctgctgctgccgctgcgaagaacaaaactggcagcaagccgcgaacatctgccaacagcaataaagacaaagacaaggacgagcgcaagtggtttaaggttcccagtaaaaaagaagaaactagtacatgcattgcgacccctgacgtggagaaaaaagaagatttgcccacatctagtgagacctttggattgcatgtcgaaaacgtgcccaagatggtgttcccgcagcctgaatccacactgtctaataaaaggaagaacaaccaaggaaacagctttcaggcaaaacgagccagactgaataagattaccggcttgcttgcaagcaaggctgtgggagtcgacggtgctgaaaaaaaagaggactataatgagacagcaccgatgcttgagcaggccatctcaccgaagccccagtctcagaagaagaatgaggccgacatctcctcttcagcaaacacccagaagccagcattgctgagctccactctgtcgtcgggcaaggctcgttctaaaaaatgtaagcatgaatctggcgactctagtggctgcatcaagccgccaaagtctccactgagccctgaactaattcaggtcgaagaccttactttggtcagtcagctgtcttcctcagtgattaacaagacgtcaccaccacagcctgtgaacccgcctagacctttcaagcattccgagaggcgacggagatctcagagactagccacattgcccatgcctgatgattcggtcgaaaaggtttcttcaccttctcctgccacagacggaaaggtcttctccatttctagtcagaaccagcaggagtcatctgtgccggaggtgcccgatgtcgctcatctgcctctcgagaaattgggtccgtgtctcccacttgatctgtctaggggctccgaggtcaccgcaccagtagcctccgacagtagctatagaaacgagtgcccccgagccgagaaggaagatactcagatgcttccgaaccccagcagtaaagctatcgccgatggaaggggcgctcctgctgctgcaggaatttccaagactgagaaaaaagtgaaactggaagacaagtcgtctaccgcattcggtattcgaagctgggatttcagcgcactgcttatgaaaattccctcctatagccccatcagcctgagtggacttcccgaatcctag

SEQ ID NO: 58162 - DNA, 1332 bp, Artificial Sequence
  Description of Artificial Sequence: Synthetic coding sequence
atgcatatcaaagcgatgcccgaggacgctaaggggcaagtgaagagccagcaccctctctcctggtgttgcccaatcgaccctgccggtagttgcaatcaatcgatggggagtgaagactggatcgctcttgtgaaagcggcagccgctgctgcagcaaaaaataagacggggtccaaacccagaactagtgctaattctaacaaggataaagacaaggatgaacgcaagtggttcaaagtcccaagtaaaaaggaggagactagtacttgtatagctacccccgatgttgaaaaaaaggaagacctgccaaccagctcagagaccttcggcttacatgtggaaaatgttccaaaaatggtgtttcctcagccggagtccacactatccaacaaaaggaagaataatcagggaaacagttttcaagccaagcgggcacggctgaacaagattacaggcctgttagccagcaaggccgtgggcgtggatggcgcagaaaagaaggaagactataatgagacagctcccatgctggaacaggccatctcacccaagccccagtctcagaagaaaaatgaggctgatataagcagctccgcaaacacacaaaagcccgctctcctgagttccaccctttccagtgggaaggccaggtccaaaaaatgcaagcatgagagcggtgattccagcgggtgtattaagccccctaagagccccctaagcccagagctcattcaagttgaagatctgacactggtatcccagctctcttcgtcagttattaacaagacttctcccccacagccggtaaatccaccccgtcccttcaagcactccgaaagaagacgtagatcccaaaggctagctacgttacccatgcccgatgattccgttgagaaagtgtcttctccttctcctgccactgatggtaaggtcttctccatttcatcacaaaatcagcaggagtcctctgtcccagaagttccagatgtggcgcacctgccactggagaagctcggaccttgcttaccactggacctgtcccgaggatcagaggtgactgcccctgtggcaagtgattccagctacagaaacgaatgtccgagggccgagaaagaggatactcagatgttgcctaaccctagctctaaggccatcgcagacggtaggggcgcaccagcagcagctggcatttcgaaaaccgagaagaaggtgaagctggaggacaaatcatcgactgcatttggtattcgcagctgggacttttcggcgctattaatgaaaatacctagttatagtcccattagtctgtctggactgccggagagctag

SEQ ID NO: 58163 - DNA, 858 bp, Artificial Sequence
  Description of Artificial Sequence: Synthetic coding sequence
atgtccaagaagccccctaaccgtcctgggataacattcgagattggagccaggctggaggcgctcgattaccttcagaaatggtatccatcccggatagagaaaatagactacgaggaaggtaagatgttggtgcactttgagagatggtcccaccgttatgacgagtggatttattgggactcaaatagactgcggccactggaaagaccagcactgcgcaaggaagggctgaaggatgaagaggatttctttgactttaaggccggtgaagaggttctggccagatggacagattgtcggtactatccagccaaaatcgaagccattaacaaagaaggcacgttcaccgtccaattctacgatggtgtgattaggtgcttaaagcggatgcatatcaaagctatgccagaagacgcaaaaggacaggactggatcgcactagtcaaagcagccgcagcggctgccgctaagaacaaaaccggttccaagccaaggaccagcgcgaactcaaataaggacaaagataaagacgagagaaagtggttcaaggtcccttcaaaaaaagaggagacttctacctgcattgctacccctgacgtggagaaaaaagaggacctccccacctcctctgagactttcggcttgcacgttgagaatgtgcctaagatggtttttccacaacccgaatccactctatccaacaagaggaaaaacaatcagggaaacagcttccaggcgaagcgagcccgtcttaacaagataaccggcctcctcgcctcaaaggctgttggcgtggacggggctgagaagaaggaagattataatgagacagccccaatgctggagcaggtgtag

SEQ ID NO: 58164 - DNA, 3054 bp, Artificial Sequence
  Description of Artificial Sequence: Synthetic coding sequence
atgtctaaaaaacctccgaatcggccaggcatcacgttcgagatcggtgccagacttgaggccctggactatttgcagaaatggtatccatctagaattgagaagatcgattacgaagaaggcaagatgctggtgcatttcgagcgctggagccaccggtacgacgaatggatctactgggactctaatcgactgcgcccactggagcggccagctcttcgcaaggagggcctgaaagatgaggaggatttcttcgatttcaaggccggtgaggaagttctggctcgctggactgactgtcgatactaccctgcaaaaatcgaggcaattaataaagagggtacgtttacagttcagttctatgatggggttatccgctgcttaaagcgcatgcatataaaagccatgcctgaggacgctaagggccaagtgaaaagtcagcaccctctgagctggtgttgtcccatcgaccctgcaggctcttgcaaccagtcaatgggtagcgaagactggattgctctcgtgaaggccgcagcggctgcagccgcaaagaataaaacaggttctaagcctcgaacaagtgccaacagcaataaggacaaggacaaggacgagcgtaaatggtttaaagttcctagcaagaaagaagaaacctccacttgtatagcgacccccgacgtggaaaaaaaagaggacctccccacctcatctgagacctttggcctacacgtcgagaatgttccaaaaatggttttccctcaacctgaatcaacccttagcaataagcggaaaaataatcagggaaactccttccaggctaagagggccaggctgaataagattaccggcctcctcgcctccaaggccgtcggtgtggatggggcagaaaaaaaggaggactacaatgagaccgccccaatgctggaacaggccatttctcccaaaccacagtctcaaaaaaaaaatgaagctgacatctcatcatccgctaacacacagaaaccagccctgctgagttccaccctctccagtgggaaagctagatccaagaagtgtaagcatgaatccggtgattccagcggctgtattaagccaccgaagtcacctttgtccccggagctgatccaagtcgaggatctgacccttgtgtctcagctcagctcgtccgtcataaataagacatcgccccctcagcccgtgaacccacccaggccatttaaacattcagaaaggcggagaaggtcccagcggctggcaactctcccgatgcctgatgacagcgtagaaaaagtgtcctcaccatcaccggcaacagacggaaaagtgttctctattagctcacaaaaccagcaggagagctcagtgcctgaggtacccgacgtggcacaccttccgcttgaaaaactgggtccctgcttgcccctagatctgtcccggggaagcgaagtcaccgcacccgtggccagcgacagcagctataggaacgaatgtccacgggcagaaaaagaggatacccaaatgctgccaaacccatcatcaaaagcaatcgccgatggcaggggcgctcctgctgccgctggaatctcgaagaccgagaagaaggttaaattagaggacaagtcatccaccgcttttggcaaacggaaagagaaagataaggagagacgcgagaaacgggacaaagaccactatcggccaaaacagaagaaaaaaaagaaaaaaaaaaaaaagagcaaacaacatgactacagtgattacgaggattcttccttggaattcctcgaacgctgctcatctcctctgaccaggtcctccggatccagcctggcatccaggtccatgttcacagagaagacgactacgtatcagtaccccagagctattttaagcgtcgacctgtctggggaaaacttatccgacgtggacttcctagacgattcatcaacagagtctcttcttctgtctggagacgagtacaatcaggactttgacagcaccaactttgaagaatctcaagacgaggatgatgcattaaatgaaattgtacggtgtatctgtgagatggacgaagagaacggatttatgattcaatgtgaagagtgcctatgctggcagcattccgtgtgtatgggccttctggaggagagtatcccagagcagtatatttgttacatttgccgagaccctccgggacaacgttggtccgccaagtatcggtacgacaaggagtggctgaataacggtcgcatgtgtgggctctcattcttcaaggaaaattattcgcatttgaacgccaaaaagatagtgtccacccatcatctgctagcagacgtttacggcgttactgaggtgctacacggtttgcagctgaaaatcggaatcctgaaaaataagcaccaccccgacctgcatttatgggcgtgctctggaaaaagaaaagaccaggaccagataattgctggtgtggagaaaaaaatagcacaggatactgtaaatcgagaagaaaagaagtacgttcaaaaccacaaggaaccgccacgcttgccactcaagatggaaggcacatatataacctcagagcatagttatcagaagcctcagtcctttggtcaggattgtaaatcgctggccgatcctggtagtagtgatgacgatgacgtgtccagtcttgaggaagagcaggagttccacatgagatcaaagaatagcctccagtacagtgccaaggagcacggcatgcctgaaaaaaacccagctgagggcaataccgtgttcgtatacaacgataaaaaggggacggaggacccaggggattcccacctgcagtggcagctgaacctgttgacccacattgaaaacgtgcaaaacgaggtgacaagtcgcatggacctgattgaaaaagaagtagacgtcttagagtcctggctggacttcacaggtgaattagagccccctgatcccctggccaggctccctcaacttaagcgccacatcaaacagctattaattgacatgggcaaggtgcagcagatcgccacgctgtgcagtgtctag

SEQ ID NO: 58165 - DNA, 1596 bp, Artificial Sequence
  Description of Artificial Sequence: Synthetic coding sequence
atggagttgcaatcacgtcctgaagcactcgccgtcgaactggcaaggcaccaaaacggcgacttaaagaagcagcttcatgagcgccagcccaggattgcagcgctgtccgacaagcaggcactgggcaccattactgctgtccccgtaactggccctcaagtgagcagtctgcagagactagctggacagggagccgcagtgctacctcaagtgcgcccaaaaacacttatcccagacagcctgcctgtggcccctggacgggaccgtccccctaagcaaccacccactttccagaaggcaacagtggtctcggttaagaacccgtcacccgcacttcccactgccaacaatacagtttcccacgtgcccgctcccggtagccagccccaggccctggcagagccggctgcgcttgcctcacccttatctagcgccggagttgcctacgccatcatttctacaagcccaagtaacgctgctgcaatggcacctagtaccgccgtttccgtggtaagtgacagtattaaggtccagcccctgctgatttctgctgataataagcctccaccacggttgttatcaagccctcatcctgcgacacaccattgccctctacatccatcctctctccccttgacgccgccatctccctccctaagtccttcccctctacacgggatattccaggtgatcatcatccagccccaagttcaaacccaacccgagtctacagccgaatcccgacctccaacagaagagccttcacaaggcgctcaggccaccaagaaaaaaaaggaggacagacctcccactcaggagaatccagaaaaaatcgccttcatggtggccctgggccttgtcactaccgaacatcttgaggagatccagagcaagcggcaagaaagaaaacggcgttctaccgccaatcccgcatactcaggtctgctcgagactgagagaaagagactggcttcaaactatctgaacaatcctctgtttctgaccgctagagcaaacgaggacccgtgctggaagaacgagatcacccacgatgagcactgtgccgcttgtaagcggggtgcgaatttacaaccttgtggaacatgtcctggagcctatcatctttcatgtctggagccgccactgaaaactgcccctaagggagtatgggtgtgcccccgatgtcagcagaaggctttgaagaaagatgagggcgtgccgtggaccggcatgttagcgattgtgcattcctacgttacccataagacagtcaaagaagaggagaagcagaaactcctgcagaggggttcagaattgcagaatgagcatcagcagttggaggagcgtgatcggaggttggcctcagccgtacagaagtgcttagagctcaaaacctccttgctggcgcgacaaagagggacccagtccagcctggacaggctgcgagcactgcttcgtctgatccagggcgaacaactgttgcaagttacaatgacaaccacaagcccggctccacttctggccggaccatggacaaaaccatccgttgctgcaacccaccccacggtccagcatccccagggccacaattag

SEQ ID NO: 58166 - DNA, 1470 bp, Artificial Sequence
  Description of Artificial Sequence: Synthetic coding sequence
atggaattgcagagtcggccagaagcgctggccgttgagcttgctagacatcagaatggcgatctcaagaaacagctgcatgaacggcagccccgaattgcggctttatctgataagcaggcgcttggtacaattacagcagtgccagtaaccggtccgcaggtgtcttccctgcaacggctggccggacagggtgcggctgtcctcccgcaggtgcggcctaagaccctgatacccgacagcttgccagtcgccccaggacgagatagacctcctaaacagcctccaaccttccagaaggctaccgttgtgtccgttaaaaacccctctccggcactgcccaccgcgaacaatactgtaagtcacgtgcctgctcccggtagtcagccacaggcactggccgagcccgctgctttggcctccccactcagcagcgctggtgttgcctatgccattatcagtacctcaccgagcaacgctgcagcaatggctccaagcacagccgtcagcgtcgtgtccgacagcataaaggtacagcctcttttaattagtgccgacaacaaggtgataataatacagccccaggtgcagactcagccggagtccacagctgaaagccgcccacctacggaggaacccagtcagggagcccaggcaaccaagaagaaaaaggaggacaggcccccaacccaggaaaaccctgaaaagattgcattcatggtggccctcgggcttgtcaccaccgaacatctggaagaaatccaatcgaaacgacaagaacggaaacgccgttcaacagcgaaccctgcgtacagcgggcttcttgagacagagcgaaagcgactggcctccaattacttgaacaaccctctgtttctcactgctcgagcaaatgaggatccctgctggaaaaatgagattactcatgacgagcactgcgccgcttgtaaaaggggggcaaacctacagccatgcggaacctgccccggagcctatcatctcagttgtctggagccacccctgaaaacagcccctaaaggcgtctgggtctgcccaaggtgccagcagaaggccctgaaaaaggacgagggtgtgccctggactggtatgctcgcaattgtccatagctatgttacccataagacagttaaggaggaagagaagcaaaaattgctccaaaggggctcagagttgcagaatgagcaccagcagctagaggagagggaccgcagacttgcgagcgccgtgcaaaaatgtctggagctaaaaacatcactgttggcaagacaaagggggacacagagcagtctcgaccggctgagagctctgttaagacttattcagggcgagcagctgctgcaagttactatgacaactacaagtccagctcctctcctcgcaggaccctggacgaagccctcagttgccgcaacgcaccctacagtgcaacaccctcagggacacaactag

SEQ ID NO: 58167 - DNA, 1434 bp, Artificial Sequence
  Description of Artificial Sequence: Synthetic coding sequence
atgagaagacagccacagaatggagatctaaagaaacagctgcacgagcggcagcctcgaatcgccgctctcagtgataaacaggcactgggcaccattaccgcagtgccagtcaccgggccacaggtgtccagtctgcagaggcttgctggacaaggcgctgcggtattgcctcaggtgcgcccaaagactcttatacctgattctcttcctgtcgccccagggagagataggccaccaaagcaaccccctacatttcagaaagctactgtggtgagcgtcaagaacccctctcccgctctgcctactgcaaacaataccgtgagtcacgtcccagcaccaggctcccagcctcaggcactggcagaacctgctgcgctagcatctcccctcagttcggctggagtcgcttacgctatcatttcaactagccccagcaacgcagctgccatggccccatccaccgccgtgagtgtggtcagtgattccatcaaggtgcagccgctcctgatcagcgccgataataaggttattattatccagccacaggtgcaaacccaacctgaatcaactgcagaaagccgaccccctaccgaggagccaagtcagggggcacaggcaacaaaaaaaaaaaaggaagatcgccctcccactcaggagaaccccgagaaaatcgcctttatggttgcactcggcctggtgactaccgagcacttagaagaaatacagtcaaagaggcaggaaaggaagagacggagcacagccaatccagcgtactccggcctcctggagacagagagaaaacggttagcctcaaattatctgaacaaccctctttttctgactgctcgggctaatgaagatccatgctggaagaatgaaatcacacatgatgagcactgcgctgcctgtaaaaggggcgcaaacttgcagccatgtggaacgtgccccggagcctatcacctttcttgcctggaacctcctctcaagacggcacccaaaggtgtgtgggtgtgccctcggtgtcagcagaaagccctcaaaaaggatgagggggttccatggactggcatgctggcgatcgtccattcctatgtgacacacaagactgtgaaggaggaggagaagcaaaaactcttacagaggggcagtgaactccagaacgagcaccaacaactggaagaaagggatcgacggctcgctagcgccgtacaaaagtgtctagaactgaagacctccctgctggcgagacagcggggaacacagagcagtctagacagactgcgcgcactattaaggttaattcagggggagcagctccttcaggtaacgatgaccaccaccagcccagcgcctcttctcgccggaccctggacaaaaccttcagtagccgctacacatccaactgtgcaacacccacagggtcataactag

SEQ ID NO: 58168 - DNA, 873 bp, Artificial Sequence
  Description of Artificial Sequence: Synthetic coding sequence
atgcggaggcagccacagaacggtgatttgaaaaagcagcttcacgaacgccagcccaggatcgccgctctgagcgacaaacaagccctggggacaatcactgctgttccggtcacaggaccccaggtctctagtcttcagcgactggccggtcaaggggctgctgtccttccacaggtgcgacccaagactctaattcccgactccctgccagtggccccaggacgcgatagacctcctaagcaaccaccaaccttccagaaggcaaccgtggtaagtgtgaaaaacccgtcacctgctttgcctactgccaacaatactgtctcacacgtgccggctccgggatcccagccccaagccctcgccgaaccagcagcactggcaagccccttgtcctcggctggtgttgcctacgctatcataagcacgtctccttcgaatgccgctgctatggctccatctacagcagtaagtgtggtatcagactctatcaaagttcaacccctcctgattagtgctgataataaagtgataatcatccagccacaggtacagactcagcctgagtctactgccgagtctcggccaccaactgaggagcctagccaaggcgcacaggctactaagaaaaagaaggaagatcggcctccgactcaggaaaaccccgagaaaattgcatttatggtggctttgggtctggttacgaccgaacacctcgaagaaattcagagcaaaagacaagagcggaaaaggaggtctaccgcgaatcccgcttacagtggcctattagagacagaacgcaagaggctggccagcaattacctaaataaccccctgttcctcaccgctcgggagcgcgaccaccccagatag

SEQ ID NO: 58169 - DNA, 1743 bp, Artificial Sequence
  Description of Artificial Sequence: Synthetic coding sequence
atggattacccaaagatggactattttttagacgtagaaagcgcgcaccgactgcttgacgtggaatctgcccaaaggtttttctatagtcaaggtgctcaggcgagacgagccacgctgttgctcccgccaaccctcatggccgctagcagcgaggacgacattgaccggagacctattcgccgagtgagatcaaaaagtgatactccgtatctggcggaggcccgaatctctttcaatctcggggctgctgaagaggttgaaaggttggcagccatgcggtcagactccctggtgccaggaacccacacccctcctataaggcgcaggagtaaatttgccaatctcggccgaatttttaagccctggaaatggaggaaaaagaaatctgagaagttcaaacatacttcggccgcacttgaaagaaaaatctccatgaggcaatcacgcgaggagttgattaagcggggtgtgctgaaggagatttacgacaaggacggtgaactcagtattagtaatgaagaagattccctggaaaacgggcagagcttgagcagttctcagctgagtttgccagccctatccgagatggagcccgtgcctatgccccgagacccgtgctcttacgaggtcctgcaaccgtccgacattatggacggcccagaccctggcgcacctgttaaactaccatgcttgccagttaagctcagcccgcctctcccaccaaagaaagtgatgatttgcatgcccgtgggcggtcccgatctatctctggtgagttatactgcacagaaaagcggccagcagggagtcgctcagcaccatcacacagtcctcccaagtcagatccagcaccaactacagtacggttcgcacggccagcacctcccctctactacaggatctctgcccatgcatcctagcggatgccgtatgattgacgagctcaacaaaaccctagcaatgaccatgcaacgcttggaatccagcgagcagcgggtcccttgtagcacaagctaccattcctccgggctgcactccggagacggggtcacaaaagctgggccaatgggcctccctgagatccggcaggtgcccacggtggtgatcgagtgcgacgataataaggagaatgtgccgcatgagagtgactacgaagacagtagctgcctctatacaagggaggaagaggaggaagaggaagacgaagatgacgattcttctctctacactagcagccttgcaatgaaggtgtgccgaaaggactctttggctatcaaactcagcaatcggccatctaagagagaactagaagaaaaaaacattttgcctaggcagactgatgaggaaaggctcgagttgagacagcagataggaacaaagttgacaaggagattgagccagcgtcctaccgccgaagagctcgagcagcgcaatattctgaagcccagaaacgaacaggaggaacaggaggagaaacgcgagatcaagaggcggttgactaggaaactgagtcagcggccaacagttgaagagcttcgtgaacgaaaaattttgatccgattcagtgactacgtcgaggtcgctgatgctcaggattacgataggcgcgcagacaagccttggaccaggctcactgccgcagacaaagctgctatccggaaggagctgaacgaattcaaatcaaccgagatggaggtgcacgaattgtccagacacctcacctctttccggtttccctag

SEQ ID NO: 58170 - DNA, 423 bp, Artificial Sequence
  Description of Artificial Sequence: Synthetic coding sequence
atgtacttgcaaggtcctcgaaaacttatgacccagggcggttacgacatggtgcagaagctgttcctggacttctttagacgtagattgagccagaggccgacggccgaggaacttgagcaaagaaatatactgaaaccaagaaacgaacaagaagaacaggaggaaaagcgcgaaatcaagagacggctcaccagaaaactcagtcagcgccctactgtggaggagctccgggaacggaagattctcattcgcttctccgattacgtagaggtcgccgatgcccaggattacgaccggcgagctgacaagccttggacaaggctgacagctgcggacaaggtatcacggggagagtgctggcgcgttggaggtcggacggtgtgttgggtgtcactcggcagtcctctcggcagtgtctag

SEQ ID NO: 58171 - DNA, 435 bp, Artificial Sequence
  Description of Artificial Sequence: Synthetic coding sequence
atgtaccttcagggacctcgcaaacttatgacacagggtgggtacgacatggtgcagaagctcttcctggattttttcagaagacgcctttctcaacgacccactgccgaagaattggagcagcgcaacatcctgaaaccgagaaatgaacaagaagagcaagaggagaagagggagatcaagcgccgtttgaccaggaaacttagccagagacccacagtggaggagctccgagaacgaaagatcctgattagattctctgactatgtcgaggtagccgacgcacaggattatgatcgcagggcggacaagccgtggacgaggttgaccgctgcagataaggctgccattcgcaaagaactcaacgagtttaagtccacggagatggaggtacatgaactctctcggcacctgacacgattccaccgtccatag

SEQ ID NO: 58172 - DNA, 600 bp, Artificial Sequence
  Description of Artificial Sequence: Synthetic coding sequence
atgagacagtcccgagaggagttgattaagaggggagtgctcaaggagatctacgacaaggatggtgaactgtccatttctaatgaggaagacagtctcgagaatggccagagcttgagttcctcccagctgagtctccctgccctgtcagagatggaacccgtgcctatgccaagagacccttgttcttacgaggtcctacagccaagtgatatcatggacggccctgtgtcggaagaatcaccatcagcctcagagtccggtgtgctgttgtcgcaggatccatcagccaaacccgtgctcctccttccccctaagaaacccgctgcttttcccggtgaccacgaggaaaccccagtcaagcagctccccctgctgaaacagccgccagccctccctccaaaacccacaactcgaattgccaatcacctgacagactggcaccaggcccatcaggtgggtcagcgccacccactccccccatggcagtgggctttttcaagccctgggtcaagcaagcgaatccagagcagacctggcgctgtcgcctatgcttgcaaccccagtactctcgggggtcggggtaggtggatcacatag

SEQ ID NO: 58173 - DNA, 510 bp, Artificial Sequence
  Description of Artificial Sequence: Synthetic coding sequence
atggactatcccaaaatggactatttcttggatgtagaaagcgcccacagactgctagatgtggagagtgcacagagattcttttattcccaaggtgcacaggctcggagagccaccctgctgctgcctcccacgctgatggctgcttcatccgaggatgatattgatagacgtcccattcgaagggtgcggagcaagtctgataccccttatctggccgaggcaagaatttcctttaatctgggggcaggcgtgtcgctgtttggggacatggatgaagccaggatggggccagctgtgccaacgctggggcgaccactgggactggagctgtgctccctggagaatcacggccttctgaagactgcccctacctacaccacttctgcccatatttgttcaggaccatcaaccggtggccagttttcaactcagggcatgagcccagtgcagggggcaaagcgccgacgggtggtgtggctcccccttgagggggaggagttcggttag

SEQ ID NO: 58174 - DNA, 1455 bp, Artificial Sequence
  Description of Artificial Sequence: Synthetic coding sequence
atggactaccctaagatggattactttctcgacgtggagagtgctcacagactgctcgacgtggaaagtgctcagcgtttcttttactcacagggagctcaggccaggcgggctaccctccttctgcccccaacactaatggcagctagctcagaagatgatattgacagaagaccaattaggcgggtgcggagtaagtctgatactccctatctggcggaagccagaatttcttttaacctgggcgctgctgaggaggtcgagaggctggctgctatgcggtcggatagcctggtcccaggaacccatactcctcccattcgtcggagatctaagttcgccaatctgggacgcatcttcaagccctggaaatggcggaaaaagaagagcgaaaagttcaagcacacaagcgccgctctggagaggaagattagtatgagacagagccgtgaggagctgattaagcgcggtgtactgaaggagatctatgataaggatggagagctgagcatcagtaatgaggaagattctctagagaatgggcagtccctaagctcttcccagcttagtttgcccgcactttccgaaatggagccggtgcccatgcctagagacccctgcagttacgaggtattgcaaccgtcagatatcatggacggaccagatccaggcgcacccgtgaagctcccttgcctgccggtcaagctgtcacctccactgcctccaaagaaagtgatgatctgtatgccagtgggtggcccagacctgagtctcgtctcttacacagcacaaaaaagcggccaacaaggagtagcccagcatcaccacacagtgcttccttcacagatccaacatcagctgcagtacggttcacatggccagcatctcccatcgacaacaggctcccttccaatgcatccctcggggtgcaggatgatcgacgagctgaacaagacactcgctatgacaatgcagcgcctagagagcagtgagcagcgcgtgccttgttcaacgagttatcattcaagcggcttacactcaggcgatggcgtgactaaagccggacccatggggctgcctgagatcagacaggtaccaaccgtggtgatcgagtgcgatgataacaaggaaaacgtgccccacgaatccgattacgaggacagcagctgtctttatacacgtgaagaagaggaggaagaggaggacgaagacgacgattctagtctatatacgtcctctctcgctatgaaggtttgtcggaaagactccctggctattaaactgtcaaatagacctagtaagagggaactggaggaaaaaaacattctcccaaggcagactgacgaagagcgcctggagctgaggcagcagattggcaccaaactgacaaggcgcctgtcacagcgaccgactgctgaggagctcgagcagcgaaacattttgaaaagaaagtag

SEQ ID NO: 58175 - DNA, 798 bp, Artificial Sequence
  Description of Artificial Sequence: Synthetic coding sequence
tgaagccccttcacaccattctcccctttgctgtccttctttttgtcccccttcttttttttgtttccctcactgtcgcattccctgcctactccgagcttgcccctaccaagtccttttccttcaccatctcctgtccgggagcctttaccgcttcccagctcgccattcagattatccccatctcccagtgtgtcattttccctgagcgcgaggagagccacactgcttttacctcccacccttatggccgcatcatcagaagatgacattgaccgcaggcccatccgccgtgtgcgctctaaaagtgacactccttacctggcggaggctcggattagtttcaatctgggcgctgcggaggaagtggagcggctcgccgctatgagatcagactccttggtgcctggtacgcacaccccacccatacgcagaaggtccaagttcgccaacctaggcagaatcttcaaaccttggaagtggagaaagaagaagtcagaaaagtttaagcatacatctgcggctctcgaacgcaagatcagtatgaggcagtctcgggaggagctgatcaaacgcggagtgctgaaagaaatctacgacaaggacggtgagctgagcatctcaaatgaagaggacagcctggaaaatgggcagagcctgtcgagcagccaactcagtctccccgctctgtcagaaatggagcctgttcctatgccaagagatccgtgctcttatgaggtactccaaccctccgatatcatggatggtcctgtgtctgaagagagccccagtgcctag

SEQ ID NO: 58176 - DNA, 1248 bp, Artificial Sequence
  Description of Artificial Sequence: Synthetic coding sequence
tgaggcgagctgagcatctccaacgaagaagatagtctggagaatgggcagtctctctctagttcgcagttgtcactcccagcattatctgaaatggagccagtccccatgcctcgagatccttgcagctacgaggttctacagccttccgatatcatggacggacctgatcctggggctcccgtaaaactcccttgcttgccagtgaagctcagcccacctttacctcccaaaaaagtaatgatttgtatgccagtaggaggccctgatctgtcccttgtgtcttacaccgcccaaaaatccggtcaacagggcgtagctcagcatcatcacaccgtgctgccgtcccagatccagcaccaacttcagtatgggtcacacgggcagcatctgccctccaccaccgggagtctgcctatgcatccttcaggctgcagaatgatcgatgaactgaataaaaccttagcaatgactatgcagcgccttgagagctcagagcagcgagtgccttgcagtacctcataccactcgtcaggcttgcatagtggcgacggcgtcaccaaagccggacccatgggcctgccggagattcgacaagtgcctaccgtggtcattgagtgcgatgacaataaggaaaacgtgccccacgaaagcgactatgaagactcttcttgtctttatacgagggaagaggaggaagaagaggaggacgaggacgacgacagcagcttgtacacatcgtcactcgcaatgaaggtgtgtcggaaggacagccttgccattaagttaagcaaccggccaagcaaacgagagctggaggagaagaacattttacctagacagactgatgaggaaaggctcgaactgagacagcagatcggaactaaattaacccggaggttatctcagcggcctaccgccgaagagctcgagcaacggaacattctgaaacccagaaatgaacaggaggaacaggaagaaaagcgcgagatcaagcggaggctcactcggaaactatcccagcggccaaccgttgaagagctgcgcgaacggaagatcctgatccgattttccgactacgtcgaagtagctgatgctcaggattacgaccgacgggcagataagccctggaccaggttgaccgccgctgacaaagccgcaatcaggaaggaactgaacgaatttaaaagcacggagatggaagtgcacgaactaagccgtcatctcacacgctttcataggccctag

SEQ ID NO: 58177 - DNA, 1644 bp, Artificial Sequence
  Description of Artificial Sequence: Synthetic coding sequence
atggactaccccaagatggattacttcctggacgtggagagcgctcaccggctgctggacgtcgagtccgctcagcggtttttctattcccaaggcgctcaggcaaggcgagctaccctgcttttaccgccaactcttatggccgcttccagcgaagatgatattgacaggcgccctattagaagagtgcggtcgaagagcgatacgccgtatctcgccgaggctcggataagctttaacctgggtgcagccgaggaggtggagagattagccgctatgcggagcgattcgctcgtaccgggtactcacacgcccccaatcagacggagaagtaaatttgctaatctaggcaggatttttaagccctggaagtggcggaagaagaagtcagaaaaatttaagcacacaagcgcagccctcgaacgcaagatcagtatgcgacagtcgagagaagaattgattaagcggggagtgctgaaagaaatttacgacaaggatggcgagctttccatttctaatgaggaagattccctggaaaacggccagtccctgtcctcctcccagctgagtttgccagcactgagcgagatggagcccgtccctatgccaagggatccttgctcatacgaggtcttgcagcctagcgatatcatggatggccctgtgagcgaggagagccctagcgcatccgaaagtggcgtgctcttgagtcaggatccttctgcgaaacccgtcctcctcctgccgcctaaaaagccagccgcttttcctggtgaccacgaggaaactcccgtcaaacagctgcccctcctcaagcagcctccagctctgcctcctaagcctacaacccggattgcaaaccatctaacagatcctggagcccctgtaaagctgccatgcctgcctgtgaaactcagcccccctctaccccctaaaaaagttatgatctgtatgccagtgggaggtcctgacctcagtttggtttcttatacagctcagaagtcaggacagcagggtgttgcccaacatcaccacacggtgctgcccagccaaatccagcaccagctgcagtacggctcccatgggcagcacctcccatccacaaccggaagcctccctatgcatccgtccggttgccgtatgattgacgaactcaacaagacattagctatgaccatgcaacggctagagtccagcgaacaacgggtgccttgttcaacctcgtaccactcttccggcctccatagcggcgacggcgtcaccaaagcgggaccaatgggcctgccggagatcaggcaggtgccgaccgtggtaatcgagtgtgatgataacaaggagaatgtgcctcatgagtctgattatgaggactcttcctgtctttatacacgtgaagaggaggaggaagaagaagatgaagacgacgactccagcctgtacacatcaagtttggctatgaaggtgtgccggaaggatagcctggccatcaagctgagcaaccggccttccaagcgcgaacttgaagagaagaacatcctgccccgacagactgacgaggagcggttagagctgagacagcagatcggtaccaagcttacccggaataaattcagacgggacttcgggaggcagctggaaggcaaatag

SEQ ID NO: 58178 - DNA, 693 bp, Artificial Sequence
  Description of Artificial Sequence: Synthetic coding sequence
aatcttgggagaatctttaagccatggaaatggcggaaaaagaaatcggaaaagtttaagcataccagtgcggcactagaacgcaaaatcagcatgagacaatctcgcgaggaacttattaagagaggagtgttgaaggagatttacgacaaagacggagaactgtccatcagcaatgaggaggattccctggagaatggccagtctctcagcagctcccagctaagcctcccggctctgagcgagatggaacctgttccaatgccaagagatccttgctcttatgaggtcctgcaaccaagcgacatcatggacgggccagtgagtgaggagtctccctcagcttctgagtccggcgtactgctgagccaagacccgtcagccaagcccgttcttctcttgccaccaaagaaaccagctgccttccccggtgaccatgaggagacccccgtcaagcagttaccactactgaaacagccacccgctctgccccctaaaccgaccacacggatcgccaatcatttgaccgattggcatcaggcccaccaagttgggcaaagacatccacttccgccatggcagtgggcattcagttccccgggatcctccaaacggatacagagcaggccgggtgcagtcgcttacgcttgcaacccctcaaccctggggggtcggggtcggtggataacctag

SEQ ID NO: 58179 - DNA, 1308 bp, Artificial Sequence
  Description of Artificial Sequence: Synthetic coding sequence
atgagacagagcagggaagagttgatcaagagaggcgtcctgaaggaaatatacgacaaggatggcgagctcagtatctctaacgaggaagactctcttgaaaatggccaatctttgtcgagctctcagctctctttacccgctctaagtgaaatggaacctgtgccaatgcctagggacccatgttcctacgaggtcctgcagccttctgacatcatggatggcccagacccaggcgctccagttaaacttccctgcttacccgttaaattgtctccaccactccctcccaagaaagtgatgatctgcatgccagttggaggcccagacctgagcctggtttcatatacggctcagaagagtggacagcagggcgtggctcaacaccatcacactgtgctgccgtcacagatccagcaccaactccagtatggatctcacggtcagcatctaccctctaccactggtagcctccccatgcacccttcaggctgccgcatgattgacgagctgaacaagacgctggcaatgactatgcaacgacttgaatcctccgaacagcgcgtgccttgctccacctcctaccatagctctggcctccatagtggggacggcgtgacgaaggcgggtcccatgggcctgcccgagattcggcaggtaccaacagtggtgatcgagtgtgacgataacaaagagaatgtgcctcacgagtcagactatgaggattccagctgcctgtatacccgggaggaggaggaagaggaggaagacgaagatgacgattcttcactgtataccagttctttggcaatgaaggtttgtaggaaggacagcctggccatcaagctgtcaaacagaccatctaaacgggagctagaagagaagaacatcctgccacgccaaactgatgaggagagacttgagttaaggcagcagatagggactaaactcacgcggagattatcacagcggccaaccgccgaggaactggagcagcgaaacattctgaaaccaagaaacgagcaggaagagcaggaagaaaaacgagagataaagcggagattaaccaggaaactgagtcaacgtcccactgtggaagaactgagggagaggaagatcctgatccggttcagtgattatgttgaggtcgctgacgcacaggactatgataggagggccgacaagccttggacgcgacttaccgccgctgacaaagcggctatccgaaaagagttaaatgagttcaagtccactgaaatggaggtgcacgaactttccaggcatctcacatccttccggttcccttag

SEQ ID NO: 58180 - DNA, 1665 bp, Artificial Sequence
  Description of Artificial Sequence: Synthetic coding sequence
atggacaatgccgtggacggtcttgacaaggccagcattgccaatagcgatgggccaacagctgggagccagactcctccctttaaaagaaaaggcaagctgagtaccattgggaagatcttcaagccttggaagtggcggaaaaaaaagacaagcgataagttcagagagacaagcgccgtgttggaaaggaaaatatctacccggcaatctagagaggagcttatcaggaggggagtgcttaaagaacttccagaccaggatggcgacgtgactgtgaacttcgaaaactcgaacgggcatatgattcctattggcgaggagtcaacccgcgaagaaaatgtggtaaaaagtgaagaaggcaatggaagcgtgtccgagaagacccccccattggaggagcaggccgaggacaagaaggcaggttcttcgcacagcaagaaaactaccgggtccaaagccagcgcctctccgtcaactagctcaacaagcagtcggccaaaggcatcaaaagaaacggtgagttcaaaggcaggcacagtgggcactacaaagggcaagcggaagacggacaaacagcctataacatcacatctctcatccgacactaccacctctggcacaagcgacctaaagggggagcccgctgagacccgggttgaaagtttcaagctggagcagacagtgcctggcgctgaagaacagaacaccgggaaatttaagtcgatggttcctcctccaccagtcgcacccgctccgtcccccttggccccaccgcttcctcttgaggatcagtgtattactgcctccgacaccccagttgtgcttgtgtccgtgggtgcggacctcccggtgtccgctctggacccgtctcaactgctctgggccgaagaaccaacaaacagaacaaccttgtactccggaaccggcctgagcgtcaatcgtgagaacgccaagtgtttcaccacaaaagaggagcttggtaaaaccgtccctcagttgctaactccaggcttgatgggcgaatcatctgagagtttttctgccagcgaggatgagggccatcgcgagtaccaggcgaacgacagcgactcagacggcccaattctgtatactgatgacgaagatgaggacgaggatgaggacggaagtggggagtccgcactcgccagtaagatcaggaggagagacaccctcgctatcaagctgggaaaccgcccttctaagaaggaactggaggacaaaaatatccttcaaaggacatccgaggaggaacggcaggaaatccgacagcagattggaacaaagctagtacggcgtctctcacagcggccaaccacagaggagctggagcagcgcaacattttaaaacagaaaaacgaggaggaagaacaggaagctaagatggagctgaaacggagacttagtaggaagctgagcttgcgtcctacagtcgcagaactacaggccaggcggatcctgagatttaacgaatatgtagaagtgacggattcacctgattatgataggcgtgccgataaaccctgggccaggttaacccccgctgacaaggccgctatccggaaagagctgaacgagtttaaaagtacagaaatggaggtacatgaagagtccaggcagtttaccaggtttcatcgcccttag

SEQ ID NO: 58181 - DNA, 1698 bp, Artificial Sequence
  Description of Artificial Sequence: Synthetic coding sequence
atggggcagacatcagtctctaccctgtccccacaaccgggaagcgtagatggtctggataaagctagcatagcgaacagcgatggccctacggctggaagccagaccccgccattcaaaagaaaagggaagctgtcaactatcggaaagatcttcaaaccatggaaatggcgaaagaagaaaacaagcgacaagttccgtgaaaccagcgccgtgctcgagcgaaagattagcacgcgccagtcacgggaggagctgatcagacgcggagtgctgaaagagctcccagaccaagacggagacgtcacagtgaacttcgagaatagtaatgggcacatgatccccattggtgaggagagtacaagggaggagaacgtggtcaagtctgaagagggcaatggatccgtgagcgaaaaaacccctcccttggaggaacaagcagaggacaagaaagcagggtctagtcattccaagaagaccaccggatctaaggcctctgcctccccctcgacaagtagtacttcttcccgcccaaaggcctctaaggagaccgtcagttctaaagcagggacagttggtacaacaaagggtaagaggaagaccgataaacagccaattacctcgcaccttagctcagatacgactactagtgggacctcagacctgaagggagaacctgcggaaacacgtgtcgagagcttcaaactcgagcagacagtgccaggagctgaagaacagaacaccggcaagttcaagagcatggttccacccccacccgtggccccagcaccgagccccctggcccctcccctccctctagaagatcagtgtatcaccgcaagtgacacaccagtggtcctggtgagtgtgggcgcagatctgcctgtttcagccctggatccctcacaactgttgtgggccgaggagcccaccaatcggacaacactgtactctggcaccggccttagcgtaaatagagaaaatgctaaatgctttaccaccaaggaggaacttggcaagactgtgcctcagctattgacccctgggctgatgggcgagagctcggagtccttcagcgccagcgaggatgagggccaccgggagtaccaagccaacgacagcgactcggacggaccaatcttgtacacggacgatgaggatgaggatgaggacgaggacgggtcaggcgagtcagcacttgcttccaagattaggaggagagacacactcgccattaaactcggtaatcgcccaagtaagaaggagctggaagataagaatatactccagaggacaagtgaggaggaacgtcaagaaatcagacaacagattggtacaaaactggttcgccgactgagtcaacgccctacaacagaagaactggagcagaggaacatcttgaaacaaaaaaatgaagaagaagaacaagaggccaagatggaactcaaaagaagactcagtagaaaacttagcctaagacccaccgttgccgagctccaggcaaggagaatactcagatttaatgaatatgtggaggtgaccgatagtcccgactatgataggagggccgacaaaccctgggctcggctgactcccgctgataaagctgctatccgcaaggaactgaacgaatttaagtcaacggagatggaggtccacgaggagtctagacagtttaccagattccacagaccgtag

SEQ ID NO: 58182 - DNA, 537 bp, Artificial Sequence
  Description of Artificial Sequence: Synthetic coding sequence
atgggccagacgagcgtgagtaccctgagcccacaacctggttctgtggatggattggataaggcctctattgcaaactcagatgggccaacggccggatcacagaccccaccattcaaacggaagggaaagctgagtactatcggaaagatattcaaaccttggaaatggcgtaaaaaaaaaacgtcagacaaattccgagaaaccagtgccgtgcttgagagaaaaatctccacacggcagagtcgggaagaactgatacgcaggggggtcctgaaggagttacctgatcaggcgggatcttcgcactcaaagaaaaccaccgggtccaaagcctcggcatccccgagcacaagttcgacgtccagtcgtcctaaggctagcaaagaaacagtttcttccaaagcagggacagtgggcactacaaaaggcaaacggaaaactgacaagcagccgattacctctcatttaagtagcgacacaaccacctcgggcacctctgatttgaagggcgagccagctgaaactagggtatag

SEQ ID NO: 58183 - DNA, 1905 bp, Artificial Sequence
  Description of Artificial Sequence: Synthetic coding sequence
atggacaacgcagttgatggattggacaaagccagtatcgcaaatagcgatggccctacggcgggaagccagaccccgcctttcaaaagaaaaggtaaactcagcactattggcaagatcttcaagccatggaaatggaggaagaaaaaaacttcagataaatttcgcgaaactagcgctgtgctcgaacgcaaaatcagcactcgccaatccagagaagagcttatcagaaggggagtgctgaaagagctgccagaccaggacggcgacgtgactgtgaattttgaaaatagtaatggccatatgatcccaatcggggaggagtctacccgggaagagaatgtggtgaaaagcgaggagggtaatggaagtgttagtgagaaaacaccacctctggaagaacaggccgaggataagaaagaaaataccgaaaaccatagcgagacccctgccgcaccagccctgccaccaagtgcaccacccaagcctaggcccaaacctaagcccaaaaaaagtcccgtccctcctaagggcgctacagccggtgcaagtcacaaaggagacgaggtgcccccaattaaaaagaataccaaagcccctggaaaacaagctcctgtacccccaccaaaaccagcgtcacggaacactacacgggaggctgctggctcttctcactccaaaaagaccacgggatccaaagcgtctgccagcccgagcacctcatcgacctcttcccgcccaaaagctagcaaagagacagtgagctctaaagctggcaccgtgggaaccactaagggcaaacgcaaaactgataaacagcctatcacttcacacctgagtagtgataccaccacttcagggacctcagacctgaagggtgaacccgctgagactcgagtagagagttttaagctggaacagacagtgccaggtgcagaagaacagaacactggcaaattcaaatcaatggttccaccgccacctgtggccccagctccctcgccactggctccccctctgccgctggaggaccagtgcatcaccgccagcgacacgcctgtggtcctagtgagtgtcggtgccgatcttccagtgtctgctctggaccctagccagctgctgtgggccgaggagccaacgaacaggactactctctacagtgggacgggtctgtctgtgaacagggagaatgccaagtgttttacaacaaaagaagagctgggcaaaaccgtgccccagctcctcacaccagggcttatgggagagagttccgaatcattttcagcctccgaggatgagggtcaccgggagtaccaggctaatgatagcgatagcgacggccctattctgtatacagacgatgaggacgaggatgaggatgaggacggctcaggcgaatcggcccttgcatcaaaaatcagaagacgcgacacacttgctatcaagcttggtaaccgaccctctaaaaaggaattagaagacaagaacattctgcaacgcacatccgaagaggagcgacaagaaattaggcaacagatagggacgaaactcgtcagacggttaagccagcggcctacgacagaggaacttgaacagcgaaacatcctgaagcagaagaacgaggaagaggaacaggaagctaaaatggaactgaaaaggcgcctatcgcgaaaactcagcttaagacccaccgtagcagaattgcaggccagacgcattttgcggttcaatgaatacgttgaggtgaccgatagccccgactatgaccgccgagctgataaaccttgggccaggttgacacccgctgacaaggcagctatccgaaaggagctcaatgagttcaaatcaacagagatggaggtgcacgaggagtctcggcagttcacacgtttccataggccttag

SEQ ID NO: 58184 - DNA, 1938 bp, Artificial Sequence
  Description of Artificial Sequence: Synthetic coding sequence
atgggacagacttctgtctctacactgagtccccaacccggttcagtcgacggactggataaagcttcgatagcgaactctgacggaccgaccgcgggtagccagacgcctcctttcaagcgtaaaggcaagttatccactattggcaagattttcaaaccctggaagtggcggaaaaaaaaaacgagcgataaattccgggaaaccagcgcggttctggagagaaagatctctacaagacaatcgcgggaagagctaataaggaggggcgtactgaaagagttgcctgatcaggacggtgacgtgacagttaatttcgagaatagtaatgggcacatgatccctattggcgaagaatcaacccgtgaagaaaacgtagttaaaagcgaggagggcaatggctctgtgtccgagaaaaccccccctttggaggaacaagccgaagataagaaggaaaacactgaaaaccactcagagacccctgctgctcccgctttgcctccatctgcccctcccaagcctaggcctaagcctaagcccaagaagtctcccgtcccaccaaaaggtgctactgccggtgcatcccataaaggcgatgaggttccacccatcaagaaaaacacaaaagcacctggtaagcaggcgccagtaccaccacccaaaccagcatcgagaaacacaactagggaggctgcaggaagttcccattctaagaaaacaacaggctctaaagcgagtgcaagccctagcacatcttccacctcatcacggcctaaggcatctaaagagacagtgtcctccaaagccggaacagtggggactactaaagggaaacgaaagaccgacaaacaaccaatcacatctcacctgtccagcgacacaaccacttcagggacatccgaccttaagggggagccagccgagactcgggtggagtcttttaaattggagcaaacagtcccaggggcagaggagcagaacacaggtaagttcaagtcgatggtgccaccccctcccgtggccccagctcctagccctctggcccctcctctaccacttgaagatcaatgcattacagcctctgatactccagtggtgctggtcagtgtcggcgctgaccttccagtttccgcactagacccatcccagctattatgggctgaagagccaacaaacagaacaacgctatactcgggcactggtctgtctgtgaaccgggagaacgcaaaatgcttcaccactaaggaggagctgggaaagacggtcccccagttgctaaccccaggactgatgggcgagtcatccgagtccttcagcgccagtgaggatgaaggacatagggagtaccaggctaatgattctgacagcgatggcccaattctctacaccgatgacgaggacgaagatgaagacgaggacggatccggcgagtctgcccttgcctctaaaatccgcagacgcgacacgttggctataaaactggggaatcggccatctaagaaggagttggaggacaagaacatcctgcagcgtacatcagaagaggaaagacaggaaatccggcaacaaatcggcaccaagctggtacggagactgagccagcgccctactacagaggagctggagcagcgaaacatactaaagcaaaaaaatgaagaggaagagcaggaggccaagatggaacttaagagaaggctgtctcgaaagcttagcctgagacctaccgtggccgagttgcaggccaggcgaattctccgtttcaacgagtatgtggaggtcaccgatagtcctgactacgataggagagccgataagccgtgggctcggcttacaccagctgacaaggctgcaatccgcaaggaactgaacgagtttaagtccactgagatggaagttcacgaagagagcaggcagtttactcggtttcaccgaccttag

SEQ ID NO: 58185 - DNA, 2139 bp, Artificial Sequence
  Description of Artificial Sequence: Synthetic coding sequence
atggggcaagccgacgtctccagacctgtcaatcctgacgcagtcgaggaagcagatcagcctacaacagagcctggcatggtgctcgatagcgtcgaagctggcgacactacaccccctacaaaaagaaaatcgaagttcagcggctttggcaaaatctttaaaccatggaagtggcggaagaagaaaagcagcgataagtttaaggagacttcagaggttctggaacgcaagatcagcatgagaaaaccaagggaggagctagtgaaacgaggagtgcttctggaggatcccgaacagggcggtgaggaccccggtaagccgtcagacgcaatgctcaagaacggccatactacaccaatcggaaacgcgagatcaagctcccccgttcaagtggaagaagaaccagtacgactggcatccctaaggaaggccataccagaggaggatcttaagaagcggctgggcagcacgggatcgcagcctaacagtgaggcagaatcagtcccagagaatgtgcccaagccgcctctcctgcctcctaaaaggccactgtcatccagccacgaggcgtccgagggacaggctaaggatgccaccagttccggcggtaccgcacggttcatcatttcgaccagtattacgaccgctcccgctgccacgaccgccgctacttccctcgccaaaactgtgaatctcagtgttaccccatcaccagcccctcgaacgctgcccgcagccccagcctccaccaataccactgccacgccttctctgacacatatggtgcccgcaaagcagcctcccatcccccctccaaaacctgcacacagaaactcaaacccagtcatcgctgaactcagccaggctattaacagtgggacccttctctctaaacccagtccacccctgcctcctaaaagaggaatcccttctacctctgtcccgacactcgaatcagccgctgccatcacaacgaagacaccctcagacgaacgggagaagtccacctgtagtatggggagcgagctcctcccgatgataagcccaaggagcccctccccgccactgcccactcacattccaccagagccccctcggaccccaccttttcctgcaaaaacctttcaggttgtccctgagatagagtttcccccatcgcttgacctccaccaggagatcccacagcaagaggatcaaaaaaaggaagtgccaaagaggatactcgaccagaactttggggagccgcacatccctagtcgcctgccacctcttccgcttcatatacgaatacaacaggccctgacaagtccactacccatgactcctattctcgaggggtcacaccgagctcactccctcctctttgaaaatagtgattctttctcagaagattcatccaccctgggcaggacaagaagcctgccgatcaccattgagatgcttaaggtgccggacgatgaggaagaggaggaacagacatgcccgtccacgttcagtgaggaaatgactccgaccagtgtgatcccaaagctgccccagtgcctgagagaggaagaggaaaaggaaagtgacagcgactcagaagggccaattcagtatagagacgaagaagacgaagacgaatcatatcagtccgcactggccaacaaggtgaagaggaaagacacactggcaatgaaactcaatcatcgcccatcagagcctgaactgaacctgaactcctggccctgcaagagcaaagaagagtggaacgaaatcaggcaccaaatcgggaacacccttattcggagactatctcaacgcccaacccctgaagagctggagcagcgcaatatactacaacctaaaaacgaggctgacagacaggcagagaagagagaaataaagcggcgactgactaggaaactgagccagagaccgacagtagcagaattgcttgctcgaaaaatcctgcgtttcaatgagtacgtcgaggttactgatgctcaagattacgacagaagggctgataagccttggactaaactgacccccgctgataaagctgctatccggaaagaactgaacgaattcaagtcgagcgagatggaagtacatgaagagagcaaacattttactcggtaccatcgcccttag

SEQ ID NO: 58186 - DNA, 1938 bp, Artificial Sequence
  Description of Artificial Sequence: Synthetic coding sequence
gaacggccagctgaggaagctgatcaacccaccacagaacccggaatggtgctggatagtgtggaagccggagacactactcctccgactaaaagaaagagcaagttctctggctttgggaagatttttaaaccttggaagtggagaaagaagaagtcatcggacaagtttaaagaaacttctgaggtcttggaaaggaagatttccatgcgcaagcccagggaggagttggtgaaacgcggagtcctgctggaagatcccgagcaggggggagaagatcctggaaaacccagcgatgctatgctcaaaaatgggcacaccactcccataggcaacgcacgctcctcttccccagtccaggtagaagaggaacccgtcaggctcgcctctctgcgtaaggcaatacccgaggaggacctcaaaaagaggctgggaagcactggatcccagccaaatagtgaagccgagtctgtgccagagaacgtcccaaagccacctcttctgcctcccaagcggcctctttccagtagccatgaagcatctgaagggcaggccaaggacgctacatcctccggtggcacagctagatttataattagtacatccattaccaccgcaccagctgcaaccactgccgctaccagtctggccaaaaccgtgaatctctctgtgactccctctccagcacccagaaccttgcccgctgcacctgcgagcactaacacaactgcgactccttcactgacacacatggtccctgcaaaacagccccctatcccaccacctaagcctgctcaccggaacagcaaccctgttattgccgagttatcccaggcgatcaactccggcaccctcctttctaaaccttctcccccactgccccctaagcgcggaatcccttcaacaagcgtgccaacactcgagtccgctgccgctataactaccaagacgccatctgacgaaagggagaagtctacctgctcaatgggaagtgagctcttacctatgattagcccacgaagcccctctcctccacttcccacccacattccaccggagccacccaggacccctccctttcccgctaaaacctttcaggtggttccagagattgagttccctcccagccttgacctgcaccaggaaattcctcaacaagaggaccagaagaaggaggtgccgaaacgaatcctcgatcaaaattttggggaaccacatatacccagtaggctccctcccctccctcttcatattagaatacagcaggccttgacttcccccctgccaatgacaccaatcctggagggctcccatagggcacactccctgctgtttgagaactctgattcattttccgaggacagctccacccttggtcgaacccgctcattgcccattaccatagagatgctgaaggtccccgacgatgaagaggaggaagagcagacctgccccagcactttcagcgaggaaatgactccaacgtccgtgattcctaagctcccccagtgtctgcgtgaggaggaggagaaggagtcagatagcgactctgaaggcccaattcaatatcgagatgaggaggacgaggatgagtcctatcagtccgctcttgctaataaggtgaagagaaaagacacactggccatgaagctgaatcaccgcccaagcgagcccgagttaaatttaaattcatggccttgtaaatctaaggaggagtggaatgaaattcggcatcagattggtaacaccctgattagaaggttaagtcagcgccctactcccgaagagctggagcaacgtaatatactgcagcagtatagagttaaattcggcctaaaaagtctgcttacagagaaggtgtgggcctccctgggactttttgttagtatgttcagcctgactaacccctctccagttctgagtgcattgttgggctag

SEQ ID NO: 58187 - DNA, 2109 bp, Artificial Sequence
  Description of Artificial Sequence: Synthetic coding sequence
atggaggatccttttgaagaggccgaccagcctactactgaacctggtatggtacttgacagtgtcgaggcgggtgataccacacccccaaccaaaaggaagtctaagttttccggcttcggcaagatcttcaaaccttggaaatggagaaaaaaaaagagttccgataagttcaaggaaacaagcgaggttctcgagcgtaagatctcgatgagaaaaccgcgagaggagctggtgaagaggggtgtgctactggaagacccagaacagggaggcgaagatcctggtaaacctagcgacgccatgcttaaaaacggccacactactcctattggaaatgcccgaagtagcagcccagtgcaggtcgaggaggaacctgttaggctggcatcactgcggaaagccattccggaggaagatttgaagaaaaggctcgggtccaccggctcacagcccaattctgaagcggagagcgtccctgagaatgtccctaaacccccattgttacccccaaaacggcctctgtccagctcccacgaggcctccgaggggcaggccaaagacgcaacctcctccggaggcactgcaaggttcataatctcaacatccatcaccaccgccccagcagccactacagcagccacctctctggcaaagactgttaacctcagtgtgacaccctctcctgcccctcggaccctgcccgcagcgcctgctagcacaaacaccaccgcgaccccatcattgacccacatggtacctgccaaacagcctcccatacctccgccaaagccagctcaccggaactccaatccggtcatagcggagctgtcccaggcgattaactcagggacccttctctccaagccatcccccccacttcctcccaagaggggcatcccgtctaccagtgtccccaccctcgaaagtgcggctgcgattacgaccaagactcccagcgacgagagagagaagtcaacatgttctatggggagtgaactcctgcccatgatctcacccagatcacctagccctcctcttcccacacatatccctcccgagccaccacggactccaccttttcctgccaagacctttcaggtggtgcccgaaatcgagttccccccaagcctagatctgcaccaggagatcccccaacaggaggaccagaagaaagaggttcctaaacggattctggaccagaactttggcgagccccatatcccttctcgccttcccccactacccttgcatatcaggattcaacaagcgctgacatcgccccttcccatgacgcccattctagaggggagccatcgcgctcactcacttctcttcgagaactctgatagcttttccgaagattcctcaacacttggacgtacacgaagcctcccaattaccatcgagatgttaaaagtgcccgatgacgaggaggaggaagagcagacctgtccgtctacttttagcgaggaaatgacaccaacatcagttattccgaagctgccccaatgtctacgcgaagaggaggagaaggagtcggatagcgacagtgaagggcctattcagtaccgagacgaagaggacgaggacgaatcctatcagtccgctctggccaataaggtgaaacggaaggataccctggctatgaagctgaatcatcggccaagtgagcccgaactgaatctaaactcctggccatgcaaatctaaagaagagtggaatgagatcagacatcagataggcaatactctgattaggagactaagccagcggcctactccagaagagttggaacagaggaatatccttcaacccaagaacgaagcggatcgccaggctgaaaaacgggagatcaagcgcaggctgactcgcaaactcagtcaacggcctacagtggcagagctgctagcacgcaaaattctccgcttcaacgagtatgtagaagttacagatgctcaagattatgacaggagggcagataagccttggacgaaattaacccctgctgataaagccgctattagaaaagagctgaatgagtttaagagcagtgaaatggaggttcacgaggagtccaagcatttcaccagatatcatcggccttag

SEQ ID NO: 58188 - DNA, 804 bp, Artificial Sequence
  Description of Artificial Sequence: Synthetic coding sequence
atgtctggatgctttcccgtttccgggctgcgatgtctctctcgcgacggccgaatggccgctcagggagccccacggttcctgctcacttttgacttcgacgaaactattgtcgatgagaattctgacgattctatagtcagggcggctcccggacaaagactcccagagtctttaagagcaacttacagggagggcttctataacgaatacatgcagcgggttttcaaatatctgggtgagcaaggagtaagacccagagatttatccgccatttacgaggcaattccccttagccctggaatgagcgatctgctccagtttgtggctaaacagggcgcttgtttcgaggtgattctcatcagcgatgcaaacacctttggtgtcgagtctagcctaagagccgctggacaccatagcctcttccgcagaatattaagcaaccctagcggcccagatgccagagggctcttagccctgcgcccattccacactcactcatgcgcccgatgtcctgccaacatgtgcaaacacaaagtgttgtctgactacctaagggaacgagcccatgacggcgtgcactttgagcgccttttctatgtgggtgatggcgcaaacgatttctgtcccatgggactgctggctggtggggacgtggcgttcccccgtagagggtatccgatgcacagactgatacaggaagcacagaaggcggaaccatctagcttcagagcttccgtcgtgccctgggagacagcagctgatgtgcggctacacttgcagcaggtgctgaaatcctgctag

SEQ ID NO: 58189 - DNA, 879 bp, Artificial Sequence
  Description of Artificial Sequence: Synthetic coding sequence
atgtgccagcggctctggccatggcctgcaaatcagcctctgccgggtggattactccccaggcccctcagcctggcacctagttccagttcctcctgttgtagtcctccttgctcccaggatggaaggatggccgctcagggtgcccctagattcctgcttaccttcgatttcgatgagactattgtcgatgagaattcagacgactccatagtgcgtgccgcacccggacagaggcttcctgagtctctacgggcaacctaccgggagggcttctacaatgaatacatgcagcgcgtgttcaaatatctgggcgaacagggagtgcgcccacgcgacctgtctgccatttacgaagctattcccttgagccccggtatgtcagacctgctgcagtttgtagccaagcaaggtgcatgcttcgaggtcattctaatctccgatgcaaacaccttcggtgttgagagttccctgagagctgccggacatcactcactgtttcggaggatactcagcaacccatccgggcctgatgccagaggtcttcttgctctcagaccattccatacccacagctgtgcacggtgccctgcaaatatgtgcaaacataaagtactatccgattatctgcgcgagagggctcacgacggtgtgcactttgaacgactgttctatgtgggagatggtgccaatgatttctgccctatgggcctgcttgctggtggcgacgtcgcctttccgcgtagagggtacccgatgcacagacttatccaggaagcccagaaagcagaaccttccagctttcgggcatcagtggtcccctgggagacagccgcagatgtgcgcctccacctccagcaggtgctgaagtcctgctag

SEQ ID NO: 58190 - DNA, 615 bp, Artificial Sequence
  Description of Artificial Sequence: Synthetic coding sequence
atgagtggctgcttcccagtcagtggactgcgctgtctgtctcgcgatggaagaatggccgctcagggcgctcccaggttcctacttacattcgattttgacgagacaatcgtggacgaaaattccgatgattctatcgttagagcagcccctggtcagcgtctgcccgagagtctgcgcgctacctacagagaagggttttataacgagtacatgcagcgggtgtttaagtaccttggggaacaaggcgttagacctcgagacctctctgcaatctacgaagcaattccactgagcccaggcatgtcagatctactgcagttcgtcgcaaagcagggagcttgtttcgaagtcattcttattagcgatgctaatacctttggggtggagtccagccttagagccgcaggccaccacagtttatttcggcgtatactgagtaacccctctggccctgatgcaagaggactacttgccctcagacctttccacacccatagctgcgccagatgtccagcgaacatgtgtaagcataaggtcttgtcagactacctcagagaacgtgcacacgatggtgtgcacttcgaacgcctcttttacgttggagatggatag

SEQ ID NO: 58191 - DNA, 336 bp, Artificial Sequence
  Description of Artificial Sequence: Synthetic coding sequence
atgtgccagcgcctttggccatggcctgcgaaccagccgctgcctgggggactgcttcccaggcccctcagcctagcgccaagcagttcgagctcttgttgcagtcctccttgttcacaggacggaaggatggccgcacagggggcacctagattcctactcacgtttgacttcgacgagaccattgtggacgagaacagcgacgactcgatagttcgagccgctccgggacagaggttgcctgagtcgctgagagccacctacagagagggattctacaatgaatacatgcagagagtattcaagtatttaggcgagcagggcgtccgcccatag

SEQ ID NO: 58192 - DNA, 879 bp, Artificial Sequence
  Description of Artificial Sequence: Synthetic coding sequence
atgtgccagcggctgtggccttggccagctaaccagccacttccaggcggtttgctaccaaggcccctgagcctggccccatcctcctccagctcttgctgctcgcccccatgttcacaggatggaagaatggccgcacagggggctcccaggttcctcttgacgtttgattttgacgagaccatagtagatgagaattccgacgacagcattgtcagagccgctcctgggcagcggctgccagaatctctccgggctacatatagggagggattctacaacgaatacatgcagagggtatttaagtatctgggagagcaaggagtcaggccgagagatctcagtgccatctatgaggcgattcccttatctcccggaatgtcagacctcttgcagtttgtagccaagcaaggagcctgctttgaagttatattgatatccgatgctaacacatttggcgtggaatcaagcctgagagctgcgggacaccactccttgtttcgccgtattctcagtaacccctctggccctgatgcacggggtctgcttgcactgaggccatttcatacccacagctgtgcccgttgtcctgccaatatgtgcaaacacaaagtgctcagcgattatctccgagagcgcgctcatgacggagttcatttcgaacgtttgttctatgtcggggatggagcaaatgacttttgccctatgggattactggcgggaggggatgtggcctttccacgaaggggatatcctatgcataggctgatccaagaggcccagaaagccgaacccagtagtttcagggcttcagtagtaccatgggagaccgccgctgacgtgcgcctccatttacagcaggtgctgaagtcctgctag

SEQ ID NO: 58193 - DNA, 726 bp, Artificial Sequence
  Description of Artificial Sequence: Synthetic coding sequence
atgaaaattctgctcgtattcgactttgacaatactatcatagatgataattcggacacctggattgtgcagtgtgctccgaataagaagctgcctatcgagctcagagatagctatcgcaagggcttttggacagagtttatgggcagggtgttcaagtatctgggcgacaaaggcgttagagaacacgaaatgaaacgggcagttacgtcgctgccattcacccctggaatggttgagctgttcaacttcattaggaagaacaaagataagttcgactgcatcattatcagtgacagcaatagtgtatttattgactgggttctggaggctgcatctttccacgacatcttcgacaaggtcttcaccaaccctgccgcatttaatagcaacggccacctcaccgtagaaaattaccatacacactcctgcaataggtgtcctaagaacctgtgcaagaaggtcgtgctgatagagtttgtcgataaacaactgcagcaaggcgtgaactacactcagatagtctacattggagatggagggaacgatgtgtgccccgtgacctttctaaagaatgatgacgtggccatgcccaggaagggatataccttacagaagacacttagtcggatgtctcagaatctggagcccatggaatatagcgtcgtggtctggtcaagtggcgtagatatcataagtcatctccagttcctgatcaaggattag

SEQ ID NO: 58194 - DNA, 411 bp, Artificial Sequence
  Description of Artificial Sequence: Synthetic coding sequence
atgaaaattctgctcgtcttcgactttgacaacactatcatcgacgacaattccgatacctggatcgtgcaatgcgctcccaacaagaaactgccaatcgagctcagagactcctataggaaaggattctggaccgaatttatggggagggtgttcaaatatctcggtgataagggcgtcagagaacacgaaatgaagcgcgcagtgaccagcctacccttcacacctgggatggtcgagttatttaatttcatcaggaagaacaaagataagttcgattgcattatcattagcgactctaactctgtgttcatcgactgggtgctggaagccgcatccttccacgatattttcgataaggtttttactaacccagccgctttcaattccaatggacatctcacggtctag

SEQ ID NO: 58195 - DNA, 171 bp, Artificial Sequence
  Description of Artificial Sequence: Synthetic coding sequence
atgaagatcctcctggtgtttgattttgacaacactatcatcgatgataactccgacacctggattgtccagtgtgcacccaacaagaagctcccgatcgaactgcgtgactcatatagaaaaggattctggacggaatttatggggcgagtcttcaagtacttaggatag

SEQ ID NO: 58196 - DNA, 150 bp, Artificial Sequence
  Description of Artificial Sequence: Synthetic coding sequence
atgaagatcctcttggtgtttgattttgataatactataatcgacgacaactctgatacttggattgttcaatgcgcacccaataaaaagttgccaatcgaacttcgagactcttatcgtaaggggttttggacagaattcatgggctag

SEQ ID NO: 58197 - DNA, 936 bp, Artificial Sequence
  Description of Artificial Sequence: Synthetic coding sequence
atggtgcaagccataaaatgggtcgatgaagtcgtgccagcagccccttatgttaccaccctggagaccctggataagtataattgcgacttttgtgttcacggaaatgacatcacactcactgtcgacggtcgggacacctatgaagaagtgaaacaagcgggtcggtacagggagtgtaaaaggacccagggagtctctacaaccgacctggttggccgaatgttgctagtgaccaaggcccatcacagctcccaagagatgagctctgagtatcgagagtacgccgacagcttcgggaagtgtcccggaggcagaaacccttggactggagtctcccaattcctccagacctctcagaaaataattcagttcgcttcaggtaaggagccgcaacccggtgaaaccgtcatttacgtagcaggcgcattcgatttgtttcacataggccacgtggatttcctggaaaaggtacaccgcctcgccgagcgcccttatattatcgccggtcttcattttgatcaggaggtcaaccactataaggggaaaaactaccctataatgaacttacatgaacggactctgtccgtacttgcttgtagatatgtttccgaagtagtgatcggagctccttacgctgtaacagcggagttgctgagtcactttaaggtggacttggtatgtcacggcaagactgaaatcattcccgaccgggacgggtccgatccctatcaagagccaaagagacgaggaatcttccgccagatcgacagtggttccaacctcacaactgatctgattgtgcaacggatcattactaatcgtctggagtacgaggccaggaatcaaaagaaggaagcaaaggaattggccttcctcgaggccgcacgtcagcaggcagcgcagcctctgggcgagagggacggcgacttttag

SEQ ID NO: 58198 - DNA, 1224 bp, Artificial Sequence
  Description of Artificial Sequence: Synthetic coding sequence
atgatccggaatggacggggagcagcagggggagccgaacaacctggccctgggggtcgacgcgcagttcgtgtgtggtgcgacggatgttatgacatggtgcattatggacactctaatcaacttcgacaggctcgagctatgggggactacttaattgtgggcgtgcacactgacgaggagattgctaaacacaagggaccgccagtctttactcaagaggaaagatacaagatggtgcaggccatcaagtgggtggacgaagtggtccctgctgctccctatgtgaccacccttgagaccctcgacaagtacaactgtgatttttgtgtccacggtaacgatatcaccttgacagtagacggaagagacacgtacgaggaggtgaagcaggctggacggtaccgtgagtgtaaacgcacccagggggtctcgacgacagatcttgtgggcagaatgctcctcgtgactaaagcacaccattcttcccaggagatgtccagcgaatacagagagtacgctgactcatttgggaagccgcctcatccaatccccgctggggatattctgagttcggaaggatgctcccagtgtcccggaggtagaaacccatggactggagtgtctcagttcctgcagaccagccaaaaaataattcaattcgcttctggtaaggagccacaacctggggagaccgtcatttacgtggccggagcatttgacctcttccatatcggccatgtggatttcctggaaaaagtgcaccgcctcgcagaaagaccctatattattgccggactgcattttgatcaggaagtaaatcactacaaaggcaagaattaccccatcatgaacctccacgaaaggacgctgagcgtgttagcttgtcgctatgtatcagaagtggtaattggagcgccttacgcggtgaccgctgagttactgtcccattttaaggtggatctcgtatgtcatggaaaaaccgagataattcctgaccgcgacggcagtgacccataccaggagccaaagcggagaggcatctttcgtcaaatcgactctggaagcaacctcacaaccgacttgatcgtacagcggataatcacgaacaggctggagtacgaagccagaaaccagaaaaaagaagcaaaggagctcgcttttctggaagccgctcgacagcaagctgcccagccactgggagagcgggacggggacttttag

SEQ ID NO: 58199 - DNA, 1170 bp, Artificial Sequence
  Description of Artificial Sequence: Synthetic coding sequence
atgattcgtaacggcagaggcgcagcaggcggtgccgaacaaccaggccctgggggtcgcagggccgttagggtttggtgcgatgggtgctatgatatggtccattatggccacagcaaccagttaagacaggccagagctatgggcgattatctgatcgtgggggtgcacaccgacgaagaaatcgcaaaacataaagggcctcctgtcttcacccaagaggaaagatacaaaatggtgcaagcgattaaatgggtcgacgaagtggttcctgcagcgccatatgtaacaaccctggagactcttgataaatacaactgtgacttctgtgttcatggcaacgacatcaccctgacagttgatgggcgagatacctatgaggaagtcaagcaggccggacggtacagggagtgtaaacggacccagggcgtgtccacaaccgacctggtcgggagaatgctattagtcacaaaggcccaccacagttcccaggaaatgtctagcgaatatcgggagtacgcagactccttcgggaagtgccctgggggtagaaacccctggaccggtgtgtcgcagtttttgcaaacctcccagaagattatccagttcgcctcaggcaaggaaccccaaccaggcgaaactgtgatatatgtcgccggagcgttcgatctcttccacatcggtcatgtggatttccttgaaaaggtgcaccgtctagccgaacgcccttatatcattgcaggcttgcatttcgaccaggaggttaaccactataagggcaaaaattatcccataatgaatcttcatgagagaaccctgtctgtgctggcctgtagatacgtctccgaggtcgtgattggagccccttatgccgtcacagcagaactgctgtcccattttaaggtggaccttgtttgccatggaaaaactgaaattatccccgaccgtgacgggagtgatccctaccaggaaccaaagaggaggggcatcttccgacaaatcgactctgggagcaacttgaccacggacctaatcgtccagagaatcatcaccaatcgactcgagtacgaggctcggaatcagaaaaaagaggccaaggagctggcattcttggaggccgcaaggcagcaggccgctcagccattgggagaaagagatggggacttctag

SEQ ID NO: 58200 - DNA, 1515 bp, Artificial Sequence
  Description of Artificial Sequence: Synthetic coding sequence
atgagcgagaaacagatgaaggaagcatttgttagtaatctgaatgggaccacagttcttgaaatcacacaagggctgtgttttcccgcattttgtatcctgtgcagaggctttctcataatcttctcacagtatctttgctccttttcgccgacttggaagactcgctttcttactgattttgtggttcttatagtccctatggtggcaacactgacaatctgggccagctttatcttgctggagctgctgggagtgataattttcggcgcaggcctactgtaccaaatttatcggaggaggacatgttatgctcggcttcccttcctcaagattttggagaaatttctcaatattagcctcgaaagcgagtataaccccgctattagttgttttcgagtgatcacaagcgcattcacagctatagctatcctggctgttgacttcccattgtttccacgaaggttcgcaaaaaccgaactgtacggtacaggagctatggattttggggtcgggggattcgtgttcggctccgccatggtctgtctcgaggttcgaaggcgcaagtacatggagggttcgaagttgcactatttcaccaacagcttgtattccgtctggcccctggtgttcctcggaatcgggcgacttgctataatcaagagcattggctaccaagaacatcttacagaatacggagttcattggaactttttttttaccatcatcgtggtcaagctcataacacctctactgctcataatctttcctcttaataagtcctggatcatagcactgggcatcaccgtgctttaccagctcgcccttgatttcacgtccttaaaaagactcatactatatgggaccgatggctcaggaacccgtgttgggctccttaacgctaatcgggagggcatcatcagcacactgggatacgtggcaattcacatggccggtgtgcagaccggcctatacatgcacaagaatagatctcatatcaaggacttaattaaggtcgcttgctttctcctgttggcagccatatccctttttatctcattatatgtcgtacaggtgaacgtggaagccgtttctcgtaggatggctaacctcgccttctgtatctggatcgtcgcatctagcctgatcctgctatcctcccttctactgggcgacattatcttaagctttgcaaagttcctgattaagggggctctcgtgccgtgctcctggaaattaattcagagccctgtcacgaacaagaagcactctgagtcactggtgcctgaggcagaacggatggagccttcgttgtgcctgattactgctttgaacaggaaacaactcatcttcttcctcctcagcaatataaccaccggactgattaacttgatggtggacaccttgcactcctcaactctttgggctctatttgttgtaaatctgtatatgttttctaactgcctcatcgtgtacgtcctctacctgcaggacaaaacggtacagttttggtag

SEQ ID NO: 58201 - DNA, 807 bp, Artificial Sequence
  Description of Artificial Sequence: Synthetic coding sequence
atgctgctcaaggaataccgaatctgtatgcctctgaccgttgacgaatataagatcggacagctgtatatgatatcgaaacacagccacgaacagagcgacaggggcgagggtgtcgaagtagttcagaatgaacccttcgaggacccacaccatgggaacggccagtttacagaaaagcgcgtgtatctgaactctaagctaccgtcctgggctagggctgtagtgcccaagattttctacgtgacagagaaagcctggaattattacccctatactatcaccgaatatacgtgctccttcctgcctaaattttccatacatatcgagaccaaatatgaagacaacaaaggttcaaacgacacaatcttcgacaacgaggccaaggacgtggaacgcgaagtctgttttatagacatcgcatgtgatgagatacctgagcggtactataaggagtctgaggatcccaaacatttcaagtccgaaaaaacggggcgaggccagctccgtgaaggatggagggactctcatcagcctattatgtgtagctacaagctggtaaccgtgaagttcgaggtgtggggtttgcagacaagagtagagcagtttgtccacaaagttgtgcgggatatactgctcattggccatcgccaagccttcgcatgggtggatgagtggtacgacatgactatggacgacgttcgcgagtacgagaagaatatgcatgagcagacaaacattaaggtctgtaaccagcacagctcacctgttgacgatatcgagtcccacgcccaaacctccacatag

SEQ ID NO: 58202 - DNA, 807 bp, Artificial Sequence
  Description of Artificial Sequence: Synthetic coding sequence
atgctgcttaaggagtaccgtatatgcatgcctctaacagtggatgaatacaagataggacagctgtatatgattagcaaacatagccacgagcagtcagaccggggagaaggcgttgaggttgtacagaacgagccatttgaagatcctcatcacggaaatggacagttcacagaaaaaagagtttacttaaacagcaagttgcctagttgggcacgcgctgtagtgcctaagatattctacgtgacagaaaaggcctggaactactacccgtatactatcaccgaatacaaatgttcattcctgcctaaattttccatccatattgaaactaaatacgaagacaacaaaggtagtaacgatactattttcgacaacgaggccaaggatgttgaacgtgaggtctgttttatcgacatcgcctgcgatgagattcccgagaggtattataaagagtctgaggatccaaagcactttaagtctgagaaaaccggaagaggtcagctacgcgaaggctggagggatagccatcaaccgatcatgtgctcctacaagctggtgaccgttaagtttgaggtttggggccttcaaacgagagttgagcagtttgtgcataaggtggttagagacatccttctgatcggacaccgccaggcattcgcttgggtcgatgagtggtacgacatgacaatggacgatgtgcgggagtacgaaaagaacatgcatgagcagacaaatattaaggtgtgtaaccagcattcttctcccgtggacgatatcgaatctcatgcccagacaagcacttag

SEQ ID NO: 58203 - DNA, 999 bp, Artificial Sequence
  Description of Artificial Sequence: Synthetic coding sequence
atgctgctcaaggaataccgaatctgcatgccccttacagttgatgagtacaagattgggcagctgtatatgattagtaaacacagccacgaacaatccgatcggggtgaaggtgtcgaggttgtccagaacgagcccttcgaagatccccatcatgggaacggacagtttacagagaagcgggtgtacttaaatagcaaacttccaagctgggcacgagccgtggttcctaagatcttctacgtgacggagaaagcgtggaattattacccatacaccataaccgagtacaaatgtagctttctgcccaagttcagtattcacatcgagaccaagtacgaggataacaaaggcagcaatgatactattttcgataacgaggctaaggacgtagagcgagaggtgtgttttatcgatatcgcatgcgatgaaatccccgagagatactacaaggaatcagaggacccgaagcacttcaaatccgagaagaccggaaggggtcagctcagagagggatggagagacagccatcagccgataatgtgtagctacaaattagtgactgtgaaattcgaagtgtgggggctgcaaactagggtcgagcagtttgtacacaaggtcgtgagagacatcttgctcatcggccacaggcaggcattcgcatgggtggatgaatggtacgacatgactatggacgaggtcagggagttcgaacgagctacccaggaggctactaataaaaagattggcatctttccccctgctatttctatctcttccataccgctcttgccgtcctctgttcgcagcgcaccttcttctgccccttccactcccctgtctacagacgcccctgagtttctctctgtgcccaaggaccgtccacggaaaaaatccgcccctgaaaccttgaccctgccggaccctgaaaagaaggccacactaaacctgcctggcatgcactctagcgataagccctgccggccaaaatctgaatag

SEQ ID NO: 58204 - DNA, 801 bp, Artificial Sequence
  Description of Artificial Sequence: Synthetic coding sequence
atgcataacattctgaagaaatatcaccaatatattgtagagtgccatggaatcacattgttgccccagttcctgggcatgtacaggctgaacgtcgatggggtggagatctacgtgattgtgactcggaatgtgttttctcacaggctctccgtctacaggaagtatgatctcaaaatggccaacctgaaagctacattcacattccctaagcccactggctctactgtcgctcgggaagcttctgataaggagaaggccaaggaactgcccacgctgaaggataatgacttcatcaatgagggccaaaagatctacatcgacgataacaacaagaaggttttccttgaaaaattaaaaaaggatgtggagtttctggcccagctcaagcttatggactattccctgttggtgggaatacacgacgtagagagagccgagcaggaggaggtggaatgcgaagagaacgatggggaggaggagggagagagcgacggcacccatcccgtaggaaccccacctgactctccaggaaacacattaaattctagccctcctttagctcccggagagtttgacccaaacattgacgtttacgggatcaagtgtcatgaaaactcacctaggaaagaagtgtattttatggctattattgatatactgacccattacgacgccaaaaagaaggccgcacatgcagcaaaaaccgtgaagcatggtgccggagctgagatatcaaccgttaatcctgagcagtattctaagaggttcctggattttatcggccacattctcacttag

SEQ ID NO: 58205 - DNA, 669 bp, Artificial Sequence
  Description of Artificial Sequence: Synthetic coding sequence
atgtggggcgtaaaccacagtatcaacgaattgtcacatgtccagattccagttatgcttatgcccgacgactttaaagcctatagcaaaatcaaggtggacaaccacctgttcaacaaagaaaatatgcccagccattttaagttcaaggagtactgccctatggtattcaggaatctgcgggaaagatttggcattgacgaccaggattttcaaaactcactgacccgatcagcgcctctgcccaatgacagtcaggccaggtccggagctaggtttcacacctcttatgacaagaggtatatcataaagacgattacatctgaggatgtggccgagatgcataacattctcaagaagtaccatcaatacatagtggagtgtcacggtatcacgctgctgccccaattcctgggcatgtatagactgaacgtggacggggtggaaatttatgttatagtaaccagaaacgtgttcagccacaggctgagcgtgtaccggaagtatgaccttaagggatctacagttgcgagggaagccagtgataaagagaagtcacccacacctgccattgttgtactccccgtcccccatagtgcagcgacgtcagaaaaacattgcatcgaccctatgagggtgctgctgcatttctccagctctaattgctag

SEQ ID NO: 58206 - DNA, 1221 bp, Artificial Sequence
  Description of Artificial Sequence: Synthetic coding sequence
atggcgacccccggtaacctgggcagcagcgtgcttgctagcaaaaccaagaccaaaaaaaaacacttcgtggcacagaaggttaagctgttccgagcctcggacccgcttttgtctgttctcatgtggggcgtgaatcattctattaatgagctctcacatgttcagatacctgtcatgctaatgccagatgatttcaaggcctatagtaagatcaaagtagataaccatctgttcaacaaggagaatatgcctagccatttcaagttcaaggaatattgcccaatggtgtttcgcaatctccgtgaacgcttcggaattgacgaccaggatttccagaactcgctgacccgcagtgccccactccctaatgattctcaggctaggtccggagccaggtttcacactagctacgacaaacgctatatcataaagaccataacctcagaggatgtggctgagatgcataatattttaaagaaataccatcagtatatcgttgagtgccacggcatcacgctgctaccacagtttctcggcatgtacagactaaatgtggacggtgtcgagatctacgtgatcgttacccgcaatgtgttcagccaccgcctctcagtctatcggaaatacgacttgaagggttcaacagtggccagggaagcctcggataaagaaaaagccaaagagttgcctaccttgaaggataacgactttattaacgaggggcaaaaaatttatattgatgacaacaacaagaaggttttcctggagaagctgaaaaaagacgtggaatttctggctcagctgaagcttatggattattccctgttggtgggaattcatgatgtggaaagggctgaacaggaggaagtcgagtgcgaagaaaatgatggtgaagaggagggggaatcggacggaacgcaccctgtcggtactccgcctgatagtcccggtaacacccttaattccagtccacccctagcccctggcgagttcgaccctaacattgacgtctatgggatcaagtgccacgaaaactcacccaggaaagaggtttacttcatggccatcattgacattttaacacattacgatgcaaagaagaaagccgcacacgcagccaaaacagttaaacacggcgctggggcagaaatctcaaccgtgaaccctgagcagtactcaaagaggtttcttgattttattggtcacatcttaacgtag

SEQ ID NO: 58207 - DNA, 648 bp, Artificial Sequence
  Description of Artificial Sequence: Synthetic coding sequence
atcaacgagctttcccatgtgcaaatcccagtaatgcttatgccagacgactttaaagcgtactcaaaaatcaaagtagataaccacttatttaataaagaaaatatgccttcccattttaaattcaaggagtactgtcctatggtgttccgaaacctgagggaacgattcggaatcgacgaccaggacttccagaattcacttaccagaagcgctccactgcccaatgacagtcaggcacggtcgggggcaaggttccacacttcttacgacaaaaggtacattattaagaccatcacaagtgaagacgtggctgaaatgcacaatatcctcaagaaataccaccagtacatagtcgaatgtcacggcattaccctgcttccgcagtttttggggatgtaccggcttaatgtcgacggggtagaaatatatgtgatagtgacaagaaatgtattctctcaccgtctctcggtataccggaagtatgacctcaaagggtccacggtggccagggaggcgtctgacaaggaaaagtcccccacacctgcaatcgtggtactccccgtgccccactcagcagctacttcagagaaacactgcattgaccctatgagagttctgttacacttctcgtcaagtaattgctag

SEQ ID NO: 58208 - DNA, 228 bp, Artificial Sequence
  Description of Artificial Sequence: Synthetic coding sequence
atcaacgaattgagtcacgttcagatcccagtaatgctgatgccagatgattttaaagcttactcaaagatcaaagtagataaccatctgtttaataaggaaaatatgcctagccacttcaagtttaaggaatactgccctatggttttccgcaaccttcgggaacggttcggcatcgatgatcaggatttccaagtgtcctgcgtctgtaatatctgttttcagtag

SEQ ID NO: 58209 - DNA, 1044 bp, Artificial Sequence
  Description of Artificial Sequence: Synthetic coding sequence
atgctaatgcctgatgacttcaaggcctactctaagattaaggtggataaccatttatttaataaggaaaatatgccgtcccacttcaaattcaaggagtattgcccaatggtgttccgtaatttacgagagcggttcggaatagacgatcaagacttccagaattctctgaccaggtcagcccctttgcccaatgattctcaggctcgttcaggggctaggttccatacatcctatgacaagagatacatcattaagactatcacttccgaagatgtcgctgagatgcataatattctcaaaaagtaccaccagtacatcgtcgaatgccacgggatcacactcctacctcagtttctagggatgtataggttgaatgtggatggggtcgagatttacgtaatcgtgacccggaatgtgttcagtcatcgcctgagtgtttatcgcaagtacgacctgaagggatccacagtcgccagagaagccagcgataaagaaaaagccaaggaacttcccacattaaaagacaatgacttcattaatgaagggcagaagatatacattgatgataataacaagaaggttttcctggagaagctcaagaaggatgtcgaatttctagcccagctcaagctcatggactattccctgctggttggaatccacgatgttgagcgcgcagagcaagaggaggtcgaatgcgaagagaatgacggcgaagaggagggtgaatccgacggtactcacccagtcgggacgcctcccgactctcctgggaacacactcaatagctctccaccacttgccccaggcgaattcgaccctaatatagacgtttacgggatcaagtgccacgaaaactcccccagaaaggaagtatacttcatggccattatcgacattctcacacactatgatgctaagaaaaaggcggcacacgccgcaaaaaccgtcaaacacggcgctggagctgaaatatcgactgtgaatccagaacaatactccaagaggtttcttgactttatcggacacattctcacttag

SEQ ID NO: 58210 - DNA, 972 bp, Artificial Sequence
  Description of Artificial Sequence: Synthetic coding sequence
atgggcggacaggtatcagcctctaacagcttctcccggcttcactgtagaaatgctaatgaggattggatgtctgccctttgtcctcgcctgtgggacgtcccactccaccatttgtccatccccggatctcacgacacaatgacttattgtctgaacaaaaagtccccaatatcacacgaggagagcaggctgctgcagctgctcaataaggccctgccatgtattaccagacccgtcgtgttgaagtggtctgtaacgcaggctctcgacgtcacagaacagctggacgccggagtgagatatctcgacctccgaattgcgcacatgttggaaggctcagagaagaatctgcacttcgtccacatggtttatacaactgctctagtcgaggacactctcactgaaatctcagaatggctggagcgacatccccgagaggtggtaattttagcatgtcgcaacttcgagggcctatccgaggaccttcatgagtacctcgtggcctgtatcaagaatatcttcggcgacatgctttgccccagaggagaggttcccaccctgagacagctctggtctcgcggacagcaagtgatcgtatcctatgaggacgaatcctctctccgaaggcatcatgagctttggcctggagtgccttactggtggggcaatagagtgaagactgaagccctgattcgctatctagagacaatgaaatcctgcggcagacctgggggactttttgtcgcaggcatcaacctaacagaaaacctgcagtacgtgttggcccacccatcggaatccctggagaaaatgactcttcccaacctgccgagactgagtgcatgggtgcgtgagcagtgcccagggcctggctcaagatgtacaaacataattgcaggagatttcattggggctgacgggttcgttagcgacgtaatcgcactgaaccagaaactactgtggtgttag

SEQ ID NO: 58211 - DNA, 972 bp, Artificial Sequence
  Description of Artificial Sequence: Synthetic coding sequence
atgggcggacaggttagcgcctcgaactcgttctcgagactgcattgcagaaacgcaaacgaggactggatgagtgcattgtgtcctagattatgggacgtccccctgcaccacctgagcattccaggcagtcacgacacgatgacctactgtctcaacaaaaagtccccgatctcccacgaggagagcagactcttgcagctattgaacaaggcgttaccttgtattacacgaccagtcgtcctcaagtggtcagtgacccaggccctcgatgtgaccgagcagctggatgctggtgtgagataccttgatctccggattgcccacatgttagagggctccgagaaaaatctgcacttcgttcacatggtttacacaacagcgttagtcgaggacacgttaaccgagataagcgagtggctcgagagacacccaagggaagtcgttatcctagcctgcaggaattttgagggcctgagcgaggacctgcacgaatatctggttgcttgcatcaaaaacatcttcggtgatatgctatgtcctcggggagaggtgcctactctgagacagctgtggtctcggggacagcaggtgattgtgtcatacgaggatgagagttctctccggaggcatcatgaactttggcccggagtgccctattggtggggaaatcgcgtgaaaactgaagcgttaatccgatacctagagaccatgaaatcttgcggacggcctggcggtctattcgtggcagggatcaatttgacagagaacttgcagtatgtgcttgctcatcctagtgaaagccttgaaaaaatgacgctgccaaatttgccacggctctcggcctgggtgcgcgagcaatgccccggtccagggtctaggtgcacgaatattatagctggagattttatcggggctgacggctttgtgtccgacgtgatcgctctcaaccaaaagctgctgtggtgctag

SEQ ID NO: 58212 - DNA, 972 bp, Artificial Sequence
  Description of Artificial Sequence: Synthetic coding sequence
atgggcggtcaggtgtccgcatccaacagtttcagccgtctgcactgcaggaatgctaacgaagattggatgagcgccctctgcccccgtttgtgggatgtccccttgcaccatctgagcatccctggtagccacgacactatgacttactgtttaaataagaagtctcccatctcccacgaggagagtcgcctgcttcagcttctgaataaggccctgccatgtatcacacggccagttgtgctcaaatggtccgtgactcaggcgttggatgtaacagagcagttggatgcaggcgtcagatacttagacctgcggatcgcccatatgctcgaagggagtgaaaaaaatctgcatttcgttcatatggtctataccacagcactcgttgaggacactctgaccgagatttccgaatggttggagcgacacccccgagaggtcgtgattctggcttgtcgaaattttgagggcctgtccgaggatctccacgaatacctggtggcctgcataaaaaacattttcggtgacatgttatgtcccagaggggaggtgcccacccttcgacagctttggtctcggggtcaacaagtcattgtcagttatgaggatgaatcttctttgcgaagacatcacgaactatggcccggagtcccctactggtggggcaatagagtcaagaccgaagccttaattagatatctggaaactatgaagtcttgtggtcgccctggaggtttgttcgtcgctgggatcaatctcaccgaaaacctacagtacgtcctcgctcacccttcggagtctttggaaaagatgactctgcccaatctacccaggctaagcgcatgggtgcgagagcagtgtcctggcccaggctcaagatgcacaaatatcatcgctggggatttcatcggggcagatgggttcgtctccgacgttatcgcattaaatcagaagctgctttggtgctag

SEQ ID NO: 58213 - DNA, 537 bp, Artificial Sequence
  Description of Artificial Sequence: Synthetic coding sequence
atgggagggcaggtcagtgcttccaattccttcagtcggcttcattgcagaaatgcaaatgaggattggatgtctgctttgtgtccaaggctatgggacgtccctctgcaccacttgtctatcccaggttcccatgatacgatgacatattgtctgaacaagaaatcgcctatttcacatgaagaaagtaggttgttgcagctgctgaacaaggccctgccatgcattactcggcctgtggtgctcaaatggtccgtaacacaggctctggacgttacggagcagctcgatgctggggtgcgatatcttgacctccgaatcgctcacatgcttgagggatcagagaaaaacttgcatttcgttcacatggtctatactacagcgctggttgaggacactctcactgaaattagcgagtggctcgagagacacccaagggaggtggttattctggcatgccgcaactttgagggcctgtccgaggacttgcatgagtacctcgttgcttgcataaaaaatatttttggtgacatgtag

SEQ ID NO: 58214 - DNA, 183 bp, Artificial Sequence
  Description of Artificial Sequence: Synthetic coding sequence
atgggagggcaagtgtccgccagtaacagtttttctcggctgcattgcagaaacgctaacgaagattggatgagcgcactgtgcccgagactctgggatgtccctctacaccatctgtcaatccctggaagtcacgacaccatgacctactgtctgaacaaaaagagccccatttctcactag

SEQ ID NO: 58215 - DNA, 525 bp, Artificial Sequence
  Description of Artificial Sequence: Synthetic coding sequence
atgggtggacaggtcagcgcgtctaatagcttcagccgtcttcattgtcgcaacgccaatgaggactggatgtccgctctgtgtccacgtctttgggatgtgccattgcaccatctttccattcccggatcccatgacactatgacttattgtctgaacaaaaagtcccctattagtcacgaggaatcccgcctgctacagctgctgaacaaggctctgccctgcataacccgacccgtggtactgaagtggtccgtgacccaagcactcgatgtaactgagcaacttgacgctggtgtgcgttatttagatctgagaattgctcacatgctcgaaggcagcgagaagaacttgcactttgtgcatatggtgtacactaccgctctggtagaggacaccttgaccgaaattagcgagtggctggaaagacaccctagagaagtcgtgatcttagcttgcaggaactttgaaggcctgagcgaggatctgcatgagtatctcgtggcatgcatcaaaaacatttag

SEQ ID NO: 58216 - DNA, 225 bp, Artificial Sequence
  Description of Artificial Sequence: Synthetic coding sequence
atgggcggtcaggtgagcgcttctaactcattttcgcgcttgcattgccgcaatgccaatgaagactggatgtccgccctctgccctcgcctctgggacgtccctcttcaccatctcagcattcctgggtcccatgacacgatgacatactgcctaaataagaagagccccatttcccatgaagagtcaagactactccagctgctgaataaggctctcccatag

SEQ ID NO: 58217 - DNA, 267 bp, Artificial Sequence
  Description of Artificial Sequence: Synthetic coding sequence
atgggcggacaggtttccgctagtaatagcttttctagactgcactgccgcaacgcgaacgaagattggatgtccgccctgtgtcccaggctttgggacgtgcctctgcatcatctgtccatcccaggaagtcacgatactatgacgtattgcctgaacaaaaaaagccccattagccacgaagaatccaggctgctgcagctgctgaacaaagctctcccatgtattacccgccctgtggtcttgaaatggagcgtaacccaatag

SEQ ID NO: 58218 - DNA, 525 bp, Artificial Sequence
  Description of Artificial Sequence: Synthetic coding sequence
atgggtgggcaggtaagtgccagcaacagctttagtcgtctccattgccggaacgccaacgaggactggatgtccgcactgtgcccacgcttgtgggatgtccctctgcatcatctctcaatccctgggtcacatgacactatgacctactgtctgaataaaaaaagtccgatctcccacgaggagagtaggctgctccaacttctgaacaaggctctgccgtgtatcacccgccctgtggttctcaagtggtcggtgacgcaggcgctcgacgtgactgagcagttggacgccggagttcgttacttagaccttagaattgctcacatgctggagggatccgagaaaaatctgcactttgtacacatggtgtacacgaccgccctggtggaggacacactcaccgaaatctcagaatggttagaaagacaccccagagaagtcgttatccttgcatgtagaaacttcgaggggctgtctgaagatctgcatgagtacctcgtggcatgcataaagaatatctag

SEQ ID NO: 58219 - DNA, 375 bp, Artificial Sequence
  Description of Artificial Sequence: Synthetic coding sequence
atgggcggacaggtgtcagcttctaatagtttctcccgattacattgtcgcaatgccaacgaggactggatgagtgccctgtgccctcgtttgtgggacgtccccctgcatcatctgagcatccctggttcccacgacaccatgacctactgcctgaataaaaagagcccaatttcacatgaagagagccgcttactccagctcctgaataaggccctcccctgtatcactaggccggtagtgcttaagtggagtgtgacccaggctctggatgtaacggagcaacttgacgccggtgttagatatctggacctgcggatcgcccacatgttggagggaagcgagaagaacctgcacttcgtgcacatggtgtag

SEQ ID NO: 58220 - DNA, 915 bp, Artificial Sequence
  Description of Artificial Sequence: Synthetic coding sequence
atgttagccgtcaggaaagccaggaggaagctccgcatgggtaccatatgttcccccaacccatcagggacgaagactagcagcgaagtttgtaacgctgactggatggcgtccctcccccctcacctacataatctgccactaagtaatctggcaattccaggcagccatgatagttttagctactgggtcgacgagaaatcgcccgtggggcctgaccaaactcaggcgatcaagaggctggccaggatcagcttagtgaagaagctcatgaagaaatggtcagtgacccagaatttaacattccgcgaacagctggaagcgggtatccgatatttcgacttgagggtctcctcaaaacccggtgatgcagaccaggagatctatttcatacatggcttgtttggtattaaagtttgggatgggctgatggagatagactccttcctaacccaacatccccaggagattatttttttagattttaatcacttttatgctatggacgagacacaccataagtgtcttgtgctgaggattcaggaagcctttggtaataagctatgtcccgcttgctcagtggaatcactaaccctccggactctgtgggaaaaaaactgtcaagtattgatcttttatcattgccccttttataaacagtatcccttcctgtggcctggcaagaagattcccgctccctgggctaacactacatccgttagaaaactgatcctgtttctggagaccaccctctcagagcgggcttctcgaggttctttccatgtttcccaagccatcctgacccccagggtgaaaacaattgccaggggccttgttgggggactgaaaaatacactcgtacaccgactcgccttgatcccggtgtaccctctccgtttcagccgcaggagttag

SEQ ID NO: 58221 - DNA, 918 bp, Artificial Sequence
  Description of Artificial Sequence: Synthetic coding sequence
atgttggctgtgcggaaagctagaaggaaacttagaatgggcacaatatgctcgcccaacccaagcggtacaaagacatcatccgaggtgtgcaatgctgattggatggcatctcttcctccccatctgcacaacctgcccctgagcaaccttgctattccaggctcacacgacagcttttcctattgggtagatgaaaagtctcccgttgggcctgaccagacacaggccattaagagactcgctcgcatttcactcgtaaagaagctgatgaaaaagtggtcggtgacccaaaacttaacattccgcgaacaactagaagccggaatccgctacttcgatctccgcgtttcatcgaagcctggcgacgccgatcaggagatctacttcattcatggcttatttggcataaaagtgtgggatggcttgatggaaattgatagtttcttgacccagcatccccaggagatcatctttctagacttcaaccacttttacgccatggacgagacccaccacaagtgcttagtgctgcgcattcaagaggccttcggcaataaactgtgtcctgcctgcagcgtagaaagcctgaccctccggaccctgtgggaaaaaaactgtcaagtgctgatcttttatcattgccccttctacaagcagtacccctttctctggcccggaaaaaagatacccgcaccctgggccaacaccacaagtgtgcgaaagcttatactgttcctggagacgacattgtctgagcgggcttctcgtggatcgttccacgtatcccaggccattctcacacctcgagtaaaaacaatcgcgagaggcctggttggtggattgaagaataccctggtacatagcaatcgatggaatagccacggaccttctctcctgtcacaggaacgcagctag

SEQ ID NO: 58222 - DNA, 966 bp, Artificial Sequence
  Description of Artificial Sequence: Synthetic coding sequence
atggcttccagccagggaaagaacgaattgaagttggccgattggatggctacactgcccgagagcatgcattccatcccgctaaccaacctcgccatcccaggctctcacgattctttctccttttatatcgacgaagcttcccctgtaggacctgaacaacctgagaccgtacagaacttcgtcagcgtttttggaaccgtggcaaagaagctgatgcgcaaatggctcgctacccagactatgaatttcactgggcagctgggagctggcatccggtacttcgatctacggatttccaccaagcccagggatcccgataacgagctctactttgcgcatggactgttttcagccaaagtaaacgagggcctggaggagatcaatgctttcctgactgatcaccacaaggaggtagtttttcttgatttcaaccatttttatggaatgcaaaagtatcaccatgaaaagctggtgcagatgctcaaggacatttacggtaacaaaatgtgtccagccatctttgcccaagaggtgtcgttgaagtacctttgggagaaggattatcaggtactcgtgttctaccactctccggtcgccctggaagtccctttcctgtggccagggcagatgatgcctgctccatgggcgaacactaccgaccctgaaaaactgattcagtttcttcaggcttccattaccgagagaagaaaaaagggaagcttctttatcagccaagtggtcttgactcctaaggcctcaacggtcgtcaagggcgtagcctcagggctccgtgagaccattaccgagagggcgctgccggctatgatgcagtgggttcggactcaaaaacccggagagagcggaattaacatcgttacagccgatttcgtggaactaggcgatttcatctccaccgtgattaagttgaattatgtctttgatgaaggtgaagccaatacctag

SEQ ID NO: 58223 - DNA, 966 bp, Artificial Sequence
  Description of Artificial Sequence: Synthetic coding sequence
atggccagctcacagggtaaaaatgagctgaaactcgctgattggatggccactttgcccgaaagcatgcactccatccccttaaccaatcttgctattcctggatcacacgacagtttcagcttctacattgatgaggcaagccctgtgggcccagaacaacctgaaactgtgcagaattttgtgagtgtgttcgggaccgttgcgaagaaactcatgagaaaatggctagccactcaaacaatgaacttcaccgggcaactgggagctggaatcaggtacttcgatctgcggatcagcaccaagccacgggatcctgataacgaactgtacttcgcccatggcctcttttctgcaaaagtgaacgaaggattggaagagatcaatgcttttctgaccgatcatcacaaagaggtcgtgtttctggatttcaaccacttctatggcatgcagaaatatcatcacgagaagctcgtgcaaatgctcaaagacatttatggcaataagatgtgtccggctatcttcgcccaggaagtcagcctgaagtatctttgggaaaaggactatcaggtgttggttttttatcacagcccagtagcactcgaagttcccttcctatggcccggtcagatgatgccggctccatgggctaacaccactgatccagaaaagctgatccaattcttgcaagccagtatcaccgagcgaaggaagaaaggcagcttctttatctctcaggttgtcctgacgcctaaagcctccaccgttgtaaagggggttgctagcggccttcgggagacgataacggagagggcgctgccggctatgatgcaatgggttaggactcagaaacccggagaaagcgggatcaacatcgtgaccgccgatttcgtcgaacttggggattttatcagtactgtgattaagctgaattacgtgtttgacgagggcgaggcaaacacatag

SEQ ID NO: 58224 - DNA, 351 bp, Artificial Sequence
  Description of Artificial Sequence: Synthetic coding sequence
atgggacctaaggatcacatggtgacgtccagtttttgttgccagtcagacggatgcaactctgctttcctgagtgtgcctttgaccaacttgaccgagaacggacttatgtgtcccgcatgtaccgcctccttccgcgataagtgtatggggcctatgacacattgtaccgggaaggagaaccattgtgtgtctctgtccggccatgtgcaggctggaattttcaagccaagattcgcaatgcgcggttgtgcgaccgaaagcatgtgcttcactaaaccaggggcagaggtcccaacgggtacgaatgttctcttcctccatcacatcgaatgcacacattccccatag

SEQ ID NO: 58225 - DNA, 615 bp, Artificial Sequence
  Description of Artificial Sequence: Synthetic coding sequence
atgagactcagtagacgcccagaaactttcctgttggccttcgtgctgctctgtacactactgggcctggggtgtccccttcactgcgagatttgcactgcagccggtagccgttgtcatgggcaaatgaaaacctgcagctccgacaaagacacttgtgtgctgctcgttggcaaggcgacttctaaaggaaaggagctcgtgcacacttataaggggtgcattcggagtcaggattgctacagtggtgtaatctcgaccacgatgggccctaaagatcatatggtgactagcagtttctgctgtcagtcagacgggtgcaacagtgcgttcctaagtgtgcccctcacaaatttgaccgagaacgggctaatgtgtcccgcttgtactgcctcctttcgcgacaaatgcatgggcccaatgacacattgtaccgggaaagagaaccactgcgtaagcctgtctggccacgtccaagcaggtatctttaaacctagattcgcaatgcgtgggtgcgccaccgagtccatgtgcttcacgaagcccggtgcagaagtgccaactgggacaaacgttctgttcttacaccacatagagtgcacgcactccccatag

SEQ ID NO: 58226 - DNA, 2520 bp, Artificial Sequence
  Description of Artificial Sequence: Synthetic coding sequence
atgagggccaagtgcatcaccgagcccgtcggcattgaattagccccatgcttgcaggccccttcagtccctgagactgatttaaaaggcgtggtgcaggccaggggtgggggtgccagtgtgctcgagaagcctagggagggattcaaacgagccgaacaggtgcccgtctctcagaccgactgcttcgtgtcgctctggctcccaaccgctagccagaagaaactacgcacaagaacaatttccaattgcccaaatccagagtggaacgaaagctttaactttcagattcaaagtagagtcaaaaacgttctagaactcagtgtgtgcgatgaagataccgttacgcctgatgaccacctgttgacagtactgtacgatctgactaaactttgtttccgtaaaaaaacccacgtgaagtttccactgaatccgcaggggatggaagagctggaagttgagtttcttcttgaggagagcccctcgcctccagagaccctcgtcaccaacggggtgctggtttcccggcaagtatcctgcctggaagtacacgcccaatcccgaaggcggagaaagagggagaaaatgaaggacctgttggtcatggtgaatgagagcttcgaaaatacacagcgggtccgtccctgtctcgagccttgttgtcccacctccgcttgcttccagaccgccgcttgttttcactacccaaagtattttcaatctcaggtgcacgtagaggtgccgaaaagccactggtcctgtggtttgtgttgtcgctctaggaagaaaggcccaatctcacagccactggattgcctttctgatggtcaggtgatgaccctgcctgtgggcgaatcttacgaacttcacatgaagtctaccccctgccctgagactttggacgtccgattgggcttcagcctttgccctgccgaattagaatttctccagaagcggaaggtcgtagtggcaaaggccctcaaacaggtgctccagttggaagaggatttacaggaggatgaggttcctctcatcgcaatcatggctacagggggtgggacacgctcgatgacttctatgtacgggcatctcttggggctccagaagctaaatcttctggactgtgcctcatacatcaccggcttgagcggggctacttggaccatggcgactctgtatagagacccagactggagctctaagaatctggaacctgccatcttcgaggcccgtcggcatgtggtgaaagataaactgccatccttgtttccggatcagcttcgtaagtttcaagaagaactccgccagcgctcccaagagggctatcgggtgactttcacagacttttggggactgctgatcgaaacctgtcttggcgacgaacgtaatgaatgcaagctgtctgatcagagagccgctcttagttgtggccaaaaccccctgccaatttacctgactatcaatgtgaaagatgatgtatccaatcaggattttagggagtggtttgaattttccccctatgaggtaggactacagaaatacggggcttttatcccatcagaattatttggcagcgaattctttatgggacgcctggtgaaacggatccccgaatccagaatctgctatatgttaggactctggagtagtattttttcacttaacttgctagatgcttggaatctaagtcatactagcgaggagttcttccaccgctggacacgcgaaaaggtacaggatattgaagacgagcctattctgccggaaatccctaaatgtgacgcaaacattctagaaaccacagtggtcatacccggtagctggctctctaacagcttccgagaaatcctgacccataggagctttgtgagcgaattccataacttcttgtccggactgcaactccacacaaattatctgcagaatgggcagtttagtcgttggaaggacacagtgctggacgggtttccaaaccagctcacagaatcggcaaaccatttatgcctgctggatacggccttctttgtgaacagcagttacccacccttgctaaggcctgaacgaaaggccgacctcattattcacttaaactattgtgcaggtagccagacaaagcctctgaagcagacatgcgagtattgtactgtccagaatatcccgttcccaaagtatgagctgccagacgaaaatgaaaacctaaaggaatgttacctcatggaaaatcctcaggagcccgacgctccgatcgtaacgttttttcccttgatcaatgatacttttaggaaatacaaggctcctggagtcgagcgcagccctgaagagttggaacagggtcaggtggacatttacgggcctaagacgccgtacgcgactaaagaattaacctacaccgaggcgacttttgacaagcttgttaagctgagtgaatacaatattctgaataataaagacaccttgctgcaggccctaagactggcagtggaaaagaagaagagactgaagggtcaatgcccaagctag

SEQ ID NO: 58227 - DNA, 2388 bp, Artificial Sequence
  Description of Artificial Sequence: Synthetic coding sequence
atgacttccggtgccacacggtaccgcctttcgtgtagccttcggggacacgaactcgatgtgcggggacttgtttgttgcgcttatcccccaggagctttcgtgtcagtcagcagagatcgcactacccgcttatgggcacccgatagccccaacagaagctttaccgaaatgcattgtatgtcgggtcacagtaacttcgtttcctgcgtctgtatcattccaagttctgacatttaccctcacgggttgatagccaccggaggcaacgaccacaatatatgtatcttcagtctggactcacctatgccactgtacatactcaaaggccataaaaatactgtgtgctccctcagttcaggaaagtttgggacactgctgagcggttcgtgggatactacagccaaagtctggttgaacgacaagtgcatgatgaccctgcagggccataccgccgctgtgtgggccgtgaaaatcttgcctgagcagggtctgatgttgaccggaagcgcagacaaaacagtcaagctgtggaaggccggacgctgcgagcgcacctttagcggccacgaggactgcgtacgcggtttagcgatcctctctgagactgaattcctgtcttgtgcgaacgacgcctcaataaggcgttggcagatcacgggcgaatgtctcgaggtctattatggccatacgaattatatctactctatcagtgtgttccctaattgtagggattttgtgactacagcagaagatcgctctctcagaatttggaagcacggtgagtgcgctcagactatccggcttcccgctcagagtatctggtgttgctgcgtcctcgataacggcgatatcgtcgtgggggcatcagacggcatcattcgggtgttcactgagtcggaagacagaaccgcaagcgccgaagagatcaaagcattcgagaaggagttgagccacgccaccattgacagcaaaaccggggatttaggagatataaacgctgagcagctgcccggtagagagcatttaaacgagcccggaaccagagagggccaaacaagactcattagggacggcgaaaaggtggaggcatatcagtggagtgttagtgagggtcggtggatcaaaattggggacgttgtcgggagttccggggcaaatcagcaaaccagtggcaaggtgttatatgaaggcaaagagtttgattatgtctttagcattgacgtcaacgaggggggaccttcttacaagttgccatacaatactagcgacgatccatggctcaccgcctacaatttcctgcagaaaaacgatctgaatcccatgttccttgatcaggtcgccaagttcatcatcgacaacacaaaggggcaaatgctaggcctgggtaacccatcgttcagcgacccattcacagggggtggaagatacgtgcccggttcatctggctccagcaacaccctccctaccgccgaccctttcacaggtgccggacgctacgtccccggatctgccagcatgggaaccacaatggcaggggtcgatccctttaccgggaacagtgcctacaggagcgcagcctccaaaacaatgaatatttatttcccgaagaaagaggccgtcacttttgaccaggccaacccgactcagattcttgggaagttaaaagaacttaatgggacagctcccgaggagaaaaaactgaccgaggatgacctcattttgctggagaaaattctgtcgctcatatgcaactcttcaagtgaaaagcctacagtgcagcaacttcagatattgtggaaagccataaactgccctgaggacatagtattccctgcacttgacatcctgagattgagtatcaagcacccgtccgtgaacgaaaatttctgcaatgagaaagaaggggcacagttttcatcccacctgattaacctgttaaatcccaagggcaaacccgcaaaccaactcctggcactgcgcacattctgcaactgctttgtgggccaggccggtcagaagcttatgatgtcgcaacgggagtccctgatgtcacacgcgatcgagctgaaaagtggctctaataagaacatccatattgcgctggcgacgctggccctgaattattcagtgtgctttcataaggaccacaacattgaaggcaaggcccagtgcttgtctttaatctcgacgattcttgaagtagtgcaggacctcgaagccacatttcgcctcttggtggctttgggcaccctcatttcagacgattcaaacgctgtgcagctggccaaaagcctgggggtggattcccagatcaaaaaatactctagcgtttctgagccagccaaagtctccgagtgttgtaggtttatcctaaacttactgtag

SEQ ID NO: 58228 - DNA, 2367 bp, Artificial Sequence
  Description of Artificial Sequence: Synthetic coding sequence
atgctgtgtggcaggtggcggagatgccgccgtccccctgaagagccacctgtggccgcacaagtagctgctcaggtcgctgcccctgtggccctgccatcccccccaacccccagtgacgggggtactaagcgcccagggctgcgagccctcaaaaagatgggactgactgaagatgaggatgttcgggctatgttgcgcggatccagacttcggaagataaggagtcggacctggcacaaagaacggttgtatcgcctgcaggaagatggattgagtgtctggttccagaggaggattcctagagccccttcacagcatatcttctttgtgcagcacattgaggctgtgagggagggacaccagagcgaaggtctcaggaggtttggcggtgcctttgcgcctgccaggtgcctgactatagccttcaagggcagacggaagaacctggatctggctgctcctacggcggaagaggcccaaaggtgggtgcgcggtctgaccaaacttagggctcggctcgacgcaatgagccagcgggagcggctagacccctggattcactcctacctccatcgggcagattctaatcaggacagcaaaatgtcttttaaggaaattaaatctctactccggatggtgaatgtagacatgaacgatatgtacgcctatctgctgtttaaagaatgtgaccactcaaataacgatcgtctggaaggcgctgaaattgaggagtttctgagaaggctgctgaagcggccagagctggaggagatcttccatcaatactccggggaagacagggttttgtctgctcctgaactgctggagttcctggaggaccaaggggaggaaggcgcaacactggctcgtgcccagcagcttattcagacgtatgagttaaacgaaactgccaagcagcacgaactgatgaccctcgatggcttcatgatgtacctgctgtcacctgaaggggctgcactcgataacactcacacttgtgtgttccaggacatgaaccaaccgctagctcactattttatctcctcctcccataatacatatctgactgactctcaaatcggcggtccctcctcaacggaggcatacgaccgggcttttgcccaggggtgcaggtgtgttgaacttgactgctgggagggccctggtggcgagcccgttatctaccatgggcacactttgacatccaaaatccttttcagagatgtcgtccaggctgttagggatcatgcattcaccttgagtccataccccgtcattttaagcctggagaaccactgcggattagagcagcaggctgctatggctcgccacctgtgtaccatcctaggagacatgctcgttacccaagcgctggacagccctaaccccgaggagctgccgagccccgagcagctgaagggacgtgtcctcgtgaaagggaagaaactgcctgcagcaaggagtgaagacggaagggcattgagcgaccgcgaggaggaagaggaagatgacgaagaagaagaggaagaagttgaagcggctgcacagagacgcctcgccaagcagatatctcccgagctttcagcattggcagtttactgtcacgctactcgcctgagacttcatcctgcccctaacgctccccagccttgccaagtgagcagcctgtcagagaggaaggctaagaagctcatccgcgaagccggaaactcatttgtgcggcataatgccagacaattgacacgagtttacccattgggactgcggatgaattcagcaaactatagtccacaggaaatgtggaattctggctgccagctggtggcacttaacttccaaacccctggttatgagatggatctgaacgccggaagattcttggttaatggacagtgtggctacgttctgaagcccgcatgcctgcgacaacccgacagcacgtttgatccagagtacccaggaccccctcggaccaccctaagcatccaggtgctgacggcacagcagttaccgaagctaaatgccgagaagcctcactctatcgtggaccctcttgtgcggatcgaaattcatggcgtgcccgcagattgtgctcgccaagagactgattacgtcctgaacaatgggttcaaccctcggtggggacagactttacagtttcagttgcgtgcgccagagctggcccttgttaggtttgttgtcgaggactacgacgcgaccagtcctaatgatttcgtgggacagtttaccctgccactatccagccttaagcagggctacagacacattcacttacttagcaaggacggggcatctctctcaccggcaactctgttcattcagatcaggattcagcgctcctag

SEQ ID NO: 58229 - DNA, 144 bp, Artificial Sequence
  Description of Artificial Sequence: Synthetic coding sequence
atgtcacagcagaagtgtatcgttatctttgcgctcgtctgctgcttcgcgattctggtggcactgatcttcagcgccgtggatattatgggcgaagacgaggatggactgtctgagaaaaactgccaaaacaaatgcaggtag

SEQ ID NO: 58230 - DNA, 816 bp, Artificial Sequence
  Description of Artificial Sequence: Synthetic coding sequence
atggcttccaaggatgcacagaaccaacgtaggggactgcctgggtttctcccaggagctcccgaccctgatcaatctctgccagccagttctaaccccggaaatcaggcgtggcagttaagcctgccattgccttcttctttcttgccaactgtctccctcccaccgggactggagtacctgagccagttggatctgattatcatccaccagcaagtcgagctgctcgggatgattctcgggactgaaaccagcaacaagtacgaaatcaagaactcactgggccagaggatctactttgcagtggaagagagtatttgcttcaacagaactttctgcagtaccctgcgcagctgcacattacgaatcactgacaatagcggcagagaggttataacagtgaatcggcctctgcgttgcaatagctgttggtgcccctgctatctccaggaactggaaattcaggctcccccaggtaccatcgtagggtatgtgacccagaagtgggatcccttcctccctaagtttacaatacaaaatgcaaataaagaggatattctgaaaattgtgggtccatgcgttacatgtggctgctttggcgacgtcgacttcgaggtgaaaacaatcaatgagaaacttacaataggcaagatcagcaaatattggagtggattcgtgaacgatgtcttcacaaatgcagataatttcgggatccacgtccccgctgacctggacgttacagttaaggcggctatgataggagcttgtttccttttcgactttatgtttttcgagcacagcctggcaggcttgtag

SEQ ID NO: 58231 - DNA, 816 bp, Artificial Sequence
  Description of Artificial Sequence: Synthetic coding sequence
atggcttccaaggatgcgcagaaccagagaagggggttgcccggatttctgcctggagcgcctgatcctgatcaaagcctgcctgcatctagtaatccgggaaatcaagcatggcagctgtcgctaccgctaccctcgtctttcttacccactgtgtccttaccaccaggcctcgagtacctctctcagctggatctcatcatcatacaccagcaggtggagctgctaggaatgatccttggtaccgaaactagtaataaatacgagattaaaaactctctggggcagcggatttactttgcggtcgaggagagtatttgcttcaacagaacgttttgcagtaccctccgcagctgtaccttgcggattacagacaattctggtcgggaggtgatcacagttaaccggcctctgagatgtaactcttgctggtgtccttgttacctgcaagaactagagattcaggctccccctgggacaatcgtgggctacgtgacgcagaagtgggaccccttcctgccaaaattcacgattcagaacgccaataaagaagatattctgaaaattgtgggcccatgtgtaacatgtggctgtttcggagatgttgacttcgaagtgaaaactataaatgagaaattaactataggcaagattagcaaatactggtctgggtttgtgaacgacgtgttcacaaacgctgacaacttcggtattcatgtccccgctgatttagatgtgactgtgaaggcagctatgatcggcgcatgttttcttttcgactttatgtttttcgagcacagccttgccggactgtag

SEQ ID NO: 58232 - DNA, 3033 bp, Artificial Sequence
  Description of Artificial Sequence: Synthetic coding sequence
atggccgcaagggtgctaatcattgggtccggaggaagggaacatactctcgcttggaagctggctcagtctcaccatgtcaagcaggtcctggtcgccccaggcaatgctgggaccgcttgttctgagaagatttcaaatacagcaataagcatctccgatcacactgcactggctcagttctgcaaagagaagaaaatcgagtttgtggtcgtcggcccagaagccccactcgctgctgggatcgtaggtaatttacgctcagcaggtgtccaatgtttcggcccaaccgctgaggcagcacagctggagtcctccaagaggtttgcgaaggagtttatggatcgtcatggaattccaaccgctcagtggaaagcattcacaaaaccggaagaagcctgctccttcattctgagcgctgacttcccagccctggtcgtgaaggcaagtggactcgccgcaggtaaaggggtgatcgtagcaaagtcaaaagaagaggcctgcaaagctgtccaagagataatgcaggagaaggcttttggagcagccggagagaccatagtgatagaggagctgttggatggggaggaagtcagttgcctgtgtttcactgatggcaaaaccgtcgccccaatgcctcccgctcaggaccacaagagactgctggagggcgacggaggtcccaatacagggggaatgggcgcatactgcccagctccccaggtatcaaacgacctacttctgaagattaaggataccgtactccagagaactgtggacggcatgcagcaggagggtaccccctataccgggatcctgtacgctggcatcatgttgactaaaaacggacccaaggtactggagtttaattgcagatttggcgatcccgagtgccaagttattctgccgctgttgaaatcagatctgtatgaggttattcagagcaccctggacggcttgctatgtacttcactcccagtgtggttggagaaccataccgctctcactgtggtgatggcttcaaaaggataccccggagattatacaaagggcgtggaaattactggctttcccgaggcacaggcacttggcctcgaggtgttccatgcaggtactgccttgaagaacggaaaggtggtgacgcacgggggacgggttttagccgtgactgccatccgcgagaacttgatttctgcccttgaagaagctaaaaaaggactcgccgcaatcaagttcgaaggtgccatatataggaaagatgtcgggttcagggcaatcgcctttctgcagcagcccagatcattaacttacaaagagagtggggtcgacattgcagcaggtaacatgctcgttaagaaaattcagccactggcgaaagccacaagccggtctggctgtaaggtggatctgggtggcttcgccggactcttcgatctcaaagccgctggcttcaaggacccgttgctggcttccggaactgatggggtgggcacgaagctcaagatcgcccaactttgtaacaaacacgatacaattgggcaggacctcgtggctatgtgtgtgaatgatattcttgcgcagggcgctgagcctctctttttcttggactatttttcctgtggaaaactcgatcttagcgtgacagaagcagtcgtggccggtatagccaaggcctgtgggaaagcagggtgcgctctcctgggcggtgagacggctgaaatgcctgatatgtatcctcccggagagtacgacctggccggttttgctgtgggcgcaatggaaagggatcagaaactcccgcatctggaacggatcaccgagggcgacgtggtggtgggcatcgcctctagcgggctccatagtaacggattctctctggtgaggaagatagtggccaagtcaagtctgcagtactcctctccggctcctgatgggtgtggtgaccagacactgggtgacttgttactgacgcccacgcgtatctattctcatagcctcctgcctgtgttgcgaagcggtcatgtgaaggcattcgcacacatcacgggagggggtcttcttgaaaacatccccagagttttacccgagaagctcggtgtcgacctggacgctcagacctggcgcattcccagggtgtttagctggctgcagcaagagggacatctgtctgaggaagagatggctcggacattcaactgcggggtcggggcagtcctcgttgtgtctaaggagcagacagaacagatactgcgagatattcaacagcataaggaagaggcttgggtcatcggttctgtggtggcccgtgctgagggcagccctcgagtcaaggtaaagaatctcattgaaagtatgcagatcaatggatcggtattaaaaaacgggtctttgacaaatcatttctctttcgagaagaagaaagctcgcgtcgcagtacttatctccggaaccggctcaaatctgcaggccctgatcgattcaacgagggagcctaattcttccgcacagattgacatagtcatcagcaacaaggccgcagtggccggactggacaaagcggagagagctggcattcccacaagagtaataaaccacaagttatataagaacagagttgagttcgactctgctattgatctggtcctcgaggaattttccatcgacattgtatgtctggccggttttatgagaatcctctctgggccttttgtgcagaagtggaatggcaaaatgttgaatattcaccccagtctgttgccatcctttaaaggttccaacgcccacgaacaggctctcgagaccggggtaaccgttactggatgcaccgtacatttcgttgctgaggacgtagatgcaggacaaattatcctccaggaagctgtgccagtgaagaggggagatacggtcgccaccctttctgaacgggtgaagttggccgagcacaagatttttcctgcagccctgcagctagttgcctctgggactgttcagctgggagaaaacggcaagatctgttgggtgaaggaagagtag

SEQ ID NO: 58233 - DNA, 3033 bp, Artificial Sequence
  Description of Artificial Sequence: Synthetic coding sequence
atggcagctcgcgttctgattatcggctccggtggacgcgagcatacactcgcatggaagctagcccagagccaccacgtgaagcaggtgctggtcgctcctggcaacgccggtacagcctgttctgagaagatcagcaatacagccatcagtattagcgaccacacagcgcttgctcagttctgcaaagagaagaagatcgaatttgtggtcgtgggacctgaagcgccacttgcggctggaatcgttggcaatctccggagcgcaggagtgcagtgctttggtcctacagctgaggctgctcagctggaatcctcaaagagatttgccaaggagttcatggataggcatggcatcccaacggcccagtggaaggcctttactaagcctgaagaggcttgttctttcattcttagtgctgacttcccagctctggtggtgaaagcgagcgggctggccgcagggaaaggggtgatcgtagcaaaatcaaaggaggaagcatgtaaggcagtacaggagattatgcaagaaaaagcctttggcgctgctggggagacaatcgttattgaggagctcctggacggggaagaagtgagctgcctgtgcttcaccgatggaaagaccgttgcacccatgcctcctgcacaagatcacaagagattgctcgaaggggatggcggtcccaataccgggggaatgggtgcttattgccccgctccacaggtatccaatgatcttttacttaaaattaaggataccgtcctgcagcgtaccgtggacgggatgcagcaggaaggcacaccatacaccggtatcctgtatgccggtattatgctcactaagaatgggccaaaggtcctggagttcaattgtcggttcggtgatccagagtgccaagttattttgccactactcaagtccgacctgtacgaggtaattcagtccaccctggacgggctactttgcacatccttgccagtgtggttagagaatcatactgcactgactgtggtgatggcttccaaaggctatcccggagattataccaaaggcgtggaaattactggcttcccggaagcccaggccctgggcttggaggttttccatgcaggtacagccctcaagaacggcaaagtggtgacacacggaggcagggtgctggcggtcaccgcgatcagggagaacctgatttctgcactcgaagaagccaagaaggggctggctgctatcaaatttgagggtgctatctatcggaaggacgtaggatttcgcgcaatcgcattccttcagcagcctaggagtttgacatacaaggaatctggagtagatattgccgcagggaatatgctggtgaaaaaaattcagccactcgcaaaagccacatcccggtcaggatgcaaggtggatcttggcggattcgctgggctctttgatctcaaagccgcaggcttcaaagatcctctgctagcctctgggacagacggtgtggggacaaaattgaagatcgcacagctgtgcaataaacatgataccataggccaagacttggttgccatgtgcgttaacgatattctggcccagggcgcagaaccgctctttttccttgactacttttcctgcgggaagctggacctgagcgtgaccgaggccgtagtggcgggtatcgcaaaggcgtgtggaaaggccggatgtgcgctattgggtggagagactgcagaaatgccagatatgtatccaccgggagagtacgaccttgcaggctttgcagtgggcgctatggaacgggatcagaaactgccccacctggaacgcattacagaaggggacgtggtggtgggaatcgcttccagtggtcttcattcaaatggtttcagcctcgtgagaaaaattgtggctaaaagctccctccaatactctagtcccgcacctgatgggtgcggcgaccagaccctcggggatctccttcttactcctactcgaatctactctcattctctcctgcccgtgctgagaagcggacacgtcaaagcctttgcccacattactgggggaggactgctcgagaacattccgagggtgcttccggaaaagctaggcgtagacctagatgcacagacttggagaataccaagagtgttctcctggttgcagcaggagggccacctgtccgaagaagagatggcgcgaactttcaactgtggcgttggtgctgtcctcgttgtttctaaggagcagactgagcagatactgagagacatccagcagcataaggaggaagcttgggtgattggaagcgttgtcgcaagagctgagggcagcccccgtgtaaaagttaaaaatttgatagagagtatgcagattaacggttcggtccttaaaaacggcagtttaactaaccatttctctttcgagaaaaaaaaagctcgggtggccgtgttgataagcggcaccgggagcaatctccaggccttgatcgactctacgagagaacccaatagctccgcccaaatcgatattgtgatttccaacaaagctgctgtggccggactggacaaggctgagcgggctgggatccccacacgcgttattaaccacaaactgtacaagaaccgcgtcgaattcgactccgcgatagatctagtccttgaggagttctctatcgatattgtttgtctggccggattcatgcgtattctgtcaggaccttttgttcagaagtggaacggaaagatgctcaacattcaccctagtttgctaccctcatttaaggggtcgaacgctcacgaacaggctctagagaccggagtgactgtcacaggttgtaccgtgcatttcgtggccgaggatgttgatgccggacagatcatcttgcaggaggctgtacccgtgaagcgcggtgatacagtcgcaacactgtccgaacgggtgaagttggctgaacataagatcttcccagcggcactacaattggtggcctccggcactgtccagctgggcgaaaacgggaagatctgctgggtgaaggaggaatag

SEQ ID NO: 58234 - DNA, 3033 bp, Artificial Sequence
  Description of Artificial Sequence: Synthetic coding sequence
atggccgctagagtcctgattattggctccggagggagagaacatacactcgcttggaaactagctcagtcgcaccacgtgaaacaagttctggtggctcccggaaacgcaggaaccgcatgctcagagaaaatctctaataccgcgatttccatctcagatcacacagccctggcacagttttgtaaagaaaaaaagatcgagtttgtcgtggttgggcctgaggccccactcgcggcaggtatcgtcggtaacctgcggtccgccggtgtgcagtgctttgggcctactgcagaggctgcacagttggagtctagtaagcggtttgccaaggagtttatggataggcacgggatccctactgcacagtggaaagccttcacaaaacctgaggaggcctgctctttcatcctctccgccgacttcccggcactagttgttaaggcctccggcctggccgcaggaaagggcgtcatcgttgcaaaatcgaaggaagaagcctgcaaagccgtgcaggagataatgcaggaaaaagcttttggcgctgctggggagactattgttatcgaagagcttttagacggggaggaggtatcctgcctctgctttaccgatggcaaaactgtcgcacccatgccacccgcacaggatcacaaacgcttgctggagggcgacggcggtcctaatacagggggaatgggagcttactgtcctgcaccccaggtgtccaatgatttactcttgaaaattaaagacacagtactgcaacggaccgtggacggcatgcaacaggagggtaccccttatactggaattttgtatgcgggaatcatgttgaccaaaaacggcccaaaagtgctcgagtttaattgtcgatttggggatccagagtgccaggtgatccttcccctgctgaaatcagacttatacgaagtaattcagtccacacttgacggcctgctgtgcacttccctgcccgtctggctcgagaatcatactgccctcaccgtcgtaatggccagcaagggctacccaggagattatactaaaggggtagaaattaccggattccctgaagctcaagcactcggcctcgaagtgtttcacgcaggaactgctctgaaaaatgggaaggtggtgacacatgggggtcgggtcctggcagtgaccgcaatccgcgaaaatcttattagcgcattggaagaggctaagaagggacttgccgcaattaagttcgaaggcgctatctatagaaaagatgtcggcttcagagcaattgcattcctgcagcaacctcgttccctgacatataaggagtcaggtgtggatatagccgcaggcaatatgcttgtgaagaaaattcagccgctagcaaaagcaacctcaagatccggctgtaaggtggacctcggtgggttcgctgggttatttgacttgaaggctgctggatttaaggatccccttctagcaagcggcaccgacggtgtcggcaccaagctgaaaattgcacaattatgtaacaaacatgatacaatcggacaggaccttgtggccatgtgtgttaatgatattctggctcagggtgccgagcctctattttttctcgactatttttcatgcggcaagcttgatctgtctgtaacagaggccgtggttgccggaattgcaaaggcttgcggaaaagcgggatgcgcattactggggggagaaactgctgagatgccagatatgtaccccccaggcgagtacgaccttgctggcttcgcagtgggtgctatggagagggaccagaagctcccccatcttgagcgcattacagagggcgacgttgtggtgggcattgcctctagtggcttgcattccaatggcttctccctggttaggaagatcgttgcaaagagctccctacaatatagctctccagcacccgacggttgcggagatcagaccctcggagaccttcttctaacgcctacacggatttactcccatagcctccttcctgtgctgagaagtggccatgtgaaggcatttgcacacatcactggaggcggactgctcgagaacatcccgagagtgttaccggaaaagctgggggtggatctggacgcacaaacttggcggatcccacgtgtgttttcctggcttcagcaggaaggccacctgagcgaggaagagatggccagaacctttaactgtggcgttggcgctgtgctagttgttagcaaggaacaaactgaacagatattgagagacatccagcagcataaagaggaagcctgggtgatcggtagcgtggtagcaagagcagaaggttctcctagggtgaaggtaaaaaatttaattgagagcatgcagataaacgggagtgtcttgaagaatggctcccttacaaatcacttttctttcgaaaagaaaaaggcccgtgtggcagtgctgatttcagggaccgggagtaacctgcaggcactgatagactctaccagagagcccaacagttcagcgcagattgacatcgtgatctccaataaagccgcagtagctggtctggacaaagcagagcgggcaggaattcccacccgcgtcatcaaccataagctgtacaagaaccgggttgaatttgactcagccattgacctggtactagaagaattctctattgatatagtctgtctcgccggattcatgcgcattctgagcgggccattcgtgcagaagtggaatggcaagatgttaaatattcatccaagcttactaccaagttttaagggctctaacgcccatgaacaagccctcgaaacgggtgtaacagtcaccggttgcacggtgcactttgtcgctgaggatgttgacgcaggccagataatactgcaggaagccgtacccgtcaaacggggagatacagttgcaacgctctcagaaagggtaaaactggctgaacataaaatctttcctgccgctttacagcttgttgcctcgggcaccgttcagctgggggaaaacggtaagatctgctgggtaaaggaagaatag

SEQ ID NO: 58235 - DNA, 993 bp, Artificial Sequence
  Description of Artificial Sequence: Synthetic coding sequence
atggagctgctctcaacccctcacagtatcgaaatcaacaatattacctgcgattctttccggatatcctgggcaatggaagactctgatctagaacgcgtgacccattacttcatagatctcaacaagaaagaaaataagaactcaaataagttcaaacatcgagacgtgccaacaaagctggtggctaaggcggtgccgctccccatgaccgtgcggggtcattggtttctgtctcccagaacggagtattctgtcgccgtacaaaccgccgtgaaacagtctgatggcgaatatctggtgagcgggtggagtgagacagttgaattttgtactggtgattacgccaaggagcacctggcccaactgcaagaaaaagctgaacaaatagccggaaggatgctgcggttctctgtattctatagaaaccatcataaagagtacttccaacacgctcgaacccactgtggtaatatgttgcagccttacttgaaagacaatagtggaagccacggcagtccaacatctggcatgctgcacggcgtgttcttctcttgtaataccgagtttaatacaggccaaccaccacaagactccccctatggcaggtggagatttcagattccagcccagaggctctttaacccctcaaccaacctctattttgcggatttttactgcatgtacactgcttaccactatgccatcttggtgcttgccccaaagggaagtctgggtgaccgcttctgtcgtgatagactccctctgcttgatatcgcctgtaacaaatttcttacctgtagtgttgaggatggggaacttgtatttcgccacgcccaagacctgatactagagatcatatacacagagcctgtggatctctccctcggcaccttaggcgagatatcaggtcaccagctaatgagcctctccaccgcagatgcaaagaaggatccgtcttgtaaaacctgtaacattagcgttgggagatag

SEQ ID NO: 58236 - DNA, 714 bp, Artificial Sequence
  Description of Artificial Sequence: Synthetic coding sequence
atggaacttctgtctaccccacatagtatcgagattaacaacatcacatgcgattctttccgaattagttgggccatggaagattccgacttggaaagggtgacgcactacttcatcgacttaaacaagaaagaaaacaagaattctaatcaccataaggagtattttcaacacgccaggacacattgcgggaatatgttgcagccctacctgaaggataactccggaagtcacggcagtcccacgtccgggatgctccacggggttttctttagctgcaacactgaattcaatactggccagccgccacaggactcaccatacggcagatggcgttttcagatacctgcgcaaagactgttcaatccaagtacgaacttatatttcgccgacttctattgtatgtacactgcataccactacgccattctcgtgctcgccccaaagggctctcttggtgacagattttgtagagacaggctcccactgctcgatatagcctgcaataagtttctaacttgctccgtcgaggacggagagctggtgtttaggcatgcccaagacctcatactggagataatatacaccgaacctgtggatctttccctcggaacccttggagagattagcggtcaccaactgatgtctctgtctacagcagatgccaaaaaagatccttcctgtaagacttgcaacatatcagtagggagatag

SEQ ID NO: 58237 - DNA, 993 bp, Artificial Sequence
  Description of Artificial Sequence: Synthetic coding sequence
atggaacttttgtcgacgccacacagtattgagataaacaatattacatgtgactccttcaggatctcctgggctatggaggatagcgatttggagcgagtgacgcattactttatagatctgaacaaaaaagagaataagaattccaacaaattcaagcatcgggacgtcccaaccaaacttgtggctaaggcagtgcctctgccaatgaccgtgagaggccattggtttctgtctcccaggactgagtattctgtggcagtccagaccgccgtcaaacagagtgacggcgaatatctggtaagcggttggagtgagactgtggaattctgcacaggcgattacgccaaagagcatctggcccagctgcaggagaaagctgagcagatcgcgggaagaatgctacgattttcggttttctacagaaatcaccacaaggagtactttcagcacgcccgtacacattgcggcaatatgctgcagccataccttaaggacaattcgggaagccatggctcccccacttcaggtatgctacacggagtgttcttctcctgtaacacagagttcaatacgggacagcctccccaagattccccgtacggccgatggagatttcagattccggcacagagactctttaatccctccacaaatctctattttgcagatttctactgcatgtatacagcctaccattatgccatcttagtcttagctccgaaagggtccttaggcgacaggttttgccgcgacaggctgcccttactggacattgcatgcaacaagttcctgacttgttccgtggaggacggcgagctggtctttcggcatgctcaagatctgatcctagagatcatatataccgaacccgtggatctgtccctcggcacgctgggggaaatctccgggcaccagttgatgtctctgagcacggccgacgctaaaaaggacccatcctgtaaaacctgtaatatcagtgtcggcagatag

SEQ ID NO: 58238 - DNA, 894 bp, Artificial Sequence
  Description of Artificial Sequence: Synthetic coding sequence
atggcttgtcttagcccatctcagctgcagaaatttcaacaggacggatttcttgtgctggaaggttttttgtcagccgaggagtgcgtcgctatgcaacagagaataggggagatagtagccgagatggatgtcccattgcactgccgcacagagttttcaacacaggaggaggaacagctgagagcccaaggatccacggattactttctgagctcaggggacaagatccgctttttctttgaaaagggcgtattcgacgagaagggcaatttccttgtgccgccagaaaagtccatcaacaagatcggccacgcacttcatgcccacgatcctgtgttcaaaagtatcactcattcttttaaggtccagacgctggccaggtcacttggtctccagatgcccgttgtcgtccaatcaatgtatattttcaaaagccccctaatcaggacccccccttcttgtactcggagcccgtgggccggatgctgggcctgtggaagtcagtggcgtatgcctagatggaggaccgccgtgagtggctcctcattggcaccgactccagtcgtttgtcaggaggggtggagtggccctctgttggctcagcgccttgttccagccagcctgggacagagtcaaccgggtatcacagccagcttatgccctcctcagtgcagggaaggcccttggagctctagtatggagaagtggtatactcgggcatccagaacatcactgaccgctcgggcacggcctactttatccacaagttggaggccactggccccaccaggagcccgacggacgggctccagtcagcagctcaactgcccttttccaaattgcacccccaagggtagccgccgtgcgggagcactggctccacccggttag

SEQ ID NO: 58239 - DNA, 813 bp, Artificial Sequence
  Description of Artificial Sequence: Synthetic coding sequence
atggcttgcttaagcccaagccagctccagaagttccagcaggatggttttctcgtgcttgaaggctttctgtcagctgaggaatgcgttgcgatgcagcagcggatcggagagattgtcgccgaaatggacgtgcccctccactgtcgaactgaattctccacccaggaagaggagcagctccgcgctcaggggtctacagactactttttgtcgtctggagataaaattagattctttttcgagaagggcgtgtttgacgagaaaggaaattttctagtgccacccgagaagtctattaacaaaattggccacgccctgcacgcacatgacccagtatttaagtcgataacccactctttcaaagtgcagcagccacattttgggggagaggtgtcccctcaccaggatgcctcctttttgtatactgaaccactaggcagagtccttggtgtctggatcgccgtagaagacgcgacactggagaatggctgtctgtggttcatcccaggcagccacaccagcggagttagcagaagaatggtgagagctcccgtcggctctgcacctggaacaagcttcctgggcagcgagcccgctcgagacaactctctctttgtaccaacccctgtgcagcggggagcactggttctcatccatggggaggttgtgcacaaaagcaagcagaacctctccgaccggagtagacaagcgtataccttccatcttatggaagcttcaggaactacttggtcaccggagaactggctgcagcccaccgcagaactcccttttccccagctgtacacctag

SEQ ID NO: 58240 - DNA, 876 bp, Artificial Sequence
  Description of Artificial Sequence: Synthetic coding sequence
atggcatgtctctcccctagccaactccaaaagttccagcaagacggttttttggtattggaaggtttcttatcagcagaagagtgtgttgctatgcaacagaggattggggaaatagtggctgagatggatgtaccgctgcattgtcgcaccgagttttcgactcaggaagaggagcagctgcgagcccagggatccaccgactattttctgagctcaggtgacaagattagattttttttcgagaaaggcgtgtttgacgagaaggggaacttcttggtcccgccagaaaaaagtatcaacaaaattggccacgccctgcacgcgcacgaccctgtgtttaaaagcatcactcattccttcaaggttcagactctggccagatctttaggactgcagatgcctgtcgtggtccagtcaatgtatatatttaagcagccccacttcggcggtgaggtgtcacctcaccaggatgctagctttctgtacactgagcccctcggcagggtactcggcgtgtggatagcagtcgaggacgctacactggagaacgggtgcctgtggttcattcccggttctcataccagcggcgttagtagacgcatggtgcgggcaccagtcggtagcgccccaggcacaagttttctcgggtccgagcccgctcgagataacagtctgttcgttcccacccccgtgcagagaggagctcttgttttgatccacggtgaagtggtgcacaaaagtaaacaaaatttgtcggatcgatcccggcaagcgtataccttccacctaatggaggcctctggaactacatggtctcctgagaattggttgcagcctaccgccgaactgccttttccgcagctgtacacatag

SEQ ID NO: 58241 - DNA, 201 bp, Artificial Sequence
  Description of Artificial Sequence: Synthetic coding sequence
atggcgtgtctgtcgcctagccagctccagaagttccagcaggacggcttcctagtgctggaagggtttctctccgctgaggagtgcgtggccatgcagcagcgtattggagagatagtggcagagatggatgtgccgcttcactgccgaaccgagttcagcactcaggaagaggaacagctccgggctcaagggtcctag

SEQ ID NO: 58242 - DNA, 813 bp, Artificial Sequence
  Description of Artificial Sequence: Synthetic coding sequence
atggcctgtctaagcccctcccagctccagaaatttcagcaggatggattcttagtgttggaaggctttttgagcgccgaagaatgtgtggctatgcagcaaaggataggggagatcgtggcagagatggacgtgcctctccactgtagaaccgaatttagcacacaagaggaggaacagctgagggcgcagggctcaacggactacttcctaagctccggagataaaatccgtttcttcttcgagaaaggcgtcttcgatgaaaaaggaaatttcctggttccccctgaaaagtccatcaataagattgggcacgccctccacgcccacgatcccgtgttcaagtccatcactcatagtttcaaggtccagcaaccacacttcgggggagaggtgtcccctcaccaggacgcgagtttcctttacacagaacctctgggcagggtcttgggagtgtggatcgccgtcgaagatgcgactttggagaacggctgcctgtggttcattcctgggtcacacaccagcggcgttagtagacgcatggttcgggcacccgtaggttctgcacctgggacctcctttctgggctctgaacctgcaagagacaatagtctattcgtccctacccctgtgcagcgcggagctctcgtgctgattcacggcgaagttgtgcacaagtccaaacagaacttatcagatcgcagtagacaagcctataccttccatcttatggaggcaagcggaacaacgtggtccccagagaattggctgcagccgacggccgagctcccgtttccccaactgtacacctag

SEQ ID NO: 58243 - DNA, 534 bp, Artificial Sequence
  Description of Artificial Sequence: Synthetic coding sequence
atggcctgtctctcccctagtcagctgcaaaagttccagcaggatggctttctcgtattagagggattcctgtcagcagaggagtgtgtagccatgcagcagcgtatcggagagatcgtggcagaaatggatgttccgctccactgcagaactgagttttctacccaagaagaggagcagctgcgcgctcagggaagcacagactattttcttagtagcggagacaagatcaggttctttttcgaaaaaggggtgttcgacgaaaagggaaattttctggtccctcccgaaaagagcatcaataagataggccatgccctacacgcccatgatccagtgtttaagtcgatcacacacagcttcaaagtgcagactctggcccgatctctcgggttgcagatgcccgtcgtcgtccagagcatgtacatctttaagcagccccactttgggggagaggtcagcccgcatcaggacgcatccttcctgtatacagaaccgctgggcagagtgctgggtgtttggatcgcagtttag

SEQ ID NO: 58244 - DNA, 195 bp, Artificial Sequence
  Description of Artificial Sequence: Synthetic coding sequence
atggcatgcctctcaccctctcagctccagaagtttcagcaggacggattcctggtgctcgaaggattcttaagtgccgaagagtgcgtggctatgcagcagcgaattggagagatcgtggcggaaatggatgtccccttacactgccgcacggagttttctacacaggaagaggaacaactgcgggcacagtag

SEQ ID NO: 58245 - DNA, 1779 bp, Artificial Sequence
  Description of Artificial Sequence: Synthetic coding sequence
atggcctcaacatctcgggacgtgattgccggacgcggtattcattccaaggtcaagagcgctaagctcctagaagtgctgaatgctatggaggaggaagaatcaaacaataacagggaagaaatcttcattgccccacctgacaatgcagctggagaattcacggatgaagacagcggtgatgaggactcccagagaggggctcatctgcctggttcggttctgcatgcaagcgtgttgtgcgaagattccggtaccggagaagacaatgatgacctggagctgcaaccggctaagaagaggcagaaggccgtcgtgaagccccagcgtatatggacaaagcgggatattcgcccagactttggcagctggaccgcctcagacccgcacatcgaggatctcaagagccaggagctgtcccctgtaggtctgttcgagctcttttttgacgagggaacaatcaactttatcgttaacgagactaatcgctacgcttggcagaagaacgtcaatttaagcctcactgcccaagagcttaaatgcgtactgggcattctgatcctatctggatacataagttatccgcgaagacggatgttctgggaaacttcgccagactcacatcaccacctggttgcagatgccatcaggagggataggtttgaacttatctttagctacttgcattttgccgataacaatgaattagatgcctctgacaggttcgccaaggtaagaccattgatcataagaatgaactgcaactttcagaaacatgcccctctagaagaattttattctttcggagaaagcatgtgtgagtacttcgggcacaggggcagcaagcagctgcacagaggaaaacctgttagacttggctataaaatttggtgtggaacaacaagtcgaggatatctcgtgtggttcgaaccatctcagggaacgctgttcaccaagcccgaccggagcctggatctgggcggatccatggtaatcaagttcgttgacgcgctccaagaaagaggctttctgccctatcacattttcttcgataaggtattcacctctgtaaaattgatgagcatcctccgcaagaagggagtgaaagccactggcaccgtccgagaataccggacagagcgatgtcccctgaaggacccaaaagagctgaagaagatgaagcgcggaagctttgattacaaggtcgacgagtctgaggagattatcgtttgtcgctggcacgacagttcagtcgtaaacatttgctcaaatgccgtgggcatcgagcctgtacgcctcacttccagacacagcggggctgctaaaactcgcacccaggtgcatcaacccagtcttgttaaattataccaagagaaggtgggcggagtagggagaatggatcagaacatcgctaagtataaggtcaaaatccggggaatgaagtggtatagcagcttcatcgggtatgtcatagacgccgcactaaataacgcctggcaattacaccgcatttgttgccaggacgcgcaggtcgatttgctggcctttcgacgttacatcgcctgtgtgtacttggaatcaaatgctgataccacctctcagggcagaagaagccgccgtctggaaacagaaagccgcttcgacatgatagggcactggattatccaccaggacaagagaactcgatgtgccctttgccactcacagacaaatacacgatgcgagaagtgccagaagggtgtccacgccaagtgctttcgcgagtaccatatacgctag

SEQ ID NO: 58246 - DNA, 1026 bp, Artificial Sequence
  Description of Artificial Sequence: Synthetic coding sequence
atgaattgtaactttcagaagcacgcccctctggaagagttctatagctttggggagagcatgtgtgagtattttgggcacagaggaagcaaacagctgcacaggggaaaaccagttagacttggctataaaatttggtgcggcactacttctagagggtatttagtgtggtttgagccgagtcaagggacactgtttacaaaaccagatagatcattggaccttggcggatccatggtcattaaattcgtggacgcactacaggaacgcggtttcttgccttaccacatcttttttgacaaggtattcactagtgtgaagttaatgagcatcctgcgtaagaagggggttaaagctacaggcactgtgcgagagtatagaacggagcggtgtccattgaaggatcctaaggagctgaagaaaatgaaacgaggctcgttcgactataaagttgacgagagcgaagagatcatcgtgtgcaggtggcacgatagttcagttgtgaatatctgctctaacgcagtgggcattgagcccgtacgattgacctctcggcactcaggggctgcgaagacccggactcaggtgcaccaacctagtctggtgaagctatatcaggaaaaagtcggaggggtcggtcggatggatcaaaacatagctaaatataaggtaaagatccgcggaatgaagtggtattcttcgtttatcggttatgtgattgacgctgcgctgaacaatgcctggcagctgcacaggatttgctgtcaggacgcacaggttgaccttttggcttttcgtaggtacatcgcatgtgtttacctggagtcaaatgccgacacaacctcccaggggagaagaagccgacggctggagacagaatccaggttcgatatgattggccattggatcattcaccaggataagcgaactcggtgcgccttgtgccatagtcaaactaacacgcggtgcgaaaagtgccaaaagggggtgcacgctaaatgttttcgggagtaccatattcgatag

SEQ ID NO: 58247 - DNA, 1770 bp, Artificial Sequence
  Description of Artificial Sequence: Synthetic coding sequence
atgggtcgggatgttattgcgggacgtggcatacatagcaaggtgaaatccgccaagctgctcgaagtcctcaacgcaatggaagaggaagagtccaataacaacagagaagagatttttattgctccaccagacaacgccgctggagagttcactgacgaggacagcggggacgaggactctcaacgtggggcacacctccccggtagcgtgcttcacgcatccgttttgtgtgaggattcgggaacgggggaggataacgatgatctcgagttacaacctgcgaagaagcgccagaaagctgtcgtcaagccccagagaatctggaccaaaagggacattcgaccggactttggctcttggaccgcatctgaccctcacattgaggatctgaaatcacaagaactaagccctgtgggcttattcgaacttttctttgacgagggcaccataaacttcatcgtgaatgagaccaaccggtatgcttggcagaagaatgtcaatctgagtctgacagctcaggagctgaaatgcgtactgggtattttgattctatctgggtacatttcctatcctaggagacggatgttctgggagacgagtccagacagtcaccatcacttggtggcagacgccatccgtagagatcgatttgagctgatattttcctatctccatttcgccgacaataatgagctcgatgcaagcgacaggtttgcgaaggttcgccctttaatcatccgcatgaattgcaatttccagaaacatgcgccattagaagagttttactcgttcggggaatcgatgtgtgagtacttcggccatcgaggatccaaacagctgcatagaggaaaaccagtgagacttggatacaagatttggtgcggcaccactagcagggggtatctggtgtggttcgagccgagtcagggaaccctatttaccaaacctgacaggtctctcgatttgggtggttcgatggtgatcaagttcgtggatgcgcttcaagaaagagggtttctgccctatcatatctttttcgataaagtcttcacctcggtgaaactgatgtccatcctccggaagaaaggtgttaaagcgactggcacagtgcgggagtataggactgagaggtgccctctgaaagatcccaaagaacttaagaagatgaagcgcggatccttcgactacaaagtggacgagtccgaggaaatcatcgtgtgccgttggcatgactcatccgtcgttaatatttgctccaatgccgtcggcattgaacctgtgagacttacgagccgccactcgggagccgctaagaccaggactcaggtgcatcagccctctctcgttaagctgtaccaggagaaagtggggggtgttggtagaatggatcagaatattgccaaatacaaagtgaagattagaggaatgaagtggtactcctctttcatcggctacgtgatcgacgctgcgctcaataacgcctggcaacttcaccgaatctgttgtcaggacgcacaggtggatctgcttgcctttcggcgttatatcgcttgcgtgtacctggaatcaaatgctgataccaccagccaaggtcggaggtctcgtcggcttgaaaccgaatctcgcttcgatatgatcggtcactggatcattcatcaagacaaacgtacaaggtgcgcgctatgtcattctcagactaacactcgctgtgagaagtgccaaaaaggtgtgcacgccaaatgtttccgagaatatcacatccgctag

SEQ ID NO: 58248 - DNA, 1782 bp, Artificial Sequence
  Description of Artificial Sequence: Synthetic coding sequence
atgcccagaactttatcactgcacgagattacagacctcctggagactgatgattccatagaagcatcagcaatagtgattcagccccctgagaatgccactgctccagtgagcgacgaggagagtggagacgaagagggtggaacaatcaacaacctgcccggatcactgttgcatactgctgcataccttattcaggatggcagcgacgcagaatctgattcagacgacccttcttatgctcccaaggatgactcccccgacgaagtgcccagcacattcaccgtacaacagccccctcctagccggaggcggaaaatgaccaaaatcctttgtaaatggaagaaggcagatctgacggtccagcctgttgctggacgtgtgaccgctccgcctaacgatttttttactgtaatgagaacaccaactgaaatattggagctgttcctggacgacgaggtgattgagttgatcgtcaaatattctaatctgtatgcctgctccaaaggtgtgcacttggggctcacctcctctgagttcaagtgttttcttgggatcatcttcctctccggttatgttagcgttccaaggaggcggatgttctgggagcaaaggaccgatgtgcacaacgtgctggtgtcagccgctatgcgaagagaccggttcgaaactatattcagcaatctacacgttgctgataacgccaacttggatccagtggataaatttagtaaactgaggcccctaatatcaaaacttaacgagcgctgtatgaagttcgtgccaaacgaaacctacttttcatttgatgagttcatggtcccgtactttggacggcatggatgtaagcaattcatccggggaaagccaatcaggtttgggtacaaattctggtgcggcgcaacctgcctggggtatatttgttggttccagccataccaggggaaaaacccaaacacgaagcatgaggagtacggggttggcgcttccctggtgcttcagttcagtgaggcattgaccgaggcccacccaggccagtaccatttcgtcttcaacaatttcttcacaagcatagcgctgctggataagctctcaagcatgggacaccaagcaaccggaaccgtgagaaaagatcatatcgaccgagttcctctcgagagcgatgtggcgttgaaaaagaaagaaagaggtacatttgattacagaatagatgggaaaggcaacattgtgtgcagatggaatgataacagtgtggtcacagtggcgtcctcaggggctggtattcacccattgtgtctggtgtcgaggtacagccagaaattgaagaaaaaaatccaggtgcagcagcccaatatgatcaaggtgtataaccagttcatgggtggcgtcgaccgcgcagacgaaaatatcgataaatatcgcgcaagcatccgcggaaaaaagtggtattcaagcccactcctgttttgcttcgagttagttttacaaaacgcctggcagttgcacaagacttatgacgagaaacctgtggacttcctggaatttcgccgtagggtagtatgtcattatctagagacccacgggcacccccctgagccaggacagaagggcagaccgcagaagagaaacattgattcccgctacgatggaattaatcatgtgattgtcaagcaaggaaaacagaccaggtgtgccgaatgtcataaaaatactaccttcaggtgtgaaaagtgcgatgttgcactccacgttaaatgttccgtggagtaccatacagagtag

SEQ ID NO: 58249 - DNA, 1782 bp, Artificial Sequence
  Description of Artificial Sequence: Synthetic coding sequence
atgccccgtaccttatccctgcacgagattacagacctcttggagaccgacgactctatagaggcaagtgccatagtcatccagccacccgagaatgccaccgcccctgtgagcgatgaggaaagcggtgatgaggaaggagggaccatcaacaacctacctggttccctactgcataccgctgcctatttgatacaggacggcagtgatgccgaatccgacagcgacgacccaagctacgcccctaaggatgatagtcccgatgaggtgcctagcacctttactgtgcagcagccccctccatcccgccgtcgcaaaatgaccaagattttgtgtaagtggaaaaaagcggatctgacagtgcagcccgtcgccggaagggtgactgcccctccaaacgacttctttacagttatgcgtaccccaacggagatcctagaattattcctggatgatgaggttatcgagctcatcgtgaaatacagcaacctatacgcctgcagtaaaggcgttcatcttgggcttacttcctctgagttcaaatgtttcctgggcatcattttcctaagcggatacgtctcagttccaaggcgtcgtatgttttgggaacagcggactgacgtccacaacgtgctcgtctctgccgcaatgagaagggatagattcgagacgatctttagcaatctacacgtggccgataacgcgaatttggaccctgttgataagtttagcaaactgcgtcctctgatctccaagctgaatgaaagatgtatgaagttcgttcccaacgagacctactttagctttgacgaatttatggtgccatatttcggacgccatggctgtaagcagttcatcaggggaaagccaatcaggttcggctataaattctggtgtggcgcaacttgccttggctacatctgctggtttcagccttatcagggaaaaaatcctaacactaaacatgaggagtatggagtcggcgcatccctcgttctgcaatttagcgaagcgctgaccgaagcacacccaggacagtaccatttcgtttttaataattttttcaccagcattgcgctactcgacaagttgtcttctatgggacatcaggcgacaggcaccgtgaggaaagatcatatcgaccgcgtgccactggagagcgacgtggccctcaagaagaaggagagaggcacattcgattaccggattgacggcaagggcaatatcgtatgtcgttggaatgataactccgtggtcaccgtggcctcatctggcgctgggatccatcccctgtgcctggtaagcaggtacagccagaagttgaagaaaaaaatccaggtccaacagcccaacatgattaaggtgtacaatcagttcatgggaggagtagatagagctgatgaaaatatagacaagtaccgggcttctatccgcggaaagaaatggtacagcagtcccctccttttctgtttcgagcttgtactgcaaaacgcttggcagctgcacaaaacatacgatgaaaaacccgtcgattttctggagtttcgtagacgcgtggtgtgccactatctagagacgcatggccaccccccagagcccggacagaaagggcgacctcaaaagcgtaacatcgatagccgctatgatggcattaaccacgtcattgtcaaacaggggaagcagacgagatgcgccgagtgtcacaagaataccactttccgatgtgaaaaatgtgacgttgcacttcatgtgaaatgctccgtcgagtaccacacggaatag

SEQ ID NO: 58250 - DNA, 1758 bp, Artificial Sequence
  Description of Artificial Sequence: Synthetic coding sequence
atgtctaatcctagaaagcgtagcattcccatgcgcgattccaacactggattggagcaactgctggcagaagactcctttgatgagtcggatttctccgagatagatgacagcgacaattttagtgatagtgctttggaagcggacaaaattcgacccctctctcatcttgagagcgacggcaaaagctccacaagctctgactccgggagatctatgaaatggagcgctcgagccatgattccaaggcagcggtatgacttcacaggaacccccggaagaaaggtcgacgtatctgatattactgatccccttcaatatttcgaactgttctttactgaggaactcgtgtcgaagatcacccgggaaaccaacgctcaagcggctctcctggcgtccaagccccctgggcctaaggggttcagtcggatggataaatggaaagacacggataatgatgaactgaaggtgtttttcgctgtgatgctgctccagggcattgtgcaaaaaccagaactcgaaatgttctggagtaccaggccattgctcgatacgccctatctgcgccagatcatgacaggcgagagattcctgctactgttccggtgtctgcacttcgtgaacaattctagcatcagcgctggccagagcaaagctcagatttcactccagaagatcaagccagtgtttgattttctggtgaataaattttccaccgtgtacacccccaatcgcaacatagcagtagacgagagcctaatgttatttaagggacctcttgcaatgaaacagtatctgcctaccaaaagggtgcgctttggccttaaattatatgttctatgcgaatcccaatccgggtatgtctggaatgctctggtgcacaccggccctggcatgaacctgaaagactcagccgacggcctgaaatccagcagaatcgttttgacacttgtgaatgacctcctcgggcaaggttactgtgtgttcttggacaattttaacataagtccgatgctgtttcgagagcttcaccagaaccgaactgatgctgtgggcacagctcgcctgaaccggaaacagataccaaatgatttaaaaaaaaggatcgctaaaggcaccacagttgcacgattctgcggagagctgatggcgctcaagtggtgcgatggcaaggaggttacaatgcttagtactttccataatgacacagtgatagaggttaataacaggaacggtaaaaagacaaaacgccctcgcgtgatcgttgactacaatgagaacatgggcgcagttgactccgcggatcagatgctgacatcatacccctccgagcgcaagcgtcataaggtgtggtataagaagttcttccatcatctgctgcatattacagtgcttaactcatacatacttttcaagaaggataatccagagcacactatgtcccacattaattttagactcgccctgattgagcgcatgttggagaagcaccataagcctgggcaacagcatttgcgcggtcggccatgtagcgatgacgtaacacccctgcgactgagcggaaggcactttccaaagagtatccctgcaacgtctggaaaacaaaaccccactggtcgatgtaagatatgttgttcccagtacgataaagacgggaagaagatccggaaggagactcggtacttctgtgcagagtgcgacgtgcccctgtgcgtggttccatgcttcgagatctaccacacaaagaagaactattag

SEQ ID NO: 58251 - DNA, 948 bp, Artificial Sequence
  Description of Artificial Sequence: Synthetic coding sequence
atggaaacctccagtaaggggctccttactcaggtcactcagttttggaatcttcttgatgacctggcccaatccgatcccgagggttacgaaaagtttatacagcaacaactgaaagagggcaagcagttatgcgccgcaccagaaccacagctgtgcttgcagacccgaatactgaagccgaaggagaaaattctcttcattaacctgtgtcaatggaccagaatcccagcgccacaaagcaccacacaccccgttcctctgacagtgggcaaacccgaagatacaaccgaaatatcagacgcgtatactgttatcgacgttgcatacaatcccgatgtactccatgctgcggagaaagaccaggtaaagaaaaaccagttgatccagatggctatgaagtgtatcgaggagaagttccagttcactttgagccactcctatcacataactaaatttagaatcaaaggtagtatacagcggatgaagcagaatctgatgggcatacagaccgactccattgatttaagggagaaaatgagacgcgaactgactctggggcagattcgctctagcaccatgagcaacccagaccacttcccgcaactgctactccctaaagaccaggtgagcggcaaagctgtttgcctaatcgaggagataagctcaacggaaatccaggtggaaatgaagatgccagcatacgagctcaagatcgtacatgaccacagtgagaaacccctcaaaatcgaattgaaggtggaattaccagggatcaattcggtttcgctctgtgacctttccgtgagcgaagatgatctgctcatcgaggtctcagagaagtacagattgcacctgaaccttcccaaattaatcgataccgaaatgactaccgcaaagtttatcaaagagaagtccacacttatcattacaatgccactagtgtag

SEQ ID NO: 58252 - DNA, 867 bp, Artificial Sequence
  Description of Artificial Sequence: Synthetic coding sequence
atggagactagcagtaaagggttattaacacaggtgactcagttctggaatctcctcgacgacctggctcaatccgatcctgaaggttatgaaaaatttattcagcagcagcttaaagaaggtaagcagctctgcgcggctccagagccacaattgtgtctgcagaccaggattctcaaaccaaaggagaagattttgtttattaacttatgtcagtggacacgaattcccgctcctcagtccacaactcatcccgtcccactgacagtaggcaaacctgaggatactactgaaatctcagacgcctacactgttatagacgtcgcttataacccggatgtcttgcatgccgcagagaaggatcaggtgaagaagaatcagctcattcagatggctatgaagtgtatcgaagagaagtttcagtttaccctctctcattcctatcacatcaccaagttccgtatcaagggcagtattcagagaatgaaacagaatctgatggggatccagacggattctattgatttgagggaaaagatgcggcgagaactgacactgggacagattaggtcctcaaccatgtcaaacccagatcatttcccccagcttctgcttccgaaagaccaagtgtccggaaaagcagtgtgcctgattgaggaaattagctcgaccgaaatccaggtcgagatgaagatgccagcttacgagctgaagatcgtccacgaccattctgaaaaacctctgaagattgaactgaaagtggagctcccaggtattaatagtgtgtcattgtgcgatctgtctgtctcagaaggaaccaccgagccacaggccctggctaaggatgaactctctctgaagttctag

SEQ ID NO: 58253 - DNA, 867 bp, Artificial Sequence
  Description of Artificial Sequence: Synthetic coding sequence
atggaaacatcctccaagggtctcctcacccaggtgacacaattttggaatctgctggacgaccttgcccagtcagaccctgaagggtacgagaagtttattcagcagcagctcaaagaaggcaaacagctgtgcgccgcaccagaacctcagctatgtctccagactcggatcctcaaacccaaggagaaaatactattcataaacctttgccagtggacacggatccccgctcctcaatctactacccacccagtgcccctgacagtcggtaagccagaggacaccactgaaatctctgacgcctataccgtgatcgacgtcgcctacaacccagacgtgttgcacgccgcagaaaaggatcaggtcaaaaaaaaccagctgattcagatggccatgaagtgcatcgaggagaaattccagttcaccctaagtcattcttaccacataaccaagtttcggattaaaggaagcatccagcgcatgaaacagaatttaatgggtattcagaccgactcgatcgacttgagggagaaaatgaggcgtgagcttactctggggcagatcagatcctcgaccatgtctaatcccgaccacttcccccagctcctgctccccaaggaccaggtctctggtaaggccgtgtgtctgatagaggaaatctcgtctacggagattcaggttgagatgaaaatgccagcctatgaactcaagattgttcacgaccattctgagaagccccttaagattgagctaaaggttgagcttcctggcattaattctgtgtctttgtgcgacctgtcagtttccgaaggtactacggaacctcaggccctggccaaagacgaactgtctctgaagttctag

SEQ ID NO: 58254 - DNA, 948 bp, Artificial Sequence
  Description of Artificial Sequence: Synthetic coding sequence
atggagacttcttccaaagggctccttacccaggtgactcaattctggaatctactggacgacctggcccaatctgaccccgagggctacgagaagttcattcaacagcagctgaaggaggggaagcagctgtgtgccgctccagaaccccagctctgcctacagacgcggatcttgaagccaaaggagaaaatcctatttataaacctctgccagtggacgaggatccccgcaccccagtccaccactcaccctgtcccactgaccgtgggcaagccagaagatacaactgagatatctgacgcctacacagtgatcgacgtagcatataacccggatgtgctgcacgctgccgagaaggatcaagttaaaaagaatcagttgatccaaatggcaatgaagtgcatagaggaaaaattccagtttaccctgtcccattcctatcacattacaaaattcaggatcaaagggagcatacaacggatgaaacaaaatcttatgggaatacagacagactctatcgatttacgtgagaagatgcgaagagagctcactctcggccagatcaggtcttctaccatgtctaaccccgaccactttccgcagctcctgttgccgaaggaccaagtgtctgggaaagcagtgtgtctgatcgaagaaatttcaagcactgagatacaggttgagatgaagatgcctgcgtacgagttaaagatagtgcacgaccattctgaaaagcccttaaagatcgagctcaaggtggaattgcctggaattaacagtgtctctttgtgcgacctgagtgtgtccgaggacgacttgctgattgaggtgagcgagaaataccgcctccacctgaatctgcctaaactcatagacactgaaatgaccaccgccaaattcatcaaggagaagtcgactctgattatcaccatgccacttgtttag

SEQ ID NO: 58255 - DNA, 636 bp, Artificial Sequence
  Description of Artificial Sequence: Synthetic coding sequence
atgtctcatggacactctcatggtgggggtggttgtaggtgtgctgcagaacgcgaagaaccgccagaacagcgagggttggcttacggtctgtacctgaggattgatctcgagagactgcagtgtctgaacgaatctagagaaggctcagggagaggcgtgtttaagccttgggaggagagaacagatagaagtaagtttgttgaaagtgacgctgacgaggaacttctcttcaacatcccatttacaggcaatgtgaaactgaagggaattatcattatgggagaggatgacgattctcacccatccgaaatgcgactctacaagaacatcccccagatgagcttcgatgacaccgagagagaacctgaccaaactttctctctaaaccgtgatcttactggcgaactggagtacgccacaaagatttcccgcttcagtaacgtgtaccatctgagcatccacatctctaagaacttcggagctgatactaccaaagttttttacatcggcctgcggggagagtggacggagctgaggcggcacgaggtaacgatatgcaactacgaggcttcagccaacccagccgatcatcgagtacaccaggtcacaccccaaacgcactttatttcttag

SEQ ID NO: 58256 - DNA, 297 bp, Artificial Sequence
  Description of Artificial Sequence: Synthetic coding sequence
atgagtttcgacgatacagaacgggagcccgaccaaacttttagcttgaacagagacttaacaggcgagctcgagtatgccactaaaattagcaggttcagcaacgtgtatcacctgtccatccatataagcaaaaactttggcgcagataccaccaaggtcttttacatcggacttagaggagaatggacggaactccgaaggcatgaggtcaccatttgcaattacgaggctagcgccaacccagccgatcatagggtgcaccaggttactccccaaacccactttatctcatag

SEQ ID NO: 58257 - DNA, 213 bp, Artificial Sequence
  Description of Artificial Sequence: Synthetic coding sequence
atgggagaggatgatgattctcacccgagcgagatgcgactctataagaacattccccagatgagtttcgacgatacagaacgcgaacctgaccaaacattttccctgaatcgggacctaaccggggagctcgaatacgccaccaagatatccaggttctccaacgtgtaccacctttctattcacatctccaagaactttggtgccgattag

SEQ ID NO: 58258 - DNA, 903 bp, Artificial Sequence
  Description of Artificial Sequence: Synthetic coding sequence
atggaaccgccaatggagccgtccggaggagaacaagagccgggagccgtaaggtttctagacctgccctgggaagacgtgctgctgcctcatgtgctgaatagggttcccctccggcagttgctacggttacagcgggttagcagagccttcagatcactggtgcagttgcacctggccggactgcgcagattcgacgccgcacaggtcggtccacagattccaagggcagccctggctcgtctgctgagggatgcagaagggcttcaagaattggccctggctccctgccacgagtggctcagtgatgaggacctcgtccctgtgctggcacgtaatccgcagctccgttccgtggcgctcggcggatgcgggcagctcagcagaagagctctgggggctttggccgagggatgtccaaggctacagcgcctctctctggcccactgcgattgggtggacggcttggccctgcggggactggccgataggtgtcctgccctggaggaattggacctcaccgcatgtaggcagctcaaagatgaggccatagtctatctcgcccagaggaggggtgccggactgaggtctctgagcctggcagttaatgccaatgtcggagatgccgcagtgcaggagctcgccaggaattgtcctgagctgcaccatctcgacctgaccggctgccttcgcgtaggtagtgatggagtgaggacactggccgagtattgccccgtgctgagatcactccgtgtcagacactgccaccacgttgccgagtcttctttatcccgcttaaggaaaaggggtgtggatatcgatgtggagccaccattgcatcaagcactggttctgctccaggacatggctggctttgccccatttgtgaatctgcaggtgtag

SEQ ID NO: 58259 - DNA, 3093 bp, Artificial Sequence
  Description of Artificial Sequence: Synthetic coding sequence
atgaggaatgtggcccttcgcagggccgctggcccagtgtgtgctgaggccgcagagaggcgaacatgtacaccacagtcagtcgctatggaacagtataaactgggagataaaatccacgggtttacagtgaatcaggtcacaagtgtacctgaactgttcctgacagcagttaaacttactcatgacgacactggagccagatatctgcatctggcaagagaagatactaacaacctcttcagcgtgcagttcaggaccacaccaatggattcaacgggcgtcccacatatattggaacataccgttctgtgcggaagccagaagtacccctgtcgcgacccattctttaaaatgcttaataggagcctgtcaactttcatgaatgcattcacagcttcagattatacgctgtacccattttcaacacaaaaccccaaggattttcagaacctgctgtccgtgtatctcgacgcaactttcttcccatgccttcgggaactggatttctggcaggagggatggcgactcgagcacgaaaatcccagtgacccccagaccccactcgtctttaagggcgtggtgttcaatgagatgaaaggcgcatttaccgacaacgaaaggatcttttctcaacatttacaaaaccggctcctccccgatcacacatatagtgttgtaagtggcggagatcccctgtgtattcctgagctcacctgggagcagctgaaacagttccatgccacacactatcacccatccaatgcaagattttttacctatgggaactttcctcttgagcagcacctgaagcagattcacgaggaagcactcagcaaattccagaagattgagccttcaacagtggtgccagcccagaccccctgggataagcctagggaattccaaatcacctgtggcccagacagcttcgcaaccgatcccagtaagcaaacaaccatctcggtgtcctttctcttaccagacatcactgataccttcgaagcctttacactttccctgctttctagcttgctcacgagtggaccaaattcacctttctacaaggctcttatcgaatccggcctgggaaccgatttcagccctgacgtgggatacaacggctacaccagagaggcctattttagcgtagggctgcagggaatcgcagagaaggatatagaaacagtacgtagcttgattgaccgtaccattgacgaggtagtcgaaaaaggatttgaggacgatcgaatagaagctctgctgcacaaaattgaaatacagatgaagcatcagagcacctcttttggtctgatgttgactagctacattgctagttgctggaaccatgacggtgatcctgtggaattacttaagctggggaatcagctcgccaagtttaggcaatgcctccaagaaaaccccaaatttttgcaggagaaggtgaaacagtattttaaaaataaccagcacaaactgacactgtccatgcggcctgacgacaaataccatgaaaagcaggcccaggtagaggcaacaaaactgaaacagaaagtggaggcactgtcccccggagaccgccagcagatttacgagaagggtcttgaactgaggagccagcaatctaagccacaggatgcaagttgtttaccggcattgaaggtgagcgacatagagcctacaattcctgtgaccgagttggatgttgtccttaccgcgggtgacattcccgtgcaatattgtgctcagccaaccaacgggatggtttactttagggccttcagcagtttaaacaccctccccgaggaactgaggccctacgtgcctctcttttgctcagtcctgacaaagttagggtgtggactattagattaccgcgagcaggcacagcagatcgagttgaagactggaggaatgagtgctagtccccacgttctgcctgacgattcccacatggatacctacgagcagggcgtgctcttttcgagcctgtgtctggatcgcaacctgcccgatatgatgcagctttggtctgagatcttcaataatccctgctttgaagaagaagagcatttcaaggtgttggttaagatgactgcacaagagctggcaaatggcatcccagactcgggacatctatatgcatccatccgcgcagggagaacgctgaccccggcaggggacctgcaagaaacctttagcggcatggaccaggtccgccttatgaagaggattgccgaaatgaccgatattaagcccatcttgcggaaactcccgcgaatcaaaaagcatctattgaatggtgacaatatgaggtgctctgtgaatgctactccgcaacagatgccgcaaaccgagaaagcagtcgaagattttctgcgaagcatcggacggtccaaaaaagagcgcagacctgtcaggccccataccgtggaaaaacctgttccatctagcagcggtggggatgctcacgttcctcacggcagtcaggtgatacggaagctggtcatggaaccaacctttaagccatggcagatgaaaacccacttcctcatgccattccccgtcaactatgtgggagagtgtattagaacggtgccttacaccgatcctgaccatgcgtcactgaaaatactcgctcggcttatgacggccaagtttctccacaccgagatcagagagaaggggggtgcatacggaggcggtgcaaaactgtcccacaatggaatttttaccctgtattcctatagggatcccaacaccatagaaacactgcaatccttcgggaaggcagttgattgggccaagtctggcaagttcacccagcaggacatcgacgaggcaaaactgagcgttttctcgacagttgacgcaccagtggctccttcagataagggcatggaccatttcctgtacggcttgagtgatgagatgaagcaggctcaccgggaacagttgttcgcagttagccacgataaactcctggccgtatctgaccgctatctcggaaccggaaagagcacgcatggactggctatcctgggccctgagaatcccaaaatcgctaaggatccttcatggataattcagtag

SEQ ID NO: 58260 - DNA, 3117 bp, Artificial Sequence
  Description of Artificial Sequence: Synthetic coding sequence
atgtggcgttgtgggggacggcaggggctgtgcgttctgaggaggctgtcgggaggacacgcccaccacagagcatggcgttggaacagtaatcgcgcttgtgagcgtgccctgcagtataagttgggggacaagatccacggcttcaccgtgaaccaggtaacctctgttcctgaactgtttctcacagctgtgaaactcacacacgatgacacgggagcccgttatctgcacctggcgagggaagatacgaacaatttgttctccgtgcagttccggaccactcctatggactctaccggcgttccacacatcctggaacacacagtgctttgtgggtctcaaaagtatccttgtcgcgatcctttttttaagatgcttaaccggtctttgagcactttcatgaatgcatttaccgctagcgattacaccctctatcctttctcaacacaaaaccccaaggacttccagaatctcctctctgtatatctggatgcaactttcttcccttgtctgagagagctcgacttctggcaggagggatggcgcctggagcacgaaaacccatccgatccgcagactcctcttgtgttcaagggagtggtgtttaacgagatgaaaggagcctttacagataacgaaagaatattctcccaacatctccagaataggttactgcccgatcatacctactctgtggtttccggaggcgatcctctgtgcatacccgagttaacctgggagcagctgaagcagtttcacgccacccattatcatccttccaacgctagatttttcacctacgggaactttcctctcgaacagcaccttaagcagatccatgaggaagccctaagcaaattccagaagattgagccttctaccgtggtacccgctcaaaccccctgggataagcctcgggagtttcagatcacgtgtggccctgattcgttcgctactgatccatcaaagcaaactaccattagcgtcagctttctgctccccgacatcactgataccttcgaggccttcaccctgagtctgctgtcaagcctgcttacctcaggtcctaactccccattttataaagccttgattgagtccggtctgggcaccgatttcagtcccgatgtggggtacaatggttacacaagggaagcatacttctccgttgggctacagggaatcgcggagaaagacattgaaaccgtgcggagtctcattgaccggaccatcgacgaggttgtggaaaagggatttgaagatgaccgcatcgaggcactacttcataagatcgagatccagatgaagcaccagagtacctcctttggccttatgctgacttcgtacatcgcgagctgctggaaccatgacggagatcctgtggaattgctaaaacttgggaaccagttggcgaaatttagacagtgcttgcaggagaatcccaagttcttacaagaaaaggttaagcagtactttaagaataaccagcataagctgaccctttccatgcgccctgatgataaataccatgagaaacaagcgcaggttgaagccacaaagctaaagcagaaggttgaggccctttcccctggcgaccgccaacagatttacgagaagggtctcgaactgaggtcacagcagagtaagccccaggacgcgagctgcctgccagctctgaaagtgtcagacattgagcctacgatcccggtcaccgagctcgatgtagtgctgactgctggggatattcctgtccaatactgtgcccaacctactaacggaatggtgtactttcgggctttctccagcctcaacacacttccagaagagctcaggccttatgtccccctgttctgctcagtcctgacgaagctggggtgtggacttttggactatagggaacaagcccaacagattgaactcaaaacaggcggaatgagcgcctcccctcatgtgctacccgatgactcccacatggacacatatgagcaggtgggggtcctgttttcctccctgtgtctcgaccgcaatttaccggacatgatgcagctctggtctgagatcttcaataacccttgcttcgaagaggaggagcactttaaggtgctggtgaagatgaccgcacaggaactagccaacggtatcccagactcaggccacctgtatgcttctatcagagcagggagaacactgacgcctgccggagacctccaagaaacattcagcggcatggaccaggtcagacttatgaaaagaatcgcggagatgacagacattaaaccaattctgagaaaactccctagaattaagaagcatctcctgaacggagacaatatgcggtgctccgtgaacgctacacctcaacagatgccacaaactgaaaaggctgtagaggattttttgagatcaataggccgaagcaagaaggagcggaggcccgtgcggcctcacacggtggaaaaacctgtgcccagttcgtccgggggagatgcacacgtgccacatggcagccaggtaatccggaaactggtgatggagcctacgtttaagccttggcaaatgaaaacccattttctgatgcctttccctgtaaattacgtgggagagtgcatacgcactgtgccgtacactgacccagatcacgcctccctgaaaatacttgccaggctgatgacagctaagttcctccataccgaaatacgggagaaaggcggtgcatacgggggtggcgctaagctttctcacaacggaatatttaccctgtacagctatcgagaccctaacacaattgagacacttcagtcatttggcaaagctgtcgattgggctaaaagcggaaaattcacccagcaggacattgatgaagcgaaattgtcagtcttcagcactgtcgacgctcctgtggcacccagcgataagggtatggatcactttctttacggcctctcagatgaaatgaaacaggcccacagagaacagctgtttgctgtatctcatgacaagctcctggccgtcagcgatagatacctgggaacaggaaaaagcacacacggactggccattttgggcccagaaaaccctaagatagctaaggaccccagttggatcattcaatag

SEQ ID NO: 58261 - DNA, 1788 bp, Artificial Sequence
  Description of Artificial Sequence: Synthetic coding sequence
atgtggaagtcctcctttcagtatatagcctcttgctggaaccacgatggcgaccccgtcgagctgctcaagttaggcaatcagctggctaaattcagacagtgtctgcaggagaatccgaagttcttgcaagaaaaggtgaaacaatacttcaaaaacaaccagcataagctcaccctgtccatgcgacccgacgataagtaccatgagaaacaggcacaagtggaggctacaaaattgaagcagaaggtcgaagccctctctccaggtgaccggcaacagatatacgagaaaggcctagagctaaggagccaacagtccaagcctcaggatgcatcctgcctccccgctttgaaggtatccgacatcgagccgaccattcccgtgaccgaactggatgttgtgctgacggccggtgacatacccgtgcagtattgtgcccagcctaccaacgggatggtttatttcagggccttcagctccctgaacaccttgcccgaagagctgagaccctacgtgcccctcttttgttcggtcttgacaaaactcggttgtggtctgttggattacagggaacaagcccagcagatagagcttaagacaggaggaatgtcggcttctccacacgtgctgccggatgactctcatatggacacttacgaacagggagttctcttctcctcactgtgtctggacaggaatcttcccgatatgatgcagctttggagtgagatattcaacaacccatgctttgaggaggaggagcattttaaggtactagtgaaaatgaccgcgcaagagctcgccaacggaattccagattctgggcacctatacgcctccatccgcgctgggagaactttaacacctgccggagatctgcaggaaactttttctggaatggatcaggtgaggctgatgaagcgaatagccgagatgactgacataaagcctatcttgcgcaagctcccaagaatcaagaaacatctcctgaacggggataacatgagatgttctgtgaacgccacaccccagcagatgcctcaaacagaaaaagcagttgaggacttcttacgatccattggcaggtccaaaaaagagcgaaggccagtgaggcctcacaccgttgaaaaacccgtaccatccagctccggtggtgacgctcacgtgccccatggcagccaggtgattcggaagctggtgatggagcccaccttcaaaccgtggcagatgaagacacacttcctgatgcccttccccgtaaactatgtaggcgagtgcattcgaactgtgccatacacggatcccgatcacgcttccctcaagattttagcacggctcatgacagctaaatttctgcataccgagatccgcgaaaaaggcggagcttacgggggaggggcaaagctgtctcacaacggcatcttcacactgtactcctatagagacccaaacacgattgaaacattacagtcatttggaaaggccgtggattgggctaagtcaggaaaattcacccaacaggatatagatgaagccaagctgtcagtgttcagtacagtggacgctcctgtcgcgcctagcgataagggaatggatcactttctttacggactgtcagatgagatgaagcaagcgcatagagagcagctgtttgctgtatctcacgacaagttgcttgctgtgagcgaccggtatctgggcactggcaaatctactcatggattggctatcttgggccctgagaaccccaaaattgccaaagatccatcatggattatacagtag

SEQ ID NO: 58262 - DNA, 261 bp, Artificial Sequence
  Description of Artificial Sequence: Synthetic coding sequence
gtcaacgctactccacagcagatgccccagaccgagaaagccgtcgaggactttctacgtagcattggcaggtccaaaaaggaacgcaggcccgtcagaccgcacactgttgagaaacccgtgcccagctcatccggtggcgacgctcacgtcccacatgggtcccaggttattcgaaaactcgtcatgtacaccttgcggcatcatgtaaagatcggcggactgcatgtctcttttaccgtccgcaattgtgttgaatag

SEQ ID NO: 58263 - DNA, 702 bp, Artificial Sequence
  Description of Artificial Sequence: Synthetic coding sequence
tgattgatcgaatccggtcttggtacggatttttcccctgatgtgggatacaatggctacacgcgtgaggcgtatttctccgtcggtctacagggaattgcagagaaagatattgagaccgtgcgcagcctgatcgaccgcactatcgacgaagtggtggaaaagggctttgaggatgatcggattgaagcactgctccacaagattgagatacaaatgaaacaccagagtacaagcttcggtctgatgctgacgtcttacatagcaagctgctggaaccatgacggggatccagtggaacttctgaagctgggaaatcaattagctaaattccgccaatgcctgcaggagaatcctaaatttctacaggaaaaagtcaagcagtacttcaagaataaccagcacaagctgactctctccatgcgccctgacgacaaataccatgaaaagcaggcccaggtagaggcgaccaaactcaagcagaaggttgaggccctgtcacccggagacagacagcagatatacgagaagggtctggagctaagatcacagcaaagtaagcctcaggacgcctcctgcctgcccgctctaaaagtcagcgatatcgagcctacaatacctgtgaccgaattggacgtagtcttgactggacattgcgaacgatacgctttcccgggtagcagggttccctgggggaattag

SEQ ID NO: 58264 - DNA, 2820 bp, Artificial Sequence
  Description of Artificial Sequence: Synthetic coding sequence
atgcgaaacgtggcgttgcgaagggcggcagggccagtctgcgctgaggccgctgagcgtcgcgtcacttccgtgcctgaactctttctgaccgccgtgaaactgactcacgatgatacaggggcacgctacctgcatctagcacgcgaggacaccaataatttgttttccgtgcagttcagaactacccccatggatagcaccggagtgccccacatcctggaacatacagtcttgtgcggctcgcagaaatatccttgtagagatccttttttcaaaatgctgaatagatcgttgagcacatttatgaacgctttcacagcttccgattacaccttgtatccattctccacgcagaatcccaaagacttccagaatctgctaagcgtatacctcgatgccactttctttccatgcctgagagaactcgacttttggcaggagggctggaggttagaacacgagaacccgtcagacccacagacccccctggtgtttaaaggtgtggtgtttaacgaaatgaagggggcattcacggataatgaaagaattttcagccagcatttacaaaacagactcctgccagaccatacctatagcgttgtaagtgggggtgatccactgtgcatacccgagctcacttgggagcagttgaagcagttccacgcaacgcattaccaccctagcaacgcaagatttttcacctacgggaactttccccttgaacagcatctcaaacagatacacgaggaagctctctcaaaattccagaagattgagcccagtactgtcgtaccagcccagaccccctgggataagccccgagaatttcagatcacctgcgggcctgactcatttgcaacagacccttcaaagcagactaccatcagcgtgagcttcctcctccccgatataaccgatacatttgaggcttttaccctgtctctgcttagtagcctgttgactagcgggcctaactcgcccttctataaggcgctcattgagagcgggctgggtacagacttttctccagacgtgggatacaacggttatacgcgtgaagcctacttttcggtgggactgcagggcattgccgagaaggatatcgagacagtccggtcactgatcgatcgtaccattgatgaggtggttgagaaggggttcgaggatgatcgcatagaggcactcctgcacaaaattgagattcaaatgaaacaccagtctacatccttcggtttgatgcttacatcctatatagcctcctgttggaaccatgatggcgatcccgtggaacttcttaagctcggaaatcagcttgccaagttccgccagtgtctacaggagaaccctaaattcttgcaggagaaggtcaagcagtatttcaaaaacaatcagcacaaactgaccctgagtatgcgccctgacgacaagtaccacgaaaaacaggcgcaggtagaggccacgaagttaaagcagaaggttgaagctctgtctcccggtgatcgccaacagatctacgaaaaggggctcgagctgcggtctcagcagtcaaagcctcaggacgcttcctgcctccctgcacttaaggtaagtgatattgaacccaccatccctgttactgagctggatgtcgtactgaccgctggagacatcccagtacagtattgcgcccaacccacgaatggaatggtgtattttcgcgctttctcatctctgaacaccctccctgaagagttgcggccttacgtgccgctgttttgtagcgtcctaacgaatccttgtttcgaggaggaagaacactttaaagtgctggtcaaaatgactgcccaggagcttgctaacggaatccctgattctggccacctctatgcctccatccgcgcagggcgaacactgacacccgcaggtgatcttcaggaaacattctcaggcatggaccaagtccggctgatgaaacggatcgctgaaatgaccgacattaagccaattctccgcaagcttccgcgtatcaagaagcatctccttaatggggacaacatgagatgctcagttaatgccacaccacagcaaatgccgcagaccgagaaagccgttgaggatttcttacgatctattggacgttcaaagaaagaaagacgacccgtcaggcctcacacggtcgaaaaacctgtgccgtccagcagtgggggagacgcccacgtgcctcatggttcacaggtgatccgaaagttggtgatggagcccactttcaagccatggcagatgaagacccacttcctgatgccattcccagtgaattacgtgggcgaatgtatcagaaccgttccctacaccgaccccgatcatgcttccctcaagattttggccagactaatgaccgcaaaattcctgcacaccgaaatccgggagaagggaggggcttatggagggggagccaagttgtctcacaatgggatttttacgctgtatagctaccgggatcccaacactattgagaccctgcagagcttcgggaaggccgtggattgggcgaaaagcggaaagttcacccaacaggacatcgatgaggcgaagttaagtgtgttcagcacggtggatgctccagttgccccttctgataaaggcatggaccatttcctgtacggtctctctgacgaaatgaagcaggcccatcgagagcaactctttgcggtatcacacgacaaactgttggccgtgtccgatcggtatctcggcaccggcaaatcaacacacggtctggccatcctcggaccagagaaccccaaaattgccaaggatccatcttggattatccagtag

SEQ ID NO: 58265 - DNA, 780 bp, Artificial Sequence
  Description of Artificial Sequence: Synthetic coding sequence
tgattcagttcactgtgtctggatcgcaacctgcctgacatgatgcagctctggagcgagatcttcaacaatccatgctttgaagaagaagaacactttaaagtccttgttaagatgaccgctcaggagctggccaacggcattccagactcaggccacctctacgcctccattcgcgctgggagaaccctgactccagctggagacctccaggagacattttccggtatggaccaggtccgattaatgaagcgcatcgccgaaatgactgacataaagccaatacttagaaagctgccaaggataaagaagcatttgctgaatggggataacatgaggtgttctgtcaatgcgaccccacaacagatgccccaaaccgagaaggccgtcgaggatttcctacgctccatcggtagatcaaaaaaggaaagacgcccagttaggccgcacaccgtggagaagcccgtaccctccagcagtggcggagacgctcacgttccacatggaagtcaggtcattcgcaagctggtcatggagcccaccttcaaaccatggcagatgaaaactcacttcctaatgccctttcctgtgaattacgtgggagaatgcatcaggaccgtaccctataccgatccagaccacgcaaggaagagacctgtctgcggatcaggcgacttaggtctcattagccctcgggcatccagccggtcactatgcttatgctgccgcccaagccaccattgtttaccaagactcttgtccgaagttgatgtgttctag

SEQ ID NO: 58266 - DNA, 555 bp, Artificial Sequence
  Description of Artificial Sequence: Synthetic coding sequence
aaaccagtgccatcttctagcggtggagatgcccacgtgcctcatggatcccaggttattcggaagctggttatggaaccaacttttaagccatggcaaatgaagactcacttcctgatgcccttccccgtgaactatgtaggcgaatgcattcgcaccgtcccttatacggatcctgatcacgccagcctgaaaatactggccaggctgatgaccgcaaagttcctgcacacagaaatcagggaaaaaggaggtgcatacggcggaggggcaaaactctcgcataacggcatttttacactctactcatacagggatcctaacacgatagagactctgcagtccttcgggaaagccgtcgattgggcaaagtctggcaaatttactcaacaggatatcgatgaggctaagcttagcgtgttctctaccgtcgatgctccggtggctccaagcgacaagggcatcctaagtatcacagtgcgtatcagtacccacagtctgaccgatgatgtggcagtatttcaagtgcctggcatgcacgggcaagagcactag

SEQ ID NO: 58267 - DNA, 534 bp, Artificial Sequence
  Description of Artificial Sequence: Synthetic coding sequence
atgaattggttcgggtccaacttcttccgctgcccagaagatctcagcctgctgaatatttattctcctctgctctcgcatatgtcaagcgaggatgaacactttatcagtaatctcagaggccacgtacccgcatcggcagtcgtgaagcagccagtgaggggggcttcaggacgcacgaccatcacggccatagtacagactggcggtgggtggtctaccggactgttcagcgtgtgccgggatagacgaatctgtttctgcggcctattctgtcccatgtgtctcgagtgcgatatcgccaggcactacggggagtgcctctgctggccacttcttcccggatctaccttcgcccttcgtattggcacaagggaaaggcataaaatacagggaaccctttgcgaggactggctggccgtgcactgttgttgggctttctcaatttgtcaagttgcacgcgagcttaagatgcgaacatcacaggtgtacgagatctgcgccgtacccatgaccaaggacacattagtctag

SEQ ID NO: 58268 - DNA, 348 bp, Artificial Sequence
  Description of Artificial Sequence: Synthetic coding sequence
atgcaggcgcaggcgcctgttgtcgtggttactcagcctggggtgggcccaggacccgcaccccagaacagcaattggcagacaggtatgtgcgactgtttcagtgactgtggagtttgtctgtgtggtaccttttgcttcccatgtctaggatgccaggtcgccgcagacatgaacgagtgttgcctgtgcggcacgagcgtggccatgaggactctatatagaacccgttatgggatacctggaagcatctgcgacgactacatggcgactctctgttgccctcactgtacgctgtgtcaaatcaagagagacatcaaccggcgtagagccatgcgcactttttag

SEQ ID NO: 58269 - DNA, 348 bp, Artificial Sequence
  Description of Artificial Sequence: Synthetic coding sequence
atgcaagctcaagctcctgtggtcgtggttacccagcccggagtggggcctggtccagccccacaaaatagcaactggcagacaggcatgtgcgactgcttttctgactgcggagtgtgcctctgtggtacattctgctttccttgtctcggatgccaggtggcggctgacatgaatgagtgctgcctgtgtggaacttctgttgccatgagaaccttatataggaccaggtatgggattcccggttccatctgcgatgactacatggccactctgtgttgtcctcattgcacactttgtcagatcaagcgcgacatcaataggcggagagctatgcggaccttctag

SEQ ID NO: 58270 - DNA, 348 bp, Artificial Sequence
  Description of Artificial Sequence: Synthetic coding sequence
atgcaggctcaggcgcctgtggtggtggtaacccagccgggtgtcggcccagggccagcccctcagaattctaattggcaaactggtatgtgtgactgtttttcagactgcggagtatgcctctgcgggacattctgctttccttgtctggggtgtcaggtggccgctgacatgaatgagtgttgtctgtgcggcacctctgttgcgatgcggacactctatcggacccgatacggtattccgggatccatttgcgacgattatatggctacgctgtgctgcccccactgtaccttgtgccaaattaagcgcgatattaacaggcgtagggccatgagaacattctag

SEQ ID NO: 58271 - DNA, 348 bp, Artificial Sequence
  Description of Artificial Sequence: Synthetic coding sequence
atgcaggcccaagctcctgtggtggttgtcacccagcctggtgtcgggccagggccagctccgcagaactcaaactggcaaactggcatgtgcgactgcttcagtgactgcggcgtgtgtttatgcggaaccttttgttttccatgtctggggtgccaggtggccgcagacatgaatgagtgttgcctgtgcggtactagtgtggctatgcggacactgtataggaccaggtacggaatccccggatcaatctgcgatgactacatggccacgttgtgctgtcctcattgtacgctgtgccagataaagcgcgatatcaatagacggagggccatgaggactttttag

SEQ ID NO: 58272 - DNA, 1893 bp, Artificial Sequence
  Description of Artificial Sequence: Synthetic coding sequence
atggatgagatggccacaactcagattagtaaagacgaactggacgaattaaaggaggccttcgcgaaagtcgacctcaacagcaatggatttatatgcgattacgagctccatgagttatttaaagaagccaacatgccacttcctgggtacaaagttagggagattattcagaagctcatgttggatggagatcgcaataaggatggcaaaattagttttgacgagtttgtctatatttttcaggaggttaaaagtagcgatatagctaagacatttaggaaggcaatcaataggaaggagggaatctgtgccctgggcggaactagtgagctgagcagcgaaggtactcagcattcgtactcagaggaggagaagtatgctttcgtgaattggattaacaaggccctcgagaatgacccggactgccgtcatgtaatccccatgaaccctaacaccgatgaccttttcaaggccgttggggacggaatcgttctctgtaaaatgatcaacctgtctgtgcccgatactatcgacgaacgagcgattaacaaaaagaaactgactccgtttatcattcaggagaacctgaatcttgctctgaatagcgcctctgccatcgggtgtcacgtcgtaaacatcggtgccgaagatctccgcgctggcaaaccacacttggtccttggattgttatggcaaattatcaaaatcggactgtttgcagatatcgagctgagccgcaatgaggccctggccgcactgctccgcgacggcgaaacgctggaagaactgatgaaacttagtcccgaggagctcctcctgcggtgggctaacttccacttggagaattctggttggcagaaaatcaacaatttttccgctgacatcaaagatagcaaagcatacttccacctgctgaaccaaatcgcccctaagggccaaaaggagggcgaacctaggattgacataaacatgagcggctttaatgaaaccgatgatttgaaacgcgctgaaagtatgctccagcaggccgacaagctcggatgcaggcagttcgtgacccctgccgatgtagttagtggcaaccccaaactgaacctggcttttgtggctaatctatttaacaagtaccctgctctcacaaaacccgaaaatcaagacatcgactggacactactggaaggggagacgcgagaggaaaggacctttagaaactggatgaactccctaggtgtgaacccacatgtaaaccacctgtacgccgacctgcaggatgcactggtgatcctgcaattgtatgagaggattaaggtgccagtagattggagtaaggtgaacaagccgccatatccgaagctgggcgcaaacatgaaaaagctcgagaattgtaattatgctgtggagctcggtaaacaccctgccaagtttagtctggttggaattggcggacaggacctcaacgacggcaatcagaccctcacactagcactggtgtggcagttgatgagacgctatactttaaatgtgttggaggatttaggagatggccaaaaggccaacgacgatattattgtcaattgggttaataggaccttgtccgaagctggaaagtcaactagcatccagagttttaaggataagaccattagctcctccctggcagtggtggacctgatcgacgcaatccaacccggttgcattaactacgaccttgtgaaaagtggcaatctgacagaggacgataaacataataatgctaagtacgctgtttccatggctcgcaggatcggcgcacgggtgtatgccctgcctgaagacctggttgaagtgaagcccaaaatggtcatgacagtgtttgcctgtctcatggggagagggatgaagagggtttag

SEQ ID NO: 58273 - DNA, 3849 bp, Artificial Sequence
  Description of Artificial Sequence: Synthetic coding sequence
atggctgccgatttaaatttggaatggatcagcttaccgagaagctggacctatggtatcacacgaggaggccgagtgtttttcatcaacgaggaagcgaagagcacgacatggctccatcccgtcactggggaagccgtggtaaccggccatcgcaggcagtctactgatctcccaacaggatgggaggaggcttacacattcgagggcgctcggtattatattaaccacaacgaacggaaggttacatgcaagcatcctgttacaggccaaccgtcgcaggacaattgtatattcgtcgtcaacgagcaaacagtggccactatgacctcagaggagaagaaagagcggccaatcagtatgatcaacgaggccagcaactataacgtgacctcagattacgccgtccaccccatgtcgcctgttgggcgaacctcacgagctagcaagaaagtccacaattttgggaaaagatccaactcgatcaaacgcaatccaaacgcacccgtggtcagaaggggctggctttacaaacaggacagcacgggcatgaaactatggaagaagagatggtttgtcttgtcggacctctgtctgttttattatagggacgagaaagaggagggcattctaggatcaatccttcttccgtcatttcagattgctcttctgacctccgaagatcatattaaccgtaaatatgccttcaaagccgcacaccctaacatgcgtacgtactacttctgtacagacacaggaaaggaaatggaactttggatgaaagccatgctggacgctgcactcgtccagactgagccggtgaaacgcatcacattcaatttccgagtcgacaagatcacctcggaaaatgctccgactaaagagacaaataatatccccaatcaccgggtgcttattaagccggagatccagaacaaccagaaaaataaggagatgtccaaaattgaagagaagaaggcgcttgaggccgagaagtatgggttccaaaaagacgggcaggatagacccctgacaaaaatcaatagcgtcaaacttaactcgttaccgtcggagtacgagagcggcagtgcctgtcccgctcagacagtgcattataggccgattaatctgagctcctcagaaaacaaaatcgtcaacgtgagcctggcagatctgcgtggaggcaatagacccaatactgggcctctctataccgaagctgaccgtgtcatccaaagaaccaactctatgcagcagctagagcagtggataaagatccagaaggggagagggcatgaggaagagacacgtggagtaatttcttaccaaaccctgccccgtaacatgcctagccaccgggctcaaatcatggctaggtacccagaggggtatcgcacgctccctcggaacagcaagaccaggccggaatcgatctgctccgtgaccccaagtacacacgataaaaccctggggccaggagcagaggaaaagcgtcggagcatgcgcgatgacaccatgtggcagttatacgaatggcagcaacggcagttctataataagcagtccaccctcccgcgtcactctacattgagtagtcccaaaacaatggtgaatattagcgatcagactatgcattctattccgacgtccccatctcatggcagcattgccgcttaccagggctactcaccccaacggacttataggtccgaggttagctctccaattcagagaggcgacgtgaccatcgaccgtagacatcgcgctcatcatcctaagcatgtgtacgttcctgatcggaggtctgttccagctggcctcactttgcagtccgtgagtcctcagtcactgcagggcaagacaccagaggaacttacgttgctgctgatcaaactccgtaggcagcaggccgaactctcctccatacgtgaacataccctggcccagttgatgcagctgaagctggaggcacattctcccaagaacgaaattctgagtcatcacctgcagagaaacacgatatacttagaccaccaaatgaaagagaacgaaccaataatcaccatggttcataccatgattgagaattccgcattgagaccccagctctaccagcagttcctccggcaaaagtctaaaattagcctctactgcctttcacaggacgaaggacggggaactttatataagtaccgccctgaagaagtggacatagacgctaaactttcacggctatgcgaacaagataaggtggtacacgccctcgaggagaagctgcagcagttgcacaaggaaaaatacactttggaacaagcgcttctctcggcatctcaagaaatcgaaatgcatgcagataatcccgctgcgatccagaccgtggtgctgcagagggacgatctgcagaacggcctcctgtccacatgtcgggagctctcccgagccaccgcagagctggagcgcgcatggagagaatacgataagctcgagtatgacgttactgtcaccagaaaccagatgcaggaacagcttgatcacctgggggaagtacaaaccgagagcgccggtattcagcgagctcagatacagaaggagctgtggagaatacaggatgtgatggagggtctgtccaagcataagcagcaacgcggaacgacggagattggtatgatcggctccaaacccttctcgactgtaaaatacaagaacgaagaggaggaagttgtgccccctcggcctccactaccgcgaagctatgatttcaccgaacagcccccaatcatcccacctctgcctagcgattcttcaagtttgctatgctatagccgaggtcccgtgcacctgcccgaggagaagaagatgtaccaggtgcaggggtaccctcgcaacggaagtcattgcggtccagactataggctgtacaaatccgagcctgaactaacaactgtggccgaagtagacgagagtaatggcgaggaaaagtccgagcccgtcagcgagatcgagaccagcgtggtcaagggtagccactttccagtgggggtcgtcccaccacgcgctaaatctcctacacccgaaagcagcaccattgcctcttacgtcaccttgaggaagactaaaaagatgatggatctgcggacagaacggcctcgttccgccgtggagcagctctgcttagctgagagcacacgccctagaatgaccgtcgaagaacagatggagagaatccgacggcatcagcaagcctgtctccgtgaaaaaaaaaaaggcttaaatgtgattggagcctccgatcagagcccactgcagagcccctccaacctgagagataacccatttcgcactacccagacccgtagaagggacgacaaggagctcgacaccgctattcgcgaaaatgatgtgaagcctgaccacgagaccccagccaccgagattgttcaattgaaggagactgaaccgcagaacgtggacttctcaaaagaactgaagaagaccgagaatatctcatacgagatgcttttcgagccagaacctaacggcgtcaacagcgtcgaaatgatggacaaggagcggaacaaggataagatgcccgaggatgtcactttttcccctcaggatgaaactcagaccgctaatcacaagcccgaggaacatccagaagagaacacaaagaactcggtcgacgaacaggaagaaaccgtgatctcctacgagtccaccccggaggtgagcagagggaaccagactatggccgtgaaatcgttgtctccctcccccgaaagtagtgcctccccagtgccttccacccagcctcaactaactgaaggctcccacttcatgtgcgtatag

SEQ ID NO: 58274 - DNA, 231 bp, Artificial Sequence
  Description of Artificial Sequence: Synthetic coding sequence
atggccgcagacttgaacctggagtggatttccctgccaagaagctggacatacggcattacaaggggaggacgtgttttcttcatcaacgaggaggcgaagtctacaacttggctccaccccgtcacgggcgaagccgttgtgactggccaccgcagacagtcaaccgatctgcccacggggtgggaggaagcttataccttcgagggcgcacggtactacatcaattag

SEQ ID NO: 58275 - DNA, 2382 bp, Artificial Sequence
  Description of Artificial Sequence: Synthetic coding sequence
atgcctctgcctggcggtctttggtggctcctgtgctgccgcagggggttcactctgctccatcgagattacggtgacggagaactctccggcgacggagatgaagacgaagatgaggaaacattcgagctccgcaccccctccccagctggaggcggaagaggtccccttgaagtgactctgacgcagccagtcagatccggccctgtatctaaccggctgcagtcttgggaggagacttggtctctgattccagaaaagggactccctgaggacgatccagacatcgtcgttaaggggtggctgtaccgggagccacgcggaggtggtgctcgtccctggttgccaccgcgacgagcttggttcgtacttaccagagacagcttagatcagttctcatcatcaggcaagggggctcgccgtctcgggagcctggtgcttacttctctgtgttcagtaaccgggccagaaagacgcaggaaagagactggactttggtctgtcaccgtctccggtaggaagcactctgtacggctctgctccccgaggcaggccgaggcagaacgatggggcgtggctctccgagaagtcattgcttccaaagctcccttagagacaccaacccagctgctcctcagggatattcaggagtcctgtggcgatcccgaagctgtggctctgatatacctccgcaatccaattctgaggcataccagtggggctctttatgccccactgctgccattgccttatggagtgagcgcccctgggccaggatatgctcccctgcgggaggaggctgtgaggctgtttctggcattacaggccctggaaggggcaaggaggcctggccctcttatgcagggcgttctgcaaacttgtagggacctgcccgcactgcgggacgagctgtttttacaactggcaaaacaaacatctggcccagccggtccacccggtttgcccgcaacacaggacccagctgcgttgcgctattggcagctcctcacatgcatgtcttgcacgttccgcccagggggtgccgtgcggggacatctactaggccacctggaacgcacggaacaggcattgcccgatagcgaattggcagaatacgctcgctttatccgcaaggcactgggcaggacaagggggagggagctggtgccttccctggccgaaatcagcgcgctgtctcagcgtcaagaacttctctgcacagtccactgcccaggcgctggagcgtgcgccgtagccattgacagccacaccaccgcaggtgaagtggccagagaactggtcgggcgactggggcttgcaaggtctagaaacgcgttcgccctctacgagcagagaggagcccaggaaagagctctcgcaggcggtactctcgtcgcggatgtcttgaccagattcgagaatcttgccgcagaggaagcgggactcgaagactcacctgacagcgggtggagattatgtctgcgccttcatggtcctcttcacccagaaggtctgtccccagacggacacgagctccctttcctcttcgaacaggctcacgcactgctgctaaggggtcggccacccccacccgatgacacactccgagcccttgccgcactcagacttcagtctctacagcgggatttcagtcccagagtgccccttcccagattggatagactgcttccgccacccgcaccacccagagaggaccccccaagaccaactcctcggccaccacccagcgctgcactgttagctggagcactctggtcccccggacttgctaagcggagagccgaacgggctcggaggggcggtgcgggacggaccgctggctcaatagctagggaagggggtggtggagccggaactgcggctgcagtcctggggggttggaagcgtttacggggtatgggtcgcgcagaagccatggctgcttacctggcactcgccgctcagtgccccggatttggtgcagcccgatatgacgtgctcgagctttccaccgagcccggtcgcggtgcccctcaaaagctctgcctcggcctgggtgcaaaggctatgtccctctctcggccaggcgagactgagccaatacattcagtgtcatatggccacgtggctgcttgccagttgatggggccacatacactcgcactgcgggtgggcgagtcacagctgctgcttcaatctccacaggtcgaagagatcatgcagctagtcaatgcttatttagctaacccttccccggagcggccttgtagctcatcatcacccccttgccaagatctacccgacacatcaccaccgagtcagcgacctggtctcgacgagccgcagggtcagagtggttgcctgggacagctccaggattag

SEQ ID NO: 58276 - DNA, 450 bp, Artificial Sequence
  Description of Artificial Sequence: Synthetic coding sequence
atgagatataacgagaaagagctgcaggccttgagccgccagccagcagaaatggccgcagaactgggcatgcgcggacctaaaaaaggaagtgtcctcaagcgccgattagtcaagctggtagtgaatttcctcttctacttcagaactgacgaagccgaaccagtcggggctttattgcttgaaagatgtagggtagtgagagaggagcctggtactttttcaatcagtttcatcgaggatcctgagcgtaaatatcattttgagtgctcctccgaagagcagtgtcaggagtggatggaagccctgcgacgggcatcttacgagttcatgagacgctccctgatattttacagaaatgaaattcgaaaagttactggcaaagaccccctggagcaatttggaattagtgaagaagctcgcttccagctgagcggactgcaggcatag

SEQ ID NO: 58277 - DNA, 3351 bp, Artificial Sequence
  Description of Artificial Sequence: Synthetic coding sequence
atggctgctgacctcaacctggagtggatatccttgcctcggagctggacctacggtataacgcggggtggcagagtgttttttatcaacgaagaagccaagtcaaccacctggctgcaccccgttaccggagaggctgtcgttaccgggcaccgacggcagtcaactgacctgcctactggatgggaagaggcgtatacctttgagggcgcaagatattatattaaccataacgagaggaaggttacatgtaagcatccggtgaccggccagccttctcaggacaattgtatatttgtggtgaacgagcagaccgttgctacaatgacttccgaagagaaaaaggaaaggcccatatctatgatcaatgaggcttccaattataatgtcaccagcgactatgccgtgcaccccatgtctccagtcggcaggacttctcgggcttctaagaaggtgcataacttcggaaagcgatccaattcaatcaagagaaatccgaatgcccctgtagttcgtagaggatggctttataaacaggattctactggcatgaagctgtggaaaaaacggtggttcgtgctgagtgacctatgtctattctattatagggatgagaaggaggaaggcatcctgggtagtatactactgccttcgtttcaaatcgcgctgctgacctctgaggatcatattaatcggaagtacgcttttaaggcagcgcaccccaatatgcgaacctattatttctgtacagacaccggtaaggagatggagctgtggatgaaggccatgctggatgcagccctagtgcagaccgaacccgtgaagagagtggataaaataaccagcgagaatgcccctacaaaggagaccaacaatattcccaaccaccgtgtgttaatcaagcccgaaattcaaaacaatcaaaaaaataaggaaatgtctaagattgaagagaagaaagcactcgaggctgaaaaatatgggtttcaaaaggatgggcaggacaggcctttgactaaaataaacagcgtgaagcttaattcattaccatcggagtatgagtctgggtccgcttgccctgctcagacggtccactatcgacctatcaacctgtccagcagcgaaaataaaattgtgaacgtctccctggctgacttacgcggaggtaaccgtcccaacaccggacccctatataccgaggccgacagagtgatccagcgtacgaatagcatgcagcagttggagcagtggataaagattcagaagggaaggggacatgaggaggagactcgcggagttatcagttatcaaacattaccaagaaatatgccctcgcacagagcacaaattatggcccgttatccagaggggtacagaacactccccaggaactctaagaccaggcctgaaagcatctgcagcgtgacaccctccacacatgacaagactttgggtcctggagcagaagaaaagcggaggtcaatgcgcgacgacactatgtggcaactctacgagtggcagcagcgccagttctataacaagcagagtaccctgccgcgtcattcgaccctttcatcacctaagaccatggtgaatatctctgatcagacaatgcacagcatccccaccagccctagccacggcagcatagctgcctatcagggatatagcccccagcgcacgtatcgcagcgaagtgagcagtcccattcagcgcggtgacgtgacgatagatcggaggcatagggctcatcacccgaagcacgtatacgtgcctgaccgtcggagtgtgccagccggattgacgctgcaaagcgtgtcaccccagtctctccaggggaaaaccctatcacaggacgaggggagaggaacgctctacaaatatagaccagaagaggttgacatcgacgcgaagctgtcaaggttgtgcgaacaagacaaggtggtgcatgctctcgaagagaagcttcagcagctacacaaggagaagtacacactcgaacaagccctcttgtccgcctcccaggaaatcgagatgcatgccgataaccctgcagcaattcaaacagtggtgctacagagggacgacttacagaacggtctgctgtcaacatgccgcgaactttccagagcaaccgccgagctcgagagagcctggagggagtacgataagctcgagtacgacgtaacagtgactaggaaccagatgcaggaacaactagatcacctaggcgaggtgcagactgaatctgctgggatacagcgggcacagattcagaaagagctctggcggattcaggacgtgatggagggccttagcaaacacaagcaacaacgcggtaccaccgagatcgggatgattgggagtaagccgttttccaccgtcaagtacaagaatgaaggcccagattaccgcctctacaaatcagagccagagctaacaactgttgctgaggttgacgagtccaacggggaggagaagtccgaacccgtaagtgagatcgagacatccgttgtaaaagggtctcatttccccgttggagttgtgccaccacgagccaaatcgcccaccccagagagcagcacaatcgcttcgtacgtgacgctgcgcaaaactaaaaagatgatggacctccgcaccgaaaggcctcggagtgccgtcgagcagctttgtctggctgagtcaaccaggccccgtatgactgtcgaggagcagatggagcgcatccgccgacaccagcaggcctgcttgagagagaaaaagaaaggcctgaacgttataggggctagtgatcagtctcctttacagtctccatcaaacctccgggacaacccttttcgaaccacacagacaaggagacgtgatgataaagagctggacacagccattcgcgagaatgacgtaaaaccagatcacgagactccagctaccgagatcgtgcagctcaaagaaaccgagccccagaacgtcgacttttctaaggaactgaagaaaaccgagaatatatcctacgagatgctgtttgaacctgagccaaatggcgtcaattccgtggaaatgatggacaaagagcgaaacaaagataagatgccagaggacgttactttctctcctcaggatgagactcagactgccaatcataagccagaggagcatccagaagagaatacgaagaattccgttgacgagcaggaggagactgtcatttcgtacgaatccactcccgaggtgtctcggggaaaccagactatggcagtcaagtccctcagcccgagccccgaatccagcgcctccccggtgcctagcacccagccccagctgaccgaaggttcccacttcatgtgtgtgtag

SEQ ID NO: 58278 - DNA, 1953 bp, Artificial Sequence
  Description of Artificial Sequence: Synthetic coding sequence
atggctgccgacctgaacttggaatggatttctctgccaagatcatggacatacgggatcacaagagggggtcgggtatttttcattaatgaggaggctaagtccacgacctggctccacccagtaaccggagaggctgtggtgactggtcataggaggcagtcaaccgacttgccaacgggatgggaagaggcgtatactttcgagggcgctcgctactacatcaatcataatgagcggaaggttacatgtaaacatccagtgacggggcagccttcccaggacaactgcattttcgtggtcaacgagcagaccgtggcgaccatgaccagcgaagaaaagaaggagcggccaatctccatgattaatgaggcttcaaactacaatgttacttcggattacgctgtgcaccctatgtccccagtgggtaggacctcgcgcgcttctaagaaggtgcacaacttcggtaagcggtctaatagcataaagagaaaccccaacgctccggtagttagaaggggatggctctataagcaggactctaccgggatgaaactgtggaaaaaaaggtggtttgtcctgagtgatctgtgtctgttctactatcgcgatgagaaggaagaaggaattctgggctcaattcttctgcctagcttccagattgccctcctgaccagcgaagaccacataaatagaaaatatgctttcaaggccgcacaccccaacatgcgcacgtactatttctgtacagacactgggaaagagatggaactgtggatgaaagctatgctggacgccgctctggttcagacagaaccagtcaaacgcgtggataaaattaccagtgagaatgcccctacaaaggagacaaacaatattcccaaccaccgcgttctcatcaagcctgagatccagaataaccaaaagaataaggagatgtctaaaattgaagaaaaaaaggccctcgaagccgagaaatatggcttccaaaaggacggacaggacaggccattaactaagattaatagcgtgaaactgaatagcctcccctccgaatacgaaagtggaagtgcatgccctgcacagaccgtccactatcggcctattaacctctcttcatctgaaaataaaatagtgaacgtgtccctcgctgacttacggggaggaaaccgccctaatactgggcctttatacacggaagcagatcgtgtgatccagaggaccaattccatgcagcaactggaacagtggattaagattcagaaagggaggggacacgaagaggagactcgcggtgttattagctaccagaccctgccaaggaacatgccttcacacagagctcagatcatggcacgttaccctgaagggtatcggaccctgccccgtaattcgaaaactcggccagagagtatctgttccgttaccccgtcaacccacgacaaaacactaggcccaggggcagaagagaagcgccgtagtatgagggacgatacaatgtggcaactgtacgagtggcaacagcggcagttttataataagcaatcaaccctgcctcgacacagtactctttcatcccctaagaccatggtgaatattagcgaccagactatgcacagtattcccaccagtcccagccacggatctattgccgcttaccaaggatatagtcctcagcgtacataccgctcggaggtttcctcacccattcagcgaggcgacgtcaccatcgacagacgccatagggcccaccatcctaaacacgtgtatgttcccgatcggagaagcgtcccagccggactcactttgcagtccgtcagccctcagagcttgcaggggaagacctgggggcgagagaaggtggctacggccactggcgctgctgaggcagtcgctagcgacacccatctcccaagaactggaagctcttctccatctcttttgtgcgtgtag

SEQ ID NO: 58279 - DNA, 3540 bp, Artificial Sequence
  Description of Artificial Sequence: Synthetic coding sequence
atggctgctgatctcaatctcgaatggattagtctaccgaggtcttggacctatggcatcacacgaggaggcagggtgttctttatcaatgaggaggctaaatctacaacctggctccacccagttacgggtgaagccgtggtgactggacacaggagacaatcaacggatctcccaaccgggtgggaggaagcttacacattcgaaggagcgcgatattatattaaccacaacgagcggaaagtaacctgcaagcaccccgtgactggccagcccagccaggacaattgcatcttcgtggtcaacgagcagactgttgcaactatgacaagcgaggaaaaaaaggagagacctatctccatgatcaatgaagcctccaattataacgtgacatctgactacgccgtgcacccaatgagtcccgtagggcgaacgtctagggcctctaagaaagtgcataactttggcaagagatcaaacagtatcaagcgtaacccgaacgcccctgtcgtgcgcagaggttggctgtacaaacaggattcaaccggcatgaagctgtggaagaagaggtggttcgttttgtctgacctctgccttttctactaccgggacgaaaaggaagagggcatcttgggcagtatactactcccttcgttccagatcgctcttttgacttctgaagaccatatcaaccggaaatacgctttcaaggctgctcaccccaacatgcgtacttattatttctgtaccgatacaggtaaggagatggagctgtggatgaaagccatgctggatgccgctttagtccagactgagcccgtgaagcgggtagataagatcacatccgagaacgcacccaccaaggagacaaataacattcccaatcatagagtgttaatcaagcccgagatacaaaacaaccaaaagaacaaagaaatgagcaagattgaggagaaaaaagccctagaagcagaaaaatatggtttccagaaagacggacaggacaggcccctgaccaagataaactcggttaagctcaattccctccctagtgagtacgaaagcggatccgcctgccctgctcagaccgtgcactaccgccctataaacttgtcgagtagcgaaaacaaaatcgtcaacgtgtctctcgctgatttgcgagggggaaacagaccaaataccggacccctttataccgaagccgatcgggttatccagcgtacaaattccatgcagcagctcgagcagtggatcaaaattcagaagggacggggtcacgaagaagagacccggggagtgatcagttaccagacactcccccgtaatatgccctcccacagagcccagattatggccagataccctgagggctatcggacgctgcctcggaatagcaagaccaggccggaaagtatctgtagcgttacacctagcacccatgacaaaacactcgggccaggagccgaggaaaagagacgaagcatgagggacgacacaatgtggcagctctacgaatggcagcaaaggcagttttacaacaagcagtcgaccttgccgaggcacagcactctgtcctcacctaaaaccatggtaaacatcagtgatcagaccatgcattcgattcccacctcgccctcccatggttccatcgcggcatatcagggttattcaccgcagcgtacgtacaggtccgaggtctcaagccctattcagcgcggtgatgtgactatagaccgacgacatcgtgcacaccatccgaaacatgtctacgtgccggaccgacgcagcgtgcctgccggtctcaccctccagtcagtgagtccacagtcgcttcaggggaagacactctcccaggacgaggggaggggcaccctttacaagtaccgacccgaagaggtggatattgatgccaagctttcccgactgtgcgaacaagataaagtcgttcacgccctcgaagagaaactgcaacagctccacaaggagaaatacaccctagagcaggccctactctccgcttcacaggagattgaaatgcacgcagacaaccccgcagctattcaaaccgtggtgctgcagagggacgacctgcagaacggtctgctctccacgtgtagagaactatcacgggcaactgccgaactcgagcgagcatggcgtgagtatgataagctggagtatgatgtgaccgtcacacgcaaccagatgcaggaacagctggatcatctgggtgaagtccaaacggagtctgcaggcatccagcgggctcagatccagaaggagctttggcggattcaggacgtgatggagggcctgtcaaagcataaacagcagcgaggcacaacagagattggtatgataggttctaagcccttctccactgtgaagtacaaaaacgaggaggaggaagtcgttcctcccagaccacccttaccaaggtcgtatgactttacggaacagcctcccatcatcccccctctgcccagtgatagttctagcctactctgttattcccgaggacctgtgcatttgcccgaggagaaaaagatgtatcaggtacaagggtaccccaggaacggctctcactgcggcccagactatcgcctgtacaaatcagagccagagctcactaccgttgccgaagtggatgaaagtaatggtgaggaaaagtcagagccagtctctgagattgaaacgtctgtggtgaaaggttcgcacttccctgtcggtgtagttccacctcgcgctaagagcccaacccccgaatcatccacaatcgcttcttacgttacactgagaaagacaaagaagatgatggacctgcgcactgagaggccgcgaagcgctgtagagcagttatgtcttgccgaatccacacgtccaaggatgactgtggaagagcagatggagcggattcgacgtcaccagcaggcatgcctccgtgagaagaaaaaaggtctgaatgtaattggggcttccgaccagtctcccctgcaatccccttctaatctgcgcgataacccattcaggacaactcagacccgcagaagagatgataaggaactggatactgccataagagaaaacgacgtaaagcccgaccatgagacacctgcaaccgagattgtccaactgaaagaaactgaaccccagaatgtagacttttccaaagagttaaagaagacggaaaatatctcttacgaaatgctgtttgagcctgaacctaacggcgtcaactccgtcgaaatgatggacaaagagcgtaacaaggacaaaatgccagaggatgtcaccttctccccccaggatgagacacaaactgcaaaccacaaacctgaggaacatcccgaggagaatactaagaacagtgtggatgaacaggaggaaactgtaatttcttacgaaagtactccagaggtgtctcgtggtaatcagactatggccgtgaagagcctgtctccctctcccgaaagctctgcatcacctgtgccctctacgcagccacagctcacagaaggctcacactttatgtgcgtttag

SEQ ID NO: 58280 - DNA, 3525 bp, Artificial Sequence
  Description of Artificial Sequence: Synthetic coding sequence
atggccgcagatcttaatctggagtggatatcattgcctaggtcatggacctacggaataactaggggcggaagagtgttttttattaacgaggaagcaaagtccactacctggctgcacccggtcactggggaggctgttgtgacagggcaccggaggcagagcacagatctgcccacagggtgggaggaggcctatacttttgagggcgctagatactacattaatcacaacgagcggaaagttacttgcaagcaccccgttaccgggcaaccatctcaggataattgcatctttgttgtgaatgaacaaacagtcgcaacaatgacaagcgaggaaaagaaggaacgacccatctccatgattaacgaggcaagcaactataacgtgacatcagattacgccgtacacccgatgagtcccgtgggacgcacgtcccgggcaagcaaaaaagtgcataatttcggcaagagaagcaactcaattaaacgaaaccccaatgcccctgtcgttcggaggggatggctgtataagcaggacagcacaggcatgaaactgtggaaaaagcgctggtttgtgttatccgatttgtgtcttttttactacagagacgagaaagaggagggtatattagggagcatcctgctgccgtcttttcagatagccctgctcaccagtgaggatcacataaataggaagtacgcctttaaggccgcacatccgaacatgcgtacctactatttctgtacggatacgggcaaggagatggagttgtggatgaaggcaatgctggacgctgcgttggtgcagactgagccagtgaagagagtcgacaagattaccagtgagaacgcacctacaaaagaaaccaataatattccgaaccaccgagtgctaatcaaaccagaaatccaaaataaccagaagaataaggagatgagtaaaatcgaggagaaaaaggccctggaggccgagaagtatggattccagaaggatggtcaggaccgtcccctgacaaagattaacagcgtgaagctgaattcattgcccagtgagtacgaaagtggtagcgcatgcccggctcagaccgttcactatcgtcctattaatctgtcatcctctgaaaataaaatcgttaacgtcagtttagctgacttaagaggtgggaacagaccgaacacaggcccactgtacaccgaggcggacagggtcatccagagaacaaattctatgcagcagttagagcagtggataaaaatccagaaagggcgaggacatgaagaggagactcggggtgtcatctcctaccagaccttgcctcggaacatgccctcccatcgtgcccaaattatggccagataccctgagggataccggacactgcccaggaattcgaagacaagaccggagtccatctgtagcgtgactcctagtacgcatgacaagacattgggaccaggagccgaggagaagcggcgaagtatgagagacgatacaatgtggcagttatatgaatggcagcaacgtcaattttacaacaagcagtcaacattgcctagacattctaccctgagctcacccaaaaccatggtgaacatcagcgaccagaccatgcactcaattccaacgtcaccgtcccatgggagtattgccgcataccagggctacagcccccagaggacttataggagtgaggtttcttctcctatacaacggggagatgtcacaattgaccgacggcatagggctcaccatcccaagcatgtctacgtgcctgataggcggagcgtgccagctggtttgaccctgcaaagcgtcagcccccagtctctgcaaggcaagacgcctgaagagctgacattgttattaattaaactgaggcgccaacaggcagaactaagctccatccgcgaacataccctcgcacagctgatgcagctgaagcttgaggcacattcccccaagaacgagatcctgtctcaccatctgcaacggaacacaatatacctggaccaccagctgagtcaggacgagggacggggtacgctgtataaatatcggcctgaagaggtggatatcgatgctaagcttagcaggttatgtgagcaggacaaagtggtacatgcgcttgaggagaaactgcagcaattacacaaagaaaagtacacgctagagcaggctctcctgtctgcgagtcaggagattgaaatgcacgccgataaccccgcagctatccagacagttgtactgcagagagatgacctgcaaaacggcctcctctcgacatgccgcgaactatccagagccacagcggagcttgaacgggcatggagggagtacgacaaactggagtacgacgtcaccgtcacccgcaatcagatgcaggagcaactggaccacctgggggaagttcaaactgagagtgccggaatccagagagcccagattcagaaagagctttggcggatccaggacgtgatggaaggcctgtcaaagcacaagcagcagcggggaactactgaaatcggaatgatcggctcgaagccgttctccaccgtcaaatacaaaaatgagggaccagactacagactgtacaagtcagagcctgaattgaccaccgtggccgaggtcgatgaaagtaacggggaagagaagtctgaacctgttagcgaaatcgagacaagtgtggtgaaggggagccactttcccgtgggggtggtgcccccacgggctaaaagcccaactccagagtcctctaccatagcctcatatgtgaccttgagaaagacaaaaaagatgatggacttgaggaccgagcgcccacggtcagccgtcgagcagctgtgcttggccgaatcaacaaggccaaggatgacggtcgaggaacagatggaaaggatcaggagacaccagcaggcatgcctccgtgaaaagaagaagggcctgaatgtgataggggctagtgatcaatctcctctgcagagtcctagtaatttacgtgataatccctttcgaaccacgcagacacgacggagagatgacaaggagctagacaccgcaatccgagagaacgacgtcaaacctgaccacgaaacccctgccaccgagattgttcagcttaaggagactgagccgcagaacgtggactttagtaaggaattaaaaaaaaccgagaatatctcctacgaaatgctgtttgagccagaacccaacggagtcaacagtgtcgaaatgatggacaaggagaggaataaagataaaatgccggaggacgtgacattctccccacaggatgaaacacagacagcgaaccataaaccagaggagcacccagaggaaaacacgaaaaactcagtggacgagcaagaggaaacggtcatttcatatgaatctactcccgaagtgtccaggggtaaccagaccatggctgtgaaatctcttagtccctccccagaatcctccgcctcccctgtgccatccactcagccccagctcaccgagggcagccacttcatgtgcgtttag

SEQ ID NO: 58281 - DNA, 3183 bp, Artificial Sequence
  Description of Artificial Sequence: Synthetic coding sequence
atggcggctgacctgaaccttgagtggatctctctgccaagatcttggacctacggcatcacgagaggtggacgcgtcttcttcatcaacgaagaggccaaaagtacaacatggctccaccctgtgaccggtgaggcagtcgttacgggccatagaaggcagtcaacggacctgcctaccgggtgggaggaagcctacacatttgaaggggcacgctactacatcaatcacaatgagcggaaggttacatgcaagcacccagtcaccggtcagcccagtcaagataactgcatctttgtggtgaatgagcagactgttgccacaatgactagcgaggagaagaaggaacgtccgataagcatgattaacgaggcgtctaattacaatgtcacgagtgactatgccgttcaccctatgagccctgttggcaggacctctcgggcaagtaaaaaagtccataactttggcaaacgcagcaacagcatcaagagaaaccctaatgctcctgtggtgcggcgtggctggctttataagcaggactccactgggatgaagttgtggaagaagcgctggttcgtgctcagcgacttgtgtcttttctattaccgggacgagaaggaggaaggcatactgggtagcattctgctgcctagctttcagatagcgcttttgacatctgaggatcacattaatcggaaatacgcatttaaggctgcccaccccaatatgaggacgtactacttttgtacagacactggtaaagaaatggagttatggatgaaagctatgctagacgcagcactggtacaaaccgaacccgttaagcgcgtggataaaattacatccgagaatgcaccaaccaaggaaaccaacaacattcctaaccatcgcgtactaattaaacctgaaatccaaaacaatcagaagaataaggagatgtctaaaatcgaagaaaaaaaagccctggaggccgagaaatatggcttccagaaagacggacaggaccgtccactcaccaagatcaattccgtgaaacttaactctctgccaagcgaatacgaatcaggctcagcgtgccccgctcaaaccgttcactatcggccaattaacctttcgtcttcagaaaataagattgtaaacgtgtccctggccgacctacgcggaggaaatcgtccgaacacaggcccactatacacggaagctgatcgcgtcatccaacgaaccaactccatgcagcagctcgagcaatggattaaaatccagaaaggcagagggcatgaagaggagacccggggagtaatctcataccaaactctgccaagaaatatgccgtcccatagggcccagataatggcgagatacccagaagggtaccgcaccctgccaagaaattctaagactaggccagagagcatttgcagcgtgacaccttccactcatgacaagacgctgggacccggagcagaagaaaagcgacgcagcatgagagatgatactatgtggcagctctatgaatggcagcaaaggcagttctacaataaacagtctaccctgcccagacatagcacgcttagcagtccgaaaactatggttaatatctcggaccagacaatgcacagcatacccacatccccatcacacggctccatagccgcataccaaggctactctccccagaggacatacagatccgaggtctcatcccccattcaacggggagacgtgactatagatcggaggcaccgagcccaccatccaaagcatgtgtatgtgcccgatagacggtctgtgccagctggactgactttgcagagtgtaagccctcaatcactccaaggcaagactttgtcccaggacgagggacgaggaaccctttataagtacaggccagaagaggtggatatagatgccaaacttagtcgattgtgtgaacaggacaaggtcgtgcacgccctcgaggagaagctgcagcaactgcacaaggagaagtacactctcgaacaggccttattgtcggctagccaggagatcgagatgcatgccgacaaccccgcagccattcagacagtggtgttgcagagggacgatctccagaatggactgctcagcacctgtagggaactgtctagagctacagccgagctggagcgcgcatggcgagagtacgacaaacttgagtacgacgtcaccgtgactaggaatcagatgcaggaacagctggaccatttaggagaggtgcaaactgaaagcgctggcattcagcgggcacaaatccagaaggaactgtggcgcatacaagatgtcatggagggtctcagcaagcataagcagcagagagggacgaccgagattggaagtcatttccccgtgggagtggttccaccgagagcaaagagtcccacacccgaatcttccactatagctagctacgtgaccctaaggaaaacaaaaaagatgatggatcttcgcacagagaggcccaggagtgccgtggaacagttgtgccttgcagaatcaacccgacctcgaatgacagtggaagagcaaatggaacggattagaagacaccaacaggcctgtctccgggagaagaagaaggggctgaatgtaatcggcgcttcagaccaatcaccgctgcagtccccttccaaccttagggacaaccccttccgcaccactcagactcggaggcgagatgataaggagctcgacacggcaattagagaaaacgacgtgaagcccgatcacgaaacaccggctaccgaaattgtacagctgaaggaaaccgagccccagaatgtggacttttcaaaggaactgaaaaaaactgagaatattagctatgagatgttattcgaacccgaacctaacggcgtgaatagcgtagagatgatggacaaagagcgcaacaaggataagatgccagaggatgtcaccttttccccacaagatgagacccagactgccaatcataagcccgaggagcacccggaggagaacaccaagaattccgtggatgaacaagaagaaacagtaatctcctatgagagcacgcccgaagtatccagagggaaccagacaatggctgtgaagtctctgtcaccctcgccagagagtagtgcctcccccgtgcctagcactcagccccagctgaccgaaggcagccacttcatgtgcgtctag

SEQ ID NO: 58282 - DNA, 963 bp, Artificial Sequence
  Description of Artificial Sequence: Synthetic coding sequence
atggccgctgacttaaatctcgaatggatctctttgccaaggtcttggacctacggcattacaaggggaggacgggtcttcttcataaacgaggaagccaagagtaccacttggcttcaccctgtgaccggagaggcagtggtcacagggcatcgtcgacaatctacggatctccccacaggttgggaagaagcctatacctttgagggtgcaaggtattacattaaccataatgagcgcaaggttacttgtaagcatcctgttactggtcagccatctcaggacaattgtatattcgtggtgaatgagcagacagtggcaacaatgacttctgaggagaagaaggaacgccctatttccatgatcaacgaagcctctaactacaacgtgacctccgattacgcggtacatccaatgagccccgtagggaggaccagccgggcatcaaagaaggttcataacttcggaaaaagatcaaattccatcaagaggaaccctaacgcacctgttgttaggagagggtggctctataagcaggattcaaccgggatgaaattgtggaagaaaagatggtttgttttgtccgacctatgcttgttctactacagggacgagaaggaagaaggtatactggggtcgatcttactccccagctttcagatcgccttgctgacttctgaagatcatataaaccgcaagtacgctttcaaagcagcgcatcccaacatgagaacctattacttttgtactgatactggcaaagaaatggaactgtggatgaaagctatgctggacgccgcattggtccagacagagcctgtcaaaagagtggataagatcacttccgagaatgcacccactaaagaaaccaataatattccgaatcatcgagtcctgataaaaccggaaattcagaacaatcagaaaaataaggagaaaaaaaagaagaagaagaaaaagtag

SEQ ID NO: 58283 - DNA, 3318 bp, Artificial Sequence
  Description of Artificial Sequence: Synthetic coding sequence
atgacgtctgaggagaagaaggagaggcccatatccatgatcaatgaagccagcaactataatgtgacatctgattacgcggtgcacccgatgagtcctgtaggacgtacaagccgggcatctaaaaaggttcataacttcggcaaacgctcaaatagcatcaagcgcaatcccaatgcacccgtcgtccggaggggctggctctacaagcaggactccaccggcatgaaactgtggaaaaagcgctggttcgtgctctctgacctgtgccttttctactatagggatgaaaaggaagaaggaatcttggggtctatactcttgccctcctttcagatagcactgttgacatctgaggaccatatcaataggaaatatgcgttcaaagccgcacaccccaacatgcgtacctactacttttgcacagatactggcaaggagatggagttgtggatgaaagcaatgctggacgcggcactggtacaaaccgaacccgtgaagagggtcgataaaatcacatcagaaaacgccccaacgaaggagaccaataatataccaaatcatagggtgttgattaagcctgagatacagaataaccagaaaaataaggaaatgtctaaaatcgaggagaagaaggcactggaagccgagaaatatggcttccaaaaggacggtcaggacagacctctgactaagatcaacagcgtcaagttaaattcgctcccgagcgaatacgaatccggctcagcgtgtcccgctcagactgtacattaccgacctattaatttaagctcttccgagaacaagatcgtgaacgtgtcattagccgacttgagaggaggaaacagaccaaacactggacccctctacactgaggctgaccgcgtcatacagagaacgaacagtatgcaacagctcgagcaatggataaaaattcagaaggggcgaggccacgaggaagaaactcgcggagttatcagctaccaaaccctgcctcggaatatgccatcccatcgcgcacagattatggctaggtatccagaaggatatcggacattgcctcggaactctaagacaagacccgaaagtatctgttcggtgacgccatcaacacatgataagactttgggccctggggctgaggagaagaggcggtcaatgcgtgacgacacgatgtggcagctgtacgaatggcagcagcgccagttctataacaaacagagcaccttaccacgacactcgacacttagttcccccaaaactatggtgaatatctcagaccaaaccatgcattctattcctactagtccgtctcatggttccatcgccgcttatcagggttactccccccagcgcacctatcggtcagaggtgagcagtccgattcagagaggggacgttacaattgaccgcaggcaccgcgcacaccatccgaaacatgtgtatgtccccgatagaaggagtgttcctgccggactcacactgcagagtgtatctccccagagtttacagggtaagaccatgaaggagaatgaacccattattaccatggtccacaccatgattgagaatagtgctttgcggcctcagctatatcaacagtttctgaggcaaaagtcaaagatatctctgtattgcctgagccaggatgaaggacgaggcacgctgtacaagtaccgcccagaagaagtggatattgatgctaaattatcgagactgtgtgaacaagacaaagttgtacatgcacttgaggagaagttacagcaacttcataaggaaaagtacactctcgagcaagccctgctctccgcaagccaggagatcgaaatgcatgcagacaaccccgctgccattcagaccgtggtgctgcagagagacgatttgcaaaacgggctcctgtccacatgtcgcgagctctcccgagccacagcagaactagaacgtgcctggcgggagtacgacaagctcgagtatgacgtgaccgtcaccagaaatcagatgcaggaacaactcgaccacttgggtgaagtgcaaaccgagtccgccggaatccagagggctcagatccagaaagagctatggcggattcaggatgtgatggaaggcctctctaagcacaagcagcaacgcggtatgattggtagcaaacccttttccaccgttaaatataaaaacgaagaggaggaagttgtgccacccaggccacccctcccaaggagctatgacttcaccgagcagccacccattataccccctctgccttccgacagtagtagcttgctatgctactcacgcggaccagtgcacctgcccgaggagaaaaagatgtatcaggttcaaggatacccacgaaacggctcacactgcgggccagattaccgcttgtacaagagcgagcctgaacttacaaccgtcgccgaggtggatgagtcaaacggggaggaaaagtcagagcccgtgtccgagatcgagacatctgttgtaaaaggttcgcattttcccgtgggagttgtccctccaagggcaaaatccccgactcccgaaagctccactatcgctagctatgtaacactgagaaagaccaaaaagatgatggatctgagaacagagagaccccgaagcgccgtggaacagctgtgtcttgctgagagtacacgcccaagaatgaccgtggaggagcagatggagagaatccgcagacatcagcaggcctgtctgcgggagaagaagaagggactcaatgtgataggggcaagtgaccagagccccctccagtcgccatctaacttgcgggataacccctttagaacaacccagaccagacggcgagatgacaaagagttggatacagcaataagggagaatgatgtaaaacccgaccacgagacgcctgccacagagattgtgcagctcaaagaaacagaaccacaaaatgtggatttctcaaaagagctgaaaaagacagagaacataagctacgagatgctgttcgagccagaacccaacggagtcaacagcgttgagatgatggacaaagaaaggaataaggataagatgcctgaggatgtcacattctcaccacaagacgaaacccaaacggccaatcacaagccggaggagcatcccgaagagaacacaaaaaattccgtagacgagcaggaggagacagtgatatcctacgaatctacacccgaggtgtcacggggtaaccagaccatggcggtcaaatctctgtctccttcacccgagagctccgcttcaccggttccatctacccagccccagttgacggaggggagccattttatgtgcgtctag

SEQ ID NO: 58284 - DNA, 3525 bp, Artificial Sequence
  Description of Artificial Sequence: Synthetic coding sequence
atggcagccgatctgaacctggagtggattagcctccccagatcttggacctatggaatcacccgtggaggccgtgtgttcttcatcaacgaggaggcgaaaagtaccacatggcttcaccctgtcactggcgaagctgtcgttacaggacatagaaggcaatctactgacctccctaccggctgggaagaggcttatacattcgaaggtgccaggtattacatcaaccacaacgagcggaaagtgacatgcaaacatccagtgaccggtcagccttcacaggacaattgcatctttgtcgtcaacgaacagacagtagccacaatgaccagtgaagagaaaaaggagagacctataagtatgataaatgaagcttcaaactataatgtgacatccgactatgctgtgcacccaatgtctccggtggggcgtacctcaagagcatccaagaaagtgcataactttggcaagcgtagcaactccatcaaacgtaatcccaacgccccagttgtacggagagggtggctatataaacaagactctactggaatgaagctatggaagaagcgttggttcgtgctctctgacctgtgcctcttttactaccgggacgagaaggaggaaggcattttggggagcattctgctgccaagttttcaaattgccctgttaacttccgaagaccacatcaaccgcaagtatgcgttcaaagcggcacaccccaatatgaggacttattacttctgcacagacacgggcaaggaaatggaactttggatgaaggccatgctggatgctgcactggtgcaaacggagcctgtcaaacgagtggacaaaattacaagtgaaaatgcaccaaccaaggagaccaacaacatccctaaccaccgtgttctgattaagccggaaatacagaacaatcagaaaaataaagaaatgagcaagattgaagaaaagaaagccctggaggcggaaaaatacggctttcaaaaggacggacaagaccgcccacttacaaagataaactccgtgaaactcaatagcctgccctccgagtatgaaagcggatctgcatgccctgctcaaacagtgcattaccgacctatcaacctctcatcttccgaaaacaagatcgttaatgtgtcattggccgatctgaggggcggaaacaggcctaatacaggaccactgtacactgaagcggacagagtgatccagcggaccaactcaatgcaacagttagaacagtggattaagatccagaagggacggggacacgaggaagaaactcgcggagtgattagttaccagactctcccccgaaacatgcccagtcaccgcgctcaaatcatggcacggtacccagaaggatacaggacactgccgagaaactccaagacgcgacccgagagcatttgtagcgtaacgccttccacccatgataagaccctgggcccaggagccgaagaaaagcgtagatccatgcgggatgatacaatgtggcagttatacgagtggcaacagagacaattttacaacaaacaatccacacttccaaggcactctactttgtcttccccaaagactatggtgaacattagcgatcaaactatgcactctattccaacatccccctcgcacggtagcattgccgcataccagggctacagtccacaaaggacttacaggtccgaggtgagtagtccaatccagagaggggatgtgacaatagacaggcggcacagagcccatcaccccaaacacgtatacgtgcctgacagaaggtctgtgcccgctggccttacgttacaatctgtaagtccccagtctctccagggtaagactccagaggaactcactctcctcctcataaaactcaggcggcagcaagccgagttatcttcaatccgggaacacaccctggctcagctgatgcagctcaaacttgaagcgcatagccccaagaacgaaatcctctcacaccaccttcaaaggaatactatctacctggatcaccaactgtcgcaggatgaaggcagaggcacgctttataagtatcgccctgaggaggtggacatagacgctaaactgtcaaggctctgcgaacaggacaaagtagtgcacgccctcgaggaaaagctccagcagcttcataaggaaaagtataccttggaacaggcactattgtctgcctcccaggaaatcgagatgcatgctgacaacccagctgcaattcagactgttgtcttgcagcgggatgaccttcaaaacggcttactgagcacttgccgtgaattgtctcgtgctacggctgagctggaaagagcttggcgcgagtacgacaagctcgagtacgacgtcacagtaacacggaatcagatgcaggaacagctggatcacctgggcgaagtgcagaccgagtccgcaggcatccagagagctcaaatccagaaagaattgtggcgtatccaggacgtcatggagggactcagtaaacacaaacagcaacggggaacaaccgaaattgggatgatcggctccaagccatttagcaccgtaaagtataagaacgaaggccctgattatcgcctctacaagtcagagcccgagctcacaacggtagcagaggtggacgagagcaacggtgaggagaaatcagagccggtctctgagattgagacctcagtggtaaagggctcgcacttccccgtgggagtggtgccccctcgtgccaagtctcccacacctgaatcaagcactattgcctcctatgtcacgctgcgcaagacgaaaaagatgatggatctgagaactgaacgcccaagatcagcagttgaacagctgtgtttggccgaaagcacccggcctagaatgactgtggaggagcagatggaacgtattaggaggcaccagcaggcttgcttgcgagagaagaaaaagggcctgaacgtcattggggcttctgatcaatccccattacaaagtcctagtaacctcagggacaatcctttccgcactacacagacccgcagacgcgacgacaaagagctggatacagccatcagagagaatgacgtcaagccggaccatgagactccggctactgagattgttcaattgaaggaaaccgaacctcaaaatgtcgattttagcaaagagcttaaaaagaccgaaaatatttcttatgagatgctttttgaacctgagcccaatggtgtcaactctgttgaaatgatggataaggagcgaaacaaggacaagatgccggaagatgtaaccttttccccccaagacgaaacgcagacagctaaccacaagccagaagagcacccggaggagaatacaaaaaactcagtagacgagcaggaagaaactgtgatcagttacgagtcaacccccgaggtgtctaggggaaaccaaacaatggcagttaaaagcttatcacccagtccagagtccagcgcgagcccggtgccaagcacacagccccagctgacagagggatcacattttatgtgcgtatag

SEQ ID NO: 58285 - DNA, 1194 bp, Artificial Sequence
  Description of Artificial Sequence: Synthetic coding sequence
tatacactagagcaagcattgcttagcgcttcacaggagattgagatgcatgccgataaccctgccgcaatccaaaccgtcgtgttacagcgggacgatttacagaacggattgctgtcaacttgccgcgaactgtctcgtgctacagccgagttagagcgtgcatggcgggaatacgataaacttgaatatgacgtcaccgtgaccagaaaccaaatgcaggaacagttggatcatttgggtgaagtgcagacagaatctgctggtatccagcgcgcacagattcaaaaggaactctggcgcattcaggatgttatggaggggctgagcaagcacaaacagcagcggggaaccacagaaataggatctcattttcccgtaggagtcgttcccccacgtgccaagagccctactcccgaatccagtactattgcttcctatgttacactgaggaagacaaagaagatgatggatctacgcacggagaggcctaggagtgcagtcgaacagctttgcctcgccgaaagcaccaggccacgcatgacagtcgaggagcagatggagcgcatcaggcgacaccaacaggcatgtttgagggagaaaaagaaagggctcaacgtcatcggtgcctccgaccagagtccactgcagagcccaagtaatctgcgagacaatccttttcggactacacagactcgcagacgggatgacaaagaattagacaccgccatccgagaaaacgacgtaaaacctgaccacgaaacacctgccactgaaattgtgcagcttaaggaaaccgagccgcagaatgtcgatttcagcaaagagctcaaaaagaccgagaatataagctatgagatgctgttcgagccggagccgaacggcgttaactcagtcgagatgatggacaaagagcggaataaagacaagatgcctgaggacgtgactttttccccacaggacgaaactcagaccgccaatcataaacctgaggaacacccagaggagaataccaagaacagtgtcgatgaacaggaggagactgttatctcctacgagtctaccccagaagtgtcccgcggtaatcaaacgatggcagttaaatctttgagtccctcaccagaaagtagcgctagtccggtcccaagtactcagccccaactaactgaaggtagtcacttcatgtgtgtatag

SEQ ID NO: 58286 - DNA, 2625 bp, Artificial Sequence
  Description of Artificial Sequence: Synthetic coding sequence
atgcgcacgtactacttttgcaccgataccgggaaggaaatggaactttggatgaaggctatgttggatgctgcactcgtgcagacagaacctgtgaagcgcgtcgataaaattacttctgagaacgcccctacaaaggaaactaataatatcccaaatcatcgagtactgatcaagcctgaaatccagaacaaccagaagaacaaagagatgagtaagattgaggaaaaaaaagccctcgaggccgagaaatatgggtttcagaaagatgggcaggaccggccattgactaagatcaattccgtcaaactcaatagcctgccttccgagtatgaatctgggtccgcatgccccgcacagaccgtacattatagaccaatcaacctctcctcctccgagaataagatcgtaaacgtttccctagccgatttaagaggcggaaatcgaccaaataccggacctctctatacagaagccgatcgcgtgatccaaagaactaattctatgcaacagctcgaacagtggatcaagattcagaaaggacgagggcatgaggaagagactagaggcgtcataagttatcagacactccctagaaacatgccttcccatagagcgcagattatggcccgttatcccgaagggtatcgcactttgccacgtaacagtaagactcggcctgagagcatctgcagcgtgaccccatctacacacgataagacactgggacctggagccgaggaaaagcggaggtctatgcgcgatgatacgatgtggcagctgtatgaatggcaacagcgacagttctacaataagcagagcaccctccccaggcactctaccctgtctagtccaaaaactatggtcaacatctctgaccaaaccatgcacagtatccctaccagtccatctcatggctccatagctgcttatcagggatattctccacagcgtacttataggtccgaagtgtcgtctcccatccagaggggagatgtcaccatcgataggagacatcgagcccaccacccaaaacacgtgtacgtgcctgaccgacggtctgtgcccgcaggcctgaccctgcagtctgtctccccacagtctttgcaggggaagactttgtcacaggacgaaggtcgtggaacattgtacaagtatcggcctgaggaagtggatatagacgcaaagctctcgcgtctttgcgagcaggacaaagtcgttcatgccctggaggaaaagctacaacagctgcacaaggagaaatataccctcgaacaggcgctgttgtctgcctctcaggagattgaaatgcacgccgacaaccccgcagccatccagaccgtggtgctccaacgggacgacctgcagaatggcctcttgagtacatgccgggaactgtcaagggcgaccgcagagctggagagagcgtggcgcgagtacgacaagctggaatatgatgtgaccgttacgcggaatcagatgcaggaacaactggatcacctcggcgaagtgcagaccgaaagcgcgggaatccagcgggcacaaattcaaaaagagctgtggaggatccaggacgtgatggagggcctgagtaaacacaagcagcaacgcggtaccacggaaatcggtatgatcggcagtaaacctttttccaccgtaaaatataaaaatgagggtcccgactacaggctttacaagagcgagcccgaactgactaccgttgcggaggtggacgagtccaatggggaggagaaatctgagcctgtctccgaaattgaaacatccgtggtgaagggctcccacttccccgtcggagtggtgccgcctcgcgcaaaatccccaacacctgaatcatccacaatcgcgtcttatgtgacattacgcaaaacaaagaaaatgatggatttgcgaacggagcgtcctcgatccgctgttgaacagctttgtctggccgaatccacacggccacggatgaccgtagaggaacaaatggaaagaatccggcgacaccagcaggcctgcctgagggaaaagaaaaagggcttaaacgttatcggggcttctgaccaaagccccctgcaatccccctctaatctgcgggataatcctttccgtaccactcagaccagacgcagagatgacaaggagctcgatacggcaatcagagaaaacgatgtcaaaccggaccatgagacccctgccactgagatcgtgcagctgaaggaaactgaaccccagaatgtagattttagcaaggaattgaagaagactgaaaacatttcttatgagatgctgtttgagcctgaacctaacggagtgaactctgtggaaatgatggacaaagaaaggaataaggacaagatgcccgaagatgtgaccttttcaccacaagacgagacacagacagccaaccacaaacccgaggaacaccccgaggaaaacacaaaaaacagcgtggatgaacaggaagagaccgtgatcagctacgaatctactcctgaggtctcacgcggtaatcagacgatggctgtcaaaagtctatctccctcaccagagtctagcgcctctcccgtccctagcactcaacctcaattgaccgaaggatctcacttcatgtgtgtgtag

SEQ ID NO: 58287 - DNA, 3555 bp, Artificial Sequence
  Description of Artificial Sequence: Synthetic coding sequence
atggcagccgatttgaacttagagtggatttcactaccgagatcttggacctatggcataacccggggagggagggtattttttatcaacgaggaggctaagtccaccacgtggttacaccccgttaccggggaggcagttgttaccggccacaggcgacagagcacggacctgcctaccggttgggaggaggcttacacgtttgagggcgcaaggtattatatcaatcacaacgagcgcaaagtcacatgtaagcacccagtaacgggccagccttctcaggataactgcatatttgttgtgaacgagcagaccgtcgccactatgacatccgaggaaaaaaaggagagaccaattagtatgattaacgaggcaagtaattataacgtgacaagtgactacgctgtgcacccaatgtccccagtcgggagaacatcacgggcaagcaaaaaggtccataatttcggaaaacgttctaacagcatcaagagaaaccctaacgccccagtagtcaggaggggctggctgtataaacaggatagtactggaatgaagctgtggaagaagagatggtttgtgcttagtgatctgtgtctcttctattatcgggatgagaaggaggaggggatccttggctcgatattactgccgtcattccagattgcgcttcttacaagtgaggaccacatcaatcggaaatatgcttttaaggccgcacatcccaacatgcgtacttactacttctgtacagacactggtaaggagatggagctgtggatgaaggcgatgttagatgcagctctggtgcagaccgagccggtcaagcggattttctttagtgatttcagggttgacaaaattacgagcgagaacgccccaacgaaggagaccaacaatattcctaatcaccgggtgctcatcaaaccagagattcagaacaaccagaaaaacaaggaaatgtcaaaaattgaggagaagaaggccttagaagcggagaagtatggatttcagaaagacggccaggacagacctttgaccaagatcaacagcgtcaagctaaactcactcccttctgaatatgagtcaggtagcgcatgcccagcacagacagttcactataggcctattaaccttagtagtagtgaaaataaaatagtgaacgtttcgttggctgacctcaggggaggaaatcgtccaaacaccggccctttatacaccgaggctgaccgggtgatccagcgtaccaacagtatgcagcagctggagcagtggattaaaatccagaaagggagaggacacgaagaggagactaggggcgttatcagctaccagacgctcccacgcaacatgccttctcaccgagctcagataatggcacgctatccagaaggttaccgcaccctacctcgcaattctaaaacgagacccgagtccatttgttctgtcacaccatccacacatgataaaaccctgggcccaggcgcagaagagaaaagacggtctatgagggatgatactatgtggcaactgtatgagtggcagcagaggcagttctataacaagcagtccaccctgccccgacattccacactctcgagccccaaaaccatggtaaatatatccgaccagactatgcatagcatccccacttctccatcccatgggagtatcgcagcctatcaaggttacagccctcagcgtacataccgttccgaggtctcttcccctatacagaggggggatgtaacaatcgataggcggcaccgcgcacaccacccgaaacatgtttacgttcctgaccgccgttctgtccctgcagggctgacacttcagagcgtgtctccgcagtcccttcaaggcaaaactcccgaagaattgaccctgcttctgataaagctcagaagacagcaggcggagctgtcgtccattcgagaacacaccctggctcagctaatgcaactcaagctggaagcccatagtcctaagaatgagattttgtcccatcaccttcagaggaacactatttacctggatcatcagatgaaggagaatgagccgattattacgatggtgcatacgatgatcgaaaacagtgctctccgccctcagctgtatcagcaatttctacgtcagaaaagtaagatttctttgtactgtctctctcaagacgaggggaggggaactctctacaagtaccgcccagaggaggtcgacatagacgcgaagttaagtaggctgtgcgaacaagataaggtcgtgcatgctcttgaggagaaactgcagcagctgcataaggagaagtatacactggagcaggccttgctctctgcaagccaagagatcgagatgcatgcagacaatcccgctgcaattcagaccgtggtgcttcaaagggacgatctgcaaaacggacttctgtccacctgtagggaactgtcccgggcaactgcagaactagagagggcatggagggagtacgataaactggaatacgatgtcacagtgacaagaaatcagatgcaggaacaactggatcacttaggagaagtgcagaccgaatcagccggtatccagcgtgcccaaatccagaaagaactttggaggatacaagacgtgatggaaggtctgtccaagcacaagcagcagcgcggtatgatcgggagcaaaccttttagcaccgtcaagtataaaaatgaagaggaggaggtggtaccgcctcgccctcccctcccgaggtcctatgactttaccgagcaaccaccaatcatccctccactgccttctgactcctcaagcttactgtgctacagtagagggcctgtgcatctgcccgaggagaaaaagatgtatcaggtgcaaggataccccagaaacggcagtcattgtggacctgattacagactgtacaaatctgagcccgagctgaccactgtcgcggaagttgatgaaagcaacggtgaggagaaatccgaacctgtctctgaaatcgagacatctgtagtcaaagggagccatttccccgtcggcgtcgttccacctcgggctaaatcgccaacccccgagagtagtactattgctagttatgtcacattgaggaaaactaagaagatgatggatctgcgcactgaaagacccaggtctgccgtggagcagctgtgcctggcagagtccaccaggccaaggatgacagtggaagagcaaatggaacggatacgtagacatcaacaagcctgtctccgtgaaaagaagaagggcctgaatgtcattggcgcatcggaccaatcccctctccagtcaccctccaacttgcgagataacccttttcgaaccactcagacccggagacgggacgataaggagctggacaccgctatccgggaaaacgatgtgaagccagaccatgaaacgccagcaacagaaatcgtccagttgaaagaaacggagcctcaaaacgtcgatttcagcaaagaactaaaaaaaacggaaaacattagctacgaaatgttgttcgagccagaaccaaatggcgtgaactccgtggaaatgatggattag

SEQ ID NO: 58288 - DNA, 3297 bp, Artificial Sequence
  Description of Artificial Sequence: Synthetic coding sequence
atgacatcagaggaaaaaaaagagagacccattagcatgatcaatgaggcgtccaattacaatgttacttcagattacgctgtacacccaatgtctccagtcggtagaacttcacgggcttctaagaaagtgcataacttcgggaaaaggtctaattcaataaagagaaacccgaatgccccagtcgttcggagggggtggctgtacaaacaggattctactggtatgaagctttggaaaaagcgttggttcgttctgtcagacttatgcctcttctactatagagatgagaaggaagaagggatactcggatctatcctgctgccatcttttcagattgcgctgttgacctccgaggatcacatcaatcgaaaatatgccttcaaggccgctcatcccaatatgagaacttactatttttgcacggacactgggaaggaaatggaactatggatgaaggccatgttagacgccgcattggtgcagaccgagcctgtcaaacgagtggacaagattacctctgaaaacgccccaacgaaggagactaacaatattcccaatcaccgcgtcctcatcaaacctgaaatccagaacaaccaaaagaataaagaaatgtctaaaatagaggagaagaaggccctggaggccgagaagtacggatttcagaaagacggacaggatcgccctctgaccaagatcaatagcgttaaactcaattctctccccagtgaatatgaatctggaagcgcctgccctgcccagaccgtacactatcggcctattaacctaagctcatccgaaaataagatcgtaaacgtgagtctggctgacttaagaggcggtaacagacccaatactgggccactctatacagaggccgaccgcgtgattcagcggacaaattctatgcagcaactcgaacagtggataaagatccaaaaaggtaggggtcacgaggaggagactcgcggtgtgatcagttatcagactctgcccaggaatatgcctagtcatcgggcacagattatggcacggtaccctgaaggctaccggactctcccgaggaactccaaaacgagaccggagagtatctgttctgtaactccgtccacacacgacaaaaccctaggcccaggagctgaggagaagaggagatcgatgcgcgacgacactatgtggcagctctacgaatggcagcagcgccagttttacaacaagcagagcacactgcccagacactccacactgtcatcacccaaaaccatggttaatatatccgaccagacgatgcattccattccaacatctccgtctcatgggtcaatagctgcttaccagggttactcaccacagaggacctataggagcgaggtctcatcacccatccagagaggtgatgtcacaatcgatcgtcggcatcgggcacatcacccaaagcacgtgtatgttcccgataggcgatctgtccccgctggactcactctgcagtccgtgagtcctcagtccctacagggcaagactatgaaggagaatgaacctatcatcaccatggtgcatactatgattgaaaattccgctctgcgccctcagctgtaccaacagttgtcacaagatgagggcagaggcactctgtataaatataggcccgaggaggtggacatcgacgctaagctgagccggctgtgtgaacaagataaggtagtacatgccttggaggaaaagctgcaacaactgcataaagagaagtataccctggaacaggcactcctatcggcttctcaggaaatcgagatgcatgccgacaatcccgcagccatccagactgtcgttctgcagagggatgaccttcaaaacggtctcctctccacttgtcgcgagcttagcagggcaaccgccgaattggaaagggcctggcgtgagtatgataaactcgaatacgatgtgacagtcacccgcaatcaaatgcaggagcaactagaccacctcggtgaagtccagacagagagtgctggcatacagagggcccaaatccagaaggagttgtggagaatccaagatgtgatggagggactcagcaagcataagcagcaaaggggaacaactgaaattggcatgatagggtcaaagccattttctactgtgaaatacaaaaatgaagaagaggaggtggtgccccctcgcccaccactgccaaggtcttatgacttcaccgaacagcctcccattattcctcctttgccatctgattcctcatcactgctgtgctacagtcgcggacccgtccatctgccagaagaaaagaaaatgtaccaagtgcagggctatccgaggaatggtagccattgtgggcctgactacaggttgtacaaatctgagcctgagcttacaactgttgctgaagtagatgagtccaacggggaagagaagagcgaaccagtgagcgaaattgaaacctccgtcgtgaagggaagccactttccagtgggggtcgtaccacccagagccaaatccccgactcccgagtcctcaaccatcgccagctatgtgaccctcaggaaaactaaaaagatgatggatctcagaacagaaagaccaagaagtgcagtggagcagctttgcctcgcagaaagtacgagacctcgcatgacagtggaggagcaaatggagcggattcgcaggcaccagcaggcttgcctgcgggaaaagaaaaagggactgaacgttattggtgcgtccgatcagagccccttacaaagtccatctaacctccgcgataatcctttccggacaactcaaactcgtcgaagagacgacaaggagctggatacggcaatcagggagaacgatgtcaagcccgaccacgaaactcccgctaccgaaattgttcagctgaaagaaacagagccacagaacgttgatttctcaaaggaattgaaaaagacagagaacatctcttacgagatgctgttcgaacccgagcccaatggagtaaattccgtggagatgatggacaaggagcgcaataaagacaaaatgcctgaagatgtaactttttcccctcaggacgagacccagacagccaaccataaacccgaagagcaccctgaggaaaacactaagaattctgttgacgagcaggaagagactgttatctcttatgagagtactcctgaggtaagccgcggaaatcagaccatggctgtgaaatccctgagtccatcccctgagtcctctgcttcccctgtgccatctacgcagccccagctcacagagggttcacatttcatgtgtgtgtag

SEQ ID NO: 58289 - DNA, 3147 bp, Artificial Sequence
  Description of Artificial Sequence: Synthetic coding sequence
atgtccaataaaaccgggggaaaaagacctgcaacaaccaactctgatatccccaaccataacatggtgagcgaggttcctcccgagcggccttctgtccgcgctaccagaacggctcgcaaagccgtggccttcggaaaacgctctcatagcatgaaaagaaatccgaacgctcccgtgactaaagcaggctggctgttcaagcaggcatcttcaggcgtgaagcagtggaacaagcggtggttcgtcctcgtggaccgttgcttattttattataaggatgagaaagaggagtctattctgggctcaatccccctgctgtcttttcgcgtggcggctgttcagccgagcgacaacatctctaggaaacacactttcaaagctgagcatgcgggtgtacgaacttatttctttagtgcggagtcacccgaggaacaagaggcatggatccaggctatgggcgaggccgctagagtccaaatacctccagcccagaagtcagtaccccaggcagtgcgacactcgcacgagaagcccgattccgaaaacgtgcctccttcgaagcatcaccagcaaccccctcataactctctccccaaacccgaacctgaagctaagacacgtggggaaggagatggcagagggtgcgagaaagcagagcgccgtcccgagagacccgaagttaagaaagagcctccagtaaaagctaacggcctgcccgctggccctgagcccgctagtgaacccggaagtccttaccccgaggggcctcgagtgcctggcggaggcgaacagccggcacaacctaatggatggcagtatcatagcccttcgcggcctggaagtacagccttccccagccaagatggtgagacggggggacatcgccgaagcttcccacccagaactaatccggataaaatcgcccaacggaagtctagcatgaaccagctgcagcagtgggtgaatctacggcgaggagtacccccacctgaggacctcaggtcccccagccgattttacccagtgtccaggagggttccggagtactacggcccatatagctcgcaatacccagatgactatcaatactatcctccaggtgttcgccctgagagtatctgcagcatgccagcttacgacagaatcagcccgccatgggccctggaagataaaagacacgcctttagaaacggcggtggacccgcataccagcttcgggagtggaaggagccggcaagttatggcaggcaggatgccactgtgtggatcccgtcccctagccgtcaacctgtatattacgatgaactggatgccgcttccagtagtttgcgcaggctttcgcttcaacctcggtcacatagtgtgccgaggagcccaagccagggcagctacagccgggctcgaatttacagcccagtgcggagcccctccgcgaggttcgaaaggttgccgccacggagcgaggacatatatgcagaccctgctgcttatgttatgaggcggtccatctcgagtccgaaagtgcctccctatcctgaggtttttcgggactctctgcacacctataagttgaacgaacaagacacggacaagctgcttggaaagctttgcgaacagaataaagtcgtgcgcgaacaggaccggttagtacaacaactgagggccgagaaagagagcctcgagtccgccttgatgggcactcaccaggagctcgaaatgttcggaagtcagccagcttaccccgagaaactccggcataagaaggattcattgcagaaccagcttatcaacatcagggtggagctgtcacaggcaaccaccgcactcactaattctacaattgaatatgagcacctcgagagcgaggtatctgcattacatgatgacctctgggagcagctcaacttggatacacagaacgaagtgttgaacagacagattcagaaggaaatatggcgcattcaggacgtgatggaaggactgcgcaaaaataacccctcccgtggcacggataccgcgaaacatagaggtggtctcggaccctccgcgacctattctagcaatagtcccgctagccctctaagctcggcatctctgaccagccccctcagcccattttccctggttagtggatctcagggctctcccacgaaacctgggagtaatgagcctaaagctaattatgagcagagcaaaaaggatccgcaccaaacgttaccactggacacccccagagatatctcattagtgcccacaaggcaggaggtggaagccgaaaagcaggccgctctgaataaggtgggcgtggtacccccacgaacgaagagccccacggatgatgaagtcactccctccgcggtggtgcgacgaaacgccagtggtttaactaatggactctcaagccaggagaggcctaagtccgcagtatttcccggtgagggaaaagtcaagatgtcggtcgaagaacaaattgacagaatgagaaggcatcagtctgggtctatgcgggagaagcggcgtagtctgcaactaccagcgtccccagcgcctgacccctcgcctcggcctgcatataaggtggttagacgacacaggtccattcacgaggtagacatttccaacctcgaggcagcccttagagccgaggaacctggtggtcacgcatatgaaacacccagagaagaaattgctagactgcgtaagatggagctagaaccccagcactacgacgtggatatcaacaaggagcttagcactcccgataaagtcctgatcccagaacggtatatcgatctggaacctgacaccccactttctcccgaggagctcaaagagaagcaaaagaaagtggagaggatcaaaacactgatcgccaagtccagtatgcagaacgtggtacctatcggtgagggcgatagtgtggatgtaccccaagattccgaaagccagttgcaggaacaggagaaacgtattgagatttcctgtgccctcgccaccgaggcttcccgtcggggtaggatgctcagtgtgcagtgcgcaaccccttcgcccccaacctcgcctgcatcacctgcccctcccgctaatccactgagctcagagagtccccgaggagcagattccagctacacaatgcgcgtatag

SEQ ID NO: 58290 - DNA, 321 bp, Artificial Sequence
  Description of Artificial Sequence: Synthetic coding sequence
cgagcaagaatctatagccctgttagaagcccaagtgctaggttcgagcgcctgccaccacgttccgaggacatttacgctgaccctgctgcatacgtaatgaggcgatcaataagcagtcccaagtacgactaccttggggaccgcaggcctgttcccgctggtctctttccctacaactatccccctagccctaccgtgcatgataagatggtgcccccatatcctgaggttttccgcgacagtttacacacatataagttgaatgaacaggatacagacaaactcctggggaagctgtgcgagcagaacaaggtgtag

SEQ ID NO: 58291 - DNA, 3207 bp, Artificial Sequence
  Description of Artificial Sequence: Synthetic coding sequence
atgtccaataaaacaggcggaaaaagacctgccacaaccaattcggacatcccaaatcacaacatggtgtctgaagtaccacccgaaagacccagcgtccgagccactcgtacagccaggaaggcagtggcgttcggcaaaaggtcacacagtatgaaacggaatcccaacgccccagtgaccaaagctggctggctgtttaagcaggcatccagcggcgttaaacagtggaataagagatggtttgtgctagttgatcgctgcttgttctattacaaggatgaaaaagaagagtccattctgggatccatacccctacttagcttcagagtggccgcagttcagccctctgacaacatatcccggaagcacactttcaaagtgaccgtatgctgggttgacgaagctgaagcaagttctacgcgttgcctttcaccccaggccgaacacgctggagttcgtacttactttttcagcgccgagtcccccgaagagcaggaggcttggattcaggctatgggggaagccgctcgtgtgcagattccaccagctcagaaatcagtcccacaagcggttagacattcccatgagaagcctgattccgagaatgtgccaccctctaaacatcaccagcagccaccgcacaactcattgccaaaaccagaaccggaggctaaaactcggggagagggcgatggcagggggtgtgaaaaggcagagcgtcggcctgagcggcctgaagtgaagaaggagccccctgtgaaggccaacggcctccctgctgggccagagcccgcttctgaacccggaagtccctaccctgagggccctagagtcccaggagggggtgaacaacccgctcagcctaatgggtggcagtatcatagtcccagtcggccaggatccactgcattcccttctcaggatggcgagacaggcggacatagaagatcgttcccacctcgcaccaatccagacaagatcgcccaaaggaagagctctatgaatcagctgcaacagtgggtgaatctgcggaggggagtgccaccacccgaggacctgaggtctcccagtcgtttttaccctgtgtcccgtcgagtgccagaatattacggaccatattccagtcaataccctgacgactaccagtactacccacctggtgtcagacctgagagtatctgtagcatgcctgcctacgaccgcatctcccccccttgggcgctcgaggacaagaggcatgccttcagaaacggaggcggacccgcataccagttacgtgagtggaaagagcccgcttcttacggcaggcaggatgcaaccgtgtggatcccctcacccagtagacagcctgtttattacgacgaactggacgcagcaagttcgtccctccggagactctccctgcagcctagaagccactctgttcctaggtcaccgtcccaagggagctatagcagggccaggatctactctccagtccgcagtccaagcgctcggttcgaaaggctaccgccaaggtccgaagatatctacgcagaccctgcggcttacgtaatgaggcgcagtatcagctccccgaaggtcccaccgtatcctgaggtcttccgggactcacttcatacatacaagctgaacgagcaagacacagataaactactcgggaagctgtgtgagcaaaacaaagtcgtgcgagagcaggaccgcctggttcaacagctgcgcgcagaaaaggaatctctagagagcgctcttatggggacacatcaagaactggagatgttcggcagtcagccagcatatcctgagaagctgcgccataagaaagactccctccagaatcagttaattaacatccgcgtcgaactctctcaggccacaaccgcccttaccaattcgactattgaatatgaacacctagagagcgaagtgtcagccctgcatgatgatctgtgggaacaactaaatctcgacacccagaacgaggtgttgaacagacagattcagaaagagatttggagaatccaggacgttatggaaggcctcagaaaaaacaacccaagtcgaggtaccgatacggcgaagcatcgtgggggattaggcccatcagcaacctactctagcaattctccagctagcccattaagctcagcatccctgacatctccactctcccctttcagcctcgtaagtggatctcaagggtcaccaactaagcccggatccaatgagccgaaagctaattatgagcaatctaagaaggatccacaccaaactcttcctctggatactcctcgcgacatcagcctggtgcctactcgccaagaagtggaggccgaaaagcaggctgcactgaataaagtgggcgttgttccaccaagaaccaaaagcccaacagacgatgaggtgaccccgtcggctgtggttaggaggaacgccagcggccttacaaacgggttatcctcccaggagaggccaaaaagcgctgtattccctggggaaggcaaagttaagatgtctgtggaggaacaaatcgataggatgagaaggcaccagtccggatctatgagggagaagcggaggagccttcagcttccagcttctccagccccagaccctagtccaagacccgcttacaaagttgttcggagacaccgtagcattcacgaggtggacattagcaatttggaagccgcactgcgtgcagaggagcccggtggccacgcatacgaaacccctcgcgaggagattgccaggcttcgtaagatggagctagaaccccaacactatgacgtagatatcaataaggaactgtccaccccagacaaggtcctgatccccgagcgatacattgatctcgaacccgataccccactttctcccgaggaactgaaggaaaaacaaaaaaaagtggaacgcattaagacgctgatcgcaaagtcttctatgcagaatgtagttccaattggcgagggggattcagttgacgtgccacaggatagtgagtctcaactacaggaacaggagaaacgaatcgagatttcctgtgcgctggctactgaagctagccgacgagggaggatgctgtccgttcagtgtgcaactcccagtccgcctaccagtcccgcatcccccgcaccaccagcaaatccattatcctctgagagcccaagaggcgcagatagcagctacacgatgagggtgtag

SEQ ID NO: 58292 - DNA, 315 bp, Artificial Sequence
  Description of Artificial Sequence: Synthetic coding sequence
cgggctagaatttactctcccgtgcgctctccttctgcaagatttgaacggctgccacctcgatctgaggacatctacgctgaccccgctgcctacgttatgcgaaggtcaatttccagtcctaagatgagcgagtcggaaaccctcatctcaatggtcaaccggatggtcgagaatagtagcccaagatctcagctgtttatgcaggtgcctccgtatcctgaagtgttccgggactctcttcatacttacaaattgaatgaacaagataccgataaactgttaggcaagctgtgtgagcaaaataaagtgtag

SEQ ID NO: 58293 - DNA, 456 bp, Artificial Sequence
  Description of Artificial Sequence: Synthetic coding sequence
agagcccgtatctacagtccggtacgctctccctctgccaggttcgagaggctccctccccgttctgaggacatctacgcggaccctgccgcatacgtaatgcgtcgcagtatctcttcccccaaatatgactacctgggagaccggaggcctgtgccagccggtctattcccatataattaccctccttccccaacggtccacgacaagatggacgagctgctcgacctccagttgcagcgcaacctcgaatatctagatcagcagatgtctgaatctgagacactaataagtatggtgaaccgtatggtggagaattcttctcctcgatcacagctgttcatgcaggttcctccctacccagaagtcttcagggactcgcttcatacttacaaactgaatgaacaggataccgacaagttgctcggaaagttgtgtgagcagaataaagtttag

SEQ ID NO: 58294 - DNA, 375 bp, Artificial Sequence
  Description of Artificial Sequence: Synthetic coding sequence
cgtgcgaggatttactctcctgtccgaagcccaagtgccagatttgaacggttaccaccacggagcgaagatatctacgcagatcctgccgcatacgtgatgcggaggtctatctccagtcctaagtatgactaccttggcgacagaaggccagttccagccggattattcccatacaattaccctccatcaccaactgtgcacgataaaatggatgaacttctggacttgcagctccagcggaatcttgaatacctggaccagcaggtgcccccttatcccgaggtcttcagagacagccttcacacctacaaactgaatgaacaagacaccgacaagcttctcggcaaattgtgcgagcaaaacaaagtgtag

SEQ ID NO: 58295 - DNA, 252 bp, Artificial Sequence
  Description of Artificial Sequence: Synthetic coding sequence
cgggcacgtatctactctccggtgaggtctcccagtgctaggtttgaacggctgccgccacggagcgaagatatttacgccgatcctgcggcttacgtcatgcgtcggtccatatcctcacctaagtatgactacctgggagaccgcaggcctgtgccagctggcttgtttccctacaactatcccccaagcccaactgttcacgataaaatgaaactgcttggaaagctttgtgagcagaataaagtgtag

SEQ ID NO: 58296 - DNA, 402 bp, Artificial Sequence
  Description of Artificial Sequence: Synthetic coding sequence
cgtgccaggatttattcccctgtccgctccccatcagccagatttgaacggcttccaccacgttcagaggatatctacgcagaccctgcagcctatgttatgaggcgctctatcagctcaccaaagtatgactatttgggggatcgcagacctgtaccggctgggttatttccttataattaccccccttcacctaccgtgcacgacaagatgatgtctgaaagtgaaaccctcatcagtatggtcaataggatggttgaaaacagctctccacggagtcaactttttatgcaggtgcccccttaccctgaggtgtttcgcgatagcctgcatacctataagctgaatgaacaggataccgacaagctgctcggcaagctgtgtgagcaaaacaaagtatag

SEQ ID NO: 58297 - DNA, 1386 bp, Artificial Sequence
  Description of Artificial Sequence: Synthetic coding sequence
atgaataatttcggaaacgaggaattcgattgccatttccttgatgagggctttacagctaaagatatcctcgatcagaaaataaatgaggtgtcttctagtgacgacaaggatgctttctacgttgctgatctcggggatatcctgaagaagcacttaaggtggctgaaggcactccctagagtaactccattttacgcggtgaaatgtaatgattctaaggctatcgtaaaaaccttagccgcaactggaaccggtttcgactgcgcctccaaaaccgaaatccaactggtccagagcctgggcgtcccaccagagagaataatctatgccaacccatgcaaacaggtctcccagatcaagtacgccgcaaacaacggagtccagatgatgacgtttgattctgaggtggaactgatgaaagtggcccgagcacaccctaaggcaaaactggttctgcgcatcgccaccgatgactcaaaggccgtgtgtaggttgtccgtgaaatttggagccacccttagaaccagtcgcctgctcctggagagagccaaagaactcaacatagacgtggtgggcgtaagtttccatgtgggaagtggctgcacagatcctgagacctttgtgcaggcaatctctgacgccaggtgcgttttcgatatgggcgcagaggtgggtttttcaatgtacctgttggacataggaggagggttcccgggttcagaagacgtaaaactgaaatttgaggaaatcacaggggtgattaatcccgctcttgacaagtacttcccaagtgactcaggcgtccggatcatcgccgagcccggaaggtattacgtcgcgagcgcctttaccttggcagtgaacattatcgcaaaaaaaatcgtcttaaaagaacagaccggatccgacgatgaagatgagagcagtgagcagacatttatgtattacgtgaatgacggtgtctacggtagctttaactgcatattgtacgaccatgcacatgtgaaaccgcttctacaaaagcgcccaaagcccgacgagaagtactactcctcttccatctggggtccaacgtgcgacggccttgatcgaatcgtcgaaaggtgtgacctcccagaaatgcatgttggcgattggatgctgtttgagaatatgggagcatacactgtagccgctgcatcaacttttaacggatttcagcggccaacaatctactacgtcatgtccggccctgcctggcagcttatgcagcagttccagaacccagactttccgccagaggtcgaagaacaggacgcctctaccctaccggtcagctgtgcatgggagtccgggatgaagcgtcacagagcagcctgcgcctcagcgtctatcaacgtttag

SEQ ID NO: 58298 - DNA, 930 bp, Artificial Sequence
  Description of Artificial Sequence: Synthetic coding sequence
atggctttcgtgaagagcggttggctcctgaggcaatccactattcttaagcgatggaagaaaaactggttcgatctgtggagcgatggccatctgatctactacgatgatcaaacacggcagaacattgaagataaagttcatatgccaatggactgcatcaatattcgcacagggcaggagtgtcgcgacacgcagccacccgatggcaaatcgaaggactgcatgctccaaattgtgtgtcgcgacggaaagacgatctctttgtgtgctgagtctactgatgattgcctggcatggaaatttaccctgcaggatagccggacaaatactgcctacgtcgggtctgctgtaatgacagacgaaactagcgtcgtctcatctcctccaccgtacacagcttatgccgctccggctcctgaggaactccacagcaagggcccaaagattcatactactacctccgccaagacccaagccgtcttacccacacggtgtttttttcccagcgagagtcccatccggagatctgtccagatctcggtcttgctgcccgctgtaaacatcagacgacggatcaagctcacattcccacagcctgcccgacctcgcgcaccgagaagcctctgtttatggcaaacctggttcgccggtaagcgcgcaccctcgctgccaaccgcagccactgcacctgcactgccatcatgtccgtcccctcccgctcccagccaagctcttccacccagcttggccggttggcgcagcccatccagtgcacccctaccaccagagcaagccctggctcctaggtctttccagctctcaaaacatcaggcacgcccaagacctcatcgccctggaacacctcccgtcccagcttggccaggtgtgccgcctccccctccagctcgccctcctgctctgcggtag

SEQ ID NO: 58299 - DNA, 669 bp, Artificial Sequence
  Description of Artificial Sequence: Synthetic coding sequence
atggcattcgtcaagtcagggtggctgctgcggcagtccacgatacttaagcggtggaagaaaaactggttcgatctttggagtgacggccacctgatctactacgatgaccagaccaggcagaacatagaagacaaagtccacatgcccatggattgcataaacatccggaccggccaggaatgtcgagacacacagccacccgacgggaagtcaaaagactgcatgctgcagatcgtctgccgggacggaaagaccattagcctctgcgccgagagcacggatgactgccttgcatggaaatttacgctacaggattcgcgcactaatactgcatatgtggggtccgcggtgatgaccgatgagacgtcagtggtaagcagccctccgccatatacagcctacgcagcgcctgctccagagcaagcttacggctacggtccctatggcggagcctatccccctggaacccaagtggtctacgccgcaaacggccaagcctacgctgtgccttatcagtacccctatgccggactgtatgggcagcagcctgccaaccaggtgatcatccgggaacgttatagagacaatgatagcgatctggcgctgggtatgttggctggcgctgctactgggatggctttaggttccctgttctgggtgttttag

SEQ ID NO: 58300 - DNA, 930 bp, Artificial Sequence
  Description of Artificial Sequence: Synthetic coding sequence
atggcgtttgtgaagtctggctggctactcagacagtcaaccatcctgaagaggtggaaaaagaattggttcgatctgtggagcgacgggcacttaatatattacgacgatcaaaccaggcagaacattgaggacaaagttcacatgcccatggactgtataaacatccggacagggcaggagtgccgggatacccagcccccagacggtaagtctaaggattgtatgcttcaaatcgtgtgtagagacggaaaaaccattagcctatgtgctgaatccacagacgattgcctcgcttggaagttcaccctgcaggacagcaggaccaacaccgcctacgttggctctgccgtgatgactgacgaaacaagtgtggtgtcctccccacctccgtatactgcgtatgcggcaccagcgcctgaagaacttcacagtaagggccctaagatccacacaactacttccgctaagacccaggccgtccttccaacccggtgtttcttcccctccgaaagccctattcggaggagcgtgcagatttcagtcctgttacccgcagtcaacatccgtcgacgaattaaacttaccttccctcaacctgccagacccagagcccctagatcactgtgtttgtggcagacttggtttgctggtaagcgggcaccatctctgccgaccgccgctacagcccctgcacttccgtcatgcccttctcccccagccccaagccaggccctgcctcccagcctggcgggatggcggagccctagctctgccccacttccacccgagcaagctctggcgcctaggagttttcaactcagcaagcatcaggcccgtcccagaccccacaggccgggaacccctccggtccccgcttggccaggggtgcccccaccaccacccgctcgcccacctgccctgcgatag

SEQ ID NO: 58301 - DNA, 669 bp, Artificial Sequence
  Description of Artificial Sequence: Synthetic coding sequence
atggcgtttgtgaaatccgggtggttgctgagacagagtactattctgaagcgctggaagaagaactggttcgacctgtggtcagacggccacctgatctattatgatgaccagactaggcagaatatcgaagataaagtccatatgcctatggactgcattaacatccggacaggccaggagtgccgggatacacagcctcctgacggcaagtccaaagattgtatgctacaaatcgtgtgtagggatggaaagaccatatcactctgcgccgagtcaacagacgattgcttggcttggaaatttactctacaagattctcgtaccaacactgcgtatgtgggctcggccgtaatgacagacgaaactagtgtcgtgagctctccgcctccttacaccgcctacgctgctccagcaccagagcaggcctacggctatgggccttacgggggagcctatcccccaggaactcaggtggtttacgccgctaatggccaggcctacgctgtgccttaccagtatccatacgcaggcctgtacggccagcagcccgcaaatcaggtgattatcagggaaagataccgagataacgactcggacctggctttaggcatgctggccggagccgctacaggaatggcattgggatctctgttttgggtattctag

SEQ ID NO: 58302 - DNA, 669 bp, Artificial Sequence
  Description of Artificial Sequence: Synthetic coding sequence
atggcttttgttaaatccggatggcttctccggcaatccacaatcctgaagaggtggaagaaaaactggttcgacttgtggtcagatggccatttgatctattacgatgatcaaactcgacaaaacatcgaagataaagttcatatgcctatggattgtatcaacatccgtaccggccaagaatgtagagacacacaaccaccagatggaaaatccaaggactgtatgcttcagatcgtctgtagggatggcaagacgatcagcttatgcgctgagagtacagatgactgtctcgcttggaagttcacactccaggacagccgtaccaacacagcttatgtcggatctgctgttatgacggacgaaaccagcgttgtgtcctctcctcctccctatacagcctatgcagcgcctgcacccgagcaagcctacggatatggcccatacggaggagcataccctcctggtacccaggtggtctacgctgcgaatgggcaggcgtacgctgtgccctaccagtatccatacgcaggactgtacgggcagcagcccgctaatcaggtcataatccgtgagcgataccgcgataacgacagcgacctggcactgggcatgcttgccggagctgcaactgggatggcacttggatccctgttctgggtcttctag

SEQ ID NO: 58303 - DNA, 537 bp, Artificial Sequence
  Description of Artificial Sequence: Synthetic coding sequence
atggccttcgtgaagtctgggtggctgctgaggcagtctacaattcttaagcgatggaagaagaactggttcgatctttggtcagacgggcacctgatatactacgacgaccaaacacgccaaaatatcgaggacaaggtgcacatgccgatggattgtatcaatatccggacagggcaggaatgcagggatactcagcctccagacggcaaatcaaaggactgcatgctgcagatcgtgtgcagggacgggaaaacgatttcgctgtgtgctgaaagtacggatgactgcttggcgtggaaattcactcttcaagactcgagaactaacaccgcttatgtggggtccgccgttatgactgatgaaacaagtgtggtttctagccccccaccctacactgcttacgcggctcctgcgcctgaagattttatggactctagcctgcttaccaagtcatctttcgaatccgctattgaaactactacagcaacatggcactgggcttgctggcaagaacagcctcgagcctggccatag

SEQ ID NO: 58304 - DNA, 513 bp, Artificial Sequence
  Description of Artificial Sequence: Synthetic coding sequence
atggcttttgtgaaatctgggtggctgctccggcaatctacaattctcaaacgatggaagaagaactggtttgatctgtggagcgacggccatctgatctactatgatgaccagacacgacagaacatcgaagataaagttcatatgcctatggactgtataaatatcagaaccgggcaggagtgtcgtgacacgcagccccctgacggcaagagcaaggattgtatgctgcaaatcgtttgtagggatgggaagacaatttctctgtgcgctgaatccacagacgattgtctgctgatggcgatgggccacacagttgtgcgaaccagacaagagctcaagctgagcacgctgaggatgggacgccgaatgccctgccctacttctacacacatgcaggacttcatggattcaagccttctgacgaaatccagttttgagtccgccatagagactacaaccgccacttggcactgggcttgctggcaggagcagccccgtgcgtggccatag

SEQ ID NO: 58305 - DNA, 525 bp, Artificial Sequence
  Description of Artificial Sequence: Synthetic coding sequence
atgcccatggactgtatcaacatcaggactggccaggagtgcagggacactcagccccctgacggtaaaagcaaggactgtatgctgcagatagtgtgcagggatggtaaaacaatttctctctgcgccgagtcgacagacgactgcctggcatggaagtttaccctgcaggattcccggaccaacaccgcgtatgtaggtagcgctgttatgactgacgagacaagcgtagtgagctctcctccgccttatacggcttacgccgcacctgctcccgagcaggcgtacggttacggtccgtacgggggagcctatccccctggcacacaggttgtgtacgctgcaaatggccaggcctatgcagtcccttaccaatacccctacgcaggtctctacggccagcagcctgctaatcaggtgatcatccgagagagatatagagacaatgattctgatctcgctctaggaatgctggctggcgcagccactggaatggctctagggagtctcttctgggtgttctag

SEQ ID NO: 58306 - DNA, 1521 bp, Artificial Sequence
  Description of Artificial Sequence: Synthetic coding sequence
atgtttacatccaagtcaaatagcgtgagcccctcccccagtctggagcaggctgacagtgatgccctcgatatctctactaaggtgcaactgtatggtgtcctgtggaagcgaccgttcggacgtccttccgcaaagtggagtaggagattcttcatcattaaggagtcatttttactctattattccgagagcgaaaagaagtcttttgaaacaaataagtacttcaacatccatccaaaaggagttatcccccttggaggctgcctggtcgagcctaaggaggaaccttctatgccttacgcaatgaagatatcccaccaggactttcatggcaacatcctgctggccgctgaaagtgaattcgagcaaacacagtggttagaaatgttgcaggagtcaggtaaggtgacctggaagaatgcacagctcggcgaagcaatgattaaaagcctcgaagcacagggtctgcagctggccaaggaaaaacaggagtacctagacaagctgatggaggaaaccgaagagttgtgcttgcaaagggagcagagagaggaattggagagactgaatcaagtgctagaagcggagaagcaacagttcgaagaggtggtgcaggagcttcggatggaacaagagcagataaaaagagagctcgagttaaccgctagatgcctaaaaggggtggagcaggagaagaaggagcttcgacacttaaccgagtcactccagcaaactctggaggagctgtccattgagaagaaaaagaccctcgagatgcttgaagaaaatgaaaatcaccttcaaacacttgccaaccaaagtgagcaaccccctccgagcggcggactgcattctaacttgcggcagatagaggagaaaatgcagcagctgctggaggagaaattgcttgctgaaaagcggatgaaggagaatgaagagcgtagccgggctctcgaggaagaaagggaattctattcttcacagagccaagctctgcagaattctctgcaggaattgacagcggagaaacagcaagctgagcgcgaactgaaagcggaagtcaaggtgagaatggatctcgagagacgcctccgagaagctgaaggtgccctgagatcgctcgaacagggtttgaactcaaaagtgcggaacaaggagaaggaagagcgaatgcgagccgacgtaagtcatctgaagaggttcttcgaagagtgtattagaaatgccgaactggaagccaaaatgccagtgattatgaaaaactccgtttacatccacaaggctgccaccaggcgcattaaatcatgtaggttccacagaaggaggtcgagcaccagctggaatgatatgaagccgtcccaaagcttcatgacaagtcaactcgatgccaataacatggaggaactgaaggaggtcgcgaagagactgtcgagggaccaaagatttcgcgagtccatatatcatattatggccacccagcccggtgcaccatccgcactcagcaggggaggcaaatag

SEQ ID NO: 58307 - DNA, 4158 bp, Artificial Sequence
  Description of Artificial Sequence: Synthetic coding sequence
atggagctgtctgattccgacagacctgtttcgtttggcagcacatctagttctgccagtagccgggatagccacggcagtttcggatcccgaatgaccctggtttctaactcacatatgggccttttcaaccaggacaaagaggttggcgcaattaagttagagcttattccagcaaggccgtttagttcctcagagttacagagagacaaccctgccaccggtcagcagaacgcagatgaggggtcagagcgtccccctcgcgcacagtggcgtgtcgactcaaatggtgctcccaagacgatagccgattctgctacctctccgaaattactctacgtggaccgggtcgtgcaggagatccttgagacagagcgaacctatgtgcaagacctgaagagcattgtcgaagactaccttgactgtatcagagaccagacaaaattaccccttggcaccgaagagaggagcgcacttttcggtaacatccaggatatttaccatttcaactcagagcttttgcaggatctggagaattgtgagaatgatccagtcgcaatcgcggagtgttttgtcagcaagtcagaagagttccacatatacacgcagtattgtactaactatcctaggagcgtggccgtcctcaccgaatgtatgcgaaataaaattcttgctaaatttttcagggaacgccaggagacgctaaaacactccctaccattgggatcctatttgctgaagcccgttcagagaattttaaaataccatctcttgctccacgaaatagagaaccatctggacaaggacaccgaaggatacgatgttgtgctggacgctatcgatactatgcagcgcgtcgcttggcacattaacgacatgaagcggaaacacgaacatgccgtgcggctgcaggagattcagagtctgctcacaaattggaagggaccagatctgacttcatatggcgaattagtcctagagggaacatttaggatacagcgagctaagaatgagagaactctgttcctgtttgacaaactcctgctgattacgaagaagagagacgatacattcacctacaaggcccacatattgtgtggtaatctgatgcttgtggaggttatacctaaggagccgctttcgttctctgtcttccactataagaacccaaagcttcaacatactgtacaggccaagagccagcaggacaaaagactctgggtactacatctgaagcgactcatattggagaaccacgccgctaagatccccgctaaggctaagcaggcaattttagaaatggatgcaatccaccaccctggcttctgctacagcccagaaggcggaaccaaggccctgtttggatcaaaggagggtagtgctccataccgactgagaaggaagtcagagccaagttccagaagccacaaagttctcaagactagcgagacagcgcaggatattcaaaaggtctcccgcgaggaggggtctcctcagctcagttctgccagaccctcacccgctcagaggaactcccagccctcctccagtaccatgatcagcgtcctgcgggctgggggtgctctgaggaatatctggacagatcatcaaattcgacaggctctctttccctcgcgtcgttccccccaggaaaacgaagacgatgaggatgactaccaaatgttcgttccaagctttagcagttcggatttgaacagcacccggttatgtgaggacagtacaagttcccggccttgtagctggcatatggggcagatggagagcacggaaacatccagttctgggcatagaatcgtccgaagggcatcctcagccggtgaaagcaatacctgccccccagaaatcgggacaagcgaccgaacacgggaactacagaactcccccaaaactgagggtcaggaagagatgaccccttttggaagtagtatcgagctgaccattgatgacattgatcacgtgtatgacaacatctcgtatgaggacctgaagctaatggtggccaagcgagaggaagctgagtctacccctagcaagagcgctcgtgattctgtgcgaccaaaatcgactcctgagctggccttcaccaagcggcaggctgggcattccaagggctcactgtatgcgcagacggacggcaccctgagcggcggtgaggccagttctcaaagcactcatgagctccaggccgtggaagagaatatatacgacactattggcttaccggatcccccaagtctgggcttcaagtgctcttcactgaagagagctaagcgcagcacattcttaggactggaagccgactttgtttgttgtgacagcttgcgtcccttcgtgtcccaggattcactacaactgtcagaggacgaggctccgtatcaccaagccacacctgaccatgggtaccttagcctcctctatgatagcccaagtggaaatttgagcatgccgcataaacccgtgtctgataagctcagcgaagaggtcgacgagatttggaatgaccttgagaactatataaaaaaaaatgaagacaaggccagagatagattattggccgctttcccagtatcaaaagacgatgttccagatcgcctgcacgcagaatcaacacccgaactgagtagagatgtgggcagaagtgtctccactttgagcctgcctgaaagtcaggctctgttgaccccggttaagagccgggctggacgtgctagccgggcaaactgtccatttgaggaagatctcatttccaaggaggggagcttcatgtcgctaaacaggctgagtctggcatccgagatgcctttaatggacaatccttacgacctcgccaattccggtctcagccagacagatcctgaaaaccccgacctgggtatggaagcaacagataaaaccaagtcgagagtttttatgatggccagacagtacagtcaaaagataaagaaagccaatcagctgctgaaagttaagtctctggagctggagcagcccccagcttcgcagcaccaaaaatccatgcacaaggacctggccgcaatcctggaggagaagaagcaaggaggacctgccatcggcgctcgtattgccgaatacagtcaactgtacgaccagatagtattccgggagagtccccttaaaattcagaaggacgggtgggcttcgcctcaggagagctctctgctaaggtcggtgtctccatcacaagtgcaccatggttccggggattggcttctccattccacttattctaacggtgagctggctgatttttgccttccacctgagcaagacctgcggtccagataccctacttttgaaattaataccaaatcgacccctcggcagctcagtgctgcctgctccgtgccaagccttcagacgagcgacccgctgcctggtagcgtgcagcgctgctccgtggttgtaagtcaacccaacaaggagaactggtgccaagaccacctttataattctctcggtcgcaaggggatatccgccaagtcccagccctatcacaggagtcaaagttcatcaagcgtccttattaacaagtcaatggactccatcaattacccatcggatgttgggaagcagcaactgctctccctgcatcgctctagtagatgcgagtcccaccaggacctcctccccgatatcgcagattcccatcaacagggcacggaaaaactgtccgacctgacgctccaggacagtcaaaaggtggtagtggtgaataggaacctgcctcttaatgcacagatcgctacccaaaactacttttcaaactttaaggaaaccgatggggacgaggacgactatgtcgaaattaagtcggaggaggatgaaagcgagctcgagctgtctcataacagacggagaaaatccgactctaaatttgtcgatgccgacttcagcgataatgtctgttccggcaatactctgcattcgcttaactcacctagaacgcccaagaaaccggtcaattccaaactgggcctaagcccatatctcactccctacaatgattcagataagctgaatgattatttgtggcggggaccctcacctaaccaacagaatatcgtgcagtcactcagggagaagtttcagtgcctctccagctcatccttcgcctag

SEQ ID NO: 58308 - DNA, 141 bp, Artificial Sequence
  Description of Artificial Sequence: Synthetic coding sequence
atggaactgtcagacagcgacaggccggtatcttttggatccacatcctcatctgcctcgtcccgggactcacacggttcattcggatcccgcatgaccttagtgtccaattcacatatgggcctcttcaatcaggactag

SEQ ID NO: 58309 - DNA, 4158 bp, Artificial Sequence
  Description of Artificial Sequence: Synthetic coding sequence
atggaattgagtgacagtgacagacccgtgtcttttggttccacaagctcatctgccagctcaagagactcacatggctcgtttgggtccagaatgaccctggtgtcgaactcccacatgggcttgtttaaccaagacaaggaagttggtgccataaagctggagcttatcccagccaggcctttcagttcatctgaactgcagagagataaccccgctacaggacagcagaatgcggacgaaggtagcgaacgtccacccagagcccagtggcgcgtggatagcaacggcgcacctaagacaatcgccgacagcgccactagccccaaactgctttacgttgaccgagtggtgcaggaaatcctggagacggagcggacctacgtgcaggacttaaagtcaatcgttgaagactatctggactgcatacgggaccagaccaagctgccattgggaactgaagagaggtctgcattgttcggtaacatacaggacatatatcacttcaactctgagctgctccaagacctggagaattgtgaaaatgatcccgtcgccattgccgagtgttttgtgagtaaaagcgaggagttccacatctacacacagtattgcacgaactatcctagaagcgtggcggttctgacggagtgtatgcggaacaagatccttgcaaagttttttcgagaaaggcaggagactcttaaacattcactccccttgggcagttacctgctaaaacccgttcagcgcattctgaaatatcacctgctcttgcacgaaatagagaaccacctggataaggacactgaaggatacgacgtggtgttggatgctatcgacacaatgcaaagggtggcctggcatatcaacgacatgaaaagaaaacacgagcacgctgtcaggctccaggagatacagagcctgctcacaaattggaagggtccagaccttacttcttatggcgagctagtgctggaaggcacatttcgcatccagcgcgcaaaaaatgaaaggaccctgttcctttttgacaagctcctgctcatcacgaaaaagcgagacgatacgtttacatataaggctcacatattgtgtggcaacctgatgctcgtggaagtcatacctaaagagcctctaagtttctctgtgttccactacaaaaatcctaaattacagcacacagtgcaggctaagtcccagcaggataaacgcttatgggtgctgcatctgaagcgcctgattctggaaaatcacgcggcaaagattccggctaaagccaaacaagctatattggagatggacgccatccatcaccctgggttctgctacagtccggagggtggcaccaaagccctgttcggctccaaagaaggttccgcaccgtacaggctgcggaggaagtctgaacccagcagtcggagccacaaagtcctgaagaccagcgaaactgcccaggacatccagaaagtgtctcgcgaggaagggtccccacaactgtcctcagccaggccatcccccgcacagagaaattcccaaccttcttcttccacaatgattagcgtattaagggcaggcggtgctctgaggaacatatggactgatcaccagatcaggcaggcattgttcccctctaggcgatctcctcaggaaaatgaggatgatgaggatgattatcaaatgtttgtaccatcattctcatcctcggacctcaactctacaagactctgcgaggactctacaagctctcgaccctgttcttggcacatgggacaaatggagtcaactgagacctcttcatccggccacagaatcgtgcgccgagcttcatctgccggtgaatctaatacttgcccccctgaaatcgggacctccgatagaactcgcgagttacaaaactcacccaaaacagaggggcaagaagagatgacgccatttgggtcctccatcgagctgaccatcgatgatatagatcacgtttacgacaacatctcttacgaggatctgaaactcatggttgccaagcgtgaggaagcagaaagcaccccttcaaaaagcgctcgcgatagtgtgaggcccaagagtacaccagaattggcttttacaaaacgacaggccggtcactcaaagggtagtctgtatgctcagacagacggaacgctctctggaggtgaggcgtccagccaatccactcatgaactgcaggccgttgaggaaaacatttacgatactatcggactgcctgatcccccaagccttggctttaagtgcagctcactaaagcgcgctaagcgtagcaccttccttggactcgaggcagacttcgtctgttgtgattcgctcagacctttcgtttcccaggatagtttgcagctctctgaggacgaggcaccatatcaccaagcgacacctgaccacggatacctgtccctgctatacgactctccctctggcaatcttagtatgccacacaagcccgttagcgacaaattaagtgaagaagtcgacgagatatggaatgatctcgagaattacattaaaaagaatgaggacaaagcacgtgacaggctactggcagcctttccagtgtctaaggacgacgtaccagaccgattgcatgccgaatccactcccgagcttagcagagatgtcggtcggagcgtgagcacactatcactgcctgaatcccaggccctactaacccctgtgaaaagtcgtgccggaagagcctccagagccaactgcccctttgaagaggacttaatatccaaggaggggtccttcatgagtctcaaccgactgagcctagcatcagaaatgcctcttatggacaacccatatgatttggctaattcgggtctgtcccaaacagatccagaaaatcctgacctgggcatggaagcaacagacaaaacgaaatccagagtgttcatgatggcaagacaatactcccagaaaattaaaaaggcaaaccagctcctcaaagtcaagtctctagaactggaacagccaccagcaagtcagcaccagaaatcaatgcataaagatctcgccgcaatcctggaggagaaaaaacagggaggaccggcaattggcgctaggattgctgagtattcgcagttgtacgatcagattgtgttccgcgaatccccactgaaaatacaaaaggacggttgggcctcaccgcaagaatcatctctgctgcgtagtgtaagccccagccaggtgcatcacgggtcgggcgactggcttttgcacagtacctattcaaacggagagctggcagatttttgcctgcctcccgagcaggatctacgctctaggtaccccacattcgagatcaacaccaaatccaccccaaggcaattatctgcggcatgcagcgtgcccagcctccagaccagcgaccccctcccaggcagcgtgcaaaggtgttctgtggttgtctcacagcctaataaagagaactggtgtcaggaccatctgtacaactccctggggaggaaggggatttccgccaagagccagccttatcatagatcccagtcaagctcttctgtgttgattaacaaatccatggattctataaactatccctcggatgtgggcaaacagcagcttctcagccttcatcggtcctctcgctgtgagagtcaccaagacctgctccctgatattgcagacagtcaccagcaggggactgaaaaactgtcggacctgacgctccaagatagccagaaggtggtggtcgtgaaccgcaatcttccactgaacgcccagatcgccacccagaattacttcagcaacttcaaagagaccgatggcgatgaggatgattacgttgagatcaagtcggaggaagatgaaagcgaattagaactttcccacaacaggcgccgaaaatccgacagtaaattcgtggatgcggacttttccgataacgtctgttctggcaacacactccattctctgaatagccctcgcactcctaaaaaacctgtaaactcgaagctaggcttgtctccgtacctgacgccttacaatgattctgacaagctgaacgactacctgtggagaggaccttcccccaatcaacagaatatcgtgcagtcccttcgcgaaaagttccagtgtctgagtagcagctcgttcgcatag

SEQ ID NO: 58310 - DNA, 2859 bp, Artificial Sequence
  Description of Artificial Sequence: Synthetic coding sequence
atggagttgtccgacagcgaccggcctgttagctttggctcaaccagttctagtgcctctagtcgcgattcacatggctccttcggatcacgaatgaccctggtgtccaactcacacatggggctgttcaatcaagacaaggaagtcggcgctataaagctcgaacttatacctgctagaccattttcgtccagcgagttgcagcgtgacaaccccgcaaccggccaacagaatgctgatgagggtagtgagaggccccctagggctcaatggagggtggactccaatggggctcccaagaccattgcagactctgcaacgtcacctaagctgctctatgtggatagagtcgtccaggaaatactggagactgaacgtacatatgttcaagacttgaagtctattgtggaagactatctcgactgcataagagatcagaccaaattgcccctcggaaccgaagaacgctccgcactgttcggcaatattcaggacatctatcatttcaattccgagctgctgcaggaccttgaaaactgcgaaaacgaccctgtggcaatcgccgagtgtttcgtttcaaagtcagaagagttccatatctacacacagtattgtactaactatcccagatcagtcgctgttttgaccgaatgtatgagaaacaagatcttggctaaattcttccgagaaaggcaggaaacactcaaacactcgttacccctgggcagctacttgctaaaaccggttcagcgcatcctcaagtatcatctcctccttcatgagatcgaaaaccatctcgataaggacacagagggctacgacgttgtactggacgcaatagacacaatgcaacgggtggcttggcatatcaatgacatgaaacgtaaacatgagcatgctgtgaggctgcaggagatacagagcctcctcaccaactggaagggtcccgatcttaccagttacggggagctagtcctggagggaacgttcagaatccagcgtgcgaagaacgagaggacgctgttcttgttcgataaacttcttttaatcacgaagaagcgtgatgacaccttcacctacaaggcccacatcctgtgcggtaacttaatgctggtggaggttatccccaaggagcctctttcattctccgtctttcactataagaacccgaagctccagcacaccgtccaagcaaagagccagcaagacaagcgcctgtgggtgctgcatctcaagcgcttgatcctagaaaatcacgcagcaaagatccccgcaaaagctaaacaggctattctcgagatggatgccatacatcatccaggtttctgctacagccctgagggagggacgaaagccctatttgggtccaaagagggctccgccccatatcgtctcaggagaaagagtgagccctcatctaggtcacacaaggtcctgaaaacttccgagaccgcgcaggacatccagaaagtatccagggaagagggcagtccacagttgtcaagcgctcgcccttccccagcacaacggaactcccagccttccagctcgactatgatctccgtcctgcgagccggaggcgctcttcgcaacatatggactgaccatcagatcagacaagcgctgtttcctagccggcgatctccacaagagaatgaggacgatgaagacgattatcagatgttcgtcccctccttcagtagttcagaccttaactcaaccagactgtgcgaagactcaacttcaagcaggccctgttcatggcacatgggccagatggagtccacagaaacatctagtagcgggcaccgcattgtgcgccgtgcgtcatcagctggggaaagcaatacttgtccccctgagattggcacctccgatcggaccagggaactgcagaactcaccaaagaccgagggacaagaagagatgactccgttcggcagctccatagagctcacaatcgacgacatcgaccacgtttacgataatatttcttatgaggacttaaagcttatggtagccaagcgggaggaggccgaatcaacaccctctaagtcagctagagactctgtaaggcccaagtctacccctgaactagcctttaccaaacgtcaggcaggtcatagcaaaggatctctatacgcccaaacggacggcactctctccgggggtgaagcctccagccagtctactcatgaactgcaagccgtcgaagaaaacatctatgacaccattgggctgccggaccctcccagcctgggtttcaagtgttcctccttgaagagagcgaagagatccacatttctggggctggaggcagacttcgtgtgttgtgactcattgcggcctttcgtaagtcaggacagtctgcaactgagtgaggacgaagccccatatcaccaggcgacgcccgaccacggctatttgtctctcctgtatgactccccttctggaaacctatccatgcctcacaaacctgtttccgacaaattgagcgaagaagtggatgagatttggaacgacctggagaactatataaaaaagaacgaggacaaagcccgagataggttgctagccgctttcccagtatccaaggacgacgttcccgaccggctgcacgcagaatctaccccagagctgtcaagggacgtcggtcggagcgttagcacactttccctgccagagtctcaagcgctcctgactccagtcaagagcagagcaggcagagcaagtagggcaaattgcccctttgaggaggacttaattagtaaggaaggtagcttcatgtcattgaataggttgtccctcgctagcgaaatgacgctctgccaagcattatgtagagacgctgcctggtag

SEQ ID NO: 58311 - DNA, 3492 bp, Artificial Sequence
  Description of Artificial Sequence: Synthetic coding sequence
atgccggtctctacctccttacatcaagacggctctcaggaacgcccagtaagccttaccagtactaccagctctagcggctcctcctgtgatagcagaagcgcaatggaggaaccaagttctagtgaggcacctgcaaagaacggagctggaagtctgcggtcccgtcatctgcccaattccaacaataattcaagttcatggctcaacgtgaagggcccactcagtcccttcaattccagagctgccgctggccctgcccaccacaagctgtcatacctaggcagggttgtaagggagatcgtggagaccgagaggatgtatgttcaggatctaaggtcaattgtggagtcccaggaattcgatatttatacacagtactgtaacaactacccaaactcagtcgcggcattgacagaatgtatgcgggacaaacaacaggcaaagttttttcgcgacagacaggaactcttacagcatagcctgcccctaggttcatatctcctcaagcccgttcagagaatactgaaataccacctgctgctgcaggagatagctaaacacttcgatgaagaagaggatggattcgaggtagtggaagatgctatagataccatgacctgcgtagcatggtatattaatgacatgaaacggaggcacgaacacgccgtgcgactccaggagatccagtcattgctaattaactggaaaggccctgaccttaccacctatggggaattggtgctggaaggaacattcagggtgcatagagttcgcaacgaacggacgttcttcttgtttgacaagactctcctcatcaccaaaaagaggggggatcacttcgtgtataaaggcaacattccgtgttcatccctgatgcttatagaatccaccagggactcattgtgcttcaccgtgacccactataagcattcaaagcagcagtactcaattcaggcaaaaactgtcgaagagaagagaaactggacacaccacattaagaggctcattctcgagaatcaccacgctacaataccccagaaagccaaggaagcaatcttggagatggatagttattatccaaacagatacagatgctccccggagaggctgaagaaggcctggtccagccaggacgaggtttccacaaatgtgcggcagggccgtaggcagtccgaaccaaccaaacatttactgaggcaactcaatgagaaggcccgtgccgcaggaatgaagggaaaaggacggagggagtccgaatcaagccgcagctcccggagaccatctggcagaagccccacatcaaccgaaaagcgaatgtccttcgagagtatatccagtcttcccgaggtggagccggatcctgaagctggatccgagcaggaagtgttcagcgcagtcgaggggcctagcgcagaggaaactccctctgacacagagtccccagaggtgctggaaacgcagctggatgcccaccaaggattgctgggcatggaccccccaggagatatggtcgacttcgtcgctgccgaaagcactgaagatctgaaggctctgtctagtgaggaggaggaggagatgggaggagctgcccaggaaccagaaagcttgctgcctcccagcgttctcgatcaggcctccgtgattgccgaacgtttcgtaagtagcttctcgaggcggagttccgtggcacaggaggatagtaagtcctcaggctttggttctcccagacttgtctcccggtctagcagcgtgttatctcttgagggctctgagaagggactggccaggcatggatccgcaactgactccttgagctgccaattatcaccagaggttgacataagtgtgggtgtggccactgaggacagcccttcagttaatgggatggagcctccatctcctggttgtcccgtcgagcctgacagatcgagctgcaaaaaaaaagaatcagccctgtctacacgcgatagattgctgctcgataaaatcaaatcctattatgagaatgctgagcaccacgatgcaggtttttcggtgaggaggcgtgaatctctgagctacatccccaagggactggtccggaattcgatctcacggtttaacagcctccccaggcctgacccagagcccgttcctcccgttgggagtaaaaggcaagtcggatctcggcctacatcgtgggctctgtttgagctaccaggacccagtcaagctgtgaagggggatcctcctcctatttcagatgcggagtttcggccttcaagtgagatcgtgaagatctgggagggaatggagtcatccggaggcagtcctggcaaagggccagggcaaggtcaggccaatggatttgacctgcacgaaccgctcttcatccttgaggagcatgaactgggagcaattactgaagagagcgctacggcctctccggaatcttcgtcccctacggagggtcgctcccctgcacacttggctcgggagttgaaggagctcgtcaaggagctgtcctccagtacccagggtgaactggtggcaccattgcacccacgaatagtccaactcagccatgtgatggactctcatgtgagtgagagggtgaagaacaaagtttatcagcttgcgcgacagtactccctccgcattaaatccaataagccagtcatggctagacccccattgcaatgggaaaaggttgcacctgagagggacgggaagtctccaacagtgccttgcctacaagaagaagctggcgagcccctggggggaaaggggaaacgaaagccagtactgtcacttttcgactatgagcagctcatggctcaggagcactcgccgcctaagccttcctctgcaggcgaaatgtcccctcaaagattttttttcaacccgtccgccgtgagccaacgcacgactagcccagggggaaggccctcggccaggtcaccactgagtcccaccgaaacattctcttggcccgacgtcagagagctttgctctaaatatgccagtagagacgaagctaggagagctggcggagggaggcctcgcggtcctcccgtgaatcgaagccactcggtgccggagaacatggtcgagccgccactgagcgggagagtcgggaggtgccgcagccttagcactaagcgcggaaggggtgggggtgaagctgctcagagccccggtccccttccacaatccaaaccagacggcggagaaactctctatgtgacggccgacctcacactggaggacaaccgacgtgtcattgtcatggaaaaagggccactgccaagcccaactgccggactagaggagtcctccggccagggcccttcttctcccgttgcattactgggacaggtccaggactttcagcagtccgccgaatgtcagcccaaagaagagggctcaagggaccctgccgatccatcacaacagggaagagtgcgcaatttacgagagaagttccaagccctgaactctgttggttag

SEQ ID NO: 58312 - DNA, 3660 bp, Artificial Sequence
  Description of Artificial Sequence: Synthetic coding sequence
atgccagtctccacctcactgcatcaggatgggtctcaggagcgcccagttagcctgacttcaacgacctccagcagcggcagctcctgtgacagccgctcagctatggaagagccgtcatctagcgaagcccctgccaaaaacggcgctggctccctgaggtcgcgccacctgcctaattcaaacaacaatagctctagctggctgaacgtaaagggaccactttcgcctttcaatagccgcgctgcagctggacctgcccaccacaagttgtcttatcttggtcgcgttgtgagagaaatagtcgaaaccgagaggatgtatgtgcaggacctgcgatcaattgtcgaggactatctgctgaagatcatagatacacctgggcttctgaaacctgaacaggtttctgctctgttcgggaacattgagaatatttacgcattgaactcccagttactcagagatctcgactcttgtaattccgatcccgtggcggtggcttcctgtttcgtggaaagaagccaagaatttgacatctatacccaatattgtaacaactacccaaacagtgtggccgctcttacagaatgcatgagggacaaacagcaggcaaaattctttagagacaggcaggaactgctccaacactcgcttcccttaggctcctacctcctgaagccagtccagcggattttgaaatatcacctcttactccaggagatcgcgaagcactttgacgaagaggaggatggattcgaagtcgtggaagatgccatcgataccatgacctgtgtggcatggtatatcaatgatatgaagaggcggcatgaacatgccgtacggctgcaggagatccaatccttgcttataaactggaaaggacctgacctgaccacctatggagagctggttcttgaaggcacctttcgggtacacagagtccgaaacgagcggacctttttcctgtttgataagacgctgttgatcacaaaaaaaagaggggatcatttcgtgtataaggggaacatcccgtgtagtagtctgatgcttatcgaatcaacacgtgactccctatgctttacagtgacccattataagcattctaaacaacagtactcaatccaagccaagactgtggaggaaaagagaaactggacgcatcatatcaaaagattgattctggagaatcaccacgccacgataccacagaaggccaaagaagctatcctggaaatggattcatattaccctaaccgatataggtgctccccggagcgcctgaagaaagcctggagctcccaggacgaagtcagtactaacgtacgccagggaaggcgacaaagcgagcctaccaaacatctcctgaggcagctgaacgagaaagctagagcagctgggatgaaggggaaaggtagacgcgagtcagaatcttctaggagctcaaggaggccttcaggcagatcacccacttcaaccgaaaagagaatgtctttcgagagcatctcctctctcccagaggttgagccagaccccgaggccggatccgagcaggaggtgttctctgccgttgaaggcccatcagccgaggagacaccttcggatactgagtcaccggaggtgctggaaacccagctggatgctcatcagggactcctcggaatggacccacccggagatatggtcgacttcgtagccgcagaatctacagaagatcttaaggcactcagtagcgaggaagaggaagagatgggaggtgccgcacaagagcctgagtcgcttctccctccgtcagtacttgaccaggccagcgtgattgctgagcgctttgtgtcctcattcagccgacggagcagtgtggctcaggaagattcgaagagtagtggttttggttccccacggctagtctctagatcgtcaagcgtgctgtcgctggaaggctctgagaaaggtttagccagacacggctcggcgacagactcattgtcgtgccagcttagcccggaggtcgatatctccgttggagtggcaactgaagactctccctctgttaatggaatggaacctcctagcccaggatgcccggtggagcccgatagatctagctgcaaaaagaaagagtcagcgctaagtacacgtgatagactcttgcttgacaagattaagagctattatgaaaatgccgagcaccatgacgcaggattttctgtgcggagaagggagtctctgtcctatatccccaaaggactagttcgtaattctatctcccggtttaacagcttacctcggcctgacccagagccagtgccccctgtcggatctaagcggcaagttggcagtagacccacttcttgggccctgttcgaattacccggaccctcacaggcggtgaaaggcgatcctccacccatctccgatgctgagtttcgcccaagcagcgaaattgttaagatctgggaggggatggagtcatctggcggatcaccagggaagggaccaggccagggccaggctaacgggtttgatttgcacgagcctctgttcatactagaggaacacgaactgggagccatcaccgaggaatctgcaacggcttcgccagaatcttccagccccacagaaggtagatccccagcgcacctcgccagagagctaaaagagctcgtcaaggagctctcttcctcaacccagggtgagctcgtggcacccttgcacccaagaatcgtgcagctatcgcatgtgatggatagtcacgtgtccgaacgggttaaaaataaagtctaccagctggcaagacaatacagtctaaggataaaatccaacaaaccagtgatggcccgtcccccacttcagtgggagaaagtggcacctgagagagatgggaagagccccaccgtgccgtgtctgcaggaggaagcaggcgagccacttggcggaaaaggaaagcggaaacccgtcctgtctctattcgactacgagcagctgatggctcaggagcattcccctcctaaaccttcgtctgccggtgaaatgtcaccacagcggtttttcttcaacccctccgccgtctcccagcgcaccacatcacctggaggtcggcctagcgccaggtctcctctcagtcccactgagacctttagctggccagacgtgagagaactctgcagcaagtacgcatctcgcgacgaagctcgccgagccggaggaggtcgccctagggggcctcccgttaatagatcacattccgtgcccgagaatatggtcgagcctccattatcgggaagagtaggtcgctgtaggtcactgagcaccaaacgtggcagagggggtggagaggctgcccagtcacctgggcctctgccccaaagcaaaccggacggaggggagacactgtatgtgaccgccgacttgacccttgaggacaataggcgcgtgatcgtgatggagaaaggacccctgccgagcccgactgccggactagaggaatcatcagggcaggggccatcctctcctgtcgctctcttgggccaggtgcaggattttcagcagagtgctgaatgtcagcctaaagaagaaggctccagggaccccgctgatccctcccaacaggggagagttcgaaacttgagggagaaatttcaggctctcaatagtgttgggtag

SEQ ID NO: 58313 - DNA, 486 bp, Artificial Sequence
  Description of Artificial Sequence: Synthetic coding sequence
atgcctgtgtccacgtctctgcaccaggatggaagccaggaaagaccggtatccctgacttcgacaacaagcagttcgggcagtagttgcgattcacgcagtgcaatggaagaaccgtccagttctgaagctccagcgaagaatggcgctggtagcctgagatcgagacacctgcccaactccaataataacagctccagctggttaaatgttaaaggccctctgtccccattcaatagccgcgctgctgcaggcccagcacaccataaactctcatatctgggaagggtggttcgtgaaattgtggaaactgagcgcatgtacgttcaggacctgcgatccatcgtcgaggattatttgttaaagatcatcgacactcctggcctactgaagccagaacaggtgtccgcactatttggcaacatagaaaatatctatgctctgaatagtcagctcctaagagatctcgactcctgcaattcctag

SEQ ID NO: 58314 - DNA, 567 bp, Artificial Sequence
  Description of Artificial Sequence: Synthetic coding sequence
atgcctgtgtctacctccctccatcaggacggaagccaagaacggcctgtgtctttaacctcaacaactagtagttctggctccagctgtgatagtagatcagctatggaagaaccgagcagtagtgaggctccggctaaaaatggggcaggcagcctccggagccgccatcttcccaatagtaacaataactcctcgagctggctgaacgttaagggccctttgtctccctttaattcaagagctgctgccggaccagcccatcataagctgtcgtacctgggacgggtggttcgcgagatagtcgagaccgagcggatgtatgtgcaggacctccgcagcatagttgaggattacctgctgaagattattgatactcctgggctcctgaaacccgagcaagtcagtgcactttttggcaacatcgaaaacatctatgcactcaattcacagctcttgcgcgacctcgacagttgtaacagtgaccctgtagcggttgctagctgctttgtggaaaggtcccaggagtttgatatatacactcagtattgcaataactatccatag

SEQ ID NO: 58315 - DNA, 3816 bp, Artificial Sequence
  Description of Artificial Sequence: Synthetic coding sequence
atggaggctcttaggaatcctatgccgctcgggagctcagaggaggcattgggtgacctggcctgcagttccctcacaggggcaagtcgggatctgggaaccggagctgtggcctcaggcacacaagaggaaacctccggaccacgcggagatccgcaacaaactccatccctggaaaaagagcggcacacaccttctagaaccggccctggggctgccggaagaacgctcccacggaggtctcgcagctgggaaagagctcctcggagttcacgcggtgcgcaggccgctgcctgccacaccagtcaccactctgccggatcaagacctggaggccacctcggaggacaggcagtgggcacacctaattgcgtgcccgtggaggggccagggtgcaccaaagaagaagacgtcctggcttcgagtgcttgcgtgtcgaccgacggcggttccctccattgccataacccctcagggccaagtgacgtgcctgccagacaaccccatcctgagcaggagggatggccgccaggaacgggggactttccctctcaggtacccaaacaagtcctggacgtgagccaggagctgctgcagagtggtgtggtcacactgcccggtacccgggatcggcacgggagggccgtggtccaggtacggacccgttctctgctgtggacccgagagcattcttcctgcgcagaacttaccagactgctcctgtattttcattcaattccaaggaaggaagtgcgagatctggggttggtcgtcctggtagacgctcggaggagccccgctgcacctgccgtcagtcaggcgctgtcagggttacaaaacaataccagcccgattatacactctattttgttactggtagataaggaatctgctttccggcctgataaggacgcaatcattcaatgcgaggtcgtgagcagtttgaaagccgtacacaagttcgtggatagttgccagctgacagcagatctcgatggtagcttcccctactctcacggcgattggatttgcttccgtcaaagactggaacatttcgctgctaattgtgaagaagccattatcttcctacagaatagtttttgctctctcaatacccatcgcacacccagaacagcgcaagaagttgccgaactaattgatcaacacgaaacgatgatgaaactcgtcctggaggacccattgttggtatcccttaggcttgaaggtggcactgtcctggccagactccggagggaggaactgggcacagaggacagtcgcgatacgttagaggcagcaaccagtctgtacgatcgcgtggatgaggaagtgcacagactagtgcttacatctaacaatcgcttacagcagctggagcacttgcgagaactcgcaagcctcctagaagggaatgaccagcagtcctgtcagaagggcttgcaacttgccaaggagaacccacagagaactgaagaaatggttcaggatttccgtaggggactctcggcagtggtttcacaggcggagtgccgggaaggagaactggcgcgttggactaggagtagcgaactctgcgagacagtgagcagttggatgggacctctcgatcccgaagcgtgcccaagttcaccagtggctgagtgcctgaggtcctgccatcaggaggcgacatctgtggcggcagaggccttcccaggggctggagttgctgtactgaagccacacgcccttggaaagccgtgggcatcacagcaggatctatggcttcagtacccgcagacaagactaagactggaagaggctctcagcgaagccgctcctgatcctagcctgccgcctctggctcagagtccaccaaagcacgagagagctcaggaagcaatgcgaagacaccagaagcccccatcttttccttccaccgactccggtggcggagcttgggagcctgcccagccgctcagcggactcccaggcagagcactactgtgtggccaggacggcgaaaccctacggcctggcctgtgcgcactttgggaccccctgagcctcctgaggggcttgccaggcgctggcgctacaacggcgcatctggaagactctagcgcctgctcaagtgagcccacgcaaactctggcatctcgcccacgcaagcacccccaaaaaaagatgattaagaaaacccaatctttcgaaattccacagccagatagcggccctagagactcgtgtcagccggatcacaccagcgtcttttccaagggcctggaagtcaccagcaccgtggccaccgagaagaagttgcccctttggcagcacgcacgcagcccccctgtcactcagtccaggtcgttatctagccctagcggactacatcctgcggaggaggacggcaggcaacaggtcgggtcatcccgattacggcacattatggctgaaatgattgccactgagagggagtacatccgctgcctggggtatgtgatcgataactacttcccggaaatggagcgcatggacttgcctcagggcctgagggggaagcaccacgtgatatttggtaatctggagaaacttcacgactttcaccagcagcacttcctgcgggagttggaaaggtgtcagcattgtcccctcgcagtcggaaggtccttcctgcgacatgaagaacagtttggaatgtatgttatatactccaaaaacaagccccagtccgacgcactgctgagctctcatggcaacgcatttttcaaggacaaacagagggagctgggagacaaaatggatctcgcaagctacctactgagacctgtgcagagagtcgccaaatacgccttgttattgcaggacctcctcaaagaagcgtcctgcggcctggcccaaggacaagaactcggagaattacgggctgctgaagtggtggtgtgtttccagctgaggcacggaaacgacctcctggccatggatgcaatccgcggatgtgatgtaaacctcaaggaacaagggcagttgcgttgccgagatgagttcatcgtttgttgcggccgtaagaagtacctgcggcatgtgttcctgtttgaagatctcatcctcttctcaaagacacaaaaggtggaaggttctcacgacgtttacctgtataagcagtcatttaaaacggccgagatcgggatgaccgagaatgtcggcgatagcgggctgcgattcgagatctggtttaggcgcaggcgtaaaagtcaggatacctacatcctgcaggccagttcagctgaggtgaagtccgcctggacggacgtgattgggaggattctatggagacaggctctcaagtctcgcgagctcagaatccaagagatggcgagtatgggtattggtaatcagccattcatggacgtgaagccaagagatcgcaccccagattgcgcggtcattagtgacagggctcccaagtgcgcagtgatgagcgacagagtgcctgatagtatagtcaaagggacagagtcccagatgcgagggtctaccgctgtaagcagctccgatcacgccgctccctttaaaagacctcatagtactatttccgatagctcaacaagctcttccagctctcagtcgtcttctattttgggatctctgggcctgctggtgagctcaagtcccgctcatccaggactctggtccccagcccacagtccctggtcttctgacatcagagcttgtgttgaagaagatgagccggaacccgaactcgaaactggcactcaggcggcagtgtgtgagggtgctcctgccgtgctgctttcaaggactcggcaggcctag

SEQ ID NO: 58316 - DNA, 1140 bp, Artificial Sequence
  Description of Artificial Sequence: Synthetic coding sequence
atgattttcatgaataccctacgctatctgcagacacacgaatacttattagatgtcgatctgtggcgactgtttgcaaatctggaggagctgacgcagaccagcttagggttcgtgaatagcctcttcggcatcattaaggactatgtggatgccagcgagatctcatcctccctcgacttcatctccgtacttaccaaatattttcgcggatcactctgtcagtcacaccagacctattgcttaaactacagtgctgccatattctatttggaatccctccgccaaagagacgatttcggcatctacttgaagtggtgcgagcagaacgagcagtgcagaaggttgcacgtgccagaacttttggtagcccctttgcagaggcttacccgatacccactattactcaaaaatatctggaaaaggagcatggactctgccgagaaaattatgatctactcgattaaagaaaaggtggagaaatcaatccgtgatttggagggcaaggtgaagtggctcgacaatttccagaagttcagatatctgcaggagattatcgtttggccccctctgtgggaccgagacaagcgcttttttatccccgaatgcttgaaacatatctttaaggagcacatggctgagaatatcctgagccctacatctcgacatctgctttacgaaggcaaacttaccctcgccgagtctacgcggttcctggatgtgtatttatttctgttcaacgattttctgctggtgacgaagaccaagtgtaataagaaaaagcttggaggctccgatccgggtttgatgtgtccatcactcacacccgaactgcaggccgttataaaggaaggtggatcctgcactgttttggaccaaccaattcccctggatcggcttgtggttaagtccatcgagcctctccacgtttccgtcttcgggctccgtaatgcatttctgatccagcatgaaaatcgctaccgacaatgcattgcagccttcctccttcaggcacagaccgaaaacattaaaaaaacgtggatggctcaaatcactactgcaatttcatgttttactaaaagtcaggaaaccaaaaagatctcattattcacgctgcctgccgagagctcagaaatttag

SEQ ID NO: 58317 - DNA, 4095 bp, Artificial Sequence
  Description of Artificial Sequence: Synthetic coding sequence
atggccgagctgaaggtcgaagctcccgcttccgtggattggcaaaaacgttgtctgacattggagactcagctgttcagatttaggctgcaggcttctaagattcgcgagctgctggctgataaaatgcaggagctggagcagagactgctggaggccgagcagcgcgcagagaacgctgagacccaagtgggcgttatggaagagaaggtaaaattaagcaacctcaaaaatgtggactcagagggatcccttcatcggaagtaccaggagctcttaaaggctattaagggcaaagatgagcttatatctcagctagaggctcaactcgaaaaacagaaacagatgcgtgcagaggaagctaagactgttcaggagaaggccgcaaaaattaaggaatgggtgaccttgaagttggccaaattggaaatggaaaatcagcatctgaaatcacacaaccagcggctcgtcgaacaagtgggcagcctccaagatgccctcgaagccatacagattgcaccctctcggaagttactcgtccccccatacggggcagccgaacaagatagtgtcccatcagagccagggatccaacccatgggacaggactccggaagtcaggcccagggcctgaaagccgctgtgctggcgccatctccaggagctttgcagtccaaagacagcgtaagcgaagctgcatcacccttagaagattcctcttcttccaccgtccacagcggggaaaccgtggaagctaagcctctgcagccgcacctgggcagggaaagcccccctcaccaaccgtgtatgaaactccttacatttaggtgttcctccgcttcatggggcgagggacttgttacagcacaaagagggatgcttccaggcaccaaaactagtgctcgggagggtgggccaggttcttcactgacactgccaaaggttagagccccagggactcctagagactccatccagttagcaaagagacatcacagccagccgcaggttggacacggacattttgggagagtagtcaatattgaaacagaagccttcagtgccctacacccttccggtcttcccgagctcgagtctagggctagaagcagggaagaacctgagaagatggaaatggaggagcctcctcctgctggaaagaacgaggaacgcgagtcacctaaggccctcggagctgagctagaggaggtggagctcgggaacaagccccctacaccaccccttcaccagtttagtagttgggagagccgtatttatgccgtggctacgagcggcatgaggctgtctgacatgagccctcgatcaaacaccgcttgttgcgcaagttctcctccagccttagttagtcccggaagtttctcgggtcttgtgtacaagaatgtcactgtgcccgtgtacacagcgcttaaggggagagcgacccagattagtaacatgcccttcatggatgagagctctggctcggatgacgattgctcctctcaagcgtcttttagaatatcagtgccgagtagtgagagtcgtaagacgtctggcttggggtccccccgtgccattaaaaggggggtttcaatgtcttcccttagcagcgagggtgactatgctatccctcccgacgcatgttccctcgactcagattattctgagcccgaacacaagctgcagaggacctcttcctattccaccgacggcctaggattgggcggagagagtctcgagaagagcggctacctgcttaaaatggggtcccaagtaaagacttggaaaaggagatggttcgtgctacgtcagggacagatcatgtattacaaatctccttccgacgtgattcggaagcctcaagggcaggttgatctcaattcccgctgtcagattgttagaggtgaaggaagccagacgttccagcttatatccgaaaagaaaacttattacctcacagccgactcccccagcctgttggaagagtggatacgcgtcctgcagtcactacttaaagtccaggctacaggccctccggcactgttgcgaggcggaactaaaccaaccgtgaagggttggcttaccaaagtcaagcacgggcattcaaaagtcgtctggtgcgctctcgttggcaagatcttctactattatcgatctcatgaggataagagacccttgggttgtcttcccgtgcgcgacgcacacattgaagaagtcgacaggtcttgtgattctgatgaagactacgaggcaggaggaacgcgtcgactcctgagcagtcactgtacgctggttattcacccaactgaacactcgcccacttacctgctaatcggaacaaagcatgagaaggatacttggctctaccatctcacggtggcagctggagggagctctgccaaagtaggaactgcctatgagcaactgatcgggaagcttatggatggggaaggagatcccgactcacccctgtggaggcaccccatgctctgttacagcaaggacgggctgtatgcttccctcacaaccttgccctcggaggcactccagacggaggcattaaaattattcaaaagctgtcagctcttcatcaacgttcctgtcgaagcggcttcggtggactaccatgtctctctggcacaaactgccctccaggtctgcctcgtccatcctgaactgcagagcgagatctactgccagctgatgaagcaaacatcttgtcgcccacctcagaagtattccctcatgcaatgttggcagctactcgcgctgtgtgccccattatttctgccccagcatcattttctctggtatgtgaaacagcagctccaaaggcacgccgacccccgatctgagactggccagtacgccacctattgtcagcgcgctgtggagaggacgctgcgcaccggcgaacgcgaagctagaccttctagaatggaggttgtgagcattctgcttcgtaacccattccaccattctctgccgtttagtatacctgtgcatttcactaacgggacgtaccacgtagtgggcttcgatggcagctccactgtggacgaatttctgcaacgtctgaatcaagagatcggcatgcgcaagccttcccatagcgggtttgcccttttcacagatgatccatcaggtagagacctggaacattgtctgcagggatccgtgaagatatgcgatgccatctcgaaatgggaacaggcaatgaaagaacttcatcctggcaaatcggaggggggaaccagggttgtaaaattgatgtacaaaaatagattgtattttaggtctcaggtgaagggcgaaaccgacagggagcgcctgctgctggccagtcagacaagccgcgaaatcgtcgccggaagattccctattaataaagagcttgccctggaaatggctgcactgatggcgcaggtggaatacggcgatctcgaaaaacctgccctcccgggtcccggagggacaagccctgcaaaggcccaacacctgttacagcaggtgctagacaggttccatccacgcagataccgccatggcgcaccagctgaacagttacggcacctagccgacatgctaacaaccaagtgggctaccctgcaaggatgttctccccctgaatgtatcagaatttacctgactgtggccaggaaatggcctttctttggtgccaagttatttgctgcacaacctgcacagctgagttcaaaggaaaatgcccttgtgtggatagccgtgaatgaggatggggtttccatcttagatcataacacgatgcaagttcacataacatatccatacagcagtgtgacaactttcggtggatgcagggacgatttcatgctggtgataaggtcaattcccgacaagtcaagcggcaaatctcatattgaaaagcttatttttcggatggcagccccaaagattgctgaggctacgtttatcatggcaagttatatgaatcattgcaccactaccgtgaatccaccaaccaacccccctggcgcatgtcagctgtgggagctcgacggcaggcagttcttttcttctgtatcctgcgccacaaaaggtccgaccctgttgtag

SEQ ID NO: 58318 - DNA, 990 bp, Artificial Sequence
  Description of Artificial Sequence: Synthetic coding sequence
atggcggctttgatggcacaggtggagtatggcgatctggagaaacctgctctgccagggccaggcggaacttcaccagccaaggcccaacacctgttacagcaggtgctggataggtttcatcccaggaggtaccgtcacggagcaccagccgagcaattaaggcatctcgctgatatgctcaccacaaagtgggcaacactccaggggtgttcccctcccgagtgcatccgaatatacctaactgttgcacggaaatggccattcttcggcgcaaagctgttcgccgctcagcccgctcagttatcctcaaaggaaaacgcgctagtttggatcgccgtcaacgaggatggagtgtctatactggaccacaacacaatgcaggtgcacatcacctacccctatagtagcgttacgacctttgggggatgtcgtgatgacttcatgctggtcatccggtctattccggacaagtctagcggcaagtctcacatcgaaaagctgattttcaggatggcggcacctaagccccagcatcacgccgttttgagctgggtgttgacatgcagctctttaccctgcagtagtccccaggggcgtgctgacagctctctgagagctaatcaatcccggacccttggtttgttgtttagtgaaggacactgcgcctccgagaggatttccaggcctaccggagctcatacaactggacccttgaactcaaccgtgatgatacccttcggctatttcctccctgactgccggagttaccttcaccacggacaactatacgagccattgcactacaattgcgagcctcctcaccagcccacgcggtccctgcctgccgttggtactgggtggacaacagtacttttcttctgttttctatgttatcagggcgctaatgtcgccgttaacatctcccccactagatttccgaacaccacaagcgctagtggttttcgggatatttacccacgcgtctag

SEQ ID NO: 58319 - DNA, 2382 bp, Artificial Sequence
  Description of Artificial Sequence: Synthetic coding sequence
atgccactaccgggtggtctgtggtggctcctctgttgtagacgaggcttcacccttctgcatagagattacggagatggagagctgagtggcgacggagatgaagacgaggatgaagaaacctttgagcttcgcacgccgtctcccgctgggggagggcgaggcccactagaagtgaccctgacacagcccgtccggagcggcccagtttccaatcgcctccaatcttgggaagagacttggagtctgatcccagaaaaaggcctccccgaggacgatcccgacatcgtcgtaaaaggttggctctacagggagcctcgcggaggaggggctcgcccttggctaccccctaggcgggcttggttcgtactgacccgtgattcgttagatcagttcagctcctcggggaagggagctcggagactcggctctctagtattgacttctctctgcagtgtgaccggaccagaaagacggaggaaggaaacagggctttggagcgtgactgtgtcaggtaggaagcactccgttagactgtgttccccgaggcaggctgaggccgagcgatggggggtggctttgcgcgaggtgatcgcctcgaaggctcccctggagacgccaacccagcttctgctacgcgacattcaggaatcgtgcggtgacccggaagctgtggccctgatctacctgcgaaatcccatcctgcgccacacaagtggagcactgtacgcccctctgttgcctctcccatacggggtgagcgctcctgggcctggatatgcgccactcagagaggaggctgtgcggttattcctcgccttgcaggctcttgagggagcgcgaaggcccggaccactcatgcaaggcgtcttacagacttgccgagatctccccgcactcagggatgagttattccttcagcttgccaaacagacctcaggcccagctgggcctcctggactccccgcaacccaggatccagcagctttgagatattggcaattgctgacttgcatgtcctgtacctttagacccggaggggctgtccgaggtcacctgctcggccacctggagcgcacagaacaagccctcccagactcggaactggctgaatatgcacggttcatacgcaaggccctgggccgaactaggggacgagagctcgtgccatctctagcagagatttcggccctctcccagcggcaggagctgctgtgcactgtccactgcccaggcgcaggtgcatgcgcggtggccattgacagtcacacgaccgcaggtgaggttgcaagggaactggtcggcagactgggcctcgcacgcagcagaaatgcattcgccctctacgagcaacggggagcccaggaaagggccttagcaggcggtaccctcgtggcagatgtgctgactcggtttgagaatctggcggcagaggaggcgggtctcgaagactccccggatagcggctggcgactgtgtctgagacttcacggaccactgcaccctgagggcttgtctcctgacggacacgagctgccctttctgttcgagcaggcacacgcactcctgctgcgtggtcgccctccccctcctgacgatacactgagagccttagctgctctccgcctccagtcactgcagcgagacttttcgccacgcgttccactgcctagactcgaccggctcttacccccacccgcacctcctagagaagatccccctaggccaaccccgagacctccaccgtccgcggctctgctcgccggagccctctggtcacccggactggccaaacgccgagcagaaagagcacgacgaggtggggctggcaggaccgctgggtccattgccagagagggagggggaggcgctgggactgcagctgcggtgctaggcggatggaagcggctgagaggaatgggcagggctgaggctatggcagcctacttggctctggcagcgcagtgccctggcttcggggcagccagatacgatgttctggagttaagcactgagcccggtagaggcgctccacaaaaactgtgcctcggtctaggtgcaaaagcaatgtcgttaagccgtcctggtgaaaccgagcccatccacagtgtttcgtacgggcacgtggcagcttgccaactgatggggcctcatacactggctctccgggtgggagagagtcagctgctgcttcagagccctcaggtcgaggagattatgcagctggtgaacgcctacctcgctaatccctctcccgagagaccgtgcagtagtagcagccccccttgtcaggacctcccggatacaagtcccccaagtcagaggcctggtttagatgagcctcagggccagtccggttgtcttggtcagctgcaggattag

SEQ ID NO: 58320 - DNA, 1851 bp, Artificial Sequence
  Description of Artificial Sequence: Synthetic coding sequence
atgcccctgccagggggtttgtggtggctgctctgctgtagacgaggctttacattgcttcacagagactacggtgatggcgaactgtcaggcgatggcgatgaagacgaagacgaggagacatttgagctgagaacaccatcgccagccggaggagggcgaggacccttagaagttacccttacccagccagttcgctcggggcctgtgagtaaccgtttacagagttgggaggagacctggtccctaattcctgagaaagggctccctgaagatgaccctgatattgtggtgaaaggatggctgtatcgggagcctcgcggaggaggcgctagaccttggcttccaccccgtagagcttggttcgtcctgacaagagattctttagaccagttttcatcctcagggaagggagccagacgactcggatcgctggtgcttacttcgctttgttctgtcactggcccagaacggagacgcaaagaaactggactttggtctgttacagtgagcggaagaaagcacagtgtccgactgtgttctcctagacaggcggaagccgagaggtggggggtggcgttgagagaagtcatcgcctccaaggccccactcgaaacccccactcagctgttgctcagagacattcaagagagttgtggggatcctgaagctgttgcactgatctacctgaggaacccaatcctgcgacacacctctggcgcattatacgctcccctgttgcctctcccctatggagtcagtgccccagggccaggctacgcacccctccgagaagaggctgttaggctctttctggcgctgcaggcactcgaaggagctcgcaggccaggcccacttatgcaaggagtgctgcagacttgccgcgatttgcctgccctccgggacgagctctttcttcagttggcaaagcagacctcgggtccggcaggccctcccggtctaccggctacccaggaccccgctgccctaagatactggcagttgttgacttgcatgagctgcacattccggccaggcggagccgtgaggggccatctcctcggccatttagagaggactgagcaggccctgcctgatagtgagctcgccgagtatgccagatttattaggaaagctctcgggagaacccgcggtcgcgaactggtgcccagcctagctgagatatccgctctgtcccagcgtcaggagcttctgtgcaccgtgcactgtcccggagccggagcatgcgccgtggccatcgacagccacaccacagctggggaggtggccagggagctggtgggcaggctggggctagcaaggtccaggaatgcctttgcactgtacgagcaacgaggcgcacaggagcgagctttggccggaggcactcttgtagccgacgtcctgacctccctggcggctgaggaagccggtctagaggatagcccggactctggctggcgcctttgccttcgactccatggacctctgcatccagagggcctgtccccagacgggcacgagctgccattcctcttcgaacagcccgattctgcgagcctgtctgctggagcttggtcgggttacggtcatgtggccgcttgccaacttatgggaccccatacacttgcccttagggtgggcgagtcccaattgttacttcagagccctcaggtggaagagatcatgcagctggtcaatgcctatctggcgaacccaagtcctgagcgcccttgctcctcctcctcacctccatgccaagatctgcccgacaccagccccccttctcaacgaccaggcctggacgagcctcagggtcagtccggctgcctggggcagctccaggattag

SEQ ID NO: 58321 - DNA, 1095 bp, Artificial Sequence
  Description of Artificial Sequence: Synthetic coding sequence
atgtcatgtactttccggccaggtggcgcagtgcgcggtcaccttttagggcaccttgaaaggaccgagcaagctttgcccgactcagagctggcagagtatgccaggtttattcgcaaggctctgggcaggaccaggggccgtgagttggtaccctcgttagctgagatctcagccctgagtcagcgacaagaactgttgtgcacggttcactgccccggtgcaggtgcctgcgctgttgctatagactcccacacaacagcaggggaggtagcccgtgagctggtgggaaggcttgggctggctcggagtcggaacgcctttgctctctacgagcagcgtggggcacaggagagggcattggccggaggaaccttggtggccgacgtcctgactagccttgccgctgaggaagctggacttgaggattctcccgatagcggctggcgcttgtgtctgagactgcatggtcccctgcatcccgagggtctctcaccagacggacacgagttgccttttttgtttgagcaggcacacgccctgctgctacgcggaaggccgcctcctcctgacgacacactgcgcgctcttgccgctctgcgcttacagtcgctgcagcgagatttctcaccaagggttcctctacctcgcttggaccggctgcttcccccaccagctccacccagagaggacccccctaggcctacacccagaccccctccatctgccgctctactggccggagctctttggtccccgggtctcgctaaacgaagagccgagcgagcacggcgagggggtgcagggagaacagcagggtctatcgcccgtgaaggcggtggcggagcaggtacagccgcagccgtcctggggggttggaagagacttcgagggatgggacgggctgaagccatggcagcatacctggccctagctgcacagtgccctggatttggcgctgccagatctctcgtgggagtcctccacagatcatgcgcctgggcttgggaacctcggccatgtcctagtcccggacagggcagaaggtccccttccacggtcagtgctatggcgatgtggcctccagctagttag

SEQ ID NO: 58322 - DNA, 450 bp, Artificial Sequence
  Description of Artificial Sequence: Synthetic coding sequence
atgcggtacaacgagaaggagctgcaggccctctccaggcagcctgctgaaatggccgctgaactaggcatgagaggtccgaaaaaggggagcgtgctgaaaagaagactggtgaagctcgtggttaactttctcttctactttcgaactgatgaggctgagcccgtcggagctctcctgctggagagatgccgggtggtgcgggaagaaccaggaacatttagtatctccttcatcgaggatcctgaaagaaaataccactttgagtgttctagtgaggagcagtgtcaggagtggatggaagcactccgtagggcctcatatgagttcatgcgaagaagcttgatcttttaccggaatgagattcggaaggtgacgggcaaagatccactcgaacagttcggtatatccgaagaagccagattccagttgagcgggctacaggcatag

SEQ ID NO: 58323 - DNA, 3000 bp, Artificial Sequence
  Description of Artificial Sequence: Synthetic coding sequence
atggagccaggagaagtaaaggatcgaattctcgagaatatctccctgagtgtcaagaagctgcagagttattttgccgcatgcgaagatgaaatccccgcaattagaaatcacgacaaggtgcttcagcgactttgtgagcatctggaccatgccctgctgtacgggctgcaggatctctccagtggctattgggtgttggtggtccactttacaagacgagaggccattaaacagatcgaggtgctgcagcacgttgcaaccaatttgggacggtcacgcgcatggctgtatctggccttgaacgaaaatagtttggagagctaccttagattgttccaagaaaatttgggactgctgcacaaatactacgtaaagaacgcgctcgtgtgttctcacgatcacttgactctgttcctcactttagtgtcgggtctagagtttattcggttcgagctcgacctcgatgcgccatatctggatctggctccttacatgcctgattactataaaccccagtacttgttggactttgaagatcggcttccctctagcgtgcacggttcagactcgctcagtctgaactcattcaactctgttacctcgaccaatttagaatgggacgatagcgctattgccccttcttcggaagacggtgaccttaccgacactgtgagcgggccacgtagtactgcatcggatctgacgtccagcaaagcctccacaaggtccccaactcagcgccagaacccgttcaatgaggagcctgccgagaccgtgagcagcagtgatacaacaccagttcataccacatctcaggagaaggaggaagcccaggccctcgacccgccagatgcctgcacagagctggaggtgataagggtgactaagaagaagaagatcggtaagaaaaaaaagagtcgctcagatgaagaggcttctcccttgcatccagcctgttcacaaaaaaaatgtgccaaacagggggacggggatagcaggaacgggtcaccttcactcggcagagactcccccgatacaatgttggcatcccctcaggaagaaggcgaaggcccttcctcaaccacggaatcatctgagagatccgagcctggtcttcttatacctgaaatgaaggacaccagtatggagagacttggacagcccctttccaaagtgattgatcaactgaatgggcagctcgacccatcaacttggtgttctagggccgaacctcctgaccagtcattccggaccgggtcacctggagatgcccctgagagacccccattatgtgatttttccgaaggcctttcagcccctatggatttctatcgatttaccgtcgaaagcccaagtaccgtgacaagcggcggaggacaccacgacccagccggtctaggccagcctctgcacgtcccttcttctcccgaagccgctggacaggaagaagagggcggagggggagagggacagaccccacgacctctggaggataccacacgggaggcccaggaactggaagcacagctctcactggttcgcgaaggacctgtgtccgaacctgagcctggcacccaggaagtgctgtgtcaactgaagcgggaccaaccttccccatgcctgagtagcgccgaggactcaggcgttgacgagggccagggcagtcctagtgagatggtccattccagcgagtttcgcgtcgacaacaaccatctgctcctcctaatgattcacgtattcagagaaaatgaggagcaactctttaaaatgataagaatgagtactggacacatggaggggaatctgcagttgctgtacgtgttattgactgactgttatgtctacctcttgcggaagggcgcaaccgagaaaccctatctcgtagaagaggcagtttcctacaatgagctggactacgtctcagtgggccttgaccaacagaccgtaaagctggtgtgcacaaacaggcggaagcagtttctcctggacactgctgatgtagcactggcggaatttttccttgcctccctgaagagcgccatgataaaagggtgccgcgaaccaccatatccgagcatcctcaccgacgctactatggagaagctcgcactggccaaatttgtggcccaagagtcaaaatgtgaagcttcagccgtgactgtccggttctacggactggtgcactgggaagaccccaccgacgagtcgctagggcctaccccgtgtcactgctccccccctgaaggcacaatcactaaagaggggatgctgcattacaaagctgggacctcctatctgggtaaagaacattggaaaacgtgtttcgtggtcttaagcaacggaatcctttatcagtaccctgacaggaccgatgtgattcccttgctctctgtcaacatggggggtgagcagtgtggcggttgccgcagagccaatacaactgacagaccacacgcttttcaggtgatactgagcgaccgcccttgtctggagctcagtgcagagagcgaagctgagatggccgaatggatgcaacatctgtgccaggccgtcagcaagggagtgataccccaaggggttgccccaagtccttgtattccctgctgcctggttctgactgatgaccgcctgttcacatgccatgaggattgtcagactagcttttttagaagccttggcacagctaaactgggagacatttcagccgtttcaacagagcctgggaaggaatactgtgtgctcgagtttagtcaggatagccagcaactactccctccatgggtcatttatctgagttgtacttcagaactggatcggcttctcagcgccttaaatagcggctggaagacaatttaccaggtggacctcccacacactgccatccaggaagcatccaacaaaaaaaagtttgaggatgcactgagcctgattcactcagcctggcagcgcagcgatagcctttgtaggggtagggcctccagagacccatggtgttag

SEQ ID NO: 58324 - DNA, 2154 bp, Artificial Sequence
  Description of Artificial Sequence: Synthetic coding sequence
atggaggcactggaggtcgacgacatttcacccgcactagaagtgaccgaagagttttttagtacactcgactcaaacttggagaaggccgtgcagcaggccgaagtgtacggcatccaggaagtgccagagctggtcggccacgaagttctctcaaacatcacagataatggagcaatgagaaatgtcacttcactgggcaaaggcggtatgatatgggaccactgtaaaagccggctgctggagactaaggctcagaatgttttccccgcaaaagagcagtttatggttcaaaggggtactacgccggacaacttgtcatggatggaacagaaggaagccagtacattcaatttttttaatatatgccagcgacgccgagaccggccacggagcgtgaatgacttgctggacgaaacgagcactttcaagcctggccatgccaggtcccgctcagacattactcaggtggattggagagtagtattgaagactacgccattgcaacagcaacaacagcagcagccgctactgcaaggtccccacgtaacacgaccttcctttttactgccatcaccaaataagatcgaagacgcccagggaaacaccgaacacaaacaaacatttcctaatattctgaaaaaggggtacttagagatacgaaaagaccacgatagctactggcagagctgctacgccgaactgtccccttacaatttgtacttctacagcttagacagctccgggaaccagaacctgtatgcaacatatcagctatcacacttccaatctatctccgtcctgggaaatctagaagcaaggatggttgacacagtcttatacgacaatacccaacttcagcttaaggctgagagcccatgggaggctttggattggggtcagaagttatgggaggttgtccatgcggctgttcccggatacatgggcaggcagaacgaactcacgatcagtcccggactgggccatcacgatgactatactcagaatcactccttccagaagaagaccagtgggctgctacccccaagccctgtacttgattctagcaagcaataccagaatatcttgaagtccggtaccttgtatcggctcaccgtgcagaacaattggaaagcgtttaccttcgttctcagccgggcatacttaatggccttccaaccgggtaaattagacgaagacccgctgctctcttacaacgtcgatgtatgtctcgctgtccagatggacaacctggacggctgtgattcttgtttccaggtcatttttcctcaagacgtcttgcggttgagagccgagacacgtcagcgggcacaggagtggatggaagccttgaagatagccgcaaacgttgccagaagcagcgaacaaaacctacaggtcacccttcgcaataagcctaaggaccagatgggaggccacgaacttaggaaaaacaagcggcagtccgtgactactagttttctgtctatcctgaccactttaagtcttgagagaggattgacagctcagagctttaaatgtgcaggctgccaaaggtcaatcggtttgtccaacgggaaagccaaggtctgtaactactccgggtggtactactgttcctcatgtcatgttgatgattcatttctcatccctgccagaatcgtgcataactgggacacctcaaaatataaagttagcaagcaagctaaagagttcctggagtatgtctacgaggagccccttatcgatatccaacaggaaaatgccatgctgtaccatcacgccgaaccactcgccgctgtgctccggctacggcagcgtcttaagtccctcagagcctatctgtttagctgtagagcagccgtggccgaggatctgagaaggaggatattcccacgcgaatacctcctgcagcagatccacctgtactccttggcagacctccagcaggttatcgagggtaagttggctccatttctggggaaggtgatcaaatttgcaacttcacacgtatacagctgtagtctttgctctcagaaggggttcatttgtgaaatttgtaacaatggggagatactgtatccattcgaggacatatcaacctcccggtttggagatccatacgccgacctgttgcagggatacgtagcgtag

SEQ ID NO: 58325 - DNA, 2286 bp, Artificial Sequence
  Description of Artificial Sequence: Synthetic coding sequence
atggaagctctagaagtggacgacatttcacccgcattggaggttacggaggaattctttagcaccttggattcaaacttggaaaaggctgtgcagcaggccgaggtgtacgggatacaggaagtgccagagctcgtcggccacgaggttttaagtaatatcactgacaacggcgctatgaggaatgtgactagcctgggaaaagggggaatgatctgggaccattgcaagtctagattgttggaaacaaaggctcagaatgtgttccccgcaaaggaacaattcatggttcagagggggaccaccccagataatttgtcctggatggagcagaaagaggcctcaacctttaacttcttcaacatctgtcagaggaggcgggatcgaccaaggagtgtcaacgatctcctggacgagacttcaacattcaagcccggacatgcacggagtagaagtgatattacccaagttgactggagggtggtcttaaaaaccacccccctacaacagcaacagcagcagcagccacttctgcagggacctcacgtgacaaggccttcttttcttttaccaagcccaaataagattgaggacgcccaggggaacacagaacacaaacagacctttccaaatatcctgaagaaagggtatctggaaatccgcaaggatcacgactcctattggcagtcgtgttacgccgaactgagtccctataatttgtacttctattctctcgactcaagtggcaaccaaaacctatacgctacatatcagctcagccatttccaatcaatctctgtactgggcaacctggaagcacgcatggtcgataccgtactgtacgataatactcagttgcaactaaaggctgagtctccatgggaggccctcgattggggtcagaaactttgggaggttgtacatgcggcagtgcccggttacatgggccgtcaaaatgaactgacgatttctcccggattagggcaccacgatgactatacacagaaccactcttttcagaaaaagaccagcggcctgctccccccttccccagttttggattcctccaagcagtaccaaaatatactcaagtccggcactctgtaccgccttactgtgcagaacaattggaaagccttcacctttgtgctgtctcgcgcttatctgatggcttttcaacctggcaagttggatgaagaccccctgctttcttataacgttgacgtgtgccttgcagttcagatggataacttggacgggtgcgacagttgtttccaggtaattttccctcaggacgtactccgcttgagggctgaaactcgccagcgggcacaagaatggatggaagcactgaagatcgcagctaatgttgcaagatcttcagaacagaatctacaagtgacactgaggaataaaccaaaagaccagatgggcggtcacgaactccgcaaaaacaagaggcaatcggttactactagtttcctgagcattttaaccactctaagcctggaaaggggcttaaccgcccaaagttttaaatgtgcagggtgccaacgttccatcgggttatcaaatgggaaggcgaaggtgtgcaattattcgggttggtattattgctcttcgtgtcatgtagacgacagttttctgatcccggctaggattgtgcacaactgggatacttctaagtataaggtttccaagcaggctaaagagtttttggagtacgtttacgaagagcctcttattgacatacagcaagagaacgccatgttataccatcatgcagagccactggctgcggtgctgcgcttgcgacagcgtctcaaatctcttcgcgcatacctattcagctgtagggcggcagttgcagaggaccttagacgccgaattttccctagagaatatcttcttcagcagattcatctgtactctttggcagacctccagcaggtgatagagggaaagttggctccctttttggggaaagttattaaatttgcaacatcacacgtctacagctgttcactctgctcccagaaaggattcatatgtgagatctgtaacaacggggagatcctgtacccctttgaggatataagcacttctagatgtgagtcttgcggagcggtcttccatagcgagtgcaaggaaaagagcgtaccctgtccacggtgtgtcagacgcgagcttcaaaagaagcagaagagtttctggcagcgtctgaacatggacgagtctctcgaggaggcttgtaccatgtttgaactgtcttaccagaatacctag

SEQ ID NO: 58326 - DNA, 1410 bp, Artificial Sequence
  Description of Artificial Sequence: Synthetic coding sequence
taaaaccagaacctttatgccacttatcagctgagccacttccagtctatctccgtattgggaaacttagaggccagaatggtcgacactgtcctctacgacaacacccagctccagctgaaggccgagagcccctgggaagcactggattggggtcagaaactgtgggaagtggtgcacgccgcagttcccggttatatggggcgacaaaatgagttgactatttcaccaggcctaggccaccacgatgactatactcagaatcatagctttcagaagaagacctccgggctgctgccaccgtctccggtcctggattcaagcaaacagtaccaaaacatccttaagtctgggacactgtatagacttaccgttcagaataactggaaggcttttacgtttgtactcagccgggcttacctgatggcctttcagccaggtaagctcgacgaagatccgctgctgtcatacaacgtggacgtatgcctggccgtgcagatggataaccttgatgggtgcgattcttgtttccaggtaatcttccctcaggacgtgctgagactgagagcagagactcgacagagagcccaagagtggatggaggctctcaagatagccgcaaacgtcgccaggtcctccgagcagaacctgcaggtgacactccggaacaagcccaaagatcagatggggggacacgagttaagaaagaacaaaagacaatctgtgacaacgtcgttcctatccattctgacgacactgtctctggaacgcggactgaccgcgcagtcttttaagtgtgccggttgccagcggtctataggcctgtccaacggtaaagctaaggtctgcaactattccgggtggtactactgctcaagctgccatgttgacgattcgttcctgatacctgctcgtattgtccataactgggatacctcgaaatacaaggtctccaagcaggcaaaagagttcttggaatacgtttatgaggaacccctcatcgatatccagcaggaaaatgctatgctttatcatcacgcagagcctctcgctgccgtgttacggcttcgtcagagactgaagtcactgcgcgcttatttgttcagttgccgggctgcagtcgcagaggatctgcggcgaaggatttttccgagggaatatctgcttcagcagatccatctgtactctctggccgacctgcagcaggtcatcgagggcaagctagccccatttttgggcaaggtaattaagtttgccactagtcatgtgtacagctgctccttgtgctcccagaagggattcatctgcgagatctgcaacaacggggagatcctctacccattcgaggacatatctacatctaggtttggagatccgtacgccgatttgctccagggctacgtggcctag

SEQ ID NO: 58327 - DNA, 1731 bp, Artificial Sequence
  Description of Artificial Sequence: Synthetic coding sequence
atgggaaattctcactgtgtcccccaggcaccccgacgcctccgggcaagcttcagtagaaaaccaagcctgaaaggcaatcgcgaggactctgctcgaatgtcagcaggtctgcccggacccgaggcggctcgctctggggacgctgctgctaataaactgttccactacattcccggtacagatatcctggacttggagaaccagcgggaaaatctggagcagccatttttgtcggtgttcaaaaaaggcaggcggagagtcccggtgagaaacctgggaaaagttgtacactacgctaaggttcagctcaggttccaacactctcaggacgtcagtgattgttacttggagctgttcccagcccacctgtacttccaggcccatggctcagagggactgaccttccaaggcctgctgcctctgactgagctcagcgtctgccccctggaaggatcaagggaacacgcattccagatcacgggacccctccctgctccgcttctcgttctgtgcccttctcgggctgagcttgaccggtggctgtatcacttagaaaagcagaccgcgctgcttggcggacctagacgatgccatagtgcccctccacagggttcgtgtggggacgaattgccgtggacactgcagagaaggctcacaaggttaaggaccgcctcaggacacgagccaggaggatcagctgtatgtgcatctagagtgaagctgcagcacctgccagcccaagagcagtgggacagattgctggtgctctacccaacctctctagctatattttctgaggagctggacggtctgtgcttcaaaggggaactgccgctgcgtgccgtgcacatcaacttagaagagaaggaaaaacagatcaggtccttcttgattgagggccctctgattaacaccatccgggtggtctgtgcatcatacgaagattacggccattggttgctgtgccttcgggctgtgacacacagggagggggctccaccactaccgggagccgaatctttcccgggaagtcaggtaatgggctccggtcggggtagtctgtccagcggaggccaaacaagctgggacagcggttgtctcgcccctccatctacaagaactagtcattctctgccggagagctcggtgccctctaccgtgggctgctctagtcaacacaccccacttcaccgcttgagcttagagtcaagccccgacgcacctgaccacacctcagagacatcccactcccctctgtatgctgacccttacaccccgccagctacctctcacagacgcgtgaccgatgtccgcggactggaagaatttttaagtgccatgcagtcagcacgcggtcctacaccaagcagccctctgcccagcgtaccggtatccgtcccagcgtcagatccccgtagctgctcctctggcccagcagggccttatttgctcagcaagaaaggcgcactgcagtctagagcggcacagagacaccgaggctcagccaaggatgggggaccacaacctcctgatgcaccacagctcgtttctagtgcacgagaggggagtcctgaaccgtggttacctctgacagatgggaggtcacctcgtcgctctcgagaccctggttacgatcacctgtgggacgagacactgagcagttcccaccagaaatgtcctcagctgggcggtccggaagcgtcagggggtctggtgcagtggatatag

SEQ ID NO: 58328 - DNA, 1992 bp, Artificial Sequence
  Description of Artificial Sequence: Synthetic coding sequence
atgggtaatagccactgtgtgcctcaagcaccgaggcggctccgcgctagcttttcacggaaaccttcactcaaaggaaatagggaggattctgccagaatgagcgcaggcttacccggtccagaagcagccaggtccggcgacgcagccgcaaacaagctgttccactatatcccaggaactgacattcttgacctggagaaccagcgcgagaatttggagcagccatttctgtcggtgttcaagaagggcagacgacgggtgccggttcggaatctcggcaaggtagtgcattacgctaaggtccagttgagattccagcatagccaggacgtcagcgactgctacctggagctttttcccgcacatctgtactttcaggcccacggatctgaggggctcaccttccagggactgctgccactaaccgagctatccgtctgtcccttggagggcagtcgtgaacacgcattccaaattacgggagtctgggatgcttcccgagcccctaggggcacgccggaccctggtctgggtgagggacctgccctgtggctgcggagtacttgcgtctatgtttgcgccctcagtgccttgccggctgggcctcttccagcaccgctcctggtgctgtgccccagccgagcggagttggatcgttggctgtatcatctcgaaaagcagaccgctcttctaggtggccctagaaggtgtcactcagctcctccccagggctcctgcggagacgagctaccgtggaccctgcagcgaaggctgacgcggctgcgaaccgcaagcggtcatgaacctggcggatctgcggtgtgtgctagccgggttaagctgcagcatctccctgcccaggagcagtgggacaggcttcttgttctgtacccaaccagcctggctatcttttcagaagaattggatggcttgtgctttaaaggtgagcttcctttaagggcagtacatatcaacctagaggagaaggaaaagcagatccggagcttcctaatcgaaggaccactgataaatacaatcagggtggtttgcgccagttacgaagattacggccattggctcctatgtctgcgcgctgtgacacaccgggagggcgctccacctctaccaggtgctgagtcattccccggatcacaggtcatgggctctgggagggggtccctttcatccggcggtcagacatcatgggattccggatgcctggctccaccttccacccgcacttcacacagcctcccagaaagcagcgtgccatccaccgttggttgctcaagccagcacacaccagatcaggctaattcagatcgcgcttcaattggacgtcgtcgaacggagctacggaggagcggaagctcccgatctccaggatccaaagctagagccgaaggtcgaggcccagtgacccctttgcacctcgacctaactcagttgcacaggttgagcttggagagctcaccggacgccccagatcacacctcagagacctcccacagcccattatacgccgatccctatacgcctccggcaaccagtcaccggcgagtgaccgacgtgcggggattagaggaattcctttctgccatgcagagcgctcgtggacccacgccctcgagtccgctgccttcagtcccagtatccgtgcccgctagcgatcctcggtcctgcagtagcggaccagctgggccttacctgctgtcgaagaagggtgcactccaatctcgcgctgcccaacggcatcggggaagcgcgaaagacggtggaccacagccaccagacgccccacagctcgtgtccagcgcaagagagggttctccagaaccctggcttcctctgactgatgggcgatccccaagacggagtcgcgatccaggttatgaccacctatgggacgagactttgagttcgagccaccagaagtgtccacaactcggcggtcctgaagcttcggggggattggtgcagtggatctag

SEQ ID NO: 58329 - DNA, 1836 bp, Artificial Sequence
  Description of Artificial Sequence: Synthetic coding sequence
atgggaaattcacactgtgtgccccaagctccgagacggctgagggcgagcttcagtagaaaaccatctttgaaaggcaaccgcgaggacagcgcgcgaatgtcagcaggcttacccggtcccgaagcagcccgtagcggagacgccgctgctaataagctgtttcactacattcctggcaccgatattctcgatctggaaaatcaaagagaaaacctcgagcagccctttcttagcgtgtttaaaaaaggaaggcggagagtgccagtcaggaacctcggaaaagttgtacactacgccaaggtccagctgcgatttcaacactcccaggatgtcagcgactgttacctggaactgtttcctgcgcacctctattttcaggcccacggctctgaaggtttaacctttcaggggctgctccccctcactgaactgagcgtttgccctctggaggggtctcgagagcacgctttccagatcactgggcctctccccgcacctctcctggtactgtgtccatccagagcagaattagatcgctggctctaccaccttgaaaagcagaccgccctgttaggcggaccgaggaggtgtcattccgccccaccacagcggcgactcacgcgcctgaggaccgcaagcgggcacgaacccggagggagtgctgtctgtgcctctcgcgtgaaacttcaacatctgccagcacaagaacagtgggaccggcttctggtgctgtaccctacaagcctggcgatctttagcgaggagctggatggtctatgcttcaagggagagctgcccctgcgcgctgtacatataaatttagaagagaaagagaaacagattaggagctttctgattgagggacccctgattaacacaattagggttgtttgcgcctcctatgaggactatggccactggctgctctgcctgcgggctgtgacacatagggagggggctccacctctgcctggcgcagagagttttccgggatctcaagtgatgggtagtggcaggggatcactctccagtgggggacagacctcctgggacagtggttgtctcgctccccctagcactcggacctcccactctctgccagagtccagcgtaccctccaccgtcggatgcagtagtcagcacacccctgatcaggctaacagcgaccgagcgagtataggcaggcggagaacggaattacgtcgaagtggcagctcccgtagtccaggatctaaggcccgtgctgagggccgtgggcctgtcactcctctgcacctcgatctgacacagctgcatcgcctctcgctggagagttcacctgacgcacccgaccatacatccgaaacgtcacattccccgctgtacgcagacccctacacacccccagccactagtcatcgcagggttacagacgtgcgagggctggaagaatttctctcggccatgcaatccgccagggggcctacaccatcctcccccctccccagcgtcccagtctctgtgcctgctagcgatccacggtcctgtagcagtggtcctgctggaccttacttgctcagtaaaaaaggcgctttgcagtcaagagcagctcagaggcaccgcggtagtgcaaaggatggaggcccacagcctcctgacgcaccacaactggtgagttctgcccgtgagggcagccctgagccctggctgcccctgactgacggcaggtccccacgcaggtcaagagaccctggttatgaccatttgtgggatgagaccctgtcttctagccaccagaaatgccctcaactagggggaccagaagccagtggtggcctcgtgcagtggatatag

SEQ ID NO: 58330 - DNA, 1473 bp, Artificial Sequence
  Description of Artificial Sequence: Synthetic coding sequence
atggaggaggagggagtgaaggaagccggagaaaagccacggggtgcccagatggtagacaaggctggttggatcaagaagtccagcggcggactgctgggcttttggaaagatcggtacttgcttctgtgtcaggcccaactcctggtctatgaaaacgaggatgaccagaaatgcgtcgaaaccgtggagctaggcagctacgagaaatgccaggacctgcgcgctctcctgaaaaggaaacaccggttcatcctactcaggtcgccaggtaacaaagtctcggacattaagtttcaggcaccaacaggcgaggaaaaggagagctggatcaaggccctgaacgagggcattaatagaggtaaaaataaggcattcgatgaagtgaaggtggataaatcttgcgcacttgaacatgtgactcgtgatcgcgtgcgcggagggcaaaggcgccgaccccctactcgtgtgcatctaaaggaggtggcatccgctgcctctgatggactcctgcggctcgatcttgatgtccctgactctggacccccagtattcgcgccaagcaatcatgtgagcgaggcccaacccagagagacgcctcgtcctctgatgcctccaaccaagccatttctggcccctgagaccacaagccccggtgaccgagtcgagacccctgttggggagcgggctcccacaccggtctctgcatcttcggaggtatcaccagagagccaagaggactctgagacccctgcagaggaagactcagggtccgagcagccacctaacagcgtgttacccgataaactgaaagtgagttgggaaaacccctcccctcaggaggccccagccgcagagagcgcagagccttcccaggctccatgtagtgaaacatccgaagccgctccacgagaaggtggcaaacctcccacccctccaccgaagatcctgtccgaaaagctaaaagccagcatgggtgaaatgcaggcttcaggaccgccagctcctggcacagtccaagtcagcgttaacggtatggatgatagccccgaaccagccaaaccctcacaggcagaggggacgcctgggactccacctaaagacgccacaacatccacggctctgcctccttgggatctgcctccccagtttcatccaaggtgtagttctttgggggatctgctcggtgaaggccctagacaccctctgcaaccccgagaaagactttatcgggcacaactcgaagttaaggtggccagcgagcagaccgaaaagttattgaataaggtgttgggctcagagcctgccccagtatccgccgagaccctactctcacaggccgtagagcagctcagacaggctactcaagtattgcaggagatgcgggatttaggtgagttaagccaggaagctcccggactacgcgagaaacgtaaggaattggtgaccctgtaccgcaggtccgctccctag

SEQ ID NO: 58331 - DNA, 672 bp, Artificial Sequence
  Description of Artificial Sequence: Synthetic coding sequence
atggaggaagagggcgtgaaggaggctggcgaaaagcctagaggagcccagatggtcgataaggccggatggatcaagaagtccagtggcggactgttgggtttttggaaagataggtatctactattgtgccaggcacagttactggtgtacgagaatgaggacgatcagaaatgcgtggaaaccgtggagttaggcagctatgagaaatgccaggatctgcgagcactgctgaaaagaaaacatcgtttcattctcctacgctccccaggtaataaggtaagcgatataaagttccaggccccaacgggcgaggaaaaggaatcatggattaaggctctcaacgagggcatcaaccgtggtaaaaacaaggcctttgatgaggtcaaagtagataagtcatgtgccctggagcacgtaacgagagatagagttcggggtgggcaaaggaggcgcccacccaccagagttcacttaaaagaggtcgccagcgccgctagcgacggcctgttaagactggacttggatgtccccgattcgggacctcctgtgttcgctcctagcaatcatgtgagcgaggcccagccgagagaaacccctcgacctctgatgcccccaactaagccttttttggcccctgagacaacaagtccatcatcacaccttttctag

SEQ ID NO: 58332 - DNA, 1923 bp, Artificial Sequence
  Description of Artificial Sequence: Synthetic coding sequence
atggggacgcggagctccccagaagaggggaccccccctcccctggtgccagagtgcgatgttgaagtgcagccccaggggcaccccgaagagtcacgcgagcaagaggcctccgaagttctcgcggagccatcttccagaggcggtgcagaacaacaagcggaagaagaagaggtgggcgagggatccagtaccgaatctagtagggacgccccagaggccacaccccctattgcaatggccgctactccgcctgcatccacctcctcacgtgagggtgtcagaggcgctgctcgcagactccagggccagcagcttgaggcactaacaagagtggcactaatggagcagagggtcaaggaattgcagagacaaaggaaagagctccggatcgagatggaagtggaggtcgcgctgttaaggggagaactcgctggtgaaagggtggcggctcgtagagaggaagagcaactgagagagctcctggaacagcaggccgcttctgaacagagaggacgacagcagagggagcaggaacagcgcagactgagccaggaacgcgaccgattagagggcctgaggcagcgtctcaggaaagcacaggggcagctggactcgcagccagaagaccaacgggaaagactgctccagggagtccaagagatgagagagcagctggatgtcgcccaaagggcatacgaagacctggaattccaacagctcgagagagagagcagacaagaagaggaggatcgcgactcaccaggcccacaggtcccagatcccaaagtgcaagaactccaagcttcaatggcgcagcaccgacgcggagctttgcagcaccgaataagagtcctggaggagcagctgaaaagcctcggagaacaaatggccgcagaaagccgcggactctcccgcaaaaaggaagaggcactccaagcactttcacaggagcggtctcgcctcctcgagctcaattgccttcaaggaactcccggtggagactttagtgaaccgaacccagctctcaccaagctcctctttacgcagaagacggatcggcagcttctcgtcttacaggatgccgttgctcactcagcggctaccccaactagcagctgcctctttagtgtgcattcctccttgcaaggcagtattggtctgcagcgcaccggttctctgcccagaaagagaggtgagagaggctcccagcggggaagccctcgtccattaagtttccattgcacggaaagcctggaagcatccgctctccccccagccgtgggcgatagcgggagataccccctgtatcagctgttgaactgcggccgaggcaattcctgcggcgcaatccacccagacattgcacacatggagaggttgctgcagcaggctatggctgagagggaacgactgttgaaggcacgtgaggggaccagacggggaaccgagggttcaagcggacccgcagtccctgccataaccgcacccccaactcctccccaccctcccggaccaagaatactggacctccggcaacatttggaggggtgggggcacaaccccgagaactgcccacacgttcaagtgtctggatgttgttgtcgagggccattggtgaaaatgggcggtcgcattaaaacatggagaaaacgctggttctgcttcgacaggcaggccaggcggctggcttattatgcagacaaggaggaaaccaagttgaagggggtgatctactttcaggcgatcgaagaagtatattacgatcatttgcgctgcgcatttaagtctccaaatccccgtttgacgttttgtgttaagacatatgagcgcctgttctacatggtcgcaccatctcccgaggccatgcgaatttggatggacgtgatagtcaccgcggctgacgagaaccacgccccatag

SEQ ID NO: 58333 - DNA, 528 bp, Artificial Sequence
  Description of Artificial Sequence: Synthetic coding sequence
atggccgaagcctcatccgctaatctgggttctggatgcgaagaaaaaaggcatgagggctcctcaagtgaatcagtgccacccggtactaccattagccgggtcaaactgctggataccatggtggacactttcctgcaaaaactcgtggccgcaggttcttaccagcggtttacagattgctataagtgtttttaccagctgcagccagccatgacgcaacagatctatgataaattcattgcccaactgcagacttccattcgtgaagagatcagcgacatcaaggaggagggtaacctagaggccgtgcttaatgctcttgacaagatcgttgaggagggaaaagtgcgcaaggaaccagcctggtgcgaagcccaacggtgccgcgtgcagcaacgctgtagcctgtgtgttcaggccggaggccagcggggatcagaagaaacacaggcactgccagtatcaatggctggctcgccttcccctctgcccggatcccccggagctcaggagggcggagtgtag

SEQ ID NO: 58334 - DNA, 663 bp, Artificial Sequence
  Description of Artificial Sequence: Synthetic coding sequence
atggccgaggcaagctccgcaaacctgggctccgggtgtgaagagaagcgccacgaagggtcttcctccgagtccgtcccccctggcaccacaataagcagagtgaagcttttggacactatggtggacacgtttttgcaaaagctggtggcagccggtagttatcagcggttcaccgattgttacaagtgtttttatcagctgcagcccgctatgacacaacagatctacgacaagttcattgcacaactccagacttccattcgggaggagatttcagacatcaaagaagaagggaatctggaggctgttctcaacgcacttgacaaaatagtggaggaggggaaggtgcggaaggaacccgcttgtaacggtactccttgcggtgctatgtgtcgcaatcgaagaccccgtacatccagctggcagatgccatcatggcagggaggtggtaggtggaggtcctgctcttatcgcagtagaccatccagccggcctggtaggtgcgaagcccagagatgccgtgtccaacagagatgtagcctgtgcgtccaggctggcggacagcgaggcagtgaagagacccaggccctacccgtcagcatggccggtagccccagcccactgccaggctccccaggggctcaggaaggcggagtctag

SEQ ID NO: 58335 - DNA, 2010 bp, Artificial Sequence
  Description of Artificial Sequence: Synthetic coding sequence
atggcccatcatctgcccgcagctatggagtcgcatcaggacttccgttcaatcaaggctaaatttcaggcctctcagcctgagcccagcgatctgccaaagaagcctcccaaaccggagttcgggaagctcaaaaagttttcacagccggaattgagcgaacatccaaaaaaggcacccctgccagagtttggcgctgtgtctctcaaaccccctcctcctgaagtaactgatctccccaagaaacccccacccccagaggtgaccgatttgccaaagaagccacctccccctgaggtgactgacctcccgaagaaacccccacctcctgaggtgacggacttgcccaaaaagccctccaagttggagttgagtgatctgtcgaagaaattcccacaactgggcgctacacctttcccaaggaagcctctccaacccgaggtgggcgaggcacccctgaaggcgtctctgccagaacctggcgctcccgcaagaaagccactccagccagacgaactgtcccacccagcgaggccaccctccgagcccaagtcaggggcattcccgaggaagctatggcagccggaggcaggagaggctacaccgcgtagccctcagcccgaattaagcacctttcccaaaaagcccgctcagcctgagttcaacgtgtaccccaaaaaaccaccacagcctcaggtcggaggcctccccaagaagtctgtccctcagccggagttctctgaggcagcacagacaccactctggaaacctcagtcatcggagccgaagagagactcatccgcctttccaaaaaaggcatcccagccaccactgtccgacttcccaaagaagccgccacaacccgagctaggtgatttgacacgcacaagctccgagcctgaagtctctgtgctacctaagagacccaggcccgctgagttcaaagccctttctaagaagccgcctcagcccgaactcgggggacttcccaggacctcgtcagaacctgagttcaatagtcttccacgcaaattgctacagcccgaaagaagaggcccacccagaaaattcagccagccagaaccatccgccgtattgaagcggcaccctcagcctgaattctttggggatctgcctaggaagccaccactgccctcctctgcctccgaatcttctttgcctgccgctgtggccggattcagtagtcgccatcctctaagccccggatttggggctgccggaacccctcgatggaggtcagggggtctggtccacagcggcggtgcaagacccggtctccggcctagtcatccccctaggaggaggccgcttccccctgccagtagcctgggacatcccccagccaagccacctttgccccctggcccagtagacatgcagtcctttcgcaggccgtcagctgcaagcatcgatctcagacgcacaagaagcgcagccggacttcacttccaggacaggcagcccgaggacatcccggtgcccgacgagatctatgagctttatgatgacgttgaaccacgggatgatagcagtccctcacccaagggcagggacgaggcccctagcgttcaacaggcagctcggcgaccccctcaggatcccgcattgcgaaaagagaaggaccctcagccccagcaattgcccccaatggaccctaaactgctgaaacaattacggaaagctgagaaggccgagcgggagtttaggaagaagttcaaattcgaaggggaaatcgtggtgcacactaaaatgatgatcgaccctaacgcaaagacccggcgaggcggtggcaaacatttgggcatccgtaggggcgagatattggaggtaatagaatttacctccaatgaagagatgctttgtagggatccgaagggcaaatacggctatgtgccacgaaccgccctcctgcccctggaaaccgaagtgtatgatgacgtagacttttgtgatcctttagagaatcagcctcttccattgggtcgctag

SEQ ID NO: 58336 - DNA, 2013 bp, Artificial Sequence
  Description of Artificial Sequence: Synthetic coding sequence
atggcccaccatctgccagccgctatggagagtcatcaggattttcggtccatcaaggctaaatttcaggcaagccagccagagcctagtgatttaccaaaaaaaccccctaagcccgaatttgggaaactcaaaaaattctcccaacccgagctcagtgaacaccctaagaaggcccctctcccagagttcggcgctgtgtccctgaaaccacctcctcctgaggtaaccgacctccctaagaaaccacccccaccagaagtcacagacctgcccaaaaagccacccccaccagaggtcactgacctaccaaaaaaacctcctcctcctgaagtgactgacctgcccaaaaagccaagcaaactggaactgagcgacctgtcaaagaaatttccacagttgggcgcaacccccttcccaagaaaaccactgcagccagaagtgggggaggccccactgaaggctagcttgcctgagcctggagcccctgcgaggaaacctttacagcctgacgagcttagccaccccgctcgccctccttcggaaccaaaaagcggagcgtttcctaggaaattgtggcagcctgaagctggggaggcaaccccaagatcgccgcagccagagctgtctacctttccaaagaagcccgctcagcctgagtttaacgtgtaccccaaaaaaccccctcagcctcaagttggcggtctgccaaagaaatcagtgcctcagcctgaattcagcgaggccgctcagacccctctctggaaaccacagagctccgagccaaaacgggatagtagcgcttttcccaagaaagctagtcagccccctctctcagactttcctaagaaaccaccacagcctgaactcggtgacctcaccaggacctccagcgagcctgaggtgagtgttcttccgaaacgtcctcgaccagcagaattcaaggcgctgagtaagaagcctccccagcccgagctcggaggtctgcccaggactagctctgagccagagttcaatagccttccccgaaagttgctccagccagaaagaagggggccacctcgtaagttcagccagccagagccctcagcagtactaaagaggcatccgcagccagagttcttcggcgaccttcccaggaaaccacctctacccagctccgccagcgagagctcactgccggcagcagtggccggattttctagcagacatcccttgagccctggtttcggcgctgccggaacccctcggtggcgaagcggcggattagtgcatagcgggggagctcgcccaggcttgagacccagtcatcccccacgcaggcgtcctttacctccagccagttcacttggccacccccctgccaagccgccacttccaccagggccagtggacatgcagagttttcggaggcctagtgccgctagcatcgatttaaggagaactagaagtgctgccggactccactttcaggacagacagcctgaagacatcccacaggtccccgacgagatctacgagttatatgacgatgtggaacctagagatgatagctccccttcccctaaaggacgcgatgaagcgccatcagtccaacaggctgcaaggcgtccacctcaggatcctgctcttcgtaaggaaaaagatcctcaacctcagcagctgcctcctatggaccccaagctgcttaagcaattacgcaaggctgagaaggctgagcgtgaattccggaaaaaatttaaatttgagggagagattgttgtacacaccaagatgatgatcgatcccaatgccaaaacaagacgtgggggaggtaagcaccttgggatcagaagaggcgagattctggaggtcatagaattcacctccaatgaggaaatgctgtgcagagacccaaaggggaagtatggctacgtcccaaggaccgcgcttttgcccctggaaacagaggtgtatgacgatgttgatttctgcgaccctcttgagaatcagcctcttcctttgggtagatag

SEQ ID NO: 58337 - DNA, 72 bp, Artificial Sequence
  Description of Artificial Sequence: Synthetic coding sequence
aaattctcccagccagaggtcgcggaagggatgtcccgacagaatctcgggctaaagttgagagggcgatag

SEQ ID NO: 58338 - DNA, 1320 bp, Artificial Sequence
  Description of Artificial Sequence: Synthetic coding sequence
atgagtaagactatggctatgaatctgctagaagactggtgcagaggtatggaggtggatattcaccggagcctgttggtgactggtatccctgaggactgcggccaggccgaaatcgaggaaacgcttaatggcgtccttagtccccttggaccctaccgagttctgaacaaaatctttgtgagggaagaaaacgtgaaagccgcattgattgaggtgggagagggggtgaatctgtcaacaattccccgtgagttcccgggtcggggtggtgtgtggcgggtggtgtgtcgggacccgacacaagatgccgaatttctcaaaaacttgaacgagttcctagatgcagaaggccgaacatgggaggatgtcgttcggttgctccagttgaaccaccccaccttaagccaaaaccagcatcagccgcctgagaactgggccgaggccttgggggtgcttctcggagcggtcgttcagataatcttctgcatggacgcggagattcgcagcagagaagaggcgcgtgcacaggaggcagcagaatttgaagaaatggctgcgtgggcactcgcagccggtaggaaggtgaagaaagagcctgggttggcggctgaggtgggatctgcgctgaaagccgaaacgccaaacaattggaacgccacagaggatcagcacgagccaaccaagcctctagttcggagggctggggcaaagtcccgcagcagacgaaaaaaacagaagaaaaacagcaggcaagaagcagtcccttggaagaagcctaaaggcataaatagcaactccaccgccaatctggaagaccctgaggtgggagatgctgagagcatggctattagcgaacccattaaggggtcacgaaaaccttgcgtcaacaaggaagaactagcactcaagaagccaatggctaagtgcgcatggaagggtcccagagaaccaccccaggacgcccgtgcagaggccgaaagtcccggaggggcaagtgaatcagaccaagatggcggacacgaaagccctccaaagaagaaagcggtggcttgggttagcgcaaagaatccagccccaatgagaaaaaagaagaaagtcagtctggggccagtttcctatgttctggttgatagcgaagacgggcgaaaaaaacccgtgatgccaaaaaagggccctggttctcgacgagaggcgagcgaccagaaggccccacgtgggcagcagcccgctgaagccactgcttctaccagtcgagggccaaaggcaaagccagagggaagccctagacgtgctaccaatgagtcccgaaaagtttag

SEQ ID NO: 58339 - DNA, 615 bp, Artificial Sequence
  Description of Artificial Sequence: Synthetic coding sequence
atgtctaagactatggcgatgaacctcctcgaagattggtgccggggaatggaggtggatatccaccgttctctgcttgtgactggcatacctgaagattgcgggcaggctgaaattgaggagactttaaacggcgtgctctcccccttgggaccttaccgcgtcctcaataagatcttcgtcagggaagagaatgtgaaggctgccctcattgaagttggggagggcgtaaacctctcgaccatccctagagaatttccgggaagaggaggcgtttggcgtgttgtgtgtcgtgaccccacccaggatgccgaattcctgaagaacctcaatgaattcctcgacgctgaaggacggacttgggaagatgtggtgaggctcctgcaactgaatcacccgacattgagtcagaatcagcaccagcccccagagaattgggctgaggcactcggagttcttctgggcgcagtggtgcaaatcatcttttgcatggacgccgaaataagatcgcggagggaggagggcgaggaacggaccggcgcatgctccagggggggattttgtctgaaaggacgggacccacagcagctggaatgtcacggaagaccagcctag

SEQ ID NO: 58340 - DNA, 1137 bp, Artificial Sequence
  Description of Artificial Sequence: Synthetic coding sequence
atgtcgaagacaatggcaatgaacctgttggaggattggtgtcggggaatggaagttgacatccataggtctttgctggtgacaggcatcccagaagattgcgggcaagcagaaatcgaagaaactctaaacggcgtgctgagccctcttggtccttacagagtcttgaacaagatattcgtcagggaagagaatgtcaaagctgccctcatcgaagtcggggagggagttaatctttctaccatcccaagagaatttccaggtaggggcggtgtctggagagtggtttgccgggatcccacacaagacgccgagttcctcaaaaacctcaatgagttcctggacgccgaaggccgaacgtgggaagatgtggtccgattactgcaacttaaccaccctactctgtctcagaatcagcaccagcccccagaaaactgggctgaagcccttggcgtccttttgggggcagtggtccaaataatcttttgtatggatgcagagatacgcagcagggaggaagccagggcacaggaggccgcagagttcgaagagatggccgcatgggccctggccgcaggaagaaaagtgaaaaaagagcctggcctcgccgctgaagtgggctcggcgctgaaggcagagacaccaaataattggaacgctacagaggatcagcacgaacccactaagcccctcgtccgtcgtgccggtgctaagagtcggtcccgcagaaaaaaacagaagaagaatagcagacaagaagccgttccctggaagaaacctaagggtattaactccaactccactgctaatttagaagacccagaagtaggtgacgccgaaagcatggcaatatccgagccaatcaagggcagtcgcaagccctgcgttaacaaggaggagcttgctctgaagaaacctatggctaaatgtgcttggaaggggccaagagagcctcctcaagacgccagggccgaggccgaatctcctggcggtgctagcgaatccgaccaggacgggggtcatgaatctccccctaaaaagaaagccgttgcttgggtgagcgccaagaaccccgctcctatgcgcaagaaaaaaaagaatcctgagcgatttgatctgggtgaccatccctattag

SEQ ID NO: 58341 - DNA, 840 bp, Artificial Sequence
  Description of Artificial Sequence: Synthetic coding sequence
atggcaatgagtctcttgcaagactggtgtcgcagcctggacgttgacgcccacagggccctcttggtgacaggcattcccgaaggactcgagcaggctgacgtcgaggctgtactacaaccaacactgttgcccttaggcacctttcgactgagacacatgaaggccttaatgaatgagaaggcacaggcagcacttgtcgagttcgtggaggatgtcaaccacgcagccatacctagagagattcctggcaaggacggagtatggagggtgctgtggaaagaccgcgctcaggataccagggtcttgcgccagatgagaagacttctgctcgacgacggtcctacgcaggcggctgaagcaggcactcccggagaagctccaacacctcctgctagcgagactcaggctcaggattccggggaagtaaccggccaggccggttctctgctgggcgcagcaaggaatcctaggcggggacgccgaggccgtagaaaccggacaaggcgaaaccgccttactcagaagggcaaaaagcgctctcggggaggccgaccttcagctccagcacgaagtgaagccgaggactcttccgacgaatccctcggtattgtaattgaagagattgaccagggagacctgtccggcgaggaggaccagagtgccctgtatgctacccttcaagcggctgcacgcgaattagtgaggcagtgggctccgtgtaatagtgagggcggtccctgccccacatgcccttgggagggcataggaggcttcgggtgtgatcttacagtacaaaccaggttaagtcagtcatacgtaagggatacacagatgtag

SEQ ID NO: 58342 - DNA, 1221 bp, Artificial Sequence
  Description of Artificial Sequence: Synthetic coding sequence
atggcctggtgcgtagcgaccgccgacccagcccacacctctaggcctctgtttacaggcctggctgtgagcagaggatcagctggacacgcctggtcagccggttttgattgggctgcggtggtcgtggtcacaggcagaagatgtaggtccggtcagacagtccccggtgccgctagatcccctcttctgccacatcccctccccagcccactgagagtaccaccacccacaggtgctctaggcaggccactgcctcgatggccccagccacggaggactcccttctggtctgtgatttcaaaagccacgaagttaaggtctcctccgtggaccagtgcaccaactgcaagtaacctcgagagggaccgcaggatctcacggatagaccctattcgaagccccaccatggcgggaggcctgtttgcggtttcgaagaagtatttccagtacctgggaacatatgacaccggcatggaggtgtgggggggtgagaacttagagctctcctttagagtttggcagtgcggcggaaaattggagatccatccgtgctcacacgttggccacgtctttcctaaaagagcaccttacgctcgcccaaattttctgcagaataccgcacgggcagctgaggtgtggatggacgaatacaaagagcacttctataatagaaatccgccagccagaaaagaggcttatggcgacatttctgaacgtaagcttctcagagagcggctcagatgcaaaagcttcgactggtacctgaagaacgtctttcccaacctgcacgtccccgaggacaggcccggttggcatggagccatccgttcccgcggaatctctagcgagtgcctggactacaactctcccgataacaatccaacaggtgccaacctgagcctgtttggctgccacggacagggcggaaaccaattcttcgagtacacttccaacaaggagattaggtttaattccgtcacagagctgtgcgcagaagtccccgagcaaaagaactatgtggggatgcaaaactgtccaaaggacggctttccagttccagccaatattatctggcacttcaaggaagatggtaccatcttccacccgcattccggcttgtgtttgtcagcataccgaactccagagggcagaccggatgtccaaatgaggacatgtgacgccctcgataagaatcagatttggagttttgagaagtag

SEQ ID NO: 58343 - DNA, 1728 bp, Artificial Sequence
  Description of Artificial Sequence: Synthetic coding sequence
atggcgtcggccacggaggatccggtattggaaaggtatttcaaaggccataaggccgctattaccagtctggatttgagccccaatggaaagcaactgggtgctggcagggcaagggaactaggctcccggcgattgtcagaccttcagaagaacacggaggacttgagtcgccctctctataagaagccccctgccgattcccgggctctgggggagtggggtaaggcctctaaactgcagcttaatgaggatgaattgaagcagcaagaagaactcatagagcgctacgcgatcaacatttaccttagcgatagaattagcttacacaggcatatagaggacaaacgcatgtatgaatgtaaatcccagaaatttaattacagaacactgcctaccacgtccgtgattatagccttttacaacgaggcatggtcgacactgcttcgcaccatccactcagtactcgagacctcccctgcggtacttctgaaggagattatactggtggacgacctgagcgaccgggtctacttaaagacccagctggaaacatacatttcaaacttagatcgggtcagactaattaggacaaacaaaagagagggcttggttagggctagactcatcggcgctacattcgccacgggcgacgttttgacctttctggattgccattgtgaatgtaactcagggtggctggagcctctactggaaagaatcggacgcgatgagactgccgtggtctgcccagtgattgacacaatcgactggaatacattcgagttttatatgcagatcggagagccgatgatcggtggctttgattggaggctgaccttccagtggcattccgtgccaaagcaagaacgagacaggcggatttcaaggatcgacccaattcggtcccccactatggccggaggcttgtttgcggtctccaagaagtattttcagtacctgggaacatatgatacaggcatggaagtctggggaggggagaaccttgagttatctttcagagtgtggcaatgtggcggaaagttggaaatccatccatgctctcacgtgggacacgtatttcctaaacgagctccttacgcacggccaaactttctacagaacaccgcacgcgcagcagaggtgtggatggatgagtacaaggagcatttctacaacaggaatccacctgcccgtaaagaagcgtatggggatatatcggaacgcaaactgctccgcgaacggcttaggtgtaagtcattcgactggtatctgaagaatgtgtttcctaaccttcatgtcccagaggataggcccggatggcacggtgctatccggagccggggaattagtagtgaatgtctggactataatagcccagataataatcccaccggagctaacctcagcttatttggatgccacggtcaggggggaaatcagttctttgaatatacttcaaataaagaaatcaggtttaactctgtgactgagttgtgcgccgaggtacctgagcagaagaactacgtgggcatgcagaactgcccgaaagatggctttcctgttcctgcgaacataatatggcactttaaggaagacgggaccatatttcatccccatagtggcctctgtcttagcgcctacagaactccagagggaagaccagacgttcagatgcgcacctgcgacgccctggataagaatcagatctggagctttgaaaagtag

SEQ ID NO: 58344 - DNA, 1476 bp, Artificial Sequence
  Description of Artificial Sequence: Synthetic coding sequence
atggaaaatgaggagtctgacgtgaaacctcctgattggcccaatcccatgaacgcgactagtcagttcccgcaaccacagcacttcgattccttcggacttcgcttgccacgagacatcaccgaacttcctgagtggagtgagggttaccctttctatatggctatggggttccctggatacgacttgagcgctgatgatatcgcgggaaagtttcagttctccaggggaatgcgccgtagctacgatgcgggtttcaagctcatggtggtggaatatgcagagtctacaaacaattgtcaagctgcaaagcagtttggtgtgctggagaagaatgtccgtgattggaggaaagtgaagccgcagctgcagaatgcgcatgccatgaggagagccttccgaggaccaaagaatggtcgcttcgcactggtggaccagcgagttgctgagtacgtgcggtatatgcaggccaagggcgaccctattacgcgtgaggccatgcagctaaaggccttggagatcgcccaggaaatgaacattcccgagaaaggtttcaaagcctccttgggttggtgcagaagaatgatgcgtagatacgacctgtcccttcgtcataaggtgcctgtcccccagcacttgcccgaagatctgaccgagaagttggtaacctatcagcgcagtgttctagcgctccgcagagctcacgactatgaggtggcccagatgggaaatgcggacgaaactcccatttgcctggaagtgcccagtagagtgactgtcgataaccagggagagaaacccgtgttagtgaagacacctgggagggagaaactgaagatcacagccatgttgggtgtcctcgctgacggtcgtaagctcccgccatatatcattttgcggggaacctatattccgcctggtaaattcccttcaggaatggagatcaggtgtcataggtacggctggatgacagaagacctcatgcaggattggctagaggtggtttggcgtaggcggacgggcgctgtgccaaaacagcgtggcatgctgattctgaacgggttccggggacacgctaccgactctgtgaagaactcaatggaaagcatgaataccgatatggtcataatcccaggcggattgaccagccagctacaggtgctggatgtggtcgtatacaaaccactgaatgatagtgtgcgcgctcaatactctaattggctgttggctggcaacctggctctcagccccactggaaacgccaagaagccccctttaggcctgtttctggagtgggtcatggtcgcttggaattctatcagctcggagtcaatcgttcagggattcaaaaaatgtcacatctcttcaaatctggaggaggaagacgacgtgctctgggaaatagagtctgagctaccaggaggaggcgaaccaccgaaagattgtgatacagagagcatggccgagagcaattag

SEQ ID NO: 58345 - DNA, 1011 bp, Artificial Sequence
  Description of Artificial Sequence: Synthetic coding sequence
atgtacaccgtattgacgggcacgccaccgttcatggcctctccgctctctgaaatgtaccagaacatcagggagggtcattacccggagccggcacatctcagtgctaatgcaaggcggctgattgtgcatcttctggcgcctaatcccgctgaaagacctagtttagatcatctgctccaggatgatttcttcacgcaaggtttcacgccagaccggctacctgcccacagctgtcacagtcccccaatattcgcaattcctccgcctcttgggaggatcttcaggaaggtcggccagcggttgttgactcaatgccgacctccgtgtccttttacccctaaagaagcttcaggcccaggggagggaggtcccgaccccgacagcatggagtgggatggggagtcctcactttccgcaaaggaggtgccctgcctggagggtccaatccacctcgtggcccagggtactctccagagcgatctcgctggtccagaaggttctagaagacccgaggtggaggccgctttgaggcatctgcaactttgtttggatgtaggccctccggctacacaggatcctctgggtgagcagcagccgatactgtgggccccaaagtgggtggactattcctctaaatacgggtttgggtaccagcttctggatggcggtcggacagggcgacacccacacgggccagcaacaccccgacgcgagggcaccctgccgacgcccgtacccccagccggtccaggactctgcctgctaaggtttctggctagcgagcacgcactgttattactttttagcaatgggatggtgcaagtgtcctttagcggcgtccctgcacaactggtgctgtccggagaaggtgaggggttacaattgactctttgggaacagggctcacccggtacttcctatagcctagacgtgcctcgatcacacggctgtgcaccaaccaccggccagcatctccaccacgccctgcgtatgcttcagagcatatag

SEQ ID NO: 58346 - DNA, 1893 bp, Artificial Sequence
  Description of Artificial Sequence: Synthetic coding sequence
atggatattaagggccagttttggaacgatgatgactccgaaggcgacaatgagagcgaggagtttctctacggggtgcaagggtcctgcgccgctgacctataccggcatccccagctggacgctgatattgaggccgtgaaggagatctacagtgaaaacagcgtatcaattagagaatatggaaccattgacgatgtggacatcgacctgcatatcaacatatcctttctcgatgaggaagtgagcactgcgtggaaagttctgagaaccgagcccattgtgctgcgacttcgattctcacttagccagtacctcgatggaccagaacctagtattgaggtctttcagcccagtaacaaggagggattcggactgggactgcagcttaagaaaatcctcggcatgttcacctcacagcagtggaaacacttgtcaaacgatttcttgaaaacccagcaggagaagagacatagctggttcaaggcatccggaaccatcaagaaattccgcgctggcctgagcatcttttcacctattcccaagagcccatcattccctatcatccaggatagtatgctgaaaggaaagctgggggtcccggagcttagggtgggacgactgatgaaccgctcaatctcctgtactatgaaaaacccaaaggtggaggttttcggctaccctccgtccccacaagccggtttgctgtgcccgcagcacgtcggactgccgcctccagctcgtacctccccacttgtgagtggacactgcaagaacatccccaccttggaatatgggttcttggttcaaatcatgaaatacgcggagcagcggattccaacgttgaatgagtactgtgtagtgtgtgacgagcagcatgtcttccaaaacgggagtatgttgaagcctgctgtgtgtacaagagaactttgtgtatttagcttttacactctcggcgtgatgtcaggggctgccgaagaggtggcaacaggagccgaggtcgttgacctgctggtggcaatgtgcagagccgctcttgaatcccctcggaaatcgattatttttgaaccgtacccttctgtggtggatcccaccgatccgaagacactagcattcaacccaaagaaaaagaactatgagcggctgcaaaaagcccttgacagcgtgatgtccattagagagatgacccaaggaagctacctggaaatcaagaagcagatggacaagctcgacccattggcccacccgttgctgcaatggattatttcttctaaccggtctcacatcgtcaagctgccactgtcaagactgaaatttatgcataccagccatcaattcttattgttgtctagccccccagctaaggaagccagatttcggacggcaaagaagctgtacggtagtacttttgccttccacgggagccacattgagaattggcactctatcctgagaaacgggctggttaatgccagctacaccaagctgcagctgcatggcgctgcctacggaaagggaatttatctctcccccatatcgagcatatcgtttggatattcagggatgggaaagggccagcatcggatgcccagcaaggatgagctggtgcagagatataacaggatgaataccattccccaaacaagatctattcagagtagatttctgcaatcacgcaacttgaactgcatcgccttgtgcgaagtgatcacttcgaaggatctgcagaagcatggcaacatctgggtgtgccctgtttctgatcatgtgtgtactcgctttttctttgtttacgaggacggccaggttggagatgcaaacatcaacacccaggatcccaagattcagaaagagatcatgagagtgattggaacccaggtctatacaaactag

SEQ ID NO: 58347 - DNA, 405 bp, Artificial Sequence
  Description of Artificial Sequence: Synthetic coding sequence
atgctgcttgtcctcctgagcgtcgtgctgttggccctgtcatctgctcaatcgactgacaatgatgtcaactatgaggatttcactttcaccattccagatgtggaggactcatcacagcggcctgaccagggcccacagcgaccacctccggaggggttactgcctaggccacccggtgactccgggaatcaagacgatggtcctcagcaaagacctccaaagccaggcggacaccacagacacccccctcctcctccatttcagaaccagcaaaggcctcctagaagaggccatcggcagctcagtcttcctagattccctagcgtcagcttacaggaagcatcgagtttctttcaaagggacaggcccgctagacatcctcaggagcagccactgtggtag

SEQ ID NO: 58348 - DNA, 699 bp, Artificial Sequence
  Description of Artificial Sequence: Synthetic coding sequence
atgttccacaaagccgaagaactctttagtaagactactaataatgaagtggacgatatggatacaagcgatacccagtggggttggttttatctggcagagtgcgggaaatggcatatgttccagccggacactaactcccaatgcagcgtttccagcgaggacatcgagaagagtttcaagacaaatccatgtggaagcatatctttcactacgagtaaattttcgtataaaatcgactttgcagaaatgaagcaaatgaaccttactaccggtaaacaaaggttgatcaagcgtgcccctttctcgatttcagctttcagttatatctgcgaaaacgaggctatccccatgcctccccactgggaaaatgttaacactcaggtgccataccagttgattcccctgcataaccagacacacgaatataacgaagtagccaatctgttcgggaaaaccatggacagaaacaggattaaacgaatccagaggattcagaacctcgacctctgggaatttttttgtagaaaaaaagctcagcttaaaaagaagagaggagtaccgcaaatcaacgagcagatgctttttcacggaacttcatctgaatttgtggaggcaatctgtatacacaatttcgattggcgcataaacgggattcatggcgcagtgtttgggaaagacaatatgtggaaactgtag

SEQ ID NO: 58349 - DNA, 774 bp, Artificial Sequence
  Description of Artificial Sequence: Synthetic coding sequence
atgtgggaagtcgctcacgttagcgaaatgaaacagatgaacctgaccaccgggaagcaaagacttatcaagagagcacctttctccatttctgcttttagctacatttgcgaaaatgaagccatcccgatgcccccacactgggaaaacgtgaacacccaggtgccgtatcagctgatacctctgcacaaccagactcacgaatacaacgaggtggcaaaccttttcgggaagactatggatcggaataggattaagcggatccaaaggatacagaacctcgacttgtgggaatttttttgcagaaaaaaggcgcagctgaaaaaaaaacgaggggtacctcagatcaatgaacagatgttattccatgggacctcgtctgagtttgtggaggcaatatgtattcataatttcgactggaggataaacgggatacacggagctgtgtttggaaaaggaacctattttgcgagagacgctgcatacagttccagattctgtaaagacgacatcaagcacgggaacacctttcagatccatggtgtaagtttgcaacagcgtcacctgttcagaacttataagtccatgtttcttgcacgcgtgctgattggcgactacatcaatggagattccaagtacatgcggccaccttcaaaagatgggtcctacgtcaacttgtacgacagctgtgtggacgacacctggaatcccaagatcttcgtcgtatttgacgccaaccagatttatcccgagtacctgatcgactttcattag

SEQ ID NO: 58350 - DNA, 774 bp, Artificial Sequence
  Description of Artificial Sequence: Synthetic coding sequence
atgtgggaggtcgcccacgtatccgagatgaagcagatgaacttaacgacaggcaaacagagacttatcaaaagagctcctttttctatctccgctttctcgtatatatgtgaaaatgaggctatcccaatgccaccacactgggaaaacgtcaacactcaggtgccttatcagcttatccctctacacaatcagacacatgagtataatgaggtggccaatcttttcgggaaaacaatggacaggaatcggattaagcgaattcaacggatacagaacttagacctctgggagttcttttgcagaaagaaggcacagttgaaaaaaaaacgcggagtgccgcaaataaacgagcagatgcttttccatggaacatcctctgaattcgtggaggctatctgtatccataactttgattggcgcattaatggaattcacggagcagtgttcggtaaaggaacatattttgcaagagacgcagcatactcctcccgtttctgtaaagacgatatcaaacacggcaacaccttccagatccacggagtctcactgcagcagagacacctgtttaggacttataagtcgatgttccttgcaagggtactcataggtgactacattaacggtgatagtaaatacatgaggccaccaagcaaggatggcagctacgtgaatttgtatgattcatgcgttgatgacacttggaacccaaagatttttgtcgtatttgatgccaatcagatctatcctgagtatttgatcgactttcattag

SEQ ID NO: 58351 - DNA, 141 bp, Artificial Sequence
  Description of Artificial Sequence: Synthetic coding sequence
atgaaatggatgacgtggacccgccagattccttccggagccggtttcacatggcagaacgtggggtcaggcacttgtttctctagaattcccacagtatctgtgcagcttgcggtgaaaatcagtaaaaaggccagttag

SEQ ID NO: 58352 - DNA, 1557 bp, Artificial Sequence
  Description of Artificial Sequence: Synthetic coding sequence
atggacatcaaaggccagttctggaacgacgacgatagcgaaggagacaatgagtccgaagagttcctgtatggggtgcaggggtcctgtgcagcagacctgtataggcaccctcagcttgatgctgatatagaagccgtgaaggaaatatactctgaaaattccgtatctatacgagaatatggaaccatcgatgatgtggacatcgaccttcacatcaatattagttttctcgatgaagaggtttcaacagcttggaaggtgcttaggactgaacctatagttcttagattgcgtttcagtttaagccaatacctcgatggacccgagccatccatcgaggtatttcaaccttctaataaagagggcttcggtctagggctgcagctgaaaaagattttaggcatgtttactagccagcagtggaagcatctgtcaaacgatttccttaagacgcaacaggaaaagaggcattcttggtttaaggcctctgggactatcaagaaattccgcgctggactttccattttttctcctatccctaagtcaccctccttcccaatcatccaggacagcatgctgaagggcaagttgggcgtgcccgagttgcgggtgggcaggctcatgaatcgcagcatctcctgcaccatgaaaaacccgaaagtggaagtgtttggttacccacccagcccgcaggccggactactctgtcctcagcatgttggcttgcccccacctgctcgaacgagcccgctggtatcagggcattgcaaaaatatcccaaccttagaatacggttttcttgtccagattatgaagtatgccgagcaaaggattcctacactgaacgagtattgcgtggtgtgtgacgagcaacacgtcttccagaatgggtctatgctgaagccagccgtgtgtacaagagagctgtgtgtgttttccttctacacactgggcgtcatgtcaggcgcagcagaagaggttgccacaggagcggaagtggtggatctgctggtggccatgtgtcgcgctgctctcgagagtcctagaaagtctatcatctttgaaccatacccgtcagtcgtcgacccgacagaccctaagactctcgcctttaacccaaagaagaagaactacgagagactgcagaaagccctggattctgtaatgagtatacgcgagatgacccagggctcctatctggaaattaagaagcagatggataagctagacccactggcacatcccctgcttcagtggattatttcttccaaccggagccatattgtgaagctcccactgagccggctgaagtttatgcacacgtcccaccaattcctcctgctcagctctccacctgccaaggaggctagattccggaccgccaagaagctttatggatccacatttgctttccatgggtcacacattgagaactggcattcaatcctgagaaacgggctggttaacgccagctatacaaaactgcaggaatgggagaaggactccacagggtgtcctcctcgaatgagctggtcgcgcgataccaccgggtag

SEQ ID NO: 58353 - DNA, 1893 bp, Artificial Sequence
  Description of Artificial Sequence: Synthetic coding sequence
atggatattaaaggtcagttttggaacgatgacgacagtgaaggcgataacgaaagtgaggagtttttgtacggagtgcaggggtcttgcgcagccgatttgtacaggcatccccaactcgatgcagacatcgaggccgtgaaagagatatatagcgaaaatagtgtttcgattagagaatacggtacaatagatgacgtagatatcgacctccacatcaatataagctttctggatgaggaggtctctactgcttggaaggtgttaaggaccgagcccatcgtcctgcgactccggttctccctgtcgcagtatcttgatggtcccgaaccctcaatcgaagtttttcaaccctccaacaaggaaggtttcggcttgggacttcagcttaagaagatattgggaatgttcacctcgcagcagtggaagcacctgagcaatgacttcttgaagacacagcaggagaaaagacactcctggttcaaggcaagcggcaccatcaaaaaattccgtgcaggcctgtctattttttccccaatccccaagagtcccagtttccccattatccaagactcaatgctcaaagggaaattaggtgtgcccgaactccgggtcggacgcctgatgaatagatccatcagttgcaccatgaagaatccgaaggtggaagttttcggataccctccgtctccccaggcgggtttactgtgccctcagcacgttggactgccgccaccagctcgtacctcaccgctggtgtctggtcactgtaagaacatccccacccttgaatacggcttcttagtacagataatgaaatacgctgaacaacgaattcctacactcaatgagtattgtgtggtctgcgatgagcaacatgtgtttcagaacggcagcatgcttaagcccgcagtttgtactagggaattgtgtgtcttttccttttacaccctaggcgtgatgtccggcgctgcagaagaggttgccacgggcgctgaggtggtggacttgctggtcgccatgtgtagagcggctctggaatcgcccagaaagagcattattttcgaaccctaccctagtgtcgtggatcctactgacccgaaaacactggcattcaatcccaagaagaagaactacgaaaggctacaaaaggccctggactccgtcatgtccattagggagatgacacaggggtcttacctggagatcaagaaacaaatggacaaactcgatcctttggcccatcccttgttgcagtggattatttcgtccaacaggagccatatagtcaagttaccactctcaaggctgaagttcatgcacaccagccaccagtttctgctcctgtcgtcaccaccagccaaggaggcacgattcagaacagccaagaagttgtatggtagcacgtttgccttccacggcagccatattgagaactggcactctattctccggaacggcctggttaatgcaagctacacaaaactgcagcttcacggcgcagcatacggaaagggaatttatcttagccccatttcttctataagctttggctactcgggcatgggtaaaggccagcacaggatgccctcaaaagatgagcttgtgcagcggtacaataggatgaataccattccccagacccgctccattcagtcaagattcctgcagtcccgtaatctgaattgcattgcactttgtgaggtgattacatcaaaggaccttcagaagcatggcaatatctgggtgtgtccagtatccgaccacgtttgtacaaggttcttctttgtctatgaggatgggcaggtcggcgatgctaacatcaacacacaggacccaaagattcagaaggaaattatgcgtgttatcggaactcaggtctatacaaactag

SEQ ID NO: 58354 - DNA, 1167 bp, Artificial Sequence
  Description of Artificial Sequence: Synthetic coding sequence
atggatattaagggacaattctggaacgacgacgacagcgagggcgacaatgagtctgaggagttcctgtacggtgtgcagggatcatgcgctgcagatctgtaccggcatccccagctagacgcagatatcgaagccgtcaaggagatctatagtgagaactctgtgtcaatacgcgagtatggtaccattgatgatgtcgacattgatttgcatattaacataagctttctggacgaagaggtcagcacagcctggaaggtcctgaggactgagcccatcgtgttacgactccgcttttccctgtcccagtacctcgacggtcctgaaccaagcattgaggtattccagccatcaaacaaagagggattcggcctcggtttgcagctcaaaaaaatactcggcatgttcacatcacaacaatggaagcacctgagcaatgacttcctgaaaacacagcaggagaaacggcatagctggttcaaggcctcaggcaccattaaaaaatttcgcgcaggactgtcaattttctccccaatcccaaagagcccaagttttccaatcatccaagacagcatgttaaaaggaaagctcggcgtcccagagcttcgcgtgggacgcttaatgaaccgtagtataagttgcaccatgaaaaacccaaaggtggaggtcttcggctatccgccttcgccacaggccggattgctttgtccccagcatgtgggcctaccaccccctgcaaggacctctccccttgtgtcaggtcactgcaagaatataccgaccctggaatacggctttctagtacagattatgaaatacgccgagcagaggatccccactctgaacgaatattgcgtggtatgcgatgaacagcatgtctttcagaacggatccatgctcaagccagcagtgtgcaccagggaactctgcgtgttcagcttttataccctgggtgtaatgtctggagccgctgaggaggtggctacaggagctgaggtcgtcgatctgctggtcgcgatgtgtagggctgctctggagtcccccaggaagtcaatcattttcgaaccctaccctagcgtcgtcgaccctactgacccaaaaaccgtggccttcatggtcgagctggacccaaggaccactccacactcagacggacccgattag

SEQ ID NO: 58355 - DNA, 858 bp, Artificial Sequence
  Description of Artificial Sequence: Synthetic coding sequence
atgttcacctctcagcagtggaagcacctgtccaatgatttcttgaagacacagcaggagaaaaggcattcatggtttaaagctagcggaaccatcaaaaaatttcgagcaggactgtctatcttctcaccgatcccaaagtcaccatcattcccaataatccaagatagcatgcttaagggtaagcttggtgtaccggagcttagggtggggcgtctgatgaataggtctattagttgcaccatgaagaacccaaaggttgaagtgttcggatatcccccaagtccgcaagtctctggccattgcaagaacatccccaccctggagtacggtttccttgttcagattatgaagtatgcggagcagagaattccaacgctcaacgagtactgtgtagtgtgcgatgaacagcacgtcttccagaacggatccatgctgaaaccagccgtctgcaccagggagctgtgtgtcttcagtttttatactctgggtgttatgagcggtgcagcggaagaagtggccacaggggctgaggtggttgatttgctggtagcaatgtgcagagctgccctggagagtccccgaaaatctataatatttgaaccctatccctccgtggtcgaccctaccgatcccaagaccttggcattcaacccgaagaagaaaaattacgagaggctgcagaaggctctggactctgtaatgtctatcagagagatgactcaaggatcttacctggagattaagaagcagatggataaattggacccactcgcgcacccacttctgcagtggatcatttcgtcaaatcggtcacatatagtgaaacttcctctttctcggtgggttccccactag

SEQ ID NO: 58356 - DNA, 1665 bp, Artificial Sequence
  Description of Artificial Sequence: Synthetic coding sequence
atggacatcaagggacagttttggaacgacgacgattcagaaggagacaacgagtctgaggaattcctgtacggcgtccaaggttcatgtgcagcggacctctatcgacacccacagctcgacgctgacatagaggccgtaaaagaaatttattccgagaatagcgtgtctatcagggagtacggaaccattgacgacgtggacatagatcttcacattaatataagcttcctggatgaggaggtaagtactgcctggaaggtgttgaggacagagcctattgtactgcgactcaggttcagcctgtctcagtatctggacggacccgaaccctctattgaagtttttcagccttctaacaaagaggggttcggtctgggtttacagttaaagaagatcttaggcatgtttacttctcagcagtggaaacatctgagcaacgactttctgaaaacccagcaggagaagcgacactcctggtttaaagcgagcggcacaattaagaaatttcgagcaggcctgtccatcttctctcccatacctaagagcccatctttccccattattcaggatagtatgctgaaagggaaactgggcgttccagagctgcgcgtcggtcgcctgatgaacaggtcaatctcctgcacaatgaaaaacccaaaggtggaagtgtttggatatccaccaagtccgcaggctgggctcctgtgcccccagcacgtgggactccctcccccagccaggaccagccccctggtgtccgggcactgtaaaaacatccctacattagaatatggcttcctagtccagattatgaagtatgccgagcagcgtattccaacattgaacgagtattgtgtggtttgcgacgagcaacatgtttttcaaaacggaagcatgctgaagccagctgtgtgtactagggagttgtgcgttttcagcttttatacactgggggttatgagtggcgctgctgaggaggtcgccactggggctgaagtggttgatctgttggtggctatgtgcagggctgcgcttgagagccccagaaagtctatcatatttgaaccttacccatcagtggtggaccctacagacccaaaaaccctggccttcaaccccaaaaaaaagaattacgaaagactccagaaggccctggactcagtgatgtccattagagagatgacacaggggtcctacctcgaaattaaaaagcagatggacaaactggacccgttagctcacccactcttgcaatggattatctcctctaaccggtcccacattgttaaacttcctctgtctagacaattgaagttcatgcatacctcccaccagttccttctacttagcagcccaccagccaaggaagcccgtttcaggactgcgaagaaactgtacgggtccaccttcgccttccacgggagtcacatcgaaaactggcattccatcctccggaacggccttgtcaatgcctcctacaccaaacttcagttgcatggtgcagcttacgggaagggcatctacctgtcacctatttcctccatttccttcggatattccggcatgggcaagggccagcatcggatgccgtctaaggacgagctcgtgcagcggtataaccgcatgaacaccatccctcagaggcggagcttccagatttag

SEQ ID NO: 58357 - DNA, 750 bp, Artificial Sequence
  Description of Artificial Sequence: Synthetic coding sequence
atgtttacctcgcagcagtggaagcacttgtcaaacgactttctgaaaactcagcaggaaaagagacacagttggttcaaggccagtggaacaatcaaaaaattccgcgcaggactgtccatcttctcacctatcccgaaatctcctagctttccaattattcaagattctatgcttaaaggcaaacttggcgttcccgaactgagggtgggtcgactgatgaataggagtatctcgtgcacaatgaaaaacccaaaggtggaagtttttggctatcccccatccccacaagtgtctggtcactgtaagaacattccgactctagaatacggatttttagtccagataatgaaatacgctgaacagaggatccctaccctgaatgagtactgtgtcgtgtgtgacgaacagcacgtgtttcagaacggaagtatgctaaaacctgcagtttgcacaagggaactgtgcgttttttctttctacaccttaggagtaatgtctggggctgccgaagaagtcgccacaggggcagaggtggttgacctgctcgtggccatgtgccgtgcagcccttgagtctccacgaaagtctattatattcgagccatatcctagcgtggtggaccccacagaccctaaaaccctggcattcaatcccaagaagaagaattacgaaaggctgcagaaagcgctggatagtgtaatgtcaatccgggaaatgacacagggatgccgaaattgtatcaaatag

SEQ ID NO: 58358 - DNA, 2565 bp, Artificial Sequence
  Description of Artificial Sequence: Synthetic coding sequence
atgggcatgtgctcacgccaggaaagaatacagaaagatattgacgtggtaattcagaagagtagagccgaaaaagactgtcttttcgctgattttagatattccgacagcacatttactttcacctacgttggaggccctcgttccgtatcctattcagttcacgtgagcgaggactacccggataacacctacgtgtcttcgtcggagaatgatgaggacgtgctggttacaacagagcccattcctgttatattccaccgtatcgcaaccgaactccggaaaactaatgacattaactgttgcctctccatcaaaagcaagttgcagaaagaaaatggtgaagagtctcgacagaactccacagttgaggaagactccgagggtgacaatgactcagaggagttttactatggaggtcaggtcaactatgatggagaactgcataaacatcctcaactcgaggccgatttgagtgccgtgagggaaatttacggaccccacgccgtgtctctgcgtgagtatggtgcaatcgatgatgtcgacatcgacttacatatcgatgtttcattcttggacgaagagattgctgtagcttgggaagtgatccgaactgaacctatcattgtgagactgcattgtagcctcacccagtacctgaacggccctgtgcccaccgtcgacgtcttccagatttctacgaaagagcgtttcggactcgggcatcaactcaaaaaaatcatgcagacatttgtcacccagcagtggaagcagtcaaaagaaaaaagcaactgcctccacaataaaaagttgagtgaaaaaaaggtgaagtctccgctccatctctttagcacccttcggaggtccccgagctacccccctcctggctgtggaaagtccaaatccaagctcaaaagtgaacaggatggcattagcaaaactcacaagttgctgcgcaggacttgcagctccactgtcaagacagatgacgtgtgcgtgacaaagagccaccgcacattcgggaggtcacttagttcagatcccagggccgagcaggcgatgaccgcaatcaaatcccataaactgctcaaccgtccttgtcccgctgcggtgaaatcagaggagtgcctgacactgaagtcccacagactgctcacccgctcctgctctggcgaccctcgttgtgaacacaataccaatcttaagccacacaagctgttgtctcgcagctatagttcaaatctgcgtatggaagagctctatggcctcaaaaaccataagctgttaagcaagtcttacagttctgctccgaagtctagcaagaccgaactcttcaaggagcccaatgccgagggacgtaggcttagcctgacaagtggtctaatcggcatcctcaccccctccagttcaagctcatcccagctggccccaaatggggcaaagtgcatacccgtcagggaccggggattcctggtccagaccattgagtttgcggaacagaggattcccgtgttaaacgagtactgtgtcgtttgtgacgagcctcacgtttttcagaacggccctatgttacgccctaccgtgtgtgagcgagagctgtgcgtgttcgcttttcagaccctgggagtgatgaatgaagccgcagatgaaatagcgacaggagcgcaggtcgtagatctgttagtgagcatgtgccggtcggccctcgaaagccccagaaaagtggtgatcttcgaaccttatccatcagtcgtggacccaaatgatcctcagatgcttgcatttaatccgcgaaaaaaaaattacgacagagtcatgaaggctctcgattcaatcacaagcattcgggagatgacacaagccccatacctcgagataaagaagcaaatggataaacaggatccactggcacaccccttgcttcagtgggtgatctcctcaaatcgtagccatattgtgaagttgccagttaaccgccagctcaaattcatgcatactccccaccaatttctcctactgtcaagcccaccagctaaggaaagtaattttagggccgcaaagaagctattcgggagcacattcgccttccacgggagccacattgagaattggcacagcatactgaggaatggattggtagtcgcaagtaatacaagactccagctacatggcgcaatgtacggttcaggcatttatctctccccaatgtctagcatcagcttcggctacagtgggatgaacaagaaacaaaaagtgtccgctaaggatgagcctgccagtagctccaagtcctccaacacctcacaatcacagaaaaaggggcagcagtcacaatttctgcagagccggaacctcaaatgtatcgcactgtgcgaggtcatcaccagtagcgacctgcataaacacggcgaaatctgggtggttccgaatacagatcatgtgtgcactcgcttcttctttgtgtatgaggatggtcaggtaggagatgcaaatattaacactcaggaaggagggattcacaaggagattctcagagtcatcgggaaccaaacagccacaggctag

SEQ ID NO: 58359 - DNA, 1482 bp, Artificial Sequence
  Description of Artificial Sequence: Synthetic coding sequence
atgcagacttttgtgactcagcagtggaagcaatctaaggagaagtccaattgcctccacaacaagaagctgagcgagaagaaggtaaagagccccttgcatcttttctcaacacttcgtcggtccccctcctaccccccacccggatgcggtaagtcgaaaagtaaacttaagagcgagcaggacggaatttcaaaaacccacaaactgctgcgcaggacttgcagttccaccgtcaaaacggatgatgtatgcgttaccaagtctcaccgaaccttcggtaggtctttaagctctgatcccagagctgagcaggctatgacggccataaaatctcataagctgctgaacaggccctgcccagctgccgtcaaatctgaggagtgcctgacattgaaatcacatcgcttgctgacacggtcttgctccggcgatccaaggtgcgagcacaataccaatctaaaaccacataagctgctttcacgatcctattcttccaacctgaggatggaagaactctatggcttaaaaaatcacaaattactctcgaaaagctatagttcagcccctaagtctagcaagacagagctttttaaggagcccaatgcagagggaagaagacttagccttacgagcggattaattgggattctgactccctcaagctcatcgagcagtcagctggctcccaacggcgcaaaatgtattcccgttcgggaccgtgggtttctggtgcaaacaattgagttcgctgagcaacggatccctgtactcaatgagtactgtgttgtttgcgatgagccgcacgtgttccagaatggaccaatgttgagaccgacagtttgtgagagggaactctgtgtgtttgcatttcagactcttggcgtaatgaacgaagcagctgacgaaatcgctactggggcacagaagaagaactatgaccgggtgatgaaggctctggactcaattacgtctattcgtgaaatgacccaggcaccgtacctcgagattaagaagcagatggacaaacaggaccccctcgcacaccctctcctgcaatgggtaattagtagcaatcggtcccacatcgttaagctaccagtgaataggcagcttaaatttatgcatacaccccaccaattcttactcttatcaagcccaccagccaaggaatccaattttagagccgctaagaaactgttcggctctacatttgcctttcacggttcccacatcgagaattggcacagcattctgcgcaacggattagtggtggcttccaatacgcggttacagttacacggcgcaatgtacgggagcggtatttacctgtcaccgatgtcaagcattagtttcggatactctggcatgaataagaagcagaaggtgtccgctaaagatgagccagcctcctcctccaaatctagcaatacctcacagtcacagaaaagaactgcgatcccaatcccagctaaaccttag

SEQ ID NO: 58360 - DNA, 174 bp, Artificial Sequence
  Description of Artificial Sequence: Synthetic coding sequence
atgggtatgtgctcccgccaggaacggattcaaaaggatatcgacgtggtcatccaaaagtcgcgcgcagaaaaagactgcctgttcgccgatttccgctatagcgattctactttcactttcacttacgttgggggtcccaggcggaactctgagctcgcgcctgggatgtag

SEQ ID NO: 58361 - DNA, 2439 bp, Artificial Sequence
  Description of Artificial Sequence: Synthetic coding sequence
atgggaatgtgctccaggcaggaaaggattcaaaaagacatagatgtagtcatacaaaaatctcgggcagagaaagactgcctgtttgcagactttaggtattccgactctactttcacctttacctatgtgggtggacctcggtcagtcagctacagtgttcatgtaagcgaggactatcctgataatacgtacgtatccagttccgaaaatgacgaggacgtgctagtcacaacagaaccgatccccgtgatcttccataggatcgccacagaactacgcaaaacaaatgacattaactgctgcttgtctattaagagcaagctgcagaaggaaaacggggaagagtccagacagaatagtaccgtggaggaagatagtgaaggtgacaacgacagtgaagagttttactatggagggcaggtgaactacgatggcgaactgcataaacacccccaactggaagctgacctgagtgcagtccgggagatctacggtccacacgcggtgtcattacgggagtacggcgcaattgatgacgtcgacatagatctgcacatcgacgtctcctttctggatgaggagattgcagtcgcatgggaagtgataagaactgagcccatcattgtccgattgcactgctcgctgacccaatacctcaacgggccagtgcctactgtagacgtgtttcaaattagcaccaaggagcgattcggactcggtcaccagctcaaaaaaataatgcaaacctttgtgacccagcagtggaaacaaagcaaggaaaagtccaactgtcttcataacaaaaaactgtctgagaaaaaagttaaaagccccctccacctgttcagcacattaaggaggagcccctcctacccgccaccagggtgcggaaagtccaaatcaaaactcaagtcggagcaggatggcattagtaagacccataagctgctgcgacgtacttgctcatccacggtgaagaccgatgatgtctgtgtcaccaaatctcatcgcactttcggcagatcattatcttctgatccaagagctgagcaggctatgacggccatcaagagccataaactgctgaataggccatgcccagcagctgtgaaatccgaagaatgccttactctgaagtcccacaggctcctgacaaggtcatgctccggagatcccagatgtgagcataacactaatttgaaaccgcacaagttgctgtctcgaagctattcttccaatctaaggatggaggaactttatggcctgaaaaaccacaaattactgtctaaatcatacagctcagcgccaaagtcctcgaaaacagagctgtttaaggaaccgaatgcggaggggaggcggctcagcttgacctcggggctgattggcattctaaccccctcatccagctcttcatcccagctggccccaaacggggctaagtgcattcccgtgcgggacaggggtttcctcgtgcagaccattgagttcgccgaacagaggatacccgtcttaaacgaatactgtgtggtatgcgatgaaccacacgtttttcagaacggccctatgctgagacccactgtgtgcgagcgagagctctgtgtcttcgcattccaaacactcggagtgatgaacgaagccgctgacgaaattgccactggggcacaaaagaaaaactatgaccgtgtcatgaaggccctcgacagtattacctctatccgcgaaatgactcaggccccatatctcgagataaagaaacagatggacaagcaggatcccttggcccaccccctgctgcagtgggtgattagctcaaacagaagtcacatagtcaagcttcccgtgaataggcagctgaaattcatgcacaccccacaccagttcctgcttctgagtagcccacccgctaaggagtcgaactttcgcgcagcaaagaagctctttggatcaactttcgcctttcatggatcccacatagaaaactggcattcgatcctgagaaatggcttagttgtggcgtctaatactagactccagttgcacggtgcaatgtatggctctggcatttacttaagccctatgagtagcatctcctttggctactccggtatgaacaagaagcagaaggtgtctgccaaagacgagcccgcatcttctagcaagtcaagcaacacctcccagtctcagaagaagggccaacagtctcaattcctgcaatcgcgaaatctgaaatgcatcgcactctgcgaggtgataacaagtagcgacctgcataagcatggtgaaatttgggtagttcctaacaccgaccacgtgtgtacccgcttcttctttgtctatgaggacggacaggtcggcgacgccaacattaatactcaggagggagggatacataaggagattctgagggtgattgggaatcaaaccgctacaggttag

SEQ ID NO: 58362 - DNA, 2502 bp, Artificial Sequence
  Description of Artificial Sequence: Synthetic coding sequence
atggagcccgcagcgttgcggtgcgcctactttcgatatagcgattccaccttcacttttacatacgtcgggggaccacgcagcgtgagttacagtgttcacgtttccgaggattaccctgacaatacttacgtgagttcaagcgagaatgatgaggatgtactagtgactacagagcctatcccagttatctttcaccgcattgccactgagctccgaaaaactaatgacatcaactgttgtctgagtattaagagcaagctccagaaggagaacggggaagaaagccgccagaattcgacagtggaggaggattcagagggagataatgattcagaggaattttactacggaggacaggtcaattacgatggagaactgcacaaacaccctcagcttgaggccgatttatccgccgtcagagaaatctacggccctcacgccgtatccctccgcgaatacggcgctattgatgatgtggatattgatctccacatcgatgtcagtttcctggacgaagagatcgcagtcgcttgggaggtgataaggacagagccaatcatagtcaggctccactgttccctaacgcaatatctgaatggcccagtgcccaccgtggatgtgtttcaaatctctacgaaggagaggttcgggctcggccaccagctgaaaaagataatgcagacctttgtaactcagcagtggaagcagagtaaagagaagtctaattgtctgcacaataaaaagctctccgagaaaaaagtaaagtcacctctgcaccttttttctacccttcggcgttctcccagttatcccccaccaggctgtggcaagagtaagtctaaattgaagtctgagcaggatggtatcagtaaaacacacaagctgctccgtagaacatgttcttccaccgtcaaaacagatgatgtttgtgttaccaaaagtcacaggacctttgggaggtccctgagcagtgatccacgggcagagcaggctatgacagctattaagagtcataaactgcttaatagaccatgtccagccgcagtgaaaagcgaggagtgtctgaccctgaagtcccaccgactgctgacccggagttgttcgggagacccacgctgtgagcataatactaatcttaagcctcataagctcctcagccgcagctatagttcaaacctccgtatggaggagctgtatggcctgaaaaatcacaagctcctctcaaaaagttatagctctgcacctaagagcagcaagacagagctttttaaagagcctaacgccgagggccgaaggctgtcattgacttccgggttgattggtatcttgacaccaagttcctcgagttcatctcagctggcccctaacggagccaagtgtatccccgtgagggaccgtggattcttggtgcagaccattgagtttgccgaacaacggatcccagtgcttaacgagtattgtgtggtctgtgacgaaccacatgtcttccagaatggcccaatgctgcgacccaccgtgtgcgaacgagaactgtgtgtctttgcattccagactctgggtgtgatgaatgaggccgctgacgagattgccactggggctcaggtggtcgacctgttagtgagcatgtgtcgatcagccctggaatccccaaggaaggtggtgatatttgagccttatccaagcgtcgtggaccccaatgacccacagatgctggccttcaaccctaggaagaagaattacgaccgtgtgatgaaggccctagatagtataacctctattcgggaaatgacacaggctccgtacctggagataaagaagcagatggataaacaggatcctctggcccaccctctgctgcaatgggtcatctcctccaatcggtcccacatcgtcaagttgccagtgaacagacagttaaaatttatgcataccccccaccagttcctcctcctgagttcacctcctgccaaagagagtaatttccgggctgctaagaagctcttcgggtccaccttcgctttccacggctctcatatcgagaactggcactcgattctgcggaatggactggtggtggcctccaacaccaggcttcagcttcacggggctatgtacggctccgggatttacctttcacctatgtcttccatatcctttgggtattcaggaatgaataagaaacagaaggtctcagcaaaggacgaacccgcttcttcatctaagagcagcaacacatcacaaagccagaagaagggccagcagagccagtttctgcagtctaggaatctcaaatgcatcgccttatgcgaagtaattacatcttcagacttgcataaacatggggagatctgggttgtgcctaacaccgatcacgtatgtacacgttttttctttgtgtacgaggacggacaggttggtgacgcgaacatcaacacgcaagaaggcggaatacataaagagatcctccgagtcatcgggaatcagacagctaccggatag

SEQ ID NO: 58363 - DNA, 2565 bp, Artificial Sequence
  Description of Artificial Sequence: Synthetic coding sequence
atgggcatgtgttcgcgccaagagcgcattcagaaagatatcgacgtcgtgattcaaaagagtcgagctgagaaggactgcttatttgccgactttagatattccgattccacgtttacgttcacttacgttggcggtcctaggagtgtgtcttatagcgttcacgtcagcgaggattatcccgataatacctatgtcagttcatccgaaaacgatgaggatgtgctggtgacgacagaacccattccggtgatcttccatcgaattgccacggaactgaggaaaacgaatgacatcaactgctgtctgagtataaagagtaaattgcagaaagagaacggtgaagagagcaggcagaatagcaccgtggaggaggacagcgaaggggacaacgactcagaggaattctattatgggggacaggtgaattacgacggcgaactccacaaacacccccaactggaggccgatttgagcgccgtgcgagagatttatggcccacacgcagtaagtctcagggaatacggcgcaatagacgatgtggatatcgacctgcatatcgacgtatcgttcctcgacgaagagatcgccgtcgcctgggaagtaatccggacggagcccataatcgttcgtttgcattgctccctcacccagtatctaaatggccctgttccgaccgtcgatgtctttcagatcagcacaaaagagagattcggactgggtcatcagctcaaaaagatcatgcagactttcgtgactcagcagtggaaacaaagtaaggagaagagtaactgccttcataataaaaagcttagtgaaaagaaggtcaaatcacccttacacctcttctcaacgctgcgtaggagtcctagttatcccccacccggatgcgggaaaagcaagagtaaactaaagtcagagcaggacgggattagtaaaacccacaagttactgaggagaacctgctctagcacagttaagactgacgatgtgtgcgtgaccaaatctcatagaacctttggtcgcagcctctctagcgaccctagagcggagcaggctatgaccgccatcaaatcacacaaattgctgaaccgcccatgtccagcggcagtgaagagcgaagaatgcttaaccctaaaaagtcatcgcctgctgacccgatcatgctctggcgatcccaggtgcgagcataatacaaacttgaagccacacaagttattgtccaggtcttacagctctaatttacgcatggaagagctttacggactgaaaaatcataagctgctgtccaagtcgtactcctccgcgccaaaatcaagcaagacggagctattcaaagagccaaacgcagaaggaaggaggctctctctgacatctggactgatcggaatcctcactccctcttccagttcctcatcccagctggcaccgaacggcgcaaaatgtatccccgttcgagatcgaggcttcctggtccagacaatagagtttgccgagcagcgcatccctgtcctaaatgagtattgcgttgtgtgcgacgagccccatgtcttccagaacggtcctatgctgaggcccacagtttgtgaacgtgaactctgcgtgttcgcttttcaaaccctgggagtaatgaacgaagctgcagacgaaattgccaccggtgcccaagttgtggacctcctggtgtccatgtgcaggtccgccctagaatcaccgaggaaagtggttatattcgaaccctatccttctgtggtggatcctaacgatccacagatgctagcatttaatcccagaaaaaaaaattatgatagagtgatgaaggccttggattccatcacctctatcagggaaatgacccaggccccttaccttgagatcaagaagcagatggacaagcaggaccctctggcacacccactcctgcaatgggttatctcgtcaaaccgtagccatattgtgaaactgccggtcaatcgacagctgaaatttatgcatacacctcaccagtttctcctattgtcctcaccaccagcaaaagagagcaatttccgcgctgccaaaaaactgtttggatcaacatttgccttccacgggtcccatattgaaaattggcatagtatcttaaggaacggtctggtcgtggccagcaatactagattacaactgcacggcgctatgtacggcagcggaatctatctctcaccaatgagcagcatcagcttcggctacagtgggatgaataaaaaacaaaaggtgtcagcaaaagacgaacctgccagttcaagcaagagcagcaatacttcacagagtcaaaaaaagggccaacagagccagttcctccagagtcgaaaccttaaatgcatcgcgttgtgcgaagttataacatctagcgatctccataagcacggggagatttgggtagtgcccaacactgatcatgtctgtactcgttttttctttgtatacgaggatgggcaggtgggcgacgctaatattaatactcaggaaggaggcatacacaaggaaattctgagagtgatcggcaaccagactgcaacgggatag

SEQ ID NO: 58364 - DNA, 2439 bp, Artificial Sequence
  Description of Artificial Sequence: Synthetic coding sequence
atggggatgtgttcacgccaagagcgcatccaaaaggacattgacgtcgtaattcagaaatcccgggcagaaaaggactgcctcttcgctgacttccggtactcagactctactttcactttcacttacgtagggggacctcgctccgttagctatagcgtgcacgtcagcgaggactaccctgacaacacttacgttagcagctctgagaacgatgaagacgtgctggtaactaccgaacctataccagtaatattccatcgtatagctaccgaactgcggaagactaacgatattaactgttgtctctcaattaagagtaagctgcagaaggagaacggagaggagagccggcaaaactctacagtggaggaggacagcgagggtgacaatgactccgaggaattctactatggcggacaggtaaactacgatggggagctgcataagcatccccagctagaggcagacctgtcagctgttcgggagatttacggtccccatgctgtgagcctgcgcgagtatggtgctatcgacgacgtggatatcgatttgcacatcgacgtttctttcctcgatgaagagatcgcagtggcttgggaggttattaggaccgaacccattattgtcagattacactgcagccttacacagtatctgaacggtccagtgcctactgtggacgtgtttcaaataagtacgaaggaaaggttcggcttaggtcaccagctcaaaaagattatgcagacctttgtgacacagcagtggaaacagtcgaaagaaaagtccaactgtttacacaacaagaagctgtcggagaagaaggtgaagtcacctcttcatctcttttcaacgttacggagatcaccctcctaccccccaccagggtgcggtaaatctaaaagtaagctgaagagcgagcaggatggtatctccaaaacccataagctcctgcgtaggacctgtagtagtacagtaaagaccgacgatgtttgcgtcaccaaaagccaccgtacgtttgggcgtagcttgtcctcggacccgagagctgagcaggctatgacggccattaagagtcataaactcctgaatagaccctgccctgcggcagtgaaatccgaggagtgccttactctaaaaagccatagactcctcaccagatcttgcagcggagaccccagatgcgagcacaacacaaacctgaaaccccataagctgctctctcgtagctactccagcaatctgcggatggaggagctgtacggcctcaaaaaccacaagctgttaagtaagagttacagttcagcccctaagtcttccaaaactgaactctttaaggagcccaatgctgaaggaaggagactgtctcttactagtgggctgattggcattctcaccccctcgtcatcttcatcatcgcagctggctcccaacggggctaaatgcatccctgtccgcgacagggggttcctcgtccaaaccatcgaatttgctgagcaaagaatccccgtgctcaacgagtactgtgttgtatgcgacgagccacacgtattccagaatggcccaatgctgagacccaccgtgtgtgagagagaactctgcgttttcgctttccagactctcggtgtgatgaacgaagccgcagacgagattgctacaggtgcccagaagaaaaactatgatagagtcatgaaagcgctcgacagcattacatctatcagggaaatgacccaggcaccgtatttagagattaaaaagcagatggacaaacaggatcctctggcccacccactccttcagtgggtcatttcctcaaacaggagccatattgtaaaattgcccgtgaataggcagctgaagtttatgcacactcctcaccagtttctgctgctgagctccccacccgcaaaggaatcgaatttcagggctgcaaaaaaattattcggctctacattcgcctttcatggctcccatattgagaactggcatagcatcctgcggaacggtctggtggtggcctcgaacaccaggctgcaattgcatggagccatgtatggtagtggtatttatctctcgcctatgagcagtatcagcttcgggtattctggcatgaacaagaagcaaaaggtgtcggccaaggacgagcctgcaagttcaagtaagagctccaatacaagccagtctcagaagaagggccagcaaagtcaatttctccagtctcggaacctcaagtgtatcgccctgtgtgaagtgataacctcaagcgacctgcataagcatggagaaatctgggtggtgcccaataccgaccacgtgtgcacacggttttttttcgtctacgaagatggccaggttggagacgccaacatcaacacccaggaaggcggtatccataaggagattctgagagtcatcgggaatcaaactgcaaccggatag

SEQ ID NO: 58365 - DNA, 1485 bp, Artificial Sequence
  Description of Artificial Sequence: Synthetic coding sequence
atgcagacctttgttacccagcaatggaaacaatcaaaagagaagagtaactgtctgcataataagaaattgtccgaaaagaaagtgaaaagcccactacatctcttttctaccctccgacgatcaccatcctaccctcctcctggttgcggaaagtcaaagtccaagcttaagtcagaacaggatggaatttccaagacccataagcttctacgcaggacctgctccagcacggtcaagaccgatgacgtttgtgtgacaaaaagccatcgaacctttggtcggtccctgagttcggatccacgtgcggagcaggccatgaccgctataaagtcgcacaagctgctgaatagaccctgcccagccgcagtgaagtcggaagaatgtttgaccttaaagtctcatcggttgttgacgcgaagctgctctggggatccacggtgtgaacacaatacgaacctcaagccccataaattgctgtctaggagctactcctctaatctccgcatggaagaactatacggccttaaaaaccacaagctactgagcaagtcgtattcgagcgcgccaaaatcttccaagactgagctctttaaagaacccaacgctgaggggagacggctgtcgctgacatccgggctcattggaatcctcacaccatcttcctcaagcagtagccagctggcacccaacggcgctaagtgtatccctgttcgagacaggggctttttggttcagaccatcgagtttgccgagcaacgcatccccgtgctcaacgagtactgtgtggtgtgcgacgagccacacgtgtttcagaatggacccatgcttcggccaacagtctgtgagagggagctctgtgttttcgcttttcaaacgcttggggtgatgaacgaggcagcggatgaaattgcaaccggagcacagaaaaagaattacgatcgcgtgatgaaagccctggactctatcacaagcattagagaaatgacccaggcaccataccttgagataaaaaaacagatggataagcaggatcctctggctcacccccttctgcagtgggtgatttcaagtaatcggagtcacatcgtgaaattacctgtgaaccgacagttgaaatttatgcatacacctcaccagttcttgttattatcttctccccctgctaaggagtctaatttcagggctgcgaaaaagctgtttggctcaaccttcgcattccacgggagccacattgaaaattggcacagcattctccgcaatgggctggtggtggcgagtaacacccggctccagctgcacggagctatgtatggaagtggcatttacttgtcccccatgtcaagtatcagctttggatattctggcatgaacaaaaagcagaaggtaagcgccaaggatgagccagccagtagcagcaaaagctccaatactagccagaaaaccaaaaagcgtacagctattccgatcccagctaaaccgtag

SEQ ID NO: 58366 - DNA, 603 bp, Artificial Sequence
  Description of Artificial Sequence: Synthetic coding sequence
atggcgtccttgtatgtcggcgacctgcaccctgaggtcaccgaagctatgctgtacgagaaattctccccagcaggccctatcctctctattcggatctgtagggacaagattacgagacggagccttggttacgcttacgtaaactaccagcaacctgtagatgccaaacgcgctctcgagactctgaactttgatgtgattaaaggtagacctgttcggataatgtggtcacagagggaccccagcctccggaaaagcggtgttggcaatgtctttataaagaatctgggaaaaaccatcgataacaaagctctgtacaatatcttctcagcgttcgggaatatcctgagttgtaaggttgcttgtgacgagaaaggcccaaaggggtacggctttgttcactttcagaaacaggagtccgcagaacgggctatcgacgtgatgaacggcatgtttctgaattatcgtaaaatattcgtcggacgctttaagtcgcacaaagaaagagaggccgaacggggagcctgggctcgtcagtcgacctctgcagacgtaaaagatttcgaggaagacactgatgaggaggccactctgcgatag

SEQ ID NO: 58367 - DNA, 603 bp, Artificial Sequence
  Description of Artificial Sequence: Synthetic coding sequence
atggcaagcctgtacgtgggggatctgcatccagaggttactgaggctatgctatacgagaagttcagtcccgcaggcccaatcttgtcaattagaatctgtagagacaagatcacaagaagatccttaggatatgcatacgtgaattaccaacaacccgtggatgccaaaagagcactggagacactaaatttcgacgtgatcaagggaagacctgtgcgaatcatgtggagtcagcgggacccaagcctgcgcaagtccggggtcgggaatgtgtttatcaagaatctcggaaaaacaatagataacaaagcgctctataatattttcagtgccttcggcaacattctaagctgtaaagtggcttgcgatgaaaagggtcctaagggctacggattcgtccatttccagaaacaggagtctgctgaacgagccattgatgtcatgaacggcatgttcttgaactataggaagatcttcgtgggccgtttcaagtcccataaagagcgggaggccgagagaggcgcttgggcacggcaaagtacaagcgctgacgtgaaggacttcgaagaagacactgatgaggaagccactctgcggtag

SEQ ID NO: 58368 - DNA, 1113 bp, Artificial Sequence
  Description of Artificial Sequence: Synthetic coding sequence
atgaacgtagccgctaaataccgaatggcctcattgtacgtcggcgatctccatgccgacgtcacagaggacctgctgtttagaaagttctctaccgtgggtcccgtcctcagcattcggatttgccgagaccaggtcacccgccgatcactaggttacgcctacgtgaacttcctgcagctggctgacgcgcaaaaagccctggacaccatgaatttcgacataatcaaggggaagtctatccggctcatgtggtcccaaagggacgcatacctgagacgcagtggcattggtaacgtgtttatcaagaatttggacaaatccatcgataacaagaccctctacgagcacttcagcgctttcggtaagattctgagtagcaaagttatgagcgacgatcaagggtctaagggctacgcattcgtgcattttcagaatcagagcgcagccgaccgtgctatcgaggaaatgaatggcaaattattaaaagggtgcaaagtctttgtgggacgatttaaaaacaggaaggaccgcgaagccgagctgcgttcaaaggcatctgagttcacaaatgtctacatcaagaacttcggaggtgatatggacgacgaacgactgaaagacgtctttagtaaatatgggaaaactctttctgtgaaggtgatgactgattcctccggcaaaagcaaagggtttgggttcgtatcctttgattcacacgaggcagcaaagaaggctgtggaggaaatgaatggaagagacatcaacggccagctgatcttcgtgggacgggcacagaagaaagtggagcgccaagccgaactcaagcagatgttcgaacagttgaaaagagaacgcatacggggttgtcaaggcgttaagctgtacataaagaatctggatgatacaatcgacgacgagaaactgcggaatgagttttcttcttttggcagtatttccagggtgaaagttatgcaggaagaggggcagagtaagggtttcgggctcatttgcttcagcagcccagaggacgccaccaaggcaatgactgaaatgaacggaagaattctaggatctaagccacttagtattgccttggcccagcggcactag

SEQ ID NO: 58369 - DNA, 1287 bp, Artificial Sequence
  Description of Artificial Sequence: Synthetic coding sequence
atgcgggtcctacccgagctgggggagagctgcctcaattccatagcttggccactttgtggagatcccgaggcctctaccctcgagccgggtcaaagctgcgatctggtgtcccctcatagggattgcagtaagaattctcggggacagacacatagcggcaaggataaggagatgaatgtcgctgccaagtatcggatggccagtctgtatgttggtgacctccatgcggacgtcaccgaagacctcttgtttcgcaagttctctactgtggggccagtcctctctatccgtatttgccgcgaccaggtcactaggaggagcctgggctatgcatatgtgaacttcctgcagctggcagatgcccaaaaggctctcgatacaatgaattttgacatcattaaaggcaagtcgattcgcttaatgtggagtcaacgggatgcatacctcagacgaagtggaataggcaatgtattcatcaagaatctcgataaatctatcgacaataagaccctctacgagcactttagcgcattcgggaagatactgtcatccaaggtcatgtccgacgaccagggaagcaagggctacgcatttgtacacttccaaaatcagagcgccgcagatcgcgctattgaggagatgaatggcaaattgctgaagggctgtaaggtgttcgtcggacggtttaagaatcgtaaagatcgcgaagccgaacttagatccaaagcttccgagtttaccaacgtctatattaaaaactttggtggcgacatggatgacgaacggctaaaagacgttttcagcaaatatggcaagaccttgtctgtcaaagtaatgactgattcttccggtaaatctaaaggatttggctttgtgtctttcgactcccatgaggcagccaagaaggctgtcgaagagatgaacggcagggatattaatgggcagctgatcttcgtgggaagggcccaaaagaaagtcgagcgccaagcggaacttaaacagatgttcgaacagctcaaacgcgaaagaattagaggatgtcagggcgttaagctctacatcaagaacctggatgacaccattgatgacgaaaagttgaggaacgaattttcctcctttggatccatatcacgggtgaaggttatgcaagaggagggccagtccaaaggatttggcctgatctgcttctcatccccagaagacgccaccaaggctatgaccgaaatgaacgggaggatccttggcagcaagccgctgtcaattgcactggctcagaggcattag

SEQ ID NO: 58370 - DNA, 762 bp, Artificial Sequence
  Description of Artificial Sequence: Synthetic coding sequence
atgccgttgctaccttccacagtagggttggcagggttgctgttctgggctggtcaggccgtcaacgcactcataatgcccaacgctacccccgcacccgctcagcccgaatccacagccatgcggctgttaagcggcttagaagtcccaaggtaccggagaaaaaggcacatatctgtcagagacatgaacgcactgcttgactatcataatcatataagggcttccgtgtatcctcctgcggcaaacatggagtacatggtatgggacaaacgcctggctcgggcagcggaagcttgggctacccagtgcatttgggcccacgggccatcccagctcatgcgatacgttggacagaacctttccatacattcgggacaatatcgtagcgtagtggatttgatgaagtcatggagcgaggagaaatggcactatctatttcccgctccgagagattgcaatccacactgtccttggcggtgcgatggtcccacatgttcccactacactcagatggtctgggcctcctcaaatcgcttgggctgcgctattcacacttgctcaagtataagtgtctgggggaatacctggcaccgagctgcctacttagtgtgcaattacgccatcaagggcaactggataggagagagcccgtataaaatggggaagccatgctcatcgtgccccccaagttatcaaggcagttgcaattcaaacatgtgtttcaagggtcttaagtccaacaagttcacatggttttag

SEQ ID NO: 58371 - DNA, 1845 bp, Artificial Sequence
  Description of Artificial Sequence: Synthetic coding sequence
atgaatgcttccggttctggctatcctctcgcatcattgtatgtgggggatctgcaccctgatgtgaccgaggcaatgctatatgagaagttttccccagccggtccgatcttgtctatcagagtgtgccgtgacgtggccacgagacggagtttgggctacgcatatattaattttcagcagcccgcagatgctgaacgggcacttgatacaatgaacttcgaaatgctgaaaggccagcctatcaggattatgtggtcgcagagggaccctggcctgcggaagtccggtgttgggaacatttttatcaaaaatctagaggattcaatcgacaataaagctttatatgataccttttcgacgttcgggaacatcctgtcctgtaaagtggcttgcgacgagcatggctctcgtggtttcggcttcgtgcatttcgagacccatgaagctgcacagcaggcaattaacaccatgaatggaatgctgcttaacgatcgcaaagtgttcgtaggtcactttaagtcccgccgagaacgggaggctgagttaggcgcaagggccctggaatttacaaacatctacgtaaaaaacctacccgtggacgtagacgagcaggggctgcaagatctattctcccagtttggtaaaatgctaagcgtgaaggtaatgagggataattcagggcacagcaggtgcttcggttttgtcaacttcgaaaaacacgaagaggcccagaaggccgtagtgcatatgaatgggaaagaggtgagcggtcggcttctgtacgctggccgtgcccagaagcgcgtggaaagacagaacgagctgaaacgcagatttgagcagatgaagcaagataggctgcgcaggtaccaaggtgtcaatctctacgtgaaaaacctcgatgatagcatagacgatgataagcttcgcaaagaattcagcccctacggcgtgattacttccgcgaaggtgatgactgaagggggtcactcaaaaggttttggctttgtctgttttagtagcccggaggaagccaccaaggccgtaacagaaatgaacggtaggattgtggggaccaagcctctgtatgtcgcattggctcagcgcaaagaagagagaaaagctatcttaacaaatcagtatatgcagcgactctcgacgatgcgcactcttagcaaccccctcctgggcagcttccagcagccaagttcgtactttctgccagcaatgccccagccaccagcccaggcggcttactacggctgcggcccagtcacacctacacagccagcccctcggtggaccagccagccacctcgacctagttgtgcttcaatggttagacccccagtcgtgccgaggagaccaccagctcatatcagctccgtgcgccaagcaagtacacaggtgcctcgcactgtcccgcatactcagcgagtggccaatataggcacccagacgacaggcccttcgggcgtgggctgttgcaccccagggcgtcccctcttgccgtgcaagtgcagctctgctgctcattccacttatagagttcaggaaccggcagtacacatccccggacaagagccactcactgcatccatgcttgcagcggctccactacatgaacagaagcagatgattggtgagcgtctgtacccgttaatccatgatgtccatacccagttggccggaaaaataaccgggatgctgttggaaatagacaattctgagcttctcctcatgttagaatctccagaatccctgcatgccaagatcgacgaagccgtagctgtactgcaggcacaccaggcaatggaacagccaaaagcatatatgcactag

SEQ ID NO: 58372 - DNA, 993 bp, Artificial Sequence
  Description of Artificial Sequence: Synthetic coding sequence
atgaacgcgtctggctccggctaccccctagcgtccctctatgtgggagacctccacccagatgtaacagaggctatgctatacgagaagttttcgcccgctggccctatactgtctatacgggtgtgcagagatgtggccacaaggcggagccttggctatgcctatatcaactttcaacagccggcagacgccgagcgagccctggatacaatgaacttcgagatgcttaagggacagccaatccgcattatgtggagtcaaagagatcccggactgaggaaatctggtgtgggaaatatctttataaagaacctggaagacagcattgataataaagccctgtatgatacatttagtacattcgggaacatcttgtcatgcaaggtcgcttgcgatgaacatggatctagaggttttgggttcgtccactttgagacccacgaagctgcccagcaggccattaacacaatgaatggcatgttgcttaatgacaggaaagtatttgtaggccattttaaaagtcgtagagaaagagaggccgagcttggcgctagggctttagaattcactaacatttacgtgaagaaccttcccgtggacgtcgatgagcagggactgcaagaccttttcagccagtttggcaaaatgttatctgtcaaagtgatgcgcgacaattcagggcactcaaggtgtttcggatttgtcaactttgaaaaacatgaggaggcccagaaggctgtcgtacatatgaacggaaaggaagtgagcgggagattgttgtacgccggacgcgctcaaaaacgcgtcgagcggcagaacgagctaaaacgacgatttgaacagatgaagcaggatcgtctgcgaagataccagggagttaacctgtacgtgaagaatctggacgattcaatagacgacgataagctgagaaaggagttttccccttacggagttatcacaagcgctaagaagcggaggcagaggccatag

SEQ ID NO: 58373 - DNA, 1845 bp, Artificial Sequence
  Description of Artificial Sequence: Synthetic coding sequence
atgaatgccagcggctctggatacccactggcgagcctgtatgtaggtgatctgcaccctgatgtcaccgaagctatgctgtatgagaaattctctcccgctggacccatactttcaattcgggtctgccgtgacgtcgccactaggcggtccctgggatatgcttacatcaatttccagcagcccgctgatgccgagcgcgctctggacaccatgaacttcgaaatgttgaaaggtcagccaattcggatcatgtggtctcagcgtgatcccggtctaagaaaaagcggagtgggaaacatcttcatcaaaaatctcgaggattccatcgacaataaagccctatacgataccttctccaccttcggcaacatactgagctgtaaggtcgcctgcgatgaacatggatcgagaggctttggttttgtgcacttcgaaacacacgaggccgctcagcaggctatcaacaccatgaacgggatgctgctgaacgatcgcaaagtttttgtgggacacttcaaatcccggagggaacgcgaggcagagttaggtgccagagcgctggagtttaccaatatctatgtgaagaatctgccggttgacgtagacgagcaggggctccaggacctgttctctcagttcggcaaaatgctttccgttaaggtgatgagggataattcagggcacagccggtgttttgggtttgtgaatttcgagaaacacgaagaggcgcagaaagccgtcgtccacatgaacggcaaggaagtcagcggacgcttactttatgccggacgcgcacagaaacgtgtggagaggcaaaacgaattaaaacgtagatttgagcagatgaagcaggatagactgcgccgttaccagggagtgaatctttatgtcaagaacctggacgattccatcgacgacgacaagctccgcaaggagtttagtccttacggggtgataactagtgccaaagtaatgacagaaggaggccattctaagggatttggatttgtctgcttcagctcacccgaagaagccaccaaagcagtcaccgagatgaacggcaggattgtggggacaaagccactgtacgtcgccctcgcacaacgcaaggaggagcgcaaggccattctgacaaaccagtacatgcagcgtctatccactatgcgaaccctttccaatccactgctcggcagttttcaacaaccttccagttacttcctccccgcaatgccacagccccctgctcaggcagcctattacggatgtggcccagttacaccgacacagccagcgcctcgctggaccagccagcctcccagaccatcttgtgcttctatggtgaggccgcctgtggtgccgaggcgccctcccgcacacatcagcagtgtgaggcaggcttccactcaagtgccacgcactgtcccccatacacagcgggttgccaatattgggacccaaacaacaggcccaagcggtgtgggctgttgcacaccgggtcgacccctgcttccttgcaagtgttcctccgccgctcatagcacttacagagtgcaagaacctgctgttcacatcccaggccaggagcctttaacagcttctatgctcgcagccgctcccctccacgagcaaaaacagatgatcggtgagagactgtacccattgatacatgacgtccacacgcagctcgctggaaagattacaggtatgctgctggaaatagacaactccgagttgctgcttatgctcgagagtccagagagcttacacgcaaagatagacgaggccgtggccgtgttacaggctcatcaagccatggagcagcctaaggcatacatgcactag

SEQ ID NO: 58374 - DNA, 450 bp, Artificial Sequence
  Description of Artificial Sequence: Synthetic coding sequence
atggtgcgccctccggttgtcccgaggcggccaccggctcatattagtagcgttagacaggcaagtacacaggtgccgagaacagtcccgcatacccagcgggtcgccaacatcggtacgcagactacaggcccaagtggggtggggtgctgcactccgggacgtccactgttgccttgtaagtgctcgagtgctgctcacagtacttatcgagtgcaggaacccgctgtgcatataccagggcaggagcctttgactgcttctatgctcgcagctgcccctttgcatgagcagaagcaaatgattggagagcggttgtaccctctcattcatgacgtgcacacgcagcttgccggtaaaattacagggatgcttctcgaaatcgacaactccgaactgctacttatgttggagtcccccgagagcctacacgccaagatatcagcatag

SEQ ID NO: 58375 - DNA, 582 bp, Artificial Sequence
  Description of Artificial Sequence: Synthetic coding sequence
atggtgagaccacctgtggtgccaagacgtcctccggcacacattagcagcgtgagacaggctagtacacaagttcctcgaaccgtgccacacactcagagagtcgccaacattggaacccagaccactggcccttccggcgttggttgttgtacacccggtaggccattgttgccatgcaaatgctcatccgcagctcactctacctacagggtgcaggaacccgcagtgcacatcccgggacaagaacccttgacagccagcatgctggcagccgctcctcttcatgaacagaaacagatgatcggcacctgttacttagtcttgaaaagatggtccgactggatggtcttaagctttctgccgctcctcttatcctgcgacttcgagggaagcgtctcgacccctctgagcatgatgtccaccccctcctggctcgcccgtagcagggcttgctgttggaggttaacaactcagtcttgctgttcctgttggtcactgcagaatccatcaatgcccagaaagggaaaccccaggttccatggctgtcaaaaggacagtgtcagcggcagccagccatag

SEQ ID NO: 58376 - DNA, 405 bp, Artificial Sequence
  Description of Artificial Sequence: Synthetic coding sequence
tgtaagtgtagcagcgccgctcacagcacatatcgagtacaagaaccagctgtccatatccccggtcaggaacctttgacagcctccatgctggccgcagccccactgcacgagcagaaacaaatgatagggacttgttatctagtgctcaagcggtggtcagattggatggtcctctcattcttaccccttctgcttagctgtgacttcgaagggagcgtgtcaacaccactgagtatgatgagtacaccttcatggttagctcggtcacgcgcttgttgctggagactgaccacacagagttgctgttcgtgttggtccctgcagaatccaagcatgcccagaaaaggcaacccgcgtttccatggatgccagaaggacagtgtctctggttctcaaccgtag

SEQ ID NO: 58377 - DNA, 507 bp, Artificial Sequence
  Description of Artificial Sequence: Synthetic coding sequence
atggtgcggcctcccgttgtccccaggcggcctcccgcacatatatcttcggtcagacaagcctccacacaagtaccccgaactgttccccacacccagagggttgcaaatatcgggacacagaccactggaccatctggcgtggggtgttgcactcccggtaggcctctgctgccttgtaagtgctcctctgcagcccacagcacgtaccgcgtccaggaacccgctgtgcatattccagggcaggaacccttgactgcctctatgctagcggctgcaccgctccacgaacagaaacagatgataggtgaaaggctgtaccctctgatccacgatgtgcatacacagctggcaggcaaaattaccggcatgctcctggagatcgacaactctgagttactattgatgctcgagtcgccagagagcctccacgcgaagattgacgaagcagtggcagtattgcaggcccatcaggcaatggaacaaccgaaggcctacatgcattag

SEQ ID NO: 58378 - DNA, 459 bp, Artificial Sequence
  Description of Artificial Sequence: Synthetic coding sequence
tagcaagcctctacacaagtgcctcgcacagtgcctcatacccaaagggtggccaatattgggacccagaccactggaccatccggagtcggatgttgcacccccggtaggcctttgctgccctgtaaatgctcaagcgctgctcactccacgtacagggtacaagagcctgctgtgcatatccctggacaggagcctctgactgctagtatgctggccgcagcgcctttacacgagcagaagcagatgatcggtgaaagactgtacccacttatccatgatgtacatacgcagctggccggaaagattactggaatgctactcgaaattgacaactccgaactgctgctgatgcttgagtcacctgagtccttacatgcgaaggctcaaaggagaaaagtccaacggctggtgaaatacatactcgctcttaaggaactttccacccaaaacttatag

SEQ ID NO: 58379 - DNA, 513 bp, Artificial Sequence
  Description of Artificial Sequence: Synthetic coding sequence
atggtcaggcctcccgtcgtcccaagacggcctccggcacatatcagcagtgtgagacaggcctcaactcaagtgccacgcactgtgccgcatactcagcgagtggcaaatattggcacacaaactactggtccctcaggtgtcggctgctgcacccctggtaggccactgctcccttgcaagtgctcatcagccgctcacagtacatacagagtgcaagagcctgccgtgcacatcccagggcaggaacctcttaccgctagtatgctagccgctgcccctctgcacgagcaaaagcagatgataggcgaaagactgtatcctctcattcatgacgttcacactcaactggcagggaagatcacaggcatgctgctagagattgataatagcgagttgctgctgatgcttgaaagccctgagtcactacatgctaaagctcaaaggcgcaaagtccaacggctcgtgaaatatatcctggcactcaaggagctgtcaacacagaatctgtag

SEQ ID NO: 58380 - DNA, 993 bp, Artificial Sequence
  Description of Artificial Sequence: Synthetic coding sequence
atgaatgcaagcggctctggctacccactggcctctctctatgtcggcgatttgcatccagatgttaccgaggctatgttgtacgagaagttctctcccgcaggccctattctgtcaattagagtgtgtcgggatgtggccactagacgcagcctgggttatgcttacattaacttccaacaaccagccgatgccgaaagagctctggacacaatgaactttgagatgctgaaaggtcagcccatccgcataatgtggtcacagagggaccctgggctgcgcaagagcggggtcggcaacatcttcatcaaaaatctcgaggatagtattgacaataaggctctctacgataccttttctacctttgggaacatcctgtcttgtaaggtagcatgcgacgagcatggttctagaggatttgggttcgtgcactttgagacacatgaggccgcacagcaggcgattaatactatgaatggcatgctactgaacgacaggaaggttttcgtgggacatttcaaatcacgcagagagcgggaggctgaactgggtgccagagccctcgaatttaccaatatttatgttaaaaacttgcctgtggatgtggatgaacagggactgcaggatctgttcagccagttcggcaaaatgctgtcagtgaaggtgatgagggataacagcgggcattccaggtgttttggatttgtcaattttgagaagcacgaggaggcgcaaaaagccgtggtgcatatgaacggtaaagaggtcagcggccgtcttttgtacgcgggtcgcgctcagaagagggtggagcggcagaacgagctcaaacgaagatttgaacagatgaaacaagatcgcttacgcaggtaccaaggggtgaatctgtatgttaagaacctggatgatagtatcgacgacgacaagctccgcaaggagttttcgccatacggggttatcacctccgcgaaaaaacgcagacaacggccatag

SEQ ID NO: 58381 - DNA, 603 bp, Artificial Sequence
  Description of Artificial Sequence: Synthetic coding sequence
atggcctctctgtacgtgggcgacttgcatcctgaggtaaccgaagccatgctatacgagaagttctcccccgctggcccaatccttagtattcgaatatgtagggacaaaatcacacgacgtagtctgggttacgcgtacgtgaactatcaacagcccgttgacgcaaaacgggctcttgaaacactgaatttcgacgttataaagggtcggcctgtccgcatcatgtggtcacaacgtgacccctcactccgcaagtccggcgtgggcaacgtgtttatcaagaatttgggcaaaactatcgataacaaagccctttataacatattcagcgcgttcggaaacatactttcttgtaaggttgcttgcgacgaaaaggggcctaagggctatggatttgtacatttccaaaaacaagagagtgcagaacgggcaatcgatgttatgaacgggatgttcttgaattatcgaaagattttcgtcggacgctttaagagtcataaggaaagggaagccgagcggggagcatgggcgagacagtctacaagcgcggatgtgaaagactttgaagaggacaccgacgaagaagcaacactccggtag

SEQ ID NO: 58382 - DNA, 603 bp, Artificial Sequence
  Description of Artificial Sequence: Synthetic coding sequence
atggcctcactttatgtcggcgacctgcatccagaagtgacagaagcaatgctctacgaaaaattcagtccagctggcccaatcctttcaatcagaatctgcagggacaagatcacgaggcgctcactcggctatgcctatgtcaactaccaacagccggtcgatgccaagcgcgctctggagacccttaacttcgatgtgataaagggcagacccgtccgcataatgtggtcgcaacgcgatccaagcctcagaaaaagcggcgtagggaacgtattcattaagaacctgggcaagacgattgataacaaggccttgtataatattttctctgcatttggcaacatcctgagctgtaaagtagcatgtgacgagaaagggccaaaaggatatggcttcgtacactttcagaaacaggagtctgcagaacgggcaattgatgtgatgaatggcatgtttctgaattaccgcaagatttttgtcgggaggtttaagtcacataaggagcgcgaagctgagagaggagcatgggcccgtcagtctacatctgctgacgtgaaggactttgaggaagatacagatgaagaggccacactgaggtag

SEQ ID NO: 58383 - DNA, 603 bp, Artificial Sequence
  Description of Artificial Sequence: Synthetic coding sequence
atggccagcctctatgttggggacctccatcccgaagtcaccgaagcaatgttgtacgagaagttctcaccagccggacctatactgtccatacgaatctgccgcgacaagattacaaggaggtccctgggttacgcttacgtgaattaccagcagcctgtcgatgccaaacgggctttggagacactgaacttcgacgtcatcaaaggtcggccagttagaataatgtggtcacaacgcgatccatcactccgcaagtcaggcgtagggaatgtctttattaaaaacttggggaagaccatcgataataaggcattatataacatttttagcgcctttgggaatatcctgtcttgcaaggtcgcctgcgacgaaaaagggccaaaaggttacggctttgttcacttccagaagcaggagtcagctgaaagagccattgacgtgatgaatggaatgttcctaaattatagaaagatattcgtcgggaggttcaaatcacataaagagcgggaagcagaacggggtgcttgggcacgacagagtacctccgccgatgtgaaggatttcgaggaggatactgatgaggaggcaacactgcgttag

SEQ ID NO: 58384 - DNA, 603 bp, Artificial Sequence
  Description of Artificial Sequence: Synthetic coding sequence
atggctagcctgtacgtgggggacctgcatcccgaagttaccgaggccatgctgtatgaaaagttcagccctgcagggccaattctttctatccggatttgccgggataaaatcacacgaagatcactcggatacgcctacgtgaactatcagcaaccggtggatgctaaaagagccttggagacactcaattttgatgttataaaagggcgacctgttaggataatgtggtcacagcgcgacccgagcctccgaaagtcaggcgtcggtaacgttttcattaagaacttagggaagactattgataataaggccctatataacatcttcagtgcattcggaaacatcctgtcttgcaaggtcgcttgcgatgaaaaagggcctaagggatacgggttcgtgcactttcagaagcaggaaagcgccgagagggcaattgacgtgatgaacggcatgttcctgaattataggaaaatcttcgtaggacgcttcaagtctcacaaagaacgggaggccgaacgcggtgcttgggccaggcaaagcacgtcagccgatgtcaaggacttcgaagaagacactgatgaagaggctacacttcggtag

SEQ ID NO: 58385 - DNA, 1134 bp, Artificial Sequence
  Description of Artificial Sequence: Synthetic coding sequence
atgtctgggtctgacggaggactcgaggaagaaccagagctttctattaccctgaccttacgtatgttgatgcacgggaaagaagtagggtctataattgggaagaagggcgagacagtgaagcgtatccgcgaacaaagttctgccaggataaccatcagtgaggggtcatgccccgaacgcataaccaccattaccggtagcactgctgccgtgttccatgcggtttcaatgattgcgtttaagctcgatgaagacctctgcgccgcaccagccaacgggggtaatgtcagccgaccacctgtgacgctgcggctggttattcccgctagccaatgtggatctctgattgggaaggccggtacaaagatcaaggaaatcagagagaccacaggtgcccaagtgcaagtcgcaggcgacctcttacctaactcaactgagcgtgcagtcaccgtatcaggcgtcccagacgcgataattctgtgcgttaggcagatctgcgctgttatcctggaatctccaccaaagggtgctaccattccctatcacccgtcccttagtctcggcaccgtgctcttgtcagctaaccagggattttccgtgcaggggcagtacggggcagtaaccccagccgaagttactaaactccaacagctgagttcccatgccgtgccattcgccactccctccgtcgtgccaggcttagacccaggcactcaaacgtcatcccaggaatttctggtacccaacgatctcattggttgcgtcattgggcgacagggttctaagatcagcgaaattcgacagatgtccggagcccacattaaaattggtaaccaggctgagggagccggagagcgtcatgttacaattaccgggtcgcctgtctcgatcgcactggcccagtacctgattaccgcatgcctggagactgctaaatccacatcaggcggtactccgagtagcgcgccagccgatctgcccgctcctttttcccccccacttaccgcccctcaactgccccttgcttgctgggcccatccgatgccaagcccctccccaaccagctccgcccaggcacatgcgctgctcggtttcaccacctgtttcccgagagcagctgccggactgtag

SEQ ID NO: 58386 - DNA, 732 bp, Artificial Sequence
  Description of Artificial Sequence: Synthetic coding sequence
atgattgcgttcaaactggacgaggatctgtgcgctgccccagcaaacgggggaaacgtttccagacccccagtcacactgcggctggttatacccgcatctcaatgcggatccttaatcggcaaggctggaacgaaaataaaagaaataagagaagtaactaagctccagcagctctcctcccacgccgtgcctttcgctaccccatctgtcgtgcctggactcgaccctgggacccagacatcttcccaggagtttctggtgcctaacgacctgattggatgcgtcatcggtcgccaggggagcaaaatctcagaaattcggcagatgtcaggagcccacataaagattggcaatcaggccgagggcgctggggagaggcacgtcactataacagggtcccctgtttcaatcgccttagcccagtacctgataaccgcctgtctcgaaaccgccaagagcacgagtgggggaaccccctcaagcgccccagctgatctgcccgcaccttttagccctcctcttaccgctctgccaacagcgccaccgggactgctgggaactccgtacgcgatatcgctcagcaatttcatcggactgaagccaatgccatttctggcactgccacctgcgtcaccaggtccaccgcctggcttggccgcttacactgccaaaatggccgcagcgaatgggagcaagaaagctgagagacagaaattttccccctactag

SEQ ID NO: 58387 - DNA, 1275 bp, Artificial Sequence
  Description of Artificial Sequence: Synthetic coding sequence
atgccacgctgtcccgctctcatactctaccttcagtcctctgcacggatcactatttctgaggggtcttgtcccgagagaattacaaccattaccggctcaacagcagcggtgttccacgcagtttctatgatcgcatttaagctcgatgaggacctgtgcgccgctcccgcaaatgggggaaatgttagcaggccccctgtgaccctcaggctggtaatccctgctagccagtgtggatccctaatcgggaaggcgggaaccaagatcaaggagataagggaagtgcggggagagatctaccatccacagggtatcaggggcaaaggtgctgtggtgcgaggagttttaggactgtggcgccctcctcacttagagagttccgaacccggtcagcccttctcgggtttgtgggagcagccagaagtggcacccgttctatgtctgcaaacaactggagctcaggtgcaggtggccggagatctcctcccgaattcaactgagcgggctgtgaccgttagtggcgtccccgacgcgataatactctgcgtccgccagatatgcgctgtaattcttgagtcccctcctaagggagccaccatcccataccatccaagcctgtcactcggtacagtgcttttgagtgccaaccagggtttctccgtacaggggcagtatggagcagtcaccccggctgaggtgaccaagctgcagcaattaagtagccatgctgttccattcgcaaccccatcagtggtgcctggcctcgacccaggcacccaaacatccagtcaagagttcctggtgcctaatgatttgataggctgcgtcatcggcagacaaggttccaagatttcggagatcaggcaaatgtccggggcacatatcaagatcggaaatcaggcagagggtgctggggagcgccatgtgacaataaccggcagccctgtcagcatagcacttgctcagtatctaatcacggcctgtctcgaaacggcaaagagtacaagcggaggaacgccctcatctgcgcctgctgacttacctgcaccattctcccctcccctgactgctctccctacagcaccacccggactcctcggtaccccatacgctatctcgctctctaacttcattggtttgaaacctatgccattcttggccctcccccctgcctcccccggtcctcctcctgggctcgccgcttataccgctaaaatggcggctgctaacggctccaaaaaagctgagagacagaaattttcaccctactag

SEQ ID NO: 58388 - DNA, 1083 bp, Artificial Sequence
  Description of Artificial Sequence: Synthetic coding sequence
atgtctggctccgacggaggcctggaggaagagcccgaattaagtattacattgacactgaggatgttaatgcacggaaaagaggtaggcagtataatcgggaagaagggggaaaccgtcaagagaataagggaacagtcgtctgcccgaattacaatctccgagggctcatgcccagaacgaatcaccacgataacgggcagcacagcagccgtctttcacgccgtctccatgattgcgttcaaactggacgaagacctctgcgcagcacccgctaatggtgggaatgtctctcgtcctcctgtgacgctgaggctcgttattcctgcatctcagtgcggttctctaatcggaaaagcgggtacaaagataaaggaaatcagggagagcccacctaaaggcgctactattccgtaccacccatccttgtctttgggcactgtcctgttgtctgctaaccagggattctctgtccaggggcaatacggtgcagtcactccagctgaagtgacgaagctgcagcagctttcatcgcatgcagtgcctttcgcaacaccctctgtggtgcccggattggacccaggaacgcagacatcgagccaagaattcctagtgcctaacgatcttattggctgtgtgatcggccgtcaagggtctaagataagcgagattcgccagatgtcaggcgcacatataaagattggcaatcaagctgagggtgccggtgagagacacgtgaccatcactggatccccagtgtcaatagcactggcacaatacctaatcaccgcttgtctagagaccgccaagagcacgtccggtggcacgccctcttcagcccctgctgatctgccggctccttttagccctcccctgacggcccttcctacagcgcctccgggattacttgggacaccatacgcgatttcactttctaattttatcggtctgaaaccaatgccctttctggcactgccgcctgcttcccctgggccaccacccggactggcagcttatactgctaaaatggcggctgctaacggttccaaaaaggcggagaggcagaagttcagtccttattag

SEQ ID NO: 58389 - DNA, 141 bp, Artificial Sequence
  Description of Artificial Sequence: Synthetic coding sequence
atgtcaggctcagacgggggactggaggaagagcccgagctcagtattaccctcacgctacgcatgctgatgcacggaaaggaggtgggcagcattattggcaaaaagggtgaaacagtgaagagaattcgcgagcagtag

SEQ ID NO: 58390 - DNA, 375 bp, Artificial Sequence
  Description of Artificial Sequence: Synthetic coding sequence
atgtcagggagcgacggagggctcgaagaggaacccgagctcagcattaccctgactctgagaatgcttatgcatggcaaagaggtgggttctataatcggaaaaaagggcgagaccgtgaagcgaatcagagaacagtcttctgctagaataaccattagtgaagggagctgtcccgaaaggattaccacgatcactggaagcactgccgcagtgttccatgccgtgagtatgatcgccttcaagctcgatgaggatctgtgtgccgcaccagctaacggcggaaacgtgagtcgaccaccagtgacccttcgcctggtgataccggcaagccagtgcggcagcctgattggaaaggctggcactaagatctag

SEQ ID NO: 58391 - DNA, 507 bp, Artificial Sequence
  Description of Artificial Sequence: Synthetic coding sequence
atgtctggatcagatggagggctggaagaggaacccgagctgagcatcaccttgaccctccgcatgctgatgcatggaaaggaagttggaagtattatcggtaaaaagggtgagacagttaaacgcattagggaacagagctccgcacgaataactatcagtgagggcagctgtccagaacgcatcacaacaatcaccggctccactgccgcagtgttccacgctgtgtccatgatagcctttaaattagacgaagatctttgtgccgcaccagctaatgggggtaacgtgagccgaccgccagtgactttgcgcctggtgatcccggcttcccaatgtgggtctctaataggaaaggccggaacaaagatcaaagagatcagggagaccacaggggcacaggtgcaggttgcaggggacctcctcccaaacagtacagagagagccgtcaccgtgtcgggagtgcccgatgctattattctgtgcgtgcgacagatatgcgcctag

SEQ ID NO: 58392 - DNA, 228 bp, Artificial Sequence
  Description of Artificial Sequence: Synthetic coding sequence
atgagtggatctgacggtggcctggaggaggaacctgaactctctataacccttaccctgaggatgctgatgcatggaaaagaggtgggcagtatcattggaaaaaagggcgaaactgtgaagcggattcgtgaacaatcctccgcacgaattacaatcagcgaggggagctgccccgaacgcattactaccatcacaggcagcacggcagctgtcttccacgcctag

SEQ ID NO: 58393 - DNA, 1083 bp, Artificial Sequence
  Description of Artificial Sequence: Synthetic coding sequence
atgtccggttcagacggcggactcgaagaggaaccggaattgtcgattactctcacccttagaatgctcatgcacggcaaagaagtgggctccatcataggcaagaagggggagacagtgaagcgtattagagaacagagttctgcccgtataactattagcgaaggttcgtgcccagagcggataactactattactggctccaccgcggcagtgtttcacgctgtcagcatgattgcttttaagttagacgaggatctatgcgccgcacccgctaatggcggtaatgtttctaggccgccagtgaccctccgattagttattcctgcctcacagtgcggtagcttaattggcaaggccggaaccaaaattaaggagatccgcgagagcccacccaaaggggctactatcccgtaccacccatcactgtccctgggcacggtgctgttaagcgcaaatcagggattttccgtacagggacaatacggagcagtgactcccgcagaagtgactaaactgcaacagctgagttctcacgcggttccatttgccacgcctagtgttgtaccgggactggacccaggcactcagactagctctcaggagttcctggttcccaacgacctcattggctgtgtgataggcagacaggggagtaagatttctgagattcgacagatgtctggcgcacacattaaaatcggaaaccaggctgagggagccggtgaaagacatgtcacaattaccgggagtccagttagtatcgctctcgcacagtacctgatcaccgcctgtctcgaaaccgccaaaagtacatctggagggacccccagcagcgcacccgctgatcttcctgcgccattctccccccctctgacagccctccccacagccccaccaggcctgcttgggacaccttacgccatatccctgagtaacttcattggcctcaagcccatgccattcttagcgctcccccctgcaagccccggacctcccccaggcttggccgcttacacagcaaaaatggccgctgctaatggctctaagaaggccgagcggcagaagttcagcccatattag

SEQ ID NO: 58394 - DNA, 279 bp, Artificial Sequence
  Description of Artificial Sequence: Synthetic coding sequence
atgtccggaagcgatggtgggcttgaagaggagcccgagctgagtatcacgttgacgctgaggatgttaatgcacggtaaggaggtcgggagtatcatcgggaaaaagggggaaacagtgaagaggattcgggaacaatcctccgccaggatcaccatcagcgagggctcatgtccagagcgaatcaccacaatcacagggagtacggccgctgtgttccacgcagtttccatgattgcctttaaactcgacgaggatctttgtgccgctcccgcatag

SEQ ID NO: 58395 - DNA, 261 bp, Artificial Sequence
  Description of Artificial Sequence: Synthetic coding sequence
atgtccggttcagatgggggactagaagaggagcccgaactaagcattaccctcacccttagaatgctgatgcacgggaaagaggttggttccattatcgggaagaagggcgagacagttaagagaatccgggagcagtctagtgccaggataacaattagtgaagggagctgtcccgaacgcattactaccattacggggtcgacagccgcagtcttccacgccgtgtctatgatcgcctttaagctggatgaagtttag

SEQ ID NO: 58396 - DNA, 324 bp, Artificial Sequence
  Description of Artificial Sequence: Synthetic coding sequence
atgtccggatcggatggaggccttgaagaggagcccgaacttagcataacacttacattgagaatgctgatgcatggaaaggaagtgggatctattatcggcaaaaagggagagaccgtcaaaagaatcagagaacagtcatctgccagaattaccatatccgaaggcagctgccccgagaggattaccacaatcacaggcagcactgcagccgtctttcatgcggtgtccatgatagccttcaaattggatgaggacctctgtgccgctcccgctaatgggggaaacgtgtccaggcctccagtgacgttgagactcgtctag

SEQ ID NO: 58397 - DNA, 3024 bp, Artificial Sequence
  Description of Artificial Sequence: Synthetic coding sequence
atgaaagacgaggctggggagagggaccgggaggtgtctagtttaaattccaagctgcttagtctgcagcttgacatcaaaaacctgcatgacgtgtgcaaacgccagagaaagacactgcaggacaaccagctgtgcatggaagaggccatgaatagcagccacgacaagaagcaagcccaagccctggcttttgaggaaagcgaagttgaatttggtagctcgaagcagtgtcatttgcggcagctacagcagctgaaaaagaagttgctggtcttacagcaggagttggaatttcacactgaagaactgcaaacatcttattactcgttacgtcagtatcagagtattctggaaaagcagacaagcgatctggttctcttacatcaccactgtaagcttaaagaggacgaggtgatcttgtacgaagaggagatggggaaccacaacgagaatactggggaaaagctccatctggctcaagaacagcttgcgcttgccggagacaaaatcgccagcctagaaaggagcttgaatctttacagagacaagtaccagagcagtctgtctaacattgaactgctggaatgtcaggtgaaaatgcttcagggcgaactgggcggaattatgggacaggaacccgagaataaaggggaccatagcaaggtccgaatttacacttccccctgtatgatccaagagcaccaagagactcagaagcgcctttccgaagtgtggcaaaaagttagccagcaagatgacttgatccaggaactccgtaacaaactggcctgttccaacgcgctcgtcctggagcgcgaaaaagccttgattaaactgcaggccgatttcgccagctgcaccgccactcaccgctacccaccgtcctcctcagaagagtgcgaggatatcaaaaagatcttgaagcatctgcaagagcaaaaagatagtcagtgcctgcatgtggaagaataccagaatctggtgaaggaccttcgtgtggagttggaagccgtgagcgaacaaaaaaggaatatcatgaaggatatgatgaagctggagttggacctccatggcttgcgggaagaaacgtcagcccacatcgaacggaaggataaggatatcactatcctgcagtgcaggctgcaggagctccagctcgagtttacagaaacacaaaagcttactctgaagaaagacaaatttctgcaggaaaaagacgagatgctgcaagaactggagaagaagctaacacaggtgcagaactcccttcttaaaaaagagaaagaactggaaaagcagcagtgcatggccacagagttggagatgaccgttaaggaggccaagcaggacaagagcaaggaggcagaatgcaaagcactgcaggctgaggtgcagaagctgaagaatagcttggaggaggccaaacagcaagaacggcttgccgcacagcaagccgcacaatgtaaggaagaagccgcactggcgggatgccacttagaggacacacagcgaaagctccagaaaggcctgctgctcgacaaacaaaaggccgacactatccaggaacttcagcgagagctgcagatgctgcagaaagagtcatctatggccgagaaagagcagaccagtaacaggaaacgggtggaagaactgtccctcgagctgagcgaagctctgagaaagctggagaatagcgataaagagaaacgacaacttcaaaagacagtggcagagcaggatatgaagatgaacgatatgctggacaggatcaaacaccagcatagagagcaaggatctataaaatgcaaattggaagaagatctgcaagaagccaccaagttgttggaggataagagggagcagctgaaaaagtcaaaggagcatgaaaagcttatggagggagaactggaggccctgcgtcaagagtttaagaagaaagataagactcttaaagaaaacagccgcaagcttgaggaggaaaatgagaatctgcgagccgagctgcagtgttgtagcacacagctggagagttctctgaacaagtataatacctcccagcaggttattcaagatctgaataaagagatagccctgcaaaaagagtcattgatgtccctgcaggctcaattagataaggctctgcagaaagagaaacactacttgcagactacaatcaccaaggaggcctatgatgcgttgtctcgcaaaagcgctgcatgtcaagacgacttaacacaagcactggaaaaactgaatcatgtgacttcagaaacaaagtctcttcagcagagccttacacagacccaggaaaaaaaggcacagcttgaggaagaaatcatcgcctacgaagaacgcatgaagaagctcaatactgaacttcgcaagttgcggggtttccaccaggagagcgagttggaggtgcacgcctttgataaaaaactggaagagatgagttgtcaggtgctgcaatggcagaaacaacatcagaatgatctgaagatgctggctgccaaagaggaacaactccgggagttccaggaggagatggccgcacttaaagaaaatttgctggaggatgacaaggaaccttgctgtctgccacagtggagcgttccgaaagacacatgccgactttatcgcggtaacgaccagataatgactaaccttgaacaatgggccaaacagcagaaggtagctaacgagaaactgggcaaccagttgcgggaacaggtcaaatacatagccaagctctctggcgagaaggatcatcttcattctgtcatggtgcatttgcaacaggaaaacaagaagctgaagaaagaaattgaggaaaagaaaatgaaagccgagaatactcggctctgtactaaagccctgggtccaagtcgcactgaaagcactcaaagagagaaagtctgcggcaccctgggctggaagggactgccccaggatatggggcagagaatggatctgacgaagtatattggcatgccccactgtccaggatcgagttactgctag

SEQ ID NO: 58398 - DNA, 2649 bp, Artificial Sequence
  Description of Artificial Sequence: Synthetic coding sequence
atgggaaaccacaacgagaacaccggggaaaagctgcacctggcccaggagcagcttgcgctggcaggggataagattgcgagcttagagagaagcttaaacctgtacagagacaaataccaatcaagtctgtctaatattgagctacttgaatgccaggtgaagatgttacaaggcgaactgggcggaattatgggtcaggaacctgagaataagggcgatcattccaaagttcggatttatacctcaccatgtatgattcaggagcaccaggagacccagaaaagactcagcgaagtatggcagaaggtctcccagcaggacgacttgattcaggaactgagaaacaagctcgcttgttcaaatgccctcgtgcttgagcgagagaaagccctgattaaactacaggccgactttgcctcatgcaccgcaacccaccggtatccaccttctagctctgaggagtgcgaggatattaagaaaatactcaagcatctgcaggagcaaaaagattcacagtgcctccacgtagaggaatatcaaaacctggttaaggatctgagagtggagcttgaggccgttagcgagcagaaaaggaacatcatgaaggacatgatgaaactggagcttgatctgcacggacttcgcgaggaaacttcagcccacattgaacgtaaggataaagacattaccatcctgcaatgccggcttcaggagctgcagctcgagtttactgagacacagaaattgacccttaaaaaggataaattcttgcaggagaaggatgaaatgctgcaggagttggaaaagaagctgacccaagtccaaaacagtttgctcaagaaggagaaggagttggagaaacaacagtgcatggcaacggaactcgaaatgactgtcaaggaggcaaaacaggacaagtctaaagaggcggaatgtaaggctctgcaggccgaggtacagaaactgaagaacagcctggaggaagctaaacagcaagaacgcctcgccgcacaacaggccgcacaatgtaaggaagaagccgcactggctgggtgccatctcgaagacacccagcgaaagcttcagaagggcctcctgctggacaagcaaaaggcggataccattcaagagctgcagagagagctccagatgctgcagaaggagtcgagcatggcggaaaaagaacagaccagcaataggaaaagggtggaggagctcagtctcgaactgagcgaggcgttacgcaagctggaaaatagtgataaagagaaacggcagttgcaaaagaccgtcgcagagcaggatatgaagatgaacgacatgcttgatcgcattaagcaccagcatagagagcagggttcgataaagtgcaagcttgaagaggatctgcaggaggctaccaaactgctggaggacaagcgagagcaattgaagaaatccaaggagcacgagaaactcatggagggtgagctggaagcccttcgacaggagttcaagaaaaaagacaagacgttaaaggagaactcacgaaagcttgaggaggagaatgagaatctaagagccgagctgcagtgctgttcaacccagctggagtcaagtctgaacaaatataatacaagccagcaggtgattcaggacctgaataaagaaatagctctgcaaaaagaatcactgatgagtttacaggcacaactcgacaaggctctccagaaagagaagcactacctccaaactactatcactaaggaggcatacgacgcactcagtcgtaagtcagctgcttgccaggacgatctgacacaggcactcgaaaagcttaaccatgtaacatcagaaaccaagtccctgcagcagagcctgacacagacacaggagaagaaggctcagctggaggaggaaattatcgcatatgaggaacgtatgaaaaagctgaacacagaactcaggaagctccgaggcttccatcaggagagcgagctcgaagtgcatgctttcgacaagaagcttgaggagatgagttgtcaagtgctgcagtggcagaaacaacatcagaacgatctgaaaatgctagcagccaaagaagaacagcttagagagtttcaggaagaaatggccgcacttaaggagaacctcctcgaagacgacaaagaaccctgttgcctcccacagtggtcagtgcccaaggatacatgtagattgtataggggtaacgaccagatcatgactaatctggagcagtgggccaagcaacaaaaggtcgcgaacgagaagctcggcaatcaactgagagaacaggtgaagtatatcgccaaactgagcggagagaaagacagggagcccacacgagcaagtagtccaaacacaaccagaccgagctcacctagccactcccacttgcactctgttatggttcatctacagcaagaaaataagaaattgaaaaaggagattgaggaaaagaagatgaaggccgaaaataccaggctgtgtaccaaagccttaggcccttctagaacggaaagtactcaaagggagaaagtctgcgggacactaggctggaagggccttccccaggacatggggcagcgcatggacctgacgaaatacataggaatgccacattgtcccggatcgtcctactgctag

SEQ ID NO: 58399 - DNA, 474 bp, Artificial Sequence
  Description of Artificial Sequence: Synthetic coding sequence
atgaaagacgaagccggagaacgagaccgagaagtctcctctctcaattctaagctgcttagcctccaactggatattaagaatctccacgatgtgtgcaagaggcagcgaaagaccttacaggataatcagctgtgcatggaggaggctatgaattcttcacacgacaagaaacaagctcaggcactcgcatttgaagaaagtgaggtcgaattcggaagctctaagcaatgccatttgaggcagcttcagcagctgaagaagaaacttctagtgcttcaacaggagctggaattccatactgaggagctgcagacctcatactactctctgaggcagtatcagtccattctggaaaagcagacctccgacctcgtgctcctgcaccatcactgcaagcttaaagaggatgaagtgatcctgtacgaggaggagatgggcaatcataacgagaacaccggggagaaattatag

SEQ ID NO: 58400 - DNA, 207 bp, Artificial Sequence
  Description of Artificial Sequence: Synthetic coding sequence
atgaaagatgaggccggtgaaagagaccgagaggtttcaagcttgaactctaagcttctgtcactccagttggacattaaaaacctgcacgatgtgtgtaagagacaacgcaagacattacaggataaccagctgtgtatggaagaggccatgaattccagccacgacaagaaacaggctcaggcattggctttcgaggaaagttag

SEQ ID NO: 58401 - DNA, 3069 bp, Artificial Sequence
  Description of Artificial Sequence: Synthetic coding sequence
atgaaggacgaagctggggagagagatcgcgaggtgtcgtcgctgaactccaagcttctgagcttgcagctggacatcaaaaacttacacgatgtgtgtaagcgccagaggaagacccttcaggacaatcagctatgtatggaggaagcaatgaacagcagtcatgacaagaagcaggcccaagcgctggcttttgaagaatccgaggtggaattcggcagttcgaaacagtgtcatcttcgacagctccagcagctaaagaaaaaactcctggtgctgcagcaagagctcgaatttcacactgaggaattgcagacaagctattacagccttcgacagtatcagagcatcctcgaaaaacagacgtcagacctagtgttgttacaccatcattgtaaactgaaagaggatgaggtgatattgtacgaagaagaaatgggcaatcataatgagaacacgggcgaaaaacttcacttagcccaggagcagcttgcccttgcaggagacaagattgcgtccctagaacggagtctgaatctttatagggacaaataccaatccagtctctcgaacatcgaactcttggaatgccaagtgaaaatgcttcagggtgaactcggcggaatcatgggccaagaacctgagaacaagggagaccactccaaagtgcgcatctatacctccccgtgtatgatccaggagcaccaagagactcagaagaggctctctgaggtctggcagaaggtgtcccagcaagatgacctgattcaggaattgcgaaataaactggcctgttccaacgccctggtgctcgagcgtgagaaggcccttattaaacttcaggctgactttgcgtcatgcacagctacccaccgctaccccccatctagctctgaagagtgcgaagatatcaaaaagattttgaagcatctccaggagcagaaggactctcagtgcctccacgttgaggaataccagaatttggtgaaagatctccgggttgaactggaggcagtctctgaacagaaacgaaatatcatgaaggatatgatgaagctagagcttgatctccacggcctccgcgaagagacgtcagcccacatcgagaggaaggacaaagatatcacgatcctccagtgccgactgcaggaattgcagctcgaatttacagagacacaaaagctcacactcaagaaggacaagttcttgcaagaaaaggacgaaatgctgcaggaactggaaaagaaactgacccaggtgcagaattcattactcaagaaagaaaaagaactcgagaagcagcagtgtatggctacagaactcgagatgactgtgaaggaagcaaagcaagacaagagtaaggaggctgaatgtaaagctcttcaggcggaggtccagaaactcaagaattccctcgaagaagcaaaacagcaagagaggctcgccggtgaagcacctgcagcacagcaagccgctcaatgcaaggaggaagccgcattagctggatgtcatctggaggacacccagagaaagcttcagaaaggcctcctgctggacaagcagaaggcggataccatccaggagctgcaaagggaacttcagatgctgcagaaggagagtagtatggcagagaaggaacagacaagtaacaggaagagagtggaggaactttctctggaactaagtgaagccctgcggaagcttgagaattccgacaaagaaaaaagacagctgcagaagacagttgcagaacaggacatgaaaatgaatgatatgctcgaccggattaaacatcagcatagagagcagggcagcatcaaatgcaagctggaggaagacttgcaagaggccacaaagctccttgaagataagcgtgagcagctgaaaaagagcaaggaacacgagaagcttatggagggcgagctggaagcattacggcaggaattcaagaagaaggataaaaccttgaaggagaactccagaaagctagaagaagagaacgagaacctgagggccgagctgcagtgttgtagcacgcaattagagagctcacttaataaatataacacttcccagcaggtgattcaagatttaaacaaagagatagcacttcagaaggagagtctaatgtcactgcaggcacagctggacaaggctctgcagaaggagaagcattacttgcaaaccactattacaaaggaagcttacgatgcccttagccgaaagagtgcagcatgtcaggatgacctgacacaagccttagagaagctaaaccatgtcacctctgagaccaagagcctgcaacagagtctcactcagacgcaagagaagaaggcccagttggaggaagagataatcgcctatgaagaacgcatgaaaaaattaaataccgaactgcgtaagttgcgaggatttcaccaggaatctgagctcgaggtccatgcatttgataaaaagctggaagaaatgagttgtcaggtgctgcagtggcagaagcagcaccagaacgatcttaagatgctggctgctaaagaagagcagttacgggaattccaggaggagatggctgccttaaaagagaatctgcttgaggatgataaggagccgtgctgcttgccacagtggagtgttcctaaagatacatgcagactttaccgaggcaacgatcagatcatgacaaatctcgagcaatgggcaaagcaacagaaggtggctaatgaaaagctgggcaaccagctacgcgagcaggtgaagtatattgcaaagctctctggcgagaaggaccacctgcactcggtgatggtccatttacagcaggagaacaaaaaacttaagaaagaaatcgaagaaaagaaaatgaaggccgaaaatacgaggctgtgcacaaaagctctgggtcccagccggacggagtctacacaacgcgaaaaggtgtgtggcactttaggatggaaaggcctgcctcaggatatgggccagagaatggacctgacaaagtatataggtatgccccattgccccggtacctctgctatctgtcagaagaataagtgtgatttctttctctag

SEQ ID NO: 58402 - DNA, 333 bp, Artificial Sequence
  Description of Artificial Sequence: Synthetic coding sequence
atgaaggacgaggcgggagagcgcgaccgggaagtgagttctcttaattctaagctgctttctctccaactggacattaagaacctgcatgatgtgtgtaagagacagaggaaaactctgcaggacaatcagctctgtatggaagaggccatgaatagcagtcatgacaagaaacaggcccaggccctggctttcgaggagagcgaagtggaattcgggtccagcaagcaatgtcacctgcggcagctgcagcagttaaagaaaaagttgctcgtgctgcagcaggagctggagttccatactgaagagctccaaacaagctactactcctag

SEQ ID NO: 58403 - DNA, 144 bp, Artificial Sequence
  Description of Artificial Sequence: Synthetic coding sequence
atgaaggacgaggccggagaacgggacagagaggtgtcctctctgaactctaagctcttatccctgcagctcgacatcaaaaacctgcatgatgtgtgcaaacgccagcggaagaccctccaggacaatcagctatgcatgtag

SEQ ID NO: 58404 - DNA, 1536 bp, Artificial Sequence
  Description of Artificial Sequence: Synthetic coding sequence
atggagagtacagggagcgtgggggaagctccgggaggacccagggtccttgtggtcggagggggtattgctggccttggggcagcacagcgcctgtgtggacattccgcatttcctcaccttcgggtgctcgaggccaccgctagggcgggtgggcgtatccggtctgaacgatgctttggtggcgttgtcgaggtaggcgctcattggatccatggaccgagccgaggcaaccctgtattccagcttgcggcagagtatggtctgctcggggaaaaagagctcagtcaggaaaaccagttggtggaaactggtggccacgtgggcctaccatccgtctcttacgcgagctccggagcttctgtctctctccagcttgtggccgagatggccaccctgttttatgggctaatcgaccaaacccgagagtttctgcatgccgctgagactcccgttccctcggtcggagaatacctgaagaaggagattgggcaacatgtggctggttggacggaggatgaagagacgaggaaactcaagcttgccgtgctcaattccttctttaacctcgaatgctgcgtgagcggcacccattcaatggatctagtggccctggctccatttggtgaatacaccgtgctgcctggcttagattgtacctttagcaagggctatcagggccttactaactgtatgatggccgcacttccagaagacactgtcgtgtttgaaaaaccagtgaagactatccactggaatggctctttccaggaagcagcattccctggcgaaacttttcccgtatccgtggaatgcgaagacggagataggttccccgctcatcacgtcatcgtgaccgtcccactcggatttttgagggaacacttggataccttttttgacccaccactgccagccgagaaggccgaggctatccgcaaaatcgggtttgggacaaacaataaaatatttttggaattcgaggagccattttgggagccagactgtcagttgattcagcttgtatgggaagacacttcccccttagaggatgcggcaccagagctgcaggacgcctggttccggaagctgattggctttgtagtgcttcccgctttcgcttcagtacatgtgctatgcggcttcattgcagggctcgagtccgaattcatggagactctgtccgacgaagaagtcctgctgtgcctgacccaggtgctgcgtcgtgtgactggtaacccacgtctgcctgcgccaaaatccgtattacgcagcaggtggcacagtgctccttatacacgcggatcctattcttatgtggccgtgggctctaccggaggggacctggatttgctcgcacagccccttcctgcagacggggctggtgctcaactacagatcctgttcgccggtgaggccacacaccgtacattctattctactacccacggggctttattgagcgggtggagagaggctgacagactcctctcgctgtgggcaccccaagtccagcagcccagacctcgtctttag

SEQ ID NO: 58405 - DNA, 1461 bp, Artificial Sequence
  Description of Artificial Sequence: Synthetic coding sequence
atggaaagcaccggaagtgtgggagaggcaccgggaggacccagagtgctcgtcgtgggaggtggcattgcaggcttgggggcagctcagcgtttgtgtggccatagcgcttttccccatttaagggttctagaagccaccgctagagccggagggaggatccgctcagaacgatgttttggcggtgtagtcgaggttggcgcacactggatccatggtcctagtcggggaaaccctgtatttcagttagcagcagagtacggcctgctcggtgagaaggaactgagccaggagaaccagctggtggagacaggaggacatgtgggccttcccagcgtttcctacgcaagctcgggcgcttctgtcagtctccagttggtggcggagatggccacgctgttctatggcctgatcgaccagacacgcgagttcctgcacgcagccgagacgccagtgcctagcgtgggcgagtatcttaagaaggagatcggtcagcatgtggccggttggaccgaagatgaggaaacacggaaactcaagttggccgtgcttaactccttttttaatttggagtgttgcgtgtccggcactcatagcatggatttagtcgccctggcgccttttggggagtacacagtgttgccgggactggactgcactttttccaagggctatcagggcctgaccaactgcatgatggccgctctccctgaagacacagtggtgttcgaaaagcctgttaaaactattcattggaatggttcctttcaggaggcagccttcccaggagagacttttccggtgagcgtggagtgcgaggatggggatcgttttcccgctcaccatgtgatagtgactgtcccactcgggtttctacgcgagcacctggacaccttctttgatccacccctgccagccgagaaagcagaagcaatccgtaagataggattcgggacaaacaataaaatctttttggagttcgaggagccattctgggagccagactgccagttgattcaacttgtgtgggaggacaccagcccactggaggatgcagcgccagaactgcaggacgcctggtttaggaaacttatcggcttcgttgttctgcctgctttcgccagcgttcatgtcttgtgcggatttatcgccggactggagtcggaattcatggagactctctcggacgaagaagtgcttctctgtttaactcaggttctgcgaagggtcacagcgcctgaccctgtgtgcgggggatctcatacttcacacgtgttactccacgatgccagaggctccgccgtgggcatggaagggggacgccctccccctcagtctgttgggcctgcaggtgctgccgcacaggcccaagctttggcagggccttctctgctctgtagcacgcgggtgggcggacgacttgggcctagctttctgttgaccgacttctcactcgcatag

SEQ ID NO: 58406 - DNA, 342 bp, Artificial Sequence
  Description of Artificial Sequence: Synthetic coding sequence
atggccactctcttctacggattgatcgaccagactagagaatttctccacgcggcagaaacacccgttcccagcgtcggcgagtacctcaagaaagagattggtcagcacgtggcgggatggactgaggatgaggagactaggaagctgaagctcgctgtactcaattcttttttcaacctagaatgctgcgtgtcaggtacgcatagacgcaccggactctgctgtagagacggcggtcgacccacagcgagcagcgtgtgcgggccacgccgatgtagctccccaggccctggatctagctgggctcagccaaccctgtttcacccctgcagaggctag

SEQ ID NO: 58407 - DNA, 699 bp, Artificial Sequence
  Description of Artificial Sequence: Synthetic coding sequence
atggagagcacgggaagcgtcggggaggcacccggtgggcctcgggtcctggtggtcggcggtggaatcgcagggctgggcgcagctcagagactgtgcggccactcagcgttcccgcatctaagggtgctggaggccaccgctagagctgggggaaggattcgctcagaacgctgttttgggggtgtcgtagaggttggtgcacattggatccacgcagcaccggaactccaggacgcctggtttcgcaagctcatcggctttgttgtcctccccgcattcgctagcgtgcatgttttgtgcggcttcatagctggcctagaatccgaattcatggagaccttgtcagacgaagaggtcttgctgtgtctgacccaggtcctcagacgtgttaccggtaacccccgactgccggctcccaaaagtgtgctaagaagtaggtggcattcagctccctacactaggggatcctactcctatgtggcagtgggcagtacaggtggggacctcgatctcctggctcagcccctgcccgctgatggagcaggtgcccaactacaaattttgtttgccggagaggctacccaccgcacgttttactcgacgacccatggcgctctgctcagcgggtggagagaggctgaccgcctgttatctctgtgggctccccaggttcagcagcccagaccaagactttag

SEQ ID NO: 58408 - DNA, 210 bp, Artificial Sequence
  Description of Artificial Sequence: Synthetic coding sequence
atggagagcactggaagcgttggagaagcccctgggggtccacgagttctggtggtggggggagggattgctggtttgggcgcagctcagaggctgtgtgggcactccgctttccctcacctcagagtactggaggccaccgctcgcgctggaggacgtataagaagcgagcggtgttttggcgcaattaaagatagccagaccgcgtag

SEQ ID NO: 58409 - DNA, 1392 bp, Artificial Sequence
  Description of Artificial Sequence: Synthetic coding sequence
atggagtcaaccggaagcgtaggcgaggctccaggtggccctcgagtgctggttgtcggaggtggaatagctggattgggcgcagcccagaggctctgcggacacagcgcgtttccccatctgcgcgtgttggaggcaactgctagggccggtggcagaatccgatctgagcgctgtttcgggggagtagtggaagtcggtgctcactggattcacggacctagccgtggcaacccagtttttcagcttgcagccgaatacggactgctgggggaaaaagagttgtcacaggaaaaccagcttgtggaaactgggggtcacgtcgggctcccgtcggtgagttacgcctctagcggtgctagcgttagtttgcagctggtggctgagatggccacactgttctacgggctgattgaccaaactcgcgagtttctgcacgcggcagaaacacccgtgccaagcgttggggaatatttgaagaaagaaatagggcagcacgttgcaggctggacagaagatgaggagaccaggaaactgaagcttgctgtcctgaactcattcttcaacctcgagtgctgcgttagtggaactcattcaatggacctagttgccctggcccctttcggagagtacaccgttttacctgggttggattgcacgttttccaaaggctaccaggggctgaccaactgtatgatggcagcacttcctgaggacacagtcgtcttcgagaaacccgtcaagactatccattggaacgggtcatttcaggaagccgcatttcccggtgagacgttccctgtctctgtcgagtgcgaagacggagacagatttccagcccaccacgtgatcgttacagtgccgctagggttcctgcgcgagcatctggacacttcaccactggaggatgccgcaccagaactgcaggacgcctggttcagaaagctgattggtttcgtggttctacccgcttttgcttctgttcatgtactgtgcggcttcattgccggactggaatcagagttcatggagacactttccgatgaagaagtcctcctttgtttgacgcaggtgctccgaagagtgactggaaacccgcgactccccgctcccaagtccgtgttgagatctagatggcattccgctccatacaccagaggtagctacagttacgtcgccgtgggatcgactgggggagatcttgaccttctcgcgcaacctctgccggctgacggagccggagctcagcttcagattctctttgctggggaagcgacacacagaaccttttactcaacaacccacggcgctctgttgagtggctggcgcgaggccgacaggctgctgtccctctgggcacctcaggtgcaacagcctcgccctcgactgtag

SEQ ID NO: 58410 - DNA, 252 bp, Artificial Sequence
  Description of Artificial Sequence: Synthetic coding sequence
atggaatccactgggagcgtgggagaggccccaggaggacctagggtgctggtggtaggaggcggaatcagccgcagctgccttcgcggtaaaccccatatagctcgatttactccacgcaggactggactgtgttgtagagatggtggtcgccctaccgcaagctcagtgtgtggcccacgcaggtgcagctcacccggacccggttcttcctgggcccagccaacattattccatccctgccgcggatag

SEQ ID NO: 58411 - DNA, 978 bp, Artificial Sequence
  Description of Artificial Sequence: Synthetic coding sequence
atggagtccaccggctccgtgggggaagctccgggtggaccgcgtgtgctggtggtcgggggtggcattgctggtctaggggctgcccagcggctgtgcggccacagtgcattcccgcatctgagagttctagaagctactgcgagagctgggggtaggatcaggtccgaaaggtgctttggcggagttgttgaggtcggcgcacactggattcacggcccttcccggggtaacccagtctttcagctcgccgctgagtatggcctgctgggagagaaagagttgagccaagagaaccagctggttgagacgggagggcatgtcggtctacccagtgtgtcgtatgcatctagcggcgcatccgtgtccctgcagctggtggctgagatggcaaccctgttctacggcctcatagaccagaccagagagttcctgcacgccgctgaaacacccgtgccctctgtgggggagtacctgaagaaagaaatcggacagcacgtcgccggatggaccgaggacgaggagacgcggaaattgaagcttgctgtcctgaatagttttttcaacttggagtgctgtgtctcaggaacacatagcatggacctcgtagccctggctccatttggcgagtatacggttctgcctggactcgactgtacgtttagcaaaggatatcaagggctcacgaattgtatgatggcagccctccctgaggacaccgtggtttttgaaaagccagtgaaaaccatccactggaatggatcattccaagaggcagcattcccaggtgagacttttcctgtcagcgtagaatgtgaagatggggacagatttcctgctcaccatgtgattgtgactgtgcctctcggacttagcacatttagcgtggggtccttgccagacttatccctgtcctcctggcggctctgccgcatgaagaaatatttctgtgtctctcccaaatgtagtggtgagtag

SEQ ID NO: 58412 - DNA, 132 bp, Artificial Sequence
  Description of Artificial Sequence: Synthetic coding sequence
atggaatctaccgggtccgtaggggaggcaccaggaggcagacatggtccccgacggggtccccaccccttaggagcgttgctacgatggcgtggagggggaggacgggcattggatccctgttgcccctag

SEQ ID NO: 58413 - DNA, 2976 bp, Artificial Sequence
  Description of Artificial Sequence: Synthetic coding sequence
atgtctgccgttggactcgttctgctggtgcttgctctgagattacgggcaaccacagtgaagcctgaagaagggagtttctgctcaaacagccaagtggcttttcgcgatgcgtgttacgagttcgttcccttggggaggacattcagagacgcacagagctggtgtgaggggcagggcggacatctggtctttatccaggacgaaggaactcaatggttcctgcaaaaacacatttctcaggatagggaatggtggattggactaacctggaatctggcacggaatggtacaaccgagggcccaggtacatggctcgatacttcgaacgtgacctatagcaactggcatggcggtcaggccgctgcagccccagatacctgtggtcacattggcagaggcccatcatcagaatgggttacgtctgattgcgctcagaccttcgcctttatgtgcgagtttagagtaggtcagagccttgcgtgcgaaggacttaacgcaaccgtacattgcggcctgggtcaagtgatccaagtgcaggatgcagtttacggtaggcagaacccccacttctgcacacaggacgccggaaggccttcagatttggaacaggggtgttcttgggctaacgtgaaggaggaagtggcaggtcaatgtcaagagctccaaagttgtcaggtggctgccgacgagacttattttgggaatctctgccccacccagggctcctatttgtgggtgcaatatcagtgcagggaagctcttcagctgatggttagctctgaatcttttatatttgataacgtgacgatatctctcacctggcttctttcaccatatattgggaacctgagctgcattatttctactggggactcccatacattcgacccctacaacccaccaagtgtaagcagcaacgtgacccaccagttcactagccctggcgaattcacagtgtttgccgagtgcacaaccagtgagtggcatgttaccgctcagaggcaggtcaccgtacgcgataaaatggagacactgagtgtgactgcctgcagcgggctctctcaatcaggggctggacccttatgccaggccgtgttcggcgatcccctctggatccaggtggaactcgatggcggaacgggcgtgacctacactgttttgctcggcgacattacgctcgctgaatcaactacgcagaaggggagccttccatataacctgatcctcgatagagagacacagaaactgatggggcctggacggcacagacttgaaatccaggctacagggaatacaactacaagcactattagtagaaacattactgtgcacttggtggaattactgtccggtctgcaagccagctgggcctctgaccacctggagttggggcaggacttgctcatcaccataagcctggcccaaggcactcctgaggaacttaccttcgaagtcgcaggacttaacgctactttctctcatgagcaggtgagcttcggagaaccgtttgggatctgcaggctcgcagtgcccgtcgaggggacttttttggtgactatgttggtccggaacgctttctccaatctgtcactggagattggcaatatcacaattacagcccctagcggactgcaggagccctcgggtatgaacgctgaaggcaaatccaaagataagggggacatggaggtttacatccagccagggccatacgttgacccatttaccaccgtgacgcttgggtggcctgataatgacaaagaattgcgcttccagtggtcctgtgggtcctgctgggcactctggagctcttgtgtggagcgacaactgttgcgtacggatcagagagaattggttgtgccagcttcgtgcctgcccccacctgactccgccgtgaccctccgcctggctgtcctcagaggccaagaactggagaacagggccgaacagtgtctgtatgtgtcagcgccttgggagttgcggcctagagtaagctgtgagagaaattgtcgacccgtgaacgcctccaaggacattttgctcagagtaacgatgggcgaggacagtcccgttgccatgttttcctggtaccttgataacaccccgactgagcaggcagagcctctgctggatgcctgtcgactgagaggattctggccccgaagcttgactctccttcaatccaatacttcaactttgctgctgaactcttccttcctccagagcaggggagaagtaattcgtattagagctacagctctgactagacatgcctatggagaagatacgtacgtgataagtaccgtacccccaagggaggtgcccgcatgtactatagcccctgaagagggcactgtgctcactagtttcgctatcttttgtaacgcctcgactgcacttggcccactcgaattctgtttttgcctggaatctggtagttgcctgcactgtggcccagaaccagccctaccttccgtgtacttgccgttgggggaagaaaacaacgatttcgtgctgacagtagtgatttccgccactaatcgggctggtgatacacagcaaacccaagctatggccaaagtggcactcggggatacctgcgtagaggatgttgccttccaggccgctgtcagtgaaaagatccccactgccctgcagggcgaggggggtcccgaacaattgctgcagctggcaaaggccgtctcctcaatgctgaaccaggagcatgagtcccagggtagcggccagtcactaagtatagatgtcaggcagaaggttagagagcatgtgctgggaagcctaagtgcggtgaccaccggtcttgaggatgtccagcgagtgcaggaactggctgaagtgctcagggaagtgacatgtaggagcaaggagctgactccttccgctcagggatcctgcatgggagatagttgggaaggcgctccgcctgccgctcatgtgtcccatgccaggtag

SEQ ID NO: 58414 - DNA, 1560 bp, Artificial Sequence
  Description of Artificial Sequence: Synthetic coding sequence
tgattagcccagggcacccctgaggaactgacatttgaggttgccggactgaatgccacatttagtcacgaacaggttagctttggggagccctttgggatctgcagactggccgtgccagtagaggggacctttctggtgactatgctcgttcggaacgccttctctaatctctctctggagattggtaatattactatcaccgcgccttccggcttacaggagccatccgggatgaacgcagaaggtaaaagcaaagacaaaggagatatggaggtgtatattcagcctggaccttatgtagacccttttacaaccgtgactttgggctggccagacaatgataaagagctgcggttccagtggtcgtgtggatcttgctgggccctttggtcaagctgtgtcgagaggcagctgctccggacagaccaaagagaactggtggtgcccgcatcatgcctgccccctcccgattcagcagtgacgctgaggctggctgtcctcagagggcaagaattggagaaccgagctgaacagtgcctttacgtgagcgccccttgggagctgcgcccacgcgtctcttgtgagcgaaattgccggccagtgaatgcctcaaaggacatcctgctgagggtgaccatgggtgaggactcccctgtggcgatgttttcttggtacttagataatactcctaccgaacaggctgagcctctgctggatgcatgtcgcctccggggtttttggcctcggtctctgactttactgcagtccaatacttctacgctcctgttgaattcctcattccttcagagtagaggtgaggtgatcaggattagagcaaccgcccttactcgccacgcctatggggaagatacttatgtgatcagcacggtgcccccacgcgaagtgccagcctgcacaatcgcacccgaagagggaactgtcctcacgagctttgccatcttttgcaatgcctccaccgctctcgggccactggagttctgtttctgtctcgagtcaggttcctgcctccactgtggcccagaaccagctttgccttctgtatacctacccctcggggaggagaataatgacttcgttctaaccgttgtcatctcagctacgaatcgagctggcgatactcagcaaacccaagctatggccaaagtagcactgggcgatacgtgcgtggaagatgttgcatttcaggcagctgtgtctgaaaagattccaactgctcttcagggagaaggtggcccagaacagcttttgcagctcgccaaggcagtcagctcaatgctgaatcaggagcatgagtcccagggaagcgggcagtccctcagtattgacgtgagacaaaaagttagagagcacgttttggggtctctatcggcagtgacaaccggattagaagacgtgcagcgggtacaggaactggccgaggtcctgcgagaggtgacgtgtagatccaaagagctgacaccttctgcccaggggagctgtatgggtgatagctgggaaggagcccctccagcagcacacgtctcacacgcacggtag

SEQ ID NO: 58415 - DNA, 798 bp, Artificial Sequence
  Description of Artificial Sequence: Synthetic coding sequence
atgcctctaccggtagcgctgcagaccagactggccaagcgaggaattctcaagcatctagaaccagagcctgaggaagaaattatcgcagaggactacgatgatgatcctgtggactacgaggcaacaagactggaaggcctgcccccttcctggtataaagtgttcgaccctagctgcggtctcccctattattggaatgctgacactgatttagtttcctggcttagcccccacgatcccaacagtgtggtaactaagtcagctaagaagctacggagctcaaacgccgacgcagaagagaaattagacaggtctcacgacaaatcggatagaggacatgataagtcagatcgttcacatgaaaagctggatcggggtcacgacaagagcgatcggggtcacgataagagcgatagagatagggaaaggggttatgataaggtggatcgcgagcgagaaagggaccgagagcgggaccgggacaggggttacgataaggctgaccgtgaggaaggaaaggagcggcgtcatcatagaagggaagagttggccccttatccaaagtcaaagaaggccgtatctagaaaagacgaggagctcgatcccatggatccctcatcttactcggatgcccctcgaggtacctggagtaccggattgccgaaacgaaacgaggcgaaaactggcgctgatactacggcagccggacccctctttcagcagaggccttacccctccccgggtgccgtgctccgtgctaatgccgaggcgagtaggaccaagcaacaggattag

SEQ ID NO: 58416 - DNA, 798 bp, Artificial Sequence
  Description of Artificial Sequence: Synthetic coding sequence
atgcccctgcctgtagccttgcagactagactcgctaagagggggattctgaaacacctagagccggagcctgaagaggaaattatcgccgaggactacgacgatgaccccgtcgactacgaggctacacgcctggaggggctccccccatcctggtataaagtctttgatcctagttgtggactgccatactactggaatgctgatactgatctggtgtcgtggctttcccctcacgatcctaactctgtggtgactaaatccgccaagaaactgcgtagcagcaacgccgacgccgaggaaaaactcgatcgaagtcacgataagagcgaccgaggacacgacaaaagcgacagatcccatgagaaattggatcggggacacgacaagagcgatcggggacatgataagtccgatcgcgatagggaacgcggatacgataaagtcgacagggagagggaacgtgacagggaacgggaccgcgatcgaggttatgataaggctgacagggaggaaggaaaggaacggcgtcatcatcgacgagaggagctggcaccgtaccctaagtcaaaaaaagctgtctcacgaaaggacgaagagttagacccaatggatccttcaagctatagtgacgctccaagaggtacatggagcaccgggcttcctaagcgcaacgaggccaagacaggtgcagacactacagccgcaggcccattgtttcagcagcgtccttaccccagccccggtgccgttttgcgcgcaaacgcagaggcaagcagaactaagcagcaggattag

SEQ ID NO: 58417 - DNA, 798 bp, Artificial Sequence
  Description of Artificial Sequence: Synthetic coding sequence
atgcccttgcctgtggcactgcagacgagattagccaaacgcggaattttgaagcatctcgagccagaacccgaggaggagatcattgccgaagattacgacgatgatccggtggactatgaggccacgagattggaaggattacctccatcttggtacaaggtgttcgatccttcgtgtggacttccttactactggaatgccgataccgacttagtgtcctggttaagtccacatgaccctaacagtgtggtcaccaaatccgccaaaaaattgaggagtagtaacgccgacgcggaggagaagctcgaccggagccacgataaaagcgacaggggacacgacaaaagtgacagaagccatgagaagctcgatcgtggccatgataagagcgatcgaggccatgacaaatccgaccgcgaccgcgaaagaggctacgacaaagtggacagggaacgggaaagagaccgagaaagagacagggaccgtggatacgacaaagccgatcgggaggaaggcaaagagaggagacaccacaggcgagaggaactcgccccttaccccaaaagcaaaaaagcagtgtcacgaaaagacgaggagctggatccgatggacccctcgtcctactcagacgcccctcggggaacctggtcaacaggcttacccaaacgcaatgaggctaagaccggggcagataccacagccgcaggcccactctttcaacaacgaccttacccgagccccggagctgttcttagagctaacgccgaagcatcccgcacgaaacagcaggattag

SEQ ID NO: 58418 - DNA, 513 bp, Artificial Sequence
  Description of Artificial Sequence: Synthetic coding sequence
atgccactgcctgtcgcacttcagacgagactggcgaagcggggtatcctgaaacatcttgaacccgaacccgaggaggaaatcattgccgaagactacgatgatgacccggtcgactacgaagcaactcgtctggaaggactgcctccaagctggtataaggtctttgacccgtcctgcggactcccttactactggaacgcagacacagatctggtgtcctggctctccccacatgacccaaattcagtcgtcaccaaatccgctaaaaaattgagaagtagcaatgcagcagttagcaggaaagatgaggagttagatcctatggacccaagctcctattctgatgcccctcgcggaacatggagtaccggcctgcctaaaaggaatgaagctaagaccggggcagacacaaccgccgctgggcctttgttccagcagcgcccttatccgagcccaggtgcagttttaagagcaaatgcggaggcgtcacgcaccaagcagcaggactag

SEQ ID NO: 58419 - DNA, 1446 bp, Artificial Sequence
  Description of Artificial Sequence: Synthetic coding sequence
atgtaccaggcaagtgccgtatctctgctccccagagacataccctcctgccatagtccatctcctggtttctcccacctgcccacatcttctagccagctcgctcctgacctgctacagtttcctctcggccaggaccccagtttcttggccatccctatcctaacacttcctccctcagactcactagtgccgccatacattgtctggtacattgtttggcccagcgcgttaatttcctttctggggtgcacactgactgtgcagttcagtaatggcaaactccagtcccccggaaatatgaggttcaccctatatgagaataaagactccacaaacccacgaaaaaggaatcagcgcattttggccgctgagaccgaccgcctgtcctacgtaggaaataacttcgggaccggagccctgaagtgcaacacgctatgtcggcatttcgtcggcatcctgaacaagacatctggacaaatggaagtctatgatgctgaactgtttaatatgcagccattattcagtgatgtgtcagtagagagtgaactagccctcgaatcccaaaccaagacataccgagaaaagatggactcctgtattgaggcttttgggacaaccaaacaaaagagggccttgaatacgcgcaggatgaatagagtgggcaatgagagtcttaatcgggctgtggcaaaggccgcagagaccattattgatactaaaggtgtgaccgcactggtctctgacgcgattcataatgacttgcaagacgatagcctttaccttcctccctgttacgacgacgctgccaaacccgaggatgtgtacaaattcgaagatcttctgtcaccagccgagtacgaggccctgcaatcaccgtccgaggcttttagaaatgtgaccagtgaggagatactaaagatgatcgaagagaactcacattgtacatttgtaattgaggccctgaaatctctgccttccgacgttgaatcgagggatcggcaagccagatgtatctggtttctcgacactctgataaagtttagggctcaccgggtcgtcaagaggaaatctgcgctgggacctggagttccacacatcatcaacacaaagttgctgaagcacttcacctgtttgacctacaataacggcaggctcaggaatttgatcagcgacagcatgaaggccaagattaccgcttatgtgataatccttgccttgcatatccacgactttcagattgacctgaccgtgcttcaaagggaccttaaacttagcgaaaaaagaatgatggaaatcgccaaggccatgaggttgaagattagcaaacgaagagtgagtgtggccgctggttcagaggaagaccacaaacttgggaccctttcactgcccttacctcccgctcagacgtccgatcggctggccaaaagacgaaaaatcacatag

SEQ ID NO: 58420 - DNA, 1260 bp, Artificial Sequence
  Description of Artificial Sequence: Synthetic coding sequence
atggccgctgaggttctcccttccgccagatggcagtactgcggggcacctgatgggtcacagcgtgctgttcttgtgcagttctccaacggcaaactccagtctcccggaaatatgcggtttacactgtacgagaacaaagatagcaccaatccacgcaaaaggaaccagcgaatactcgcagccgagaccgacaggctgagttacgtgggcaataatttcggaaccggcgctctgaagtgtaacacactctgccgccacttcgtgggaattctgaataagacatccggtcagatggaggtatacgatgccgaattgtttaacatgcaacccctgttctccgatgtttcggttgagtctgaactggcattagaaagccagacaaaaacatatcgcgagaagatggactcatgcattgaggcctttgggaccacgaaacagaagagagcgctgaacacccggaggatgaatcgcgtcggaaacgagtctctcaatagagctgtagccaaggctgcagaaaccatcatcgacactaaaggggtcaccgccctggtaagcgacgctatccacaacgaccttcaagacgactctctgtatctccctccatgttatgatgacgcggctaagcctgaagatgtttacaaattcgaagatctactgtcacccgcagaatacgaggctctgcagtccccatccgaggcttttcgaaatgtcaccagcgaggaaattcttaaaatgatcgaggagaatagtcactgcacattcgtgattgaggcgctgaagagcctccctagcgatgtggaatctagggaccgccaagcacggtgcatctggtttctcgatactttgatcaaattccgggcacatagagtcgtgaaaagaaagtcagcgctgggtcccggagtaccacatattatcaataccaaactgctgaaacacttcacatgtctgacctataataacgggcgacttagaaatctgatctcagacagtatgaaggctaagataaccgcttacgttattatcctggctttgcacatccacgatttccagattgacttaacagttttacagcgtgacctcaaactgtctgaaaaacgcatgatggagatagctaaggccatgagactcaagattagcaagaggagagtgagcgtagcagctggcagcgaggaggatcataagttaggtaccctgtcactgccattgccaccggctcagaccagtgatcgcctggcaaagcgcagaaagattacttag

SEQ ID NO: 58421 - DNA, 561 bp, Artificial Sequence
  Description of Artificial Sequence: Synthetic coding sequence
atggccgcagaagtccttccgagtgcaagatggcagtattgcggcgctccggatgggtcacagagagcggtcctcgtccaattttccaatggtaaactgcagtcaccagggaatatgcgcttcactctatacgagaataaggattcaacaaaccctcggaagcggaaccagcgcattctagctgctgagacagatcggttgagctacgtggggaacaactttggtacgggggcactgaagtgtaacaccttgtgccggcattttgtggggatcttgaataaaacaagcgggcagatggaagtgtatgatgcagaacttttcaacatgcagccactctttagcgacgtaagcgtcgagagtgaactagcccttgaaagtcagaccaaaacttaccgcgagaaaatgaccccttctacatttctgcccgcaatgatgatgcagccttctcttaaaacatgcataaatttgaaaattttctttcccttgtggcgagctgagactgcccgtccagatgcatacggattctggatacccagctccaacttcgaactgatcggctag

SEQ ID NO: 58422 - DNA, 1050 bp, Artificial Sequence
  Description of Artificial Sequence: Synthetic coding sequence
atgatgttaaattgcagcacttgctcccattacttccaggtgttccatcaggaaagcaaaattatcttttggaaagagccaagaacatgcttcctgatcctgtcactgcctcttcccggagaactcacgtgggatgtatctgtcgaatcagaattggccctcgagagccagacaaagacttatcgcgagaagatggacagctgcattgaagcttttggcactacgaagcagaaacgggctctcaacacccgaaggatgaatcgggttggtaacgaaagcttgaaccgcgcagtagccaaggccgcagaaaccatcattgatacaaaaggggtcactgcgttagttagtgacgcgatccataatgatctgcaggacgacagcctatacctcccaccgtgctatgacgacgccgcaaagcctgaagacgtatacaagttcgaggacttactcagccctgctgagtatgaggcccttcagagtccgtccgaggcgtttcgcaacgtcactagtgaagagatactcaagatgatcgaggaaaacagccactgtacattcgtgatcgaggcactgaagtccctaccgagtgacgttgagtccagagacaggcaagcaaggtgtatttggtttctcgacacactgatcaagtttcgcgctcacagggtggtgaagagaaagagcgcgttagggccaggggtgccgcatataattaacacaaagttgctaaaacattttacctgtctcacctacaataacggcaggctgcgcaatctgatttctgactccatgaaggcgaagattacggcttatgtaatcatccttgctctacatattcatgacttccagatcgacctgactgtcttgcagcgcgatttgaagctgtcagaaaaacgaatgatggagatagcgaaagctatgaggctcaaaatcagcaagcgtcgcgtgtctgtggcagctggaagtgaagaggatcacaagctcgggactctgtcactccctctccctcctgctcagacatctgaccgcttggctaaacgcagaaaaatcacatag

SEQ ID NO: 58423 - DNA, 588 bp, Artificial Sequence
  Description of Artificial Sequence: Synthetic coding sequence
atggcttcccgcggaggtggccgtggacgcggtcggggtcaattgacgtttaatgttgaagctgtgggcattgggaagggcgacgctcttccgcctccgacgctccaaccatcccccctcttccctccattggagtttagacctgtgcccctcccaagcggagaggaaggcgagtatgtgctggctttgaaacaggagcttaggggagccatgcggcagctcccctactttatcagacctgccgtgccaaaacgggactggagaaggctgcccagagaacttaagatccgggtgagaaaattgcagaaggagagaataacaattttgctgccaaaaagaccaccaaaaacaactgaggataaggaagagacaattcaaaagctggaaacactcgagaaaaaggaggaggaggtgactagtgaggaggacgaagagaaggaggaggaagaggaaaaggaggaggaggaagaagaggaatatgacgaggaggagcacgaagaagaaaccgactacataatgagttacttcgacaatggtgaggactttgggggagacagtgatgataacatggatgaagcaatttattag

SEQ ID NO: 58424 - DNA, 657 bp, Artificial Sequence
  Description of Artificial Sequence: Synthetic coding sequence
atggcgagcagaggagggggacggggtagaggacggggtcagcttacgtttaatgtagaggccgtgggcatcggaaagggcgacgccctgcctcctccgacgctccagcctagtcccctgtttccccctctcgaatttaggcctgtgcctcttccttcaggggaagaaggcgagtacgtgctggcactgaaacaggaactccgtggcgcaatgcgccaactgccttattttatccgtcctgcagtccctaagagggacgttgagcggtacagtgataagtaccagatgtctggtcccattgacaacgcgattgattggaatcccgactggagacgtctccctagagagctgaaaataagagtgagaaaactgcagaaagagaggatcacaatactcctgcccaagaggcctccaaaaaccacagaggataaagaggagaccatacagaagctagaaaccttagagaaaaaggaagaggaagtgacttctgaagaagatgaagagaaggaagaagaggaagaaaaggaggaagaggaggaggaagagtatgatgaggaggagcacgaagaggagaccgattatatcatgtcttacttcgataacggagaggatttcggcggtgattccgacgacaacatggacgaggctatctactag

SEQ ID NO: 58425 - DNA, 1680 bp, Artificial Sequence
  Description of Artificial Sequence: Synthetic coding sequence
atggcgaccgccaccatcgccctgcaagtcaatggtcaacaaggcggaggctctgagcccgctgccgcagcggctgtggtcgctgcgggagataagtggaaaccgccacaaggcactgactccattaaaatggagaatgggcaaagcactgctgccaagttaggtctgccacccttgactcccgaacagcaggaagctctccagaaggcaaagaagtatgctatggaacagagtattaaatcagttcttgtgaaacagactatagcacatcagcagcagcaacttaccaacttgcagatggccgctgtcaccatgggttttggcgaccctttgtcccctctgcaatctatggcggctcagaggcagcgagcgctggctatcatgtgtcgggtgtacgtgggatccatttactacgagttgggcgaagataccattcgccaagccttcgccccatttggcccaatcaaatctatcgacatgtcctgggattctgtcactatgaagcataagggcttcgccttcgttgagtacgaggtcccagaagcggcacagctggcactggaacaaatgaattccgtcatgttaggaggacgaaatatcaaagttggcaggccttccaatattggacaagcccaaccaatcatcgaccagctggccgaggaagcaagggcttttaacaggatctatgtggcctccgttcaccaggacctgtcagatgacgacattaaaagtgtcttcgaagcgtttggcaagattaagagctgtacactggctcgagacccaactacaggaaaacacaagggctacggcttcattgaatacgagaaagcccaaagctcacaggacgcagtcagctcaatgaatctattcgatcttggaggccagtacctccgggtaggaaaagcggtcacccccccaatgcccttgctgactcctgcgacaccaggaggcctgcccccagcagcagctgttgcagcagctgccgctaccgccaagatcacggcacaggaagccgttgccggagctgcagttttggggacattaggaactcctgggctggtcagtcctgccctcacattagcccagccattaggaaccctgccacaggccgtgatggccgcacaagctccaggcgtgatcaccggggtcaccccagcgagacctccaattcctgttacaataccgagtgttggcgtcgtaaaccctattttagcctcgcctcctacgctcggcctcctagaacccaaaaaggaaaaggaagaggaagagctctttccagagagtgaacgccctgagatgctgtcagaacaggagcacatgagtatttcaggctctagcgcgcgacacatggtgatgcagaagcttctgaggaagcaggaatccacggtgatggttctccggaacatggtcgaccccaaagatatcgacgatgatctggagggcgaggtgactgaagaatgcggtaagtttggcgctgtcaatcgggtgattatctaccaggaaaaacagggcgaggaggaagacgcggaaataatagtgaaaatctttgttgaattctccatcgcttccgagactcacaaagcaattcaggcgcttaacggcaggtggtttgccggtcgcaaagtcgtcgcagaggtctacgaccaggaacgttttgacaactcagacctgtctgcttag

SEQ ID NO: 58426 - DNA, 1500 bp, Artificial Sequence
  Description of Artificial Sequence: Synthetic coding sequence
atggagaacggtcagtctacagccgcaaaactaggtctgcctccactaaccccggagcagcaggaggccttacagaaggcaaagaagtacgcaatggagcaaagtataaagtcggtcctagtcaagcaaacaatcgcacatcaacagcaacagcttacaaatctgcagatggcggctcagaggcaaagggccctggccattatgtgtagagtatacgtgggctcaatatactacgagctgggtgaagatacaatcagacaggcctttgctccattcgggcctattaagagtatcgatatgtcgtgggatagcgtaacaatgaaacataaggggttcgccttcgtcgagtatgaagtgcccgaagcagcacaactggccttagagcaaatgaacagtgtgatgctggggggtcgcaatattaaagtgggacgcccaagtaacatcggccaggcacagccaataatagatcagttagctgaagaggctagggcatttaaccggatctatgtagcatctgtacaccaggatctttcggacgacgatataaagtcagtgtttgaggcctttggaaagattaagtcctgcactctggctagagatcccactacaggtaaacacaaaggctacggattcattgagtacgaaaaagcccaatcatcccaggacgccgtctcctcaatgaatctcttcgatcttgggggacaatacctgcgcgtgggcaaggccgtaacccctcccatgccattgttgacccctgccacacccggtgggcttccgcctgccgctgctgttgcggcagccgcagcaacagccaagattacagcccaagaagcggtggcaggggctgccgtcctgggaaccttgggtacccctggcctcgtgagccctgccctcactttggcccagcccctaggcaccttgccacaggctgtgatggcggctcaggccccaggtgtcattaccggagtgacgccagcacggcctccaataccggtgacaattccatctgttggcgttgtcaatccgatcttggcatcaccacctactttgggactgctggaacccaaaaaggagaaggaggaagaggaactctttcccgaatccgaacgtccagaaatgctctctgagcaggagcacatgtctattagtgggtctagtgctcggcacatggtcatgcagaagctgcttcggaagcaagagtccaccgtgatggtcctgcgcaacatggttgaccctaaggatatcgacgacgacctagagggggaggtgactgaggagtgcggcaaatttggcgctgtgaaccgggttataatctaccaggaaaagcagggcgaggaagaagatgccgaaatcatcgtgaaaatcttcgtggaattctcgattgcttcagaaactcataaagcaatccaggccctgaatgggcgatggtttgctggacggaaggtagttgcagaagtgtatgatcaggagcgatttgacaactcagacctctctgcctag

SEQ ID NO: 58427 - DNA, 1629 bp, Artificial Sequence
  Description of Artificial Sequence: Synthetic coding sequence
atggctactgctaccatagccctgcaggtgaacggccagcagggtgggggatccgaacctgccgctgcagccgctgttgtggcggcaggggataagtggaagccccctcagggaaccgattcaattaaaatggagaacggacagtcaactgcagcaaaactggggctgcctcctttaactcccgagcaacaggaagccctccagaaagcaaagaaatacgccatggagcagagcatcaagtctgtgcttgtgaagcagacaatagctcaccaacagcagcagctcacaaatctccagatggccgcacaacgacagcgcgcacttgcgatcatgtgccgcgtatacgttgggagcatctactatgaactgggggaagataccatccgtcaggcatttgcaccgttcgggcctatcaagagcattgacatgagctgggactctgtaacgatgaaacataaaggattcgcattcgtcgaatacgaagtccccgaggcggcacagttggccctggagcagatgaattctgtcatgctgggaggtaggaacattaaggtcgggaggccctccaatattggtcaggcccagcccatcatcgatcagctggcggaagaggcgcgagcatttaacagaatctatgtagctagtgtgcaccaggacttgtcggacgacgatataaagtccgtatttgaggctttcggcaagattaaaagctgtactctggccagggatcctaccactggaaaacataaaggctacggtttcatcgagtacgagaaagcccagtcatcccaggatgccgtcagttcaatgaacttgttcgaccttggtggacagtatctgagggtcgggaaagcagtgaccccaccaatgcccttactcacccctgccactccgggaggactcccaccagcggcagcagtcgccgcagccgcagccaccgccaaaattacagctcaggaagctgtggccggagctgctgttctcgggaccctcgggaccccgggtcttgtgtcaccagctctcaccctggcccagcccctaggtaccctaccccaggccgtgatggccgcacaagcccctggggttataacgggcgttacgccggctcgaccccctataccggtcactattccatctgttggcgtggttaaccccatcctggcttcccctcctacacttggcctccttgaaccaaaaaaggagaaagaagaggaagaattattcccggagtcggagagacccgaaatgctgagcgaacaggaacacatgtccatcagtggctctagcgccagacatatggtgatgcagaagctgctcagaaagcaggagtctaccgtaatggtgctgcgaaatatggtcgacccaaaagatattgacgacgatttggagggggaagtcacagaagagtgcggaaagtttggggcagtgaaccgggtcatcatttatcaggagaagcagggcgaggaagaggacgcagaaattattgtgaagatctttgttgagttttctatcgccagtgaaacccacaaggccatccaggcactgaacgggagatggttcgctgggcgtaaggtggttgcagaggtatacgaccaagaacgctttgacaatagcgatttaagtgcctag

SEQ ID NO: 58428 - DNA, 891 bp, Artificial Sequence
  Description of Artificial Sequence: Synthetic coding sequence
atgggagcggcagctcccgctgagagcgctgatctgggcaacttctggaaagccggagagcccctgctgcaagggccagatgccctggccgcaccaatgagccgaagtccatccacacctcaaaccacacccagtccccagggccgacagagcccatggcccctccggagcctgactcaatcccatatccaatatttccaatggggcaggccagtcccttctactcaccttattgaagtgcggcctacacaagaccctgcgaagccgcaaagagtggttagcgaggggtggaggcggcctgccctgccaggggagacagccctggggagagatctgtcttgcgcctgggagggatgtatgaagggtggattgtgcagggcatggaatccgggacggacttggagccccgtcacaattgggatcgcaccccctgaacgccaggaatcgccatggcgttctcctggccagagggcacgtccggctgggcgacctgctgctcaggaactgttggacccttgtacacgagaaaccttattaggggctctgtcccaatgccctaaaggctctgcccgattcgatggtcctctatggttcgaagtgagcgattccaagggcggaaggcggaacctgcagccccgaccgagcgcatttaaacccttgtctaagaacggagcggtggcctcttttgtccccagacctggccctttgaagccatctctgggaccttggtccctgtcattttgcgacgatgcatggccaagcgtcctggtgcagcctgctccaagtgccatatgggacttttgggaggccaccacgccatcgtgtggatcgtgtagcagagtgtcctttgctctcgaagtcactcagagcgccggtcctttcggaagttag

SEQ ID NO: 58429 - DNA, 2916 bp, Artificial Sequence
  Description of Artificial Sequence: Synthetic coding sequence
atggggtcctttcttagtaagctggaactgtcccctagttccccagcacaggtgaggacagatctgcctgagagacctacaaagagaagacctcctcagcccttacatcaggtgcacagagtccagttcgtccacagagcccaccccgcaccaaggtatcgcccagtcaggaggcggcctaatctagacccagccaacccgacaacctggctagccaatgaagcatggcgtaggttccccatgaaaaaatctcagaattctccactgggtcctctgccctctgattggtgggagtcgtacctgaaaagaaccatctggtccctgcggcatccacgcccaatttggtcccctgttactatccgcattaccccacctgaccaacgcgtgccaccctccacgtcacccgaggatgtgatcgccttggcaggcctgcccccttccgaggagctagccgacccatgcagcaaagagacagtgctgagagcccttcgcgaatgcaggaagggaaagggaaggctggaggagccccttttccctgagtcgctggatagcaagcggagaagtcctgaaacacgccctagcgcctttaaaccccttatgaaaaatggtactttgacctcttttgtgcccagacctgggccactgaagcggtccctgcattcatgggggagcgaccactcactaacaaaaagaccgaactgctccagtatgagcagcttagccagtatctatcgtgggggtactctgagcagtaagaggaatgctattggcagtagctattcatcctgccggaatttctctgatccctggaaacgttctgtgccttccgtgagtttcgagacaccagagtggccgatcaagaaagaaaagtcttgccatcgaccatcttcccccgttccactcgtctccgattttgaaagtttgggcggaagtgaatccagtggccagcaaaaccaaaagattccacagctgccgtcatccccagagaacttggtatccgagatcccccctccccaactgggttatgcggtcagtgacgagaatctgactctcggaaagaaagccgaattgcaatctactggtgaggcaacctctgtcgcacactcacctctgaagacgccatccctcccaactcccccagggtgctctcagagcgagctcctccctgggacctctccagatagtaagcctactgctacttttatcctgctaacacccacgagcccgactttgcctgttacagatacgacatggcctccctcaacttcacaggccgatagatcacccatgccacccgacccacccgcacctccaactatccagagtacgctgctcggcatggttagcagtcccacttctcatttaagcgccagcgctccaccagatgccacatcagcacatctgatgctgaaacctatccttggaccacttcataactctgagattgggagtagcagctacagcagaatcagtgtgactgcggcagccagtagtattagctcgctcagcactatacaaggcacgttaacacccactttcaaacctatctttggctcaatcgatcctctgaaaacaaccccaatgattgcccctttttccagtaagcagacccctccgcctttcacccacgcgtctacccaccatttccatgggctcgtcaaagcgacctccgtggttatgtctactacgttggccagtacgtcaaaagatagcgtgtttaagccacccttggacttcggggtagtgaacgtgacatcagcagtcggaaatacgtactcagtgccgtccacatgcgatactttcttgctaggaaccgcccaggccttccgcgctgatttcacaccagcaacagggtttattttcccaccacaccaccacccaacaatccctacagtgcataccgtgaccatgttcacccaggttctatcgtctgtagtgcagatctctccgcgttccagcactgccaacttccggggtatgggttccccactgccagccagcgctctggtgtccaccaattggctggcctccactcccagcatatcaaatttgacacccgcaataacttccccactgggctcctcatcacgaccaccattccccttgtcacagggagctaatccccagcctgcctttggagctactaatgggcaaaagcaggggcctagtcaaccggcactgatgcctagcgtttcatctagctttctgttcggctctagtgccgtcgcgctgcccacaccaatgcccacacctgctcagccagcatttatctctactactcaatctgctttgggctgcctcacgcccagcgcttctacttctcaaacacctgcaagtacctggtccggaatcggcggaatacccgcaggctttccaatctctcaggcctctacaacaggatttcggatcgtcatacaaacacatcagtccggagcatttggctccgtctttggctcccgcgcacctcagcccttcacgtttggaggctttgtgacaccgatggattgtgatgaatctgggataatcatgaccggccctgacatgagccccacttctggcgctttcagtattggcgctcttccctcagggacaaccaatacaatgatccccttcggcaagggatggagtcaaaatactgagggcttaccttcccaccggacagctttctccctaggacgcggatcaatttccgctcgcaagactatggcaccgattgcccagaacaccccagtcccgggacaggcgaaggcgggttcctcagtgggatttggtatgcccttccctcccgctcagggatctgtggggaggggaccctttcgatcctcagcctcttcattcagtattggtgccaagtctaaaactcctaagaacagagaaaaaggccactccaggcggcaccacgcatacaagaagtag

SEQ ID NO: 58430 - DNA, 3108 bp, Artificial Sequence
  Description of Artificial Sequence: Synthetic coding sequence
atgggaagtttcttgtcgaaactagagctgtcccctagctctcccgctcaagtccggaccgacctcccagagagaccaacaaaacgcaggccgccacagcccttgcaccaggttcaccgggtccagtttgtacatagagcccaccctgcccctagatatcgccctgttcgtaggcgaccgaacctcgaccccgcaaatcccactacatggctggccaatgaggcatggcgccgttttcctatgaagaaatcccaaaactcacccctcggaccactcccgagtgattggtgggaaagctatttaaaacgcactatttggtctctccgccacccccgacccatatggagccctgtgaccattagaataacccccccagaccagagagtgcctccttctacttccccagaggatgtgatagccttggcaggcctcccaccttctgaggagctcgctgatccctgcagtaaagagactgtgctgcgtgcgcttagggagtgtcgcaagggaaagggacggttagaggaacctctgtttccagaatctctggattccaaaaggagatctccagagacacgcccttccgcgttcaagccactgatgaaaaatggaaccctgacaagctttgtccctaggcctggcccactaaagcgctctctgcactcgtgggggagcgaccacagcctcactaagcggcctaactgctcaagtatgagctcgttggcaagcatctaccgaggtggcactctgagctccaagaggaatgccataggtagcagttacagctcatgccgtaacttctctgacccttggaagcgcagcgtgccctcagtctccttcgaaacaccagaatggcccataaaaaaagaaaagtcatgccaccgtccttcatcaccagttcccctggtgagcgacttcgagagccttggaggctcagaaagcagtggacaacagaatcagaaaattcctcagttacctagcagtcctgaaaacctagtgtccgaaatccctccacctcagctgggatatgccgtgtcagacgaaaacttaacacttggcaaaaaagccgagcttcaggtgagcaacaacgccggtgaagatactactgaggtgaacaccgacccatttcctgagacctggttggctatacagccctcattatcactcgcgctcccatcctcagagaccgatctgacgcagggagccaacccacaacttgaaaatctgagaaaaatgcagaaatctctgggcccactcgcatctccccagagtactggtgaggcaaccagtgtagcccattcaccccttaaaacacccagcttgcccacccccccaggctgctcacagtccgagctattacctggtacctctcccgattcaaagccaaccgctacattcattctgctcactccaaccagccccacactacccgttacagacactacttggccccctagcacaagccaggcagatcgtagtccaatgccccctgaccccccagccccaccaaccatccagtccaccctccttggaatggtgagttcacccacctctcaccttagcgccagcgctccaccagatgcaacttcagcccatcttatgctgaaacctatacttggccctcttcataattccgagatcggtagcagttcatatagccggatctccgtgactgcggcagcaagctcaatctcttcactaagtactatccaaggaaccctcacgccaacctttaaacccatattcggttcaatagacccactgaagacgactcccatgattgctccctttagctcaaaacagaccccccctcccttcacccacgcctctactcaccattttcatggcctggtgaaggctacatctgttgtaatgtccacaaccttggctagcacaagtaaggacagcgtgttcaagcctccactcgactttggcgtggtcaatgtgaccagtgcagtcggtaatacttactctgtgccctccacttgcgacaccttcctgctaggcacagctcaggccttccgtgccgacttcaccccagccaccgggttcattttccccccacatcaccaccctacgattccaaccgtacatacagttacgatgttcacacaggtgctgagctctgtcgtgcagatttcgccaaggtcttccactgcaaacttccgtggaatgggttcacctcttcctgcttcagcattagtgagcactaactggctggccagtacaccatctataagtaacctgaccccagctataaccagccccctggggtcatcctctagacctccttttcctctgagtcaaggtgcaaatcctcagcctgcgttcggagcgaccaatggtcaaaagcagggcccatcccagcccgctctgatgccctcagtcagttcatcgtttctgttcggttcatccgccgtcgccctgcccacgccaatgccgactcctgcccagcccgcatttatcagtactactcagtcagctctgggatgtctgaccccatccgcgagcaccagccaaacccctgcaagcacgtggtccggcatcggtggcatcccagccggatttcctatttcccaggcgagcactaccgggtttaggatcgttattcagacacatcaaagcggagcttttggcagcgtgttcggtagcagggcccctcagccatttacctttggaggattcgtgaccccgatggactgtgatgaatccgggataatcatgacaggccctgacatgtctccaacctccggcgctttctccattggcgcactcccgtccgggacaacaaatactatgatacctttcggcaaagggtggagccaaaatactgaaggattaccctctcaccgaacagcattttcacttgggagaggatcaatcagcgcccgtaaaacaatggctccaattgcacagaacactccagtgcccggtcaggccaaggccggttcgtcggtggggtttggaatgcccttcccacccgcacagggttctgtaggacggggaccctttcgctcaagcgccagctcattttctataggagccaagtccaaaacaccgaaaaatagggaaaaaggccatagtaggaggcaccacgcctacaagaaatag

SEQ ID NO: 58431 - DNA, 1374 bp, Artificial Sequence
  Description of Artificial Sequence: Synthetic coding sequence
atggattcactgtggggaccgggtgcaggtagtcatccattcggcgttcacaatagccgtctgtcgccagacctgtgcccgggtaaaattgtcttgagggccctgaaggaaagtggtgctggcatgcctgagcaggacaaagatcctcgtgtccaggagaacccaggcgatcagcggagggtccccgaagtaactggagatgctcccagtgcctttcgccctcttcgggataacggtggtctgagtccattcgtaccgggacctggcccactccagacagacctgcatgcacaacgctcggagattaggtatgaccagtcatcccagaccagctggaccagttcctgcactaatagaaacgctatatcctctagctattctagtaccggaggcctgcccggactgaaaaggcggcgtgggccagcttcgagccactgccagttaacgctgtcctccagcaaaacagtatcggaagaccggcctcaggcagtgtcctccgggcacacgcagtgcgagaaggttgcagagaaggcacccggacagacattggccctgaggaacgactcaagtcgttcggaggcatctaggcctagcacgcgtaagtttcctttactcccccaccggcgtggcgaacccttaatgctcccccctcctgtcgaactgggctaccgcgtcactgcagaggacctggattgggagaaggaagcagcctttcagtgcatcaagagcgcattgcaggttgaagataaagctattagcgattgtaggccatcgagaccctctcataccctgtccagcctcgccacaggcgcaagcgggttacccgctgtcagtaaggctcctagcatggatgcacaacaagaacgacataagtcccaggattgtctgggactcgtcgccccattggccagcgctaccgaggtgccctctacagctcccatgtccggcgagaagcatcggccacctggccctctgtttagcagcagcgaccccttgccagcgacctccagccactcccaggattccgcacaggtgacgtccctgatccctgccccatttcctgctgcatccatggatgctggtatgagaaggaccagacctgggactagcgcgccagcagccgctgctgccgcaccacctccctccaccctgaaccgcaccctcgggtcgttgcttgagtggatggaggcactccacatttcgggccctcaaccccagttacagcaggtcccacgtggacagaatcagagatcacagacgtcaaggacttcaagttgtcctaagcggaatgcaatttctagcagctgttcaagcactggggatctgccaggtcgaaagagaaagagacgacagccacaccccaccgcatcctag

SEQ ID NO: 58432 - DNA, 1389 bp, Artificial Sequence
  Description of Artificial Sequence: Synthetic coding sequence
atggacagtctgtggggcccaggtgccggatcacacccttttggagtgcataacactcgcctaagtccagacctctgcccaggaaagattgtcctgagggcgctcaaagagtctggagcgggtatgcccgaacaggataaggatccgagagtgcaggagaacccaggggaccagcgtagggttcccgaagtgactggtgacgccccaagtgccttcaggcccctgcgcgataatggcggtctgtctcctttcgtgcccggacctggtcccctacagacagacttacatgcccagagaagtgagatacgctataatcagacttcgcagacctcctggactagctcctgtacaaaccgcaatgccataagttccagctactcaagcactggcggacttcccggtttgaagcgccgtcgaggacccgcatcttcacattgtcagctgacgctctcttcctcgaaaacggtatccgaggaccgcccacaagcagtgtcctcaggtcatactcaatgtgaaaaagccgcagatatagcccctgggcaaacgctagcgctccgcaacgacagcagcacgagcgaagccagcaggcctagcacccacaaattccctctcctgccccgacgcagaggtgaacctctgatgcttcctcccccactcgagttgggttaccgcgtgacggttgaagacctagaccgcgagaaggaggccgctttccaacgaataaacagcgcattgcaagtcgaggataaggcgatatccgattgcagaccctcccgcccaagccacactttgtcttcgctggctacaggtgctagcgggctgcctccagtctcgaaggcccctagcatggacgcccagcaggagacacacaagtctcaggactgtctgggcctgctggctcccctggccagcgctgcaggggtcccttctaccgcacccatgagtgggaaaaaacaccgtcctcccggtccactgttctcttctagcgatcctttgcccgctacaagctcccattcccaggatagcgcacaggtcacctccctgatccccgctcccttccctgctgcatccatggacgccggaatgagacgaactagatgtgggactagtgccccagccgctgccgcagccgctccaccaccaagcacactcaatccaacacttggtagcctgctagagtggatggaagccttacacatcagtggaccccagcctcaacttcaacaggttcctagaggacaaaatcaacggtcccagaccagccggacttctagttgtcctaaaagaaatgcaatttcgagtccttaccgtagcacgggagggcttcccgagcgcaagagacggcgtgggcctgcaagttcccactgtcaactaacattatctagctag

SEQ ID NO: 58433 - DNA, 1389 bp, Artificial Sequence
  Description of Artificial Sequence: Synthetic coding sequence
atggattcgctgtggggtccgggtgcaggatcgcacccctttggggtgcataatacccgcttgtctcctgatctctgtccaggtaaaatcgtcctgagagcactgaaagaaagcggcgcaggcatgcctgagcaagacaaggatcctcgggtacaagagaaccccggtgaccagcgtcgcgtccccgaagtgacgggcgatgcaccttccgcttttcgcccactccgcgataatggcggattatcccccttcgtccctggccctggaccactgcagacagaccttcacgcccagcgaagtgagattcgctataatcaaacttctcagacttcttggacctctagttgcaccaacaggaacgcgatctcttcctcctacagctctacagggggtctgcccggattaaagagaaggcgtggaccagccagcagtcactgccagctcacgttgtccagttccaagactgtgtctgaagatcgccctcaggcagtgagctcagggcacacccaatgtgaaaaggccgcagatattgcccctgggcaaactttggccttgcggaacgatagtagtacgagcgaagcaagcaggccttcaacacataaattccccctactccctaggagacggggtgagcccctcatgctgccccctcctctcgaactaggctacagagtgaccgttgaagatctggatcgggagaaggaggcagcattccagagaataaactccgccctgcaagtggaggataaagctatttccgactgccggccttcacggccttcgcatacactcagttcactcgctacaggggcatctggactcccccctgtgagtaaagcaccatccatggatgctcagcaggaaactcataagagccaagactgcttgggcctgctggcaccattggcctctgctgcaggtgtccccagcaccgccccaatgagcggcaagaaacaccgccctccaggacctcttttttcttcctcagatccactgccagccactagcagccacagtcaggactccgcgcaggtaaccagccttatccccgctcccttcccagcggcttctatggatgcgggaatgcggaggaccaggtgcggtacttccgctccagccgctgccgctgccgcaccgcctccctctacactgaaccccacattgggtagtctcctcgagtggatggaggctcttcacattagcggtcctcagcctcagttacagcaggtgcccagagggcagaaccagcggagccagacgtcacgtacgtctagctgtcctaaacggaacgcaattagctccccctacaggagcaccggcggactgcccgagcggaaaaggaggcgcggtccagcaagttctcactgccagctgacccttagcagttag

SEQ ID NO: 58434 - DNA, 3000 bp, Artificial Sequence
  Description of Artificial Sequence: Synthetic coding sequence
atggtgtgttcgccagtgaccgttcgtatagccccaccagataggcgattcagcaggtctgccattccagagcaaatcatatccagcaccctgtcatcccccagttcaaacgcccctgatccctgtgctaaggaaaccgtactctcagcccttaaggaaaaagagaagaaaagaactgttgaggaggaggaccagatatttctcgatgggcaagagaacaagcgaaggagacacgactcctccggctccgggcatagtgccttcgaaccactggtggccaatggagtccctgcgagtttcgtccctaagcctggttctctgaaacggggactgaactcacagtctagcgatgaccacctcaataagcgttcaaggagttcctcaatgtcaagccttaccggcgcatatgccagcggaattccctccagttcaaggaacgccattacctctagctactcttctactagaggtatctctcagctctggaaaaggaatgggccttcttcatcacctttcagcagtcctgcttcttctcggtcccagactcccgagcgtccagctaaaaagatccgagaggaggagttgtgccatcattctagctcatcaacacctctggcagccgacagggagagccaaggagagaaagcagctgacacgacccctaggaagaagcagaattctaactcacagtccacccctgggtcaagcgggcaaaggaaacgtaaggtccaattgctgccttctcgccgaggagaacaactgaccctacctccaccgcctcagctgggctattcaatcacagccgaggacctcgatctggaaaaaaaggcatcattacagtggttcaaccaggccttagaagacaagagcgatgcggcttctaatagcgtcaccgagacgcctcccatcactcaacctagcttcactttcacattacccgcagctgccccagcaagccctcccaccagtcttttagccccttctacaaatccgcttttggagtctctgaaaaagatgcagacaccgccaagtttacccccatgtccggaatccgccggtgctgccacgacagaggcactctcacctcctaaaaccccttccctcttaccaccgctagggctgtcccaatcaggaccccctggactgctcccttccccatccttcgactcaaaacctcccactacacttctgggtcttatcccagccccttccatggtgcccgctaccgacaccaaggccccacctacacttcaggctgaaacggctaccaaaccccaggccacaagcgctccatctccagctccgaagcagtctttcctttttggtactcagaatacctccccctcttctcccgcagctcctgctgcctccagtgcacctccgatgttcaagcccatattcactgcccctccaaagagtgagaaggaaggaccaactccaccgggtccctctgtgaccgcaactgcaccaagctcttcctccctccccaccactacatcaaccactgctccaacctttcagccggtgtttagctccatgggaccacccgcaagcgtgccccttcctgctcctttttttaaacagactaccaccccagccactgcccctacaacgacagcacccctctttacaggtctggcctcggccaccagcgctgtagccccaatcactagtgcaagcccctctacagactcggctagcaagcccgcatttggttttggcataaatagtgtatcaagttcctcagtgagcacaactacgagtactgccaccgccgctagtcagcccttcctcttcggagcgcctcaggcgtccgcagctagttttacccccgctatgggctcgattttccagtttgggaagcctccagcactgcctaccactacaacggtgactaccttcagtcagtctttacacactgccgtgcccaccgccacttcctctagtgccgcagacttctccggctttgggtccactctggctacgtcagcgccagcaacatcctctcagccaactctgaccttctctaacacatcaacccctacttttaacatcccatttggcagctctgctaagtcacccttgccaagctaccccggtgctaatcctcagccggcatttggtgcggctgagggacagcctcctggcgctgccaaacccgctctggcaccttctttcggtagttcgtttacttttggaaacagcgccgctccagccgcagcccctactcctgctccaccgtccatgatcaaggtggttcccgcttacgtaccaactcccattcatccaatcttcggaggtgcaacacactccgctttcggactgaaggctacagctagtgcgttcggcgcacccgcttccagccagcccgcatttggaggctcgaccgctgtcttctttggagccgctacgagcagcggcttcggagctacaacgcagaccgcctcctccggcagctcttcctccgtttttggatctaccaccccctctcccttcaccttcgggggatctgctgctcccgctggaagcggctctttcggcatcaatgtggcaacccctggaagcagcacgacaacaggtgcattcagttttggggcaggccagtccgggagcaccgctactagtacacctttcgccggagggcttggtcagaatgccctaggcaccaccggacagagcacaccctttgcattcaatgtgtcgtctaccacggagagcaagccagtgtttggagggacggctacccccaccttcggtcttaacaccccggcaccgggtgtagggaccagtggatcctccctaagctttggagcctcctctgcaccagctcagggcttcgtgggtgtggctccatttggaaatacctttgcccaccagcaagagcattcacctagaaaaggccctaataatctgtccaaaagaaaactccttccagccgtgagggcgcagggtctgccacgtcgcggacaggcgagtagcttccccacacgaaaagaatag

SEQ ID NO: 58435 - DNA, 1386 bp, Artificial Sequence
  Description of Artificial Sequence: Synthetic coding sequence
atggctaccttctctcgacaggaattcttccagcaactgttgcaggggtgcctccttcccacagcccagcagggccttgaccagatatggctgctgttagctatttgcctggcatgccggttgctgtggcggttggggctgccgagctacctgaaacacgcgtctactgttgcgggaggattcttttccctctaccacttcttccagctacacatggtgtgggtggtgttgctgtcactgctgtgctacctggttctgttcctgtgccgccatagcagccaccgcggtgtattcttgtccgtgaccatcctgatttacctcttgatgggcgagatgcacatggtcgacacagtaacatggcacaagatgagaggcgctcagatgattgttgctatgaaagctgtcagtttgggcttcgacctcgacagaggcgaggtgggcacagtaccctctccagttgaattcatgggttacctctactttgtcggcacaattgtctttggcccatggattagctttcactcatacttgcaggccgtccagggacggccactgtcatgcaggtggctccagaaagttgcacggagtctcgcactggcgctgctgtgcttagttctgagtacctgcgtcggaccctacctgttcccctatttcattcctctgaacggagacagattgttacggaataaaaaacgcaaggctcgtggtactatggttcgatggctgagagcatatgagtctgcggtgtcctttcacttttctaattacttcgtgggtttcttgagtgaagccaccgctacccttgctggtgctggcttcaccgaggaaaaggatcacctagagtgggacttgaccgttagcaagcctctgaacgtggagctacctcgcagcatggtggaggtcgtcacgagctggaatctgccaatgagttattggttaaataactatgtgtttaaaaatgctcttcgtttagggacgttttccgctgtcttggttacctacgcagcgtcggccctgctccacggcttcagttttcatttagccgctgtccttttgtcattggcgtttattacttacgtcgagcatgttctgcgaaagaggttggcaagaatactgagcgcttgtgttttgtcgaagcgctgtccgccagattgctcccatcaacatcggctgggcctgggcgtcagagccctaaatctgcttttcggcgctctggccatctttcacctcgcctacttgggcagcctttttgacgtcgatgtggacgacaccacagaggaacaagggtatggaatggcatacaccgtccataagtggagtgagctcagttgggctagtcattgggtcacgtttggttgttggattttctaccggctgataggttag

SEQ ID NO: 58436 - DNA, 1368 bp, Artificial Sequence
  Description of Artificial Sequence: Synthetic coding sequence
atggctacattcagtagacaggagtttttccagcaactcctgcagggctgcctgctgcctacagcccagcagggattggatcagatatggctgctactggccatctgcctggcctgtaggctactatggagattaggcttgccttcatatctgaagcacgccagcactgtggccggtggctttttttcactgtatcacttcttccagcttcacatggtttgggtagtcctgttgagtctcttgtgctacttggtgctgtttctctgtaggcacagtagccatagaggggtctttctttccgtcacaattttgatttatcttctgatgggcgaaatgcacatggtggacacggtcacgtggcataagatgcgaggggctcagatgattgtcgctatgaaggccgtttccctcggcttcgacctggaccgcggtgaggtcgggactgttccgtctccagttgaatttatgggctacctatattttgtaggcactattgtgtttggcccatggatcagttttcactcctatctgcaggccgtgcagggacggcctctgagctgccgatggttgcagaaagtggctcgatcactggctttggctctcctctgcctggtgctgtctacctgcgtggggccttatctgttcccttatttcattcccctgaatggagacagacttctgagaaaaggtaccatggtccgttggctaagggcttacgagtccgcagtgagctttcatttctctaactactttgtcggtttcctgtcagaggccacagcgacactcgcaggagccggattcactgaggaaaaggatcatctcgaatgggacctgacagtctcgaaacccctgaatgtggagctgcccagatctatggtagaggtggtgacgtcgtggaatttaccgatgagctactggctgaacaattacgtcttcaagaacgcactaagactgggtactttctctgccgtattggttacatatgcggcttcagcgctgctgcacgggtttagtttccacctggctgccgtgctcctctctctggcctttatcacctacgtggaacacgtgctgagaaagcgcctggctcgaattctgagcgcatgtgttctgtctaaacgctgccccccagattgtagtcatcaacaccgtctgggcttgggggttcgcgctttgaacctgctgtttggagcactggcaatcttccacctggcgtaccttggatccctatttgatgtggatgtggatgacaccactgaggaacaaggatatggcatggcttacaccgtgcacaagtggtccgagctgtcctgggcctcacactgggtgaccttcggctgttggatattctaccggctgatcggctag

SEQ ID NO: 58437 - DNA, 1146 bp, Artificial Sequence
  Description of Artificial Sequence: Synthetic coding sequence
atgagcaggcacgagggcgtctcatgcgacgcctgcctcaaagggaacttccggggaaggcggtataagtgcctgatctgctatgattatgacctctgcgccagctgctacgagtctggtgcaactactacgcggcacaccacagaccaccctatgcaatgtattctcacaagggtggacttcgatctctactacggaggcgaggctttctccgtggagcagccccaatctttcacttgcccctattgcggaaaaatgggatacacagagacctctttacaggagcacgtcacctctgagcatgcggaaacttctactgaagtcatatgtccgatctgcgccgcactaccaggaggtgatcccaaccacgtcacggacgatttcgccgctcacctaacactcgagcatagagcaccccgtgatctggatgagtctagtggtgtgcgacacgttcgacgcatgttccacccagggagggggctggggggtcccagggctaggcgaagtaatatgcactttacgagctcaagcacaggcggtctttccagttctcaatcgtcatactccccgagtaacagggaggccatggatcctattgccgagctcttgagtcagctgagcggcgttcgtcgcagcgccggtgggcagctgaactcctccgggcctagtgcgagtcagctgcagcagctgcaaatgcagctccagctggaacgccaacatgcacaggcagcacgtcagcaactcgagactgccaggaacgccactagaaggacaaatacctcaagtgtgactactactatcacccagtccactgctaccaccaacattgcaaatacggagagctcgcaacagacgctccagaactctcagtttctgctgacacggctcaatgatccgaagatgagcgagactgaaaggcagtcaatggagtccgagagagccgatcggtccctgtttgtccaagagctccttctttccaccctggtgcgggaggaatcaagctcttctgacgaagatgatcgcggtgaaatggcagactttggagctatggggtgcgtggatatcatgcctctcgatgtggctctcgaaaaccttaacttaaaggagagcaacaaaggtaacgaacccccacctcctccactatag

SEQ ID NO: 58438 - DNA, 705 bp, Artificial Sequence
  Description of Artificial Sequence: Synthetic coding sequence
atgccccaccggaaggaaagaccgagcggaagcagcctgcatacgcatggttccactgggaccgccgaaggagggaacatgtcccgcctctctctgactaggagccccgtgtcacctttggctgcacagggaataccccttccagcccagctgaccaagtccaacgctccagtgcacattgatgtgggaggacacatgtatacaagtagtctggcaaccctcacgaagtatccagacagtcgcatttctcgtcttttcaatggtactgaaccaattgtattagatagtctgaaacagcattattttatagacagggatggggagattttcaggtacgtgctcagttttctgcgcactagtaaacttctcctgccagacgattttaaagatttctcactgttgtatgaagaagcccgatattaccagttacagccgatggtcagggaactggaaaggtggcagcaggaacaggagcagaggagaaggtcacgagcttgcgattgccttgttgtgcgagttacgccagatctgggagagagaatcgcgctgtctggggaaaaagcactcattgaggaagtgttccctgagacgggcgatgtaatgtgtaactctgttaatgctggatggaaccaagaccctacccacgtgattagattccctctcaatggatactgcaggcttaactctgtgcaggatgtcctgtag

SEQ ID NO: 58439 - DNA, 915 bp, Artificial Sequence
  Description of Artificial Sequence: Synthetic coding sequence
atgactctacgaacatctgtgtgctgcacccgtaggcgtgccacaatttcaagttcaccttggtgcgcttcttggtctgcaggctctcggtctcgcagctcgggagccgcagccggaccagtgaccgcttggtggtgcgcatcaagaccaacttgggcgagcggtagtcacagtgcagccaggagaccaagttcacggcgaagcagtccacggcctgaaaccagctgtgccaccccatccacgcccgcaggaaccaggacaccaagaacttcgtcagccagccgatccatggcaaccgcagggtcaacacggtatcgcagctggtctggctgcagtcggggtgtgagcgcttggctccgacccgtaggcgcagtctggacgccacctagttcagcgtccatgtgcttcgcgggacggtccggagggcgaagccctccaccattgctgttcgagtcatctcgaaatccttggactaggccctgcttctccgctcacctgggtcctcctagagacctggaaacagtgcttgggtctagcgcttgtgtgtacctagccgtgggcatgaggcccagggtacggctcgaaggacccaagctggcccagcgggctcccggttcccaggtgagttggcagcagaacgtgggctgttggcggcacgcctgtcggaggacagtcgatgctacacaacgatactccggcggaatctctgccgcttctagtcccagcccgtccgcctctcaacctggcgctgcatccagcgaggcgccaggcccagtaggagcagggctggaagagccttcggccgcaacctcagaagagttgttcattcccctgcatgcaggtcagacattggccggacttctcgcttcagaacggtggctaatattccagtatctcaagtggatgcagccatag

SEQ ID NO: 58440 - DNA, 498 bp, Artificial Sequence
  Description of Artificial Sequence: Synthetic coding sequence
atgagtgacccaattacactgaacgttggcggaaagctgtatactacgagccttgccactcttacctccttccctgacagtatgctgggggcaatgttcagcggcaaaatgcccaccaaaagagactcccagggtaactgctttattgatagggatggcaaagtgtttagatatattctaaacttcctcaggacgagccacctggatctcccagaagatttccaggaaatgggcttgctccggagggaggctgacttctatcaggtccagccactcatcgaggccttgcaggaaaaggaagttgagctgtcaaaagctgaaaagaacgccatgctcaatatcactctgaatcagcgtgtgcagacggtgcactttacggtccgagaggcccctcagatctatagcctgtcatcctctagcatggaggtgtttaacgccaatatcttttccacatcctgcttatttctgaaactacttggaagtaaactgttttactag

SEQ ID NO: 58441 - DNA, 114 bp, Artificial Sequence
  Description of Artificial Sequence: Synthetic coding sequence
atgagtgacccgattacgctcaatgtaggtgggaagctttatactacctccctggcaaccttgacgtcttttcctgatagcatgttgggagctatgttctccggaaagatgtag

SEQ ID NO: 58442 - DNA, 351 bp, Artificial Sequence
  Description of Artificial Sequence: Synthetic coding sequence
atgtcggatccaattacgctcaacgtggggggaaaactgtatacgacatcactggcaacactgactagctttcccgactcgatgttgggagccatgttctctggtaaaatgcccactaagagggactcacagggcaattgttttatagatagggacggaaaagttttccgctatattttaaactttcttagaactagtcaccttgacctgcccgaggactttcaggaaatggggctactgcgacgagaagcagatttctatcaggtccagcccctgatcgaggcgttgcaggaaaaggaagtcgaactgtcgaaggcggagaagaatgcgatgttgaatatcactctttag

SEQ ID NO: 58443 - DNA, 216 bp, Artificial Sequence
  Description of Artificial Sequence: Synthetic coding sequence
atgtccgatcccataaccctaaacgtaggcggtaagctgtataccacctcactagctactttgactagtttccccgatagtatgctgggcgctatgttctctggtaagatgccgaccaagcgcgatagtcaaggcaactgtttcattgaccgagatggaaaggtgtttcgttatattctgaacttcttgcgtacctcacatttggacctcccatag

SEQ ID NO: 58444 - DNA, 3450 bp, Artificial Sequence
  Description of Artificial Sequence: Synthetic coding sequence
atgtttcagactaagctcaggaatgagacttgggaagacttgcccaagatgtcctgtaccacagaaatccaggccgcattcatcctgtcctcctttgtcaccttcttctctgggctgataatcctcctcatcttccggctcatctggagatccgtcaaaaagtggcaaattataaagggcaccggaattattctggaactgttcaccagtggtacgatagcccgaagccatgtgcgaagcctacactttcagggccaattccgtgaccacatcgagatgctactctctgcacagacattcgtggggcaggtcctggttattctggtcttcgtcctgtccatcggctccctgatcatttactttatcaactctgccgatcctgttggctcttgctcctcttatgaggacaagacaatccctattgacctggtttttaatgccttcttttcattttactttggacttcggtttatggccgctgatgacaaaattaagttctggctggagatgaactctatcgtagacatcttcaccatccccccaacatttatttcttattacctgaagtcaaattggctgggtctccgctttctgcgcgcactcagattattggagctgccccagattcttcaaattctgcgcgctataaaaacaagcaattctgtcaagttctcaaagctgctgtctataattctctccacgtggtttacagccgctggatttattcacttggtagagaacagtggcgacccctggctaaaggggcgtaatagtcaaaatatttcctacttcgagagcatctaccttgtgatggctacaaccagtaccgtgggattcggagatgtggtggcgaagacatccctcggcagaacatttatcatgtttttcaccctgggcagtctgatcctgttcgcaaactatatcccggaaatggtggagttgtttgccaataagcgcaagtatacgtcatcctatgaagccctcaaaggcaagaaatttatcgtggtctgtggcaatatcactgtggatagtgtaaccgcattcctgagaaatttccttagagacaaaagcggggagattaacacagagatcgttttccttggcgaaactccccctagcctcgagctggagacgatcttcaaatgctaccttgcctatactacctttatatcaggatccgcaatgaagtgggaagacctgagacgcgttgcggtggagtcggccgaagcgtgcctgattattgcgaacccactgtgttcggattcgcatgccgaggacatcagtaacatcatgcgggtgctctctatcaagaactacgacagcacaacacgaattatcatccagatcctccagtcccacaataaagtctatctgcccaaaatccccagctggaactgggataccggcgacaatatcatctgctttgccgagctcaagctgggctttatcgcccagggatgtcttgtgcccggtctctgcacattcctgacaagcctgttcgtggagcaaaacaaaaaggtgatgcccaaacagacatggaaaaagcacttcttaaacagcatgaaaaacaagatcctgacccaacgcctcagtgacgatttcgcgggaatgagttttccagaagtggccagattgtgcttcctgaaaatgcatcttttgctgatcgccattgagtataaaagtcttttcaccgacggcttctgcgggttaatactgaaccctccaccccaagttcgaattcggaagaacaccttgggcttcttcatcgccgagactcctaaggacgtgagacgcgcattgttttattgctcagtctgccatgacgatgtattcatccctgaactgatcacgaactgcggttgcaagtccagaagcaggcagcacataacggtcccttcagtcaagaggatgaaaaaatgtctgaaaggaatcagctctcgcattagcgggcaggatagtcctccaagggtgtctgcaagtacctcaagtataagcaatttcacaaccagaacactgcagcacgatgttgaacaggactccgaccagttagactcttcaggcatgtttcactggtgtaagccaacatccctggacaaagttactttaaagagaaccggcaaaagcaagtacaagttccggaatcatatagtggcttgcgtcttcggggacgcccacagcgccccaatggggctgcgaaattttgtgatgcctctccgcgcatccaactacacaaggaaggagctcaaggacattgtcttcatcgggtccctagattatttacagagggaatggcgttttttatggaattttccccagatttacattcttcccggatgcgccctctactcaggggacctgcatgcagcgaacatagagcagtgttctatgtgcgcggtgctctcccctcctcctcaacccagcagcaatcaaacattagttgacaccgaagcaattatggctactcttacaattggctctttacagatcgacagttcatcagatccttcccccagcgtatctgaggagactcctggctataccaatggtcacaacgaaaagagcaattgccgcaaagtccctatcctcacagaactgaagaatccaagcaatattcatttcattgagcagctgggtggccttgagggaagcttacaagaaaccaatctgcacttgtcgacggccttctctactgggactgtattctctggctcgttccttgactcactcctggctactgccttttacaattatcatgttctagagctcttacagatgctggtgacaggcggtgtgtcttcacagcttgagcagcatttagacaaggacaaggtctacggggtggccgatagttgtacctcacttctttccggtaggaatcgctgtaaactgggtctactgtcattgcacgagaccatcctttccgatgtaaaccccaggaatactttcggccagctgttctgtggctcgctggacctgttcggaatcctctgtgtgggactgtaccgaataattgacgaagaagagctgaaccctgaaaataaacggttcgtgattactcggccagcgaatgagtttaagctcctgccctcagacctggtcttctgtgccatcccttttagcaccgcatgttacaaaagaaatgaggaattcagcctccagaagtcctatgaaatcgtcaacaaggctagccagacaaccgagacacatagcgataccaactgtccacccactatagatagcgtgacagagactctctattctcccgtgtatagctatcagccacgcactaatagtctttcttttcctaaacagattgcctggaatcagagccgcaccaacagcattatttcttcacaaattcctttaggcgacaacgctaaggagaacgagagaaaaacatctgatgaggtgtacgacgaagatccttttgcttacagcgagccactttag

SEQ ID NO: 58445 - DNA, 1302 bp, Artificial Sequence
  Description of Artificial Sequence: Synthetic coding sequence
atgacggccgcaagtcgggctaacccttattccatcgtttcactcgaagaggatggattacacctggtgaccatgtcgggcgcaaatgggttcggcaacggcaaagtacacacaagacggcgatgccgcaatcgctttgtgaaaaaaaatggacagtgcaatatcgccttcgcaaatatggacgaaaagagtcagcgctacttggcggatatgtttacaacttgtgtggatattcgatggcggtatatgctcttgattttttccctcgcgtttctggcttcttggttactgttcggagtgatattctgggtgattgcagttgcacatggagatctcgagccggcagaagggcatggacggacaccatgcgtgatgcaggtgcacggctttatggccgctttcctgttctccattgagacacagacgaccatcggctacggccttaggtgtgtgacagaggagtgcctggtggctgtgtttatggtagtggcgcagtctatcgtaggctgcatcatagacagctttatgattggcgcaattatggctaagatggccaggcccaaaaaacgcgcacaaacgctactcttctcccataatgccgttgtagccctccgggatggcaagctctgcctgatgtggcgagtcggcaatctccgaaaatcccacatcgtcgaagctcacgtgagggcgcaactgatcaaacccagggtgactgaggaaggcgaatacatccccctcgaccagatcgatattgacgtgggtttcgacaagggtttggataggattttccttgtgtccccaattactatcctccatgagattgacgaggcgtctcccctgttcgggatatctagacaggatttggagactgatgactttgagatcgtcgttatcctagagggcatggtagaggccactgcaatgacaactcaggctcgctcttcatacctggccaatgagatcctctgggggcaccgtttcgagcccgtactgtttgaagaaaagaaccagtacaaaatcgactacagtcattttcataagacttacgaagtgccttccacccctcgctgtagcgccaaagatctggttgagaacaaatttctgctgccctcagcaaattccttttgctacgaaaacgaactggcattcctcagcagggacgaggaggatgaagctgatggcgatcaggacggcagatctagggatggcctgagtcctcaggcccgtcatgattttgatcggctgcaagccggtgggggtgttctggagcagcgaccttaccgtagggggtccgagatttag

SEQ ID NO: 58446 - DNA, 1875 bp, Artificial Sequence
  Description of Artificial Sequence: Synthetic coding sequence
atgcagaagagctcaacatgtagtttcatgtacggtgagctgactgataaaaagacaattgagaaggtcagacagacattcgataactacgagtctaactgcttcgaggttcttctctataagaagaatcgtactcccgtatggttttatatgcaaatcgccccaattcgaaatgagcacgaaaaagtggtgctcttcctctgtacttttaaagatattactttgttcaagcagcctatcgaagacgatagcacaaaaggttggacaaagttcgccaggcttaccagagccctgacgaactcaagatccgtactgcaacagctcacgccaatgaataaaactgaggtcgtccacaagcattctagactggccgaagtcttgcaactgggctccgatatcctgcctcagtataagcaggaagccccaaaaactccccctcacatcatcttgcattattgcgcattcaagactacttgggactgggtgattctgattttgaccttctacacggctattatggtgccctacaacgtctccttcaagactaagcagaacaatatcgcctggctggttctcgattctgtggtggacgttatctttctcgtcgacattgtgcttaactttcacacaacattcgtggggcctgggggagaagtgatctcggacccgaagttgatccgcatgaactacttgaagacatggttcgtaatcgatctgctgagctgtctgccctacgacatcatcaatgctttcgagaacgtagacgaaggcatcagtagcctgtttagcagtctgaaagtcgtgcgactgctgaggctgggccgagttgcaaggaaactggatcactacctggagtacggtgccgcagtgttggtactgctagtgtgcgtgttcggtctggtcgcccactggcttgcttgtatttggtactccatcggtgattatgaggtgattgacgaggtgactaatacaatccagattgactcgtggctgtatcagctggctttgagcattggcactccttaccgttataatacctccgctggcatctgggagggcggaccgagcaaggatagtctgtacgtcagttccctttattttactatgacctctttgactactatcgggttcgggaacattgcacctactacagatgttgagaagatgttttccgtggccatgatgatggtgggatctctactgtatgcaaccatatttggcaacgtgaccacaatcttccagcaaatgtatgccaacaccaaccgataccatgaaatgcttaataatgtgagggactttctgaagttataccaggtacctaaaggcctgagcgagagagtgatggactatatagtttccacttggtccatgagcaaagggatcgacaccgaaaaagttctctcaatctgccccaaggacatgcgggcagatatttgcgtccacctgaaccgcaaagttttcaacgaacacccagctttccgcctcgcttctgacggatgcctgcgagcgttagcggtggagttccagacaattcactgcgccccaggagacctgatctatcatgccggtgaatccgtggatgcactgtgtttcgtcgtgagtggttcattggaagttatccaggacgatgaggtggttgcaattctcggaaaaggggatgtgtttggagacatcttctggaaagagacgaccctggcgcacgcatgcgctaacgtaagagccctgacgtactgcgatctccatatcattaagagagaagctttactcaaggtactcgatttctacacagcgtttgcaaattcgttcagtcggaatcttactctgacttgtaatttgcgtaaacggggatggtttagtatggccaatgctctatag

SEQ ID NO: 58447 - DNA, 1836 bp, Artificial Sequence
  Description of Artificial Sequence: Synthetic coding sequence
atgcccggtgggaaacgcggtctggtggctcctcagaacacttttctggaaaatatagtgcgacgctcctcagagtcatcttttcttctcggtaatgcacaaatcgtcgattggccggtggtttactccaatgacggtttttgcaaactgtcaggataccaccgtgccgatgtcatgcagaagtcatcgacttgctccttcatgtatggggaactaaccgacaagaagacgatagagaaggtccgtcagacgttcgacaactatgagtccaactgtttcgaggtccttctatataagaagaatcggactccagtgtggttttacatgcagatcgcacctattcgcaatgaacacgagaaagttgtgctcttcctttgtacctttaaggatattaccctgttcaaacagcccattgaggacgacagcactaagggctggaccaagttcgcacgcctcactcgcgcactgacaaactcccgaagcgtattacagcagctgaccccgatgaataagacggaagttgttcacaagcacagtaggttggctgaggtcctccagttgggctcggatatcctgcctcaatacaaacaggaagcacctaaaacccccccacatattatcctgcactattgcgcatttaagactacttgggactgggtaatcctgatcctcaccttctacactgcgatcatggtgccctacaacgtatcatttaaaacaaagcagaataacattgcatggctcgttctcgactcagtcgtggacgttatttttcttgtcgatatcgtcctgaacttccataccaccttcgtagggccaggaggtgaggtgattagtgaccccaagctgattagaatgaactacctgaagacctggttcgtgattgacctgctgtcgtgcctcccgtatgatattattaatgccttcgaaaacgtcgacgaagggattagcagtctgttctccagcttgaaggtggtaaggctcctgaggctgggccgtgtggccaggaaattggaccactatcttgagtacggcgctgctgtcctggtattactcgtgtgtgtcttcggcctggtggcacactggttggcttgcatctggtactctatcggagattatgaggtgattgacgaggtcacaaatacaatacagattgatagttggctgtatcagctagctttgagcattggcaccccctaccgctataatacctccgctggcatctgggaagggggtccttccaaagacagcctctatgtgtcaagtttgtacttcacaatgacctctctgacgaccatcggcttcggcaacatagccccaacgactgatgttgagaaaatgttctctgtcgctatgatgatggtcggctccttactttacgccacgatatttggtaatgttactacaattttccagcagatgtacgccaataccaatagatatcacgaaatgctcaacaatgttagggatttcttaaaattgtaccaggtgcctaaaggcctgtccgaacgtgttatggactatattgtctcgacatggagtatgtctaagggaatagataccgagaaggtactgtctatatgtcctaaagatatgcgcgctgacatctgcgtgcacttgaaccggaaggtcttcaacgagcatcctgcattcaggcttgcatccgacggctgcctacgggcattggcggtagaatttcagacaattcactgtgccccaggggatcttatatatcacgcaggagaatctgtggatgcattgtgctttgtcgtgtctggatccctggaggtcatccaggatgatgaagtcgtggcaatactcgaccacttgagctag

SEQ ID NO: 58448 - DNA, 1755 bp, Artificial Sequence
  Description of Artificial Sequence: Synthetic coding sequence
atggtggcagaggtctgcagcatgccaactgcatctaccgtcaaaaagcccttcgatttaaggagcaagatggggaagtggtgtcatcatcggttcccttgctgcagaggaagcggtaagtcaaatatggggacctccggagaccacgacgactcctttatgaagatgctgagatccaagatgggaaaatgctgtagacactgcttcccatgttgtcggggatccggcacaagcaatgtgggaaccagcggggaccacgagaattcttttatgaagatgctgagaagtaagatggggaagtggtgctgtcactgttttccatgctgcagaggcagcagtaaaagcaacgtgggagcctggggtgactatgatcactctgcattcatggaacctcgataccatgtgcgacgggaggatttagataaattacatcgtgccgcttggtgggggaaagttccaaggaaggatctaatcgtcatgctgcgcgatacagacatgaataagcgcgataaggagaagcgaactgccctgcacctggcctctgcaaacggcaactctgaagttgtccagttactgcttgacagacggtgtcagctcaacgtgctcgacaacaagaagcggacggccctcatcaaggcgatccagtgtcaggaagatgaatgcgtcctcatgttgctggaacacggcgctgataggaacattcccgatgagtatggtaatacggccctgcactacgctatttacaacgaagataagttgatggccaaggccctactgctgtacggggcagatattgagtccaagaacaagtgcggcctcactccccttctgctgggggtccatgagcaaaagcaacaggtcgtgaagttcctgatcaagaagaaggcaaacctgaacgttctcgaccggtacggcaggaccgccctgatcctggcggtgtgttgcggatccgcctctattgtgaatctgttgttggaacaaaacgtagatgtgtcatcacaagacctgagcggacaaaccgcccgtgaatatgccgtgagttcccatcaccacgttatttgcgagctgctctccgattacaaagagaaacagatgctgaagatctcatctgagaatagtaaccctgagcaggatctcaaactgaccagcgaggaagaaagccagcgcctgaaagtatctgagaattcccagcctgagaaaatgagtcaggagcccgagatcaacaaagattgtgaccgggaggtcgaggaagagataaaaaaacatggatctaatcctgttggactgcctgaaaatttgaccaacggggcatctgccggaaacggggatgatgggcttattcctcaacgccgttcccgaaagcctgagaatcaacagttcccagatacagagaatgaggaataccattctgacgagcaaaatgatacccggaaacagctgagcgaggaacagaacacagggattagccaggatgaaatcttgacaaacaagcagaagcagattgaggttgccgagcaaaaaatgaacagcgagctatcattgtcccacaaaaaggaagaggatttgctgcgggagaattctgtgctgcaagaagaaatcgctgtcctgcggctagagctagatgaaacgaaacaccagaaccagctgcgcgagaacaaaatcctcgaggagatcgagtctgtgaaagaaaagactgacaagctattaagagcaatgcagctgaatgaggaggccctcacaaagactaacatctag

SEQ ID NO: 58449 - DNA, 3228 bp, Artificial Sequence
  Description of Artificial Sequence: Synthetic coding sequence
atggtagtagaggttgatagcatgcccgcagcgtcatctgtcaagaagccattcggactgaggtctaagatgggaaagtggtgctgtcgctgcttcccctgttacagggagagcgggaaaagcaacgtgggaaccagcggagaccacgacgactccgccatgaaaaccctgcggagcaagatgggcaagtggtgccaccattgtttcccttgttgtaggggctctggcaaatcgaatgtcggtgcctccggtgaccacgacgattcggctatgaagactctgaggaacaagatgggaaagtggtgttgccactgttttccctgttgcaggggatccggtaagtctaaggtgggcgcatggggcgactacgatgactccgcatttatggaaccacggtatcatgtccgcggagaagacctggacaagctgcatagggctgcctggtggggaaaagtgccgaggaaagacctcattgtcatgttgagagataccgacgtgaataaaaaggataaacagaagcggaccgcgctccacctggcctcggctaacggcaatagtgaagtcgtaaagcttctgttagacagaaggtgtcaactaaatgtgcttgataataaaaaacggactgctcttattaaggctgtgcaatgtcaggaggacgaatgcgcactgatgctcctcgaacatgggacagacccaaacatccccgatgagtacgggaatacaacgttgcactacgccatatataacgaggacaagttgatggcaaaagcactcttgttgtacggggctgacatagagagtaagaataagcacggacttacgcctctgctacttggcgtgcacgaacaaaagcaacaggtagttaaattcttgataaaaaaaaaggcgaacttgaatgccctcgacagatatggcagaacagcattaattctcgcagtgtgttgtggcagcgccagcatagtcagtctgctgctggaacaaaacattgacgtttctagccaggatctgagcggccagactgcacgcgagtacgcagtttcgtcccaccaccacgtcatttgccaacttctgagcgactacaaagagaagcagatgctcaagatatcctctgagaattctaatcctgaacaggagctgaagttaacctccgaggaggaatcccagagatttaaaggtagtgagaacagtcagccggagaagatgtctcaggagcttgagataaacaaagatggcgacagggaggtagaggaggaaatgaagaagcatgagtcgaacaacgtcggactcctcgagaatctgacgaatggcgtgaccgctggtaatggtgataacggcctcatacctcaaaggaaaagcagaacaccggagaaccaacagttcccagacaatgagtcagaggagtaccatcggatttgcgaactgctgagcgattataaggagaagcaaatgccaaaatatagcagtgagaattcgaacccagaacaggatctgaaactgacttcggaagaggagagtcagcggctcaagggcagcgaaaatgggcagcccgaaaagagatctcaggagcctgaaatcaataaggacggggaccgtgaactggaaaatttcatggccatcgaagagatgaaaaaacacggttctacccatgtcggtttcccagagaacctgaccaatggcgctactgccggtaacggcgatgatgggctaatcccgccaagaaagtcaagaacccctgaaagtcagcagttccccgataccgagaacgaagagtatcactctgatgaacaaaatgacactcagaagcagttctgtgaggagcaaaacacggggattctgcacgatgagattctcattcacgaagaaaaacagatcgaagttgtggagaagatgaacagcgaactgagtctttcatgtaagaaagagaaagacgttttgcatgagaattccaccctgagggaagagatcgcgatgttgaggctcgagttggacacaatgaaacatcaatcacagcttcgggaaaagaagtatttggaagacatcgaaagtgtgaagaagaaaaatgacaacttactgaaagccctccaactgaatgaactcaccatggacgacgataccgctgtgctggtcatcgacaatggatcaggcatgtgcaaggcaggatttgccggtgatgatgcccctagagcggtctttccttctatcgtgggcaggcctaggcaacaagggatgatggggggaatgcatcaaaaagaaagctacgtcggaaaagaagcccaatctaagcggggtatcttgacgttaaagtacccgatggaacatggcatcatcaccaattgggatgacatggagaaaatctggcaccatactttttataacgaactgagagtagcccctgaggagcatccaattttgctcacggaagccccattgaatcctaaggcaaacagggagaaaatgacccagattatgttcgaaaccttcaacacacccgcaatgtatgttgctatccaggcggtaccgtccctctacacgtccggcagaacgacggggatagttatggatagtggggatggcgttactcacaccgtgccaatatatgaggggaatgccctgccccatgccaccctgaggctcgacttggccggtagagaactgccagattatctaatgaagatcctgacagagcgtggttacagattcactaccatggctgagcgcgaaatcgtgcgagacatcaaagaaaagctgtgctatgtggcgttggactttgagcaggagatggcgactgcggctagctccagctctctagagaagtcatacgagcttcccgatgggcaggtgattaccattgggaatgagagatttcgctgtccggaagccctgtttcagccgtgctttttgggtatggagtcctgcggcattcacgaaactactttcaactctatcatgaagagcgacgtagacatcaggaaggacctgtatactaataccgtgctcagcgggggaacgacaatgtatcccggaatggcccacagaatgcagaaagaaattgcagccctagcccctagcatgatgaaaatccgcataatcgcgcctccaaaacggaaatactcagtttgggtaggaggctcaatcctggccagcctgtccacgttccagcaaatgtggatctcaaaacaggaatatgatgagagcgggcctagcattgtacaccgtaagtgcttttag

SEQ ID NO: 58450 - DNA, 1185 bp, Artificial Sequence
  Description of Artificial Sequence: Synthetic coding sequence
atggtggtagaagtggactctatgcccgctgcctcatcagtgaagaagcctttcggcctccgttccaagatgggcaagtggtgctgcaggtgtttcccctgctacagagagagcggaaagtcgaacgtcggaacgagcggcgatcacgatgattcagcaatgaagacactgagaagtaaaatgggaaagtggtgccaccattgctttccgtgttgccggggatccgggaaatcaaacgttggtgcgtcaggggatcacgatgacagtgccatgaagacactgaggaacaaaatgggcaagtggtgttgccattgttttccctgctgtagagggtcagggaagagcaaagtgggagcatggggcgattacgacgattcggcctttatggaacccagatatcatgttcgcggagaagatctcgacaagctgcaccgagccgcttggtggggtaaagtccctaggaaagacctgatagtgatgctgagagacacagacgtgaataagaaagacaagcagaaaaggaccgccttgcatttggccagcgccaatggtaactccgaagtcgtgaaactactgctagacaggaggtgtcagctgaacgtgttggataacaaaaaaaggaccgcgcttataaaagtgtgttccagccagctgtaccaacacgaggccgtgcagtgccaggaagacgaatgtgctttgatgctgctcgagcacgggacagaccctaatatccccgatgagtacggcaacaccaccctgcattacgctatctacaacgaagataagctaatggcaaaggccctgttactgtacggcgctgatattgaatctaagaacaagcatgggcttacgccactattgctcggagttcacgagcaaaaacagcaggtagtgaaatttctgatcaaaaaaaaggctaacttgaacgcattggaccgctatggtaggacggctctcattctggcggtgtgctgcggctcagcgagcatagtcagcttactgctggaacagaacatagatgtgagttcacaggatctctctggacagacagccagggagtacgctgtgagcagtcaccatcatgtgatctgccagttgctgtccgattataaggagaaacagatgctgaagatctcaagtgaaaattctaaccccgagaatgtgagccggacacggaataaatag

SEQ ID NO: 58451 - DNA, 1527 bp, Artificial Sequence
  Description of Artificial Sequence: Synthetic coding sequence
atggtggctgaagccggatctatgcccgctgcaagctccgtgaagaaacctttcgggctcaggagcaaaatgggcaaatggtgcagacactgtttcccttggtgcagagggagcggaaaaagcaatgtgggtacgagcggtgatcacgacgacagcgctatgaagaccctgcgcagcaaaatgggcaagtggtgtcggcattgtttcccctggtgccggggaagcggcaaatcaaatgtggggacttcaggagaccatgacgactcggcaatgaagactctccgctctaagatggggaaatggtgttgtcattgcttcccctgctgtagaggatctggcaaatctaaagttggcccttggggggactatgatgactccgcattcatggagcctcgttatcatgttcgtagggaggacctggataagctccatcgagcagcctggtggggaaaggtgcctaggaaggatctcatcgtgatgttgaaggataccgatatgaacaaaaaggataagcagaaaagaacggctctgcaccttgcatccgccaatggaaactcggaggtggtaaagctgcttttagatcgcagatgccagttgaacatcctggacaataagaaacgaaccgccttgaccaaggctgtgcaatgccaggaagacgagtgtgccctgatgcttctcgaacacggaacagatcccaatatccccgatgagtacggaaatactgcgctgcactatgcaatctataacgaagataagctgatggccaaggctctcctgctatatggggctgacatcgaaagtaaaaacaagcacggcctcacgccactgctgctgggagtccacgaacagaagcagcaggtggtcaagttcctcataaaaaaaaaggcaaatttaaatgccctggatcggtacggtcggactgtgttaattctggccgtttgctgcggatctgccagcattgtttctttactgcttgagcagaatatcgacgtttcctcacaagatcttagtggacagactgcaagggagtatgcagtctcatctcgccacaatgtcatttgccagctcctgtccgattacaaagaaaagcagatcttgaaggtgtcttcagaaaatagtaatcccgaacaggatctcaagctgacctcggaagaggagagccagcgcttgaagggctccgaaaacagtcagccagaagaaatgtcccaggaaccagagattaataaagggggagatcgcaaggtagaggaggagatgaaaaagcacggaagtacccatatgggttttccggagaatctgcctaacggagctacagctgacaatggagacgacggccttattccgccacggaaaagccgaacaccggaaagtcaacagttcccagacacagaaaatgagcagtaccacagcgacgaacagaacgatacacagaagcagttaagcgaggaacagaatactggcatcctccaagacgaaatcctcattcatgaggagaaacagatagaggtagccgagaacgagttctag

SEQ ID NO: 58452 - DNA, 1629 bp, Artificial Sequence
  Description of Artificial Sequence: Synthetic coding sequence
atggtcacagaggtgtgcagtatgcccgcagcatccgctgttaaaaaaccattcgacctacgatcaaaaatggggaaatggtttcaccacagattcccatgttgcaaaggctctggaaagtctaatatgggtacttcaggcgatcacgacgatagtttcatgaaaatgttaagatccaaaatgggtaaatgctgccaccattgctttccatgctgcaggggaagcggcacaagcaacgtgggaacctcaggagaccatgataactcatttatgaagacactgcgttccaagatgggaaagtggtgctgtcactgtttcccttgctgtcgcggaagtggcaagagcaacgtgggcgcatggggcgactatgacgactccgcttttatggagccacgctaccacgtaagacgggaagatctggacaaacttcaccgcgcagcatggtggggaaaggttccaagaaaagaccttatcgtgatgctccgggacaccgatatgaataagcgtgacaagcagaaaagaacagcactacacttagcctccgccaatggaaattcagaggtggttcagctactcctggaccgacggtgccagttgaatgtgttggacaacaagaagcgtactgcactcatcaaagccgttcagtgccaggaggacgagtgcgttcttatgctcctggaacacggtgccgatcaaaatatcccagacgagtatgggaatacaacattgcattacgccgttcacaatgaggacaaactgatggcgaaagccttactcctgtatggagccgacatcgagagcaaaaataagtgcgggctaacgcccctgctactcggcgtgcatgagcagaagcagcaggtcgttaagttcctgataaagaagaaggccaatttgaacgccctggacagatacggcagaaccgcgctgatactggcagtatgctgcgggtccgcgtctatcgttaatctcttgcttgagcagaatgtagatgtgtctagccaggatctctctggacagaccgctagagagtacgctgtgtcgtcccaccatcatgtgatctgcgaacttctctccgactacaaagagaagcagatgctgaagatctcctctgagaatagcaaccccgagcaggacctcaagctaacttccgaggaggaaagtcagcgtcttaaagtgagcgagaactcccaacctgaaaagatgtcacaggagcccgaaataaataaggattgcgatagagaggtcgaagaagagatcaaaaaacacgggagtaaccctgtcggcctacctgagaacttaaccaacggggcatccgccggaaacggcgatgacggccttattcctcagcgcagaagccgtaagccggaaaatcagcagtttccagataccgagaatgaagagtaccatagcgacgagcagaacgatactcgtaagcagctgtccgaagaacagaacacaggcatatctcaggacgaaatactgacaaacaaacagaagcagatcgaggtcgcggagaagaaaatgaacagtgaactgtccctgtcacataagaaggaagaagatttgctaagagaaaactcaatgctgcaggaagagattgccatgctcatcagcggtgactggaactag

SEQ ID NO: 58453 - DNA, 1146 bp, Artificial Sequence
  Description of Artificial Sequence: Synthetic coding sequence
atggttactgaggtctgttctatgcctgccgcttcagctgtgaaaaagcctttcgacctacggtcgaaaatgggcaaatggtttcaccacaggtttccttgctgcaaaggctccgggaagagtaatatgggtacctctggagaccacgatgacagcttcatgaagatgctccgctccaagatgggtaagtgttgccatcactgcttcccttgttgtcgagggtctggcaccagcaacgtcgggacctcaggggaccacgataacagctttatgaaaacgctcaggtccaaaatggggaaatggtgttgccactgtttcccctgttgcagaggatccggcaagtcgaatgtaggagcttggggggactatgacgacagcgctttcatggagcctcgctaccacgtgcgcagggaggacctggataaactgcatcgggctgcttggtgggggaaagttcctcgcaaagatttgattgtcatgctgcgagacacggatatgaacaagcgggataaacagaaaaggacggcccttcacctggctagcgcgaacggcaactctgaggtggtccagctgctcctggatcgacgctgccaactgaacgttttggacaataagaagcgcacagcactaatcaaggctgtgcaatgccaagaagacgagtgcgttctgatgcttctcgagcacggcgctgaccagaatatacccgatgaatatggcaacacaactttgcactacgccgtacataacgaggacaagctcatggcgaaggcattacttctctacggagccgatattgaatcaaaaaacaaatgtggactgaccccattactactgggcgtccacgagcagaaacagcaggtcgtcaaattcctgatcaagaagaaagcgaatctgaacgccctggacagatatgggagaacagcgctgatcctggctgtgtgctgcgggagtgctagtatcgttaatctgctgcttgaacagaatgtggacgtctcgtcacaggatctctctgggcagaccgctcgggaatatgcagtgagtagccatcatcatgttatctgcgaattactgtccgattacaaggagaagcagatgctgaagatcagtagtgagaactctaatcccggaaaggaagccgaggaatag

SEQ ID NO: 58454 - DNA, 1527 bp, Artificial Sequence
  Description of Artificial Sequence: Synthetic coding sequence
atggtcgcagaagctgggagcatgcctgcagcttcttcagtaaaaaaaccatttggtctaaggagtaagatgggaaagtggtgtcgccactgctttccatggtgtcggggatccgggaaatcaaacgtcgggactagtggcgaccatgatgactcagcgatgaagacccttaggtccaaaatgggcaagtggtgtagacattgctttccgtggtgtcgcggatcctctaagtcaaacgtgggaacttcgggcgatcacgatgacagcgcgatgaaaaccctgaggtcaaaaatgggaaaatggtgttgccactgctttccctgttgtagagggagcggcaaaagtaaggtcggcccttggggagattacgatgattctgccttcatggagccgagatatcatgtcagaagagaggacctggacaaactccacagagcagcctggtgggggaaggtgcctcggaaggacctcatcgtgatgctgaaagacactgacatgaacaagaaggacaagcagaaacggactgctttacacctcgctagtgcaaatggtaatagcgaggtcgtgaagttgctcctagacaggcgttgccagctaaacattctcgacaacaaaaaacgcacagcccttactaaggccgtccagtgtagggaagacgaatgtgctttgatgctgctcgagcacggaacagatcctaacatcccagatgaatacgggaatacagccctccattatgcaatctacaacgaggacaagctcatggcaaaggctctcctactgtatggagccgacatcgagtccaaaaataagcacgggctaacacccctgctcttgggcgtacatgagcagaagcagcaagtggttaagttcctaatcaaaaagaaggcaaacctcaacgccctcgatcgatatggccgtactgctcttatcctcgcagtctgctgcggctctgcttccatcgtatcattgctcctggaacagaacattgacgttagctcccaggacttatccggacagacagcaagagagtatgcagtgagcagtcatcacaatgtcatttgccagttgttgagtgattacaaagaaaagcagatgctcaaggtgtctagcgagaattcgaacccagagcaggaccttaagctcacttctgaggaggaaagtcaaagactcaagggttcagagaacagccaacctgaggagatgtcccaagaacctgaaatcaacaaaggaggcgatcgtaaagtagaagaggagatgaagaaacacgggtccacacacatgggtttcccagagaatctccctaatggagctaccgcagataacggagatgatggactcatcccgccaaggaaaagtagaacacccgagagtcagcaattccctgatactgaaaatgaacagtaccacagtgacgagcaaaacgacactcagaaacaattaagcgaagagcagaacaccgggatccttcaggatgagatcctgattcacgaggagaagcaaattgaggtggctgaaaacgagttctag

SEQ ID NO: 58455 - DNA, 1461 bp, Artificial Sequence
  Description of Artificial Sequence: Synthetic coding sequence
atggtggcagaggcgggatctatgccggcagctagctcagtgaaaaaaccattcggcctccgcagcaaaatggggaaatggtgtcgacattgcttcccttggtgtcggggaagtggaaaatccaacgtgggcacctccggtgaccacgatgactccgctatgaagactctgcgatccaagatgggaaagtggtgtcgacattgcttcccatggtgccggggatccggtaaaagcaatgtggggacatcaggagaccatgacgactcagcgatgaagaccctgaggtctaagatggggaagtggtgttgtcactgcttcccatgctgtcgcggttctgggaagagcaaagtagggccttggggagattacgacgacagcgccttcatggagccacgttaccatgtacggagagaagaccttgacaagctgcatcgggctgcctggtggggaaaggtaccccgtaaggacttaatcgtcatgttgaaggacacagacatgaataagaaagacaaacaaaaacggaccgccctgcacctggccagcgctaatggtaattcagaggtcgttaagctcctgctggacaggcgttgccagctcaacatactggataacaaaaagcggacagccctgacaaaggctgtgcagtgtcaggaagatgaatgcgcactaatgctattggaacatggcacagatcctaatattcccgacgagtatggtaataccgctcttcattacgctatctacaacgaagacaaactgatggccaaagctttgctcctgtacggtgcagacatcgagtctaaaaataaacacgggctgacccccctcctgctgggagttcacgaacagaagcagcaggttgtaaaatttctcataaaaaagaaagccaacttaaatgctctggataggtacggacgaactgtcttaatcttggctgtgtgttgcgggtccgcctccatcgtgtccctcctgcttgagcagaatattgatgttagctctcaggatctgtccgggcagactgctcgggaatatgccgtgagcagccggcacaacgtcatctgccaactcctcagcgattacaaggaaaagcagattttgaaggtttcaagtgagaacagcaaccctgagcaggacctgaaactgactagtgaagaggagagccaacgcctgaaggggagcgagaactcccagccagaggagatgagccaggagccagaaattaacaagggcggagatcgtaaagtggaggaggagatgaaaaaacacggttcaacccacatgggattcccagagaacctgcccaatggcgctactgccgacaacggggatgatggcttgatacccccaaggaaatctcgcacaccagaaagtcagcagtttcctgatacagaaaacgagcagtatcacagagattttagtggccaccctaattttccgacaacccttcctatcaaacagtag

SEQ ID NO: 58456 - DNA, 1782 bp, Artificial Sequence
  Description of Artificial Sequence: Synthetic coding sequence
atggtggctgaagccggttccatgccggctgcctcctcagttaagaaaccattcggcctgcggtctaagatgggcaaatggtgccgccattgcttcccctggtgccggggaagcggaaagagcaatgtcggaacttccggggatcatgacgacagcgccatgaagacactgcggagcaaaatggggaagtggtgcagacactgttttccatggtgtcgcggttctggtaaatcaaacgtgggcacatccggagaccacgatgatagtgctatgaaaacactaaggtccaagatgggcaagtggtgttgtcactgtttcccatgctgcagagggagcggaaagtctaaggtaggaccctggggtgactatgatgacagcgcgttcatggaaccaagataccacgtacggagagaagacctggataagcttcatcgtgcggcttggtggggaaaagtgccaagaaaggacctcatagtcatgctgaaggacactgacatgaacaagaaggataaacaaaaacgcacagctctgcacttggccagcgcaaacggaaactctgaggtcgtcaagctactgttggacagaaggtgtcagctcaacattttggacaacaaaaaacgcacagctctgaccaaagcggtgcagtgccaggaagacgagtgcgcactgatgttgttagaacacggcaccgaccctaatatccccgacgaatatggaaataccgcccttcattatgccatatacaacgaagataagttgatggccaaggctttactgctctatggcgctgacatcgagtccaaaaacaagatcgagtcacactccgtatctcaggctggcgtgcagtggtgtgatcattccagcttgcagcccaggccacctgaagcgcagatggttctccaaccacaaccacagttttttttcctatcctttttcttatttttattcctgttcttattctttttttcgagggacgaggtgttcgccatgttcctccgactggtattgaattcttgggcccaagcgatacacccacctcagcccccaaaagtccttgggctccagcatggcttaacaccacttttgctgggcgtgcacgagcaaaagcagcaggtggttaaattcctgatcaagaagaaagccaacttgaatgccctcgatcgatatggccgtacggtactgattcttgctgtgtgttgtggatcggcatctattgtgtccttacttctcgagcagaacatcgacgtttctagtcaggacctctccggacagacagcgagagaatacgcagtttccagtagacacaatgtcatctgtcaactactgtccgattacaaagaaaagcagatcctgaaggtttcttctgaaaactccaaccctgaacaagacctcaagctgacatctgaggaagaatcccagagattaaagggctcggaaaattcgcaaccggaggagatgtcccaggaaccagagatcaacaaaggcggtgaccggaaagttgaggaggagatgaagaagcatggctctacccacatgggattccccgagaatttgcccaacggcgctaccgccgataatggagacgacggcctcattccacctcgtaaatctagaacccccgaatcacagcagtttccagacaccgaaaatgagcagtatcattctgacgagcagaatgacacccagaaacaactgagtgaggaacagaatactggcattctgcaggacgagatcttaatccacgaggaaaagcagatcgaagtggccgaaaacgagttttag

SEQ ID NO: 58457 - DNA, 1080 bp, Artificial Sequence
  Description of Artificial Sequence: Synthetic coding sequence
atggccggtcatcttgctagtgattttgcctttagcccgcctcccggaggcggtggcgacgggccttggggtgccgagccaggttgggtcgaccccctgacatggctgagcttccagggacctccaggcggtcctgggatcgggccaggggtgggacccggttccgaagtgtggggaatccctccgtgtccccctccttatgagttatgcggcggtatggcttattgcggccctcaggttggcgttggactagttccacaggggggactcgaaacctcacaacccgagtctgaagcaggagtgggggtcgaaagcaacagcaatggcgcttctcctgagccatgcactgttccccctggggctgttaagctagagaaggagaagcttgaacaaaacccagaaaagagccaagatattaaagctctgcagaaagagttagaacagttcgccaaactgctcaagcagaaacgtatcactttgggctacacacaagccgatgttggactgattctgggggtacttttcggaaaagtcttttctcagaagacaatttgtaggtttgaagctttacaattgagctttaaaaatatgtgtaaactgcgcccacttctgcagaaatgggtcgaagaggccgataacaacgagaacttgcaagaaatttgcaaagctgaaaccctgatgcaggccagaaaacgcaagcgcacaagtatagaaaatagggtgcggggtaacctggaaaatctgtttctgcaatgtcccaaaccgactcttcagatctcacatatcgcacagcagctcgggttagaaaaggacgtggtccgagtttggttctgcaaccggaggcagaaaggcaaacgttcctccagcgactatgctcagcgcgaggacttcgaagcagcgggttcccccttttccggcggacctgtctcttttcctcctgctcccggtccacatttcggtacccccggatatggatccccccattttaccgcactttactcaagtgtacccttcccagagggtgaagtgtttccaccagtgagtgtgatcacattggggtcccctatgcatagcaactag

SEQ ID NO: 58458 - DNA, 1080 bp, Artificial Sequence
  Description of Artificial Sequence: Synthetic coding sequence
atggcagggcacctggcaagtgatttcgctttttcacccccaccgggagggggaggtgacggcccttggggcgctgagcccggatgggtcgacccacttacctggcttagcttccagggacctccgggaggaccgggtatcggacctggggttggccctggtagcgaggtgtgggggataccaccctgccccccaccgtatgagctctgtggcggaatggcatattgtgggccacaggtgggcgtcggcctagtcccccaaggcggattggaaacgagccaacctgagagcgaagcaggcgtcggtgtggagtcaaattccaacggggcaagccctgagccttgtaccgttcccccaggggcagttaagttagagaaggaaaagctagagcaaaatccagagaagtcacaagacatcaaagcgcttcagaaggagctagaacagttcgcgaaattgctgaaacaaaaacgaatcacgctcggctatacacaagccgacgtgggcctgatcctgggcgtgctgttcgggaaggttttcagtcagaaaaccatctgtaggttcgaagctttgcagttgagtttcaaaaacatgtgcaaattaagaccattattgcagaaatgggtggaagaagccgataataatgaaaaccttcaggagatttgcaaggctgagacattgatgcaggcgaggaagaggaaacgaaccagcattgagaacagagtgcgtgggaatctcgagaacctgttcctgcagtgcccaaaacctactctgcagatatcacacatagcacagcagctgggactggaaaaagatgtagtgagggtttggttttgtaacagaaggcaaaaaggtaagcggagttctagcgattatgcgcaaagggaagattttgaagccgcaggtagccccttcagcggaggtccagtgtccttccccccagcgcctggacctcacttcgggacacccggttacggcagcccccactttactgccctgtattcatctgtgcccttcccagaaggcgaagtctttccacctgtcagcgtgattacactcggctcgcccatgcacagcaactag

SEQ ID NO: 58459 - DNA, 987 bp, Artificial Sequence
  Description of Artificial Sequence: Synthetic coding sequence
atggctgggcaccgaccatcgaaccatttctgcccacttcccggaagcggcggaggcggacccaggggacctatgccactgcgggtggacacccttacatggctgagcacgcaggcggcacctggacgggtcatggtgtggccagccgtcagaccagggatctgcccagggcctgacgtgtggcgtatcccccttggtcccctgccgcatgagttccgcggatggatcgccccttgtagaccacgactgggggcatccgaagctggggattggttgcgtcgaccctccgagggggctctgcctggcccatatatcgcactgcgtagcatcccgaaactacccccaccggaggacattagtggaattttgaaagagttacagcaactggccaaggaattgcgccaaaagcgcctgagcctggggtactcccaggctgatgtgggcatagccgtgggagctctcttcggcaaggtgctgtctcaaaccacgatatgccggtttgaggcacaacagttgtccgtcgccaacatgtggaagctgaggcccttactgaaaaaatggctgaaggaagtggaagccgaaaacctgctcggactctgcaagatggagatgatcctgcaacagagcggtaagtggaggagggccagtcgggaaaggagaatcggcaacagtttagagaaattctttcagcgctgtcccaagcctacccctcaacagatttcccacatcgctggctgcctgcaactccagaaagacgtggtgcgggtgtggttctacaacaggagtaagatgggcagcagacccacgaacgacgcttcaccacgagaaatcgtgggtactgccggacccccatgccctggagcgcctgtgtgcttccacctgggactcggcctgcccgtcgatattccgcactacactaggttatacagtgcaggagtggcacactcttcagccccagcaacaaccctgggactgttacggttttag

SEQ ID NO: 58460 - DNA, 2385 bp, Artificial Sequence
  Description of Artificial Sequence: Synthetic coding sequence
atgggacagtccgggagatcgaggcaccaaaaacgtgcccgtgcacaagcacagctgaggaacctagaggcctatgcagctaaccctcacagcttcgtatttactcgcggatgcacagggagaaacattaggcagctgtccctggacgtacggcgagtcatggagccccttactgccagtagattgcaggtgcggaagaagaacagcttgaaggattgcgtggccgtggctggcccactaggggtcacccactttttgattctttccaaaaccgaaacaaacgtctatttcaagctcatgcggctacctgggggtcccacattaaccttccaggtcaaaaagtacagcctggtccgcgatgtggtgagcagtctgagacggcatagaatgcatgaacagcaattcgcacatccaccactgctcgttctgaatagtttcggacctcacggtatgcatgtgaagctgatggcaacaatgtttcagaatctgtttccctcaattaatgtgcacaaagtcaatttaaataccatcaagaggtgtttactaatagactacaaccctgattcacaagaactggattttagacactacagtattaaagtagtacccgttggcgcttctcgcggaatgaaaaaattactgcaagaaaaatttccaaacatgagtagactccaggatatctccgagctccttgcaaccggggcaggcttatctgaatcagaggcggagccggatggcgaccataacattactgaactgccacaagctgttgcagggcgaggaaacatgcgggctcagcagtccgctgttaggctgactgagattggcccaaggatgaccttgcaactgatcaaagtgcaggaaggcgtgggtgaaggaaaggtcatgtttcactccttcgtatcaaaaacggaagaggaattgcaagctattctcgaagcaaaagaaaaaaaattgcgcttgaaggcccagaggcaggcccaacaagcacagaatgtccaacgcaaacaggaacaacgcgaagctcacagaaagaagtctttggaagggatgaaaaaggcccgagtcggaggcagcgatgaggaagcttcaggaattcccagtcgcacggcttccctggaattgggagaagatgatgacgaacaggaggacgacgatattgagtacttttgtcaggccgtgggagaggcgccatcagaggatctatttccggaggccaagcaaaagcgtctggctaaaagtccaggcaggaaacggaaaaggtgggaaatggatcgcggagctaagtcttgtcccgctaatttcctggcagccgctgacgacaaactgagtgggttccagggtgactttctgtggcccattctggtcgtggagttcctggtggcagtggcctctaatggcctcgccctatatcggtttagtattcggaagcaacggccttggcacccggctgtagtcttttctgtgcagttagcagtatctgaccttctgtgtgcacttacgcttcctcctctcgcggcttatttgtatccaccaaaacattggcgctacggcgaggcagcctgcagattagagcgcttcctctttacgtgcaacctgctcggatcagtaattttcattacatgcatcagcctcaaccgatacctggggatcgtgcatccattttttgctcggagccatctccggcctaagcacgcatgggcggtctctgctgctggctgggtgctcgccgctcttctggctatgcctaccctgtcattcagccacctgaaacgaccgcaacagggagctggcaactgttcagtcgcacgtccggaggcctgcatcaagtgtctgggcactgcagaccatggactcgctgcttacagagcttacagcttagtccttgccggactgggttgtggtttgcccctgctgcttactctcgctgcctacggagctttgggtagagccgtgctgcgctccccaggaatgacagttgccgagaaacttagagtcgctgcactggtcgccagcggcgtggccctctacgccagtagctatgttccttatcacatcatgagagtgttgaatgtggacgcccgtcggaggtggtcaaccagatgtccctctttcgccgatatcgcccaggcaactgccgcattggagctgggaccttatgtgggctatcaggtgatgcgaggtctgatgccactggccttttgcgtacacccactactctatatggctgctgtacccagcctgggttgttgttgccgccattgtccgggatatagagacagttggaatcccgaagacgctaaatctaccggccaagctttacctctcaacgcgacagcagcaccaaagcccagtgaaccacaaagtagggagctgtcacagtag

SEQ ID NO: 58461 - DNA, 1563 bp, Artificial Sequence
  Description of Artificial Sequence: Synthetic coding sequence
atgggccagagcggccgttcaaggcaccaaaagagagcgcgtgcgcaggcacagctcaggaacctggaggcttatgctgccaaccctcattcctttgtcttcacacggggatgcaccggaaggaatatacgccagctgtctctcgacgttcgcagggtgatggaacccttgaccgcatcaagactacaggtcagaaaaaaaaacagcctgaaagattgtgtcgcggtcgctggccctttgggggtgacgcacttcctcatcctgtctaagaccgagacaaacgtatacttcaaactgatgaggttgcctggcggtccaacattaactttccaggttaagaaatactctctcgtccgcgacgtggtgtcctccctcagacgacataggatgcatgagcagcagtttgcccaccctccccttcttgtactgaattcgttcggccctcacggcatgcacgtaaaactaatggcaacaatgttccagaacctgtttccaagtattaacgttcacaaggtgaacttaaataccattaagagatgcctattgattgactacaatcccgattcacaggagctggatttcagacattactctattaaagtggtgcctgtcggagcttctcgcggtatgaagaagctgttacaagagaaatttcccaacatgtctagactgcaggacatctctgagttactggcaactggagccggactgtctgaatctgaagccgaacccgatggagatcacaacatcactgagctgccacaggccgtggcaggcaggggcaatatgcgcgcacagcaatccgccgtacggcttacagaaattggacccaggatgaccctgcaactgattaaagtgcaggaaggcgtgggagagggaaaggtgatgtttcactcctttgtctctaagaccgaggaagaactgcaggccatcctagaggcaaaggaaaagaaattacgcctcaaggctcagaggcaggcccagcaggctcagaacgtgcaaagaaaacaggaacagcgtgaggcacatcgcaagaagtcccttgagggcatgaagaaggctcgtgttgggggatcagacgaagaggcatcgggaataccaagcaggaccgcctcattggaactcggagaagacgacgacgagcaagaggatgatgatatcgaatatttctgtcaggccgtaggggaggctcctagcgaagacttgttcccagaggctaagcagaagcgcctggccaagagccctggcaggaagcgtaagaggtgggaaatggaccgcggacgagggagattgtgtgatcaaaaatttccaaaaactaaagacaaatcccagggcgctcaggtcccgagcccagcacttcctacctcatggcaactacccaccacgaatagtgtcggatcccgaggaacaagctgtgggccttattggtggctgtcgtcttggtggccctggcctgctatggcctggccctgcacagcatcagcctctggatcctctgctcatgggactcctccttggagctcgctcagctcctggcagtccgccacctgcagcgccccttag

SEQ ID NO: 58462 - DNA, 378 bp, Artificial Sequence
  Description of Artificial Sequence: Synthetic coding sequence
tagtcgcttcaatgtgtgaaattaggcagggccacagccagatggtggtgggtagtgaaggttaaaccacacgataaagacgcaaaaatgaagtatcaggagtgcaacaagatcgtgaaacagaaggcatttgaacgagcgattgctggggatgagcacaagcgctccgtcgtggattcgttagatattgaatcaatgacgattgaaggtgagtatagcggacccaaactggaggatgataaagtgacaatcacttttatgaaagggctcatgcagtggtataaagaccagaaaaagctgcatcagaagtgtgcttatcaggatttcagacagaagagtgggatcattacatcccaggattgcgtacagaccacctag

SEQ ID NO: 58463 - DNA, 486 bp, Artificial Sequence
  Description of Artificial Sequence: Synthetic coding sequence
atgggagccaatcagctggtggttctgaacgtatatgacatgtactggatgaacgagtacaccagctcgattggaataggagtgtttcatagcggcatcgaagtgtatggacgcgcagtggtgctgggatccacggactttttggaggacgacatcgaaaagattgttgaagagctcggtaaggagtataaaggcaatgcgtatcatctaatgcataagaactgcaatcacttttctagtgccctgtctgaaatcttgtgcggcaaagagatcccaaggtggatcaacagacttgcctacttctccagctgcattcctttcctccagtcttgtttgcctaaggaatggctcacacccgcagcattgcagtcttcagtgagtcaagagctgcaggatgagctagaggaggctgaggatgcagctgccagcgcatccgtggcttcaaccgccgctggttcccgacctggacgccacacgaaactgtag

SEQ ID NO: 58464 - DNA, 585 bp, Artificial Sequence
  Description of Artificial Sequence: Synthetic coding sequence
atgggagccaatcagctggtggtgcttaatgtgtacgacatgtactggatgaacgaatacacttcttctatcggtattggagtcttccactctggcatcgaggtctatggcagggaattcgcatacggagggcacccataccctttcagcggcatcttcgaaatcagtcccggtaacgcctccgagctgggcgagactttcaaattcaaagaggcagttgtccttggctcaactgattttcttgaagacgacattgagaagatagtggaggagctaggtaaggagtataaaggtaatgcctatcacttaatgcacaagaattgtaatcatttttcttctgccctttccgagatcctctgcgggaaggaaattccacgctggataaataggctggcctacttctctagctgcattcctttcctgcaatcctgtctgcctaaggagtggcttacccccgctgccctgcaaagcagcgtgtcccaggagctgcaggatgaactggaagaggcagaggacgcggcagccagtgcctcggtcgcatctacagctgccggatcacgccctgggaggcacaccaaactgtag

SEQ ID NO: 58465 - DNA, 306 bp, Artificial Sequence
  Description of Artificial Sequence: Synthetic coding sequence
atgcgactaaccttcttaaagaaaatcgcccaactgaattacctggagattctggtggtgttactgtcctacactctgaaaaccaccttccagtattggatgaacgagtacaccagctccattggcataggggtgttccattctggcattgaggtgtacggcagagagtttgcttacgggggtcatccttatccatttagcgggatttttgaaatttccccgggaaacgccagcgagctaggcgaaacctttaagttcaaagaggctgtggtgctcggcagcaccgacttcttggaggacgattag

SEQ ID NO: 58466 - DNA, 3072 bp, Artificial Sequence
  Description of Artificial Sequence: Synthetic coding sequence
atgtcggcctacagcgtccctagcacattcgcccaagctagcctgccagtgcacaaccaggtgcttccctctatcgagagtgtggatggatctgatcctctggccaccctccaaacacccttgggccgactagaggctaaagaagaggaggacgaggacgaggatgaagatactgaggaggatgaggaggaagacggcgaggacaccgacctcgatgactgggagcctgaccccccacgccctttcgaccctcacgacctatggtgtgaggagtgtaacaatgcccacgcctccgtttgcccgaaacatgggcctctgcaccccatcccaaaccgtcccgtccttacacgggcacgtgcatccctgcccctggtcctgtacatagacaggttcctggggggtgtgtttagcaaaagacggatccctaagcggactcagtttggaccagtcgaaggccctcttgtccgcggtagcgagctcaaagactgttatatccatctcaaggtgtccctcgacaaaggcgataggaaggagagagatctccatgaggatctgtggtttgagctgagtgatgagaccttgtgcaactggatgatgttcgtgcgaccagcacagaatcacctggagcaaaatttagtagcttaccagtatgggcaccatgtgtattatacaacaatcaagaacgtggaaccaaagcaggaactgaaggtttggtacgctgcctcatatgccgaattcgtgaatcagaaaatacatgatatatccgaagaggagcgtaaagtcctgagggagcaggagaaaaattggccctgttatgaatgcaatagacggttcatcagctccgagcagctacagcaacatcttaacagccacgatgagaaacttgatgtgtttagtcggacacggggacgagggcgtggacgcggtaagcgccgtttcggaccagggagaaggcccggaaggcctccaaaatttattcggctggaaattacctccgagaatggcgaaaaaagcgacgatggcacccaggacctgctccatttcccaaccaaagaacagttcgatgaggccgaaccagccaccctgaacggcctcgaccagcctgaacagaccactattccaatccctcagttaccccaggaaacacaaagctcgctcgagcacgagcctgaaacccacactctgcacctacagcctcagcacgaggaatctgtcgtgccaacacagtcaactctgaccgcagatgatatgcgaagagccaaacgcattcgaaatgctgctctccagcacctgtttatacggaagtcgtttcgtccatttaaatgccttcaatgtggcaaggcttttcgggaaaaagataaactggaccagcacctccgtttccacggccgtgaagggaattgcccgttgacttgcgacctgtgcaataaaggctttatcagcagtacgtctctggagtctcacatgaagctccatagtgaccaaaagacttattcttgcatcttttgccccgaatcctttgacagacttgatttattgaaggatcacgtggcaatccatatcaacgatggctatttcacttgcccgacgtgtaaaaagcgcttccccgattttattcaggtcaaaaagcacgtgcgtagttttcatagcgagaagatataccagtgtaccgagtgcgacaaggctttctgccggcctgataagttgaggttgcatatgctgagacatagtgacagaaaggattttctgtgttccacctgcggaaagcagtttaaacgcaaggacaaactgcgggagcacatgcagagaatgcataacccggaacgtgaagcaaagaaagccgaccgtatttcccggtctaagacgtttaaaccaaggattacttctacggactatgactcatttaccttcaagtgccggctctgtatgatggggttccggcgaagaggcatgcttgtgaatcatctgagcaagagacatccagacatgaagatcgaggaggtccctgagctgactctccctattattaaacccaatcgggactatttttgccagtactgtgataaagtctataaatctgcctcaaaacgtaaggctcacattctcaagaatcaccccggagccgaacttccgccaagcataaggaagctgagacccgctggacctggggaacctgatcctatgctgagcacacatactcagctgactggcactatcgccaccccccctgtctgctgtccccactgcagcaagcaatacagctccaaaacaaaaatggtccaacacatccggaaaaagcatcccgaattcgctcagttatccaacaccatccatactcccctcactacagcagtgatcagcgccacccccgctgtcctcaccacggactctgcaacaggcgagacagtcgtgactaccgatctgctgacacaagccatgactgaactcagccagaccctgaccacagactatcggacgcctcagggtgattatcagagaatacagtacatccctgtgtctcagtccgcaagtggtctgcaacaaccacaacacatccagctgcaggttgtccaggtggccagtgtgtcaggccaacctctgtccccctctgcccaacaggcgcagcaaggcttgtccccgagtcatattcaagggtccagttccacacagggacaggccctgcagcagcagcagcagcagcagcagaactcttcggtccagcacacgtatttaccatccgcctggaatagctttaggggctatagctccgagattcagatgatgactctgccacctggccagtttgttattaccgacagcggagtcgccactcccgtcacgacaggtcaggtgaaggcagttactagtggccattacgtgctgagcgagtctcagagtgagctggaggagaagcaaacgtctgccttgagcggcggagtgcaagtggagcctccggcacatagtgactcactggacccccagactaacagccagcagcagactacccagtacatcatcactacgacaaccaatgggaatgggtcaagcgaggtccacatcacgaagccctag

SEQ ID NO: 58467 - DNA, 3483 bp, Artificial Sequence
  Description of Artificial Sequence: Synthetic coding sequence
atggattctaaggacgaaagcagccacgtctggcctacatcagccgagcatgaacaaaatgcggctcaggtccatttcgtccccgacaccgggacggttgcgcagatcgtgtacacagatgaccaagtacgcccaccacagcaggtggtgtacaccgcagatggtgcctcttacactagcgtggacggccctgaacacacactggtgtatattcacccagtcgaagcagcccagactcttttcactgacccaggtcaggtggcttatgtgcagcaagacgccacggcccagcaagcctcattgcccgtccacaaccaggtgcttccctcgattgaaagcgtcgatggcagcgaccccctggccaccctccagacacccctgggaaggcttgaggctaaagaagaagaggacgaagacgaagacgaggacacagaagaggacgaggaagaagacggagaagatactgacttggacgactgggaacctgatccccctcgcccatttgatccccatgacctttggtgcgaagagtgcaacaatgctcacgcgtcagtctgccccaagcacggcccactgcatcccattcccaatcggccagtgctgacccgcgcaagagcgtccctgcctctagttctgtatatagacaggttcctcggaggcgtgttcagcaagcgaagaatcccaaagcgtacacagtttgggcctgtggaaggaccactggttcgcggtagtgaactgaaggactgttacatacatctgaaagtgagcctggataaaggcgacagaaaggagcgcgatctgcatgaggatttgtggttcgagctgtcggatgaaaccctgtgcaactggatgatgttcgtgaggccagcgcaaaaccaccttgaacaaaacctagtagcttaccagtacggccatcatgtttattatacaacaattaagaacgtcgagcctaaacaggagctgaaggtatggtacgccgcatcatacgctgaattcgtgaaccaaaaaatccatgatatcagtgaagaagagcgcaaggttctccgcgagcaggaaaagaattggccttgttacgagtgtaaccgaaggttcatctccagtgagcagctgcagcaacatctcaattcccatgacgagaaattggacgttttttctcgcacacgtgggagaggccgtgggaggggcaagcggcgatttggaccaggcagaagacctggtcggccacccaagttcatccgtctagagattaccagcgagaacggtgagaaatccgacgacggcacccaagatttgctgcattttcctaccaaagagcagtttgacgaagcagagcccgctaccctcaacggtcttgaccagcccgagcaaaccactattcctataccacagctgccccaggaaactcagtctagcctggagcacgagcccgagactcatactctgcacctgcaaccccagcatgaggaatccgttgtgcctacccagtcaacgcttactgctgatgatatgagaagagccaaacgcattcgtctcgagctgcagaacgctgccctgcaacatcttttcatccgcaagtcatttaggccctttaagtgcctgcagtgcggcaaggccttccgtgagaaggataagctcgaccagcaccttcgtttccacgggagggaaggcaattgccctctaacctgcgacctgtgcaataagggatttatcagctccactagcctggaatcccacatgaagcttcactccgatcagaaaacatatagttgtattttctgcccggagagtttcgatcgccttgacctgcttaaagaccacgtggcgatacatatcaatgatggttatttcacctgccccacctgtaaaaaacgctttcccgacttcattcaggtcaagaagcacgtgagaagttttcacagtgagaagatctatcagtgcacagagtgcgataaagcgttttgtcgtcccgacaaattgaggcttcacatgcttcggcactctgacagaaaggatttcctgtgcagcacatgtggaaaacaatttaagcggaaagacaagttgagggagcacatgcagcggatgcacaaccctgaaagagaggcaaaaaaagctgaccgcatcagcaggagtaagaccttcaaaccccgtattacgagcaccgattacgattctttcactttcaagtgccggctatgcatgatggggttccggagacggggaatgttggtcaatcacctgtcaaaacgacatcctgatatgaaaattgaggaggtccccgagctgactttgccaattatcaagccaaacagggactacttctgtcagtactgtgataaagtgtataagtctgcaagcaaaaggaaggcgcatatacttaagaaccatcccggagccgaactcccgccatcaatccgtaagctgcggccagcgggaccgggagagcctgatccaatgctgtcaacacacacccagctgaccggcacaatagccacccctcccgtgtgctgtccccactgctccaagcagtattcctccaaaactaaaatggtacagcacatccgaaagaagcatccagaattcgctcaactaagcaacaccatccacacaccccttaccacagcagtaataagcgctactcccgcagtcttaaccaccgattctgcaacaggcgagactgtggtaaccacagacctcctcacacaagctatgaccgagttaagccagacccttaccaccgactaccgaacaccccagggggactatcaacgcatacaatacatcccagtcagccagagtgcttctgggctgcagcagccacaacacattcagctccaagtggtgcaggttgcttctgcgacttcccctcatcagagccagcaatctacagtggacgtgggacaattacacgatccacagccatacccccaacacgcgatccaggttcagcatatccaggtatcagagcctacggcatctgccccatcttctgcgcaggtgagtggtcagccgctcagccccagcgctcagcaggcccagcagggattgagcccctcccacatacaggggtcctcgtctactcagggacaggccttgcagcaacagcaacaacagcagcagaactcctcagtccagcatacttacctgccaagtgcttggaacagcttcagaggctacagctccgagatacagatgatgacattgccacccggacagttcgtgatcactgactctggcgtcgcgactccggttacaaccgggcaagtcaaggctgtaactagcggccattacgttctgagcgagtctcagagtgaattggaagaaaagcagacctctgctctgtctggtggggtgcaggtcgagcctcctgcgcactccgactcactggacccccagactaacagccaacagcagacgacccagtatatcataactaccaccactaatggaaatggatcctctgaggtgcatattaccaaaccttag

SEQ ID NO: 58468 - DNA, 3471 bp, Artificial Sequence
  Description of Artificial Sequence: Synthetic coding sequence
atggattcaaaagatgagtcctcacatgtgtggccaacctctgcggagcatgaacagaacgcagcacaggttcattttgtcccagacaccggaaccgtagcacaaatagtgtatactgacgatcaggttagaccaccacagcaggtggtctataccgctgatggggcaagttacacgtccgtggatggacccgaacacacgctcgtatatattcatccagtggaagcagctcaaaccctcttcaccgacccaggccaagttgcttacgttcagcaggatgctacagcccagcaggcatcactgccagtgcacaaccaggttctcccttccatcgaatccgtggacggctccgatcctctcgcaaccctccaaacccccctgggcaggctggaggctaaagaggaggaagacgaggatgaggacgaggacaccgaagaggatgaggaggaagatggagaggacaccgacctggatgattgggaaccagaccctcccaggcccttcgatccacacgacctctggtgtgaggaatgcaataacgcacatgccagcgtatgtcctaaacatggaccactgcacccaattcctaaccgacctgtgctgacacgtgccagggcctctttacccttggtgctgtacatcgatagatttttgggcggagtctttagcaaacggaggattccgaagcgcacacagtttggacccgtggaaggcccactcgtccgaggttcagaactaaaagattgctatattcatctaaaggtgagtctggataagggcgaccggaaagagcgggatctgcacgaagacttgtggtttgagctttcagatgaaacactctgtaattggatgatgtttgtaaggcctgctcagaatcaccttgagcagaatctggttgcataccagtacggacaccatgtgtactatacaacaatcaaaaatgtggagccaaaacaggagctgaaagtctggtatgcggcttcttatgcagagttcgttaaccagaagatccacgatatctctgaggaggaacgtaaggtcctgcgcgaacaggaaaaaaactggccatgttatgagtgcaacagacggttcatatcctcagagcagcttcagcagcacctgaactcccacgatgagaagcttgacgtgttctctcgcactcggggtcgcggacgcggacgcggaaagagacgttttggccctgggaggcggccaggtagaccgccaaagtttatccgactggagataactagcgagaatggtgagaaaagtgatgacgggacccaggaccttctgcatttcccgacaaaagaacagtttgacgaagctgagccagcaaccctgaacggactcgatcagccggagcagaccacaatcccaatacctcagcttccccaggagactcagagtagtcttgagcacgaacccgaaacacacactttgcacctccagccacagcatgaagaatcagtagtacccacacagtccacgctgactgccgacgacatgaggagagccaaacggattagaaacgctgccctgcaacatctcttcattcgtaagtcattcagaccatttaaatgcctgcagtgtggcaaggctttccgggaaaaagacaagctcgaccagcatctccgcttccacggaagagagggcaactgcccattaacatgcgacctgtgcaacaagggctttatctccagtacctccctcgagtcgcatatgaaactgcactcggatcagaagacctacagctgcattttttgtccagagtcgttcgacagactggatttattgaaggatcatgtcgccattcacataaatgacggatactttacttgccctacttgtaagaagaggttccctgactttatccaggtgaaaaagcatgtcaggtcgtttcactccgaaaaaatatatcagtgtacagaatgtgataaggcattttgccgtccagacaagcttcgactacatatgctaaggcactctgaccgcaaggacttcttgtgctctacatgtgggaagcaatttaagcggaaagacaagctgagggaacatatgcagcggatgcataaccccgaacgggaggctaaaaaggccgaccgtatatcacgctccaagaccttcaagcctaggatcaccagcaccgattatgatagcttcactttcaaatgtagactttgcatgatgggctttcgcaggagaggcatgctggtgaatcacctgagcaaacggcatcctgatatgaagattgaggaagtcccagaactgacactgcccatcataaagcccaaccgagactatttttgccagtactgcgacaaagtttacaagtccgcatctaaaaggaaggctcatatattgaagaaccaccccggagccgagttacccccatctatccgcaagctgaggccggcaggtccgggagaaccggatccgatgctttcaacacatactcagctcacaggtactatcgcgacacctcctgtttgctgcccacactgcagtaaacaatattccagcaaaacaaagatggtgcagcatattagaaaaaagcacccagagttcgctcaactgagcaatacgattcacaccccattaaccacagcggtaatctccgcgacccccgctgtgttgaccaccgatagcgctaccggggaaacggtcgtgactaccgacctattaacccaggccatgacagagctcagtcaaacgctcacgacagattacagaaccccacagggagattatcagaggatccagtatatccctgtctcccagtctgccagcggcctgcaacaacctcagcacatacagctccaggtggtgcaggtggcttctgcaacctcaccacaccagagccagcagtctacggtggatgtaggtcagctgcacgaccctcaaccttacccccaacacgccatccaagtgcagcacatacaggttagcgaaccgacagcctctgcaccttcttctgcgcaggtgtcaggccagcccctcagccctagtgctcagcaagctcagcaggggctgtctcctagtcacattcaagggagttcgagcacacaggggcaggctctgcaacagcagcaacagcagcagcagaacagctcggtccagcatacatatctgccttctgcatggaattcgttcagaggctacagctctgagatccagatgatgaccctcccaccaggacagtttgtgattaccgattcaggtgtcgccactccggtcactacaggccaggtcaaggccgtgacaagtggccattacgtgctgagcgaatctcaaagcgagctggaggagaaacagacctctgctctctccgggggagtgcaagttgaaccacctgcccattcagattctcttgatccccagacaaactcccagcagcaaactacccagtatattattactaccaccaccaacggaaacgggagcagcgaagtgcatatcaccaaaccttag

SEQ ID NO: 58469 - DNA, 3186 bp, Artificial Sequence
  Description of Artificial Sequence: Synthetic coding sequence
atgagcgcatacagcgtcccctctacatttgcccaggccagcctgcccgttcacaaccaggtcttaccttctatcgagtctgtggatggttctgaccctttagcaactctgcagaccccactcgggagactggaggccaaggaggaagaggatgaagatgaggatgaggatacagaagaggacgaagaggaggatggcgaagacaccgacctcgacgactgggagcccgatccaccgaggccttttgacccgcatgacctatggtgtgaggaatgcaataacgcccacgcaagcgtgtgtcctaagcatggtcccttgcacccgatccctaaccgcccagtcctgaccagggctcgagcaagtctgcccttggttttatacatcgatcggttcctgggtggagttttcagcaaacgcagaatacctaagcggacccagtttggacccgtggagggaccactcgttcggggttcagagcttaaggattgttacatccacctgaaggtctccctggataagggcgatcgaaaggagagggatctgcacgaggatctctggttcgagttatcggacgagaccctctgcaactggatgatgttcgttcgaccagctcagaaccatttggagcaaaatcttgtcgcctatcagtatggccaccacgtctattacacaaccattaaaaacgtggaaccgaagcaggagttgaaggtctggtacgctgcatcctatgctgagtttgtgaatcagaagatccatgatattagtgaggaggaacgtaaggtcttgagagaacaggagaagaactggccctgttacgaatgcaatcgacgctttatctcctccgaacaactgcagcaacatcttaactcccacgacgagaagttggatgttttctcaaggacccgcggacggggtcgcggtcgcggaaaacgacggtttggacctgggaggcgtcccggaagaccgcctaagtttatcaggctcgaaatcacatctgagaatggagaaaagtccgacgacggaactcaggacctactgcacttcccgactaaagagcaattcgacgaggcagaacccgctactctgaatggactggatcaaccggagcagactacaatccctattccacaactgcctcaggagacacagagcagtctggagcatgaacctgaaacacacactttacatctgcagccgcagcatgaggaatcggtggttccaactcagtctactctgacagccgacgacatgaggagagcaaaaagaataaggctggagcttcagaatgccgcactgcagcacctttttattaggaagtccttccgccctttcaagtgcctccaatgtggtaaggcattcagggaaaaagacaaattggaccagcatctgaggttccatggacgggagggaaattgccctttgacctgcgacctgtgtaacaaggggttcatttcgagcacgtccctggagagtcacatgaagctccacagcgaccagaaaacgtattcctgcatcttctgtcccgaaagttttgacaggcttgatcttctgaaagaccacgtggctatccacattaatgacggatattttacttgtccgacctgcaaaaagaggtttcccgatttcatccaggtgaaaaaacacgtccggtcttttcacagtgagaagatctatcagtgtactgagtgcgacaaggctttctgtcggcctgataagcttagattgcacatgttacgccactcggataggaaagacttcctttgcagcacgtgtggtaaacagtttaaacgtaaggataaactgagggagcacatgcaacgaatgcataacccagagcgagaagccaagaaagccgatagaattagtcgttctaaaacctttaagcctagaattacgagcacggattacgattctttcacctttaagtgccgtctgtgcatgatgggctttcgcagacgcggaatgctagtcaaccatcttagcaaacgtcacccggatatgaagattgaggaggtgcctgagctgacattacctatcatcaaacccaacagggattatttttgccagtactgcgacaaagtctataaaagcgcttcaaagcgaaaggcccacattctcaagaatcacccaggcgctgaactacctccctccataaggaagctgcggccagctggccctggggagcccgatcccatgttgagtacccacactcaactgacgggaactattgcaacaccaccggtgtgctgcccacattgctcgaaacagtactcttctaagactaagatggtgcaacatatccgcaagaaacatcctgaattcgctcagctgtcaaacactatccatactcccctgaccactgccgtgatctcagccaccccggcagtgttgactaccgactccgctaccggtgagaccgtggtgacaactgatctcctaacacaggccatgaccgagctgtcccagacactgactaccgactatcgcacacctcagggcgactatcagagaatccagtatatccccgtgtcccagagtgcttctggcctgcagcagcctcagcatattcaacttcaggttgtccaggtggcctctgccacatctcctcaccagagtcagcaaagcacggtggacgtgggccagttacatgatccccaaccttacccccagcacgcaattcaggtccaacatatccaggtatccggccagcctttaagcccttctgcccagcaagcgcagcaagggctgtcaccatcacacattcagggcagctccagcacccagggccaggccctgcagcagcagcagcagcagcagcagaactcaagcgtgcagcatacttacctgcccagcgcatggaactcctttagggggtactcatcagaaatccaaatgatgacgctcccccctggtcaattcgtcatcactgattctggcgtcgccactccggtaacaaccggtcaagtaaaggccgtgacctcaggacattacgtgctgtctgagtcacaatcagagctcgaggagaaacagacgtctgcactttccggaggagtacaggtcgaaccgcctgcacactcagattcactagatcctcagaccaactcccagcagcagactactcagtatattatcacaaccaccaccaacggaaacggaagctctgaggttcacattaccaaaccttag

SEQ ID NO: 58470 - DNA, 3225 bp, Artificial Sequence
  Description of Artificial Sequence: Synthetic coding sequence
atgtctgcctacagcgttcccagcactttcgcccaggctagcctgcccgttcacaatcaggtgctcccaagtatcgagtcagtagacgggtctgaccccttggccacgttgcagactcccctcggacgtcttgaagccaaagaagaagaggatgaggatgaggacgaagacaccgaagaagatgaagaggaggatggcgaagacacagatctcgatgattgggagcctgatccccctcgaccttttgaccctcacgatctctggtgtgaggagtgcaataacgcccatgcatccgtgtgtcccaagcacggcccattgcaccctattccaaacagaccggttctgacacgagcgagagcctctctgcctctagtgctgtatattgaccgatttcttggaggagtgttctctaaacggaggatccccaagaggacacagtttgggcctgtggaaggcccattagttcggggaagcgagctgaaggattgctatattcacctgaaggttagcctcgacaaaggcgatcgtaaggagagggacttgcatgaagacctgtggttcgagttgagtgatgagacactctgtaattggatgatgttcgtccgccctgcgcagaaccaccttgagcagaacctcgtggcctatcagtacggtcatcacgtttattacaccaccatcaaaaatgtggaacccaaacaggagctgaaggtttggtatgccgcatcttacgcagaattcgttaatcagaagatccacgacatctccgaggaagagaggaaggttctcagggagcaggaaaaaaactggccctgctacgagtgcaaccgcagatttatttccagtgagcagctccagcagcacctcaacagccacgacgagaagcttgacgtctttagtcggaccagaggaaggggaaggggcaggggaaagcggaggtttggtcccggtcgacgacctggtcgccctcccaagttcattaggctcgagatcacaagtgaaaatggagaaaaaagcgatgatgggacccaggatctgttgcacttccccaccaaggagcaatttgacgaggctgagcctgccacactgaacgggttggatcagcctgagcaaaccacaatacccatccctcagctcccacaggagacccagagctcactggaacatgaaccagagactcacacccttcatcttcagccccagcacgaagagtccgtggtccccactcaatctaccctgactgccgatgacatgcggcgagcaaagagaatccggttggaactgcagaacgctgcgctgcagcatctttttatccgtaagtcgttccggcctttcaagtgcttacagtgcggcaaagccttcagggaaaaggacaagttggaccagcatcttcgctttcacgggagggaaggcaactgccctctaacttgcgacctgtgcaacaagggattcataagcagtacctccctcgaatcacatatgaagttgcactcagatcaaaagacgtattcctgtattttctgccctgaatcatttgaccgcctcgacctgctgaaagaccacgtcgccatccatattaatgatggatattttacctgtcctacatgtaaaaagcgatttcctgattttattcaggttaagaaacacgtgagatcctttcacagcgagaaaatctaccaatgcaccgagtgcgacaaggccttctgccgccctgataagcttaggttacacatgctgaggcactctgaccgcaaggactttctgtgctctacctgtggaaagcagttcaagcggaaagacaagcttagagagcacatgcagagaatgcataatccggagcgcgaggccaagaaggcagataggatatctcgctcaaagacttttaaacccagaatcacttctacggactacgattcgtttacttttaaatgtagactatgtatgatgggcttccggaggcgcggaatgctggttaatcacctgagtaagcggcatccagatatgaaaatagaggaagtacctgagctgacgctaccaattatcaaacccaatcgtgactacttttgccagtattgtgataaagtgtacaagtcagccagtaagaggaaagcgcacattctgaaaaaccatcccggagctgagctaccaccgtctatcagaaagctacggcctgctggtccgggtgaacccgaccctatgttaagcacacacacacagctgactggcacaattgctaccccacctgtgtgttgcccccactgttccaagcagtacagtagtaaaactaaaatggtccagcacataagaaagaaacacccagagttcgcccagctttcaaataccatccacacacctttgaccactgcggtcatcagtgccaccccggctgtactcaccaccgattcagccaccggggagactgtcgtcactacagatttgctgactcaggcaatgaccgagctaagtcagaccctgactaccgattatcgtactccacagggcgattaccagcgcattcagtatatacccgtgtcccaatctgcctccggcctgcaacagccacagcacatccagctgcaggttgttcaagttgctagcgctacaagcccccaccagagccagcagtccaccgtagatgtgggccagctccacgacccccagccttatcctcagcatgcgatccaggtccagcacatccaggtgtcagaacctacggcgtccgccccatcctcggcacaagtgtctggccagcccctctctccctccgcccagcaggcgcagcagggactgagtccttcccacattcagggcagcagcagcactcaaggtcaggctctccagcagcagcagcaacagcagcagaattcgagtgtgcaacacacctacctcccttcagcctggaacagcttccggggatattcaagcgagatccagatgatgacacttcccccaggccaattcgttatcactgactcaggagtggccacccctgtcacgaccggacaggtcaaggctgtaaccagtgggcattacgtgttgagtgagtctcaatctgagctggaggaaaagcagacaagcgccctcagcggaggagtgcaggttgagcccccagcccattccgacagccttgaccctcagaccaattctcaacagcagaccactcagtatatcattaccacaactacaaatggtaacggctcttcggaggtacacatcaccaagccatag

SEQ ID NO: 58471 - DNA, 1536 bp, Artificial Sequence
  Description of Artificial Sequence: Synthetic coding sequence
atgcttaaaatggccgaacccatcgcctcactgatgattgtcgagtgtagagcttgtctccgatgttctcccttgtttctgtaccaacgggaaaaggacaggatgaccgagaatatgaaggagtgtctcgctcaaacaaatgcggcagtcggggacatggtgaccgtggtcaaaaccgaggtgtgtagtcccttgcgcgaccaggaatatggccagccttgcagtcgcagacctgactccagcgctatggaggtagaaccgaaaaaactgaaaggaaagcgggacttgattgtgcctaagagcttccagcaggtggatttttggttctgtgagtcatgtcaggagtacttcgtggacgaatgccctaaccacggtccaccggtgttcgtctcagatacccctgtgccggtgggtattcccgatcgggcagctctgaccataccccagggcatggaagtcgtaaaggacacctccggggaatccgatgttcgctgtgtgaatgaagtaatcccaaagggtcatatcttcggcccttacgaaggtcagatatctacacaggacaagtccgccggtttctttagctggctcatcgtggataagaacaataggtacaagtcaattgacggctccgatgaaacaaaagccaactggatgcgatacgtggtgatttccagggaagagagagaacagaacttgctcgccttccagcacagtgaaaggatttattttagagcctgccgggacataaggccaggggagtggctccgggtctggtactctgaggactatatgaagcggctccacagcatgtctcaggagaccattcataggaacttagcacgaggtgaaaagcgccttcagagagagaaatcagagcaggtcctcgacaacccggaggatctgagaggtccgatacacctttccgtgctgcgccaaggcaaaagcccctacaagcgcggattcgacgagggcgacgtgcatccccaagccaagaagaagaaaatagatcttatatttaaggacgtcctggaagccagcctggagtctgctaaagttgaggctcaccagctggctctctctacctccctggtcatcagaaaagtgcctaagtaccaggacgatgcttatagccagtgcgcgacaacaatgacacacggagtgcagaatataggacagacccagggagaaggggactggaaagttccccaaggtgtatcaaaagaaccaggccagctcgaggatgaggaagaagaaccgagctccttcaaggcggattcccctgccgaagcatcacttgccagcgatccccatgagctgcctactacaagcttttgcccaaattgcatcagactgaaaaagaaggtcagagaactccaagccgagctagatatgcttaaatcaggtaaactacctgagcccccagttctccctccacaagtgctggagctccctgagttttcggatcccgcaggcaaactcgtctggatgagacttttatccgagggacgggtcaggtccgggctatgcggcggttag

SEQ ID NO: 58472 - DNA, 1536 bp, Artificial Sequence
  Description of Artificial Sequence: Synthetic coding sequence
atgctgaaaatggcagaacccatcgccagcctcatgatcgtagaatgtcgcgcttgcttgcgctgcagcccactctttttataccaaagagaaaaggacaggatgactgagaatatgaaggagtgcctggcacagacaaacgccgctgtgggcgatatggtaacagtcgtgaagacagaggtgtgttcaccactccgggaccaggagtatggccagccatgttcaagacggccagattccagcgccatggaagttgagccaaagaagctaaaagggaaaagggacctcatcgtacccaagtccttccagcaggtggacttttggttctgcgagagctgtcaggagtattttgttgatgaatgtccaaaccatgggcctcctgtgtttgtctctgacaccccagtccccgtgggcatcccggacagggccgctctgacaatcccgcagggaatggaagtggtgaaagacacctctggagaatccgatgtgcgatgtgtaaacgaagtgatccccaaaggccacatctttggaccttacgaaggtcagatttccacccaggacaagtccgccggtttcttctcctggttaattgtggacaagaacaatagatataagtcgatcgatgggagcgatgagacaaaagccaactggatgcggtacgtggtgattagccgggaagaacgggaacagaatttactggcgtttcagcacagcgagcgaatatattttcgcgcttgtcgggatataaggcccggtgagtggttgagggtctggtattctgaggactacatgaaacgtctgcacagcatgagtcaggagaccatccaccggaacctggctaggggtgagaagaggctgcagcgcgagaaatctgaacaggtccttgacaatcccgaagacctgcgaggtccaatacatttgtctgttttgcggcaggggaaaagtccttacaagcgcggatttgatgagggtgacgtccaccctcaggccaagaaaaagaagatcgacctgatcttcaaggatgtcctggaagcaagcctggagtccgcaaaggttgaagctcaccagctggctcttagtacctcactggtgattcgcaaagtgcctaagtatcaggatgatgcatactcccaatgtgcaaccactatgacccacggcgtccagaatatcgggcagacccagggtgaaggagattggaaagtgccacaaggggtgagtaaggagccagggcagttggaggatgaagaagaggagccttctagctttaaagcagactcgcccgctgaggcttccctcgctagcgacccacacgaattgcctactacttcattctgccctaattgtatccggctcaaaaaaaaggttagagagttgcaggccgaactcgacatgctgaaatccggaaaactaccagagcctcctgttttgccgcctcaggtacttgaattgccagagttttccgacccggctggcaagctcgtgtggatgagacttctgagcgaagggagggttaggtctggactctgtggtggatag

SEQ ID NO: 58473 - DNA, 1434 bp, Artificial Sequence
  Description of Artificial Sequence: Synthetic coding sequence
atgactgagaatatgaaggagtgcctggcacagacaaatgctgccgtgggagacatggtgacagtggtgaaaacagaggtctgctcacctctgcgggaccaggagtatgggcagccttgttccaggagaccagattcctctgccatggaagtcgagccaaagaagttaaaaggcaagcgcgacctgatcgtgcctaaaagctttcagcaggtcgatttctggttttgtgaaagttgccaggagtatttcgtggatgagtgtccgaatcacggcccaccagtcttcgtgtcggacacccctgtccccgtaggcatccccgacagagctgctctcaccattcctcaaggtatggaggtagttaaagatacttctggggagtcagacgttaggtgcgtaaacgaagtgattcctaaaggacacatcttcggcccatacgagggccagatctctacccaggataagagcgctggttttttctcctggcttatagtggacaagaataatcgttacaaaagcattgatggatctgatgagacaaaggcaaattggatgcggtacgtagttatttcacgggaagaaagagaacaaaatcttctggcatttcagcattcagagagaatctatttccgtgcttgccgcgatataaggcccggagagtggttgcgcgtgtggtactccgaggactacatgaaacgactgcacagtatgagtcaggagaccattcaccgcaatctcgcccgtggcgaaaaacggctccaacgcgagaagagtgaacaagtactggataatcctgaagacctacgagggcctatccatctatcagttttacgtcaagggaagtccccctataaaagaggtttcgacgagggagacgttcatccccaggccaaaaaaaaaaagattgacctgatattcaaggatgtcttggaggcctcgttggaatcggcaaaggtagaagcccatcagttggcactcagcacatcattggtgatacgcaaggtgcccaaataccaggacgacgcctattcccagtgtgccaccaccatgacacacggcgtgcagaacatcggtcagacacagggagaaggcgattggaaggtgcctcagggggtctctaaagagcccggtcagctagaggacgaggaagaagaaccttcttcctttaaagcagacagtccagcagaagcaagtttggcctccgatccccatgagctcccaacgacttccttctgtccaaactgcatccggctcaagaaaaaagtacgggaactgcaggctgaactggacatgctcaaatcggggaaactcccagagcccccagtgctgcccccacaggtgttggaactccctgagttctcggaccctgccggaaagctggtctggatgaggctgctctccgagggtcgcgtccgcagtggattgtgcggcggttag

SEQ ID NO: 58474 - DNA, 1425 bp, Artificial Sequence
  Description of Artificial Sequence: Synthetic coding sequence
atgtccatacaggcccctccacgtcttctggaactcgcaggtcagtccctgttgcgggatcaggctctctccatctccgcaatggaggaattacccagggtgttatacctgccgcttttcatggaggcattcagccgacgtcacttccaaacactcacagtaatggtgcaggcatggccctttacatgcttacctcttggcagccttatgaagaccttgcacctagaaactttaaaagcactgctggagggccttcacatgctcctgactcagaaagatcggcctcgaaggtggaagctccaggtcctggacttgcgcgatgtagatgaaaatttttgggcacggtggcctggggcatgggcgttgagttgctttcctgagacaacgtccaagcggcaaacagccgaggactgccctagaatgggagagcatcagcccttaaaagtcttcatcgatatctgtttgaaggaaatcccccaggacgagtgtcttcgatacttatttcagtgggtctatcagcggagggggcttgtgcacctgtgttgctcaaagttggtcaactacctgactccgataaagtacctgcgaaaatccctcaaaatcatatacctgaattcaatacaggaactcgagatccggaatatgtcttggccccgactcataaggaagctgcgatgctacctgaaggaaatgaagaatctccgtaaactggtgtttagtcgctgccaccattatacaagtgataacgagttgcagggccgattggtcgccaaattcagctccgtgttcctcaggctggaacatctgcagttgctcaaaatcaaattgatcaccttttttagcggacatctggaacagctgatccgctgcctccagaatccactcgagaatctagagctgacatacggctacctattggaagaagacatgaaatgcctgagccagtatccctccctggggtatctgaagcacttgaacctttcctacgtcttgctgttcaggatatcccttgagcctctcggagcactgttagaaaagattgccgcatccctgaagactcttattttggaaggctgccagatccattacagtcagctttctgctattttgccagctctgagccggtgctcgcagctgactacattctacttcggacgcaactgcatgagcatcgacgctctaaaggacttgctccgccacacatccggactgagcaaactctcacttgaaacctaccctgcccctgaggaatccttgaattctctggtaagggtgaactgggagatttttacacccctgagagctgaactcatgtgtacgcttcgtgaagtcaggcaaccgaaacgtattttcatcgggccaaccccgtgcccatcttgtggcagttcaccctctgaggagctggaactccatctttgttgttag

SEQ ID NO: 58475 - DNA, 690 bp, Artificial Sequence
  Description of Artificial Sequence: Synthetic coding sequence
atgaagggtgggaaagcccaccaaacttgcccgttccacaaccgtacttcagtcctgaccggattagtaatcaccaacgacccagtgtcagattccctgttcgtgaaaggatgttttgagttgcaggagagatgtctacaaaatccactggagaacctcgaattgacctatggctatctcctcgaggaggacatgaagtgtttatctcagtacccatcgttggggtatctcaagcacctgaacctttcctacgtactgctgttccgcatttcccttgaaccacttggggcactgttggaaaaaattgccgcatccttgaaaacactaatcctggaaggctgccagattcactactcccagttaagcgccattctcccagcactgtcccgctgtagccagctcacgactttctatttcgggaggaactgcatgagcatcgacgcgttgaaagatcttcttcgccatacatctgggctgtcaaaactctccctcgagacttatcccgctccggaggagtctctgaatagcctggtgagggtcaattgggagatttttaccccccttcgtgccgagctgatgtgtactctgagagaggtgcgacagcctaaaaggatctttatcggccctaccccgtgccctagctgtggatccagtcccagcgaggaactggagctccacctctgctgttag

SEQ ID NO: 58476 - DNA, 1425 bp, Artificial Sequence
  Description of Artificial Sequence: Synthetic coding sequence
atgtctctgcaggccccatcccggctactggaacttgcgggacaatcgctcctccgcaatcagttcctcaccatcttcaccttggacgagttaccacgtgaagtctttccactgatgtttatggaagccttttcaatgagaagatttgaggctttgaagcttatggttcaggcctggccatttcttagcctccctctggggtctcttatgaaaactttacatctcgagaccctgcaagccgtcttgagaggcctggacaccctggtggcccagaaggtgcggccaagacggtggaagctgcaggtgctggatctgcgggatgtggacgaaaacttttggaccatctggagcggggctagggtgttgtcttgctcccccgaagcaatgagcaaaagacagaccgtcgaggactgtccgagaatgggagaacaccagcccctgaaagtgtttatcgatctttgcttgaaagaatctactcttgatgagtgcttgtcatacctcttcggatggattcactaccgtagaggactcgttcacctctgttgctccaaagtgcagaactacagtatgcccacaagctcttttcggaacctgctcgagcgcatctatcccgacagcattcaggaattggaggtgtggaagaagtgttctctgaacaagacaggaaaatttgcaccctatctatcccaaatgagtaatcttagagagctcttcctcgcttttggatacgaacgcgagctgtacgtctccgtgcagtggccctgtatccctgacctggattccccatttctgtgcctttactatccccagatgctgtacattaagaagatttcaaacatcaaggaacatctggaacatttgctgaggtacttgaaaaatccacttggcgcattcattttttccgatgcttatctgactgatcgggatatggaatgtttatcacagtatccctcgctgagtcagcttaaggagctccggttgatccacattttgatgtggaccacacacctagagccactcggcgtgcttctggaaaaagtagcagctacactgaagaccttagtgcttaaggattgcagaatccaagatcctcagcttcgcgttctcctgcccgcactcagccactgcagtcagctgacgactttcaactttcatggcaacgaaacgtccatgaacgcacttaaagatctgctgcggcatacaggaggtttaagcaagctcgggttagagttgtacccagctcccctcgagtctttggattacaaaggacacgtgaattgggaaatactgaccccaatacgggctgaactcatgcgcacactgcgcgaagttcgccaacccaagcggatttttttcggaccagtgccatgtccaaattgcgggtcttggcccagcgaaaaggtagacttccacttgtgtagttag

SEQ ID NO: 58477 - DNA, 1434 bp, Artificial Sequence
  Description of Artificial Sequence: Synthetic coding sequence
atgaagatgtcaatcaggattcctccacggctgctcgaactcgggcgatccctgttacgggaccaggcactggcggtgtccaccctggaggaactgcctacggagctgtttcctcccttgtttatggaggccttttcaagacgcaggtgtgaagccttgaagttgatggtacaggcctggccattccgcagactcccactgcgaccattaatcaaaatgccctgcctggaggcttttcaagccgtgcttgacggactcgacgctctcttaactcagggcgtacgtcctcgtcggtggaaactccaggtgttagaccttcaagacgtgtgtgaaaatttctggatggtttggtccgaggccatggctcacggctgctttctcaatgctaagagaaataagaccccagtgcaggactgtcctcggatgcgggagaggcagccacttacggtgttcgtggagttatggctaaaaaataggacgttggacgaatatcttacctgtctcttactgtgggtaaagcagagaagagaccttctgcatctgtgctgtaaaaagcttaaaattctgggcatgccttttagaaatattagatccatcctcaaaatggttaacctggattgcatccaggaggtcgaggtaaattgtaaatggatccttcctattttgacccagtttaccccatatcttggacatttaaggaacctgcaaaaactagttctctcacacatggatgtgagcagatatgttagccctgagcagaagaaagaaatagtaacacaatttacaacacaattccttaagctgaggtgtctgcagaaactttatatgaacagcgtgtctttcctcgaaggtcaccttgaccaactgctctcgtgcttgaagacctcacttaaggtactgacaatcacaaactgcgtgctgttggagtccgacctaaagcatctttctcaatgtccctccatctcacaactcaaaactctggacctcagcgggattcgcctgacaaactactccctggtacctctgcagatcctgctggagaaagtcgcagctacgctcgagtacctggacctagacgactgtggaattattgacagccaggtgaacgcaattctgcccgcacttagcagatgctttgagctgaataccttttctttctgcggtaatccaatttgcatggctacccttgaaaacctgttaagtcacaccattatactgaagaatttatgcctggaactgtatccagccccacaggagtcctatggtgccgatgggaccctctgctggtcccggttcgctcagattagagcggagctgatgaaaaaagtacgccacctccgccaccccaagcgcatcctcttctgtaccgataactgcccagaccatggagatcgatccttctatgatctagaagcagatcaatactgctgctag

SEQ ID NO: 58478 - DNA, 1308 bp, Artificial Sequence
  Description of Artificial Sequence: Synthetic coding sequence
atggaggcgttttccagacgacggtgcgaagcgctaaagctgatggtccaagcatggcccttccggaggttgccgctgcggccattaattaagatgccctgtctggaggcctttcaggccgtcctcgacggcctggacgcacttctgacgcagggggttcgccctcggaggtggaaactccaggtcttggacttacaggacgtctgtgagaatttctggatggtgtggtctgaagccatggcacatgggtgctttctgaatgcaaaaaggaacaagactccagtgcaagattgccccagaatgagggaacgccagcctctgaccgtattcgtcgagctgtggctgaaaaaccgtacccttgacgaatacttgacttgtcttctcctgtgggtgaaacagcgcagagacctcctccatctttgttgcaagaagctgaagatcttagggatgccatttaggaacattcgctctattttgaaaatggtgaatctggattgtattcaggaggtcgaagtgaactgcaaatggattctccccatcttgacccagtttacaccttacctggggcacctgagaaacctgcagaaactggtgctaagtcatatggacgtcagcaggtacgtctccccagagcagaagaaggagatcgtcacacagttcaccacccagttcctcaagttgcggtgcctccagaagttgtatatgaattcagtgtctttcctggaaggacacttggaccagctcctctcctgtctgaagacatccctaaaagtccttacgatcacaaactgcgtccttctcgagtccgacttaaagcacctttcccaatgtccatcaatctcccagcttaagaccctggatctgtctggcattagattaaccaactattccttggttcccctgcaaatcctgctggagaaagtcgcagctactctggagtaccttgacttggatgattgtggtattattgattcccaggtcaatgccatcctcccagccctctcacgttgtttcgaactgaataccttttccttctgtggtaatccgatctgtatggctactcttgagaatctgctgtcccacacgatcatactcaagaacctgtgcctggagctatatcccgctccacaggaatcttatggagctgacggaaccctctgctggtccagattcgcacagattcgggcagagctgatgaagaaggtgcggcacctgaggcaccctaaaagaatcctcttctgcacggataactgccctgaccacggagacagaagcttctacgacctagaggcagaccagtattgctag

SEQ ID NO: 58479 - DNA, 1311 bp, Artificial Sequence
  Description of Artificial Sequence: Synthetic coding sequence
atggaagccttcagccgacggagatgcgaggcgctaaagctgatggtgcaggcatggccgtttcgacgcttgccgctgcgtccactcataaaaatgccttgccttgaggcatttcaggctgtgcttgacggcttggacgcactccttacccagggcgtacggcctcgtcgctggaagctgcaagtgctcgatctacaggacgtgtgcgagaacttttggatggtgtggtcggaagctatggcacacgggtgctttctcaacgccaagcgtaataaaacaccagtgcaggattgtcccaggatgagggaacgtcagccgctgactgttttcgtcgaactatggcttaagaataggacactggatgagtacctcacatgtttgttgctttgggtgaagcagaggagagaccttctgcatttatgctgcaaaaaactgaagattttaggcatgccattccgtaacatccggtcaatcctgaagatggtaaacctcgattgtatccaggaggtcgaagtgaattgtaaatggatcctgcccatactgacacagtttactccatatcttggccacctgcgcaatttgcagaagctggtgctcagtcacatggatgtcagtagatatgttagtccagagcagaaaaaggagatcgtgactcagttcacaacacagtttttaaagctgcggtgcctgcaaaagctgtatatgaatagtgtcagttttctggaaggccacctagatcagctgctctcgtgcctgaagacctccctgaaggttctgactatcactaactgtgttctgctggagagtgatctgaaacacctgtcccagtgtccctccatttcacagctcaagaccttggatctcagcgggatacggcttacgaattactctcttgtccctctccagatcttgctggagaaggttgccgctactcttgaatacctggatctcgatgactgcggaattatcgacagccaggtgaacgcgatcctaccagctttaagtaggtgcttcgaactgaatacattttctttctgtggcaaccccatttgcatggcgaccttggagaatctcctatctcacaccatcatactaaagaacttatgcttggagttgtaccccgctccgcaggaaagttatggcgctgatggcaccctctgttggtcccgattcgcacaaatcagggccgaactcatgaaaaaggtccgccatttaaggcaccctaagcgtattctcttttgtacggacaactgtccagaccatggagatcggagtttctacgacctcgaggccgaccagtattgttgctag

SEQ ID NO: 58480 - DNA, 1452 bp, Artificial Sequence
  Description of Artificial Sequence: Synthetic coding sequence
atgtctctccaggccccacctcgcctgctagaactggccgaacagtctctgcttcgagacagagcactggccatccccacgctagaagaactgccacgggagctattcccgcctctcttcatggaagccttcacacgtaggtgttgtgagaccctcacaacaatggtacaagcctggccatttacctgtctgccacttggatccctaatgaaatcatgcaatctggagatcttccgcgcagtgctggaaggactggacgcattgctggcccagaaggtgcgccctcgaagatggaaattgcaggtgctggacctcaggaatgtggacgaaaacttttggggcatatggagtggggctagcgcactctcaccggaggccttgtccaagcgcaggaccgccggtaattgcccgaggccgggaggtcaacagccactgatggtgatcttggatttgtgtttcaaaaatggtatgctggacgaatgcctcacacattttctggagtggggaaaacagagaaaagggctgctgcacgtgtgctgcaaagaacttcaaatctttgggatcgctatccatcggatcatcgaggtcctgaataccgtcgagctagattgcatccaggaagtggaggtctgctgtccctgggaactaagcatccttatacgattcgctccttatctcggacagatgcgcaaccttcggaaactcgtgctcttcaacattcatgtaagcgcgtgtattccactcgatcggaaggaacaatttgtgatccagtttacttcccaattcctgaaactcgattacttccagaaactgtacatgcactccgtctcattccttgaaggtcacctggaccagctgctgagatgcttgcaagctccccttgaaacagtggtgatgactgagtgcctgctaagcgagtccgacctaaaacatctgagctggtgtccgtctattagacagctgaaagaacttgatctgcggggtattaccttaacccacttttctccagaaccattaagtgtgttactggaacaggcggaggctacactgcaaaccctcgacctcgaggactgtggaatcgtagactcacagctcagtgccatcctgcctgctctatcaaggtgttcacaactgtcgacattctcattctgtggcaacttaatttctatggctgccctcgaaaacctcctgaggcacaccgtgggcctatcaaagctgtcgctggaactctaccccgcacccctggaatcatatgacgcgcaaggagccctgtgctggggtagattttctcaattgggagctgagctgatgaaaactttgagggatctcagacagcccaagattattgtctttagcaccgtgccttgccccaggtgtggtattcgggctagttacgatctggagccctctcactgcttgctgaatgcgtgttgccagggaggctttatttag

SEQ ID NO: 58481 - DNA, 1425 bp, Artificial Sequence
  Description of Artificial Sequence: Synthetic coding sequence
atgtctatccaggctccaccacgtttactggagctcgccggacagtccctcttacgcgatcaggccctttcaatcagcgccatggaagagctaccacgggtgttgtatctgcccctgttcatggaggccttcaggcgcaggcattttcagactttgaccgtgatggtccaagcctggcctttcacttgtctccccttgggttctctgatgaagacgctgcatttggaaacgcttaaggccctgctggaggggctacacatgctcctcactcagaaagaccgaccgaggaggtggaaattacaggtgcttgacctgcgcgacgtggacgagaacttctgggcgaggtggcctggcgcttgggcactgagctgcttccccgagaccatgagcaaacggcagaccgcggaggattgtcccagaatgggcgagcaccagcccttgaaggtgtttatcgatatctgtctcaaagaaatccctcaggacgagtgcctgcgctatttattccaatgggtctatcagagaagaggcctcgttcacctctgctgctcgaagctggttaactatctgacgcccatcaagcatctgagaaagtccctgaaaattatttatctcaactcaatccaacaactggagatccgaaacatgagttggcctcgactgatcagaaagctgaggtgctacctgaaggagatgaaaaaccttcgaaagctggtgttttctagatgccaccactctatgtcagataatgagctagagggacgcctggtcaccaagttttcgtcagtctttctcaggctcgagcaccttcagcttctcaaaatcaagctcatcaccttcttcagcggacatctggaacagctgatcagatgtctgcagaaccccctggagaatctcgagcttacatatggctacctgctggaagaggacatgaaatgcctgagtcagtatcccagccttggatatttgaaacacctgaacctctcttatgtacttttatttcgcatttccctcgaacccctgggagcactcctggaaaaaatagccgcttcattggagactctgattcttgaaggttgccagatccactactcccagctaagtgccatcctccctgggctctcacactgcagtcagttaactaccttttacttcgggaggaactgtatgtctatgggggcactgaaagatctcttacgacacacatcaggactttctaagttgagcctcgaaacatatccagcccctgaggaatccctcaattcattagtacgagtcgactgggagatattcgccctcctccgagcagaacttatgtgcaccttaagggaggtgcggcagcctaaaaggatattcattgggccaactccctgtccttcttgcggcagctctcctagcgaagagctggagttgcacctctgctgttag

SEQ ID NO: 58482 - DNA, 1425 bp, Artificial Sequence
  Description of Artificial Sequence: Synthetic coding sequence
atgtcaatacaggccccaccaagactactggagctagcaggccagtcattgctgcgggaccaggcactctccatctccgcaatggaagagcttcctagagtgctttacctccctctcttcatggaggccttccgccgtcgacactttcagacattgactgtgatggtgcaggcatggcctttcacttgcttgcctctcggatcactgatgaagactctgcacctggaaaccttaaaggccctgctggaaggacttcatatgttgctgacgcaaaaggataggccacggagatggaagctacaggtgctcgaccttagggacgtggacgaaaatttttgggctaggtggcctggggcttgggccttgagttgcttcccagagaccatgagcaagaggcagactgcagaggactgtccaagaatgggcgaacatcagcccttaaaagttttcatcgacatctgtttaaaggaaattcctcaggatgagtgcttaagatatttgtttcagtgggtctaccaacgcagaggtctcgtgcatctgtgttgctccaaactagttaactacttaaccccaattaaacatcttcgtaaaagcctgaaaattatctacttgaattccatacagcaattggagattagaaacatgtcatggccacggctgataagaaagctgagatgttaccttaaagagatgaaaaacctgagaaagcttgtgttctcccgctgtcatcactccatgtctgataatgagttggaggggaggcttgttaccaagttttctagtgttttccttcggttggaacatttgcaactgctgaaaattaaactgataaccttcttctctggtcatttggagcagctcatccgctgcctgcagaatccattggagaatctcgagctgacatatggataccttcttgaagaagatatgaaatgcctgtcgcagtaccctagcctgggctacctgaagcacttgaacttatcatacgtcctgctgtttcgtatttctttagaaccactcggggctctgttagaaaagatcgcagcgtcgctggagaccttaatcctagaggggtgtcagatacactatagtcagctgagtgccattttgcctggcctgagccactgttctcagttgacaaccttttattttggcaggaattgtatgagtatgggagctctgaaagacctcctttgccatactagcggcctgagcaaactgtcgctggagacatacccagcccctgaagaaagcctgaatagtctcgtcagggttgactgggagatctttgctcttctcagggctgaactcatgtgtactctgcgcgaggtgcggcagccgaagagaattttcatcggccctaccccctgcccgtcctgcgggtcgagccccagcgaagagctggagctccatctttgctgttag

SEQ ID NO: 58483 - DNA, 1281 bp, Artificial Sequence
  Description of Artificial Sequence: Synthetic coding sequence
atgtctatccaggccccacccaggctgctggagctggccggtcagagcttgcttcgggatcaggctctttcaatttccgcgatggaggagctgcctagagtactctacttgcccctgtttatggaagccttccgcagaaggcactttcagacactgactgtgatggtccaggcctggcccttcacatgcttacctctgggcagcctgatgaaaaccctgcacttggaaactctaaaggccctgctggagggactgcacatgctgcttacacagaaagaccgacctcgtagatggaagctgcaggtgctcgaccttagggacgttgatgagaatttttgggcgagatggccgggagcctgggccttgagctgctttcctgagaccatgtcgaaacgccagaccgccgaggattgtcctcgcatgggtgagcatcagccactcaaggtttttattgatatatgtttgaaggagattcctcaggatgagtgtttaaggtacttatttcagtgggtgtaccaaagaaggggcctggtacacctgtgttgctctaagctggtgaactacctgacgcccataaagcacttgaggaaatccctcaagattatttacttgaattccatccaacagctcgaaattcgaaacatgagctggccacgattgattcgcaagctgaggtgctatctgaaggagatgaaaaaccttcgaaagctggtctttagccggtgtctgcaaaatcctctagagaatctggaattgacatatggatacctgttagaagaggacatgaaatgtctgtcgcagtacccttcgttaggatacctcaagcacctgaacctctcttatgtactgttgttccggatctccctggaaccattaggagcactgctagagaaaatcgcggcatctctggagaccctcatcctcgagggctgccagatccactatagtcagctgtccgccatccttccaggactgtcccattgctcccagctgactaccttttattttggcaggaattgcatgagcatgggcgcactgaaggacctgctttgtcatacgtctggcctctctaagctctctctcgagacatatccagcgcctgaggaaagtctcaactccctggttcgcgtagactgggagatattcgctttactcagggctgagctgatgtgtaccttgcgggaggtgcggcagcctaagaggattttcataggtcccacaccgtgccctagctgcggttccagtcccagtgaagagctggagctgcatctctgctgctag

SEQ ID NO: 58484 - DNA, 1437 bp, Artificial Sequence
  Description of Artificial Sequence: Synthetic coding sequence
atgaagatgtcgattcggaccccccctcgactgctggaactggctggcagatctctgctgagagatcaggccctggccatgtcgaccctggaggaactgcctaccgagctgtttcccccactgttcatggaggcattctccaggcggcgatgcgaagccctgaaattaatggttcaggcctggccgtttagacgcctccctctgcggcctcttattaagatgccgtgcttagaggcgttccaggcagtgctggatggcttggacgctttgttgactcagggtgtccgccctcgcagatggaagctccaggttctcgatttacaggatgtgtgtgagaacttttggatggtgtggagtgaggccatggctcatggttgcttcttgaacgctaagcggaacaagaaaccagtccaggactgtccacggatgagggggagacagcccctaacagtgttcgtggaactgtggctgaagaaccggactctggacgaatacctcacctacctgcttctctgggtgaagcagcggaaggatttactgcacctatgctgtaagaagctgaaaatccttgggatgccctttcgcaatatacgctccatcctgaaaatggtgaatctcgattgcatccaagaggtcgaggtaaactgcaagtgggtgttaccaatactaacacagtttacgccatacctcggccatatgcgaaatctccagaaactggtactgtcccacatggatgtcagcagatatgtgtctccagagcaaaaaaaggaaattgtgactcagttcactacccaattcctgaaattgcggtgtctccaaaagttatacatgaatagcgtctctttcctggaaggacatctcgaccaactgctgtcatgtttgaaaacttcgctcaaggtcctgacaattaccaattgcgtcctcctggaaagtgacctgaaacatttgtctcaatgtccatctatctcccagttgaagacactggatctgtcaggcatccgcttaactaactatagtcttgtgccattacagatcctcttggaaaaggtggctgcgactcttgagtatttggatctcgatgattgtggcatcattgattctcaggtgaacgcgattctgcccgcactgtcgagatgtttcgagctaaacactttctccttttgcgggaatccaatctgcatggccactctggaaaatctgctgagccatactattattctgaaaaatttatgcgtggaattatacccggcaccccgtgagtcatatggtgctgacggcaccttatgttggagtcgttttgctcagatccgagctgagctcatgaacagggtgcgggacttacggcatccgaagcggattctattctgtactgattattgcccggattgtggaaacaggtctttctatgacctggaggcagaccagtattgctgttag

SEQ ID NO: 58485 - DNA, 1437 bp, Artificial Sequence
  Description of Artificial Sequence: Synthetic coding sequence
atgaaaatgagcatcagaacaccgcctagactactggagttagccggtagatctctgctgagagaccaggccctggcaatgagcacactagaggaacttcccacggagctgttccccccactgttcatggaggcattcagccggcgtcggtgcgaggctctgaagctgatggtgcaggcctggccatttcgcaggctgcccttaaggcccctgattaaaatgccctgtctcgaagcgttccaggctgtgctggacggtttggacgctttgctcacacagggcgtgaggcctagaagatggaaattacaggtgttagacttgcaggatgtctgtgagaacttctggatggtatggtccgaggcaatggctcacggttgcttcctaaacgctaagcggaacaaaaagcctgtgcaggactgccctagaatgcgcggaaggcagcctcttacggtttttgtggagttgtggctcaagaatagaacactcgacgagtaccttacttatttgttgctgtgggtcaagcagagaaaggacttgcttcatctgtgttgcaagaaactaaagatactagggatgcccttccggaatattaggtccatactgaagatggtgaatctggactgcattcaagaagtggaggtgaattgcaaatgggttttgcccatcctcactcaattcacaccctatttagggcacatgcggaatttgcagaagctggtgctgtctcatatggatgtttcgcgatatgtctccccggagcagaaaaaagaaattgtcacccaatttaccactcagtttctaaaacttagatgtctgcagaagctttatatgaattctgtcagtttccttgagggccatctcgatcagctgcttagttgtctgaaaacatctctgaaggttctcaccatcaccaattgtgtgctcctggagtctgacttgaaacacctgagtcagtgtccgtccatcagccagctcaagacactggacctgagcgggattagactgactaactactctctcgtccccttacagatactcctcgaaaaggtagcagccaccctggaatatctcgacctggatgactgtggcatcatcgactcccaggtcaatgctatactgccagctctgtcccgctgctttgaactgaataccttctctttttgcggtaaccctatttgcatggccaccctcgagaacctcctgtcacacaccatcatactgaaaaacctgtgcgtggagctgtaccctgccccacgtgagtcctatggggctgatggtaccttgtgttggagtcgctttgcccagatccgggcagagctgatgaatagagtgagagacctccgacacccaaaacggatcctcttctgcacagactattgcccagactgcggcaacagaagtttctacgacctcgaagctgaccaatactgttgctag

SEQ ID NO: 58486 - DNA, 1425 bp, Artificial Sequence
  Description of Artificial Sequence: Synthetic coding sequence
atgtccttgcaatctccctcaaggctgctagagctcgcgggacagtcgcttttacggaatcagttcctcactatttttatcctggatgaactacccagggaagtattccccctgatgttcatggaggcctctagtatgagacacttcgaagctttgaaattgatggtacaggcatggccttttttacggttgccgttgggaagtctgatgaagacaccgcaccttgagacccttcaagctgtgctgaagggcctggacaccttactggcacagaaactgcggcctcggagatggaagctgcaggtgctcgatcttagagatgtcgatggcaacttctggaccatatggtctggagcaagagccttgagttgttctccggaggcaatgagaaagcggcagacagtcgaagactatcccaggactggcgagcatcaacccttgaaggtgtttatcgatctttgtcagaaagagtcaaccttagacgagtgccttagctatctgtgccggtggatacattatcgcagaggactagttcacttgtgttgcaataaagtacaaaattattctatgccaacctcttcattccgtaacctcttaaagagggtgtaccccgattctatccaggagttagaaattaaacggaaatgctccctgaacaaaacaggaaaatttgcaccttacctgtcccagatgtccaatctgagaaaactgttcctggcctttgggtacgatgatgaactgtatgtctccggtcagcagcagttcgtgcctgacctggattgtccttttctttgtctgtactatccacagatgctgtacattcgcaaaatcagtaacataaaggagcatctggagcacctcctgagatgtttgaaaaatcccctaggcacattcatcttttgccacgcctatcttgccgaccaggatatggaatgtctaagccagtatcctagcctctcccagctgaaggagctccacttgattcacatcttgatgtggacaaccaatctcgaacccctgggggcattgctggaaaaggtggctgcgaccttagaaatcttaacacttaaggattgccagatccaggactcccagctgagggtcctcctaccagcattgagcaggtgtagtcaacttacaacattttactttagggggaacgagacctcaacaaacgccctgaaagacctgctctgtcacactggagggctcagtaagctggggctggagctctatcccgctccccttgagtgtctggataacagaggccatgttaattgggagatcctggcacctatcagagccgagcttatgtgcacactgcgggaggttaggcaacccaaacgaattttttttggacctattccgtgcccctcatgtgggtcttggcccagtgagaaagtcgactttcacctttgcagctag

SEQ ID NO: 58487 - DNA, 1425 bp, Artificial Sequence
  Description of Artificial Sequence: Synthetic coding sequence
atgagcctccagtcgccatcgcggctgctggagttggctggccagagtttactgaggaaccaatttcttacaattttcatcctggacgagttgccaagggaagtatttcctctgatgttcatggaggccagcagcatgaggcatttcgaggctctgaagctcatggtccaggcttggccattccttcggctgccactgggctcactaatgaagacacctcacctcgagacattgcaggcggtgctgaagggtctggatactttacttgctcagaaactgagaccgaggcgatggaagttgcaagtattagacttacgggacgtggatggcaatttttggaccatctggtcaggggctcgtgcgctgtcatgcagtcccgaagcaatgtctaaaagacaaaccgtggaagactatccaagaaccggtgagcaccagccactcaaagtgttcattgacctgtgtcagaaggagagcacattggatgagtgcctgtcgtacctctgcaggtggatccactacagaaggggcctagtgcatctgtgttgtaacaaggtccagaattattcaatgcctacttccagctttcgaaatttactgaagcgggtatatccagactcgatacaggagctggaaattaaaaggaagtgttcccttaacaaaacgggcaagttcgcaccctatctgtcacaaatgagcaatctgcggaaactgtttctggcttttgggtacgatgacgagctgtacgtgagcgggcagcagcagttcgtacctgatttagattgccctttcctgtgtctgtattatcctcaaatgttgtacattcggaagataagtaacataaaagaacacctcgaacacctacttcgctgcttaaagaaccctctgggtaccttcatcttttgtcacgcctatttagcagaccaggacatggagtgtctatctcagtacccctccctctctcagctgaaggagctgcatctgatccatatccttatgtggactactaatctggaaccgctcggcgctttactggagaaggttgcagccaccctggaaatcttgacattgaaggattgtcagatacaagactcacaactgcgcgttttgttgccggcactgtccagatgtagtcagttaactacattttacttcagaggcaacgagactagcaccaacgccctgaaggacttgctttgccacactggtggcctctcaaagctcggactggagctctaccccgctccgctggagtgcttggataatcggggacacgtcaactgggagatattggccccaattcgcgcagagctcatgtgtaccctccgtgaggtgaggcagcctaagagaatcttttttggtccaatcccgtgtcccagctgcggtagttggccgtcagagaaggttgatttccatctgtgtagctag

SEQ ID NO: 58488 - DNA, 1440 bp, Artificial Sequence
  Description of Artificial Sequence: Synthetic coding sequence
atgtcctttcaggcccctcgcagattactcgaactggcaggacagtcccttctgagggaccaggcccttgctatcagcgtcctggacgagctgcctcgggaattatttccgaggttatttgttgaagcttttaccagcaggcgatgtgaagtccttaaggttatggttcaggcttggcccttcccctgcctgccacttggctcgctcatgaagacacccgatcttgaaatcctgcactacgtggtggacggaatcgactgtctgttggcgcagaaggtgagaccgagacgatggaaactgcaggtcctggaaatgagagacgtcgacgagaatttttggactatctggagcggggctcgccctctttcatgtagcccagaggctatgagcaagcggcagactgtggaggattgtcctaggaccggagagaagcagcccttgaaggtctttatggatgtatgcctgaaagaaaagagcgtcgacgaggatttaagcttcttctccgggtgggtccagcacaggagacgttctgtgcacctctgctgcactaaggtcgtgaattattcaatgaacatcttgaatttccggaacatactggagaccgtctatcccgatagcattcaggtgctagagatatggaatatgtgctggccgtgtatggtagccgaagtgtccagatacctgtcccagatgaaaaaccttcggaagctcttcatatccgacgggtgtggatacttgccatctttcgagagccaaggccaactagttgcagagttctcatctgtttttctgaggctggaatatctccagatgctgtatatgaggcggatacggttcttcgaggggtacttggatcagctgattcgctgcctgaaaagtccccttgaaaccctcgcactcacatacggctcactggacgaagaagatttgaagtgcttgccatggtacccctccttgagtcagttgaagcagctaaacctttcacatgggactttaaggtttatccggttagagccactcagagcactgttagagaaggtggccgcaactctgcaaaccttatttctggtcgactgtgggatcggagactctaaactgcgggtcattctgcccgcactctctcgctgttcgaatttaaccacattttgttttcatgggaatgatacttcaatggatgggttgaaggacctgttgaggcacaccgggagactgtcaaatctaagcttagaaacttatcctgctcctagagagagcctcgataatcgtggcagagtgatttctgagttactgactccgctacaggctgagctgatgcggatcctaagggaagtccgggagcccaacagaatcttttttgggccagtctcctgcccatgttgtgggatgagtccgacagagcagctggagttcaacttttgtctcagaggccgtcctgcctag

SEQ ID NO: 58489 - DNA, 1233 bp, Artificial Sequence
  Description of Artificial Sequence: Synthetic coding sequence
atgaaaaccccagacctcgagatcttacactacgtggtggacggcatagattgtctcctcgcccagaaagtccgcccaagacggtggaaactgcaggtgctcgagatgcgcgacgtcgatgaaaacttttggaccatctggtccggcgctcgacctctctcctgttcccccgaggccatgagcaagcggcagaccgtggaggattgccctcgtacaggagagaaacagcctctcaaagtgtttatggacgtttgccttaaggagaaaagcgtcgatgaggatctctcctttttttccggatgggtacaacaccgcagaaggagcgtacatctctgctgcaccaaggtcgttaactatagcatgaatattctgaattttcgaaatattttggaaactgtctaccctgactccatacaagttctggagatttggaacatgtgttggccttgcatggtggctgaggtatctcgctacttgagtcagatgaaaaatctgaggaaactctttatcagcgatgggtgtgggtatctcccctctttcgagtcccagggccagctcgtggcggagttctccagcgtgttcttaaggctggagtatctgcagatgctctacatgcgacgtattcggttcttcgaagggtatcttgaccagctgatacggtgtcttaaatcacctctagagactctggctcttacctatgggtccttagacgaagaggacctgaagtgcctgccctggtacccatcactgagtcagcttaaacagctcaatctgagccacggtacacttcgtttcatcaggctagagccactgagagcccttctggaaaaggtcgcggcaacactgcagacactgttcctggtcgactgtggcattggatacagtaaactacgggtaatattgccagcactcagcaggtgtagtaatctgacgacattctgttttcatgggaacgacacctctatggacgggctgaaggatttgttgcgccataccgggaggctcagcaatctttcactggagacgtatccagccccaagagaatctttagataaccgtggccgagtgatttctgaactgctcacaccattacaggccgaacttatgcggatcctgcgggaagtccgggaaccaaatagaatatttttcggccctgtatcctgcccctgctgtggcatgagccccacagagcagctggagttcaacttctgtctgcggggtcgtccagcttag

SEQ ID NO: 58490 - DNA, 1440 bp, Artificial Sequence
  Description of Artificial Sequence: Synthetic coding sequence
atgtccttccaggcgcctcgcaggttgctggagctagccggacaaagcctgctacgtgaccaggctttggcaatctctgtgctcgatgaattaccccgagaattgtttcctaggttatttgttgaggccttcactagtcgcaggtgcgaagtgttgaaagtgatggttcaagcatggccatttccatgtctgccccttggttcgctcatgaagactcctgacctcgagattttgcactacgtggtggatgggatagactgcctgttagcacagaaggtgcggcctaggagatggaagctgcaggtgttagagatgcgtgacgtcgacgagaatttctggaccatctggtcaggtgccaggcctttgagctgctccccagaggctatgtcaaagcgtcagacagtggaagactgtccgaggactggagaaaagcaaccgttaaaagtgtttatggacgtatgtctcaaagaaaagagcgttgatgaagacttatctttttttagtgggtgggtgcagcaccgtagaaggtccgtgcatctttgttgtaccaaggtggttaactactcgatgaacattctcaacttcaggaacattcttgagacagtgtaccccgacagcattcaggtcctcgagatatggaatatgtgctggccttgcatggttgccgaggtcagccggtacctcagccaaatgaagaacctgagaaagctgtttatttctgatggctgtgggtacctgccctcctttgaaagtcagggccaactagtcgctgagttcagctctgtatttctccgactcgagtacctgcagatgctgtacatgaggcggatccgcttttttgagggttatcttgaccagctcatcaggtgcctgaaatctcctctggagacgctcgccctgacttatggcagcctggatgaggaggacctaaagtgcctgccctggtacccaagccttagtcagcttaagcaactgaatctctcgcacggaaccctgagatttattaggctcgagcccttaagagccctattagaaaaagtggccgctacgctccagaccctctttctggtcgactgtgggatcggatattccaagctgcgcgttatccttcctgcactgagtaggtgcagtaatctgaccaccttttgctttcatggcaatgatacttcaatggacggactaaaggatttgctgaggcatactggtagacttagcaatctgagtctcgaaacgtaccccgctcctcgcgaatccctggacaatcggggacgtgtaatcagtgaactgctgacacccctccaggcagagctgatgaggattcttagagaagtcagggagcctaaccgcatttttttcggtcccgtgtcgtgtccatgctgcggtatgagccccaccgagcaattagaattcaatttctgtttgcgtggacgccctgcttag

SEQ ID NO: 58491 - DNA, 1425 bp, Artificial Sequence
  Description of Artificial Sequence: Synthetic coding sequence
atgtctatccaggcaccccctagacttctggagctggctggccagagcctgctacgggaccaagcactgtctatatctgcaatggaggagttaccacgagtcttgtatttgcccctttttagggaggccttctccagaagacactttcagaccctcactgtaatggtgcaagcttggccattcacgtgcctgccccttgtttccctgatgaagactctgcaccttgaacctttgaaagccctgctggagggcctgcacatgcttcttacccagaaggatagaccgaggcgctggaagctccaagtgttagacctgcgcgacgtcgacgagaatttttgggcaaggtggcccggtgcctgggctctatcctgttttcctgaggcgatgagtaaacggcagacagcagaagactgcccgaggaccggggaacaccagcccttaaaggtgtttatagatatctgtttgaaggagatcccccaggatgagtgcctgcgatatctgtttcagtgggtgtaccagagaaggggcttagtccatctgtgctgctctaagctcgtgaactatctaactccaataaagtacttaagaaagtcgcttaaaatcatatacattaactctattggcgaattagaaattcacaatacttgttggccgcatctgatcagaaagctgtattgctacctgaaggaaatgaagacactttgtaaactggtgtttagccgctgtcaccattacacatccgacaacgaacttgaagggtggctagtgacacgattcacgtctgtgtttttacgcctggaacacctgcagctcctaaaaattaagctgatcaccttcttctccgggcacctcgaacagctgattaggtgtctgcagaatcctcttgaaaatcttgaactgacttgtgggaatctcctagaagaggacctcaaatgtttgtcacagttcccttctttggggtatttgaagcatctgaatctgtcttatgtgttgctattccggataagcttagagccattgggtgccttgctggagaagatcgcagcttccctggaaacactcgtgctcgaggggtgtcaaatccactatagccagctgtcggcgatacttcccggtcttagctgctgcagccaactaacaactttctactttggctcaaactgcatgtctattgatgccctgaaagatctcctgcggcacacaagtggattgtccaaattaagtcttgagacatatcctgcaccagaggaaagcctcaattcattggtgagggtgaactgggaaatatttacccctctccgggctgagctaatgtgtacattgcgggagttcagacagccaaagaggatatttataggtcccacaccttgcccttcttgcggttcaagcccatcagaggaactcgaattgcacttatgctgttag

SEQ ID NO: 58492 - DNA, 1428 bp, Artificial Sequence
  Description of Artificial Sequence: Synthetic coding sequence
atgtccatccggactcccccacgcctgctggagctggcaggtcgaagccttctgagggatgaggccctcgcgatatccacacttgaggaattgccgaccgaattattccccccactgtttatggaggcctttagccgcaggcactgcgaggcccttaaactgatggttcaggcctggccatttctgcgcctgcccctgggttcactgatgaaacgcccttgtccagagaccttccaggccgttttagacgggctagacgcactgcttacccaccgcgtcagactcaggcgctggaagttgcaggtgcttgaccttcaggacgtatcagaaaatttttggatggtgtggtccgaggccatggcaaggcgctgccttcccaatgccatgatgaaccgtaaaccggtgcaggattgccccaggatgcgaggccaacagccgctcacagtgttcatcgacctctgtctgaagaatcggaccctggatgagtacttcacttgtctcttcttgtgggtgaaacagcgggaaggcctggtacacctctgttgtaagaagcttaagatgcttggaatgctattccataacattaggaacattctcaagacagttaatctggactgcattcaggaggtcgaggtgaattgcaactggactctgcccgttctggcagagttcacaccatacctgggacagatgcggaacttgagaaaactcgtcctgtctgacatcgactcgcggtatatttcgcctgaacaaaaaaaagagtttgttacccagtttaccacccaatttctgaagctcagatgtctgcagaagctttacatgaactcagtcagtttcctggagggacatttggaccaaatgctgtcatgcctgaagactagcctcaatatactggccattacaaactgtgtgctgctggagtcagacctgaaacatcttagcaagtacccgtcgatcgggcagctaaaaacactggatctgtcgggaaccagacttgctaacttcagtcttgtaccactgcaagtactgctcgaaaaggtggccgcaacgctggagtacctggacttggacgactgcggcatcgtagattcccaggtgaacgctattttacccgcattatcccgttgcttcgagctgactaccttctcattcagaggtaacccaatcagcaccgccactctggagaaccttctgtgccatacgattcgcctcaataacctgtgcctggagctctacccggcaccacgggagtcttacgacgtgcgcggaatcgtttgtcgcagtagattcgcgcagttaggggcagagctcatggggagagtcagggcactcagggagccggagagaatcttattttgcaccgattactgtccccaatgtggaaaccgcagcctctatgacctggaggtggacaggtgttgctgttag

SEQ ID NO: 58493 - DNA, 1428 bp, Artificial Sequence
  Description of Artificial Sequence: Synthetic coding sequence
atgagcatccgtacaccccctcgtttattggagcttgccggtcgaagtctcctgagagacgaggcactggctatatctacccttgaagaactgccgactgagttattcccaccgctgtttatggaggctttcagtagacggcactgtgaggcactgaagttgatggtgcaggcctggcccttccttagactccccctgggctccctgatgaagcgcccttgtcccgaaacattccaagccgtccttgacggcctggacgcactgttgacacacagggtgcgcctgcgtagatggaaattacaggtgttggatctccaggacgtatccgagaacttttggatggtttggagcgaggccatggcacgtaggtgcctgcccaatgctatgatgaatcgtaagcctgtgcaggactgtccgaggatgcggggacaacagcccctcaccgtttttatcgacctgtgtcttaaaaatagaactctggatgaatacttcacctgtctatttttgtgggtgaagcagagagaaggccttgttcacctctgctgcaaaaagttgaagatgcttggcatgttgtttcacaacatcaggaacatactcaaaactgtcaacttagactgtatccaggaagtagaagtgaactgcaactggaccctccccgttttagcagagttcacaccttatctcggccaaatgcgaaatctgagaaaactcgtactgtcagacattgattcccgttatattagtccagaacagaaaaaagaattcgtgacacagttcactactcaattccttaagctgcgttgtctgcagaaactgtacatgaatagtgtgtcgttcttagaaggacatttggaccagatgttaagctgcttaaaaacctccttaaacatcctggcaattacgaattgtgttctgctggagagcgatctgaagcatttgtctaaatatccctcaatcggccagcttaagaccctggacttaagtggtacccgactcgcgaacttctcccttgtaccactgcaggttctgctggagaaagtggccgctaccctcgagtatctcgacctggatgattgcggcatagtggatagccaggtgaatgcgatcttgcctgctctgagtcgatgtttcgaactcaccacttttagtttcaggggcaaccctatttcaaccgcgactctggaaaacttactttgtcataccattaggttgaacaatctgtgcctagaactctaccctgcaccacgcgagtcttacgatgtccgcggaatcgtgtgtcgctcgcggtttgcccagctaggcgctgaactgatgggcagggtgagggccctcagggagccagagcgcattcttttctgcactgactactgcccccagtgtgggaatcggtctctctacgacctggaggtcgacagatgttgctgttag

SEQ ID NO: 58494 - DNA, 1428 bp, Artificial Sequence
  Description of Artificial Sequence: Synthetic coding sequence
atgtccatccgaacacctcctcgcctgttggagctcgcagggcgtagcctattaagagacgaggcccttgccatctccaccttggaagaactccctacggagctcttccctcctctgttcatggaggcgtttagcaggagacattgcgaagccctgaaacttatggtccaggcttggcctttcctgcgattacccctcggatcccttatgaaaaggccgtgccctgagacatttcaggcagttctggacggcctggatgcattattgacgcaccgcgtccggttgaggcgctggaagctccaagtccttgatctgcaggatgtctcagagaatttttggatggtctggtccgaagctatggcccgacgttgccttccgaatgccatgatgaataggaagcccgtccaggactgccccagaatgcggggacagcagcctctcacagtattcattgatctgtgcctgaagaatcgaaccctcgacgaatacttcacatgcctttttctgtgggtaaaacaaagagagggactcgttcatctctgttgcaagaagctcaagatgctggggatgctgttccacaatatcagaaacatacttaagactgtgaacctggactgtattcaggaggtggaggtcaattgcaattggaccctgcccgtcctggcggaatttaccccatatctgggacagatgaggaatcttcgaaagctcgtgctgagcgacatcgatagccggtacatctcgcccgagcagaagaaggagttcgtcacccaatttactacacagttccttaaactgaggtgcctgcagaagctgtacatgaactcggtgagctttttagagggtcacctagaccagatgttgagttgccttaagactagcctgaacatcttggccattactaactgcgtcttgctcgagtccgatcttaaacacttatctaagtacccaagcattgggcagcttaagacacttgacctatcagggacaagactcgccaacttttctttggtgcctttgcaggttctgctagagaaggtggccgcaacactcgaatatctggatctggacgattgtggaatcgtagatagtcaggttaacgcaattttgcccgcactctcaagatgttttgagttgaccacattctcttttcggggtaaccctatcagtacagcaacgctggagaacctgctgtgccacaccatccggctaaataatctctgcctggagctctatcctgcgcctcgggagagttacgacgtccgagggatcgtttgcaggtctcggtttgcccagctgggggcagaactgatggggagagtcagggccttgagagagcccgaaaggatactgttttgtactgattattgtcctcaatgtggcaatcgctccctgtacgatttggaggtcgataggtgttgctgctag

SEQ ID NO: 58495 - DNA, 1446 bp, Artificial Sequence
  Description of Artificial Sequence: Synthetic coding sequence
atgcgaatgagtttacaggccccaagacgactgctcgaactagccggacagtccttgcttggagaccaggcccttgccatttctatactggacgaactgccaagggagttattcccgccacttttcgtggaggcttttactagccgccgatgcgaagtgctcaaggtcatggtgcaggcttggccatttccctgcctgcccctgggaagcttaatgaaaacaccagaccttgaaatactgcactacgtagtggatggcatcgattgcctgcttgcccagaaggtgcgacctcgacgctggaagttgcaggtacttgaactccgggacgtggacgaaaacttctggacaatctggagtggcgctaggcccctgtcatgctcgccagaagctatgtcaaaaagacagactgtagaggactgtccccgaactggtgagaagcaacctttaaaagtgttcatggatgtttgcctgaaagagaagtttatggacgaagaccttagttttttctccggctgggtgcaacacagacggggaagcgtccacctatgttgtaccaaggtggtcaactattcaatgtcgattctgaattttcggaatattttggaaaccgtatatccggacagtattcaggttttggaaatttggaacatgtgctggccctgcatgatcgtcgagttttctagatacttgtctcagatgcgaaatttacgaaagttattcattagtgacggttgccgatatctgctgtcttctgactctcaggagcagctggtggcagagttcagcagtgtgctcctgcggctcgagtacttgcagatgctctacgtccgcagggtatgttttttcagagggcatctggaccagctcatccgatgcctgcggtcccccttagagaccttggccttgacttatggtttcttagagaaagttgatctcaagtgtttgccacgatatccatccttgagccaactgaagcagctcaatctgtcacacggggcactacgctttatcagactggaaccactgagggctctgctagaaaaggtggccgcaacccttcagaccctgttcttggtcgactgcggcatccgagacagtaagctgcgggtgattctgccagctctcagctgctgctctaatctcaccaccttttgctttcacgggaatgacacaagtatggatggtctcaaagatctgctgcgccataccggacggctgtcaaacctgtccttggaaacatacccggcacccagggagtctctggacgatcgaggccgtgtgatatccgaacttcttactccgctgcaggccgaactaatgcggatattgagggaggtgcgggaacccaaaaggattttcttcggcccagtttcttgcccgtgttgcggtacgagcccgaccgagcagttggaatttaatttttgcctttgggggcgtcccgcatag

SEQ ID NO: 58496 - DNA, 1440 bp, Artificial Sequence
  Description of Artificial Sequence: Synthetic coding sequence
atgtccctgcaggcccctaggcgactcttggagctcgcgggacaatctcttctgggcgatcaggctctggcgatcagtatcctcgacgagcttcctcgagaactcttcccccctctcttcgtggaagcctttacatcccgtagatgcgaggtgttgaaggtgatggtccaggcttggcccttcccgtgtctgcctctgggcagtctcatgaaaactcctgacctcgagatactgcattacgtggtcgatggaattgactgcttactcgcccagaaggttaggccccgtaggcgcaaattacaggtgttagaacttagagacgtggatgagaacttctggaccatatggtcaggagccaggcccctgtcgtgttccccagaagctatgagcaagcggcagactgtggaagattgccccaggacaggggagaagcaaccgctgaaagtgttcatggatgtgtgtttaaaggagaaattcatggacgaggatctctcttttttttcgggttgggtacaacacagacgcggaagcgtacacctctgctgtacgaaggtcgtgaactatagcatgtctattctgaatttccgcaacatcctcgaaacggtgtaccccgattcgatccaggtgctcgagatttggaacatgtgttggccatgtatgatcgtggagttcattagatatctctcacagatgaggaatctgagaaagctatttatctccgacgggtgtcgctatctcctttcgtcagatagtcaggagcagctggtcgccgaattcagctccgtgcttctaaggctcgagtacctccaaatgctctacgttcgccgagtgtgcttcttccgcggacacctagatcaactgattcgctgcctccgttctccccttgagaccctggcgctcacttatggttttctggagaaagtggaccttaagtgtttaccacggtaccccagtctgtctcagctgaagcaactcaacttatcacacggtgccctgcgcttcattcgccttgaacctctgagggcactgctggaaaaggtagctgcgactctgcagaccctgttcctcgtggactgtggaatacgagacagtaagctgcgggtgatcctgcccgctctgtcttgttgttctaatctcacaactttctgttttcacggaaatgacaccagcatggatggcctgaaggatctgttgcggcacacagggcgtctcagcaacctgtctctggagacctaccccgctccccgagagtctctagacgaccgcggtcgggtgatatctgagttattgacaccacttcaggctgaattgatgaggatacttcgtgaggtgcgagagcccaaacgaatattttttggacctgtgtcttgcccgtgttgtggtacaagcccgactgagcagctggagtttaacttctgcctctgggggaggccagcgtag

SEQ ID NO: 58497 - DNA, 1446 bp, Artificial Sequence
  Description of Artificial Sequence: Synthetic coding sequence
atgagaatgagtctgcaggctccgagaaggctcttggagctcgccggtcagagcctgctgggtgatcaggcactggctatttcaatcctggacgaattgcctagggaactgtttccccctttattcgttgaggccttcacctctaggagatgtgaggtgctcaaagtgatggtacaggcctggcctttcccctgtctacctctgggcagtctcatgaagacacccgacttggaaattcttcattatgtcgtcgatggtatcgactgtttattggctcagaaagtgagaccacgcaggcgcaagctgcaggtacttgagttgcgagacgtggacgagaacttttggactatatggtccggcgcacgaccgctttcatgttcccccgaggcaatgtcaaagagacagacagttgaagactgccctcgtactggggaaaagcagcccctgaaagtattcatggacgtgtgtctgaaggagaagtttatggatgaagatctgtccttcttctccggatgggtccagcatagacggggatcagtgcatctttgctgtactaaggttgtgaactatagcatgagcatcctgaattttcggaacatactggaaaccgtgtaccctgactcaattcaagtgcttgagatctggaacatgtgctggccctgtatgattgtggagttcatccgctacctctcccagatgaggaatttgcgtaaacttttcatttcggacggttgccgctacctcttgagcagcgactctcaggagcagctggtggccgaattttccagtgtgctgctccggttggaatatctgcagatgctttacgtaaggagggtctgcttctttaggggtcacctcgatcagctgatccggtgcctgaggagcccgctggaaacactggctctgacatacggcttccttgagaaagtggacctcaagtgtctgccaagatatccatcactttcccagctgaaacaattaaatctctcccacggcgctctccggtttatcagattagagccattacgtgcgctgctggagaaggtggccgctacgcttcagacactgttcctggtggattgcggtattcgcgattctaaactgcgggtgattctgccagctttgtcctgctgctccaacctcaccaccttctgtttccatggaaatgacacctctatggacggcttgaaagatctcctccggcatacgggacgtctttctaatctgtccctggaaacatacccagcaccgagagagtccctcgatgaccgaggtcgcgtgatcagtgagttactgacccccctgcaagctgagcttatgaggattctgcgggaggtgcgggaacctaaaaggatttttttcgggccagtaagctgcccctgctgcggcactagccccacggaacagcttgagttcaacttttgtctctggggaaggcccgcttag

SEQ ID NO: 58498 - DNA, 1437 bp, Artificial Sequence
  Description of Artificial Sequence: Synthetic coding sequence
atgaaaatgtctatttggacacctcctagactgctggagctcgcgggaagaagcttgctcagagatcaagcccttgctatgtcaactctggaggaactcccaactgagctgttccctccgctgtttatggaggcctttagtcgtcgacggtgcgaagccctgaaacttatggtgcagagctggccatttagacgcctgcccctaaggcctctgattaaaatgccatgtctagaggcttttcaggccgtactggacggcctggacgcactactgaatctgggggtgcggcctaggaggtggaaactgcaagtcctggatctgcaggatgtgtgcgaaaatttctggatggtttggtccgaggcaatggctcacgggtgcttcctcaatgctaaaaggaataagaagcccgtagaggattgccctcgtatgaggggaagacaacctctcactgtttttgttgagctgtggctgaaaaatagaaccttagatgaatatctgacgtgtctcctcctttgggtcaaacaacggaaagatctgctgcacctgtgttgtaaaaaactcaaaattcttgggatgccattccggaacatccggtctattctgaaaatggtgaatcttgattgcattcaggaggttgaagtgaactgcaaatgggtcctgcctattctcacccaattcaccccttacctgggacatatgcgcaacctgcaaaaactcatcctgtctcacatggacgtgagtcggtatgtcagccccgagcagaagaaagagatcgtgacccagtttacaacgcaatttctaaaactcagatgcctacagaagctttacatgaatagcgtctcatttctggaaggccacctggaccagctgctttcctgcctgaaaacctcccttaaatttctgacgatcacaaattgcgttctgctggaaagtgacttgaagcatctgagccagtgtccaagtatcagccaactgaaaactcttgatttaagtggcatccggttgacaaattacagcctggtgccacttcaaatcctgctggaaaaggttgcggctaccctggagtacctggaccttgacgactgcgggattattgatagccaggtgaacgcgatcctgccagccctgagcagatgcttcgagctgaatacattcagcttttgcggcaatcctatctgcatggcgacacttgaaaacctcctgagccatacaattattcttaaaaacctttgcgtcgaactatatccagctccccgtgagtcatatggagcagacggcaccttatgctggtctcgcttcgcccagattcgagcagaactgatgaacagggtccgcgacctgcgccatcccaagaggattttattttgtacagattactgccctgattgcggtaacagaagcttttatgacctagaggctgatcagtactgttgctag

SEQ ID NO: 58499 - DNA, 1431 bp, Artificial Sequence
  Description of Artificial Sequence: Synthetic coding sequence
atgtccatcaggacacccccaaggctcctagagctggctggtcggtccctgctcagagatcaggctctggctatgagcacgttggaagaactaccgaccgagttatttcctcccctgttcatggaggctttctcccgcagacggtgtgaagccttgaaacttatggtgcaggcctggccgttccggagactacctctcaggccactgattaagatgccctgcctagaggcctttcaggccgtgctggacggactcgacgctctcctgacccagggtgtacacccacgtaggtggaagcttcaagttctggacttacaggacgtgtgtgaaaacttttggatggtttggtctgaagcaatggcccatgggtgtttcctgaacgctaagcgaaacaagaaaccagttcaggactgcccacggatgcgcggtcagcaaccactgactgtattcgtggagctttggttgaagaaccgtaccttggacgagtacctcacatgcctactgctgtgggtaaaacagcgcaaggacctgcttcacctctgctgtaagaagctcaagattctgggcatgccttttagaaacattcgcagcatcctaaagatggtcaacttagattgcatacaagaagtggaggtgaattgtaagtgggtgctgcctatcttgacacaattcactccctatctgggacacatgagaaacctgcagaaactggtcctgtcccatatggatgtgtccaggtatgtctcgcccgaacagaagaaagagattgtcacacagttcaccacccagttcctcaagctgtgctgcttgcaaaaactcagtatgaatagcgtaagttttttggaaggacatctggaccagttactctcatgcctcaaaacgtctttaaaagtgctgacaatcactaactgtgtattgttagaaagcgatttgaaacacctttcgcaatgccctagtatttcccagctgaagaccctggatctctctgggatcagactgacgaattacagcctggttccgctccagattctattagagaaggtcgctgcaacactggaatatctggacctcgatgactgcgggattatagacagtcaggtgaatgctatcctccctgccctttcacgatgctttgagctgaacacattcagtttctgtggcaatccaatttctatggccacattggagaaccttctgtcccatacaattatactgaagaacctgtgcgtggagctgtacccggctccccgagaaagctacgacgccgatgggactctgtgctggtccaggttcgctcagatacgagccgagctgatgaagagagtccgtgacctgagacatcccaaaagaattctcttttgcacagattgctgccccgactgtggaaaccgcagcttttacgacctcgaggctgatcagtgttgctgttag

SEQ ID NO: 58500 - DNA, 1431 bp, Artificial Sequence
  Description of Artificial Sequence: Synthetic coding sequence
atgtcaatcaggaccccgccacggctgctggagctagccggaagaagcctgcttcgcgaccaggccctggcgatgagcacccttgaggaactcccaacggaactgttcccacctttattcatggaggcattctcacggagacggtgtgaggcattgaagctaatggtgcaggcgtggccctttaggcgtcttcccttacggcctctgatcaagatgccgtgtctggaagcctttcaggcagtgcttgatggtttagacgctctgctcactcagggcgttcatccgagaagatggaagttgcaggtgctggatctgcaggatgtttgtgaaaacttctggatggtgtggtccgaggccatggcacgtgggtgcttccttaacgcaaaaaggaacaagacccccgtccaagactgcccccgaatgcggggtcaacagccgctaacagtcttcgtagagttatggttaaaaaatcgcactctcgatgaatatctaacatgtctcctgctgtgggtgaagcagaggaaagacttgctccatctgtgctgtaagaaactcaagattttgggcatgccgtttcgaaatatccggtcaatcttgaagatggtgaatctcgactgcattcaggaggtcgaagtcaactgtaagtgggtgctgcccatactgactcagttcactccttacctgggccatatgagaaatctgcagaagctggtactgtcgcatatggatgtctcccgatacgtgagtccagagcagaaaaaagaaatcgttacacagtttaccactcagttcctgaaactctgttgtctccaaaaactgtcaatgaattcagtgtcgttcttggagggccacttggatcagctgctgtcgtgcctcaagacaagtctaaaggtactgactatcacaaactgcgtgctgctagagtccgacttgaaacatcttagccaatgtcccagtatctcccagctgaaaacgcttgatctgtccggcatcaggctaaccaattacagcctcgtcccccttcagattctactcgaaaaagtggctgctaccctggagtatctggatctggacgattgcggcattattgacagtcaagtgaatgcaatcctccccgcattatccagatgtttcgaactgaatactttcagcttctgcggaaaccctatttccatggccacgcttgagaatcttctgagccacaccataatcctcaagaacctgtgcgtagaactttacccagcacccagagagtcttacgatgccgacggaactctctgttggtcaagatttgctcagatcagggccgagcttatgaaacgcgtcagggacttgagacaccctaaaaggatcctcttctgtacggactgctgtccagactgcgggaaccgtagcttctacgatctcgaagcggaccaatgctgttgctag

SEQ ID NO: 58501 - DNA, 1431 bp, Artificial Sequence
  Description of Artificial Sequence: Synthetic coding sequence
atgtccataaggactcccccacggctgctcgagctggcaggcagaagcctgctcagggaccaggccctagctatgtccaccctggaagaactccccacagaactgtttcctcctctgttcatggaagcattctccaggcgtcgctgcgaagccctgaagcttatggtgcaagcttggccctttcgcaggttgcctctccggcctctgatcaagatgccgtgtctcgaggccttccaggccgtgctggacgggctggatgcgctgctcacacaaggcgtccacccccgacgctggaagctgcaagtccttgatcttcaagacgtgtgcgagaatttttggatggtatggtcagaggcaatggctcatggctgctttctaaatgcaaaaaggaataaaaaacctgtgcaggactgtcccagaatgcgcggtcagcagcctctgacggtattcgtcgagctgtggctgaagaataggaccctggatgaatatctcacctgtctcctcctctgggtgaaacaacggaaagacttgctccacctgtgctgcaaaaaactcaagattctcgggatgccattccgcaacattcgctcaattctgaaaatggtgaatcttgattgcatccaagaggtggaggtgaattgtaaatgggtgctccccattctgacccaattcactccgtacttaggccatatgagaaatctgcagaaattggtgctgtcacacatggatgttagccgctacgtttctccagagcagaaaaaagagattgttacccagttcaccactcaattcctgaaactttgttgtctacagaagctatctatgaacagcgtctctttcctggagggtcacctagatcagctcttgagctgcctgaagacatcattaaaggttctcactattaccaattgcgtactgctggagtctgatctcaaacacctgagtcagtgcccctcaatttcgcagttaaaaaccctggatctctccgggattcggctgacaaactactccctggtgcccctccagatcttactcgagaaagtcgcagcaacgcttgagtatctggacctagatgattgcgggataatcgattctcaggtgaacgccattcttcctgccctctcctgttgtttcgagctaaatacctttagcttctgcggtaaccctataagcatggccaccctggagaacttgctgagccacacgatcatcctcaagaatttatgtgtggaattgtaccccgcacccagagagagttacgatgccgatggcaccctgtgctggagccgtttcccccagatccgggctgagcttatgaaaagagtgagagatttgcggcatccaaaacgaattctcttctgtaccgattgctgccccgactgtggaaaccggtccttctatgatctggaagcagaccagtgttgttgctag

SEQ ID NO: 58502 - DNA, 1431 bp, Artificial Sequence
  Description of Artificial Sequence: Synthetic coding sequence
atgtctattagaacccccccaagactcctcgaactcgcaggcaggtcactgctccgcgatcaggcattggccatgagcactctggaagagctgccaactgaactcttcccacccctgttcatggaggctttttcccgtaggagatgcgaagccttaaagctgatggtgcaggcctggccctttcgtagattgccacttcgtcccctgatcaaaatgccgtgccttgaggcttttcaggcagtgcttgatggcctcgatgcgttgttgacacaaggagttcaccccagaaggtggaagctgcaggtgctggatctgcaggacgtctgtgaaaatttctggatggtgtggagcgaggctatggcacgcggatgcttcctgaatgctaaacgcaataaaaccccggttcaggattgccccagaatgcgtgggcagcagcccctgaccgtatttgtggaactctggctgaagaaccgcactctggatgagtatttaacatgtttgcttctgtgggtgaaacagagaaaagacctgttacacttatgctgcaaaaagctgaaaatcctgggcatgcctttccgaaatatccggtcgatactgaaaatggttaaccttgattgtatccaggaggttgaggtaaactgcaaatgggttttacccatcctcacacaattcacgccctacctgggccacatgcgcaacttacagaaactagtcctgagtcatatggacgttagcagatatgtgagccccgagcagaagaaggagatagttacacagttcacaacacagttcttgaagctgtgttgtctccagaagctgagtatgaactcagtctcttttctcgagggtcatctggaccagctactgagctgccttaaaacatcattgaaagtgctaacgatcaccaactgtgttttgttagagtcggacctcaaacatctttctcagtgtcctagcatttcccagctgaagacgctcgatctgtcagggattcgactgactaattacagcttggtgccattgcagatactgctggagaaggttgccgctaccctggagtatttagatctggatgattgcggtattatcgactcacaagttaacgccattctccccgctctgtcaagatgttttgaactgaatactttctccttctgtggaaatcccatctccatggctacccttgagaatctgctgagtcataccataatccttaagaacctgtgcgtggagttataccccgcaccccgtgaatcgtatgacgccgacggaacgctatgctggtccaggtttgcgcagatcagggctgaacttatgaagcgcgtccgagatttgcgccatccaaagaggatcctattctgcacagactgctgccccgactgcggaaataggtccttttatgaccttgaagcagatcaatgttgttgctag

SEQ ID NO: 58503 - DNA, 1431 bp, Artificial Sequence
  Description of Artificial Sequence: Synthetic coding sequence
atgtctattaggacacccccacggctcctggagctggcgggtcgctctctgctgcgggatcaagctttagcaatgtcgaccctagaggagctgccaaccgagctcttcccgcctctattcatggaggctttctcacgccgacggtgcgaagccctcaagcttatggtgcaggcctggccattcagacggctgccgctgcgcccactgattaaaatgccgtgcctggaggcatttcaggccgtactggatggcctggacgcactactcacccagggggtgcacccccgtagatggaaactgcaggtcttggatttgcaagatgtgtgcgaaaatttctggatggtctggagcgaggcaatggcccatgggtgttttcttaacgccaaacggaataaaaagccagtccaggactgtccacgtatgcgcggtcagcagccgctgaccgtgttcgtcgaactgtggctcaagaacagaacattagacgaatacctgacctgtcttctgctttgggtgaagcaacgaaaagatttactgcatctgtgctgcaaaaaactcaagatcctcggtatgccgtttagaaatatacgctccatcctgaagatggtaaatctagattgtatccaggaagtggaggtgaattgcaagtgggtgttacccatcctcacccagtttacaccgtatctcggtcacatgcgcaacttgcagaagctcgtgctctcgcacatggacgtgagtagatacgtgtcccctgagcagaaaaaagaaatcgtgacccaatttaccactcagttcctgaaactgtgctgccttcagaagttgtcaatgaatagtgtgagttttttggagggacacctggatcagctgcttagctgcttgaaaacctctctgaaagtcctcacaatcacaaattgtgttctgctggaatcagatctgaagcacttgtcgcagtgcccgagcatttctcagctaaagactctggaccttagcggtatcaggctgacgaattacagccttgttccccttcagattctcttggaaaaggtggctgccactctggagtacctggatctggatgactgtggaatcatcgatagtcaggttaatgctattctacccgcactgagtcgctgttttgaattgaatacgttctccttttgcggaaatcccatctctatggctactctggagaatcttctgtctcatactattatattaaaaaacctctgcgtcgagctataccccgcaccccgtgagagctacgacgcggatggaactttgtgctggagtcgctttgctcagattcgagctgagctaatgaagagggtccgggatctgcggcatccaaagagaattttgttctgtaccgactgctgtcccgactgcggtaacagatcattctacgaccttgaagcagatcagtgttgttgttag

SEQ ID NO: 58504 - DNA, 1431 bp, Artificial Sequence
  Description of Artificial Sequence: Synthetic coding sequence
atgagtatccgcacaccacccaggctgctggaacttgccggtagaagcctgctgcgcgatcaggccctggcaatgagtactctggaagagctccctaccgagttgttccctcctttgttcatggaagcattttctagacgcaggtgcgaagccctgaagctgatggttcaggcctggccctttcggagattgcccctgcggcctctgatcaagatgccatgcctggaggccttccaggccgtgttagacggactggacgcgctgctaacccaaggcgttcatccacgcaggtggaaacttcaggttctggacctccaggatgtgtgcgaaaatttctggatggtgtggagtgaggccatggcacacgggtgtttcctgaatgctaaacgtaataaaaagcccgtgcaagactgcccacggatgcggggacagcaaccactcactgtttttgttgaattatggttaaaaaaccgcaccttggacgaatacctgacgtgcctccttctgtgggtgaagcagaggaaagatctattgcacctgtgttgtaaaaagctgaagattttgggaatgccctttcggaatattcgatcgatcctgaagatggttaaccttgactgtatacaagaggttgaggtgaactgtaagtgggtgttgcccatcctcactcagttcaccccataccttgggcacatgagaaatctgcagaaactggtgctctcccatatggacgtgtcccgctacgttagccccgaacaaaaaaaagaaatagtgacccagttcactacccaattccttaaattgtgctgtctgcagaagctgtccatgaacagcgtctcatttctcgaagggcacctggaccagctgctctcctgcctgaagaccagtctgaaggtgctgaccatcacgaactgcgtgcttttggaatccgacctcaagcacctaagccagtgtccctctatctcccagctgaagaccctggatctgtctggcatcagattgaccaactattctctcgtgccgctgcagatcctcctggagaaggtcgcagccactttggagtacttagatttagacgactgtggtattatagatagccaggtcaacgccattttgcctgcgctgtcctgctgctttgagctcaacacatttagtttctgtggcaatccgatttcaatggccacgctcgaaaacctgcttagccacaccatcattctaaaaaacctgtgcgtggaactctaccccgctcctagagagtcttacgatgccgatgggactctctgttggagtaggttcccgcaaatccgcgcagaactgatgaagagagtgcgggacttgcggcatccaaaacgcattcttttctgtaccgattgttgtccagattgtgggaatcggagtttttatgatttagaagctgatcagtgctgctgttag

SEQ ID NO: 58505 - DNA, 1431 bp, Artificial Sequence
  Description of Artificial Sequence: Synthetic coding sequence
atgtcgattcgaactccacccagactcttggaactggccggtcggagtctactgcgcgatcaggccctggcaatgtccacgctggaagagttgcccaccgaactctttccacctctgttcatggaggcatttagccgccgacgctgcgaggcacttaaactaatggtgcaagcctggccatttcggaggcttcccctccgcccattaattaagatgccttgtctggaggccttccaggctgtactggatggtcttgatgcattattaactcagggggtgcatcctcgcaggtggaaacttcaagtacttgatttgcaggacgtgtgtgagaatttctggatggtgtggtccgaggctatggctcggggttgttttctgaatgccaaacgcaacaagacgcccgttcaggactgcccacgcatgcgcggtcaacaaccactgaccgttttcgtagagctatggctgaaaaaccgcacgttagacgaatatctgacctgccttctactgtgggtcaagcagaggaaggaccttctgcatttatgctgcaaaaagcttaagatcctaggcatgccattccgcaacattcgctccatacttaaaatggtgaatcttgactgcatccaggaggtggaagtgaattgtaagtgggtgctccccattctcacacagtttaccccgtacctaggccatatgaggaatttacagaagctggtactgagtcatatggatgtgagccgctatgtttctccagaacaaaagaaggaaatagtcacccagtttaccactcagttcctgaaattgtgttgccttcaaaagctgagcatgaactccgtctcatttcttgagggtcacctggaccagctgctttcttgtttaaaaacctccttgaaagtgttgaccataacaaactgtgtgttgcttgaatccgatctgaagcacttgtcccagtgtccttctatttcccagttgaaaaccctggacttgagcggaatccgccttaccaattactcattggtgccactgcaaattctcttggagaaggtggccgctacactggagtacctggacctcgacgactgtggtatcatcgacagccaggtaaatgctattctaccagccctgagcagatgtttcgagctaaacaccttctccttttgcggcaatcccatcagtatggccacattagagaatctgctgtcacataccatcattttgaagaacttatgtgttgagctttatcccgctccacgggaatcctatgatgccgacggcaccttgtgctggtcaaggtttgcccagatcagggcagaactcatgaagagagtgcgagacctccgacaccctaagaggatcctgttttgtactgactgttgtcctgactgcggcaatcgttctttctatgatttggaggctgaccaatgctgctgctag

SEQ ID NO: 58506 - DNA, 1425 bp, Artificial Sequence
  Description of Artificial Sequence: Synthetic coding sequence
atgtctatccgtgctccaccacgactccttgagctagcccgacagaggttattaagagatcaggcgctggccatcagcaccatggaagagctgcctagagaactgtttccgacgctttttatggaagctttcagcagaagaagatgtgagaccctcaaaactatggtccaagcctggccctttaccaggctgcccctgggctcactcatgaaaagtcctcatcttgagtccctgaaatctgtccttgaaggagtagacgtgctgttaactcaggaggtacggcctcgccaaagtaaacttcaggttctggatctgaggaacgtggatgaaaatttctgtgatattttcagcggggcaactgcaagctttcccgaagccctgtctcagaagcagaccgctgataactgtccaggcactgggagacagcaacccttcatggtgttcattgatctgtgtctgaaaaaccgcactctagacgagtgcctgacacatctcctagagtggggaaagcagcgaaaggggctgcttcatgtttgctgcaaggaactacaagtgtttggaatgcccattcacagcatcatagaagtgctcaatatggtggagctggattgcatccaggaggtagaagtgtgctgcccttgggaactctccacgctcgtaaaatttgccccatatctaggccagatgagaaatctgaggaagctggtgcttttcaacatcagagcctccgcctgtataccccctgataacaagggacaatttattgcgaggtttacctcccaatttttaaagttggactacttccaaaacctatccatgcacagcgtctcatttctggagggacatctggaccagcttctgagatgcctgcaggctagtctcgagatggtggttatgactgactgcctcctgagcgagtccgatctgaagcacttatcttggtgcccatcgatcaggcagctaaaggagctagatctgaggggggtgactttgacacacttctcccccgagccacttacaggcctattggagcaggttgtggccacccttcagacacttgacttagaggattgcggcatcatggacagccaactgtcggccattcttcccgtgctgagcaggtgttctcagctaagcacttttagcttctgtggcaatctgatctcgatggctgctcttgaaaacctgctgaggcacaccgtcggcctgagcaagttgtctttggagctgtatcctgcccctttagagtcatatgatactcagggtgccctctgttggggcaggttcgctgaactgggcgctgagcttatgaagacccccagggatctccggcaacccaagattatagttttttgcaccgtcccgtgtcccaggtgtggtatacgcgcttcttacgatctggaacctagtcattgcctatgttag

SEQ ID NO: 58507 - DNA, 1425 bp, Artificial Sequence
  Description of Artificial Sequence: Synthetic coding sequence
atgtctataagagcacctcctagactcctcgagctggctcgacaacgattactccgggatcaagcgttggccatcagcaccatggaagaattgcctcgcgaactctttccaacgctttttatggaggcgttctccagacgcagatgcgagaccttgaaaaccatggtgcaagcatggcctttcacaagactgcctctaggttccctcatgaaaagcccacatctagagtcgttgaagtccgtccttgaaggagtcgacgtgctcctcacacaggaagtccggccacgccaatccaaactgcaggtgctggacctgcggaacgtcgatgaaaatttctgcgacattttcagcggagccaccgcttcgtttccagaagccctctcccagaagcagacggcagataattgtccgggaacaggcagacagcagccctttatggtgtttattgacctctgtctaaaaaaccgtacactcgatgaatgccttacgcatctcctcgaatggggaaaacagagaaaaggtctgctgcatgtgtgttgcaaggaactccaagtattcggcatgcccattcactccatcatcgaggtgctcaacatggttgagttagactgtatccaggaagttgaagtttgttgcccatgggagctgagtacgctggtaaagtttgctccctacttaggccagatgagaaatttaaggaaactggtccttttcaatatacgggcttctgcgtgcatcccaccggacaacaaaggccaattcattgcacgatttacatctcagtttctcaagcttgactatttccagaatctctctatgcattcagtgagcttcctggaggggcacctagaccagcttctgagatgcctgcaggcctctcttgagatggttgtaatgaccgattgcctgttatcggagagcgatcttaagcatctttcgtggtgtccctctattaggcaactaaaagagctggatctgcgcggagttacactgacacatttcagcccagaacctctgactggactactggagcaggttgtggcaaccttgcagactctcgacctggaagattgtggtatcatggactcccagttgtctgccattctgcccgtgctctccaggtgctctcaactgagcaccttctctttctgtggcaacctgatttctatggccgcactggagaatcttctcaggcacactgtgggattgtccaagctatctctagaactataccccgctccactggaatcctacgacacacaaggtgcgctgtgttggggtagattcgccgaactgggcgcagaactcatgaagaccccacgcgacctgcgccagcccaagattatcgtgttctgcacagtgccctgtcccagatgtgggattagagccagctacgatctggagccatcccactgcctatgctag

SEQ ID NO: 58508 - DNA, 1425 bp, Artificial Sequence
  Description of Artificial Sequence: Synthetic coding sequence
atgagtattagggccccacctaggctgttagagttggctcgccagcggttgctgcgggatcaggccctggcaatctccactatggaggagctgcccagagagttgtttccgacactgtttatggaggccttctctcggcgacggtgtgagactctaaaaaccatggtacaagcatggccatttactcggctgcccctgggcagcctgatgaaatcacctcacctggaatccttgaaaagcgtcctggaaggtgtcgatgtcctgctgacgcaggaagtgcggccaagacaaagtaagctccaagtcctggatctgagaaatgtggatgaaaacttctgcgacattttctcgggggctactgcaagtttccctgaagctttgagtcagaagcagactgctgacaactgccccggtactggaaggcagcagcccttcatggtgttcatcgatctctgcctgaagaatcgtaccctggatgagtgcctgacacacctgctcgagtggggcaagcagagaaaaggacttctgcacgtgtgctgccaggaactccaggtgtttggaatgcccatccattctatcattgaagtgttgaatatggtggagctggactgtatccaggaggtcgaggtttgttgcccatgggagctgtctacattagtgaagttcgcaccttacttgggtcagatgagaaatttacggaagttggttctgtttaacatccgggctagcgcatgcatccctccggacaataaaggccagttcattgccaggttcacctcgcaattcttgaaactcgactacttccaaaatttgtccatgcacagtgtatcgttcctggagggccacctggaccagctgttgcgctgcttgcaggcctccctcgagatggtggttatgactgactgcctcttgagcgaatctgatctcaagcacctctcttggtgtccaagcatccggcagttgaaggagctggatcttagaggcgtgacactcacacacttcagcccagaaccacttacaggactcctagagcaggtcgtggcgacgctccaaactctcgatttggaagattgtggcattatggatagtcagctgtccgccattttacctgttctctcccgctgtagtcagctgagtactttcagcttctgcggcaatcttatctccatggcagcgctggaaaacttgctccgtcacaccgtaggcctgtccaagctctccctcgagctttaccccgcacccttggagtcttatgatacacaaggcgctctgtgttggggcagattcgctgagttgggcgctgaactcatgaaaacattgcgagatctgcgacaacccaaaatcatcgtgttctgcaccgtgccttgccccagatgtggcattagggccagctatgaccttgaacctagtcactgcctctgctag

SEQ ID NO: 58509 - DNA, 1437 bp, Artificial Sequence
  Description of Artificial Sequence: Synthetic coding sequence
atgaagatgagcataagaactccccctcgcttgcttgaactggccggtcgctccctgctaagagaccaggccctggccatgtcaactctggaagagctgccaaccgaactgtttcctccacttttcatggaagccttctctaggcgcagatgtgaggctctgaagttgatggtccaggcgtggccatttaggcgtttaccactccggccactgatcaaaatgccgtgtctggaggctttccaggcggttcttgatgggttagatgccttactgacacaaggcgtgcgcccacgtaggtggaagttgcaggtgttggacctacaggatgtttgcgaaaacttctggatggtgtggagtgaagctatggctcacgggtgctttctgaatgccaaacgcaacaagaagcctgtgcaagactgcccaaggatgcgcggaaggcagcccttaaccgtattcgtggaactgtggctgaagaatcgtaccctggatgaatacctcacctatctactgctctgggtcaagcagaggaaagatctcttgcacctttgttgtaagaaactgaagatcctggggatgccctttcgaaacatcagaagtatcctgaagatggtcaatttggactgtatccaagaggtggaagtcaactgtaagtgggtattgccaatcctcacccaatttactccctacttgggtcacatgcgcaatcttcaaaaactcgtcctgtctcacatggatgttagcaggtatgtgtctcctgagcaaaaaaaagaaatcgttactcagtttaccacacaatttctcaagctgagatgtctgcagaaactttatatgaacagcgtgtcattcttggaaggacacctggatcagcttctcagctgtctgaagacctcacttaaggtcttgacgatcaccaactgcgttctgttggaatctgatctaaaacatcttagtcagtgcccgtcaatctcccagctgaaaaccctggacttgtccgggatccggttgaccaactattccctggtcccacttcagattctattggagaaggtggctgcgacgttagagtatctcgatctggacgattgtggaattattgattctcaggttaatgccattctgccagccttaagtagatgctttgaactaaacaccttcagcttttgcggcaatccaatatgtatggccacacttgaaaatcttctgagccataccatcatcctgaaaaatctctgcgtcgaattgtacccagcgccacgagaaagctatggcgcagacggcacgctctgttggtcgcggtttgctcagatcagggcggaactcatgaaccgggtgagagacctgcgccaccccaaaagaatcctgttctgcacagactattgccctgactgtggaaatcggagcttctatgacctcgaagccgatcagtactgttgttag

SEQ ID NO: 58510 - DNA, 522 bp, Artificial Sequence
  Description of Artificial Sequence: Synthetic coding sequence
atgtttgcaagaggatctcgtaggcggcgaagtggaagagcaccccctgaggcagaggatccggataggggccaaccatgtaactcatgccgggagcagtgtcctggattcttgcttcacggctggagaaaaatttgtcagcattgtaaatgtcctcgagaggaacacgcggtgcacgccgtgcctgtggacctggaacgcattatgtgtaggctgatctctgatttccagagacactcaatctctgacgacgattccggttgtgcttcagaagagtacgcctgggtcccccctggccttaagccagagcaagtctaccagttcttctcctgcctgccggaggataaggtgccttacgtcaacagcccaggggagaagtaccgcataaaacagttgttacaccagcttccaccacacgattcagaggttaggagagaaaaaacgggcagggcttgtcaggcccagcacacagcctgggccaatgccggacaggggcaacgtcgcaagggcgagctgatctag

SEQ ID NO: 58511 - DNA, 1848 bp, Artificial Sequence
  Description of Artificial Sequence: Synthetic coding sequence
atgtttgcacgcggaagccggaggagacgatctgggagagccccacctgaggcagaggatccggatcgcggacaaccctgtaacagctgccgggaacagtgccccggttttctgctgcatggatggcggaagatctgtcagcattgtaaatgtccgagagaggaacacgccgtccacgccgtaccagtcgatctcgagcgtataatgtgtcgcctaattagcgatttccagcgacactcaatatccgacgatgacagcgggtgtgcatcagaagaatacgcttgggtgccacctggactgaaaccagagcaggtttatcagttcttttcttgcctgcctgaggacaaagtcccctacgtgaatagcccaggtgagaagtaccgtatcaagcagctccttcatcaactgccgcctcacgattctgaggcacaatactgtactgctctcgaggaggaagagaagaaagagctcagagccttttcccaacagaggaaacgtgaaaacctgggtcgcggaatagttagaatcttccctgtgactatcaccggtgctatctgcgaagagtgcgggaagcagattgggggaggggatatagctgtgtttgcctctcgagccggtctaggcgcatgctggcatccccagtgttttgtgtgtacaacatgccaggagctcctagtagatttaatatatttctaccacgtcggaaaagtgtactgtggcagacaccatgcggagtgtctgcgacccagatgccaggcctgcgatgagataattttctccccagagtgtacagaagcggagggcaggcactggcacatggatcacttttgctgtttcgaatgcgaggcttccttagggggtcaacgctatgttatgcggcagagcagaccacactgttgcgcatgctatgaagccaggcacgcggagtactgcgatggatgtggggagcacattggacttgaccagggccagatggcttatgagggccagcactggcacgcttctgatcggtgcttctgttgttcccgctgcgggagagccttgcttggccgtcccttcttgcccagacgcggtttgatcttttgttctcgagcatgtagtctgggatccgagcctacagctcctggaccgagcagacgaagctggtcggctgggcctgtgaccgccccacttgccgcttcaaccgcctccttctcagctgtgaaaggggcttcggagacaaccaccaagggcacgtcaactgaactggcccctgccactggtccagaagaaccgtctcgatttttgcggggagccccacatcggcactcgatgcccgagctcgggttacgctccgtgcccgagcctcccccagagagtcctggccagccaaacctgagacccgacgattctgctttcggtagacaatccacacccagggtatcctttcgggacccgttggtgtccgagggtggtccacggaggacattgtccgcacctcctgcccagcgcaggcgcccacgctctcctccccctcgggcacctagccggaggaggcaccaccatcacaatcaccaccaccaccacaaccggcacccgtcaaggaggcggcactatcagtgcgatgcagggtccggcagcgactccgagagttgctcttcctccccatcgtcatcatcaagcgaatctagtgaagatgatggcttttttctcggagagcggattcctctgccgcctcacctgtgccggccaatgccggctcaggataccgcaatggagacattcaactcgccctccctgagcctccccagggattccagggctggtatgcccaggcaggcacgagataaaaactgtatagtggcctag

SEQ ID NO: 58512 - DNA, 453 bp, Artificial Sequence
  Description of Artificial Sequence: Synthetic coding sequence
atgtttgcacggggttcacggagaagacgaagcggtcgggctcccccagaagcagaggatcctgacaggggccagccctgtaatagttgtcgtgagcagtgccctgggtttctgctgcatgggtggcgtaagatttgtcagcattgtaagtgtcccagggaagagcacgcagtacacgctgttcctgtggacctcgaacgaataatgtgtaggctcatcagcgacttccagagacatagcataagcgatgatgactcagggtgtgctagcgaggaatatgcatgggtcccccctggcctgaagccagagcaggttacgcggggacaaccttccacacttgccgttcagtgggtgcacactaacgcccatacccacacgcatactcaggtaggcacctacttctggggatacgcccgagtttgttctcagactgaggggccatccggcccatag

SEQ ID NO: 58513 - DNA, 996 bp, Artificial Sequence
  Description of Artificial Sequence: Synthetic coding sequence
tgacccccactgcctcgcctgtgcccagcaccacctcactcaggtaggtgcccctccttacccagtgcggctcagccacctgaggccgaggatcctgaccgcggtcagccctgtaactcatgtcgtgaacagtgtcccggatttttgttacacgggtggcgtaaaatctgtcagcactgcaagtgtcctagggaggagcatgcagtccacgcagttcccgtcgatctggagagaatcatgtgccgccttataagtgacttccagcggcactccatcagcgacgacgattcagggtgcgcaagcgaagagtatgcatgggtgcccccaggcctaaaaccagagcaggtttatcagttcttttcatgcctgccggaagacaaggtcccctacgtgaacagcccaggagaaaagtacagaatcaagcagctgctgcatcagctgccgccacatgatagtgaagcgcagtattgtacagccctggaggaagaggagaagaaggagcttcgagcgttctctcaacaaagaaagagagagaacttgggtcggggaattgtccgcatctttccagtcaccatcacgggcgctatttgtgaagaatgcggcaaacagatcgggggaggcgatatagctgtattcgctagtagagccggactcggagcgtgctggcacccgcagtgctttgtctgcaccacctgccaagagttgctcgttgacctgatctacttctatcacgtcggaaaggtttactgcgggagacatcatgctgagtgcttacgccctaggtgtcaggcttgcgacgagattatattcagtcctgagtgtaccgaggcagagggacgtcattggcacatggaccacttctgttgcttcgagtgcgaagcttcattgggaggtcagagatatgtgatgcggcagtcgcgcccacactgttgcgcatgctatgaggcaagacacgccgaatattgtgatggttgtggagagcacatcggcggttag

SEQ ID NO: 58514 - DNA, 1887 bp, Artificial Sequence
  Description of Artificial Sequence: Synthetic coding sequence
tgagtagaaggtagagccctcaccagccccagcttactgcccagactcacgaggccttgcatttgccctcgtccgttgcaacccccagaggccgaggaccctgatcgcggacagccctgcaatagctgtcgcgaacaatgccccggattccttctgcatgggtggcgcaagatttgtcagcactgcaaatgccccagagaggagcacgcggtgcacgctgtacccgtagacttggagcggatcatgtgtcgattaatttccgactttcaacggcactcaatatctgatgatgacagcggctgcgcctctgaagagtacgcatgggttccaccagggctcaaacccgagcaggtataccagttcttcagttgtctcccagaggacaaggtcccttacgttaattccccaggggagaagtacaggattaagcagctgttacaccagctgcctccacacgactccgaggcccagtactgcactgctctcgaggaagaagaaaaaaaagaactcagagccttttcacagcagagaaagagggaaaaccttggtcggggaattgtgaggatctttcctgtgacaatcactggagctatatgcgaggagtgtggcaaacagatcgggggtggggatattgccgtcttcgcaagtcgcgctgggctgggagcctgttggcacccacagtgcttcgtctgcacaacctgccaggagctgctcgtggatttgatctacttctaccatgtcggcaaagtatattgcgggaggcatcatgctgagtgccttcggccaaggtgccaggcgtgtgatgaaatcattttctccccagagtgcacagaggcagagggacggcactggcacatggatcacttctgctgttttgaatgcgaggcctcgctaggtggccagagatatgtgatgcggcagtcacgtccacactgctgcgcctgctatgaggctagacacgcggaatactgtgatggttgcggagagcatataggcctcgatcaaggccagatggcctacgaaggacagcactggcatgcttctgaccgttgcttctgctgcagccggtgcggtcgcgctctgctgggcagaccatttcttcctcgccgagggttgatcttctgctctagagcctgtagcctgggcagtgaacctactgcgcctggcccatcccgcagatcatggagtgcgggtccagttacagcaccactcgctgcaagtactgccagcttcagcgccgtgaagggcgcttccgaaaccacaacgaaagggactagcacagagttagctcccgctaccggtcctgaagaacctagtagattcctgagaggcgcaccccaccgccacagcatgcccgagctggggctgagatcagtgccagagcccccacccgagtcacccggacagcccaatttgcgaccagacgactcggccttcggcaggcagtccacccctcgagtgtccttcagagatcccctggtcagcgagggagggcctcggaggaccctctcagcaccgcctgctcagcgacgccgaccaagaagtccacctccacgggctcccagcagacgaagacatcaccatcataaccaccatcaccaccacaataggcaccccagtaggcggaggcactaccagtgcgatgctggatccggctccgatagcgaatcctgcagctccagcccatcttcaagctcttccgaatcctcagaggatgatgggtttttcttgggggagcgaatccccctgccaccgcacctgtgtcggcctatgccagcacaggatacagctatggagacttttaactctccatcactgagtctaccgagagacagcagagctggtatgcctagacaggcaagagataagaattgcatagtggcgtag

SEQ ID NO: 58515 - DNA, 1605 bp, Artificial Sequence
  Description of Artificial Sequence: Synthetic coding sequence
atgtgtcggcttatttccgactttcagaggcacagtatttccgatgacgatagcggttgcgcgtccgaagagtatgcatgggttcctccagggctgaagccagagcaggtcactcgtggacagccatcaaccctggctgtccagtgggtgcatacaaatgcacacactcatactcatacgcaggctcagtactgtacagccctcgaggaagaagaaaaaaaggaactgagggcattttcacagcaacggaagcgggagaacctcggaagaggcattgtcaggatcttccccgttaccattacgggtgccatatgtgaggagtgtgggaaacagattgggggaggagacatcgcagtcttcgcatctagggctggcttaggagcgtgttggcatccccagtgcttcgtctgtactacctgccaagagctgctggtggatcttatctacttttaccacgtggggaaggtttattgcggccgacatcatgctgagtgcctgcggccacgctgccaggcctgtgatgagattattttctccccagaatgcacggaagcagagggtaggcactggcatatggatcacttttgctgctttgaatgcgaagcctcacttggcggtcagcgttatgtgatgcggcagagcagaccacactgctgcgcctgttacgaagctaggcatgcagagtattgtgacggttgtggggagcacatcgggctcgatcaaggccagatggcctacgaaggccaacactggcacgcttccgacagatgtttttgttgtagccggtgcggtagggctctcctggggaggccgtttttaccacggagggggctgatcttttgctcccgtgcctgctctcttgggtccgagcccaccgctcctgggccatcacgtaggtcctggtcagctgggccagtcaccgctccactagccgctagcactgccagtttctcagctgttaagggcgcatccgagaccacgaccaagggcactagcactgagcttgctccagctacagggccagaagagccctcacggttcctccgtggtgcgccacatcgccactctatgcctgaacttggccttcgtagcgtgccagagccaccaccggagtcccctggacagcctaatctcagaccagacgactccgcatttggcagacagagcacgcctcgcgtgagcttccgggaccctctcgtatcagagggaggtccacgaaggacgctgtccgctcccccagctcagcgcagacgtcccagatcacctcccccacgggcacccagcagacgtcgacaccaccaccacaatcaccaccaccaccacaaccggcaccccagtagacgcagacactatcagtgcgacgccggttccggcagcgattcagagtcttgctcatcttctcccagctcatcgtcctccgagagctcggaagatgatggcttctttctcggtgaacgcattcccctgcctccccatctctgccgcccaatgccggctcaggataccgctatggagacttttaactccccttctttgagtcttcctcgggacagtcgggctgggatgccaagacaggcaagggataaaaattgcattgtcgcctag

SEQ ID NO: 58516 - DNA, 1320 bp, Artificial Sequence
  Description of Artificial Sequence: Synthetic coding sequence
atgttcgctagggggtcgagacggaggcgatcagggagagctccccctgaggccgaggacccagatagaggccaaccctgcaatagctgtagagagcaatgtccaggcttcctcctccacgggtggagaaaaatctgccagcactgtaagtgtcccagagaggagcacgctgtacatgccgttcctgtagacttggaacgtatcatgtgtaggttgatctctgacttccaaagacacagcatctcggatgatgactcaggctgcgctagcgaggaatatgcatgggttcctcccggactcaagccggagcaggtgacacggggtcagcccagtacgttggccgtccaatgggtgcatacgaatgcccacactcacacacacactcaggctcagtattgtactgctctcgaagaggaagagaaaaaggagctcagagcgttctcgcagcagcgaaagcgcgaaaatttaggacggggaattgtgagaatctttcccgtgactatcaccggagccatttgcgaagagtgtggtaaacagattggtggcggagacattgcagtgttcgcttctagagcagggctgggagcatgctggcacccgcaatgtttcgtctgtactacttgtcaggagcttctggttgatcttatttatttttatcatgtcgggaaggtctattgcgggcgtcaccacgctgagtgcctcaggccaagatgtcaggcgtgcgatgagatcatcttttcccccgagtgtacccctgggccacgtcctggtccagaggagccctcccggttcttgcgcggtgcgcctcatcgccattctatgccagagctgggcctacggagtgtacctgagccacctcctgaatcacctggccaaccgaatctgaggcccgatgactccgccttcgggcgtcaaagcacaccacgcgtgtctttccgcgaccctctggtctccgaaggaggccctaggcggacgttgtctgcacctcctgcccaaagacggagaaggcaccaccaccacaaccatcaccatcaccacaatagacacccgagtcgccgacgacactatcagtgcgatgccggatccggttccgactcagagtcttgctcttcctccccaagttccagcagcagtgagagctcagaggacgacggattttttctcggagagcggattcccttacctccccacctttgtagacccatgcctgcacaggacaccgcaatggagaccttcaactccccctcattgagcttacccagagacagccgtgccggaatgcccagacaggcaagggataaaaattgcatagtggcctag

SEQ ID NO: 58517 - DNA, 1644 bp, Artificial Sequence
  Description of Artificial Sequence: Synthetic coding sequence
atgtgtagactgatcagtgactttcaacgtcattccattagtgacgatgactctggatgcgcctccgaagaatacgcatgggtgccacctggtctcaaaccggagcaggtctatcagtttttcagctgcctcccagaagacaaggtaccctacgtcaattctcctggcgagaagtatcgtattaagcagttgctgcaccagctcccacctcatgactctgaggcgcagtattgtacagcgctagaggaggaggaaaagaaggagctcagggccttcagccagcagcgcaaacgggagaatctcgggagaggcatcgtccgaatatttccagtgactataaccggcgcaatttgcgaggaatgtgggaagcagatcggcggtggggatatcgccgtgttcgcttcccgggcaggtctcggcgcttgttggcaccctcagtgttttgtctgcaccacatgccaagagctccttgttgatctcatctacttttaccatgttgggaaagtttattgtggcagacatcatgctgagtgcctgcgtcccaggtgtcaagcctgcgacgaaataatctttagccccgagtgtaccgaggctgaaggcaggcattggcacatggatcatttttgctgctttgagtgtgaggcttccctgggtggccaacgatatgtgatgaggcagtccaggccccattgttgcgcttgctatgaggccagacacgctgaatactgtgatggatgtggggagcatatcggcctggatcagggtcagatggcatacgaaggtcagcactggcatgcgagtgacagatgcttttgctgctctaggtgcggaagggccctgcttggcaggcctttcttaccacggaggggactgattttttgcagcagggcttgttcactgggctctgaacccactgccccaggcccttcccgcagaagctggagcgctgggcctgtaaccgcacccctcgctgcctctaccgcatccttcagtgcagtgaagggagcctctgagacgacaactaagggcacgagcacggagttggcaccagccaccggtcccgaagagccttcacgatttctgagaggggctccccatcgtcacagcatgcctgagctgggactgaggagcgtacccgaaccgccacccgagtcacccggacagcccaatctgcggccagacgacagcgcatttgggagacagagcactcccagggtgtcctttcgcgaccctttagtgtccgagggtggacctcggcgtactttaagcgcccctcccgcacagcgtcggagacccagaagcccgcctcctagagcccctagtcgtaggagacaccaccaccacaaccaccaccatcatcacaaccgccacccctcccggagacgtcactatcagtgcgacgcgggttctggctccgattccgagtcctgttcatcttctcctagctccagttcctccgagagtagcgaggatgatggcttctttcttggagaacggattcctctcccgcctcacctgtgccggcctatgcccgcacaggatacagctatggaaacgtttaactctccctccctttcgttaccgagagacagtcgcgctggtatgcccaggcaggcaagggacaagaactgtattgttgcttag

SEQ ID NO: 58518 - DNA, 1665 bp, Artificial Sequence
  Description of Artificial Sequence: Synthetic coding sequence
atgcacattaactttcatcggcctccagccaagccaaagccacaaaaggttaaggaaatagaatatcagaacctaagattccccgtagacctgagtaatccattcgccgtcgctacggtgctgaatcaggaaccgggaaagctgaagataaaggaactcagagaggtgctcgaccagggcacggagatctctaaaaccagacagatgaaagaggccttattcgagcagaaggtccggcaggatatccacgaagaaatggaaaatcatctcaagtggcaggtgcaccttgggaaggatccaatgtcatttaagttaaagaaggagctgacggaagagtggcagaaagcctgtgcaaaatacaagctggacaggggagaccccattctagatgaagaattccaacggctaaaaaccgaagtctctcacaaaagagtggtgagaaatcaggaggaaaaaattaaggaatttcaccccacattcgatcccctcatcaacaatacctggctttccaggagtagagctcagaaaagatttcaacaagttgccagaaaagtcatgattcaaggaaggctgtttaatatgctttccgctgtccgggagatggataaagaatccatccttcggaagattggtcaggcgaagcagtctattgcccaggaggcaaatttctttaagttctttttgcggcgtatctctcaggatgactataccagcagattcagcgtatctccaaaggaagtgttaccctttgctttccctgattgttcaccacctcaggatagcaatgagctagcgcctgacggcctgggcctggttcccatcaaatcgagcgaggtgcagatcaagcagtcttatagtttcttcaatctgcaggttccccagctgtataaaatcaagcggtatcaacccttcagcgtccacaagtcaagcacctcctataggccacagaagctggctcgcgctctgaagcagggtgcggaagatgaggtcacaaccattactgctctaccaaagcaagacagcaccacacaactttccggtaagacttccgtcctctcaatgaagcccccagaggccctggcaatgtcactggattatgatccactctatgtgtttaaccccaatcctggattgtttgctgtcatgcatccattaacttacgccgaaaccctgatcgattaccatttgtgcagccaccctaaatacaaattcaccaaggagtcccgacatggttcaagcatccccgtgacgcagaagcaatttctccatcatactgatatcatcccaggcatcatgcattggaagagtttccagagtctggtcctgtctagcctacccgatccctccaagatggagacgaccaagagttgtgactccttcaactcctttatgctccctattgacgtgcctgctatcctggacgctctcccagaggaagaccgccttgaaacggtggagcgcgaactctgtgaacaaaatgtagaagtgatgcttacccctgaaatgatcaaagtcgagttcccaatgttgaattataaggatatccgcaaagaaaaggaggtcaaagatcaggcccagcccgctgaaaaggccggagagaaactgcttgaggaaatgaggaatctccggggaaaggccctcaatacatatctcattctggaatag

SEQ ID NO: 58519 - DNA, 2523 bp, Artificial Sequence
  Description of Artificial Sequence: Synthetic coding sequence
atggccgtcgtgaagactccatctcgaggcctgaagaacgccaaagagccttttaataacgcatcccctcatttgctgaagaacctggttgaggagccaaaaaagcgcaaggaagtgcccaatcacctgctggagagtaaagtctatgcaaagttagtgaataacaaagtgatccaggctcgaccaggcatcatacactttgggggttatcaagtggagaaacaacaccagcagattcttcatctcgtgaatgtgagtaacgaggacaccagggtgcatatcttacctccccagaccaaatacttcgagatcaattacgtccgcaaggagcatcacttagtgccgggtttaagcctcaccgtgactgtaacattttctcccgacgaatggcgctattattacgactgcataagggtacactgtaagggagatgatactcttctcgtccctattcatgcttatccagtcatgaattccctggacttccccagcttcattaatttgtcaaatgtgcttctgggcgagtctaagacttacgttattcccctccaatgctcctgtcctgtcgacttcgagttctatattacactaatacagagccatcaagccttcgccatcgaacctactagtgggatcattcccgcaaatggcaagatgacggtgacaataaagtttacgcctttccaatacggtacggcccagattaagatgcagctctggatctcccagttcaatagtcagccctatgaatgtgtctttaccggaacctgttaccccaacatggccctgcctctcgaagaattcgagcggttgaacaccttgtctaagaaggtgaatgtgcccccagagaaagcgatgatgcatattaatttccatagaccccctgcaaagcccaaaccccagaaagtcaaggagattgagtatcagaacctcaggttcccggtcgacctgagcaacccctttgccgtggctaccgtacttaaccaggagcccggtaaactcaagataaaggaattaagggaggtccttgaccagggcacagaaatctctaaaacaaggcagatgaaggaggctctgttcgagcagaaggtgcgacaagacatccacgaagaaatggagaaccacctgaagtggcaggtgcacctgggaaaggatcccatgtcttttaagctcaagaaggagctcaccgaagaatggcagaaagcatgcgccaagtacaaactcgacaggggagacccgatcttggacgaagaatttcaacgattaaagaccgaggtatctcacaagcgtgtggtcaggaaccaagaagaaaaaatcaaggagtttcacccaacctttgatcctttgattaataatacctggctatcacgcagtcgcgcacagaaaaggttccagcaggttgccagaaaggtaatgatacaagggcgactgtttaatatgctgagcgctgtaagagagatggataaggaatctatccttagaaaaatcgggcaggctaagcagtctatcgcccaggaagcaaacttcttcaagttttttctgcggcgaatttcacaagatgactacacaagtaggttcagtgtatctcctaaagaggttctgccctttgctttcccggactgcagccctccacaggacagcaatgagctcgcccctgacggacttggcttggtgccaataaaatcatctgaagtgcaaattaagcagagctacagtttttttaacttgcaggtgccccaactgtataagataaaaaggtaccagcccttctccgtgcataaaagttcaactagttatcgcccacagaagttagctcgggctctcaagcagggcgctgaggacgaagttacaacaataaccgctcttccgaagcaggactcaacaacacagctgagtgggaaaacatctgtactatctatgaagcccccagaagccttggcaatgtctttggattacgaccccctgtatgtctttaaccctaatcctgggctgtttgcagtcatgcatccgttgacctacgcagagactttgatcgactaccacctttgttcacatccaaagtataagtttaccaaggagtcccggcatgggtcctctattcctgtgacacagaaacagtttctgcaccacacagacataattccgggtatcatgcattggaaaagcttccagtctctcgttctctcgtctctgccagaccccagcaagatggagaccactaagagctgcgactcttttaattctttcatgctcccaatagatgtgcccgctatcttagatgctctccccgaagaagataggcttgagactgtcgagagggagttgtgcgagcagaatgtcgaggtgatgctgaccccagaaatgataaaggtcgaatttccaatgttaaactacaaagacatacgtaaggaaaaagaagtgaaagaccaggcccagccagccgagaaagctggagaaaagttgctggaggagatgcgaaacctgcggggtaaagccctgaatacctatttgatattggagtag

SEQ ID NO: 58520 - DNA, 564 bp, Artificial Sequence
  Description of Artificial Sequence: Synthetic coding sequence
atggccgttgtaaagactcctagccgcggtctcaagaacgccaaagaaccattcaataatgccagccctcaccttctaaaaaacctggtcgaagaaccaaagaagcggaaggaggttccaaaccatctcctggagtcaaaagtgtatgccaagctcgtgaacaacaaggtgatacaagccagacccggtattatccatttcggtggctatcaggttgaaaaacagcaccagcagattcttcatctggtaaacgtcagcaatgaagacaccagggtgcacatcctccccccacaaacaaaatatttcgaaataaattatgtgcgaaaggaacatcatttggtgccgggtttaagtctgacagtgacagtgacattttctccagacgaatggcgttattattacgactgcatcagagtgcattgtaaaggtgacgatacactgctggtgccaatccatgcatatccggtcatgaactccctggattttcccagttttatcaacctttccaacgtgttgctgggtgagtctctgcctaattcagtattccttgtccccgataactag

SEQ ID NO: 58521 - DNA, 1200 bp, Artificial Sequence
  Description of Artificial Sequence: Synthetic coding sequence
taacacccgacttttgacccacttatcaacaacacctggctcagtcgttcacgggctcagaaacgattccagcaagttgctagaaaagtcatgatccaggggaggctatttaacatgctttcggctgtgagggagatggacaaggaaagtatcttgcgaaagatcggccaggcaaaacaatctatagcccaggaagctaatttctttaaattcttcctacgacgtatctcccaagacgattataccagcagattctccgtcagtcctaaggaggtgttaccctttgctttcccggattgcagccccccacaggactctaacgaattagctccagacgggctggggctggtgccaatcaaatccagtgaggtgcagattaaacagtcttatagcttctttaatttacaggtgcctcagctgtataagattaaacgttatcagcccttcagtgtacataagtcttcgactagctatcgcccacagaagctcgccagagctctgaagcaaggcgctgaggatgaagttacaacaatcactgcactgccaaagcaggatagcaccacgcagctttctggaaagacaagcgtcctgagtatgaagccgccagaagccctagctatgagcttggactatgacccactctacgtgtttaaccctaatcctggactgtttgcagtgatgcacccattgacctacgctgaaactttgattgactaccacctgtgttcacaccctaaatataaattcacaaaggagtcacggcatggtagctcaatccccgttactcagaagcagtttctgcatcacaccgacatcatccccggaattatgcactggaaaagtttccaatctctggtccttagtagtctgccagacccttctaagatggaaaccaccaaatcctgcgactctttcaacagtttcatgcttcccatagatgtccctgctatccttgacgctctgccagaggaggatcgactggagacggtggagcgcgagttgtgcgagcagaacgttgaagtaatgcttactcccgaaatgattaaggttgagtttcctatgttgaactacaaggacatacgaaaagaaaaggaagtgaaagatcaggctcaaccagctgagaaggcgggagagaagctgctggaggaaatgcgcaatttgcggggaaaagccctgaatacctatttgatcctcgagtag

SEQ ID NO: 58522 - DNA, 1665 bp, Artificial Sequence
  Description of Artificial Sequence: Synthetic coding sequence
atgcacatcaatttccacaggcctcctgccaagcctaagcctcagaaagtgaaagagatcgaataccagaacctgaggtttcccgtggatcttagcaatccctttgcggtagccacagtactcaatcaggaacccggaaagctcaagataaaggagcttcgagaggtgctggaccagggtaccgaaatttcaaagacacgacagatgaaggaggcgcttttcgagcagaaagtcagacaggatatacacgaggagatggaaaatcacctgaagtggcaggtccatttagggaaggaccccatgagctttaagctgaagaaagaactgacagaagagtggcagaaagcctgcgccaagtacaaattagacagaggggatcctattttagatgaggaattccaacggcttaaaaccgaggtaagccacaagcgggtcgtgaggaatcaagaagagaagattaaggagtttcaccccactttcgaccccctgatcaataacacgtggttatcccggagtagggctcagaaacggtttcaacaggttgctagaaaggtgatgattcagggtaggctgtttaatatgctgagcgctgtccgtgagatggacaaggaatccattctgcggaagattggccaagctaaacagtccattgctcaggaagctaacttctttaaattctttctgagaagaattagtcaggacgactacacaagcagattctcagtgtcccctaaagaggttctgccgttcgcttttcctgactgcagtccccctcaagatagcaacgagctggcacccgatggactcggcctcgtaccgattaagtcctccgaggtccagattaagcagtcttactctttttttaatctccaggtgccacaactgtacaagattaagcgataccagccattttccgtgcacaagagtagcacaagttatcgaccccagaaactggcaagagccttaaaacaaggcgcagaagacgaagttactacaatcacggccctccctaagcaagactccaccactcagctgtctggtaagacatccgttctgagtatgaagcctccggaggcattggccatgtctctcgactatgaccctctgtatgtgtttaacccaaaccctggcctgtttgcggtgatgcatccactgacatacgccgaaaccttaatagattatcacctctgtagccatcccaagtataaattcacgaaagagagccggcacggtagcagcatcccagtcacccagaagcagttcttacatcacacggatattattccagggattatgcattggaaatcattccagtctctggttctgagctcactccctgatccctccaaaatggagaccactaagtcttgtgactctttcaacagttttatgctgccgattgatgtccctgcgatcctggacgctctgccagaggaggatcgactagagacggtggagcgagaactatgcgagcaaaacgttgaggtgatgttaacgcccgagatgattaaggttgagtttcctatgctcaattataaggacatcaggaaagagaaagaagtcaaggaccaggcccagcctgctgagaaggctggcgagaaattacttgaggaaatgagaaatttacgaggtaaagctctgaatacctacctgatactcgagtag

SEQ ID NO: 58523 - DNA, 555 bp, Artificial Sequence
  Description of Artificial Sequence: Synthetic coding sequence
atggcttcgcctgccgcatcctccgttcgccctcctagaccaaagaaggagccgcagactctggtgatcccaaaaaatgcagctgaagagcagaagttgaaactggagaggttgatgaagaaccccgacaaagccgtaccaattcccgagaagatgagcgaatgggccccaaggcctccaccagaattcgtacgcgacgtgatgggttcctccgccggagccggttccggagagttccacgtttatagacacctgagacgcagagagtaccaaagacaggactacatggacgccatggcggagaagcagaagctggacgccgaattccagaagagactggagaaaaataagatcgcggctgaggagcagacagcaaaacgcaggaagaaaaggcagaagcttaaggaaaaaaagttgctcgctaaaaagatgaagctcgagcagaagaagcaggaaggcccaggccagcctaaagaacagggcagcagctcctcggctgaagcctctggtactgaggaggaggaggaggtacccagtttcactatgggaaggtag

SEQ ID NO: 58524 - DNA, 786 bp, Artificial Sequence
  Description of Artificial Sequence: Synthetic coding sequence
atggctcagaacctcaaggacctcgcaggcaggctacctgctgggcctcgcggaatgggtaccgctctgaaactgctcctgggtgcaggggctgttgcgtatggagtgagggaaagcgtgttcaccgtcgagggcggtcaccgggcaattttcttcaataggatcggcggagtccagcaggacacaatcttggctgagggtctccatttccggatcccatggtttcagtatcctattatctacgacatacgagctcgaccaagaaaaatctcctctccaactggaagtaaggacctgcagatggtgaacatcagtctgcgcgtactgtctcgacccaacgctcaggagctcccaagtatgtatcagaggctcggcttggactacgaggagagagtgttgccttccatcgtgaacgaggtgctgaaatccgtcgttgccaaatttaacgcaagtcagttaataactcaacgggcacaggtgtccttgttgattaggagagaactgacagaaagggccaaggatttttcactgatactggatgatgtcgctatcactgagttgtctttcagtagggaatatacagccgcagtggaagcaaagcaggtcgccctgtcgaaaaatcccggatatattaaactgagaaagatacgggctgcgcaaaacatttctaagactatcgcgaccagtcagaatagaatttatctgacagccgacaatctagtactgaatctgcaggacgagtcttttactaggggaagcgatagcttgatcaaggggaaaaagtag

SEQ ID NO: 58525 - DNA, 2769 bp, Artificial Sequence
  Description of Artificial Sequence: Synthetic coding sequence
atggataagaaaagtttcgagatggtccttgacgaaatacgaaaggtggtggacctgctaaggtacttctcttgggcagaaccgcagttgaaggccatgaaggcgctccagcataagatggttgccgttcaaccaactgaggtcgtgaatattctgaactgcttcaccttttcaaaagataaattggtggctctggagcttctggcttccaacatcatcgatgcccagaacagtcgcccaatagaggatctgtttcgcgtcaacatgtctgagaagaagaggtgtaaacgcatcctcgaacaagctttcaaaggtgggtgcaaggctcctcacgcaatgatctcttcttgtggtaccatcccaggcaacccataccccaagggcagaccctctcgcatcaatggaatttttccaggcactcccctgaagaaggatggagaggagtgcacgaacgaaggcaagggaatcgccgcaagaattttgggtccatccaaaccccctcctagcacttacaatccccacaagccagtgccatacccaatcccaccttgcaggccccacgccactattgcaccaagtgcgtataacaacgcaggtctggtgcccttggcaaacgtgatcgccccacccccacctccctacacacctaatcccgtcggcactgagaatgaggatctgagtaatccaagcaaaccgattcagaatcaaactttttctacaccagcatctcaactgttctctccccatggctctaatccttctacaccagctgcgaccccggtgccgacagcttctcccgtgaaggcaattaatcatccctctgccagcgctgcagccactgtgagcggaatgaacttactgaatactgtcctgcccgtttttcccggacaggtctcctcagctgtgcacactccccagccctcgatcccgaatcctacggtgatccggaccccaagcctccctacagctccagttacatctattcactctaccactaccacaccggtccctagtattttttcaggcctggtgtcactgcctggcccatccgctacacccaccgcagccacccccactcctggccctacacctcggtctactctcggctcaagtgaggcctttgcttctacatcagctccatttactagtcttcccttcagtaccagttctagtgctgccagtacctctaatccaaactccgcatcattgtcttccgtcttcgccggactcccactgccgcttccacctacttctcagggtctctctaatcccactcctgtcattgcaggaggaagcactccttccgttgctggacctctgggagtgaactccccgctgctcagcgccttaaaggggtttctcacatctaatgacactaatctgatcaactcatccgccttatccagtgccgtcacaagtggcctggcctccttaagctcactgaccttgcagaattcagacagctccgctagcgcccctaacaaatgttatgcacctagtgctattccaacccctcagagaacgtccactccagggttggctctgttccctggtctgcccagtcccgtcgctaactcaacatctacccctctgactctgcccgttcagagccccctggcaaccgctgcatccgcttcaactagtgtaccggtctcatgcggcagctccgcaagcctcctccggggacctcaccccggtacttcggacttgcacattagcagcacccctgcagcaacaaccctacccgtgatgattaagaccgaacccactagtccaacgccaagcgcctttaaaggcccatcacattcaggcaatccctctcatggcaccctcgggctctccggcaccctgggccgagcatacaccagcacttccgtacctattagcctgagcgcctgcctgaaccctgccctgagtggtctaagtagcctgtcaacacccttgaacgggagcaatcctttatcaagtatctcactgccaccacacggctcttcaacaccaatcgctccggtttttacggccctccccagctttacctcgctgacgaacaacttcccactcaccggaaacccctccctcaacccatcagtgtctttgcccggttccctgattgccactagctccacagctgctaccagtaccagcctgccccatccaagtagcacagctgctgtgttgagcggtctgagcgccagtgcccctgtgtcggccgcacccttccccctcaacctgtcaacagcggtgcctagtctcttttccgtgacccagggcccactcagctcatcgaatccttcttatccaggcttctcagtatccaatacgccctcggtgacgccagcgctcccctcattccctggattgcaggccccttctactgtggctgccgttacgcctctccctgttgccgctacagctccatcccccgctcctgttctacctggttttgcctctgcatttagcagtaacttcaattcggccctagtggctcaggccggactgtcctctggactgcaggcggcagggtcttcagtgttccctggcctcctgtctttgcccggaatacccggattcccacagaatcccagtcaatctagccttcaggaactgcaacataacgccgctgcccagtccgctcttctccagcaggtacattctgctagcgccctcgaaagttatcctgctcagccggatggcttcccaagttatcctagcgccccaggaacgcccttctccctgcagccctctctgtctcaatctggttggcagtag

SEQ ID NO: 58526 - DNA, 2835 bp, Artificial Sequence
  Description of Artificial Sequence: Synthetic coding sequence
atggacaaaaaaagttttgaaatggtgttggacgagattagaaaagcagtgttgacggagtataagctcaaggccatcgaatacgtgcatggatatttcagctcggagcaggtggtcgacctccttcggtacttctcctgggcagagcctcaacttaaggctatgaaagccctccaacataagatggtggcagtacagcccaccgaggtggtcaacatcctgaactgttttacgttttctaaagacaaactggttgctctcgagctcctcgctagcaacataatcgatgctcagaatagccggcctatcgaggatctgtttcgggtcaacatgtctgaaaaaaagaggtgtaagcggatcttggaacaggcttttaaaggcggatgcaaggccccacacgccatgattagctcttgtgggacaattcctgggaacccctacccaaaaggacggcctagtagaatcaacggtattttccccggaacgccccttaagaaagatggtgaagaatgcaccaatgaaggtaaagggattgcggctaggatactgggcccaagtaagccacctcctagcacatataacccccacaagccggtgccataccccattccgccttgccgccctcatgctaccatcgccccaagtgcttacaataacgcagggctagtacccctcgctaatgttatcgcccctcctccccctccctatactccaaatccggtcggcaccgagaatgaagatctctcgaatcccagtaagcccatacagaaccagactttttccactccggcatctcagctcttctctccacatggatccaatcctagtacccccgcagccacccctgtacctactgcttcacctgtgaaagcaataaatcacccttcagcgagtgctgccgctacggtctcaggtatgaacttgctgaataccgtcctgcccgtattccccggacaggtgtctagtgcggtacacacaccccaacctagcatccccaatccgacggtgatccggacccctagtctcccgaccgcacccgtaacttccattcattcaaccactaccactccagtgccttctatcttttctgggctagtgagtcttcccggtccctctgctacgcccaccgccgctactccgacacccggaccaacccctaggtccacacttggcagctccgaggcgttcgcctccacctcggctccatttactagcctgcccttctctaccagttcgtctgctgccagcacaagcaacccaaacagcgcttctctgagttctgtgtttgcaggcctgccgctgccactcccccctaccagccaggggctgtctaaccccaccccagtaattgcaggaggatccacaccgagtgtggctggccctctaggagttaacagccccttgctgagcgctttgaaagggttcttgaccagcaacgacaccaatctcataaattcgtccgctctgtctagtgctgtaaccagcgggctggcctccctgtcatccctcacattgcaaaactctgactcctccgcgtccgccccaaacaaatgctatgcccctagcgccattccaacaccacagcgcacgagcactcctggcttagcactgttccctggacttccaagccctgtggcgaactccacgtcgactccgctgactctaccagtgcaaagcccgttggccaccgcagctagtgcaagtactagtgtgcctgtgtcctgcggatcttctgcgagcttattgcggggacctcaccctggcacttctgacttgcacatctctagcaccccagctgcaactactctgcccgtcatgatcaaaacagagccaacaagtcccacacctagcgcatttaagggcccaagccatagtggaaacccctctcacgggacgctggggctttctggaaccttaggcagggcttacaccagtacgagcgtgcccatttccctgtccgcttgtctcaatcctgcactgagtggcctttcatcactgagcactcctttgaatggaagcaaccccctcagtagcatatcattaccaccacatggttccagtaccccgattgcccctgttttcaccgctttacccagttttactagtctcacaaacaacttccccctgacaggaaatccatcattgaacccatccgtcagcctgcctggaagcctgatagctacgtcatccaccgccgctacatccacttcccttccccaccccagcagcacagccgcagtgctgtccggcctatctgccagcgctccagtgtctgccgctcctttccccctgaatttgtccacagccgtcccttctctgttttcagtgacacagggccctttatcgagttctaacccttcgtacccgggattctcagtctccaacaccccatctgttacacctgcgctcccatcatttccgggactgcaggccccatctactgtagcggcagtgacgcccctgccagtcgccgcaaccgcgccatcaccagccccagtgctgccaggcttcgcaagcgcctttagcagcaactttaatagtgccctcgttgctcaggcgggattgagctcaggcctacaggctgccggttcatctgtcttccccggtttgctgtctctgcctggtatcccgggtttcccacagaacccatctcagagcagcttgcaggagctgcagcataacgcagcggctcaaagcgcactgctccagcaggtgcactctgcatcagcattagagtcttaccctgcacagcctgatggtttcccttcttacccttcagcgccaggcaccccattttcactgcagccttccctgagtcaaagcggatggcaatag

SEQ ID NO: 58527 - DNA, 3123 bp, Artificial Sequence
  Description of Artificial Sequence: Synthetic coding sequence
atggcggcagctgtcctttccggaccgagcgctggttcagcagcaggggtacctggagggacgggcggtctcagcgccgtgtccagtgggccacgcctgagattgttattgctcgagagcgtaagtggcttgcttcagcctcgcacaggaagcgccgtggcgcctgttcacccgcctaacagatccgcccctcacctgccaggactgatgtgcctcttgcggttgcatggatctgtcggcggagcccaaaatctgtccgcgctgggagccctggttagcctctctaatgctcgactatcctcaatcaaaactagattcgaaggactatgtttgctgagcctgctggtgggcgagtccccaacggagctgttccagcagcattgtgtgagttggcttcggtcaatccagcaggttctacagacccaggatcccccagccacgatggagctggccgttgcagttctccgcgacctgctcagatacgctgctcaactccctgctctgttcagagatatttccatgaatcacttacctggcctcttgacttccctcctgggtttacgccctgagtgcgagcagtccgcactggagggcatgaaagcttgcatgacttactttcctcgcgcatgtggaagtctgaaggggaagttagcgtccttcttcttgtctcgcgtggacgcattgtcacctcaattgcaacagctggcatgcgaatgctatagccgccttccgagcctaggagccggattttctcagggcctgaaacatactgagagctgggagcaggaactccattcactgctcgcgagtcttcatactctgctcggcgctttatatgagggcgcagagactgctcctgtgcagaatgagggtccgggtgtggaaatgctgctttcctctgaggacggagacgctcacgtgctcctgcagctacgccagcgattctccggcttagccaggtgcctcggactgatgttatcatctgagtttggggctcctgtgagcgtgccagtccaggaaatcctggattttatatgccggactctgtctgttagtagcaagaacatttccctccacggcgatccatgtggctgttgttgctgccctctttcaaccctcgccctcgaccttctgtccgccctgatcttggcttgcggttccaggttgctgcgattcggtatcctgattggacgattactgcctcaggtactcaactcatggtccataggcagggactcgctgagccccggacaggagagaccatactcaacggtccgcactaaagtctacgccattcttgagctctgggttcaggtgtgcggcgcaagtgctggtatgctgcaaggtggggctagtggagaggcgttactgacgcatctcttgtcagatattagtcctccggctgacgccctcaagctgcgcagccctcgcggatcaccagatgggagcctgcaaaccggcaagccgagcgcgccaaagaagctgaaactggatgtgggggaagcaatggcaccaccttcacaccggctccttcccgtcccttgtaagccttcaccgagcgcttctgagaaaattgcactcaggtcacccctttgtagcgaggccctggtgacatgtgctgctcttacccacccgcgtgtgccgccactgcagccgatgggccctacttgcccaacgccagcacctgttcccctgcgaccccacagaccttccggccctcacaggtccattttgcgagcgccttgcccccagtgggcgccttgcccccagcaggccccatgtagcgcaggacccatgccatccgccggtcccgtgccgagtgcgcgtcccggacctccaactacggctaatcatttagggttgtcagtgccgggacttgtgtccgtacctcctagactgctgccagggcctgagaatcatcgcgctggctcaaatgaggacccaatattggcaccctccggaaccccaccaccgacaattccccctgacgaaacttttggagggcgtgtccctcggccagcgttcgtgcattacgacaaagaagaggctagcgatgtggagatctcattggagtctgattcggatgattcggtggtgatcgtccctgagggactgccccctcttccgcctcccccacccagcggtgcaacaccccctcccatcgcccctactggaccccctaccgcctctcctccagtcccggctaaagaggaacctgaggagctacctgccgctcccggtccattgcctcctccaccaccacctccaccccctgttccaggaccagtcacgcttccgcctccccagttggtgccggaggggactcctgggggaggtggtccccctgcgctcgaagaggacctaaccgttatcaacattaattcaagcgatgaggaggaagaagaagaggaggaagaggaggaagaggaagaggaagaggaggaggaggaggaggacttcgaagaggaggaggaagacgaggaagaatacttcgaagaagaggaggaagaagaagaggaatttgaggaggagtttgaagaggaggaaggggagctcgaggaggaagaggaagaggaagacgaggaagaggaggaagagctggaagaggtggaagaccttgaattcggcactgcagggggtgaggtggaggaaggtgcccctccgcctcccacgctaccacctgccctccctcctccggaatcccccccaaaagtgcaacccgagccagaacctgaacccggattgctgctggaagtcgaagagcccggaacagaggaagagagaggagcggataccgcacccaccctggctccagaggccctcccttctcagggagaggtggagagagagggagagagccccgcagcagggccaccaccacaagagctggttgaggaggaaccgtctgcgcctcctacacttctggaggaagagactgaggatgggagtgataaagtacagccccctcccgaaacccctgcagaggaggaaatggagactgagacggaagctgaggcgttgcaggaaaaggagcaggatgataccgccgctatgctggctgattttatagattgtccaccagatgacgagaagcccccacctccaacagagccggactcttag

SEQ ID NO: 58528 - DNA, 3825 bp, Artificial Sequence
  Description of Artificial Sequence: Synthetic coding sequence
atggccgctgccgtactgtcaggcccatcagctgggagtgccgctggcgtccccggtggtacgggagggttatctgctgtttcctccggtccaaggctgaggcttctgttattagagtctgtgtctgggctgttgcaacctcgaaccggaagcgctgtggctccagtgcaccctccaaatagatccgcaccccacctgcctggcctgatgtgtctcttgcggttacacggaagtgtggggggagctcaaaacctgtctgctctgggagctctcgtgtctttatctaacgcccgactgtcatcaataaaaacccggttcgagggcctatgtctattgagtttgctggtaggagagtcccccacagaactcttccaacaacactgcgtgtcttggctcaggtcgatccagcaagtgttgcagactcaggacccaccagccacaatggaattggccgttgctgttcttagagacctgctccggtacgctgcgcaacttcccgctttattccgcgatatcagtatgaatcacctcccgggattgttgaccagcctgctggggctccgccctgaatgcgagcagagtgccctggagggtatgaaagcttgtatgacgtattttcctcgggcttgcgggtctctcaaaggaaaactggccagtttcttcctgagccgagtggacgcactcagtccccagcttcaacagcttgcttgcgagtgttacagtcgccttccttctctgggcgcaggcttttcccagggactgaagcatacagaatcctgggagcaagaactgcactctttgctggcgtccctgcataccttgctcggagccctctatgaaggcgctgagaccgccccagtccagaatgaaggtcctggagtggaaatgttgcttagtagtgaagatggggacgctcacgttctccttcagctccgacaacgattcagcgggctggctaggtgcctgggtttgatgcttagttccgagttcggagcccctgtgagcgtgcctgtgcaggaaatcctggattttatatgccggaccctttccgtgtctagtaaaaacattgtgtccggaatctgtcacctctttcgcgctctcgcacaggatacacgacagccgggaaaatattgggggccagaaagtccccaaaccgtgagcagctggtctagacctcgagagctcccaacatttgtgcagatcacatctctccctatgtgtagagacacgggggcacagtgtcagtcagtagctaacgccagtctaggggagggggagtttggtgacgccgagtcattactgcgcggtcccgctatcctgctgacattccatcctgggtcgattctagaggatcgagggctcatcctcctgggtgaacttagaagcggtgtgggcttcttaacttacgtctatatttgtaagtggtcctttccagtgagcgtctcattgtggctttcactgtccagctccacactctatttgtgtcccttttttctgcaatccttacatggagacggtccgctgcgcctcctgctgctgcccagcatccacctggaggctttggacctactaagcgctctgatcctggcttgcggatcgagactgctgagattcggaatcttgatcggacgactgctgcctcaggtgttgaactcctggagtatcgggcgtgatagcctaagcccgggacaagagcgaccatacagtaccgtgagaacgaaggtctatgccatccttgagctctgggtacaggtctgtggcgcttctgcaggaatgctccaaggcggtgcatctggtgaggccctactgacacatctccttagcgatatctcacccccagcagacgctctgaaactaagatccccaagggggagcccagacggctcgctgcaaaccggcaaaccatcagcccctaaaaaacttaagctggatgtgggcgaggctatggcacctccttctcaccgtaaaggagattccaatgctaattctgatgtttgcgcggcagctctcagaggcctgagtaggaccattcttatgtgcggcccactcatcaaagaagagacccatcgcaggctgcatgaccttgtactgcccttagttatgggggtgcagcaaggcgaggtgttgggctcaagcccgtacacctcaagccgctgcagacgagagctttactgtttactgctcgccctccttctagccccttctcctcggtgcccacctcctttggcatgtgcccttcaggcgtttagtctggggcagcgggaagactcgttggaagtgtccagcttctgtagtgaggcgctggtcacgtgtgctgcattgacccatccccgagtccctccactgcagcccatgggcccaacatgtccgactcccgcacccgtcccgccaccggaggccccaagccctttcagggcccctccgtttcatcctccaggacccatgccgtccgttggatctatgccatccgcaggcccaatgccaagcgccggtcccatgccttccgccggaccagtcccatccgcgcgacccggtccacctacgacagcgaatcatctgggcctgagtgttcctggactggtgagcgtcccccctagactgctgccaggacctgaaaaccatcgtgcgggtagcaacgaggaccccatccttgctccttctgggacaccccctccgacaattccacccgatgaaacattcggcggacgggtgcctaggcctgcattcgtacactatgataaagaagaggcaagcgatgttgagatatcacttgagtcagactctgatgacagtgttgtgatcgtgcctgaagggttgccaccactgcctcccccacccccaagtggggctacgccaccacccatcgctcctacgggaccaccgactgcaagtccacccgtgcctgcgaaagaagagccagaagagctgcccgcagccccaggacctttgcctccccctccaccacctccacctccagtgccaggcccagtgacgctgcccccacctcagttagtcccagaaggaaccccaggcggaggcggaccgcctgctctggaggaagatctgacggtgatcaacatcaactcttccgacgaggaggaagaggaggaagaagaggaggaagaggaggaggaggaagaagaagaggaagaggaggatttcgaggaagaggaagaagacgaagaggagtactttgaagaggaggaggaggaagaggaagaatttgaggaagaatttgaggaggaggagggagaactcgaagaggaggaggaggaggaagatgaagaagaagaggaggaactggaggaggtcgaagacctggagttcgggacagccggaggggaggtggaagaaggggctcctcctcctccaacactacccccagctctccctccaccagaatccccacctaaagtgcagccggagcccgagccagagcctgggctgctgctcgaagttgaagaaccaggcactgaggaggagaggggcgcagatactgccccaacactagcgcctgaggctctcccttcccagggagaagtggagcgggagggagagtctcccgcagccggaccccctcctcaggaactggtagaggaggagccctcggcccctccaaccttgctcgaggaagagaccgaggatggaagcgacaaggttcagcctcctccagagactcccgcagaagaggaaatggagacagagactgaagcggaggctttacaggaaaaggagcaagatgatacggccgcaatgcttgcagactttattgactgtcctcccgacgatgagaaaccccctccacccaccgagcctgattcgtag

SEQ ID NO: 58529 - DNA, 2721 bp, Artificial Sequence
  Description of Artificial Sequence: Synthetic coding sequence
atggagttggccgtagcagttctcagagacctgttgaggtacgccgctcagctgcctgcactttttcgggacattagcatgaaccacttgccaggtctgctcacaagtctcctgggccttcggcctgagtgtgagcaatcagctttggagggcatgaaggcatgtatgacatatttcccccgtgcatgtggaagcctgaaagggaagctagcaagtttttttctgagtcgtgtggatgccctttcaccccagctccagcaactggcctgtgagtgttattcacggttacccagcctgggggctggattcagtcagggactgaagcacacggagtcgtgggagcaggagctgcactctcttctggctagccttcacacgttgttaggagcactgtatgagggggctgagaccgctcccgtgcaaaacgaagggcctggagtggaaatgctactgagctccgaagatggggacgcacatgtcctattgcagctcaggcaaagattttcgggcctcgcgaggtgcctgggattgatgctcagttccgagtttggcgctccagtcagcgtacctgtccaagaaatattggactttatttgtagaaccctgtcggtgtcttccaagaatatctccttgcatggcgacggacccctcagactgcttttgctcccaagcattcacctggaagcactcgaccttctctccgccttaatcttggcctgcggatcacgactcctgaggtttggaatattaattggacgattactgcctcaggtcctcaactcctggagcattgggagggactccctgtcccccggacaggagagaccttattcgacagtgaggacaaaagtatacgcaattttggaattgtgggtgcaggtatgcggcgcaagtgctggcatgcttcaggggggagcttccggggaggcgcttctgacccacctactgtctgatatttccccacccgctgatgccctcaagctcaggagccctagaggaagtcccgatggctcacttcagaccggaaagccctctgctcccaaaaaacttaagctggacgttggtgaggcaatggcccctccaagccaccggaaaggtgacagcaatgctaatagtgacgtctgtgcagctgccctgagaggcctgtctcgtaccatattgatgtgtgggccactcatcaaggaagagacccacagaaggctgcatgacctcgtgttacccctggtgatgggcgtgcaacagggggaggtcttaggaagcagtccatatacgtcttccagatgccggcgtgagctgtattgtcttttgttggcactgctgttggctccatcccccaggtgccccccacctctcgcctgcgccctgcaggcctttagtctgggtcagcgcgaggatagcctagaagtgtcctccttctgctctgaggctctggtgacctgcgcagctctgactcaccccagagtgcctccgctgcagccaatgggcccaacgtgcccgacgccagccccagttccgccaccagaagcaccctctccatttcgcgcacccccatttcacccccctggtcccatgcctagcgtgggcagtatgccatctgctggacctatgcctagcgcgggacccatgccctctgccggtcccgtaccatcagcccgaccagggcctcctactaccgctaaccacctcgggctatctgtgcccggtctggtgagtgtgcctcccagactccttccaggaccagagaaccatagagccggatcgaatgaggaccccatcctcgcaccctcaggcactcctccacccacaattccacccgacgagacctttggaggtcgtgttccacgcccagcgtttgtacactacgataaggaggaggcaagcgacgtggagatttctcttgagtcggactcggacgatagcgtggtgatcgtgcccgaaggtttaccccctctgcccccaccgccacccagcggggcaactccaccaccgattgctccaacgggtccgccaacagcctcaccacctgttcctgcaaaagaggagcctgaggagttaccagctgcaccaggccctttgcctccgcctcctccaccacctcccccagtcccaggtcccgtgactttacccccacctcagctcgttccggagggtactcccggaggcggaggacctccagctctcgaagaggatcttactgtgataaatataaacagttccgacgaggaagaagaggaggaggaggaggaagaggaggaggaagaggaggaggaagaggaggaagaagacttcgaggaggaagaggaggatgaagaggaatatttcgaagaagaagaagaagaggaggaagaattcgaggaggagttcgaggaggaggaaggagaactggaggaagaggaggaagaagaggacgaggaagaggaggaagaattagaagaggttgagcgagagggcgagtcaccagcagccggaccgcctcctcaggaactggtggaagaggagccatctgcccctcctactttattagaggaggaaacagaagatggtagtgataaggtgcagcctccccctgagacccccgctgaggaagagatggagaccgagacggaagcggaggctctgcaggagaaggagcaggatgatacagcggctatgcttgcagacttcatcgattgtccccctgacgacgagaaaccacctccacccaccgaaccagactcctag

SEQ ID NO: 58530 - DNA, 3543 bp, Artificial Sequence
  Description of Artificial Sequence: Synthetic coding sequence
atgctcctccctagtctttctccacgtgttcagcctgcttttactcaatgcgctcgcccacagccccctcctcacgcaccatccccagtcggcggaagaagaggagtttttgcctctagccggcacgcaacaaccggcacgcgagggaagatggcagccgcagttttgagcggcccatcagcaggctctgcggctggagtacctggagggaccggcggtttgtcagcagtgagcagcgggcctcgactgcggctgttgctactggagtcagtaagcggactgttacagcccaggaccgggagtgctgtggcaccagtgcacccccctaaccgctctgctcctcacctccccggattaatgtgtttattgagattgcatggatcagtgggcggagcccagaatttgtccgcacttggggcacttgtgtccttatctaacgccaggctgtcctcaataaaaaccagattcgaggggttgtgcctgctgtcattgttggtgggagaaagcccgaccgagctgttccaacaacactgcgtgagctggctccgtagtattcagcaggtcctccagacgcaagatccgccagcaactatggaactagctgtggccgtcttgagggacctcttaaggtacgccgctcagctccctgcattgtttcgagatatcagcatgaaccacctacccggactcctcacaagcttgctggggctgcgtccagagtgcgagcagtctgccttggaagggatgaaggcttgcatgacctattttccgcgagcatgcggcagcctcaaagggaagttggcttcctttttcctctcgcgggtggatgcacttagcccacaactgcaacagcttgcctgcgaatgttacagcagacttccctctctgggcgcaggcttcagccaggggctgaaacataccgaaagctgggagcaggaactgcatagcctgctcgctagcctccatacccttctcggggctctgtacgagggggcagaaactgcccctgtgcagaatgagggaccaggcgttgagatgctgctttcctccgaggacggcgacgcacacgtccttcttcaactgcggcagcgattctcaggactggcacgatgcctcggtctgatgctcagctcagagttcggggctcccgtgagcgttcccgttcaggagattctcgacttcatctgtagaacactgagcgtgtcctccaaaaacattagcctgcatggagacgggccacttaggcttctgctgctgccttccatacatctggaagcgctggacctcctaagtgcccttatattggcatgcggcagccggctactccgctttggtatcctaattggcagactgctgccacaggtgctgaactcctggagtatcggtagggacagcctaagccctggccaggaacgcccatacagcactgtcagaaccaaagtttatgctatccttgagctgtgggtgcaggtttgtggagcgtcagctggaatgctccagggcggtgcaagtggggaggccctcttgacacatttgctctctgatatttcgcccccagctgacgcgttgaagcttcgctcaccacgcggatctccggacgggtctctccagacggggaaaccaagcgctcctaagaagctcaagctggacgtgggcgaggctatggccccaccaagtcaccgaaaaggtgacagcaatgctaattccgacgtgtgcgccgcagcacttcgaggattgtcaagaaccatcctgatgtgcggacccctcattaaggaagaaacgcacaggcgactgcatgatctcgttttaccactcgtcatgggtgtgcaacagggagaagttttagggagctcaccatacacgtcttcgcgatgcaggagagaactctattgcctcctcctggctctccttttagccccatcccctagatgtcccccaccactggcctgcgctctacaggccttcagcctaggccagcgcgaagattccttagaagtatcttcgttttgttcagaggcactcgtcacttgcgctgccctaacacaccccagagtaccccctctgcagccaatgggccctacttgccctactcctgctccggtgcccccacctgaggcaccgtctccattcagggccccaccgttccacccccctggaccaatgcctagtgtggggtctatgccttccgccggacccatgccgagtgcaggccctatgccgtccgctgggcctgtgccgtctgcacggccagggcctccaactacagccaatcatctcgggctgtctgtgccaggcctggtgtctgtgccaccaagactgttgccgggaccagagaaccatagagccggaagtaacgaagatcccatattggccccatctgggacaccaccaccgactatccccccagacgagacatttggaggaagggtccctcgccctgcatttgtgcactacgataaggaagaggccagtgacgttgagatctctcttgaaagcgactccgatgatagcgtggtcatcgtgcccgaagggctccccccactccctcccccacctccttctggagcaacaccgccacccattgcccctaccggccctcccaccgcatctccccctgtacctgccaaagaggagcccgaagagctccctgccgctccgggtccactgcccccaccccctcccccaccccctcccgtgccaggccctgtaacactgccaccaccgcaactcgttccagaaggcacacccggaggcggaggccctccggcactcgaggaagatcttaccgttattaacataaattcatccgatgaagaggaggaggaagaggaagaagaggaggaagaggaggaggaggaggaagaggaggaagaggatttcgaggaggaagaggaagatgaagaagagtattttgaagaggaggaagaagaagaagaggagtttgaggaggaattcgaggaggaggagggggagctcgaggaagaagaagaagaggaggatgaagaagaggaggaggaacttgaggaggtggaggatctagaattcggaaccgccggaggcgaggttgaggagggcgcaccccctccacctaccctcccgccagcattgcctccccctgaaagtcctcctaaagttcagcccgaaccagagccagagccgggactgttactggaggtggaagaacccggaaccgaggaagagaggggcgctgataccgcccctacattagcgccagaggccctgcccagccagggggaggtggagagggagggggaaagccctgccgctgggccaccccctcaagagttggttgaggaagagcccagcgccccaccgacactgctggaggaggaaacagaagacgggtctgataaggtgcaaccacctcctgagacacccgctgaagaagagatggagacagaaaccgaggcagaagcactgcaggagaaagaacaggatgacactgccgctatgctggccgactttattgattgccctcctgacgacgagaagccgccaccacccaccgagcctgactcctag

SEQ ID NO: 58531 - DNA, 1083 bp, Artificial Sequence
  Description of Artificial Sequence: Synthetic coding sequence
atgcctaagtttaagcagaggagaagaaagctgaaggccaaagccgaaagactgtttaaaaagaaagaagcttcacattttcagagtaagctgatcacgccccctcctcctccccctagtccagagagggtagggatctctagcatagacattagtcagtccaggagctggctcacaagtagttggaacttcaattttcctaatattcgcgacgcaattaagctgtggacaaatcgcgtgtggtctatttacagttggtgccaaaattgcattactcagtccttagaagttctcaaagatactatcttcccctcacgcatttgccacagggagctctactccgtgaagcagcagttctgcatcctagaaagtaagctctgcaaattacaggaggcgctaaaaaccatcagcgagagcagctcctgcccatcctgcggccaaacctgccacatgtccgggaaattgacaaacgtgcccgcatgcgtgttgattacacctggcgactcaaaggccgttctgccccctactctaccacagcctgcgtcgcatttcccaccgcctccaccaccgccacccttgccacctccgcctcccccactggcgcctgtattgttacggaaaccatcactggcaaaggcgctgcaagcgggaccacttaaaaaggacggaccgatgcagattaccgtgaaagatctgctgacagtcaaactgaagaaaacccaatctctggatgagaaaaggaagctgatcccttcacctaaagccaggaacccccttgtgacagtaagtgacctccaacacgtgacccttaagcctaattctaaggtgctttccacccgggtgaccaatgtactcataacaccgggaaagtctcaaatggatctgcgaaagctactgaggaaggtggatgtggaacgttcgcccggagggacaccactgaccaacaaagagaacatggaaacggggactggattaaccccagtgatgacacaggcactgcgacgtaagttccaactcgcacacccacggtctcctaccccaacactccccctctctacctcctctttcgacgagcagaattag

SEQ ID NO: 58532 - DNA, 3651 bp, Artificial Sequence
  Description of Artificial Sequence: Synthetic coding sequence
atggaacaactgcctggagtacccccagggcctcctcacccagtccgacctcccccacctaaccctcccccacctatgcccctccagttagaagcccacctgaggtcacatggactggagcctgcagcaccctccccacggctgcgcccagaggagtcactcgacccacccggagcgatgcaagagttactaggcgctttagagccgctgcctcctgctcccggagataccggggtgggccctcccaactcagaaggtaaagatcctgctggggcatatagatcacctagcccacagggaactaaggctcctaggtttgtgcctctcacaagtatctgcttcccagattctttgctgcaggatgaagagcggagcttctttcccaccatggaggagatgttcggaggcggagccgctgacgactacggcaaggccggaccacccgaagacgagggagatcccaaagctggcgcaggaccacccccaggcccacccgcttacgacccttatggcccatactgtccaggacgcgctagcggcgctgggccagaaaccccgggtctgggactggaccccaataagcccccagagttgccctccacggtgaacgctgagcccctgggattgattcagtcagggccacaccaggctgctccccctccgccaccgccacctccgccaccaccagcacccgcttccgaacctaagggtggtctcacctctccaatattctgttccactaagccaaagaaactcctgaagaccagttcattccatttactccgccgacgcgatccccctttccaaacaccgaagaagctgtacgcccaggagtacgaattcgaagccgatgaagacaaagccgacgtgccagcagatatccggctcaatcctcgccgattgcccgatctcgtgagcagctgtcgatctcgtccagctctgagcccgttgggtgatatcgatttctgtccaccaaaccctggccctgatgggcctagacgacggggacgcaagcccaccaaggccaaaagggatgggcctcctagaccacgaggcaggcccagaatccggcctctggaggtgcccactaccgcaggaccagcctcagccagcactccaacggatggtgctaaaaaacccaggggaagaggcagaggcagaggcagaaaggctgaagaggccggaggaaccagactggagcccctcaaaccgttaaaaatcaaactctccgtcccgaaggcaggagagggcctcgggactagcagcggcgatgctatttcagggaccgatcacaatagtctggattcaagcctgacacgagagaagattgaggccaagatcaaagaggtcgaagaaaaacaaccggaaatgaaatccggattcatggctagctttctagatttccttaagagcggaaagaggcatccacctctgtaccaggctggcttaacacctcctctgtcaccacctaaaagcgtcccaccgtctgtgcccgctcgtggattacagccacaaccaccagcaaccccggctgttccacaccccccaccctctggcgctttcgggctgggcggagccttggaagctgccgaaagtgaaggactgggactgggatgcccctccccctgtaaacgattggatgaggaactcaaacgcaatctcgagacactgccaagcttttcttcggacgaggaggacagtgtcgccaaaaaccgcgatctccaggaaagcattagctccgcaatcagcgccctggatgacccacctcttgcaggtcccaaagacacttccacccccgatgggccacccctggccccagcggctgcagtgccaggccctccaccactgcccggattgccttcggcaaacagcaatgggacccccgaacctcccttgcttgaggaaaaaccaccgcctactcctcctcccgcaccaacgcctcagccccaacctccacccccacctccgcctccacagcctgcactgccatcaccccctccccttgttgccccaacccccagcagccctcccccaccaccactgcctccccctccacccccagcgatgccatccccgcctcccccaccaccaccagcagcagcacccctcgccgcaccgccagaggagccagctgccccatctccagaggaccccgagttaccggacaccaggccgcttcaccttgccaaaaaacaggagaccgctgctgtatgtggcgaaacggacgaagaagccggtgaatcgggtggggaaggtatctttagagagcgggatgagttcgtgatacgagccgaagatattccatccctgaagctggccctgcaaaccggcagggaacctccgcctatctggagggtgcagaaggctctcttgcagaagtttactccggagattaaagacggacagcgccagttctgcgcgacgtctaactaccttggatatttcggcgatgccaagaatagataccagagactttacgtgaagtttcttgaaaacgtgaataagaaggattatgttcgtgtgtgcgcacggaagccctggcatcgaccaccagtgcccgtcagaagaagtggccaagcgaagaatccagtaagcgctggcggaagctctgcacctccaccaaaggctcccgcaccccctcccaagcccgagacaccggagaagactacgagcgaaaaaccccctgagcagaccccagagacagcgatgcctgaaccaccagctccagaaaaaccgtctttgctcaggcccgtcgaaaaggagaaggagaaagaaaaggtaacccgcggtgagcgcccactacgaggggagcgagctaccagtggtcggcagacccgcccagagaggagtttggcaactggtcagcccgctacatcccggctgcctaaggctcgaccaaccaaggtaaaggccgagcccccacccaagaagagaaaaaaatggcttaaagaagcagggggtaacgcaaccgctgggggtggcccacccggtagcagtagtgatagtgagtcatctcccggtgcccctagcgaggacgagcgtgccgtgcccggacgattactaaaaacacgagctatgagggagatgtataggagctacgtggaaatgctggtgtcaacggcccttgaccccgacatgatccaggcactcgaagacacgcacgatgagctgtacttgccgcctatgcggaaaatcgatggcctgctgaatgagcacaagaaaaaggttttgaagaggctgtccctgtcccccgcattgcaggacgcgcttcacacttttccccagctgcaggttgagcagagcggggagggctcgcctgaggagggtgccgttcgactgagaccggctggcgaaccatataatcggaagacactaagcaagctcaaaagaagcgtggtaagagctcaggaatttaaagtcgagcttgaaaaaagcggctactatacactataccacagtctccatcactataaataccatacctttctcaggtgcagagatcagacactggccatcgagggtggcgcagaggaccttggccaggaggaggtagtacaacagtgtatgaggaaccagccgtggttggagcaactcttcgacagcttctctgacctcctggcacaggcccaggcacatagcagatgtgggtag

SEQ ID NO: 58533 - DNA, 3435 bp, Artificial Sequence
  Description of Artificial Sequence: Synthetic coding sequence
atggagcagctcccaggtgtgcctcctgggccaccccatccagtgagacctccgccacctaatcctccacccccaatgcctctccaactcgaagctcatcttcgcagtcacggtttggaaccagcggcaccttcacctaggttgagaccagaggaatcactcgacccacctggtgcgatgcaggagttgctgggagctctggagccgctgcctcctgctcctggggatacaggcgttggaccaccgaattccgaagggaaggacccggcaggcgcatacaggtccccctccccacaggggacaaaggctccacgatttgttccactgacatccatttgctttcctgactcccttctccaagacgaggagcggtcgttttttccaaccatggaggaaatgtttggcggtggtgctgcagatgactacggcaaagctgggcctcccgaggacgagggagatcctaaggcaggcgcaggaccacctcccggacctcctgcttacgacccttatggtccttactgcccaggacgggcatccggagctgggccagagacacctggtctcggacttgaccctaataaaccaccggaactgccttctaccgtgaatgctgagcccctcggactgattcagagtggccctcaccaggctgctccaccccctcctccccctccacctcctcctcctgcacccgcttccgaacccaagggtggactcacatcccctatcttttgcagtacgaagcccaaaaaacttctgaagacaagcagctttcatctgctccgccgaagggatcccccatttcaaacacctaagaagctgtatgcacaagagtacgagtttgaagccgatgaagataaggcagatgtgcccgctgatatccgtctcaatcctagaagactccccgatctggtgagcagctgcaggagcaggcctgcactgagtcctttgggggatattgatttctgcccgcctaatccagggccagatggcccaagacgccgaggacggaagccgaccaaagctaagcgcgacggtcccccacgcccacgaggtagaccaagaatcaggcccctggaagtaccgactacagccggtccagcaagtgcctctacacccactgatggtgctaagaaaccacgcggaagaggcagaggacgcggaaggaaggccgaggaagccggtggcactcgccttgaaccattaaaacccctgaaaataaagttgtccgttccaaaagccggtgagggactgggtacctcttctggtgacgcgatttccggtacggaccataactcactggatagcagcctcaccagggaaaagatcgaggccaaaatcaaagaagtcgaagagaaacagcctgagatgaagtcaggctttatggcatcctttctggactttctgaaaagtggcaagcgacatcctcctctgtatcaggccggattaacgcctccattgtcaccaccaaagtctgttccccctagcgtgcctgcgagaggactccagcctcagccacctgccacgccggctgtgccccatccccctccatcaggagcgtttgggctggggggagcgttggaggctgctgaaagcgaggggctgggcctgggctgcccatccccctgtaagcggctagatgaggagttaaaacggaacttggagacccttccctctttctcttcagatgaagaggatagcgtggctaaaaatcgcgatctgcaggagtcaatctcctccgccatctctgctcttgatgatccacctctggctggcccaaaagacacaagtacacccgacggacccccactggcaccagctgccgctgtccctggtcctcctcccctgcctggcctaccaagcgccaactctaatgggacacccgaacctccactgctggaggaaaaacctccacccaccccccctcctgcccctaccccacaaccccagcccccacccccacctccgcctcctcagcccgcactgcccagccccccacctttggtcgcccctaccccctcatccccacccccacctcctctgcccccacctccccctccggctatgccctctccccctccccctccaccacccgctgctgccccactcgccgcaccaccggaggaacccgctgctcctagtccagaggatcctgaactgcctgataccaggcccctccacttggctaaaaagcaggaaaccgccgctgtgtgtggcgaaactgacgaagaggctggcgagagtggcggagagggcatattccgtgaacgggacgagttcgtgatccgagcggaggacattccatctctcaaactggccctgcaaaccggacgagagccacctcccatctggcgagtgcagaaagccctgcttcaaaagttcacacccgagataaaagatgggcagcgccaattctgcgccacttcaaactatcttgggtattttggtgacgcaaaaaatagatatcagcggctgtacgttaaattcctggaaaacgtgaacaaaaaggactatgttagggtgtgcgcacgaaagccgtggcatagacctcctgtacccgtgaggcgctctgggcaggcaaagaatccagtttcagctggcggaagctccgcacccccacctaaggcgcctgccccaccacccaagcctgaaacacccgaaaagacaactagcgagaaaccacctgagcagactcccgagactgctatgcccgagccccctgctcccgagaagccttctctcctccggccagtcgagaaggaaaaagaaaaagaaaaggtgactcgtggggagaggccactgcgcggagaacgggcaacgtccggtcgccagaccaggccggagcggagtctggcaaccgggcaacccgctaccagccggctccctaaagcccgtcctactaaagttaaggcggagccccctccaaagaagaggaagaaatggctaaaggaagccggaggcaatgccaccgctggcggtggccctcccggtagctcatccgattccgaatcctcaccgggagcgccatccgaggatgaacgcgctgtcccaggcaggctgcttaagacgcgtgccatgcgtgagatgtacagaagctatgttgaaatgctcgtgagtaccgccctggatccagatatgatccaggccttagaagacacacacgagctaaagagaagcgttgtccgggcacaggaattcaaggtcgagcttgaaaagagcggctactacaccctgtatcacagtctccatcattacaagtaccacactttcctgcgctgtcgcgaccaaaccttggcgatcgaaggaggagccgaagatttagggcaagaagaggtggtgcagcagtgcatgcggaaccaaccatggctggaacaactctttgacagcttttctgacctcctggctcaggcccaagcccactcccgatgtggttag

SEQ ID NO: 58534 - DNA, 6110 bp, Artificial Sequence
  Description of Artificial Sequence: Synthetic coding sequence
atggatagaaattacccaagtgccggtttcggtgaccctctgggcgcaggcgcaggttggtcatacgaacgatctgcaaaggcatctctggtgtatggatcatcccggacctcacatcccgaaactgatatactccacagacaggcatacgccgcaccacacccactccagagctacgcaaccaaccaccatcccgctgggctctccggtctattcgacaccggattgcatcacgcaggctccgcaggccctgacgcttcagtcatgaatctgatcagcgcattggaaagccgagggccacagccgggaccatctgcctcttcgctgctgtctcagtttagatcccctagctggcagaccgctatgcatacccccggaccaaccgaactattcatcagcggcgcattgccgggaagcagcacctttccatcaagcagtgcgctgagtgcctaccaacacccggcttcttttggatctcggccatttccagtgccctcttcattgagcctgcaggatccaccattctctccgccagccaatgggctgctgagccctcatgacgtccttcacctgaaaccctcacaggcccctacggtaccgagctcactgggtttcgaaagactggccggtgggggagtgctggggccagcgggtctcggtccggctcagactccaccctaccggcctggaccgccagacccccctccccctccgaggcatctccctacccagttcaatctgctggctagcagttccgccgcagcggcagcagcggagcaaagttcaccacagctctataacttcagcggggctgcacctggtcccccacctcctgaacgagccctgccgaggcaggataccgtaataaagcattaccaaagacctgcttccgcccagccgccaccacccccacctccggctcacgctttacagcattacctgtcctgcggaggatcttacccttccatgggacaccgggctaacttggcctgttcaccacttgggggtggagagccctcacctggagccggtgagccctccaaagccggtccctctggggcaacagcgggagcttcaggcagagcaacagggcctgaagccgctggcggtgggggtgccggaggcggtggaggcggttacagacccatcattcagtctcccggatataagaccgggaagggcggatacggggctgccgcaggtggcgcaaccagaccaccgccacccagaagcactgccactcccaagtgccaatccttagggggtccagctgcggcttatgcaaccgggaaagcctctggggctggcggagctggcggacaagcctactcccccggtcaaccccaggggttgttaggccctcaggcctacggacagggcttcggaggaggccaggcccaggacctgtcgaaagcaccttcctactccggcggaccaccacagcccccaagcggccctccccctcccggacttgccacctgccaatcctactccccagaccaactgcaaggccagctctatggagtgcagggcgaaccatacccaggacccgcagcccactcccaagggctcccaacagccagccccagcctgtcatactctacaggacatagcccagccttaagtggtcacggaggaggatggggcccatcaagccttggaggaggcggtgaagcctctccgagccacattatcagaccacttcagtcaccacccgcaacaggcagacctcctggagtcggttctccaggcgcaccgggaaaatatctgagttcggtgttggcttctgcacctttcctggcccctccaggagctggctcctacgccgcaggagccggaggctataagggcaagggtgatggaagtgaactacttgcgggtcctgggggacctcccgctgaacgtacagaagacgaagaatttttgatccagcacctcttgcaggcacccagccctcctagaacctcgggagccgatggtctggtgggtgaggacggggctgcagatgcttcaaaaggcctcgggggaagtggcggagcgggagggccaccaggaacaccatacgagctggcaaaagaagatccccagcggtaccacctgcagtccgtcattaggacctccgcttctctggatgagggcgcaacagctgcactcgagcttggactcggtcgtcttaaggaaaagaaaaagggccctgagcgcggaggggagacacctgagggtttggccaccagtgtggtgcactacggggctggtgcgaaagaactcggagccttccttcaaaagtcacccccacctcccccaccaactgcacaaagcactcaaccaactcctcatgggctcttgctggaggctggcggacctgatttgccacttgtgctgcctcccccaccaccccaactccttccctccgttctctctcacgccccaagtccatctccgagcgcaagcaaagtgggggtgcacttactcgagccagccactcgggacggcgcaccacagccacctccacccccaccaccgccacccccacccatgccattacaactcgaagctcacctgaggtcacatggcctcgagcctgcagctccgagccccaggctacggcctgaggagagcttagacccccctggagcaatgcaggaactgttgggagctttggaacccctgcctcccgcacctggcgatactggggtgggaccaccgaactcggaaggaaaggaccccgcaggggcataccgcagtccctcgcctcagggaacgaaagcacccagatttgtacccttaacttcaatttgctttccagatagccttctgcaggacgaagagaggtcttttttcccgactatggaggagatgtttggcggaggcgcagctgacgactacgggaaggctggaccccctgaagacgaaggagatcccaaagccggagccggaccccctcccggaccacctgcctacgatccctacggtccatactgtcccggtagagcgtcaggcgctggcccagagacaccaggtttagggctcgaccctaacaaaccccctgagctgcccagcacagtaaacgcggagcccctgggtttaattcaaagtggtccacaccaggcagctcccccacctccgcctcctccgcctccaccacccgcaccagcctctgagcccaagggtggactgacaagtcccattttttgcagcacaaaaccaaagaaacttctgaaaacttcttcctttcacctgctgaggcggagggaccccccttttcagacccctaaaaagttatatgcccaggagtacgaattcgaagccgatgaggataaggccgatgtgcctgcggatattcggttaaacccccgtagacttcccgacctcgtgagctcctgccgctctcgacccgcactcagtcctcttggggatatcgacttctgcccacctaaccccggacccgacggacccagacgtagaggaagaaagccgaccaaggcgaagagggatgggccacctcgtccaagaggtcgaccacgaatcagaccactcgaggttcccactaccgctgggcctgcctcagcttccacccccactgatggagcaaagaaacccagagggagaggacgtggcagaggtcgcaaggcagaagaagctggtgggacaaggttagaaccgttgaaacccctgaaaatcaagctgtctgttcccaaggcgggtgaaggcctcggtacgtcgagtggggacgccattagcgggacagaccacaactccctggatagttccctgacaagggaaaagatcgaggctaagatcaaggaagttgaagagaagcagcctgagatgaagtccgggtttatggccagctttctcgatttcctgaaatcaggaaagcggcaccctcccctgtaccaagccggtctgacaccgcctctatcccctccaaagagcgtgcctcctagcgttcccgctaggggactccagcctcaacccccagccacgcccgctgtccctcaccctcctccttccggggcatttgggcttgggggtgccttagaagccgcagagtctgagggcctaggactggggtgcccttctccctgcaaacgcctagacgaagaactgaagagaaacctggaaactcttccatctttctcttctgacgaggaagactccgtggctaagaatcgtgaccttcaagaatccatctcgtcagcaatcagtgctctggacgatcctcctcttgcagggccaaaggacacttccacaccagatggccctccactggcccctgccgctgctgttccaggacctccacctctgcccggtctgccgtctgcgaactcaaatggcactcccgagcccccacttctcgaagagaaaccaccgccaacccctcctccggcaccgacaccccagcctcagcctccaccccctcctccgcctccccaacctgcgctgccaagtccccctcccctggtcgcaccaacacctagtagtcctcctcctccccctctgcctcctcctcctcctccagctatgcctagccctccaccaccaccccctcccgctgcagcgccattagcagctccgccagaggagcccgctgcaccctcacccgaagacccagaactgcctgacaccagacccctacatctggccaagaaacaggagactgccgctgtgtgcggagaaacagacgaggaagctggagagtctggtggggaaggcatcttccgcgagagggatgagtttgtgataagggccgaagatattccaagcttgaaactcgccctccaaacgggcagggagccacccccaatctggagagtgcaaaaagccctcctgcaaaagtttacaccagaaattaaggatggtcaacggcaattctgcgccacttccaactacctcggatacttcggagatgcgaagaatcgctatcagagactgtacgttaagttcctcgagaatgtgaacaagaaggattacgtgcgggtctgtgctcggaaaccatggcacaggccccctgtccccgtccgcaggtcgggacaagcaaagaatcctgtgtcagccggaggtagctccgcccctcctcctaaggcccctgcaccccctcccaagccagaaactcctgagaagactacatctgaaaaaccaccggagcaaaccccggagacagccatgcctgagccgccagcaccagagaagccttctctgcttcgaccagtagaaaaagagaaagagaaggaaaaggttactcggggagagcggcctctccggggagagcgcgctacttctgggaggcagaccaggccagagcggagcctggctacgggccagcccgctacctctaggctcccaaaagccagacctacaaaggtgaaggcagaaccccctccaaagaagcggaaaaaatggctcaaagaggcaggcggtaacgctactgccggtgggggtcccccagggtcaagcagcgacagtgagagttcgccgggagccccatcggaagacgaacgcgctgttcccggacgtctgctgaaaacccgagccatgcgggaaatgtaccgctcgtatgtcgagatgctggtgtccacggctcttgacccagatatgatccaggcgcttgaggacacccacgacgagctatatctcccgccaatgagaaagattgatggcctcctcaacgagcacaagaaaaaagtccttaagcgtctgtcgctctctcctgctttgcaggatgcactccacacctttccccagctccaggtcgagcagtccggggaaggctctccggaagagggagccgtgcgcctgcgacccgctggtgagccatacaacaggaaaacgctctctaagctgaaacgatctgtcgtacgagcccaggaatttaaggttgagttggagaagagcggctactacacactatatcattcacttcaccactataagtaccatacctttctccgctgtagagaccagacgctggctatcgaaggaggagcagaggacttggggcaggaggaagttgttcagcagtgcatgagaaatcagccttggctagagcagctctttgacagcttctctgatctcttagctcaggcccaggcccactcccgttgcggata

SEQ ID NO: 58535 - DNA, 1677 bp, Artificial Sequence
  Description of Artificial Sequence: Synthetic coding sequence
ggcagacctctggggggagacgcccgaagagaaggcgcatccgtgggaggcacatcccgagactggagcgaagaagggatttgcctgacagtagacccctggggatccaccctgagttccgaaatgttacagctgggacctcctctgtcagagagatctttcgcggcactgaaattaactggcgaaggcaaagcctccccaggcagacaggccggatggtcatcacaggctaggcccccagacccactgtgtctgtgtagagaacctctgagtcggatccatagaacatccagtacccttcgtcggcgttctcggaccactcctggtccagaggaaggccctagtcagaaagtggatagggccccacagccaacactggtggtgatgttggaagacatcgcgtccccgaggcccccagcggaaggctttatcgatgagacgccaaattttatcattccggctcagcgtgcagagcctatgaggatagttagacaaccgacacccccacctggagacctggaaccaccatttcagccgagtgccctaccagcggaccccctagaaagtcctccaacggccccagaccccgctctggagctgcccagtactcctcccccttcttcattgctgcgccctcgcttatccccatggggtttggcacccctgtttaggtctgttcggagcaagctggaaagcttcgccgatatcttccttacccctaacaaaacccctcagccacccccaccaagccccccaatgaagctggagcttaagattgcaatttctgaagccgagcagtcgggcgctgccgaaggaaccgcttccgtgagtccaagaccccctatcaggcaatggagaactcaggatcacaacacccccgcactcctccccaagccaagtttgggaaggtcgtactcctgtcctgatctaggccctccagggcctggaacctgcacgtggcccccagctccacctcagccatctagacctaggccaagacgacacacagttgggggtggagagatggccagggcgccaccccctccgagaccctgtctccgaaaggaggtcttcccattaggtggagttggtgcatctccctcattgacgacatcatgtagtagtaccgccagtacctccttttccgaacctgccgagcctaggctaggatcgacgaaaggcaaagagccaagagctagcaaagaccaggttttgagcgagccggagacaaaaaccatgggcaaggtatcgcgtttccgtattcgccgaacacctgcccgacctcaattgaaccttactccgatggggttgcctcgtcccatccgcctcaataaaaaggagttttcactcgaggagatctacaccaacaaaaactatcaatctccaaccactcgcagaacattcgaaacgatctttgaagagcctagagagagaaacgggacgctgatctttacaagttctagaaaactccgcagggcagtagagtttcgggatagcagcctaccaaggtctaggagacccagtcgcggagtgagagctgccggtggtagaacagtccctcctaatgtggcaccgagtcccgacgttggcccactactgcagcaacggttagaggaattggatgcactcctgctcgaggaggaaacagtcgacagagagcagccccactggacctag

SEQ ID NO: 58536 - DNA, 1758 bp, Artificial Sequence
  Description of Artificial Sequence: Synthetic coding sequence
atggacttaccaggggatagcagtcctccaggccagcctcgactgtgtaggcaaccactcactagagctttgtggggcgcacgtagcccgaaacgacctagactacagctgcctggcgctccgagcccgctggaaaaggctagccgccgagtgctggccgtggtgctagaggatgttatggcagtgcacatggtgccagttgtcccttcaaagcagacaagtataccacaacaccacagctatcatcaggacccggtgcaccgccagccacctgcctccccacctaggcaggcaggctggtcctcacaggcaagaccaccagaccctctctgcttatgtagggagccgctcagccgaattcaccgcacttcttcgactttacgccgaagatctaggacgacgcctggcccagaagagggtcccagtcagaaagtcgatcgtgctcctcagcccacattggtggtgatgctggaggacatcgcttcgcctcgcccaccagccgaaggcttcatagatgagacaccaaatttcatcatacctgcacagagagccgaacctatgcgcatcgtgcggcagccgacgccacctcctggcgacctggaaccaccattccaaccgtcagccctgccagccgatcctcttgagtcaccaccgacagcccctgatccggctttggagttaccctccacccctcctccaagcagcctactaaggccacgcctaagtccctggggcctggcacctctgtttaggtctgtgcgttctaaactggagagctttgcagatatcttcctgactcccaacaagactccacagcctccccctccgtcacctcctatgaagctcgaactgaagattgccattagtgaagccgaacagagcggtgcagcagagggcacagccagcgtgtcccccaggcctcccattcgccagtggcgcacccaggatcacaacactcccgctcttcttccaaagccctctctgggtaggagctatagctgcccggatctggggccacccggacccggaacatgtacctggcccccagctccaccgcaaccatctcgccctaggcccagacgccatactgtgggcggaggtgaaatggcacgagctccaccgcctccaaggccctgcctgaggaaggaggtatttccattaggcggtgtcggcgctagcccctcattaaccaccagctgctcaagcactgcgtctacatctttttccgaacccgctgaacctagactgggtagtacgaagggcaaggaacccagagcctcaaaggaccaggtattatctgagcctgaaacgaaaacaatgggcaaggtgagcaggttccgcatcagacgtaccccagcaaggccccaactaaatctgactccaatgggcctacctagacccatcaggctcaacaagaaagagttctctctagaggagatctatacaaacaagaactatcaaagtccgaccaccaggcgaacttttgagacaattttcgaagaaccaagggagagaaacggcacccttatctttacatccagcaggaagctgcgaagagccgtcgaatttagggactcttctttaccgagatcacgtagaccgtcgagaggagtgagggcagctggtggacggacggtgccacctaatgtggccccatcccccgatgtgggcccactgctgcagcagcgcctggaggagttggatgctctgctactggaagaagagaccgtagacagggaacaacctcactggacatag

SEQ ID NO: 58537 - DNA, 1758 bp, Artificial Sequence
  Description of Artificial Sequence: Synthetic coding sequence
atggacctgcctggcgatagctccccgcctgggcagccccgtctatgcagacaacccttaacgcgggctctgtggggtgccaggagcccgaagagaccgagactgcagttaccaggggcacctagtcctctggagaaggccagccggagagtcctggcagtggttctcgaagacgtaatggcagtgcatatggtgcctgttgtgccctctaaacagaccagcatccctcaacatcacagctaccaccaagatcccgtacatagacagccccctgctagcccacctaggcaagcaggttggtcatctcaggcaagaccccctgaccccctgtgtctgtgtcgggagcctctgagcagaatacatagaaccagcagcacattaagacgcaggtctcgcaccacgcctggaccagaggaaggaccttctcagaaagtggatcgggcacctcagccaacccttgtggtgatgttggaggacatagcctctcccagacctcccgctgagggattcatagatgagactcctaactttatcatcccagcccaacgagccgaaccaatgcgaatcgtgagacagcccacgcccccacctggagacctggaaccaccatttcaaccaagtgctctgcctgccgaccctttggaatcacccccaacggctcccgaccctgccctggagctgccaagcacaccaccaccttccagtctcctacggcctaggctgtcaccttggggcctggcacccctttttcgcagtgttcggtctaaactcgaaagttttgctgatatctttctgactcccaacaaaactccccagcccccacctccatcgccccctatgaaactggagctcaaaattgcaatttccgaggctgaacagtccggcgctgcggagggcaccgcatcagtgtcgccaagaccacccattaggcaatggcgaactcaagatcacaacacacctgctctgctacccaagccttcgctgggccgatcatattcttgtcctgatttagggcctccaggacccggaacatgcacctggcctccggcaccaccacagccaagcagacccagacctcggaggcatacagtagggggtggggagatggcccgagctccaccccctccacggccttgccttagaaaagaagtgtttcctctcgggggagtgggcgcttcaccttctctgaccacatcttgcagcagtaccgcatccaccagtttctctgagccagctgagcctcggctggggagtacaaagggtaaagaacccagggcctcgaaagatcaggtgctgtccgaacctgagactaaaaccatggggaaggtcagcagattccgcatcagaagaacccctgccagacctcagttgaaccttactcccatgggactccctcggccaatacgactcaataagaaggaatttagcctggaagagatctacaccaataaaaattaccagtcccccaccacacggagaactttcgagaccatttttgaggaaccaagggaaagaaatggaacactcattttcaccagttccagaaagctacgccgagctgtcgagttccgcgacagcagcttaccaaggtcaaggaggccctctaggggtgtgagggctgcagggggacgaacagtccctccaaacgtggcaccgagccctgacgtcggccctctgctgcaacagcgattagaagaactcgatgcactcctcctggaggaggagacggtggatcgggaacaaccacattggacttag

SEQ ID NO: 58538 - DNA, 6449 bp, Artificial Sequence
  Description of Artificial Sequence: Synthetic coding sequence
atgctcagcagtggggtggaaactcaacctgttccccttgactctagtatgtctgctgtggtccaagaactgtactcggaactgcctgtgtcggtgagcagggagctgcatgcagatcctgagccctctgttatcccagacgtcaagccaggtgcgtcgagcagtttattgagccagaaccgagccctgcctctagaactccaacggacgcatgtggagagctgctgcgaagagacatacgagactctggaccacggctccgagccgggtcggtgcgggctagtcgactctaccgccggagggtcagtcgccagcgggatcctagatcgcgctaaacgctccgaatccatggaacccaaggtgttccgggaccctggaggacaagccggaatcataagggagccttccgaaggcgctaaagaggatccccaccagcatagcacagcagccgaggaaaagacctcaccaagccaagaagatttgctgatgcagtcttctaaagagctcagccacgtggacctaccagaggacttcttgcggtccaaagagggcaacgttcaaattaccgccgaaacacttttaaaaagcgcagaggtccaggggatgaaggtcaatggtaccaaaacagataacaacgaaggccataaaaacggaaatgtaagtaaggatctcagcgcaggttgcggtgaattccaggaggttgacaagatcatgactagcgacgaggttagtgaaaccagcacgctggtcactcctgagcctttgacattcgtggacccagtgctgactgaagccactcctaaagagaaagaatgcgaggagttgaaaagctgtccttggctatccttgcctggaaactccgccatctcaaatgtggacaatggaaaggaagagctgtgtaagccaaatctagtatgcgaggcggatgataaccatcaacagctccacggacaccacaatgaacaaccatccagtacacacgactcccctactgccacctcgccactgaaagaaaattcagaggtttcttgctttacctcggacctgtccggcccagagtcgcgtaccatatcgcttgaaaattgcggatttgaaggtggcggactgctgaaacgcagcgcagagaagacagatagtagctacttttaccggggtgacgaccagggaaagaacctcgcctcgagggaagaaaacgaagagaggctgctgattcccaggtctgagaggggcggtccattccttttcaatgccagggagcccgagaaagaaatctctggcagatgcagcggcgagaaggaaccagttgtgagtcccaaggaaaacatacacaataattgtatccaggattcattgcacacgggcaacagtagttcattaatgcctaatagcttcaccgaagccacagaagttatgcttaataagaacgatctgaagattacagtgcacgtacagggaaacttgaccaacccggaagaccataaagagacttttacgaacatgagtcacccaggaggacatagcgaggagagctccttcagctctctgatgcaaatcgaggaagcagggcagaccaccccagtggagcccaatatcttgtctaagtctttctatactaaagattgcaacagcctagtgtctattcaacggaaccttgaaggtaacacacagttgaatgaggctagctgtaatgatttcctgttcgaacgcaaatctatcgtctcactcatgcctgaggaccagatatcacccgtctctgaagtgctgaagcctaagcaaggcactgctctgctgctgccctcccccgagtttgactacaggccagagtctgaaaaggtgattcagacctcacacgacgatatccccctgcttgatgaacagtccatcgcgtgcgagatgaatgaattgtcctgtacaaacgaacttgtggttaataaggtggagtccgaatgtgttctcaaccagcaggtgagcctaaattcccaagagcacgctaatctccccacggattccctgcttcacctcaacaaggaaatgccactggccaccgggagggacgcccaccagtcgcaccacccaccgttagagggacgggcagacgtgatcgcggatatccagactatccccatacagactaagatcaaggacatctcgccacctggaaatcaaacttgtggcgcatcctctaattgccctaccctcaacataaaacccgtctctctagagcggaagaaagagatggccgacagcggaacgaaagctcttcattcccgacttaggtccaacaaaagggaggccgctggatttcctcaggtcgtgtctgtcatagaatgccatagcgtgcaatctcaagatatctcctcttgccaccgggtgagaaaaaatgtgtcccaggagaacatgtgtagtgcgagtgccgctttcaagtcctctaagatcagcctgcaggtggataacagtctcattacgaaatatgaaaacgctttccaacaccgcgaccactgttgtcaggggaccggccactctgtcgaaaaaagtagctgtaaggtatcatataccagccaggagcgagaactggatggcaaggaaaccaacggctcccttcctggagataagattagaaataaaatggtggcagggctccttaacagcggtatcagtaacaagacaatacacacgtctagttcaatcaaattgtctgaggaaggtctggaaggcaaggagcaagatgtttccaaggagacagtgttttgcaaatataatatttctgatcacgccatccaggagctaaatcaaacagtcaatattcccggtccagagaaagtgctggaccaatcgcccactgtcatgtttagttcttttaagaatgtgaagtcagtcgagaccctcgatcagaaggccgatgaagtcttggactgtcagtccaaccaaaaccggccagatgaatgcaagagcgaaggacagagcgccaaagaaatgctatcaagcgatcagcgggagacagtgacagagccccatggagaggtgaatcacaaccagaaagacctgctcgttagcagcggatcgaacaatagtcttccctgcggttcaccaaagaagtgtaatttgaaaggcgcatttgtaaaaatgtctggatgcgatgagtcaaccgagggaatggtcgatattgtctacactgattgttccaacaaactggctgagggagtgctggatgtcaaggccagcaaccttctcgactgtggggcaagacaggagaagctggcctttcaggaggattcgcgaagtaccctgtcccgcagggagctggatgccgctcatacaggaacaaccggacaagactccgacttcccagtaactgctgcgagcacggtcgattttctcaagatcaagaagtcctgcgaagaaaatgtatgtaggagcctcaaggactgtgagatggagaaatgtcctgatagctgtgctcacgagatggaaagcgtggccgaccacgagccaaataagcggatcttaggaagagtgaacctgagtctgaacgatagtcattatgggcagcaggataaaggtacatcactccgggaaactcaggagatgaccgagggaagccgactcgaacctaacagcgaatttgggaaggaatccactttcggtatatccagtaaggagtctatgtcatgtcacgacgaaagctcagtgtctcttcgctcccttaagtccattgaaataatgccgtcccaggaaaattccgaaacaaatgttaactcagaagagacagatttgaagaatctgtgcaaaccgaaggacggagaaatgttatgcgagaacgtgaaagactgcacagtgctacctgagatgaaggaaatagtgagccgcgactggagtaatagcagcgacagagatagcgtgtgcacctgcgtggaaaagaacgcatgtaaggcctgccaccctcacgaaaatagctccgatagacacctgcccctcacagtgaaaacagacatcaaggtgaagggcgaagaaacagaagaacaccagcggggtcggcttggctatctcaccgttggggaacagtcagaagagctggtgacccgcgagactggggatggtgatcccgtctctaacatcagccagactcacttcaaatgccgcggaatattgaatcatgccgagaagcaacagagtccagaagtgttggactacatgctccagaaagaggagaagtacattagacagcagaaagctcacactattagtcagcagtgtatctcaagctcgttgctccttgatgatgctcaaaatcagaaccagccaaaggccgataaagatgaatctacaatgattaacgaaatcaccctggccaaattggcaaaggattccatcgtggcacagactcagaaattagaagaccaaaaggaagagcgacttcatcacccactgcgaaaggacacagaaagctgtacgtcaccctgtttgttaggcgctcccaggaaggcccaggatccatctagcgcgggttgcgatcaaattcatggggcttttgccaagaagggtgtgcttcccctcaaaaaacagcctcaccgcacgtgcaagaaagtgagctaccaagagcaaatcatcgtcggcaggaagataggcaagatccgctcgtccgcttttctgaaaagttcctccaatcccatccctaccaaagcgcaccgtttgctgtctctctgcacgctgtccgctcccaccaggctggaacctgaaactgccccaacaaagagcctcgtgtcacatataccgaagcagatgtcgacaccctgccacccactgagatctctcaactttcgcaagacaactaaggagtctgctctcctaaacaaactctccatcttagctagcaaactggccccagcaatgaagacgcagaagcttagatacagaagatgctcaagcgagctgcttccgatggcgaagtcgtataagcgtctgcgctataagaggctcctggatggcttttccagcagcaccgaacagctgaatccttatctggccgctagcggatgggataagcgcccaaattctaagcccatggccctgtactcactcgaatccattaagatgacatttatcgatttgtccaataaaatgccttctctgttattcggcagtgaaattttccctgtttcattccatgtcaagtcctcatcatccgactgtaccactgagagctcaaggaccttcccagaacattgcgcaccagccagactggccttgggggaggcgttgcagtgcccctcccagccgccaaaatggaccttttcgttcttcctcagccatggttgccccggaatggcaacattcagggaagatacgggagtccactcacagacccatactcaagccccaccacagcctcctgctcccttacaggactatggaggcaccgcaatcgtgcagacgcgcgctgattgcagcgtgttggggttacatacacttctagctttatgtagcccgggatgctatcgtatatggacaaaaaagagaagtttctctagccatatgccaaccatgcagcggctttttatgacacagttcactcagggattgaaaggactccgctcacctgcatctatcgctgacaaggtgttctgcagcctcccatactcagttggacgagtgttgagcatttggtcccaacacggaccatctgtatgctcatttgagattagtagcctgcatagtcctcattgcaaaagacagccatcactggggaccactagtagtcataccatgctgccttatgtccctctccccggaatggaggccacctacaacacgagtggttctcagacgcggctggagccccctttcccggctctggttcctaaatcatgcctcgtggctgagagcgcagtgtccaaactcctgctgtctgcaagtgaattccaggtccggggactagacgagctggacggagtgaaagccgcttgcccatgccctcagtcttcacccccagagcagaaggaggccgaaccggagaaaagaccaaagaaggtctcacagatacggatcaggaagacaatccccagacctgatccgaatcttactcctatgggattgcccaggccaaaaaggctgaagaaaaaggaattttctctggaggaaatctacacaaataagaattacaaatccccccctgcaaaccgggacttggatagcagttgcccctccacagacagtgagactgggcatttcctagtgttcggatatgcccagcggcaggctcagccccacccacttcttgcgagcagaagactgatcggttgtagcagcccagagggaagaggccacccacggtcctacccctattggcgtcgcctattggtcctttgttggtacctgcccggatggcgagccggacgcgtaacctggctgaggcttgccacttgggccggtcgaggcgacagctcacttta

SEQ ID NO: 58539 - DNA, 6020 bp, Artificial Sequence
  Description of Artificial Sequence: Synthetic coding sequence
atgctgtccagcggagttgaaacacagccagtgcccctggattcatctatgagtgcagtcgtccaggagctttatagcgagttgcctgtgtccgtctcacgagagctgcatgctgaccctgaaccctccgtcattccagacgttaaacctggagcctccagcagcctgcttagtcagaaccgcgcactaccgctagagctgcaaagaactcatgtcgagagttgctgcgaagaaacttatgaaactctggaccacgggtccgagccagggcgatgtggtctggttgacagcacggcgggaggtagcgtagctagtggcatcctggaccgtgctaagcggagtgaatccatggaacccaaggtctttagagatcctgggggacaggctggaattattagagagcccagcgagggggctaaagaggatccccatcagcacagtacagcagcagaagaaaaaaccagtccatcccaggaggacctcctgatgcagtccagcaaagagctcagccatgttgatctgccggaagacttcctgaggagtaaagagggaaacgtacagattactgccgagaccctgttaaagagtgccgaagtccaagggatgaaagttaatggtacgaagaccgataacaacgaagggcataaaaatggaaatgtatctaaagatctgagtgccggttgcggggaattccaggaggtggacaagatcatgactagtgatgaggttagcgaaacatcgacattggtcaccccggaacctcttacttttgttgatcctgtccttaccgaggcgacaccgaaggagaaagaatgcgaggagttgaaaagctgcccatggctgagcctgccgggaaacagtgccatcagtaatgtggataacggcaaagaagagctatgtaaaccaaatctcgtttgcgaagccgatgacaatcaccagcagttgcacgggcaccataacgagcagccttcaagcacgcatgacagtcctaccgccacttcacccttaaaggaaaatagcgaggtcagttgtttcacttctgacctgagcgggccagaatcccgcacgatctctcttgagaactgcggatttgagggcggaggactactcaagcgctcggctgagaaaaccgatagtagctacttttataggggcgacgatcagggtaaaaacctggcatctagagaggaaaatgaggaaagactgctcatacccagatcagagcggggtggcccatttctcttcaacgctagagaaccggaaaaggaaatctctggacggtgctctggggagaaggagccagtggtatctcccaaggagaacattcataataactgtatccaggactccctccataccggcaactctagctccctaatgccgaacagcttcactgaggcgaccgaggtcatgttaaacaagaacgacctcaaaatcaccgtgcacgtgcagggtaacctgactaatcctgaagaccataaagagacctttacaaacatgagccacccgggtggtcactccgaagagtcgtcattttcctctttgatgcagatcgaggaggcgggacagacaacacctgtggagccaaacattttatccaaaagtttttacactaaagattgcaattcgctagtgtctatccagagaaatctcgagggaaacactcagctgaacgaagccagctgcaacgacttcctgttcgaaagaaagtctatagtgtcactgatgccagaagatcagatctccccggtgtcggaagtgctgaagccaaagcaggggaccgcactattattgccatctcctgagtttgattacaggcccgagtctgagaaggtgatccagacttcgcatgatgatataccactgctggacgagcagtcaattgcctgcgagatgaacgagctgtcttgcaccaacgagctggtcgtgaacaaggtggagtctgagtgcgtgttgaaccaacaagtgtctctcaattcacaggagcatgccaatctgcccactgattcactgcttcacctcaacaaggagatgccacttgccactggaagagatgctcaccagtcgcaccaccctcctctcgagggccgtgcagatgttatcgccgacattcagaccattccgatccagactaaaattaaagatattagtcctcccggaaaccaaacatgcggagcctcttcaaattgtcccacgctcaacatcaagcccgttagccttgagcggaagaaagagatggccgactctggcacaaaagcgttacactctaggctgagatctaacaaacgcgaagccgcagggtttccacaggtagtaagcgtgatcgaatgtcactcagtccaaagccaggatatttcaagctgtcacagggtccgaaaaaacgtctcgcaggaaaacatgtgtagtgccagcgccgctttcaagagctccaaaatcagcctccaggtcgataattctcttatcacaaaatacgagaatgccttccaacatcgcgaccactgttgtcagggtaccgggcattccgtcgagaagtctagttgtaaggtcagttataccagtcaggaacgcgaacttgatgggaaggagactaacggttctctaccgggagacaaaattcgcaacaagatggtagcaggactactcaacagtggcatcagcaataagaccatacatacctcatcaagcattaagctaagcgaagaagggttggagggcaaggagcaggatgtttcaaaagaaacagtgttttgtaagtacaatatcagtgatcacgctatccaggagctgaaccagacggtcaatatcccaggcccagagaaagtacttgatcagagtcctacagtgatgtttagctctttcaaaaatgtgaaatccgtggagacactggaccagaaggctgacgaggtgcttgactgccagtccaatcagaatagacccgatgagtgcaagagtgagggtcagtccgcaaaagagatgctctctagcgatcagcgagagaccgtaactgaaccccatggtgaagttaaccacaatcaaaaagaccttttggtgtccagcgggagtaacaatagcttgccttgtggttctcccaaaaaatgtaatttaaagggggctttcgtcaagatgtccgggtgtgacgagtccaccgagggaatggtagacatagtttataccgactgcagtaataaactcgctgaaggagttctggacgtcaaggcaagcaatctgctggactgcggcgcaaggcaggaaaagcttgccttccaggaagacagtcgctcaactctgtcccgtcgcgagctcgatgccgcacatacgggcactacgggacaggattcagactttccagtcacagctgcctcaaccgtggatttcctaaaaattaaaaagtcctgtgaggaaaatgtgtgtagatcactcaaggactgcgaaatggagaagtgccctgatagctgtgcccacgaaatggagtctgtagctgatcatgagcctaacaaacgcattcttgggagagtcaatctgtcgctcaatgattctcattacggtcagcaggataaggggacctccctgcgtgaaacccaggagatgaccgaaggcagcagactcgaaccgaactccgagtttggaaaagagtccactttcgggatttccagtaaagagtccatgagctgccacgacgagagcagcgtgtccctgagatccctgaaatccatcgaaattatgccttctcaggagaattctgaaacaaacgtcaattcagaggagacagatctcaagaatctatgcaaaccaaaggatggggagatgctctgtgaaaatgtgaaagactgtaccgttctgcctgagatgaaagaaatcgtttcaagggattggagcaactcctcagacagagattccgtctgcacctgcgtcgaaaagaatgcatgcaaggcctgtcacccacacgagaattccagcgataggcacttgccattgactgtaaaaaccgacatcaaagtcaagggggaggagacagaggagcaccagcgtgggagactgggctacctaactgtgggcgagcaatcagaagagctggtgacacgcgaaactggggacggtgatcctgtgtcgaatatatcacagacacacttcaagtgtagggggattctgaaccatgccgaaaagcagcaatcaccagaagttcttgactatatgctgcagaaggaggagaagtacatccgccagcagaaagctcatactattagtcaacagtgtatctcctcgtctctgctcttggatgacgctcaaaaccaaaaccagcctaaggcagacaaagatgagtctaccatgatcaatgagataacgttggctaagttagccaaagactctatcgtggcccaaacacagaagctcgaggatcagaaagaggaaaggttgcaccatccccttcgaaaagatacagagtcatgtactagtccctgccttctcggcgctcccaggaaggcccaggatccgagcagtgcaggatgcgaccagatccacggcgcatttgctaagaaaggggtgctcccgcttaagaaacagcctcaccggacctgtaaaaaagtgagttaccaagagcagataatcgttggccgtaagatcggaaaaatccggtcaagcgcctttctcaagagttccagtaacccaataccgaccaaggcacaccgactcctatctctctgcacgctgtccgcaccaacccgccttgagcccgagactgcacccactaagtccctcgtttcccacattcctaagcagatgagtacaccttgtcaccctctgcggtcccttaatttcagaaagacgaccaaagagtccgcattactgaacaagctgtctatcctggcctccaaactcgctcctgccatgaagacgcagaaattacgataccgaagatgtagcagcgagctactgcctatggctaaatcatataaaaggctgagatataaacggcttctggatggattttcttcctcaacagagcagctcaacccctacctcgcagcatccggatgggataagcgacccaacagtaagcctatggctctgtatagcctggagtcaatcaagatgacgtttatcgacttatcaaataagatgccgagtctattgttcgggtcagagatcttccctgtgtcctttcatgtcaaaagtagcagttctgactgtaccactgagtcatctcgtacatttcctgaacactgtgcccctgccaggctcgctctgggggaggccttgcagtgtccaagccaaccccctaagtggacattctccttttttctttcccatggatgtcctgggatggctacattcagggaagacacaggcgtgcattcacagacacacacacaagcacccccacaacctcccgctccacttcaagattatgggggtaccgcaattgttcagacgcgcgctgattgttcagtgttgggactccatacactcctggccctttgttcgcctggctgctatcggatatggactaagaaacggagcttctccagtcatatgcctacaatgcaacgcctctttatgacacagtttactcagggtttaaaaggcctgagaagccccgcttccatagctgacaaagtgttctgctcactgccgtatagcgtgggccgtgtgttaagtatttggtctcagcatggcccttcagtgtgtagttttgaaattagctctctgcactcgccccactgcaagaggcagccttccctggggacaactagcagccataccatgctgccctatgtccccttgcccggaatggaggctacctacaataccagtggctcccagacccgcctcgaacctccctttcctgccctggtgccaaaatcatgcttggtggccgaatcagctgtaagcaagctgcttctgtcagcaagcgagtttcaggttaggggtctggacgagctggacggtgttaaagcagcatgtccctgcccccagtcaagccccccagaacagaaagaggtcaaggaagaaggagtcta

SEQ ID NO: 58540 - DNA, 6455 bp, Artificial Sequence
  Description of Artificial Sequence: Synthetic coding sequence
atgttgagctccggagtggagacccagcctgtcccactggacagctctatgtcggccgttgtgcaagagctgtattctgagctgccggtttctgtgagtagggaacttcacgctgaccctgagcccagtgtgattcccgacgtgaagccaggcgcatcgtcctccttgttaagtcaaaatcgggcactgcctttggaactgcagaggactcatgtggaaagttgctgtgaggagacatacgagactctggatcacggcagcgagcccggtcgatgcggcctggtggactctaccgccggaggctctgtcgccagcggcatcctggatagagccaagcgttctgaaagtatggagcctaaagtctttcgggatcccggaggccaggccggtatcatccgtgagccaagtgaaggggcaaaggaagaccctcaccaacacagtactgctgcggaggaaaagacctctccatcacaggaagatttgttgatgcagtccagcaaagagttgtctcacgtcgacctacctgaggacttcctcagaagcaaagaggggaatgttcagattactgctgaaacattactcaagagtgccgaagtgcagggaatgaaagttaatggcacgaagactgataacaacgaaggccacaagaacggaaatgtctccaaggacctcagcgcaggctgtggggaattccaagaggttgacaaaataatgacatctgatgaggtttccgagacttccacacttgtcaccccagagcctctgaccttcgtggatccagtgctcacggaggctaccccaaaggagaaagagtgtgaggagctcaaatcttgtccttggctttctttaccgggtaactccgcaatttctaacgttgacaatggcaaagaggagctatgcaaaccaaaccttgtttgtgaggccgatgataatcatcagcagctgcacggccaccataacgagcaaccttccagtacacatgattcacccaccgctacctcccccctgaaggaaaatagtgaagtgagctgtttcactagtgatctcagtggccctgaatcccgcaccatatcactcgaaaattgtggattcgagggtgggggactgctgaagcgaagtgctgagaaaaccgattcgagctacttctatagaggtgatgaccagggtaagaacctcgcatctcgggaggagaacgaggagcggctgctgatcccgaggtcagagagaggaggcccatttctgttcaatgcccgtgagcctgagaaagagatttccgggcgttgttcaggcgaaaaggagcccgtggtatccccaaaggaaaatattcataacaattgcatccaggactcacttcatactggcaatagcagcagcctgatgccaaactcattcacggaggctacagaagtcatgttaaataagaatgacctgaagattaccgtgcatgttcaggggaacctgacgaaccctgaagatcacaaggagacttttactaacatgtcacacccaggtggccactcagaagaatcctcattcagctctctgatgcagatcgaagaagcgggtcagactacacctgttgagcctaacattttgagcaagtctttctatactaaagactgcaactcactcgtctcgatacaaagaaacctggagggaaacacacagttgaatgaagctagctgtaacgacttcctgtttgaacgaaaatctatcgtgtcgctgatgcctgaagaccaaataagccccgtctcagaggtcctgaaaccaaaacaagggacagccctcttgttgccctcaccagagtttgactacagacctgagtctgagaaggtgatccagacatcccatgacgatattccactcctggacgagcagagtatcgcatgcgagatgaatgagttatcctgtacaaacgaactggtggttaacaaggtcgaaagcgagtgcgtcctgaatcagcaagtgtcactcaattcccaggaacatgccaatctgccaactgattccctgttgcatcttaataaggaaatgcctctggccaccggtcgggacgcccaccagtcacaccatccgcctttagagggccgagcagatgtgatagccgacatccagacgatacccatccagacaaaaatcaaagatatctctcctccgggtaaccaaacatgtggggcatcttcaaattgtccgaccctcaacataaagcctgtttctcttgagcgaaaaaaggagatggctgattcaggcaccaaggctctgcatagccgactacggtctaataaacgggaggcggcaggttttccgcaggtcgtgagtgttatcgaatgccactccgtccaaagtcaggacatttcctcctgccatcgcgtgagaaagaatgtgtcccaggagaacatgtgcagtgcgtcagctgccttcaagagctctaagatcagtctccaggtggataatagcctgatcaccaaatatgaaaacgctttccaacatcgagaccactgctgtcaaggaaccggacactccgttgagaagagcagctgtaaggtctcttacacgtcacaggagagggagctagacggaaaggaaacaaatggttcccttcccggagacaaaatcaggaacaaaatggtggccggtttgctaaactcaggaatctctaacaaaacaatccataccagctcctccatcaaactatccgaggagggtcttgagggcaaggaacaagatgtctccaaggagactgtcttttgcaagtacaatatctctgaccatgcgattcaggagttgaatcaaacggtcaacatcccaggtcccgaaaaggtcctggatcagtctccgacggttatgttctctagcttcaagaacgtgaagtccgtggaaactttggaccaaaaggcagacgaagtgcttgattgtcaatcgaatcagaacagacctgatgaatgcaaatccgaggggcagtctgctaaggagatgctttcctccgaccagcgcgagacagtcactgaaccccatggtgaggtcaatcacaatcaaaaggaccttctggtaagcagtggctccaacaattccctgccatgtggctcccctaagaaatgcaatctcaagggggctttcgtcaaaatgagtggctgtgatgagtctaccgaaggaatggtcgacattgtgtacactgactgctccaataagttagccgaaggcgtcctagatgtgaaggcctccaacctgctggactgtggtgctagacaggagaagttggcctttcaggaggatagcaggtctaccctgtccagaagggagctggatgccgcacatacagggactactggccaggactccgatttccccgtgacagccgcttcaactgtggatttccttaaaatcaagaaaagctgcgaagaaaacgtgtgtagatcattgaaagattgcgaaatggagaagtgtcccgacagctgcgcccacgagatggaaagcgtggccgatcatgagcctaacaaacggattctggggagagttaacctctcgctcaacgattctcactacgggcagcaggataagggcacatccctgcgagaaactcaagagatgactgagggctccagacttgagcctaacagtgaattcggaaaggaatcaacatttggtatctcaagcaaagagtccatgagctgccatgacgaatccagtgtgagtctgagatccttaaaaagcatcgagataatgccctctcaggagaattctgagactaacgtaaatagcgaggagacagatcttaagaacctttgcaaacctaaagacggagagatgctgtgtgaaaatgtcaaagactgcactgtcctccccgagatgaaggaaattgtgtccagggattggtcgaacagctctgatcgcgattccgtctgcacctgcgtggagaagaacgcatgtaaggcttgccatccccacgagaatagttccgacagacatctgccgctgacggttaagaccgacattaaagttaagggagaagaaacggaagagcaccagcgaggacggctgggctatttaacagtgggagagcaaagtgaggagctagttacaagagagacaggggacggcgacccagtaagcaacatctcacagacacactttaagtgcagagggattctaaatcatgccgagaagcagcaatcacccgaagttctggattatatgcttcagaaggaagagaagtatattcgacagcagaaagcgcacactatcagtcagcagtgcatttcttcctcactactgctcgatgacgctcagaaccagaaccaacccaaagccgacaaagatgaatctaccatgatcaacgaaattacactggcaaaactcgctaaagactcgatcgtggcccagacacagaagttggaggaccagaaggaggaacgactgcaccatccgctgaggaaggacaccgagagttgcacttctccctgtctcctaggcgcacctcgcaaggcccaggacccaagttccgcaggctgcgatcagattcacggagcatttgccaagaaaggggtgctcccactcaaaaagcaaccccaccgcacttgtaagaaggtgtcttaccaggagcaaatcatcgtagggcgaaagataggtaagattcgttcaagtgccttcctcaagtcatcctctaatcctatacccaccaaggcacaccgtctgcttagcctgtgcaccctgtccgccccaaccaggctggaacccgagacggctccgacaaagtccttggtgtctcacatccctaaacagatgtcaacaccttgccacccactgcgctctctgaactttcggaagacaacgaaagagtctgctttgctgaataagttaagcatcttggcttccaagttggccccagccatgaaaacgcagaagttacggtatcgcaggtgttcgtccgagctgttgcccatggcaaaatcctacaagcgcctgagatacaaaaggctcctggacggcttcagttcaagcacagagcaactgaatccttatcttgcagccagcggttgggataagcggcctaattcaaagcctatggccttatatagtttagaaagcatcaagatgacctttattgacttaagcaataaaatgcccagtctgctgttcggcagcgagatcttcccggtatcctttcatgtaaagtcttcctcctcggactgcaccactgaatcctctcggacatttccggaacattgcgctcccgctcgtctggcattaggtgaggccctgcagtgcccctcacagcctcctaaatggacttttagctttttcttgtcccacggctgcccaggtatggccacgttccgcgaggatacaggcgttcacagtcagacacatactcaggccccaccccagcctccagcacctttgcaggattatggcggtactgccatcgtccagacccgggctgactgtagtgtcctggggctgcataccttactggccctttgctcgccagggtgttatcgtatttggactaagaagcgatccttctcttctcacatgccgactatgcagcgcctctttatgactcagtttacccaggggctaaaagggctgaggagtccagccagcatagccgataaagtgttttgctctctgccctactctgtgggccgtgtgctgtcaatttggtctcaacatggaccctctgtttgttcctttgaaataagctcccttcatagcccccattgcaagagacagccgtccctgggcaccaccagttctcatactatgctcccttatgtgcctttacctggaatggaggccacctacaatacctctggttcccaaacaagactagagcctcctttccctgcgttggtgcccaagagctgccttgtggccgagagcgctgtgagtaagcttcttcttagtgccagcgagtttcaggtgagggggcttgacgagctagacggcgtgaaagcagcctgcccctgtccccaaagcagccctcccgagcagaaggaggcggaaccagaaaaacggccaaagaaggtcagccaaatccggatcagaaagaccatacccagacctgaccctaacctcacccccatgggtttaccacgccctaagaggctgaaaaaaaaggagtttagtctggaagaaatctataccaacaaaaattacaagagtccgcctgccaacagatgtttagagacaatcttcgaggagcccaaggaacgcaacggcaccctgatcagtataagtcagcaaaagcggaaaagagttttggagtttcaagacttcacggtccccaggaagcggcgtgctcgtggtaaggtgaaagtcgccggaagctttactcgggcacagaaggcggctgttcagtctcgggagcttgatgccttattaatccagaagcttatggagctcgagacattcttcgcgaaggaagaggaacaagagcagagcagcgggtgtta

SEQ ID NO: 58541 - DNA, 390 bp, Artificial Sequence
  Description of Artificial Sequence: Synthetic coding sequence
atggcggactctggtgatgctggctcctccgggccttggtggaagagtttgacaaattcacggaagaagagcaaagaagccgcagtgggggtcccacctccggcacaaccagcgcctggtgagcctacgcctccagcacccccatcaccagattggacaagctcttctcgcgaaaatcaacacccgaatctcctggggggagcgggagagcctccaaagcccgacaagttgtatggggataagagcggatcttcgcggcgtaacctcaagattagtcggtcaggcagatttaaagagaaacgtaaggtcagagctaccctgctgcccgaagccggaagatccccagaggaggctggcttcccgggagatccacacgaagataagcagtag

SEQ ID NO: 58542 - DNA, 57 bp, Artificial Sequence
  Description of Artificial Sequence: Synthetic coding sequence
atggccgactcaggagatgctggatcgtcagggccttggtggaaaagtctgacttag

SEQ ID NO: 58543 - DNA, 312 bp, Artificial Sequence
  Description of Artificial Sequence: Synthetic coding sequence
atgaccactgagatcggctggtggaagctcacctttcttaggaagaagaagagcactccaaaggtcctgtacgaaattcctgacacctacgcccagaccgagggcgatgctgaacctccacgccctgacgcagggggtccaaatagcgacttcaatacccggttagaaaagatcgtggataagtccacaaaagggaagcacgtgaaggtgtcgaattctggaagattcaaggaaaagaagaaggtgcgggcaacactggctgagaacccaaacctcttcgacgatcacgaggaagggcgatctagcaaatag

SEQ ID NO: 58544 - DNA, 846 bp, Artificial Sequence
  Description of Artificial Sequence: Synthetic coding sequence
atggcgcagtcaggcctgacggctactagcgcttcacaggtgcaggccatcctgcttccccagcctgcgtctgtgagacactatgcctgggtcgtcgaccagatcgatactctcacctcggacctgcagctggaggacgagatgaccgactcttcaaaaaccgatacactcaactcttcgtcaagtgggaccactgcctcatcacttgagaagattaaggtccaagccaatgcccctttgataaagcctccagcccatcctagcgcgatcctgactgtcctacggaagcccaatccccctcctccccctcctcgactaacgcccgtaaagtgtgaggatccaaagcgtgtcgtccctactgccaacccagttaagaccaatggcaccctcttaaggaatggaggcctacccggaggacctaataagattcctaacggcgatatctgctgcatccccaacagcaatttggataaggcacctgtccagctgttgatgcaccgcccagaaaaggacaggtgtccccaggccggtcctcgcgagagagttcggttcaatgaaaaggtccaatatcatggttattgtcctgattgcgacactaggtataatatcaaaaatagggaagtacatctgcacagcgagcctgtgcacccaccaggaaagatcccacatcagggccctcccctgcctcctaccccccatctgcccccatttcctttagagaacggaggaatgggaatttctcacagtaattccttccctccaattagacctgccaccgtcccaccacctactgctcccaagccccagaagactattcttcgtaaaagtacaacaacaacagtgtag

SEQ ID NO: 58545 - DNA, 915 bp, Artificial Sequence
  Description of Artificial Sequence: Synthetic coding sequence
atgtctgccaagagtaagggtaacccatctagctcatgtcctgccgaagggccacctgcagcttccaagaccaaagtcaaggaacagattaaaatcatcgtcgaggacctggagctggtgcttggtgacctgaaggacgtagcgaaagagctgaaggaggtggtcgatcagattgacaccctcacttcagatcttcagcttgaggacgagatgacagactcctccaaaaccgatactctaaattcaagttcctctggaactaccgccagctctctggaaaaaattaaagtgcaggctaatgctcccttgataaaaccccctgcccaccccagcgccatcctgaccgtcttgagaaaacccaatcccccaccccctcctcccaggctcacacccgtgaaatgcgaggacccaaagcgagtcgtgcccacagccaaccccgtcaagacaaatggtacactgctgaggaatgggggactccccggaggtccaaataagattccaaatggagatatttgttgcatccctaactcaaatctggataaagcaccagtgcagttgctgatgcaccgacctgagaaggaccgatgcccccaagcaggtcccagggaaagagtgcgatttaatgagaaggtgcagtaccacggctattgccctgactgcgatactagatataatatcaaaaatagggaagtgcatttgcattccgaaccagtgcaccctcctggcaaaatccctcatcaggggcctccgctcccaccaacacctcacctcccaccttttcctttggaaaatggcggtatgggcatcagtcactccaacagcttcccaccaatccgtccagctactgtccccccacccaccgcacccaagccgcagaaaacaatccttcggaagagcactacaaccacggtctag

SEQ ID NO: 58546 - DNA, 705 bp, Artificial Sequence
  Description of Artificial Sequence: Synthetic coding sequence
atgactgacagttctaaaactgacacactgaactccagctcatctggcaccaccgcctcttcccttgagaaaatcaaggtgcaagccaatgcaccactgatcaaaccacccgctcatccttctgctatcctgacagtgctacgtaagcccaacccaccgcctccccctccacgactgaccccagtgaaatgcgaagatcccaaacgcgtggttccaacagcaaatcctgtgaaaactaacggcaccttgctgcggaatgggggactccccggtggaccaaataagatcccaaacggcgatatatgctgtatcccaaactccaacctggacaaagccccagttcaactgctcatgcaccgtcccgagaaggatcggtgtcctcaggcaggtccccgagaacgcgtccggtttaatgagaaggtacagtaccacggttactgtccagactgtgacacacggtacaacatcaagaatcgtgaggtgcatttgcatagcgagcctgtgcacccacccggtaaaataccgcatcagggtcctccgctgccaccaaccccacatctgcctccttttccactggagaacggaggaatgggaatcagccactctaattcgtttcccccaataaggcccgctacggtacccccacctacagccccaaagccccagaagactattcttagaaagagcactacaacaaccgtctag

SEQ ID NO: 58547 - DNA, 705 bp, Artificial Sequence
  Description of Artificial Sequence: Synthetic coding sequence
atgacagatagttccaaaacagacaccttaaactcctctagcagcgggacaacggcctctagcctcgaaaaaattaaggtccaggcgaacgcccctttaattaagccgcctgctcatccaagcgcaattttgacagtactcagaaagcctaaccctccaccgcctcctccccgtcttactcctgtgaaatgtgaggaccctaaaagagtcgtccccaccgccaaccctgtcaaaactaatggaacgctgctcagaaatggaggcctgcctggcggacccaacaaaatcccaaacggcgacatctgttgcattcctaattctaacttagataaagcaccggtccaacttctgatgcatcgaccagaaaaggatcggtgtccccaggccggtcctcgagagagggtgcgattcaatgaaaaggtccagtaccatggatactgccctgattgtgacacccgatacaacattaaaaatcgtgaggtgcacctgcattccgagcccgtacatccgcctgggaagatacctcaccagggtccccctctgccaccgacaccacatctccctccctttccactcgaaaacggtggcatgggtatatctcatagtaatagcttccccccaattcggccagccactgtccctcccccaaccgccccaaagccccagaagaccattcttcgaaaatcaacaactactaccgtgtag

SEQ ID NO: 58548 - DNA, 429 bp, Artificial Sequence
  Description of Artificial Sequence: Synthetic coding sequence
atgacagactcttccaagaccgataccctgaactcgtcatcttctgggacgactgctagctcactcgaaaagatcaaagtgcaagccaatgcccctctgattaagccgcctgctcatccatctgcaatcctcacggttctgagaaaaccaaatccccctccccctcccccacgccttacccccgtgaagtgcgaggacccgaaaagagttgtgcctactgccaaccccgtgaagaccaatggcacacttctccgcaatggcggactgccaggcggacctaacaaaattccaaacggagatatctgctgtataccaaacagcaatctggataaggcaccagtgcagctgttgatgcatcgtccggaaaaggataggtgcccacaagcaggacccagggagagggtgcgttttaatgagaaggtccagtag

SEQ ID NO: 58549 - DNA, 1071 bp, Artificial Sequence
  Description of Artificial Sequence: Synthetic coding sequence
atggatacccagggccctgtgtcacaaccatttcagcagcctgagaagcctgggagggttaggagacgtaagacacgcagagaacggaacaaggccctggtaggatctcgtcgacccctcgctcaccacgaccctcctgtagccattagggatccccctgttgtccctactgccagcaagttagtggttattacccaaggaaggcttagtcgggagcatcggggactcttcaaccatgaggttaagtcgcttgatgtcgccagattgctgtccagcggaactctcgtgccaggttctcctaccctgcctgccaagccatccccatctcctggacgcgcacaggagcctgctcctaggtctcgcgataaggaaaatcaagtccccggaggatccgggcctggtccgcctagcagccctgaactctcaggcgttggacaattattggctgagctgcagtgccagctcagcttaccccaggcgtttcctcgcaggaacctaatacaggacgctcgggacgccattgtgcacaccctccaggcgtgtcatggctgcgtccccgacctggctctggtgctacgtggttgtcaaccccctctgcccggagcaaagcccggagtgtcagagagaaagatgacccctttttggataaattcaccggaccaggtccccgaacaggagcggcaacgcaaacaacagggcacgaaggagtttacatttcctatgccatacacatcttctatgcctacagctcacagaggaagcctggcaccccctcggggtccctggcccccatacttcccaagtctgtcatcaccatcgggtacagcatggggcccacctactgcatttgaccttctaaagagcatttggctcgtggccactccaccccctccacgcccttggggcgttggacttccccaacccttgccacagcccagcagtccacttctgccaagaacctccgtgctagactggtcacctagtccgcctagcccgctgcccagcctgtcgtgggtcgtcgcccagtcaagcccagaggcctggtcctttccgcctatgcgcctttactag

SEQ ID NO: 58550 - DNA, 1071 bp, Artificial Sequence
  Description of Artificial Sequence: Synthetic coding sequence
atggacacgcaggggccagtatctcagccctttcagcagcccgagaagccaggtagagttcggagacggaaaacccgacgtgaaaggaacaaggccttagtggggagccggagacctctagcccaccacgatccacctgtggctataagagatcccccagtcgtgcctaccgcctcaaaattggttgtcataacccagggtcgactgtctagagagcaccgcggtttgttcaatcacgaagtgaaaagtctggacgtggcgaggctcctgtcaagcggaacactcgtcccaggatcgcctacattgcctgctaagcccagcccgtcacccggaagggcccaggagccagcgcctcgttcccgggataaggaaaatcaagtgccaggcggtagcggtcctggcccacctagttctcccgagctgagcggagtgggccagctgctggcagaactccaatgccagttatctctgcctcaagcgtttcccagaagaaatctgatccaggacgcgcgtgatgcgatcgtgcatactctccaggcttgtcatggatgcgttccagacctcgcgcttgtgcttcgaggctgtcagccgcctttgcctggggcaaagcccggagtttcagagcgaaaaatgacacccttttggatcaattcaccagatcaagtccctgaacaggagcggcagcggaaacagcagggcacaaaggagttcactttccccatgccatatacaagcagcatgcctacagcccaccggggtagcctggctccacctaggggtccatggcctccgtacttccccagcctgtccagcccatcaggaacagcgtggggcccaccgactgctttcgacctgttaaagtcaatctggttggtagctactcctccgccaccaaggccttggggagttggactgccccagcctctcccccagccctcaagcccactgcttccccgtacctctgttcttgactggtcacctagtccaccatcaccccttcctagtctgtcctgggtcgttgcgcagagctcacccgaagcctggtctttccccccaatgagactttactag

SEQ ID NO: 58551 - DNA, 666 bp, Artificial Sequence
  Description of Artificial Sequence: Synthetic coding sequence
atggaggaaccgaggccttcaaaaagactgcggtcaatggcacccaatcaggcctccggcggaccccctccggaaccagggtgctgcgtggcagatcctgaaggtagcgtggaggccgacggccctgcccagcctgctcaacccgcaaagcctatcgcatatgtgaaaccctttagaagacaaccgcctgcgagacctgaatctccacccccagccgaacgcggtcgcaggagaggtgggtcacgcagaccaggtcgagggcgaggccgacgagccggtccgcgtggggacgctggacagagacagggagctgaaggcttaatggcaccagatgttcacattcaattagaccatcacggtgagcctggacaccagggtgaacctgagatcacagagactgcggcattttccttgtccgaaacagggccacctccgggtacagtgcaggaagggcctggccctgatgtcgcccagccggaactcggcttccaggaaccccctgcagccccagggccacaggcagtggactggcagcccgttctgactttatatccatgcattgggtttagagccctcggcgactccgccgtgctgcaggtcattcagacacctcagggtacctacgtgcagggagtccccgtgtttctgacagatatcgcctattag

SEQ ID NO: 58552 - DNA, 666 bp, Artificial Sequence
  Description of Artificial Sequence: Synthetic coding sequence
atggaggagcctaggccaagtaagcggcttcgaagcatggcacccaaccaggcttcaggcggtcccccacctgagcctggttgctgtgtggccgaccccgaagggagcgtggaggccgacgggcctgcccagcctgcccagccggctaaaccaatagcatacgttaaacctttccgcagacagccacctgccaggccagaaagtcctccccctgctgagcggggaaggagacgagggggaagccgcaggcctggacggggaaggggcaggagagcgggtccccgtggggacgccggacaaagacagggagccgaggggctgatggcccctgatgttcacattcagttagatcatcacggtgagccgggacaccagggagaacccgagattactgagactgcagctttcagcctgtcagaaacagggcctccgccaggaactgtgcaggagggtcccggacctgatgttgctcagcctgagcttggatttcaggagcctccagccgcacctggtccacaggcagtagattggcaaccagtcctcacattgtacccttgtataggctttcgcgcattaggcgattctgccgtactgcaggtgatacagacgccacaaggaacctacgtccaaggtgttcccgtattcctgaccgatattgcctactag

SEQ ID NO: 58553 - DNA, 666 bp, Artificial Sequence
  Description of Artificial Sequence: Synthetic coding sequence
atggaagaacctcgtccctccaagcgcttgagatctatggcacccaatcaggctagcgggggtcctccacccgaaccaggttgctgtgtcgccgatcctgaaggctctgtcgaagctgacggtccggctcaaccagcacagcccgcaaagcccatagcctatgtgaagccattccgccgacaaccacctgctaggcccgaaagtccaccacccgcagagcgtggcagacggcgaggcggttctagacggcctggaagaggcaggggtcggcgagctgggcctaggggcgatgctggacaaaggcagggtgccgaagggctcatggcacctgatgtgcatatccaactagaccatcatggggaacctggccaccaaggggagcctgagatcactgaaaccgcagccttcagtttgtcagaaacgggacccccaccaggcactgtacaggagggacctggaccggacgttgcccaaccagagctgggcttccaggagccacccgcagctccagggcctcaagctgttgattggcagccagtattaactctgtacccttgtattggttttagggcattgggagactctgcagtcctgcaggtcattcagacccctcaaggaacctacgtgcaaggggtgcccgtgttccttactgatattgcctactag

SEQ ID NO: 58554 - DNA, 666 bp, Artificial Sequence
  Description of Artificial Sequence: Synthetic coding sequence
atggaggaacccagaccatccaagcggctgcgcagcatggcgccaaatcaagcgtccggaggtcccccacccgaaccaggatgctgtgtggccgacccggaggggagcgtagaagccgatgggccagctcaacctgcccagccagctaaaccgatcgcctacgtcaagccttttcggagacaacccccagcccgtccggaaagcccacccccagctgaacgcggtcgcagacgcggaggttctcgcagaccaggccgtggccgtggacgcagggcaggcccaagaggcgacgccggacagcgccagggggctgaagggctgatggccccagatgtgcacatccagcttgatcaccacggcgagccgggacaccaaggagaaccagaaataaccgaaacagctgcattctctctcagtgagactggcccaccccctgggactgtacaggaaggaccgggacctgatgtcgcacagccggagctcggatttcaggagccaccagcagctccaggccctcaggccgtggattggcaacctgtgcttacactgtatccctgtatcggtttccgggcactcggtgacagcgcggtcctgcaggtgatacagaccccgcagggaacgtacgtgcagggagtaccggtgttcctcacagatattgcttactag

SEQ ID NO: 58555 - DNA, 666 bp, Artificial Sequence
  Description of Artificial Sequence: Synthetic coding sequence
atggaggagccaagaccttccaaaagattacggtcaatggcgcctaatcaggccagtggaggcccacctcctgagcccggatgctgcgtggccgaccctgaaggctctgtggaggccgacgggcctgctcagcccgctcagccagcaaagccgattgcttacgttaaacccttcaggaggcagcctcctgcacgaccagagtctcctccccctgctgaacggggacgaagacgaggcggatctcggagacccggacgcggacgcggaaggcgtgccggaccaaggggagatgccggacagagacagggcgctgaaggtctgatggcgccagacgtacacattcagctggatcaccacggcgagcccggtcatcagggcgaaccagagataacggaaacagccgctttttcactctctgaaacaggccctcccccaggcacagtgcaggaagggcctgggcctgacgtagctcagcccgaattgggattccaggaacccccagcagcccctggtccccaggccgtggattggcagcccgtcctcacactgtatccctgcattggatttcgcgcactcggcgactctgccgtgctgcaggtgatacaaactccccagggcacatacgtgcagggggtgccagtattcctgacggacattgcctattag

SEQ ID NO: 58556 - DNA, 666 bp, Artificial Sequence
  Description of Artificial Sequence: Synthetic coding sequence
atggaagagccgaggccttccaagcgactgaggagcatggccccaaatcaggcgtccggaggcccaccgcctgagcctgggtgttgcgtcgcagaccccgaggggagcgtagaagcagacggtcccgctcagcccgctcagccagccaagccaatcgcctacgtgaagcccttcaggagacagcctcctgcgagaccggaatcaccccctcccgctgagcgcggtaggaggcgcggaggtagccggaggccaggtaggggacggggaaggcgcgcagggccacgaggggatgcgggacagagacaaggagccgaaggcctgatggcccctgacgtgcacattcagctcgatcaccacggtgaacctggccaccaaggagagcccgagattaccgaaaccgccgctttcagtcttagtgaaactggcccaccaccagggactgtgcaggaggggcctgggccagacgttgcccagccagagctgggattccaggagccacccgcagcacccggaccacaggccgtggactggcagcccgtcctcaccctatatccctgtattggcttcagggctttgggtgacagcgcagtcttgcaggtgatccagaccccccaagggacatacgtgcagggcgtgcccgtgttcctgaccgacatcgcctactag

SEQ ID NO: 58557 - DNA, 666 bp, Artificial Sequence
  Description of Artificial Sequence: Synthetic coding sequence
atggaagagccgagaccaagcaagagactgcggtctatggccccaaaccaggcatccggcggtccgccacccgagcctggctgttgcgtggctgacccagaaggctccgtggaggcagatggaccagcccagccagcacagccagcaaaacctatcgcttacgtgaaacccttcaggcggcagcctcctgcacgacccgaaagccccccacccgctgaacgtggaaggagaagggggggatctcggagaccgggacggggacgagggcgtagggctggacccagaggcgacgccggacagaggcaaggcgcagagggcctgatggcccctgacgttcatatacagctggatcaccacggagaacccggacatcagggcgagccagaaattacagagacagcagccttttctctgtccgagactggccctccacctgggactgttcaggaggggcctggtcccgatgtcgcccagcccgaattgggttttcaggagcctcccgcagctcccggtccccaggctgtagattggcagcctgtactgacattgtacccttgcatcggattcagggccctcggggactccgctgtactccaagttattcagactccccagggcacttacgtgcaaggagtccctgtatttctcacggacattgcctactag

SEQ ID NO: 58558 - DNA, 666 bp, Artificial Sequence
  Description of Artificial Sequence: Synthetic coding sequence
atggaggaaccaaggcctagcaaacgcctgcgatctatggccccaaatcaagcctccggaggcccacctccagagccaggctgctgcgtggccgatccagagggcagtgttgaggcggatggacctgcccagccagcccaacccgctaaaccgattgcctatgtgaagccttttcggagacagccccctgccaggcccgagtctccacccccagccgaaagaggccgaaggagaggcggaagccgaagaccgggaaggggccgaggccgacgagcaggacctcggggagatgctggccagagacagggagccgaaggtctcatggcgccagatgtacatattcaactcgaccatcacggcgagcctggtcatcagggcgagcctgaaatcaccgagacagctgccttttctctgagtgagactggccctccccctggcaccgtgcaagaggggcctggtcccgatgtagcccagccagaactgggtttccaagaaccacccgcagctcctggaccccaagcggttgattggcagcctgttttgaccctatacccttgcatcggatttcgggcattaggcgactccgccgttctgcaggttatacagacaccccagggaacctacgtccagggcgttcccgtcttccttaccgacatcgcctattag

SEQ ID NO: 58559 - DNA, 666 bp, Artificial Sequence
  Description of Artificial Sequence: Synthetic coding sequence
atggaagagcccaggccttctaaacggctaagaagcatggcaccaaatcaggcatctggcggaccgcctcctgaacccggatgttgcgtggccgaccccgaggggagcgtcgaagccgacgggccagctcagcctgcacagcctgctaagccaatcgcctacgtgaaacctttccgccgacagccccctgccagacctgagagcccccctcctgccgaaagagggaggcgccgtggcggtagcaggcggccagggcgaggccgaggcaggcgagctggacccaggggagatgcaggccagaggcagggtgctgagggcctgatggcaccggacgtgcatattcagctggaccaccacggagaacccggacaccagggtgagcctgagattacagaaacagctgcgttctccctgtctgaaacgggaccaccccctggaactgtccaagagggcccaggacccgatgtcgcacagcccgagctggggtttcaagagcccccagctgctcccggacctcaggcggttgattggcaaccggtcctcactctttacccatgcattggatttagagctctgggggattcggcggtgctgcaggtaattcaaacaccccaaggcacttatgtgcagggcgtgccggtcttccttactgacattgcttactag

SEQ ID NO: 58560 - DNA, 1170 bp, Artificial Sequence
  Description of Artificial Sequence: Synthetic coding sequence
atgcacgcatgttcatctacagccctgcacccgcgtccgtttatccatgggtttagctttacaaccttcctccagcagctgttccctcacggctccagcaccgcacttcacccttggccatttatccacggatcatctcccatggcactgcaccctcggttattcacacatggcccatccagcacagctctgcacccatgccccttcacccacggaagtagtcctatgtcgctgcaccctcggctgtttactcatagtccatcttcaatgcccctgcacccacgcccattcgtgcacgcatcgtctccaaccgcccttcgcccttgccttttcacacacggccctagctcaatgcccctgcacccaagaccattcgtccatgcttcatctccaacagcccttccaccttgtctctttacacacggaccttcttccatgccgctgcacccaaggcccttcctgcacgcatcctcacccaccgccctgccgccttgcctgttcacacacgggccttcttccatgccgctgcacccgcgaccatttgtccacgcaagttcgcccacggccctcaggccctgcctcttcactcacggaccgtccagcatgcctttgcatccaagaccttttgtgcatgcaagcagtcccaccgctctgcccccatgtctttttacccatggaccttcctcaatgccacttcatcccagaccctttgttcacgcatccagtcccacagccttgcgcccatgtctgtttacccacggacccagcagcatgcccttacaccccaggccattccttcacgcaagttcgcccaccgctctcagaccatgcttgtttacgcacggtccttcttctatgccactgcatcccagaccatttgtgcacgctagttcccctacagcccttcgtccatgtttatttactcacggcccatcctcgatgccgttgcatccgaggccttttgtgcacgccagctccagtactagcctgcatcccagaccgttcatccatgctagctcctctaagtctctgcacctgcggctcttcagtcactcatcttgcctagtgggtttttcacagcaggggaatgtcttacttctgtccgctcgggcaacctttaacacctgtctgctggtgagcaacatgtatttcctgatcattagctattag

SEQ ID NO: 58561 - DNA, 1170 bp, Artificial Sequence
  Description of Artificial Sequence: Synthetic coding sequence
atgcacgcctgtagctctaccgccctccacccgcgacctttcattcacgggttttccttcacaacttttctccaacagttgttccctcacggcagctccaccgcccttcatccctggcccttcattcacggcagtagcccaatggcacttcaccctcggctgtttacgcacggaccctcatcaacagcattacacccttgcccattcacgcacgggtcgtcacccatgtcacttcaccccagactgtttacacattctccaagcagcatgcccctgcaccctcggccattcgtacatgcctcttctcccactgcacttagaccctgtctttttacccacggcccatccagtatgccgttacatccaaggccttttgtccatgcaagctcacctacagcactgcccccttgtctgttcactcacggcccaagctcaatgcccctgcacccaagaccttttctacatgctagttctccaactgccctaccaccctgcctgtttacccatggaccgtcaagcatgcccctgcatcctcgacctttcgtgcatgcatcaagccctactgcgctgaggccatgccttttcacacacggaccaagctctatgcccctgcatccccgacccttcgtccacgcctcttccccaacagcgctgccaccttgcctgttcacacatggcccatcttctatgccactgcatccgagacctttcgtccatgcatccagtcccactgctctgagaccttgcctttttacccatggtccatcctccatgcccctacatcccagaccttttcttcatgcctcgagccctacagccctcagaccctgccttttcacgcacgggccttcatccatgccccttcacccgaggccattcgtccatgcatcaagcccaaccgccctgagaccctgcctctttacacacgggccttctagcatgcctcttcacccacggcctttcgtgcatgcctcttccagcacaagcctgcacccacgaccattcattcacgctagttcaagcaaatcccttcatcttcggctcttcagtcatagctcttgtcttgtcggatttagtcagcagggcaacgtgctgctgctgtctgcccgagctacgtttaacacatgcttgctggtatccaatatgtacttcctgataatctcatactag

SEQ ID NO: 58562 - DNA, 1269 bp, Artificial Sequence
  Description of Artificial Sequence: Synthetic coding sequence
atgcagcatcccaaacctttttgcgcgcctgcggcaccccaggaaggtttttcccctcagtctctggaaggtgccgaggtgctgggaaaccagcctgccccaacctgcgctgagccccctccagccatggggagcctgaatttgtaccaccctcctgatccggaaaaagaagttttcccagctccaccagctggcttccagatggccccatgcgggtgtttctttgatcctaggatatatagaatagaatggacaactcccgatctgggccaatctgccctatataagctggctgccagcagcgggggacccgcaggggtccccagcgccccaggctcatatctacttgaaccccagccttatctgaaggcacccggacttccgccttatccgcattaccagcaggcaccgggtggtccacagttcctcctgccctatttcccaccagaggggcctggcccagaagccttaggtttcgtcggggatgccggtccagcggcttttgtggagttgccattgcctccgcttgaggagggtcccgctccattaccccctccccctccaaaagaaaataaaccccctcctgtgctgatcacactgccagcagaacctactttgcctccagatgcttacagtcatctccagggccacctcgggcattttccaggcccagagcccttggctttccccgtcaaagagctgcaaggatcgggagcgaggcctggagtgcccctatatccgcctggactctcagaactgaaagtggccgaagttaaggaaggggctctcctaggggcaggcaaggccaaggcaccaaaaaccgcgagggctctcgctttgccagataaagtgctcttggaagatgccatgaaattgtttgactgcctgcccggtgccagcgaaccagagggtacgctgtgtgaagtccccggacctgcgctgccagactcttccgggggaaattccgccgatgatatcagaagcttatgcctcccagaggaattgctgtcctttgactactcggtcccagagatactggacaccgtgtcaaacgttgattacttctttaattttaaggcactggatgaggagcagccccctcaccccggaccacctgccaccaacaccccggcacccattttgtccgggaagagaaaagcatccacggctaagaaaggcaagcctggacgaaaagctcggcagcctgccggacctgcttcagctaccccgcctgggcctcgagaggatctcggagcgactcctcattag

SEQ ID NO: 58563 - DNA, 801 bp, Artificial Sequence
  Description of Artificial Sequence: Synthetic coding sequence
atggggtctaggccacgtagtccgtcagccttccctgccccatggtggggacagcaacccggaggtcccggacctgcgaaaaggctccgactcgaggagcccgcaggccctgagccgcgtgtagcccctagcctcgaggatcccgcaggaacgccagctgttggagccttgacaagtatcgtcgtccttgcagccggttgcgctctgcgggttcctctcgacgatgtggacctggtcctcgagctgcccccaaccagtatcctgcgtgtttcacttgacggccacacacttatcttaatacccgaggtgctgctctcctccgtggacgaacggtccggggcacaggacgacagctctgctggacttgaagttgatgtcttcttgggcgctctgcgtgaagacgttgtggtggaacaggaagttttttgtgcctccgtccccgaaattgcggcacaggaggaggcttacgaagaggacgcagaccccgaattcccagaattacagatggatagcgcagctggctccgctgccggtctctactccagcgcccgatcaatgttctctccctacagggagggccctattcctgagccctgcgccttggctcctaaccccagttcggagggccacagccctggtcccttcttcgacccagagttcaggctgctggagcctgttccttctagtcctcttcaacctctgccaccaagcccaagagtgggttcccctggaccacatgcacatcctcccttgccaaaacgaccaccgtgcaaagcgagaaggcggctgtttcaggagtag

SEQ ID NO: 58564 - DNA, 798 bp, Artificial Sequence
  Description of Artificial Sequence: Synthetic coding sequence
atggtaagcagacccagatccccctccgccttcccggctccttggtgggggcaacagccagggggacctggcccagcaaagagactgcggctggaggaacccgctggccctgagcccagagctgcaccctctctggaagacccagccggtgacccggcagtcgatgccctgacatctattgtagtgctcgcagctggatgtgccctccgagtccctcttgacgacgttgatctggtactcgagccagccccaacttctatcctgcgcgtgagtttgggcggacacaccctgattctgatccccgaggtcctgctgagctccgtggatgaacgaagcggcgctcaacacgactcaagcgcgggtctagaggtggacgtctttctgggagccgtccgtgaagatgtcgtggtggagctagagttttgcgcatcagtccccgagattgccgcacaagaagaagcctatgaggaggacgcagatcctgaatttcccgaactgaggatggattcaccaacaggcagcgcagccggtctgtacccttcctcaaggtctatgttcattccatatcgcgagggccctatccccgaaccctgcgctttagctccaaaccctagctcagagagaagatcaccccgtccaatcttcgatcttgagtttaggctgctcgaacccgtgccttctagtccattgcagcctctccctccttctccatgcgtcggttcacctggtcctcatgcacggtctcctttaccagagcgaccaccatgcaaagcgaggaggcgactgtttcaggcctag

SEQ ID NO: 58565 - DNA, 789 bp, Artificial Sequence
  Description of Artificial Sequence: Synthetic coding sequence
atgggcagccgcccttgttccccttccgcttgtctggccccatggtggggccaacagcccggaggcccaggccctgccaaacgcagtcgattagaggaaccggcaggaccagagagtcgcgctgccccatcccctgaagacccagcgggaaccccggctgttgacgcattaacgagtatggttgtgttggatgccggttgtgctcttagggtgccgctcgaggatgttgacctggtcctagaactcgcgccaatgtcagtgcttagggtgtctctgggaggccatacccttatcgtaatcccagaggttctcttaagcagcgtggacgagtgtagcggtgcccagggggactggagtgccggactggaggtggatgtttttctcggcgcacacggtgaagacgtggtggtggaacaggaggtttgcgccagcgtgcctgaaattgccgcagaggaggaggcatatgaagaggacgccgacagcgagtttcccgaactatggatggattccgctgcgggttccgccgctggcctgtatcctagcgccaggagcatgttctcaccctatcgcgaaggtcccatacgaggtccatgcgcattagcccctaatccttcatccgagaggagaagtcctcggccaatctttgatctggaattccacctactggaaccagtaccctcctctccactgcagccactgccaccttcaccatctcctggcccacatgcgagacccgagctgcccgaaaggcccccttgcaaagtccgacgcagactgtttcaggaatag

SEQ ID NO: 58566 - DNA, 789 bp, Artificial Sequence
  Description of Artificial Sequence: Synthetic coding sequence
atggggtcaagaccttgtagcccttctgcctgtctggctccgtggtgggggcagcagcccggagggcctgggcctgcaaagaggtccagattagaggaaccggcaggccctgagtcaagagcagctccatctcccgaagacccagccggtactcctgcggtcgatgctcttacaagtatggtggtgctcgatgctggctgcgccctgagggtgcccctggaggacgtggatctggtgctggaactcgctcccatgagtgttctcagagtctctctaggcggacatactcttatcgtcatcccagaagtgcttctgtcgtccgtggatgagtgcagcggtgcccagggcgattggtcagctggccttgaggtcgacgtgtttttgggtgcccatggggaggacgtggtggtcgaacaggaagtgtgtgcttctgtgccagagatcgccgcagaggaagaggcatacgaggaagacgcggatagcgaattccccgagctgtggatggactcagctgccggatctgctgctgggctctaccctagcgcgagatcgatgttctccccttaccgggaggggcctatacggggtccatgcgctctggccccaaaccctagttccgagcgcagatctcccaggccgatttttgacttggagtttcacctgctggaacccgtgccttccagtccacttcagccactgcccccaagcccgagcccgggaccacatgcaagacctgaactgccagagcgaccaccctgcaaagtgaggagaaggttgttccaggaatag

SEQ ID NO: 58567 - DNA, 429 bp, Artificial Sequence
  Description of Artificial Sequence: Synthetic coding sequence
atgcggggaacttcttgcgtcggcggaggagcagaaagcccaggaggcgcaggcttgtcggagggccctaggggtaggtggctcagattagcgcctgtctgtgcttactttctgtgcgtgagcctagcggcagtgttactcgcggtttactacggactgatctgggtgcccaccagatcccccgcagcgccagccggacctcagccaagcgctccatcaccgccttgtgcggctaggccaggcgtgcctccagtcccagctcctgctgctgcttcgctcagttgcctccttggcgtccctggaggaccaaggccccagctacaactccctttaagtcggagacggcgatactccgaccccgaccgcaggccttcgcgccagaccccacgggaaacccctgaagcagcagaggggaggcggccaggctag

SEQ ID NO: 58568 - DNA, 1209 bp, Artificial Sequence
  Description of Artificial Sequence: Synthetic coding sequence
atggccaggactgaccagaaacccccttgcaggggcggatgttggggccaacccggacaccccaatacaggcggagctgctgcccacccgacgtaccaccccatgggacatcggcctcggacatgcatcctgctcagaggagatcagacaacaggaggccaggccccttcccgggaaatatctctgggcccttgggccgcagggacacacttcttggcaatctcaacaacgccctggggaagaaagactccagcctgtatctcagagctccctacttcatctggcaccgctcaaccactcgctaatgctgtgtgtgaagtgcaaaccgtgcctgggcctgggctgaggccgcagggcactcccgcaatgcgcgctccatcgcacaagggcactccacctacccccaacccttggggccctgaacaaccacagaatcgccataaacaccctaaaaagggcgtgactgggggtcctagtccacctccgccagctgcgtcgcggtatggccagaccccagggagggaacctagggtgcaggcaccgggactcggaccctgcggtcgcccagcttcaggtagactcctgtcactccatttggagaagggagatgggaaaggtacccgacaaagaattcctcttacggacgcagccgtcgggggagaccggactgatattccatctgccattgcggcaggaccagcacgcacaccagaccgccatggtttgcccattcctgggtctacacccacccccatggttggaagcggccgtctgggtgcccctgttgggagatcaggagggggtgcgtcggcacgcagctctcgccctagctgtgctaatgtcctactgcgtgctgacgcatccctggggaccgtgctcagcgtgttatggaccggacagctgagccgcggttgggcgctgctgcctcctggggatgcaggacggcacctggagacaagcgtcattagcgccggtgtggcagctgggatttggttggtggagccaggcgaagctgctcaggatcccgcaacccgccgaacagctcctcctagaaggacagcctctcccgagccacccgctcctggagccccactgcctgcatgtccaggcaggatcccaggagctgcccgatttgggccacgctcctgtcctctcggttccccagccgtgttggctgtcaccacaggttggagccataggtctgtgtag

SEQ ID NO: 58569 - DNA, 351 bp, Artificial Sequence
  Description of Artificial Sequence: Synthetic coding sequence
atgagcttctctgagcagcaatgcaaacagccttgcgtcccaccgccttgccttcccaagacacaggaacagtgtcaggctaaggcagaagaagtctgcctgcccacgtgtcagcatccctgccaggacaaatgccttgtccaggcacaggaggtctgcttgtcacagtgtcaggaaagttcccaggagaaatgcccacagcaaggacaggagccctacctgcccccttgtcaggatcaatgtccccctcagtgtgctgagccatgccaagaactgtttcagaccaagtgtgtcgaggtctgcccacagaaggtgcaagagaagtgttcttccccaggaaaggggaagtag

SEQ ID NO: 58570 - DNA, 657 bp, Artificial Sequence
  Description of Artificial Sequence: Synthetic coding sequence
atgggacgggtttttctgacgggtgaaaaggccaatagtatcttgaaacgatatcctcgggcaaatggattctttgaagagatccgtcagggcaatattgaacgcgagtgcaaggaagagttttgtacctttgaggaggccagggaagcatttgagaataatgagaagactaaggagttttggagtacatatacaaaagctcagcagggcgagtcaaaccggggatccgattggtttcagttctatctcaccttcccattgatctttgggctgtttatcattctgttggtgatcttcctgatctggcggtgctttttgcgcaacaagacgagacgccaaaccgtgacagagggtcatatcccgtttccccagcacctaaatatcattacaccgccaccccctcccgacgaagtctttgattcctcgggccttagtccagggttcctaggatatgtggtcgggagaagcgacagcgtgtcaacaaggctaagcaactgtgacccacctccgacatatgaagaagccacggggcaggtgaacctgcaacgctcagagacggaacctcatctggacccaccgccagaatacgaggatatcgtgaattccaactcagcctcggcaatacccatggtgccagttgtgactaccatcaaatag

SEQ ID NO: 58571 - DNA, 657 bp, Artificial Sequence
  Description of Artificial Sequence: Synthetic coding sequence
atgggtcgagtgtttcttacaggtgagaaggctaactctattttgaaaagatatcctagggctaacggattcttcgaagagataagacaggggaacattgaaagagagtgtaaagaggagttttgcactttcgaagaagccagggaggccttcgaaaataacgagaaaaccaaggaattctggtctacttacaccaaagcgcagcagggagagtccaacaggggttcagattggttccagttttacctgacgtttcccctgattttcgggttgtttattatacttctcgtgatcttcttgatttggcgctgttttctcaggaataagacccgccgacagaccgtcaccgagggccatatcccatttccccagcatcttaatatcattacaccccctcctccgccagacgaggtctttgattctagcggactctcccccggattcctaggttacgtcgtcggcagaagcgattctgtaagtacaagactgtctaattgcgatccccctccaacctatgaagaggctaccggccaggtgaacttacagaggtctgagactgaaccacatctagacccaccaccagaatacgaagacatcgtgaattctaactctgcaagcgcaatccccatggtgcctgtcgtaacaacgatcaagtag

SEQ ID NO: 58572 - DNA, 657 bp, Artificial Sequence
  Description of Artificial Sequence: Synthetic coding sequence
atggggagagttttcttgactggagaaaaggctaatagtattttgaaacggtatcctcgcgctaacggcttttttgaagagatcaggcaaggtaacattgagcgcgagtgtaaagaggagttctgcaccttcgaagaggcgagggaggcctttgagaataacgaaaaaacaaaagagttctggtcaacttatacaaaggcccagcagggagagagtaacagaggtagcgactggtttcagttctacctgacgttccccttgattttcggattattcattattctattggtgatattcttgatatggagatgcttcctccggaacaaaaccagaaggcagactgttactgaagggcacataccttttccccagcacttgaatataataacaccaccacccccacctgacgaggtttttgattcatccgggctgtcccctgggttcctggggtacgttgtgggaaggagcgacagcgtcagcactcgcctgtctaactgtgatccccctcctacttatgaggaagccacaggtcaggttaatttgcagcgatcagaaacggagccgcatctcgacccgccacctgagtatgaagacattgtgaactcgaacagcgccagcgctatcccaatggttcccgtggtgacaaccatcaaatag

SEQ ID NO: 58573 - DNA, 657 bp, Artificial Sequence
  Description of Artificial Sequence: Synthetic coding sequence
atgggcagagtgttcctgactggcgagaaggcgaatagtattctgaagagatatcctcgcgcaaatgggtttttcgaagaaataagacaaggaaatatcgagagagagtgcaaggaggaattctgtacgttcgaagaggctcgggaagctttcgagaataatgaaaaaacaaaggaattctggtctacctacaccaaagcacagcagggcgagtccaaccggggaagcgattggtttcaattttatctcacgttcccgctgatcttcggtcttttcattatcctgctcgtcatttttctgatctggagatgttttctccgaaataaaaccagaagacagaccgtcacggaaggacacataccatttcctcagcatttgaacattatcacacctcccccacctcccgatgaagtgtttgactcctctgggttgtcccccggtttcctgggatacgtcgttggcaggtccgatagcgtcagcactaggctctcgaactgtgatccgccacctacatatgaggaggccactggtcaagttaacctacagagatccgaaacagaaccacatctcgaccccccaccagaatacgaggacattgtgaattccaactccgcatctgctatccctatggtacccgtggtgaccacaattaagtag

SEQ ID NO: 58574 - DNA, 249 bp, Artificial Sequence
  Description of Artificial Sequence: Synthetic coding sequence
atggatcccggacctaaagggcactgccactgcggaggtcacggccatccgccaggacattgtggtccaccacccggtcatgggcctggcccttgtggacccccacctcatcacggccctggtccctgtgggcctccgccagggcatgggccaggcccatgtggcccaccgccacatcacgggcctggtccatgtggccctccaccgggacatggcccagggcacccgcctcctggcccacaccactag

SEQ ID NO: 58575 - DNA, 246 bp, Artificial Sequence
  Description of Artificial Sequence: Synthetic coding sequence
atggatccaggcaagggtcactgccattgcggcggtcatggccatccacccggtcattgcgggccaccaccaggacatggcccaggcccttgtggcccacctcctcatcatgggcctggcccttgcgggcctcccccagggcatgggccagggccttgcggcccacctccgcaccacggccctggcccttgtggccctcccccaggccatggccctggtcatccccctccagggccacaccactag

SEQ ID NO: 58576 - DNA, 537 bp, Artificial Sequence
  Description of Artificial Sequence: Synthetic coding sequence
tgacgctcacaggtctacatgcatcctagcctgagcccaccaagcaccatgattctgtccggtggaaccgcactaaagccaccctacagtgcgtttccagggatgcagcccctggaaatggtcaaacctcaaagtggatcaccctatcagcccatgtccggtaatcaagctctggtttatgagggccagttgtctcaggccgcaggcctgggagcgtcacaaatgctagatagccagcttcctcagctgactatgcccctcccaagatacggcagcggacagcaacctctcatcctgccacagtctattcagcttccccctggacaatccctttctgtgggcgctcccaggcgaatcccccctcccggatctcaacctccagttctcaacacttcccgggagccttcacagatggaaatgaaaggtttccattttgcagacagcaagcagaatgtcccgagtggtggtccagtcccatccccacaaacctaccgccagaataacgaatggatgcggaatcccgcatgggaaccctag

SEQ ID NO: 58577 - DNA, 6689 bp, Artificial Sequence
  Description of Artificial Sequence: Synthetic coding sequence
atgtcagacaggcttggccagatcacaaaaggaaaagacggtaagtccaagtatagcacattgtctttgtttgacaaatacaagggcaagtccgtcgatgcaatccggtcttctgtgattccgcgtcatggattacagagtctgggaaaggtggccgcagctagacggatgccgccaccggctaacctgcccagtttgaaaagcgaaaacaaaggcaacgaccctaatatcgttattgtgccgaaagacgggaccggctgggccaacaagcaggatcaacaggatcctaagtcctccagtgccaccgcctctcagccacctgagtccttgccccaacctgggctccagaagtctgtgagtaacctccagaagccaacacaatctatttcccaggaaaataccaattccgtccctggcggaccaaaatcatgggctcagctgaatggcaagccagtcggacatgagggcggactgcgcggatcttcccgacttctatccttctccccagaggagttccctacacttaaggctgccggtggacaagataaagccggtaaggagaagggcgtgcttgacttgagctatggacccggaccctctttgcgaccgcaaaacgtgacatcttggcgcgagggcggtggaagacacatcatttcagctaccagcctgtccacatccccaaccgagctgggttcccgcaattcctcaaccggcgatggcgctcccagttctgcgtgcacttctgactccaaagacccttccctacggcctgcccaaccagtacggaaaggagcttcacagtttatgggaaacgtctaccatccccctacgtatcatgatatgctcccggcttttatgtgttcacctaagtctagcgagaaccaggggactgtggaacgcggttccttcccccttccccaactcaggcttgagccacgcgtgccgtttcgccagttccagatgaatgaccaggatgggaaagagaaccgtcttggcctgtccaggccgttacgaccactccgccagctcgttgagcgagccccaagacccaccattataaatgccgaaaacctgaagggactggacgacctagatgctgacgcggatgatgggtgggctggactgcacgaagaagtcgactactcagaaaagctgaagtttagtgacgacgaagaggaagaggaggtggtgaaagacggtcgaccaaaatggaatagttgggatcctcggagacagcgccaactatctatgtcaagcgcagatagcgcggatgcaaagcggacaagggaagaagggaaggattgggccgaggccgtgggagcatccagagtggtgcggaaggcgcctgatccgcagcctcccccaagaaagctccacggatgggctcctggaccagattaccagaaaagctccatgggtagtatgtttcgacagcagtctatcgaggataaagaggataagccacccccaagacaaaaatttatacagtccgaaatgtctgaagccgttgaacgagctagaaaaaggcgggaagaggaagagcgacgggcaagggaagagcggctggcagcatgtgcagcaaagctgaaacagctggaccaaaaatgcaagcaagcaaggaaggcaggcgaagcccgaaagcaggccgagaaagaagtgccctggtcccctagcgcagaaaaagcttcccctcaggagaacggcccagccgttcataaagggagcccagagttccctgcacaagagactcccaccaccttccccgaagaggccccaacggtgtctccagctgttgcgcagtctaatagctccgaagaagaggccagggaggcgggttcccctgcccaggaattcaagtatcaaaaatctctacccccacgtttccagcgtcaacagcaacaacagcagcaggagcagctatacaaaatgcagcattggcaaccggtgtaccccccaccttcccaccctcagcggacattctatccccatcacccccagatgctgggattcgaccccaggtggatgatgatgcctagctatatggacccccgaatcactcccacccggactcctgtcgatttctatccatccgctctgcacccaagcggactgatgaaaccgatgatgcctcaagaaagccttaacgggaccgggtgtcggagcgaagatcagaattgcgtacccccactgcaggagcggaaagtgacacctatcgacagtcctcctgtgtggagccctgaaggatacatggccctgcagtctaaagggtacccattaccccacccaaaatcctccgatacacttgcgatggacatgagggtacgcaatgaatctagtttttccgcgtcacttggcagggcagggggagtgagcgcacaacgcgacctcttcgaggaacgtggagaggagtacctaagtgcattcgataagaaggctcaggccgacttcgactcctgtatcagctctcagcggatcggacaggagctgctgttcccaccacaggagaatgtacaggacgccggtgccccaggtggccatactcagaacctacgttgctcaccactggaaccagacttcgtgcctgatgaaaaaaaaccagaatgcggtagttgggatgtgagccatcagcctgaaaccgccgatactgcccatggggtggagagagagacaccacgggagggaacagcttttaatatttctagttgggacaaaaacggatcgccaaacaagcagccaagctccgagcccgagtggacacccgagccccgaagttcttctagtcagcatccggagcagacgggcaggactcgtaggagtggccctatcaagaaacctgtgctcaaggccctgaaggtggaagacaaggagaaagagctcgagaaaatcaaacaggagctgggagaggagtctacccgtttagccaaggagaaggagcagtctcccaccgccgaaaaggacgaggacgaggaaaatgatgccagcctcgcgaatagttcgactaccactttagaggataaaggacctggacacgctacatttggtcgggaggccactaagttcgaggaggaggaaaaacccgataaggcctgggaggcacggccaccacgcgagtcctcagatgttccacccatgaagcgtaacaactggatttttatcgatgaggagcaagctttcggcgtgcggggacaagcccgtggcagagggaggggattccgtgagttcacttttaggggcaggcccgctgggggtaatggttcagggctgtgtggcggaggtgttctgggagctagatcaatatattgctcttctcagcgatccggaagaggacgtggactgcgcgagttcgcacgccctgaagattgcccgagggcaaaaccacgaagaagggtcgccagcgagactcacagcgagggttccgagtatgaggagctgcccaagcggagaaggcagaggggaagcgaaaacggcaacgaggggagcctccttgaaagagaggaaagtaccctcaagaagggagattgtcgcgactcctggcgcagcaataagggctgttccgaggatcacagtggacttgacgccaagtctagaggccctcgggcttttggaagagcactacctcctaggttgagcaactgcgggtacggcagacggacatttgtttctaaagagtccccacactggcagtccaagtctcccggatccagctggcaagaatacggaccttccgacacctgtggaagtcggagaccaacagatagagattacgtgccggattcttataggcaccctgatgccttcggaggacgcggattcgaggattcacgagcagaggataaacgatccttttttcaggacgagcacgtcgccgatagcgagaatgccgagaacagacctttcaggcgccgaaggcctccgaggcaggacaaaccgccaaggttccgcaggctgagacaggagcgggaaagtttagggttgtgggggccagaagaggaaccccatctgttagcaggacagtggcccggacgcccaaagctatgctcaggcgacaagtccggaaccgtcgggcgacgaagcccagaacttagctaccagaactccagtgatcacgctaatgaggaatgggagaccgccagcgaatcaagtgatttttctgagcgccgtgaacgtagggaagggccagggagcgagcccgactcccaggtcgacggtgggctcagcggagcatccttaggagagaagaaggaacttgcaaagaggtccttttcttctcagcggcctgtggttgataggcagagtaggaaattggagcctggaggatttggcgaaaaaccggtgaggccagggggtggcgatacgagccccaggtatgagtcgcagcagaacggcactccactcaaagtgaagaggagccccgacgaagctcttcctggaggcctctccggttgtagcagtggatcgggtcattcaccctacgcgctggagagggcagctcacgcaagtgcagacctccccgaagccagctcgaagaaggctgaaaaagaggctaagttggctgcccctagagctggggaacagggtgaagccatgaagcagttcgatctgaactatggctccgcaattattgagaactgcggatccagccctggggaggagtcagaagttggatccatggtaggcgagggatttatagaggttctcaccaaaaaacagaggcgcctccttgaggaagagcgaaggaaaaaggagcaggccgtgcaggtcccagtgaaaggcaggggactaagctcccggatccccccacggtttgcgaaaaaacagaacaacctgtgcctggagcagggcgatgtgactgttcccggatcaagtttggggacggagatctgggagagctcctcacaggctctgcccgtacaagcacccgcaaatgacagttggcgtaaggccgtgactgcatttagcagcactgagaccggatcagctgagcaaggcttcaagagcagtcaaggggacagtggagtggatctcagcgccgaatctcgggagtctagtgcgacctcctcacagcgaagctcaccatatggcacgctgaaacctgaggagatgtcagggccagggctggcagaacctaaggccgactcgcacaaggagcaagctcccaagccttccgaacagaaagattcggaacagggcagcgggcagtccaaggaacatagaccaggtcctatcgggaacgagcggagtctcaagaatcggaagggctcagagggagccgagaggcttcagggtgccgtcgtgcctcctgtgaacggcgtagaaattcacgtagactccgtgctacctgtgcctcctatcgagttcggtgtcagtccaaaggattctgacttcagtctgccgccaggctctgcttccgggccaactggctcaccagttgttaagctgcaggacgctttggcctctaacgccggactcacccagagcattcccatcttgagacgggatcaccacatacagcgggcaatcggattgtctcccatgtcattcccgaccgccgatctcacactcaagatggagtccgctaggaaagcctgggagaattccccctcactcccggaacagtcttcccccggtggggctggtagcggaatccagcctccctccagcgtgggcgcatctagtggcgtcaattattcaagctttggcggagtgagcatgcccccaatgccagtggcttccgtcgcaccaagtgctagcatgcctggctcccacctgccaccactctatctagatggccacgtgttcgcaagtcaacctagattagtaccccagacgatccctcaacagcagagctaccagcaggctgcggctgcacagcagatcccgatttcactgcatacctctttgcaggcccaggctcagctggggctgcggggagggctgcctgtgtcccagagccaggaaatatttagtagcctccagcctttccgttcccaggtatatatgcacccctcgctgtctccgccttctaccatgatcctgtctggaggaacagccctgaagcctccctactcagctttcccaggcatgcagcctttggaaatggtgaaaccacaaagtgggagcccttatcagcccatgagtggcaatcaggcactcgtctacgaggggcagcttagtcaagcagctggcctgggcgcaagccagatgcttgactcacagcttcctcagctgacaatgcccctgcccagatacgggagcgggcagcaaccattgatcctcccacagagcattcagctacccccaggacagtcactgtctgtcggcgcacctagaagaatccccccacccggttcacagccacccgtactgaatacatcgagagagccgtcccagatggaaatgaagggattccactttgccgattcaaagcagaacgtgcctagcggcggtcctgtcccatcaccccagacatatcgcccatcttctgcttccccaagcggaaagccgagtgggagtgctgtaaacatgggatcagtccagggccattatgtgcagcaagcaaagcagcgcgtggatgagaagccgtcactgggcgctgtgaaactgcaggaggccccttcagccgcatcccagatgaagcgcactggagctataaaacccagggccgttaaagttgaggagagcaaggccta

SEQ ID NO: 58578 - DNA, 807 bp, Artificial Sequence
  Description of Artificial Sequence: Synthetic coding sequence
atgccccctatgccagtggcaagcgttgcgccatctgccagcatgcccggttcccatttgccgcctttatacctggatgggcacgtgttcgcgagccagccgaggctggtgccgcagactatcccacaacaacagagctaccagcaagccgctgccgctcagcagatacctatctctttacatacttcactccaagctcaggcacaactgggattgagaggaggactccctgtgagtcagtctcaggagatttttagcagcctgcaaccatttagatctcaagtgtacatgcaccccagcctctctcccccatctacaatgattctaagcggaggcacagctctgaagcctccgtactccgccttccctggcatgcagcccttggagatggttaaacctcaaagtgggagtccgtatcagcctatgagcgggaatcaagcgctcgtgtacgagggtcagctcagccaggcggcaggcttgggagcatcccaaatgctcgactcacagctgccccagctgactatgcctctccctcggtacggttctggccagcaacccctcattctgccccagagcatccaactccccccaggacaatccctgtcagtgggagctcccagaaggattcccccacccggttcacagccccctgtccttaacacttccagggagccatcccaaatggaaatgaaaggtttccacttcgcggattctaagcagaatgtcccttccggcggacctgtgccctctcctcagacctacaggcagaacaacgagtggatgaggaaccctgcctgggagccgtag

SEQ ID NO: 58579 - DNA, 4607 bp, Artificial Sequence
  Description of Artificial Sequence: Synthetic coding sequence
atgtcagacagactggggcagataaccaaggggaaggacggcaagagtaaatacagtactctttctctctttgacaaatacaagggaaaaagcgtggacgcgattcgctcttctgttataccccgtcacggtctccagtctctcgggaaagttgccgcagcccgtcggatgccccctcctgccaacctgccttcactgaagtctgaaaacaaaggcaatgatcctaatattgtgatcgtgccgaaggatggtacagggtgggcgaacaagcaggaccaacaggaccctaagtcgtcttcagctacagcctctcagccacctgagagcctcccccagccagggttacagaaatctgtatctaacctccagaaacctacccaaagtatctcccaggaaaatacaaattctgtccctggtgggccaaaatcttgggcccagctgaacggaaagcctgtcggacatgaaggtggtctcaggggttcttccagacttctgtctttttctcccgaagagttccccactttgaaagctgctggcggtcaggataaagccggaaaagagaagggcgtcttagatctgtcctatggccctggcccttcactgagaccacagaatgtgaccagctggagagaagggggaggcagacacatcatttccgcaaccagtctcagtacatccccgactgaactcggctcaagaaacagcagcacaggcgatggcgctccatcatccgcatgtacaagcgattcgaaagaccctagcctcagacctgcccagcctgtgaggaagggggcttcccaatttatgggaaacgtctaccatccccctacataccatgatatgctgcctgcttttatgtgcagtcccaaatcaagcgagaatcagggaactgtggagaggggctcattccctttgccacagctgaggcttgagcccagggttcccttcaggcagttccagatgaatgaccaggatggaaaggagaatagactcggtctgtctaggccccttcgtccacttcggcaactagtcgagcgcgctccacgaccaactattatcaatgcagagaatctcaagggattggacgacctggacgccgacgctgacgacggctgggcagggttgcacgaggaagttgactactccgaaaagcttaagttctccgatgatgaggaggaagaagaggtggttaaagacgggcgtcctaagtggaattcctgggaccctcggcgtcagaggcagctgtcgatgagctctgcggactcagcagacgctaaacgaaccagggaagaagggaaggattgggctgaggcagtgggagcgtctagggtggtgaggaaagcccctgatcctcaaccacctccacgcaagcttcacggctgggcccctgggcctgactatcagaaaagctctatgggttctatgtttcgtcagcagagcatcgaggataaggaagataagcctccccctagacaaaaattcatccagagcgaaatgtcagaggcagtggaaagagccaggaagaggcgggaggaagaagagaggagggcccgagaggaaaggctggccgcttgtgcagctaaattaaaacaactggaccaaaagtgtaaacaggctcgcaaggcaggtgaggccaggaagcaagccgaaaaggaagtcccctggagcccgagcgcagagaaggccagcccccaggaaaacggaccagccgtgcacaaaggctctccggagtttcctgcacaggagacccccacaaccttcccagaagaggctcctactgtgtcacccgctgtggctcagtcgaactcgtcggaggaagaagccagggaggccggatcacctgctcaggaatttaagtatcagaagtctctgcctcccagattccaacgccagcagcaacaacagcagcaggaacagctatataaaatgcagcattggcagcctgtataccctcccccaagtcaccctcagcggactttctacccccatcacccccagatgctgggatttgaccctaggtggatgatgatgccttcctatatggaccctcggatcacaccaactaggacccctgtggacttctacccttcagctttgcacccatcaggcctgatgaaacccatgatgcctcaggagtccctgaacggaacgggatgccgcagcgaggaccagaattgcgttccgcctctgcaagagagaaaagtgactccgatcgatagtccccctgtgtggtcacccgaggggtacatggctctgcagagcaaaggatacccattacctcacccaaagtcatctgataccctcgctatggatatgcgagtgcggtcccccgacgaggcactccccggagggctgtccggctgttcttccggcagtgggcactctccctatgccctggagagagccgctcacgcctccgccgacctccctgaagccagtagcaagaaagccgaaaaggaggctaagttggccgcaccacgggcaggcgaacagggcgaggctatgaaacagttcgacctgaattatgggtccgctattatcgagaactgcggcagcagcccgggagaagagtcagaagttggctccatggtgggggaggggttcatcgaggtgctcacgaagaagcagaggcggcttctggaggaagagaggcggaaaaaagagcaagctgtgcaggttcccgtaaagggcagggggttgagctcgcgtatacctcctcggttcgctaagaagcagaacaatctctgtctcgaacagggcgacgtcaccgttccgggttctagcctgggcactgagatttgggaaagcagcagtcaagcactccccgtgcaggccccagcaaacgacagttggagaaaagctgtcactgcattctcgtctacggagacaggctctgccgaacagggatttaagtcctcacagggggacagcggtgtggacctctcagctgagtcacgcgagtcctccgccaccagctcacagcggtcttcgccttacgggaccctgaaaccggaggaaatgagcggacccggtctggcggagcccaaggccgactctcataaggagcaggcaccaaaaccctccgagcagaaggactccgaacaaggatccggtcagagcaaagagcaccgccctggtccaatcggcaatgagagatccttgaagaaccgcaaggggagcgaaggcgctgaacgcctccagggcgcagtggtgccaccagtcaatggagtcgaaattcacgtggactcagtgcttccagtacctcccatcgaattcggagtgtcccccaaggattccgatttttccctgccaccaggatccgcttcaggccctacaggatctcctgtagtgaagcttcaggatgctcttgctagcaacgcagggctgacccaatctatccccatccttagacgagaccatcacattcagcgcgcaataggtctgagtcctatgtcattccctacagcagacctcacccttaagatggagtccgctaggaaagcctgggaaaatagtccatctctacccgaacagtcttcccccggaggcgcagggagtgggatccagccaccgtcatcggtcggggcatccagcggagttaattattcttcattcggcggagtatcaatgcctccaatgccagtggcaagtgtggccccttccgcatccatgccgggaagtcaccttcctcctctttacctagacggacatgtgttcgccagtcaaccgagattagttccccagacgatccctcaacagcaatcttaccagcaagcagcagccgcacagcagatcccaatcagcctccacacatctctgcaagcgcaggcccagctagggcttcgcggaggcctccccgtgtctcagtcccaggaaattttctcatccctccagccttttcgcagccaggtgtatatgcaccctagcctatccccaccatccacaatgattttgagcggtgggactgcacttaagcccccatactcagcctttccagggatgcagcctctggaaatggtgaagccacaatccgggagtccatatcaaccgatgtctggcaatcaagctctcgtgtacgaggggcaactgtcccaggctgccggactcggagctagccagatgctggactcgcagctaccccagctgacaatgcctttacctaggtacggcagtggccagcagcctctgatattgccacagtctattcaactgccacctggccaatccttgagcgttggggcaccaaggagaatcccaccacccggttcccagccgcctgtgctgaacaccagtcgggaaccctcccagatggagatgaagggattccactttgccgattctaaacagaacgtgccctccggagggccagttccaagtccacaaacataccgcccaagtagtgcatctcctagcggaaagccgagcggatccgcggttaacatggggagcgttcaaggacattacgtccaacaggcgaaacagagggtggatgagaaaccatcgctgggagctgtcaagctccaggaagcaccatctgccgctagtcagatgaagcgtaccggcgctatcaaaccacgtgccgtcaaggtcgaggaaagtaaagcata

SEQ ID NO: 58580 - DNA, 2391 bp, Artificial Sequence
  Description of Artificial Sequence: Synthetic coding sequence
atgaagcctatgatgccccaggagtctctaaatgggaccggctgtcgaagcgaggaccaaaactgtgtgcctccactgcaggaacggaaggtgacccctatcgattctccacctgtgtggtccccagaggggtacatggcattacagtcaaagggttaccctttgcctcacccaaagtcatccgataccctcgctatggatatgcgggtccgcaatgagtctagttttagcgcgtcactcggaagagctggtggagtatctgcacagagagacctgtttgaggaaagaggggaggagtacctgtccgccttcgacaagaaggcgcaggccgatttcgatagctgcataagctctcagagaattggccaggagttactgttccctccacaggaaaacgtacaagatgcgggtgctccgggaggccatacccagaatcttaggtgtagccccctcgagcctgattttgtcccagacgaaaaaaaacccgagtgcgggtcttgggacgtgtcacaccagccggagaccgctgacactgcccacggcgtcgaacgagaaacgccgagggaagggacggcgttcaacatctcaagctgggataagaacggcagcccaaacaaacagccttcttctgagcccgagtggaccccagagcccagatcttcctcttctcagcatcctgagcaaactggcagaacgagaagatcgggcccaattaagaaacctgtcctgaaggccctgaaggtagaagacaaggagaaggagctcgagaaaattaagcaggagttgggcgaagaatctaccagactggcaaaggagaaagagcagagcccgactgctgagaaggacgaagacgaagagaatgatgcgtccctggctaactcaagtacaaccacactcgaggacaaaggcccaggccacgccaccttcggacgagaagccaccaagttcgaagaagaggaaaagcctgacaaagcatgggaggcccgaccccctcgggagtctagcgacgtccccccaatgaagcggaacaattggatttttattgacgaggagcaggcttttggagtgaggggtcaggccagagggaggggacggggatttagagagtttaccttcagggggaggcctgctggtggtaacgggtcaggattgtgtggagggggagtgctgggtgccaggtcaatatactgttcttcccagaggagtggacgcggacgaggactgagagagtttgcgaggcccgaggattgccctagggccaaacctcgaaggagagtcgcatccgagacccactctgagggcagcgaatatgaagagctcccaaagaggaggcgacaaaggggatccgaaaacgggaacgaaggttcactcttggaacgtgaagagagcacactgaaaaaaggtgactgtagagactcctggcgatccaataaaggatgtagtgaagaccactccggactggacgcaaaaagtagggggcctagagctttcggacgcgctctccccccacgcctctctaactgcggatatggaaggaggactttcgttagcaaagagagcccacactggcagagcaaaagtcctggctcttcctggcaggaatacgggccttcagatacatgtggaagtagaagacccacggacagggactacgtgcctgattcctaccgccatcccgatgcgtttggcggaagaggcttcgaggactctagagctgaggacaaacgctccttcttccaagacgagcatgtggctgacagcgagaatgccgaaaatcggccattccgacgaaggcgaccaccgcgtcaggacaaacccccaaggtttcggagactgaggcaagagagagagagcctcggcctctgggggccagaggaagaaccccaccttcttgcaggccagtggccagggaggcctaaactgtgttcgggggataaatctggcacagttggcaggaggtctccagagctgtcctatcagaacagcagtgaccacgccaacgaagaatgggaaaccgcctccgaatctagcgacttctctgaaagaagagaacgtagagagggacctgggtcagaacctgatagccaggtagatgggggactgtcgggcgcttccctcggtgagaagaaggaacttgcaaagagaagcttctcatcccaacgccctgttgtggataggcagagccggaagctggagcccggtggattcggtgaaaagcccgtgaggcctgggggaggtgacacgtctcccagatatgagtcacagcagaatgggacccccctgaaagtgaaaagatctcccgacgaggccctgcccggtggcctgagtggctgttcctccgggtcaggacattccccttgccccggagctggctcaccctgccagtgctag

SEQ ID NO: 58581 - DNA, 537 bp, Artificial Sequence
  Description of Artificial Sequence: Synthetic coding sequence
tgtgaaggtcgacaggccaaggtgaagagtagcatgggtagcatgttccggcagcaatcaatagaggataaagaggataagcccccaccacggcagaaatttattcaaagtgaaatgtctgaggcagtggaaagggctcgcaagcggagagaggaggaggaacgacgggctcgggaagaaaggctggcagcttgtgccgctaagctgaaacaactagatcagaagtgcaaacaggcgcgaaaggctggggaggcccgaaagcaggcagagaaggaggtcccttggagtccgtctgcggagaaagcctccccacaggagaacggacccgctgtacacaaaggctcccccgaatttcccgctcaggagacacccactactttccctgaggaagccccaacggtatcccctgcagtggctcagtcaaatagttccgaagaggaggcacgtgaggctggctctccagctcaggagtttaaataccagaagagcctgccgccaaggtttcaaaggcaacagcaacagcagcagcaggaatag

SEQ ID NO: 58582 - DNA, 1767 bp, Artificial Sequence
  Description of Artificial Sequence: Synthetic coding sequence
tgaggcagaggctttgaggatagccgcgcagaagacaagcggtcattttttcaggatgagcatgttgccgacagcgagaatgctgagaatcgccctttccgacggagacggccacctagacaggacaaacctccccgtttcaggaggctccggcaggagcgcgagagcctgggcctctgggggcctgaggaggagccccacctgttagctgggcaatggcccggacggcctaaactgtgcagcggcgataaatcaggaacagttggcaggcgatctcccgaactgtcatatcaaaactcctccgaccacgctaacgaagagtgggaaacagcaagtgaatcctctgatttttctgagaggcgtgaaaggcgcgagggccctggttcagaacctgactcccaagtagacgggggactctctggcgctagtctcggcgagaaaaaagagctggccaagcgcagtttttcaagccagcggcctgtggtagatcgccaatcccgcaaactggaacccggaggctttggcgagaagcccgtgcgacctgggggaggtgatacaagtccacgttatgagtcccagcagaacggcactcctttgaaggtgaagagatcccctgatgaagctctgcccggtggtctcagcgggtgtagtagcggctccggacacagcccgtatgccctggaacgggctgctcacgccagcgcagacttaccagaggcttcttccaagaaggcagagaaagaagccaagcttgccgctccaagggccggagaacagggagaagcaatgaaacagtttgacctgaactacgggagcgcgattatcgaaaattgcgggtcctctcctggcgaagaaagtgaagttggatccatggtcggcgaaggattcatcgaggtgcttactaaaaagcaaagacgcctcctggaggaagagaggaggaaaaaagagcaggctgttcaggtccccgtgaaaggcagagggctgtcttctaggataccaccaaggttcgcaaagaagcagaataatctctgcctcgagcaaggagatgtaactgtgccaggctctagcctggggaccgagatctgggagtcgtcaagccaggctctcccagtgcaggctcccgctaacgacagttggcgcaaagccgtgacagctttctcttccactgaaaccggttccgccgaggggtttaagagctcacaaggcgactctggtgtggacctcagtgccgaatcacgggagtcatcagcaacttcttcgcagcgttcttccccgtacggcacgctgaaacctgaggagatgtctggacctggactcgctgagccaaaggccgactcccacaaggagcaagcccctaagcctagcgaacaaaaagactcagaacaggggtcaggtcagtctaaggagcacaggcctggccctataggaaatgagcgctcccttaagaaccggaagggctcagaaggtgcagaacgactgcagggagccgttgtaccccctgtgaatggcgtggagatccatgtggactcagtactcccagtgccacctatcgaattcggagtcagccctaaagattcagattttagcctgccaccaggttctgccagtggccctactgggagccccgtcgtgaagctccaggacgctctggcctccaacgcaggactcacacagagcatcccaatcttacgaagggatcaccacatccagagagctatcggcctctcgcccatgtctttccctacggcagatctgacattaaagtag

SEQ ID NO: 58583 - DNA, 528 bp, Artificial Sequence
  Description of Artificial Sequence: Synthetic coding sequence
gaaagaaaggtgacgcctatcgattctcctccggtatggtcccccgagggatacatggcactccaatctaaaggatatccactgccacatccaaaatcttccgatacacttgctatggatatgagagtgaggaatgaatcatccttcagcgcttccctgggcagagcaggcggagtgtccgcacagagggacctatttgaggaaaggggagaggaatacttgtctgcgttcgataagaaagcccaggccgattttgattcttgtatttcttcacagcgaattggtcaagagctgctctttccaccccaggagaacgttcaggacgcgggtgctcccggaggccacacccaaaatttaaggtgctcacctctggaacccgacttcgtaccagacgaaaagaagcccgaatgcgggagctgggatgtcagtcaccaaccggaaacagctgatactgcacatggagtcgaaagagagaccccaagagaggggaccgctttcaatatttcctcttgggacaaaaatgggtag

SEQ ID NO: 58584 - DNA, 4608 bp, Artificial Sequence
  Description of Artificial Sequence: Synthetic coding sequence
atgtctgatcgcttggggcaaattaccaaaggaaaggacggcaagagcaagtattccaccctgtctctgttcgataaatacaaaggaaagagcgttgacgccatacggtcctctgtaattccaagacatggactgcagtcactcggaaaagtcgctgcggcacggagaatgcctcctcctgccaacctgccctcattgaagtcggaaaacaaggggaacgacccaaacatcgtcatcgtgcccaaagacggaaccggctgggctaacaagcaagaccagcaagaccctaagtctagctcggctactgctagccagcctcctgaatccctgccacagcccggactgcagaagtcggtctctaaccttcaaaagcccactcagtccatctctcaggagaataccaattcagtacctggcggtccaaaatcttgggctcagctgaacggaaaacctgtgggccatgagggtggactcaggggatcatctcgcctgctgtccttcagtccagaagagttccctactctgaaggctgctgggggacaggacaaggccggtaaggaaaagggggtcttagacctgagctacgggccaggtccaagcctccggccacagaacgtgacctcatggcgcgagggtggcggtcgccacatcatctccgccacgtcacttagcacaagccccactgagctcggatcaagaaatagctccaccggagatggggctccatccagtgcttgcacttcagactcgaaggacccttcgctgaggccggctcaaccagtccgaaagggtgcctcacagttcatggggaatgtgtaccacccccctacataccacgatatgttgccagcgttcatgtgttcgcctaagtcaagcgagaatcaagggacagtggagaggggatcttttcccctgccacaactacggcttgagcccagagtcccgtttcgccagtttcagatgaacgatcaagatggaaaggagaatcgtctagggctgagccggcctctgcgtcctctcaggcaactggtggagagagccccacgacccacaatcataaacgctgaaaacctcaaaggactggatgatttagatgccgacgctgatgatggttgggccggtctgcatgaggaggtcgattactcagagaaacttaagttcagcgacgacgaggaagaagaggaggtagtcaaggacggtcgacctaaatggaacagctgggacccacgccgtcagcgccaactaagcatgagcagtgcggattctgccgatgccaaacggacccgtgaggagggcaaggattgggcagaagccgttggtgccagccgggtcgttcggaaggcgccagatccccagcctccaccgaggaaattacatggctgggcacccggacccgattaccaaaagtcctccatggggtcaatgtttcgccaacagagcattgaggataaagaagataaacctcccccaaggcaaaagtttatacaatccgaaatgtctgaggctgtggagcgtgcccgaaaaaggcgcgaggaggaagagagaagggcgcgagaggagcgtctggcggcatgcgccgctaaattgaaacaattagaccagaaatgtaagcaagcccgaaaggctggggaagctcgtaaacaggcggaaaaagaggttccctggtctcccagtgcggaaaaggcttccccccaagagaatggcccagccgtccacaaggggtccccagaatttcctgcccaggaaacccctaccacgtttcctgaagaggcgcctactgtgtctcccgcagtcgcccagtctaactcatctgaggaggaggcgagggaagccggtagcccagcacaagaattcaagtatcaaaaatctttaccaccaaggttccagagacaacagcaacagcagcagcaggaacagctgtacaaaatgcagcattggcagccagtttacccccctccgtcacatccccagcggactttctatcctcatcatccacagatgctcgggtttgacccacggtggatgatgatgccctcttatatggatcccaggataacacccacgaggacacctgtggatttttacccctctgcgctgcacccgtccggcttgatgaaaccaatgatgcctcaggagagcctgaatggaacagggtgtaggtccgaagaccaaaattgtgtcccaccattgcaggagaggaaggttacacccattgattctcctcctgtgtggtctcccgaaggatacatggcacttcagagtaaaggctatccactgcctcatccaaaatcatcagacactctggccatggatatgagagtgcgatccccggatgaagccctaccaggcggtctctcaggctgctctagcggctctggccacagcccatatgccctggagagagccgctcacgcctccgccgacttacctgaggcatcctctaagaaagcagaaaaagaagccaaactcgccgctccgagggcaggagagcagggagaagcaatgaagcagtttgacttgaactatggatccgccatcatcgagaattgcgggtctagcccgggagaagagtcggaagtgggatccatggtgggtgagggcttcatcgaggtgcttactaagaaacaacgaaggctgctcgaagaagaacggagaaagaaagaacaggcggtgcaggttcccgtaaaaggacgcggactgtcttcccggatccccccacgctttgcgaaaaaacagaacaacttgtgccttgaacagggcgatgtgactgtccctggatcctcgctcggcacagagatatgggaatcctcgagccaagctctcccggtgcaggcccctgctaacgatagctggaggaaggccgtcactgcatttagcagcacagaaaccggcagtgccgagcagggattcaaatcgtcccaaggcgacagcggagtggatctatcggcagaaagccgcgaatcctctgcaactagttcccagcgcagttctccctatggcacactcaaacccgaggaaatgtcaggccctgggttagccgaaccaaaagcagattctcataaggaacaggctcctaagccaagcgaacagaaggactccgagcagggcagtggccaatccaaagaacacaggcccggaccaataggcaacgagcgcagtttgaaaaatcgaaagggctcagagggggctgaacgcctacagggagcagtcgtgcctcccgtgaatggcgttgaaatccacgtcgactctgtacttccagtgcctcctatagaattcggggtcagcccaaaagactcagacttcagcctgcctccaggtagtgccagcggaccgacaggatccccagtcgttaagctgcaggacgcccttgctagcaacgccggattgacacagagtatacctattctgaggagagaccaccacatccaaagagccattggcctctcacccatgtctttcccaaccgccgatctgactctcaaaatggagtcagccaggaaggcctgggagaactcacccagccttccagagcagagtagtcccggtggtgctggttctggcatacagccaccgtcatctgtcggcgctagctccggtgtgaattactccagctttgggggagtcagcatgccccctatgccggtagcctcagtagcaccatccgcttctatgcccggatcccatctcccgccactgtatctagatgggcatgtcttcgcttcccagcctcggctagtaccccaaactatccctcagcagcagtcttatcagcaggctgctgccgcacaacagatccctatttcactccacacatccctgcaggcacaggcccaacttggccttaggggcggactgcccgttagtcaatcacaggagatcttttcttcactacaaccattcagaagccaggtgtatatgcacccctctttgtctcctccaagcaccatgatactatccgggggaacagctcttaagcccccatactccgccttcccaggcatgcagcctctcgaaatggtcaaaccgcagtccggaagcccttatcagcctatgagtgggaatcaagcccttgtgtacgaaggacaactctcccaggcagctggtttaggggcttctcagatgctagactcccagcttccacagctgaccatgcctctgccccgttacgggagtgggcagcaacccttgattctgccgcaatccatccagctgcccccaggccaatctttgagtgtgggtgctcctcggcgtattccacctcctgggtctcagcccccagtgcttaatacctccagggagcccagccagatggagatgaagggttttcactttgccgacagcaagcagaacgttcccagtgggggtcctgttcctagccctcaaacctaccgaccatcaagcgcttcgcccagcgggaaacccagtggctccgcagtcaatatgggaagcgtgcagggccattacgtccagcaggccaaacaacgagtcgatgagaagccctccctgggagccgtgaaactgcaagaggcaccttctgcagcgtcccaaatgaaacgtactggggcaattaagcccagggctgtgaaagtggaagagtccaaggcctag

SEQ ID NO: 58585 - DNA, 981 bp, Artificial Sequence
  Description of Artificial Sequence: Synthetic coding sequence
atgtccgatagacttggtcagatcacaaaaggaaaggatgggaaatccaagtactcgactctctctctgtttgataaatacaaggggaagagtgtggatgccatccggagtagtgtgattcccaggcatggactgcagtcccttggtaaggtggccgctgccagacggatgccccctccagccaacctgccatcactgaaatccgagaataaagggaacgatccaaatatagtgatagtgccaaaggatggaaccggttgggccaacaaacaggatcagcaggaccccaagagctcctccgcgaccgcaagccagcccccagaatcccttcctcagccaggcttacagaagagcgtctctaaccttcaaaagcccacgcaatccatttcccaagaaaacactaattccgtgcctggtggacctaagagttgggcccagctgaacggtaaacctgtcgggcacgagggaggtctccgaggaagtagcagactactgtcattcagtccagaagagtttcctacactgaaagctgcgggaggtcaagacaaagcagggaaagagaagggggtcttagatctaagttacggaccaggcccatctcttcggccacaaaatgtcacctcatggagggaagggggaggtagacacattatcagcgccacatctttgagtactagccccaccgaacttggctctaggaactcctctacgggcgacggcgctccaagctccgcctgtacctccgattctaaagatccatccctgcgcccagcacagccagttcgaaaaggggcatctcagtttatgggcaatgtgtatcatccgcctacatatcacgatatgttgcctgcattcatgtgtagtcccaaatcaagcgaaaatcaagggacggtggaacgcggttccttcccactgccgcagttgagactcgaaccacgtgtgccgttcaggcagtttcagatgaacgatcaggatggttag

SEQ ID NO: 58586 - DNA, 8453 bp, Artificial Sequence
  Description of Artificial Sequence: Synthetic coding sequence
atgagtgaaaagtctggacagtccaccaaagccaaggacggcaagaaatatgctacactaagcctattcaatacatacaaggggaaaagcctcgagacccagaagacaaccgctcgccatggtttgcagagcctcggcaaagtcgggatctcccgccgtatgcccccacccgctaacttaccctctttgaaggctgaaaacaagggaaatgaccctaacgtcaatattgtgcctaaagacggcacaggttgggcgagcaaacaggaacaacacgaggaggagaagacacctgaggtgccaccggctcagccaaagcccggtgtggcagcccctccggaagtagccccagcccctaagagctgggcttccaacaagcagggaggtcagggtgatggaattcaggtaaatagccagtttcagcaagagttcccatccctgcaggcggctggcgatcaggagaaaaaggagaaagagacaaacgatgataactacggaccaggaccttccctgaggcctcctaatgttgcatgttggagggatggcggaaaagcagcgggttctccctcctcaagtgatcaggatgaaaaacttcctggccaagatgagagtactgcgggaacatcggaacaaaacgacatactgaaagtggtggagaagagaattgcctgtggccctccacaggcaaaactaaatggacagcaggctgcacttgctagtcagtacagagccatgatgcccccttatatgttccagcagtacccacgcatgacatacccgcctctgcacgggccaatgcgttttcctccctctctgtctgagaccaacaaggggctgagaggcaggggccctccaccgtcttgggcctctgagcctgagagaccctcgattctgtcagcttcagaactcaaagaactcgataaatttgacaatttagacgccgaagcggatgagggctgggctggcgcacagatggaggtagactacactgagcagttgaacttctctgatgacgatgaacagggttcaaacagccccaaggagaataactcagaggaccagggtagcaaggcttctgaaaataacgagaacaagaaagagaccgatgaagtgagcaataccaaatcatctagccaaatcccagcacagcccagcgtcgctaaggtcccctatggaaagggcccttcgtttaaccaggagcgcggaacgtcatcccatttaccacctcctcctaaacttctggcacagcaacaccctccgccagacagacaagctgttcctggtagaccaggtccttttccttccaagcaacaagttgcagacgaagacgagatctggaagcagcgtcggcgacagcagagtgaaatatcggctgccgtggaaagggccaggaagcggagagaagaggaggagagacggatggaagagcagcggaaggcagcctgcgcagagaaactaaaaagactggacgagaagctaggcattttggagaagcagcctagccccgaagagatacgggagcgagagagggagaaggagcgtgagcgtgaaaaggaacttgagaaggagcaggagcaggagagggaaaaggagagagaaaaagacagagagcggcaacaggagaaagagaaggaattagagaaagaacaggaaaaacagcgggaaatggaaaaggagcgcaagcaggaaaaagaaaaagaactggagagacagaaggaaaaagaaaaggaattgcaaaaaatgaaggaacaggaaaaggagtgtgagttggaaaaggaaagagagaaattggaggagaagatcgaacctcgcgagcctaacctggaacctatggttgaaaagcaggagagcgaaaattcctgtaacaaggaagaagagccagtttttactagacaagactcaaaccggagtgaaaaggaagcaacacccgtcgtccacgagaccgaacctgagtctgggagtcagcccagacccgctgtgttgtccggatacttcaaacagttccagaagagcttgccaccgaggttccaacgtcagcaggaacagatgaaacagcagcaatggcagcaacagcagcagcagggcgttctaccccagacggttccttctcaaccaagctcttctaccgtcccccctcctccacataggcccttgtaccagccaatgcaacctcatccccaacatctcgcaagcatgggcttcgatccacgctggctgatgatgcagtcatatatggaccctagaatgatgtctgggagacccgcaatggacatccctcctattcatccagggatgatccctcctaaacctttaatgcgacgggatcaaatggaaggctcgcctaatagcagtgagtccttcgagcatatcgcccgaagcgcaagggaccacgctatttcactctcagaacccagaatgctgtggggttccgatccctatccacacgcggagccacaacaagcaactacacctaaggccacagaggagccagaagatgtacgcagcgaggctgccttggaccaggagcaaatcacggctgcctattcagtagaacataatcagctggaagcccaccccaaggcggacttcatcagggaatctagtgaagcacaggtgcagaaatttctatctagatccgtggaggacgtgagaccccaccacaccgatgccaacaatcagagcgcgtgcttcgaagctccagaccagaaaacactgtccgcaccgcaggaagagaggatatctgcagtggaaagtcaaccttcacggaagcgttccgtatctcacgggtcgaaccacacccaaaaacctgacgagcagagaagtgaacctagcgctggcatccccaaggtgactagtcgctgcatcgatagcaaggaacctattgaacgacccgaagagaagccaaaaaaggaggggttcatccgatcctccgaaggccctaaacctgaaaaggtgtataagtccaagtctgaaacccggtggggccctagacccagctctaaccgtcgggaagaagttaatgatcgaccagtgaggaggagcggcccaattaagaagcccgtgctgagggacatgaaagaagagcgagagcaacggaaggagaaagagggcgaaaaggccgaaaaggtaaccgaaaaggtggtcgttaaaccagagaagaccgaaaagaaagatctgccgccacctccccctcccccacagccccctgctcctatccagccacagtctgtgccgcctcccatacaaccagaagccgaaaaatttccctcaacagagaccgctacactggcccaaaaaccaagccaggacaccgaaaagccgctggaacccgtatccaccgtacaggtcgagcctgccgtgaagacagtgaatcagcagacaatggcagcgccagtagtgaaggaagaaaaacagcccgagaaggtcatctctaaggacctggtgattgaacggccacgccctgattcccggcctgccgtgaaaaaggaaagcacactcccccctaggacttactggaaagaagcacgtgagagagactggtttccagatcaaggttacagaggaagaggacggggagagtactactcccgaggaaggagctaccggggaagctatggcggaaggggtcggggagggcgtggccacactcgcgactatcctcaataccgtgacaataaacctcgagcagagcatattcctagtgggccactgaggcagagagaagagagcgaaaccaggtccgaatcgtccgactttgaagtggtccctaaaaggagacgtcaacgaggatctgaaacagatactgattcagaaatccacgagtctgcaagcgataaggattctctgagcaagggaaagctacctaaacgcgaggagcggcctgagaacaagaagcccgtcaaacctcactccagtttcaaacccgacaatcacgttagaatcgacaaccggctactggaaaaaccctacgtgcgtgacgacgacaaggctaagcctgggtttctgccaaagggcgaaccgaccagacgcggaagagggggtacctttcgccgtggaggcagggatcccggtgggaggccttcccgcccatcaactctgagacgcccagcctacagagataaccagtggaatcctaggcagtccgaggtccctaaaccagaagatggtgaaccaccccgaagacacgagcagtttatccctattgccgctgacaagaggcccccaaaattcgagcgcaagtttgaccccgctcgcgagagaccacgcagacagagacccaccagacctcctcggcaggataagcccccaaggttcagacggttgagggaacgcgaagcagcgtcaaaatccaatgaggtcgtggcggtgccaacgaatgggactgtgaacaacgtagcccaggagccagtgaacaccctgggggacatttcgggcaacaaaacacctgacctatcaaatcaaaacagtagtgaccaggccaatgaggagtgggaaacggcttcggaatcgagcgactttaacgagcggagagaaagggatgaaaaaaaaaacgccgacctcaatgctcaaaccgttgtgaaagttggagagaacgtgttgcctcctaagcgcgaaatcgcgaagcggtcatttagctcacagcgcccagtggataggcagaatcgacgcggtaacaacggtcctcctaaatccggacgcaatttttccgggccacgaaatgagaggcgcagtggtccaccatctaaatcgggtaaacgaggtcctttcgacgatcagccggcaggtacaaccggggtggacctgattaacggctcatcagcccaccatcaggaaggtgtgccaaacggtaccgggcagaaaaacagcaaagactccacgggcaaaaagcgagaggatccaaagccaggacccaagaaacccaaagagaaagttgacgcactgtcccagtttgatcttaacaactatgccagtgtcgtcattattgatgatcaccccgaggtcacagtaattgaagacccccaatctaatctgaatgacgatgggttcaccgaggtggtctccaagaagcaacagaagagactgcaagatgaggaaaggaggaaaaaagaagagcaggtgattcaggtttggaacaagaagaatgcaaatgagaaggggagatcgcagacgtccaagttgccgccacgcttcgcgaaaaaacaggctacaggcattcaacaagctcaaagctctgcgtcagtgccccctcttgcttctgcgccattgcctccatctacctccgcgagtgtgcccgcttccacctcggctcctctgccagctactcttactcctgtgcccgcttctacaagcgcccctgtgcccgcatctacactggctcccgtgttagctagcacaagtgcacccgtgccagcctctcctctcgccccagttagtgcttctgcatccgtgagcgcttctgtccctgcctcgacatccgctgccgcaatcactagctctagtgctcccgcaagcgcaccagctcccaccccaattctggcatccgtttcgactccagcatctgtcacaatcttggcctccgccagtatcccgatcctggcttccgccctcgcttccacatccgccccaacaccagccccagcagcgtctagccctgccgctccagttataaccgcacctaccatccctgcttcagcgccaacagcatctgtgcctctagcacccgcttctgcctctgctcccgcaccggcacctaccccagtctctgctccaaatccagctccacctgcaccagctcaaacccaagcgcaaacccataaaccagtgcagaaccccctgcaaaccaccagtcaatctagtaagcagcctccaccctctattcggttgccctccgcacagaccccaaacggaacggactacgtcgctagcggtaagagcatccagacaccccagtcccacggcaccctgacagctgagctctgggacaataaagtggctcctccagctgtgctgaatgacatctccaaaaagctgggaccaatttctccaccccagcctccaagtgtgtcagcgtggaacaagcccctgacttctttcgggtcagcccctagttccgaaggagccaagaatggacaggagagtggcctggagatcggcacagacactatacagttcggggcacctgctagtaacggcaacgaaaatgaagtggtgcctgtgctatctgagaagtctgcagacaagatccccgaacccaaggagcagcggcagaaacagcctcgggctggccctataaaggctcagaagctacctgacctctcacccgtcgagaataaggagcacaagccgggacccatcggaaaggagcgctctcttaagaacagaaaggtgaaggacgcccaacaggtggaaccagaaggccaagaaaagccctctccagcaaccgtcaggagtaccgatcctgtgaccacaaaggagactaaagcagtgagcgagatgtccaccgagatcggtaccatgatttctgtgagttctgccgagtacgggactaacgctaaggagtctgtgactgattataccaccccgtcgtcatctttacccaatacggtggctaccaacaacaccaagatggaagacaccttggtcaacaacgtccctctccccaatacccttcctttacccaaaagagagacaattcagcaaagctcttccctgacttctgtccccccaacgacgtttagtttgacctttaaaatggaatctgcaagaaaggcatgggagaattcgccaaatgtacgcgagaaggggtctccagtgacctcaacggctcctcccatcgccacaggagtgtcctctagcgccagcggacccagcaccgccaactataattctttcagctcagcgagtatgccccagatccccgtggcttcggttacaccaactgctagtctctcaggtgccggtacctatacaacatccagcctgtccacgaagtcaaccaccaccagtgatccccctaacatctgcaaggtaaagcctcagcagctccaaacatcctccctgccatcagcatcccacttttctcagctgagttgcatgccgtcgttaatagcccagcagcaacagaatccccaggtatatgttagtcagagcgctgcggctcagatcccagcattctacatggacacctcccacctctttaacacccagcacgccaggcttgccccaccgagccttgcccagcagcaaggcttccagcctggtctttcccagcctacctcagtgcagcaaattccaatacccatatatgcccctttacagggccagcatcaagcccaactctccctaggagcaggtccagctgtctcacaggctcaggagctctttagctcctccttgcagccttataggtctcaacccgcattcatgcaaagtagcctctcccagccttcagtggtcctgtccgggactgcaattcacaacttccccactgtacagcaccaagaactggcgaaggcgcaaagcgggctggccttccaacagacgtcaaacacacaaccaattcctattctttacgagcaccaactggggcaagcctctggactgggaggctcacagttgattgacactcatttacttcaggccagagccaatttaacacaggcatccaatctgtattcggggcaagtgcagcaaccaggccagacaaacttctataataccgcccagagtccttctgctctgcaacaggtcaccgtccctctgccagcttctcagctgagcctaccgaatttcggaagcactggccaacccctcatcgctttaccccagaccctgcagccccctctccagcataccacccctcaagctcaggcccagtccctcagccggccagcacaggtcagccagccttttcgcggactcatccctgcgggaacccagcactccatgatcgccaccaccggaaaaatgagcgaaatggagctgaaggctttcggcagtggtatagacataaaacctggtacgcctcccattgctggacgatctactaccccaacttcctccccctttcgggcaaccagcacaagtcccaattcacagtctagtaagatgaattctatcgtatatcagaaacagttccagtctgctccagccactgtcaggatgacacagccttttccaactcaattcgcaccccaggctaagcaacgagccgaggtcctgcagtcaacccagagattcttctcagaacagcaacagagcaagcaaattggcggaggaaaagcccagaaggtcgacagtgactcctccaaacctccggagaccctcaccgatccccctggggtgtgccaggagaaggtggaagagaagccacccccagcaccatcaattgctacaaagcctgtgcgcaccggtcctatcaagcctcaggctatcaaaaccgaggagacaaagtctta

SEQ ID NO: 58587 - DNA, 8696 bp, Artificial Sequence
  Description of Artificial Sequence: Synthetic coding sequence
atgtccgagaagtccggccagtctaccaaggctaaggacggcaaaaagtatgccaccctgtcgctgttcaacacttacaaaggcaagagcctggagacacaaaagacgacagttgcggctcggcatggcctgcagagcttgggtaaggtggggattagtcgacgcatgccacccccagctaatttgccttccttaaaggccgagaacaaaggcaacgatcctaacgtgaatatcgttcctaaagacgggacgggctgggcctcaaaacaagaacagcacgaagaggaaaagactccagaggtgcctcctgcacaacctaagcccggagtggccgctcctcctgaagtggcccctgcgcctaagtcttgggcatcaaacaagcaggggggtcagggagacggaatccaggtgaacagccagttccagcaggagtttcccagcctgcaggctgccggagaccaggaaaagaaggaaaaggagactaatgacgacaactatggccctggaccatccctgagacctcccaacgtggcgtgttggagagacgggggtaaggctgccggttcaccgagctcttcagaccaggatgaaaagctccctggccaggacgagtcgacggccggtacctctgaacagaacgacatcctcaaggtagtggaaaaaagaatcgcttgcggtccccctcaggccaaattgaacggccaacaggcagctctagcctctcagtaccgtgcaatgatgcctccctatatgttccagcagtatcctcgtatgacctacccccctctccatggaccgatgaggtttcctccttcactgtccgagacaaataagggcctccggggtaggggacctccccctagctgggcttctgagcctgagcgccctagtattttaagcgcttcagagctgaaggagctcgataaattcgacaacctggacgcagaggcagacgagggctgggcaggagctcagatggaagtggattatactgagcaacttaatttttcggatgatgatgaacaaggctctaattcccccaaagagaacaacagcgaggaccaggggtccaaagccagtgaaaataacgaaaacaaaaaggaaaccgacgaggttagtaacaccaagtcgtctagccagatccccgctcaaccaagtgttgctaaggtgccctacggcaagggacctagctttaatcaggaacgcggtactagctcccacctgcccccacctcctaagttgcttgcacagcagcaccccccacctgaccgtcaagctgttcctgggcgtccgggtcccttcccttcgaagcagcaggtagctgacgaggacgagatctggaaacagaggcgcaggcagcagtccgaaatctctgccgcagtggaacgagcgaggaaaaggcgcgaggaggaagagcgtcgaatggaggagcagcgcaaagcggcatgcgccgagaaattgaaacggttggatgagaagctcggcatcctggaaaaacagcctagccccgaggagatacgagagagggaaagggagaaggagcgagagcgggagaaggagctggaaaaggaacaggagcaggagcgagaaaaagaacgcgagaaggatcgcgagagacaacaggagaaggaaaaggagttggaaaaagagcaggagaagcaacgggagatggaaaaggaaaggaaacaggaaaaggagaaagagctggagcgacagaaagaaaaggagaaggagttacagaagatgaaggaacaagagaaggagtgtgagctcgagaaagagagggaaaagctcgaggagaaaattgaaccaagagagcccaatctggaaccaatggtcgagaagcaggagtccgaaaattcttgcaataaagaggaggagccagtgttcacccgccaggattccaatcgctcggaaaaagaggccacccctgtggttcatgagacagagcccgagagcggcagccaaccacgccctgcggtcctgtcagggtattttaaacagttccagaaaagcctgccaccgaggtttcagagacagcaggagcagatgaaacaacagcagtggcagcagcagcagcagcagggagtcctccctcaaactgtaccatctcagccaagctcttcaacagtgccacccccacctcacagacctctttatcagccgatgcagcctcaccctcaacacctagcctccatgggcttcgatcccaggtggcttatgatgcagtcatacatggaccccagaatgatgtcaggccgtccagctatggatatcccccctatccaccctggcatgattcctccgaagccccttatgagacgcgatcagatggaaggctctcctaatagctctgagagcttcgaacacatagctcggagcgccagagatcacgccatttcactgagcgagccacggatgctttggggcagcgatccgtatccacacgcagagcctcaacaggccactacccctaaagctactgaagaacccgaagatgtacggtcagaagccgcactggaccaagaacagattacagcagcttactccgtcgaacacaaccaactggaggcccatccaaaggctgatttcattagagaatcatcagaagctcaggttcagaaatttctcagccgaagcgttgaagacgtcagaccgcatcacacagatgctaacaatcaaagtgcctgtttcgaggcccctgatcagaagaccttaagcgccccacaggaagagcgaatctccgcggtggagagccagccctctagaaagcgcagtgtatctcacggcagcaatcacacacagaagcccgatgagcaacggagcgagccctcggccggaatccccaaagtgacgagtcgttgcatcgactcaaaggagcccatcgaaaggccagaggagaagcccaagaaggagggcttcattcgatcgtcggagggccctaagccagaaaaggtgtacaaatccaaatcagagacccggtggggaccacggccttctagtaatcgaagggaagaggtgaacgatcgcccagtgcgcaggtccggacctatcaagaaacccgttctccgcgatatgaaggaagaacgtgagcaacgcaaggagaaggagggcgagaaggcggagaaggtcaccgagaaggtggtagtgaagcccgagaagacagagaagaaagatcttcccccaccgcctcctccaccgcagcctcctgccccaattcaaccccagtctgtcccccctccgattcagcccgaggcagagaagtttccctctacagaaactgcaacactggcccagaagccctcgcaggacacagagaagcccctggagccagtttctaccgtgcaggtggagcccgcagtaaagacagtcaatcagcagacaatggccgctccagtggtaaaggaagaaaagcagcctgaaaaggttatctcaaaggatttggtcattgaacggcctcgccctgactcccgacctgcggtgaagaaggagagcactctgccaccaagaacctattggaaggaggctcgcgagcgggattggtttcccgatcaaggatacagagggaggggacggggagaatactatagtaggggcagatcctatcggggaagctacggaggcagagggcgtggaggcagagggcatacacgagactacccacagtacagagataataaaccacgagcagaacacatccccagtggaccactacggcagcgggaggagagtgagacccgttcagaaagttctgattttgaggtggtgcccaaaaggcggagacagcggggtagcgagaccgacactgactccgagatccacgagtccgcaagtgacaaagattccttgagtaaaggcaagttacccaagcgcgaagagagaccagaaaataaaaagccagtgaagccacattcctcatttaagccagataaccatgtgcgaatcgacaaccgtttgctcgagaagccttatgtgagagacgacgataaggctaaaccagggtttctgcctaaaggggaacccacgaggagaggcagaggtggtacctttcggcgaggaggacgggatccaggcggaagaccctctaggccctcaactctgaggcggccagcatatagggataaccagtggaaccctcgacagagtgaggtaccgaaacctgaggatggtgagcctccgaggcgtcatgagcaatttattcctattgcggctgataaacgccctcctaaatttgagcgtaagtttgacccagccagagagcgaccacgacgtcagagacccacgcgtcccccaagacaggataaacccccaaggttccggaggctgagggaaagggaggccgctagcaagtccaacgaggtggtggcagttcccactaacggcacggtaaataacgtcgcccaagaacctgtcaatacacttggtgatatctctggaaataagacaccagacctgagcaaccagaactcctccgaccaggccaacgaagaatgggaaacggcctctgaaagtagcgatttcaacgaacgccgagaacgcgacgagaagaaaaatgctgaccttaacgcccagactgtggtgaaagtgggtgaaaatgttctgcctccaaaaagagagattgcgaagcgctccttctctagtcagcgtcctgtcgacagacagaataggcggggtaacaacgggcctcctaagtccggaagaaacttctctggaccgaggaacgaacggagaagtggaccccctagtaaaagcgggaagagaggtccgttcgacgatcagccagcaggcacaactggagtagatctgatcaacggctcttcagcccatcaccaggagggcgtccctaatggaacagggcagaagaattctaaggacagtaccggcaagaagcgcgaagatccaaagcctggtcccaagaagcccaaggagaaagttgatgcactgagtcagtttgatctgaataattatgcttccgtggtaataatcgatgaccatcccgaggtgacggtgatcgaagacccccaatctaacctgaatgatgatggctttactgaggtggtttccaagaagcagcagaagagactgcaggacgaggagcggcgtaaaaaagaggagcaggtaatacaggtctggaataagaaaaatgccaacgagaagggtcgatcccagacctcaaagctccctcccaggtttgccaagaaacaggccactggcatccagcaggcgcagtcatctgcctcagtaccacctctggcctccgcacctttaccaccatcaacttctgcgtcggtgccggcaagcacaagcgcgcctctgccagcgacactgaccccagtgcctgcctccacctccgcccctgtgcctgcctcaaccctggcacccgttctcgcttctacctccgctcctgtgcccgctagccctctcgcccctgtttctgcgtcagcatcagtttctgcatccgttccagcctcaacttcagctgctgccatcacatcctcgtccgcacccgctagtgctcctgcgccaacacccatccttgcctccgtcagtacgccggcaagcgtgacgattctggcctcagcatcaattcccattctggcctcagctcttgcaagcacctctgcccctacccctgcccctgcagcttcttccccagctgcacccgtgatcacagcccctacaattcccgcaagtgctcccaccgcatccgtgcctctggctcctgcctccgcgagtgcccctgcccctgccccaacacctgttagcgctcctaatccagcccctcctgctcccgcacaaacacaggcccagacccacaaacctgttcagaacccactgcagaccacctctcaaagcagcaagcagccccctcctagtatccgccttccctcggctcagactccaaatggaaccgactatgtagcgtctggaaagtcaatacagacacctcagagccacggaaccctgaccgccgaactctgggacaacaaggtcgcccctcctgcagtgctgaacgacatctctaaaaagctcggccctattagcccaccacagcctcctagcgtaagcgcctggaacaaacctctcacctcgtttggctccgcccctagcagcgaaggagcgaaaaatggccaggagtctggtctggaaatcggcactgatactattcagtttggcgctccggcaagcaacggtaacgagaacgaagtggtcccagtgctctccgaaaagtcggcggataagattcccgaacctaaagaacagcggcagaagcaaccacgcgcaggcccaataaaggcccagaagctccctgaccttagccctgttgaaaacaaagagcacaaaccagggcctatcggcaaggaaagaagtttaaaaaatagaaaagtgaaagacgcccagcaggtcgagcccgagggccaggagaaaccaagccccgctaccgttcggtccaccgaccccgtgaccactaaagagaccaaagccgtgtctgagatgtccacagaaatagggaccatgatatcagtgagcagtgcagaatatgggaccaacgccaaggaatcagtgactgattacacaactccctctagcagcctgccgaataccgttgctactaacaataccaagatggaggacacactggtgaataacgtgcctttacccaatacacttccgcttcctaagagagagacgatacagcagtcttcctcacttacaagcgtacctcccactacattttctctcacgtttaagatggagagtgccaggaaggcttgggaaaatagccctaatgtccgcgaaaaaggtagcccggttacatctacagctcctccaattgccactggggtgtctagcagcgcaagtgggccttcaaccgcgaactataactccttctcgagcgcatccatgccccaaattccagttgcaagtgtgaccccgaccgcctctctgtccggggctggaacatatactacctctagtctatctactaaaagcacaaccacgagcgacccgccaaatatatgtaaggtcaaaccccaacagctccagacctcatcattgccctcagccagtcactttagccagctctcctgtatgccttctctgatcgcacagcaacagcagaacccgcaggtctatgtgagccaaagcgcagccgctcagatcccggctttctatatggacacctcccaccttttcaatacgcaacacgctaggttggcccctccctccctagcccaacaacagggctttcagcctggcctgagtcagcccacatctgttcagcagattccaatccccatctacgcacctctacaggggcaacaccaggctcagctttctcttggcgcaggacccgctgtctcacaggcccaggagctgttttcttcctctctgcagccttatcgaagtcagcccgctttcatgcagagctccttgagccagccgtctgtggtactttccgggaccgcgatccacaactttccgaccgtccaacaccaggagctggctaaagctcaatctggacttgcctttcagcagacttctaacacacaacccatcccaatcttgtacgaacaccaactgggccaggcctcaggactcgggggatcgcagttgatagatacccatctcctgcaggcacgggctaacctaactcaggcgagtaacttgtattctgggcaagtccaacagccgggacagaccaacttttacaatacagcccagagcccttccgcacttcagcaggtcaccgttccactccccgcttcacagctgagcctgccaaatttcggaagcactgggcagcctctgatagcgctgccgcagaccttgcagccccctctccagcacaccactccacaggcccaggcccagtcactgtccaggccagctcaggtcagtcagccattccgaggactgattccagcaggtacccaacattcaatgatcgcaactacggggaaaatgagtgaaatggagctgaaggcatttggttctggaatagacatcaagccaggcacgccgccaattgccggaagaagtaccacccctactagctctcctttccgcgctacatccacgtctcctaattctcagtcctcgaaaatgaattcgatagtatatcagaagcagtttcagtctgcacctgcaacagtacggatgacgcagcccttccctacccagtttgctcctcagatactgtcccagccaaacttagtccctccactagtccgagcaccccacaccaatacatttccagcccctgtgcagcgcccacctatggctctcgcaagtcagatgccaccacctctaacaacaggtttaatgtcacacgcacgcctccctcacgttgccagaggaccctgcggaagcctgtccggcgtgaggggaaaccaggctcaggccgctctgaaagccgagcaggatatgaaggccaaacagcgggcagaggttctacagtccacccaacgcttcttttctgaacaacagcaatcaaaacaaatcggcggtggaaaggcacagaaagtcgactctgatagtagcaagccgccagaaactttgaccgatcctccaggggtctgtcaggagaaagtagaggagaagcccccaccagcaccatccatcgccaccaagccagtgcgcactggaccaattaaaccccaggccataaaaaccgaggagaccaaatcata

SEQ ID NO: 58588 - DNA, 7962 bp, Artificial Sequence
  Description of Artificial Sequence: Synthetic coding sequence
gtccctaaccaaatgtttcagcagtatcctcggatgacttatcctccgttgcacggtcctatgcggtttcctcctagtctttccgaaacaaacaaggggttgaggggccgtggaccacctccctcatgggcgagcgaacctgagcggccttccatcctgtctgcaagtgagctaaaagagctcgataaattcgataatctggatgccgaggctgatgaggggtgggcgggagctcaaatggaagtcgattacaccgaacagctcaacttcagtgacgacgatgagcagggctccaattcacccaaagaaaacaacagcgaagaccagggcagcaaggcttccgaaaacaatgagaacaagaaggagactgacgaggtttccaatacgaagtcctctagccagataccagcgcagccttccgtcgctaaggtaccctacggaaaagggccttctttcaaccaggagagaggcacgtccagccacctccccccaccgcctaagcttctcgctcagcagcatccaccccctgataggcaggccgtgccgggacggccaggaccgttcccatcgaaacagcaagtcgctgatgaagatgaaatctggaagcagcgcagacgccagcaatcagaaatcagcgctgccgtggaacgggctcggaaacgacgcgaggaagaggagcgcagaatggaggagcagagaaaggcagcctgtgcagagaaactgaagagacttgacgagaaactcggtatcttggaaaagcagccatcccccgaggagatcagggagagggagcgagagaaagagcgggagcgtgaaaaggaactcgagaaggaacaggagcaagagcgtgagaaggagagggagaaggaccgtgaaagacaacaggaaaaggagaaagaactggagaaggaacaggagaaacaaagagaaatggagaaggagagaaaacaggaaaaggagaaggaactggaaagacagaaggagaaagaaaaagagctgcagaagatgaaggagcaggaaaaggaatgcgagctggagaaagaaagggagaaactagaagagaagatcgagcctcgggaacccaatcttgaaccgatggtggagaagcaagaatccgagaatagttgtaataaggcggaagaggagccagtgttcacccggcaggactcaaacaggagcgagaaggaggcgaccccggttgtccacgaaactgagcctgagagtggcagccaaccgagacccgcagtgttgagcggatacttcaaacagtttcagaaatcgctgccccctagatttcagcgacagcaggaacagatgaagcagcaacagtggcaacagcagcagcagcagggcgtgttgcctcagaccgtgccgagtcagccatcctcatctactgtgcccccaccccctcataggccactctatcagcctatgcaaccccaccctcagcatcttgcctcgatggggttcgatcctcgatggctgatgatgcagagctacatggatccaagaatgatgagcgggcgacccgcaatggatattcctcccatccacccaggaatgatccccccaaaaccactgatgaggcgtgatcagatggagggttcaccaaacagctcagagtctttcgagcacatcgcccgatcagcacgggatcacgcaatctcactgtctgagccaagaatgttgtggggttcagacccataccctcacgccgaaccccagcaggcgaccacacctaaggcaactgaggaacctgaagacgtgaggtctgaggccgctctggatcaggaacagatcacagcggcatacagcgtagagcacaaccagttggaggctcatcccaaagcggacttcattcgggagtcctccgaggcgcaggttcagaagttcctctcaagatcagtggaggatgtccggcctcaccacaccgatgcgaacaatcagagcgcttgttttgaggctccagaccagaaaacgctttccgctcctcaggaggaacgcatcagtgccgtggaatctcagccaagtagaaaaaggagcgtgagtcatggttccaatcacacacaaaaacctgacgagcagcgatccgagccttcagccggtattcctaaggtcacaagccggtgcatagactcaaaggagccaattgagaggcccgaagaaaagccgaagaaggaagggttcatacgctctagcgaaggtccaaagcccgagaaagtgtataaaagcaagagtgagacccgctggggcccacgtccatcttctaaccggagagaggaggtcaacgatcggcctgtcaggaggtccggccctattaaaaagcccgtgcttcgggacatgaaagaggagagggaacagcgcaaagagaaggagggcgaaaaggcggaaaaggtgactgagaaagttgttgtgaaacccgagaagaccgagaagaaggacctgccacccccacctcctccaccccagccaccggctcccatccagccccaatccgtgcccccaccaattcagccagaggcggagaagtttccctccaccgagactgcaaccctcgcccagaagccaagccaggacacagaaaaaccgcttgaaccagtgagtaccgtgcaggtggagccggcagtgaagaccgtgaatcagcagacaatggcagccccagtggtgaaagaagagaaacagcctgaaaaagtcatcagcaaagacctcgttatcgaaagaccaagacctgatagccggcctgccgtcaagaaagagagcaccctgcctccaagaacatactggaaagaagccagagagagggattggtttccggaccaggggtataggggtagagggaggggcgagtactactccagggggcgaagctatcgtgggtcctacggtggcagaggcagaggcggtaggggccataccagggactacccgcaatacagagataacaagcctcgtgctgagcatataccatcaggcccattgcgccagagggaagagtccgagacccggtctgagtcaagtgatttcgaagtggttcccaaaaggaggagacagcgaggatccgaaacggacactgatagcgagattcatgagtccgcatccgacaaggattccctgtctaagggaaagctgcctaagcgggaagaaagacctgaaaataagaagcctgttaaacctcatagctcattcaaacccgataaccatgttagaatcgataacagactgctggagaaaccatacgtgagggatgacgacaaggcaaagcctgggttcctgccaaaaggggaacccacacggcgtggccgtggcggaaccttccggagaggtgggagggatcctggtggccgtccttcccgcccttctacattgcgccgtcctgcctacagagacaatcagtggaacccaagacagtcagaggtgcctaaaccagaggacggcgaacctccaaggcgccacgaacagtttatccccatagccgcagacaagcgccctcctaaattcgaaagaaaatttgacccagcgagagagaggcctcgccgacagaggccaacgagaccccctagacaggataaacccccaagatttaggcggctgcgggaacgggaagccgcatcgaagagcaacgaggtggtggcagtgccaaccaatggtaccgttaacaacgtcgctcaagagccggtcaatacactcggcgatatatccggaaacaagacccctgatctgtccaaccagaattcgagcgaccaggctaacgaagaatgggagaccgcaagtgagtccagcgattttaacgagagaagggagcgagacgagaaaaaaaatgctgaccttaacgcacagaccgttgtaaaagttggggagaacgtgctgcctcctaaacgagagatcgcaaagcggtccttttccagccagcgtcctgtggacaggcaaaacagaagaggaaataacggtccaccaaaatctggacggaatttttcagggcctcggaacgagaggcggtccggtccccctagtaagtccggtaaaaggggccctttcgacgaccagcctgctggtaccaccggggtggatctcattaacgggagctcggcccaccaccaggagggcgttcctaatggaactggacaaaagaattccaaggattcaactgggaagaaaagagaggatcctaaacctggaccaaagaagcccaaagagaaggtggacgctcttagccagtttgacctgaataattatgcctcagttgtgatcattgacgatcatccagaggtgacagtgattgaggatcctcagagtaatctcaatgacgatggatttactgaggttgtctccaagaagcagcagaagcgccttcaagatgaggagaggagaaaaaaagaggaacaggtgattcaggtatggaacaaaaagaatgctaatgaaaagggcaggtcccagacctctaaacttccaccgaggttcgctaaaaaacaggcgacaggcatccaacaagcccagtcctcagcaagcgtgccccctttggcttcagcccctcttcctccctccaccagcgccagcgttcctgcctcaacttccgccccactgccggctaccctgactcccgtccccgcatcaacgagcgcccctgtaccagcctcaactctggccccagttctggcgagtacatccgctcccgtccccgcttctccactagcgcctgtgtcagccagcgccagcgtaagcgcgagcgtgccagccagcacttctgccgctgccattacttcctcctcagccccagcttctgcgccagcgcctacgcctatcctggctagcgtgtcgacccctgcatcagtgaccatactggcgtctgcatccatacctattttggcttctgcccttgcttctacgagcgctccaacaccagccccagctgcatcgagccccgcagcaccggtgatcacagctcctacgattcccgctagcgctcccacggcatcggtgcctcttgcaccagcgagtgcttccgcccctgcaccagcacccacgcccgtgagtgcacccaatccagcgccaccagcacccgctcagacacaagctcagacacacaaaccggttcaaaatccattgcagactacatcccagagtagcaagcaaccaccacccagtataaggctcccttctgcacaaacgcccaatgggaccgactatgtggctagcggaaagagcatccaaactcctcagtcccatggaaccctaaccgccgagctatgggacaacaaggtggctcccccagctgtgctcaacgatatcagcaagaagctagggcctatcagcccaccccagccgccttccgtctcagcatggaacaaacccctcacttcattcgggtcagccccatcaagcgagggagctaaaaacggccaggagagcggcctagaaataggcacagatacgattcagttcggggctcccgcatctaacggcaacgaaaacgaggtcgttccggtcctctcagaaaaatctgcggataagattcccgagcccaaagagcagcgccagaaacagcccagggcagggcctattaaagcacagaagctccccgacctctccccagtggaaaataaagagcataagcctggtcctatcggaaaagagcgttcactgaaaaatcgaaaggtcaaagacgcccagcaggttgagccggaaggacaggagaagccaagcccagccacagtccgaagcaccgacccggtgaccaccaaggaaactaaagctgtgtctgagatgagtacagagattgggactatgatatcagtgtcgtcagcggaatacggcacaaacgctaaggagtcagtgacagattatacaactcccagtagctcactccctaatactgtggccacaaacaataccaaaatggaagacacactcgtgaataacgtgccactgccaaacaccttgccattgcccaaacgcgagaccatacagcaatcctcctccctcactagtgttcctccaaccacattttctctgacatttaagatggagagtgctaggaaggcgtgggaaaatagtcccaacgtccgggagaagggctcaccggtgacctccactgctccaccaatcgctacaggcgtttcttcctcagccagcggaccatctactgctaactacaatagtttctcttcagcctccatgccccagatcccagtggctagtgtaacacctaccgcctccttgtcaggagccggaacttacacaacgtctagcttatctacaaagtctaccacaacctcagaccctccaaacatttgcaaagttaagccccagcaacttcagacgagttctcttcctagcgcatcccacttcagtcaactttcctgtatgccctcgctgattgcacagcaacagcaaaacccacaggtgtatgtttctcagtccgccgcagctcaaattccagctttttacatggatacttcacatttattcaatactcagcacgcaaggttggctcctccctctctggcccagcagcagggatttcagcctgggctaagtcagcccacctcagtgcagcagataccaatccctatctacgctcccctgcagggccaacaccaggcccagttgagcctgggcgcaggacccgctgtgtcacaagctcaggagcttttctcatcatccttgcagccctaccgaagccagcccgcattcatgcagagctcactgtcccagccttcagttgtcctctcggggaccgcaatccataactttcccactgtccagcaccaggagttagcgaaagctcagagtggactcgcttttcaacagactagcaatactcagccaataccaattctttacgagcaccagttggggcaagcgtctggcctcgggggatctcagctgatcgacacgcatctcctccaggcgagggccaatctgacgcaagccagcaatctttactccgggcaagtgcagcagcctggacagaccaacttctataatacagctcaaagcccctcggcccttcaacaggtaaccgttccacttccagccagtcagctcagcttgccgaacttcggctctactggtcaacccctgatagctctgccgcagaccctccagccaccactgcagcacacaactcctcaagcccaggctcagtcactgagcaggccagcccaagtctcgcagccgttcagggggctgatcccggcaggcactcaacatagtatgatcgcaaccactgggaagatgtcagagatggagcttaaagccttcggttcaggtatcgacattaaaccaggtacaccacccatcgctggcaggtccaccacgccaactagttcccctttcagggctacctccacatcccccaactcccagtcaagcaagatgaacagcatcgtctaccagaaacagttccaaagcgccccagccactgttcggatgacacaaccattccctacgcagtttgcaccgcagatcctttcgcagcccaatctggtgcccccactggttcgcgctcctcatacaaacactttcccggctccagtgcagcggcctcctatggccctggccagtcagatgccacctcctctcacaacaggcttgatgagtcacgcccgactgccacacgtggccagaggaccttgcggcagcctcagcggcgtgcgcggaaatcaagcccaggcagcccttaaagcagaacaggacatgaaggcgaaacagcgtgctgaggtgcttcagtccactcagaggtttttctccgagcagcagcagagcaagcaaatcggcggaggcaaggcacagaaggtggattccgattcgtctaagccaccagaaacccttaccgaccctcccggagtgtgccaggagaaggtcgaggaaaagcctccaccagctccctctatcgccaccaagcctgtgcggaccggacctatcaagccccaagcaatcaaaacagaggagactaagtcttaa

SEQ ID NO: 58589 - DNA, 813 bp, Artificial Sequence
  Description of Artificial Sequence: Synthetic coding sequence
atgagtacggaaatcgggaccatgatctccgtgagtagtgctgagtatggtaccaacgctaaggagtccgtcacagactatacaactcctagcagctccttgcctaatacagtggctactaacaatactaagatggaagatacactcgtgaacaacgtccctttgcctaacactctcccgcttcccaaacgagagacaatccagcagtccagctccctcacctctgtgccacccactaccttttctctgaccttcaaaatggagtcagccaggaaggcgtgggagaattcaccaaacgtgcgcgagaaaggaagccctgtgacttcgacagcaccccctattgccactggtgtgagctcaagcgcaagcggtccgagtacggccaactataactcctttagtagcgcatctatgccacagattccagtcgccagcgtcacaccaactgcctccctgtccggagccggaacatacaccacgtcatctctgagcacaaagagcacgaccacctctgatccaccgaacatctgcaaagtgaaaccgcagcagttgcagacctcctctctgccaagtgcttcccattttagtcagctgtcctgcatgccatccctgatcgcacagcagcaacagaatcctcaggtttatgtgagccagtctgccgctgctcagatccccgctttctatatggatacctcccatctttttaatacccagcacgcacgactggccccacctagccttgctcagcagcaggggttccagcccggtttatcccagcccaccagcgttcagctgctaacctccacgatctag

SEQ ID NO: 58590 - DNA, 8258 bp, Artificial Sequence
  Description of Artificial Sequence: Synthetic coding sequence
atgtccgaaaaaagtggccagtcgaccaaggctaaggacggtaaaaaatacgcaacactgagcctgtttaacacatacaagggaaagtctttagagacccaaaaaactactgcaaggcacggtctgcagtccctcggcaaggtcgggatcagcaggagaatgccccctccagctaacctgccctcactcaaagccgaaaacaagggaaatgaccctaatgtcaatattgtcccaaaggacggtactggatgggcctctaagcaggaacaacacgaagaggaaaagaccccggaagtcccaccagcacagccaaaacccggagtagcagcgccacccgaagttgcacccgctcctaaatcgtgggcgagtaacaagcagggaggacagggtgatggaatccaggtcaactcgcagttccagcaggaatttccatcactgcaagcagcgggtgatcaagagaagaaggagaaagaaaccaatgatgataattatggcccaggaccctccctgcggccaccaaacgtggcgtgctggcgagacggaggcaaggcagccggatccccaagttctagtgatcaggatgaaaagctaccaggacaggatgagagtaccgctggaacaagcgagcaaaacgacatcttgaaggtcgttgaaaagagaattgcctgcggccctccccaggccaagcttaatggtcagcaagctgctttggcctcccagtatcgggctatgatgcccccttacatgttccaacagtatcctaggatgacataccctcctttgcacggaccaatgaggttcccccctagcctttccgagactaacaaaggactgcgcggacgcggacccccaccttcctgggcatctgagccagagcggcctagcatattgagtgcatccgaactgaaggaattagataagtttgataaccttgatgccgaggccgacgaagggtgggctggggctcagatggaagtcgactatacagaacagcttaatttctccgacgatgacgagcagggcagcaactcacccaaagagaacaactcagaggatcagggttccaaagctagcgagaataacgagaacaagaaagagacagacgaggttagcaatactaaaagctcctcccagattccggcacagccgagcgtggcaaaggtgccgtatggaaaaggacctagcttcaaccaggaaagaggcacatcttctcacctgccacctccgccaaagctcctagcacagcaacatccgccacccgacaggcaggcagtccccggacggccaggtccctttccatctaagcagcaggtagcagatgaggatgagatctggaagcagcgcagacggcaacaatctgaaatctccgcggctgtcgagagggcaaggaagagacgcgaggaggaagagaggaggatggaggaacagagaaaggccgcatgtgccgaaaagctgaagagactggatgagaagctcggaatacttgaaaagcagccatcccctgaggaaatcagggaaagagaaagagaaaaagaacgggagagagaaaaggaattggaaaaggagcaggagcaggagcgggagaaggaaagagaaaaggacagagaaaggcagcaggagaaggaaaaggaactggaaaaagagcaggagaaacagcgggagatggagaaagaacgaaaacaggaaaaggaaaaggagctggaacgtcagaaagagaaagagaaagagctccagaagatgaaggagcaagagaaggagtgcgaactggagaaggaacgcgagaagctggaagagaaaatcgagccaagagaaccaaacctggagcccatggtggaaaaacaggaatctgagaacagctgtaacaaggaggaggaacccgtcttcaccagacaggatagcaatcggagcgagaaagaagccacccccgtggtacatgagactgaacctgagtcagggagccagcccagacctgccgtcctgagcggatatttcaagcagttccaaaaaagccttcctcccaggtttcaaaggcagcaggaacagatgaaacagcagcagtggcaacaacaacagcaacaaggcgttctcccccagacggtgcccagccagccatcctccagtacagtgccccctccaccacaccggcctctgtatcagccgatgcagcctcatccgcagcacctggcatcaatggggtttgacccaagatggttgatgatgcaatcatacatggacccccgaatgatgagcggcagacccgctatggacattccccctatccaccctgggatgatcccacctaagcccctgatgagacgggatcagatggagggaagcccgaattcttcggagagcttcgagcacatagctcgctcagctcgcgaccacgccatatcactgtccgagccaagaatgctgtgggggagcgatccgtatcctcacgccgaaccccaacaggcaactacgcctaaagccacagaagaacctgaggacgtcagatccgaggcagcgctggatcaggagcaaataactgcagcctactctgtagagcacaaccaacttgaggctcacccaaaggccgacttcatcagggaaagttccgaagcgcaggtccaaaaatttcttagtaggagtgttgaagacgttagaccacaccacacagacgctaacaaccagtccgcatgcttcgaagcgcctgaccaaaaaaccttatccgccccacaggaggaacgaatcagtgccgtcgagtctcagccctccagaaagcggtccgtgtcacatggctctaaccatacacagaaaccagatgagcaacggagtgagcccagcgccggtatcccaaaagtcacttccaggtgcatcgattcaaaagagccaatcgaacgtcctgaagaaaaacctaaaaaagaaggcttcattcgttcctcagagggcccaaaaccagagaaggtgtacaagtctaagtcagaaactcggtggggccctcggccttcatcaaaccgtcgcgaggaggttaacgaccgtccggtgaggagatcaggccctatcaaaaaacctgtgctgcgagatatgaaggaagaacgggagcagaggaaggaaaaggagggggaaaaggccgaaaaagtcaccgagaaggtggtggtaaaacctgaaaagacagagaaaaaagacctgccgcctcctcctcccccaccccagcctcccgcacctatacagcctcagtccgtcccacctcccattcagccagaggccgagaaattcccttcgacagagactgccaccttggcccagaagccatctcaggacactgaaaagccactggaacctgttagcaccgtccaggtcgagccagccgtgaaaactgtgaaccaacagacaatggccgctcctgtcgtgaaggaggaaaagcaaccggagaaggttatctccaaagatctggtaatagagagacccagacctgattctcgaccagcagtgaaaaaggaaagcacccttcctcctcgtacatactggaaggaagctagggagcgggactggttccccgaccaggggtacaggggcagagggcgtggtgagtactactcgcggggacgctcctatcgcggaagctatggcggacgcggtcgcggagggcgaggccacacccgcgattatccccaatatcgcgataacaagccacgggcagagcacattcctagtggacccctaaggcagagggaagagagcgaaacacgctctgaaagctcagatttcgaagtggtgccaaagcgaagacggcagagagggtctgaaacagatactgattccgagatccacgagtcggcctccgataaggacagcctgtctaaggggaagctccctaaacgagaggagcgtccagagaataaaaagcctgtgaaacctcacagttcatttaaaccggataatcatgtaagaattgacaatcgtctcctggagaaaccatatgtgagagatgatgacaaagctaagcccggatttctgcccaagggagagccaacgaggaggggacgaggcggaaccttccggcgtggtggcagagacccgggtggtagaccctccaggccaagcactttaagaagacccgcatacagagataaccagtggaacccccgacagagtgaagtgcctaagcctgaagacggggaaccaccacgtaggcatgaacagttcatacctatcgctgcagataagcgccctcccaaattcgagcgcaaattcgaccctgctcgcgagcgtcccagacgtcagcggcctacacgcccaccaagacaagacaagcccccaaggtttcggaggctcagggaacgagaagcagccagtaagagcaatgaggtcgtcgctgtcccgaccaacggaaccgttaacaatgtggcccaggagccggttaacactttaggggacataagtggtaataagacccctgacttatccaaccagaattcctctgatcaggctaatgaggaatgggagaccgcctctgaaagctctgacttcaatgaacgccgtgagcgagacgagaagaaaaacgctgacctgaacgctcagacggtcgtgaaagtgggagagaatgtcttaccacctaaaagggagattgccaaaaggtcattcagtagccagcggccagtggacaggcagaatcgcaggggcaacaacggccctccaaagagcggccgaaatttctcaggacccagaaacgagcggagaagcggtcctccgagtaagtccggtaaaagggggccatttgacgatcaaccagctgggaccacaggtgtggacctgattaacggcagcagtgcacaccaccaggagggtgtgccaaatggtacaggtcagaagaattcaaaagactccactggcaaaaaacgcgaagatcccaagccgggacctaaaaagccaaaggaaaaggtcgatgcgctgagccagttcgatctaaataattacgcctccgtcgtgatcatcgatgatcatccagaggtcacagtgatcgaagacccacagagtaatctcaatgacgacggttttacagaggtggtctcgaagaagcagcaaaagcggctgcaggacgaggaaaggagaaaaaaagaagaacaagtaatccaagtctggaacaaaaaaaatgccaacgagaagggcaggtcgcaaacgtctaagttgccgcctcgattcgcaaaaaaacaggccaccggcatccagcaggcccagtccagcgcctccgtgccaccactggcttcggctccactacccccatccacttccgcaagcgtgcccgcttccaccagtgcacctctcccagccactctcacacccgtgccagctagcacatccgctcctgtcccagcctccacactggccccagtactcgcttctacctcagcccctgtccccgcatcgccactcgctcccgtgagcgcatcagccagtgtttcagccagtgtccccgcttctacatccgctgccgcaattacgtcttctagtgctcctgctagcgctccggcacccacccccattctggcctccgtgagtactcccgcatccgtgacaattctggcctccgccagtatcccgatcctcgcttccgcactggccagtacatcagcgccaaccccagccccagccgcatcatctccagccgctcctgtcatcacagctcctacaatcccggcttcagctccgaccgctagcgtgccacttgctccagccagtgctagcgctcctgctccagccccaactcccgtaagcgccccaaacccagcccctcctgcgcctgcccaaacccaggcccagacgcacaaacctgtccagaaccccctgcaaaccacgagtcagagttccaagcaacccccacccagcatccgattaccaagcgctcagaccccgaatggaacagattatgtggcaagtggcaagagtatccagacaccacagagccacggcacgttaaccgctgagctgtgggacaacaaggtcgcaccaccagcagtcctcaacgatatttctaagaaacttggtccaatttcacccccacagccgccttccgtttctgcttggaacaagccactgacttcattcgggagtgccccaagctccgagggcgctaaaaacggacaggagagcgggctcgagatcgggacagatactatccagtttggagcacccgcttcaaacggcaacgaaaacgaggtggtccctgttctgagcgaaaagagcgccgataaaatcccagagcccaaagagcagcgtcagaagcagcccagggctggccctattaaggcccagaagctgcccgatttatcgcccgtggagaataaagagcacaagcctggtcctatcggcaaggagcgcagcttgaaaaatcgtaaggtcaaggatgcacagcaggtggagccagagggacaggagaaaccgtcccctgcgacggtccggtcaaccgaccccgttaccacaaaagagaccaaagccgtgtccgagatgagtaccgagatcgggactatgattagcgtctcaagcgctgagtatggtaccaacgcaaagatggagagtgctcgaaaggcatgggagaactctccaaatgtgagagagaagggatcccccgtgacttcgactgcgccacctatcgctactggcgtgtcttctagtgcgagtggcccatcaactgctaactacaattcttttagctccgccagtatgccacagatccctgtggctagcgtaacaccgaccgcctcactgtctggcgcaggtacctacactacaagctccctgagtaccaaatcaactactacatccgatcccccaaacatctgcaaggttaagccgcagcaactgcagacctcctcattaccaagcgcctcccacttttctcaactgagctgcatgcccagcctcattgcccagcagcagcagaacccacaggtgtacgtgtctcagtcggcggcagctcagattcccgctttttacatggatacttcgcacttgttcaatactcaacacgcacgcctggctcctccatcccttgcacagcagcaaggctttcagccgggactctctcagcccacctccgtgcagcaaatacctatcccgatctacgccccactgcaaggtcagcaccaagctcagctctcactcggcgcaggcccagccgtatctcaagcccaggaacttttctctagcagcctgcaaccctatagatcccagccagcattcatgcaatccagtttgtcccagccttcagtggttctcagtggcaccgcaatccataacttccctacagtgcaacaccaggagctggcgaaggcccagtcgggcctggctttccagcaaaccagcaacacgcagccaattcctattctgtacgagcatcagctgggtcaagccagcggcctgggagggtctcaactgatagatacgcacctgttgcaggctcgcgcaaatctgacccaggcctctaacttgtactccgggcaagtgcagcagcccggacagactaacttctacaacacagctcagtctccttcagctttacagcaggtgacagtccctctccctgcctcccagttgtcgctccctaatttcggctcaacaggacagcctttgattgctctgccccagactttgcagcctccattgcaacataccactccgcaggcccaagctcagagcctaagcagaccggctcaggtatcacagcctttccgagggctcatccctgcagggacccaacactccatgattgctaccacaggcaaaatgtcagagatggagctgaaagcatttgggtcaggaatagacatcaagcctggaacacctcccattgccggacgcagcactacgccaacgtctagcccattcagagcaacctcaacctcaccgaactcacagtccagtaagatgaacagcatcgtgtatcagaagcaatttcaaagtgcacccgctacagtgcgcatgacgcaacccttccccacgcagttcgcaccccaggctaagcagagagccgaggtgctgcagtcaactcagagatttttttcggagcagcagcagagtaaacaaatcggcggaggtaaagcccagaaggtcgactcagattcatccaaacccccagagacccttaccgacccccctggagtttgtcaagagaaggtcgaagagaagcctcccccagcaccttcaatcgcgaccaaacccgtgcgaacaggacctataaaacctcaggcaatcaaaactgaagagacgaaatctta

SEQ ID NO: 58591 - DNA, 8552 bp, Artificial Sequence
  Description of Artificial Sequence: Synthetic coding sequence
atgagcgagaagtcggggcaatctacaaaagccaaagacggcaagaaatacgccacattatccttgtttaacacatacaagggcaagagtttggagactcagaaaactaccgcaagacatggcctgcaatccctgggaaaagtcgggattagtaggcggatgcctccaccagctaatctcccatcgctcaaggccgagaacaaagggaacgatcccaacgtgaacatcgtgcccaaggatggaacaggttgggcttcgaaacaggagcagcacgaggaggagaaaacacctgaggttccaccagcgcagccaaagccaggcgtagctgctccgcctgaggtagctcctgccccaaaaagctgggcctcaaataagcaagggggacagggtgatggcattcaagtgaactcccaattccagcaggagtttccttcgctccaggcagctggagatcaggagaagaaagaaaaggaaactaacgacgacaattacgggcctggaccatctctgcgtccgccaaacgtggcgtgctggcgcgatggcggaaaggccgctgggtctccgagcagcagtgatcaggacgaaaagttaccaggacaagacgaatctacagctggtaccagcgagcagaacgatatcctgaaagttgtggagaagaggattgcatgtggaccccctcaggccaaactcaacggacagcaagccgctctggctagtcagtaccgagccatgatgcctccttacatgttccagcaataccccaggatgacatacccaccattgcatggtccaatgcgctttccgccttctcttagtgaaaccaataagggtctgcgcggtcgtggccctcctccatcctgggcctcggagcctgagcggccatccattttgtccgcttcagagctgaaggaattggataaatttgacaatcttgatgcagaagctgatgagggctgggcaggggcacagatggaagtggactataccgagcagctcaacttctcagatgacgacgaacagggaagcaattcccccaaggaaaacaattctgaggaccagggcagcaaagcttctgagaataacgaaaacaagaaggagactgacgaagtgtccaacactaagtcttcatcccaaatcccggctcagccatctgtcgcgaaggtcccctacggaaaaggccctagcttcaaccaggagcgcggtacttcatcgcatctaccccctccgcctaagcttctcgcccagcagcacccccctccagatagacaggcagttcctggcagacctggcccattcccgtcaaaacaacaggtggccgacgaggacgagatttggaagcaaagacgacgccaacagtcagaaatctccgcagccgttgaacgcgctcgcaaacgaagggaggaggaagaaagaaggatggaagagcagcgcaaggcagcttgcgcagagaagttaaagcgtctcgacgaaaagctggggatactagagaaacaaccatcacccgaggagattagagaaagagagcgggaaaaggaaagagaacgcgagaaggagctggagaaggagcaagaacaggaacgggaaaaagagcgcgagaaagatcgagagcgccagcaggagaaagaaaaggagctagagaaagagcaggagaagcagcgtgagatggagaaggagagaaaacaggaaaaggagaaagaactcgagcgccagaaggagaaagaaaaggagctgcagaagatgaaggagcaggagaaggagtgcgagctggaaaaagagcgtgaaaaactagaagaaaaaatcgaacctcgcgagcccaatttagaaccgatggtagagaaacaggagagcgagaacagctgcaacaaggctgaagaagagcctgtgtttacccgtcaggattctaaccgatcagagaaagaggctactcctgtcgtccatgaaactgaacccgagtctggcagtcagcccagaccggctgtcctatccgggtatttcaagcagttccagaaatcattgcctccaaggttccagaggcagcaggaacaaatgaagcagcagcaatggcagcagcaacagcaacagggcgtgttgcctcaaactgtaccctcccagccttcatcctcaaccgttcccccacctccgcacagacctctgtaccaacccatgcagccgcatccacaacatctcgcatcaatgggctttgatcccagatggctgatgatgcagagctatatggaccctcggatgatgtccggtagacctgccatggatatcccacccatacatccagggatgattcctcccaaaccactgatgcgaagagatcaaatggaggggtcccccaattcctctgagagcttcgagcacatagcaagatcggccagagaccacgccatatctttatccgagcccaggatgctgtgggggtccgacccgtatccccatgccgagccacagcaggcaacaactcccaaggccacagaggaacccgaggacgtcagaagtgaggcagcattggatcaagaacagattactgccgcatactctgtcgagcataaccaactggaggcccacccaaaggcagatttcattcgggagtccagtgaggcccaggtgcagaaatttctgtcacgatcagtggaggatgtccgaccccaccacaccgatgccaacaaccagtccgcctgcttcgaggcgcctgaccagaagacccttagcgccccacaggaggagaggatcagcgcagttgaaagtcaaccttcacgcaagcgctctgtaagccatgggagcaaccatacacagaagcctgacgagcaacggtctgagccttcggccggtatcccgaaggtgacttcgcggtgcatcgattccaaagaacccattgagcgtcctgaggaaaaacctaagaaggaagggttcatccgaagtagtgagggaccaaagcccgaaaaggtatataaatctaagtctgaaacaagatggggtccccgacccagctccaaccgacgcgaagaggtcaatgacagacctgttaggagatctgggccaatcaaaaagccagtgctgcgggacatgaaagaggagagggagcagagaaaggagaaggaaggagaaaaagcagaaaaggtcacggagaaagtcgtagttaagcccgagaaaaccgagaagaaggatctgccccctccacctccccctccccagccacccgctcccattcagccccaatccgtgcctccacctatccagcctgaggcagagaagttcccttccaccgaaactgcaacactggcgcagaaacccagccaggatacagagaaaccacttgaacctgtgtcgacagtgcaggtggaacctgccgtgaaaaccgtgaatcaacagaccatggcagcgcctgttgttaaggaggagaagcagccagagaaggtcattagcaaagatctcgtgattgagcggccacgaccagacagccgtccagccgtcaaaaaggagtccaccttaccgcctcggacctattggaaggaggcccgagaaagggattggtttcccgaccagggctacagaggccgaggcaggggcgagtactactcccgcggtaggagttatcggggaagctacgggggaagggggaggggcggaagagggcatactagagactatccccagtatagggataataaacctagagccgaacatatcccttctggacccctgaggcagagggaggagagtgagactcgatccgaatctagtgactttgaagttgtaccaaaacgcagaaggcaaagaggtagtgagactgacacagacagtgaaatccacgagtctgcctctgataaggactcactgagtaaaggcaagctgcccaaacgcgaagagaggccggagaataagaaacccgttaagccccattctagctttaagcccgataatcacgtgcgcatagataatagacttctcgagaagccctatgtgcgggatgacgacaaggccaaaccaggtttcctcccgaaaggggaacctacccgacgcggaagagggggtaccttccgcagggggggacgggaccctggcggacggccttctagaccatcaacactgaggcgacccgcatatcgcgacaaccagtggaatcccagacaaagcgaagttcccaagcctgaggatggggagccaccacgacgacacgaacagttcataccaatcgccgctgacaagcgcccaccaaagtttgaaagaaagttcgatcctgctcgggaacgcccaagaaggcaacgtcccactagacccccacggcaggataagccacccagatttaggcgactccgtgagcgcgaggctgcctccaaatcgaatgaagtagtggctgtgccaaccaacggcacagtcaacaacgtcgcccaggagccggtaaatacactcggtgacatatctgggaacaagacaccagatctaagcaatcaaaatagcagcgaccaggccaatgaggaatgggagacggcatctgaatcttccgactttaatgagagaagagaaagggacgagaagaagaatgcggacctgaacgcacagaccgtagtgaaggtgggggaaaatgtactccctcctaagcgcgagatcgcaaaacgctcttttagcagtcagaggcccgtggatcgacagaatagaaggggaaataacggcccacccaagagcgggaggaacttctccggccctcgcaacgaacgcagaagcgggccaccgtctaagtccgggaagcgcggtccttttgatgaccaacccgctggaacaactggggtcgatctgataaacggctcgagtgcgcaccaccaggagggcgttccaaatggaacgggtcagaagaacagcaaagattcaactggaaaaaagcgagaggaccccaagcccggtcctaagaaacccaaggagaaggtggatgcattatcccagttcgacctgaacaactacgcgagcgtggtgattatagatgaccatcccgaagttactgtcatagaagatcctcaatccaacctgaatgatgacgggttcacagaagtggtcagtaagaagcagcagaaacgattacaggatgaggaaagaagaaagaaagaggaacaggtgatccaagtttggaataagaagaatgctaacgagaaggggaggagccagacaagcaaactgcctccccgatttgcgaaaaagcaggccaccggaatacagcaggcccaaagctcagcgagcgttcctcctctcgccagcgctcccctgcctccatccaccctggcaccggtgagtgcttctgcaagtgtgagcgcctctgtcccggcttcaacaagtgcggctgccataacttccagctccgcaccagcctcagcccctgcccctacgcccatcttagcctctgtgagtactccagcttccgtcacaattctggcttcagcctcaattccaattttggcttcggccctggctagtacctcggcaccaaccccggctccagctgcctcaagccctgccgctccagtcataaccgcaccaaccattccagcctccgcccctacggcttcggttcctctcgcccctgcttccgcctctgcaccagccccagcgccaacccctgtgtctgcgccaaatcccgctccaccggctcctgcacagacacaggcacagactcacaaacctgtccaaaatcctctccagaccacatcccaatccagcaaacaaccccctccatcaatacggttacctagtgcccagacaccgaatggcactgactacgtagcctccggcaagtcaatccagacgccccagagtcacggaacactgacagcagagctctgggacaacaaggtggccccacctgcagttctgaacgatatcagtaaaaagctggggcctatcagcccccctcagccgccatcagtgtctgcatggaacaaacccttgacatcgtttgggagtgcgccttcaagtgagggcgctaagaacggacaggaaagtgggctggagatcggcacagatactatccagttcggggcacctgcctccaatggcaatgagaacgaggtcgtgcctgtgctatccgaaaagagcgctgacaaaattcccgagcctaaggaacagagacagaaacaaccgagagctggcccaataaaagcccagaagctgcccgacctgtcacctgtcgagaataaagaacataaacccggtcctatcggaaaagagaggtctctgaaaaaccgcaaggtgaaggacgctcagcaggtggagcccgagggccaggagaagccttcacccgcaacggtgagatctacggacccagtcacaactaaagagacaaaggccgtctccgagatgtccaccgagataggcactatgattagcgtcagttccgccgaatacgggacaaatgctaaggaatctgtaaccgattacactacaccgtcttctagcctgcccaacacagtcgcgactaacaacacaaagatggaggacaccctcgtcaacaatgtgcctcttccaaatacactgcctctcccaaaacgcgaaacaatacaacagagttcgtctctgacctctgtccctcctacgactttctcgctgactttcaagatggagtcagcccgtaaagcgtgggagaactcgcccaacgtgagggaaaaggggtcgccggtgacttctacagcgccacctatagctactggggtatcttcttctgccagtgggccatctaccgctaactacaattcctttagcagcgcctcaatgccacaaattcccgtggcaagtgtgaccccgaccgccagcctttctggtgccggaacatatacgacatccagcctcagtacaaagagcactacaacttccgacccacccaatatttgcaaggttaaacctcagcagctgcaaacttcatccctgccttctgcctcacatttcagccagctctcatgtatgccttccctcattgctcagcaacagcagaatcctcaggtgtacgtttcacagagtgccgcagcccagatccctgccttttatatggacactagccacctgttcaacacccaacacgcgcgtctcgcgccaccaagtttggcccagcagcagggatttcagcccggtctgagtcaacctacttctgtgcagcaaattccaatcccaatatatgcacctctccaggggcagcatcaagcccagttgtcactaggagcaggtccagccgtgtcacaggcccaagagctgttcagcagctcgttgcagccttatcggtcacagcccgcttttatgcagagtagcttgtctcagccctcagtcgtcctgagtggcaccgcaatccataacttccctaccgtccagcaccaggagctggcaaaggcccagagtggcttggcctttcaacagacctctaatacccagccgattcccatcctctacgagcaccagctggggcaggcctccggactaggagggtcccaactcatcgatactcatctgctgcaggctagggctaaccttacccaggctagtaacctttactctgggcaggtgcaacagcctgggcagaccaatttttataataccgcccaaagtccgtcagccttgcaacaggtgacggtgcccctgccagccagtcagctgtccctcccgaattttggctctacagggcagcccctgatcgcgttgccccaaacactgcagccccctttacagcatactactccacaggctcaagcccaatctctcagcaggccggctcaggtctcgcagccattccgcggacttattcctgccggaactcagcactccatgattgccactaccggcaagatgagcgagatggaactcaaggcatttggctctgggatcgacatcaaaccagggacccccccaattgccggacggagtactactcccacatccagtcctttccgcgctacttctacaagcccaaactctcagagctctaaaatgaatagcattgtgtaccaaaagcagttccaatcagctcccgctactgtgagaatgacacagccattcccgacccagttcgcccctcagattctttcccagcctaacctggtccctcctttagtgcgagccccacacactaacacgtttcccgcaccggtacaaaggccacccatggcattggcaagccagatgccaccacctctgactacaggcctcatgtctcatgcgcgactgccacacgtggcacgtggcccatgtgggtcgttgagtggagtccgaggaaaccaagctcaggccgcactgaaagcagaacaggacatgaaggctaaacaaagggctgaggttctgcagtctacccaacgattcttttccgaacagcaacagtcaaaacagatcggcggagggaaagctcaaaaagtggacagtgactccagcaaacctccagaaacactcacagatccaccgggagtgtgccaggagaaagtggaggaaaaaccccctcccgcaccatcgatcgccaccaagcccgtgagaactggacccattaagccccaggcaatcaagactgaagagacaaagtctta

SEQ ID NO: 58592 - DNA, 2292 bp, Artificial Sequence
  Description of Artificial Sequence: Synthetic coding sequence
attctgccccctacccagatgttccagcaatatcccagaatgacctatcctcccctgcatggccctatgagatttcctccttctctgtcagagaccaacaaaggtctgaggggtagaggccctcctcccagttgggcatcggagcctgaaaggccatctatccttagtgctagcgaactgaaagagctggacaagttcgacaatctggacgcagaagcagatgaaggctgggctggagctcagatggaggtggactatacagaacagctgaactttagcgatgacgatgagcaggggtccaactctcccaaggagaacaactcagaagaccaaggaagcaaagcctccgagaataacgagaacaaaaaggagaccgatgaggtgtctaatacaaagtcctcctctcagatcccagcccagcccagcgtggccaaggtgccttacggtaagggcccttctttcaaccaagagcgcggtacaagctcacatctgcccccaccacccaagctcttggcacagcaacatcctccacctgaccgacaggctgttcccggacgtcctggcccatttccaagtaaacaacaggttgccgacgaagacgaaatctggaaacaaagaagaaggcagcagtccgaaatatcggctgctgtggagagggctagaaaacgccgagaagaggaagagcggcgaatggaagagcaaagaaaggccgcttgcgctgagaaactcaaaaggttggatgaaaaactaggcattctggagaaacagccgtctcccgaagaaatacgggagagagagagagagaaggagagagaaagggagaaggaactggaaaaagagcaggaacaggaacgtgagaaggaaagggagaaggaccgtgagcgtcagcaggaaaaagaaaaagaactggagaaagagcaggagaagcagcgggaaatggaaaaagaacggaagcaagaaaaggagaaggagctagaaaggcaaaaggagaaggaaaaggaactgcagaagatgaaggaacaggagaaagagtgtgaactggaaaaggaaagggagaaattggaggagaagattgagccacgagaacctaatttggagcccatggtggagaagcaagagagcgaaaacagttgcaataaagctgaggaagagcccgtttttacccgtcaggatagtaatcgctcagagaaggaagccacccctgtagtccacgagactgagcctgagagtggcagccagccaaggcctgccgtgttaagcggatattttaaacagttccagaagtccctgccgcctcgtttccaacgtcagcaagagcaaatgaaacagcaacagtggcagcagcagcagcagcagggcgtgctcccgcaaactgtgccatcccagccatcgagcagtacggtgccccctcctcctcacaggcccctgtaccagccgatgcagcctcatcctcagcatctcgcttccatgggtttcgaccctaggtggctgatgatgcagagttatatggatcccagaatgatgtctgggagacctgccatggacattcctcctatccatccgggtatgatcccgcctaaacctctcatgcggcgagatcagatggaaggttccccaaacagtagcgagtcctttgaacacatcgccaggtcggccagagatcacgcaatttccctctccgagccccgaatgttatggggctctgacccctaccctcacgccgagccgcagcaggcaaccacccctaaagccaccgaggaaccagaagacgtgcgttccgaagccgcactggaccaggagcagatcaccgcagcatacagcgtagaacataatcagctggaggcccaccccaaggccgacttcatccgcgagtcctccgaggcccaggttcagaagtttctctctaggtctgtggaagatgtccgaccccaccatacagatgcaaataatcaaagcgcctgcttcgaggctccagaccagaagacccttagtgccccacaggaggagagaattagcgctgtagaatcacaaccatctcgaaaaaggtcagtttcgcacggctcaaaccatacgcagaagccggatgagcagcggagtgaacccagcgcagggatccccaaagtcacaagcaggtgcattgattcaaaagagccaatagaaagaccagaagaaaaacccaagaaagagggatttatccgctcatcagaaggcccaaagccagaaaaggtgtacaaaagcaaatccgaaactcggtggggcccaaggccatcttctaataggcgggaagaatag

SEQ ID NO: 58593 - DNA, 930 bp, Artificial Sequence
  Description of Artificial Sequence: Synthetic coding sequence
atgttgctcattttgctgagcgtagccttgctggcgctgagcagcgcccagagcttgaacgaggacgttagccaggaggagagtcccagtgtcattagtggaaaaccagaggggcgaagaccccagggcggaaaccagcctcaacgaaccccaccccctcccggtaagcctgaaggtcggccaccacagggaggcaaccaaagtcagggtcctcctcctcgacctggcaagccagagggaccaccaccccagggcggaaaccagagccagggacccccacctcgcccaggtaagcccgaaggtcagccgccacaaggcggaaaccagtctcaaggacctcctcctagaccaggtaagcctgagggtccccctccacagggcggaaaccagtcacagggacccccaccaagacctggcaaaccagaggggcctccaccgcaggggggaaaccagtcacagggcccacctccaagacccggtaaacccgagggaccacctcctcagggaggtaatcagtcgcagggtcctcccccacatcccggtaaacctgagggcccaccacctcagggcggaaaccagtcacaggggcctcctcccagacccggtaaaccggaaggtccccctccacagggagggaaccagtcccagggccctccaccacgtccgggaaaaccggaaggtccaccgagccagggcggtaataagccgcaaggaccccctccacacccgggtaaacctcagggaccacctccacaggaaggaaacaaaccacagaggcctccgcctccagggagaccccaaggacctcctccacccggaggaaacccccagcagccgctgccacctcctgctggcaagcctcaagggccaccaccccctccccaaggagggcgaccccatcggcctcctcagggccagccacctcagtag

SEQ ID NO: 58594 - DNA, 930 bp, Artificial Sequence
  Description of Artificial Sequence: Synthetic coding sequence
atgcttctgattcttctgagcgttgccctcttagcgctgtcaagcgcacagtccctgaacgaagatgtgagtcaagaagagtctccaagtgttatttcaggaaagccagaggggcgtcggcctcaagggggaaaccagccacagagaacacccccaccaccgggaaagccagagggtcgacctccacagggagggaatcagtctcagggtccgcctccaagacccggaaagcctgaaggaccaccccctcaagggggaaaccagtcccaaggaccccctccgcgacccggaaaacctgagggtcagcctccgcagggcggtaaccaatcacagggccctcctcccagacctggtaaaccagaagggccaccgcctcaaggcggtaaccagagccaggggcctccccctaggccgggaaaacctgagggccctcctccccagggcggaaatcaatcacagggtccaccccctcacccgggtaagccagaaggccctcctcctcagggcggaaaccagtcacaagggccaccgccacggcctggcaaacctgaaggtcccccacctcagggtgggaaccagtcacagggccctccccctcggccaggaaagcccgagggacctcccccacagggcggtaatcagtcacaagggccacccccacggccaggtaagcctgaaggaccaccttcccagggcggaaataagcctcagggccctccccctcatcccggaaaaccacaaggcccaccccctcaggagggaaataagcctcagcgccctccacccccaggccgtcctcagggtcctccccctccagggggaaacccccagcagcctttgcctcctcctgccggaaaaccgcagggtcctcctcccccaccgcaggggggacgcccacatcgccctccacagggccaaccccctcagtag

SEQ ID NO: 58595 - DNA, 501 bp, Artificial Sequence
  Description of Artificial Sequence: Synthetic coding sequence
atgctcttaatcctgctgagcgtggcactgcttgccttctcaagtgcacaagaccttgatgaagacgtgtcccaagaggatgtgccactggtaatctcggatggcggagatagcgagcaatttatagatgaggaacgacagggaccacccctgggcggtcagcaatctcagccttctgcgggtgacggaaatcagaacgacggccctcagcaaggccctccccagcaaggaggccaacagcagcaaggcccaccaccaccacaggggaagccccagggccctccccagcaaggaggtcacccaccacccccacagggtagaccacagggacctccccagcagggcggtcatccccgaccgcctaggggtcgccctcagggccctccccaacagggcggtcatcagcagggacccccacccccaccccctgggaaacctcaaggccctcctccccagggcggacgcccacaggggcctccccagggacagagcccccaatag

SEQ ID NO: 58596 - DNA, 501 bp, Artificial Sequence
  Description of Artificial Sequence: Synthetic coding sequence
atgcttcttatcctattatctgttgccctgttggctttctccagcgcacaggatttggatgaggatgtgtcccaggaggacgtgcctttggtgatatcagacggcggagacagtgagcagttcatcgatgaggagcggcagggcccacccctgggaggtcaacagtctcagccaagtgctggagatggaaaccaaaacgacgggccacagcaggggcctccgcagcagggcggtcagcagcagcagggccctccaccccctcagggcaagcctcaggggcctcctcaacagggcggtcacccacccccaccacagggaaggccacaaggtccacctcaacaaggtggacaccctagaccaccccgtgggcgaccacagggaccacctcaacagggcggtcaccaacagggacccccaccaccaccccctggcaagccacagggacccccaccccagggaggacgtccccagggccctcctcagggtcagtcgccacagtag

SEQ ID NO: 58597 - DNA, 501 bp, Artificial Sequence
  Description of Artificial Sequence: Synthetic coding sequence
atgttactgatccttttgagtgtggcgctcttggccttttctagtgcccaagacctagacgaagacgtttcacaagaagacgtgcccctggtgatctcagacgggggtgactctgaacagttcatcgatgaggaacgccagggccctcctctgggcggacagcagagccagccttccgccggagatggtaaccagaacgacggacctcagcaggggccaccccagcaaggcggacagcagcaacaggggcctcctcctccgcaggggaagcctcagggccctcctcaacagggaggacatcctcctccccctcagggccgtcctcaaggcccaccacagcagggcggacacccacgccctccacgcggaaggcctcaggggcctcctcagcaaggcggacaccagcaggggccaccaccaccccctcccggaaaaccccagggtcccccaccacagggaggacgtcctcagggacccccacaagggcaaagcccccagtag

SEQ ID NO: 58598 - DNA, 501 bp, Artificial Sequence
  Description of Artificial Sequence: Synthetic coding sequence
atgctgttaatattattgagcgtagccctgctcgcctttagctcagcccaggacctggacgaagacgtcagtcaggaagacgtaccgctggtgatctcggacggaggcgactccgaacagttcatcgatgaggagagacagggacctccgctagggggtcagcaatcccagccttctgctggggacggcaatcagaatgacggtcctcagcaggggccaccacaacagggaggacagcagcaacagggcccacctccaccacaaggcaaaccccagggaccaccgcagcagggaggacatccacctccacctcagggcagacctcagggacccccacaacagggcggacaccctaggcctcctaggggccgaccccaagggccacctcagcagggtggccaccagcaaggacctcccccaccaccgccaggaaagccacaaggtccaccaccccagggaggtaggcctcaggggcctccacagggacagtccccgcagtag

SEQ ID NO: 58599 - DNA, 486 bp, Artificial Sequence
  Description of Artificial Sequence: Synthetic coding sequence
atgttttcccttcccttgaattgtagtccagaccacatccggagagggtcctgctggggcagaccacaggacctgaagatcgccgctccggcttggaatagcaagtgccacccaggagccggagccgctatggccagatgcaaaaatgcagacggagtggaactctacaacgagatcgaattctacgccaaagtgaactccaaagactctcaggataagcggtcatcacgctcaattacgtgctttgtaagaaagtggaaggaaaaagtcgcttggccgagactcaccaaagaggacatcaaacccgtttggttgagcgtagacttcgataattggcgtgactgggagggagacgaagagatggaactagcccacgtcgagcactacgctgaattactgaaaaaagtctctaccaaacggccaccgccagccatggatgacttagacgacgactctgattcagccgatgatgccacttctaattag

SEQ ID NO: 58600 - DNA, 387 bp, Artificial Sequence
  Description of Artificial Sequence: Synthetic coding sequence
taacagcacgcaagaaccttgtggtatgatcgccctagctgcaagaacgcagatggcgttgaactatataacgagatcgaattttacgcaaaagtgaacagtaaagatagccaggacaagcggtcttcacgctcgattacgtgcttcgtccgcaagtggaaagaaaaagtggcttggcctcgcctgacaaaggaggacatcaaacctgtatggctcagcgtggatttcgataactggcgggactgggagggagatgaggaaatggagttagcgcatgttgagcattatgcagaactactcaaaaaggtctcaactaagaggcccccacccgctatggacgatcttgacgacgactcagatagcgccgacgatgccacaagcaactag

SEQ ID NO: 58601 - DNA, 297 bp, Artificial Sequence
  Description of Artificial Sequence: Synthetic coding sequence
atgagaaaaatgaacaccctgcttctggtaagtctgtccttcttgtacctgaaggaggtgatgggcctgaaatgtaatacttgcatttatactgaagggtggaagtgtatggcaggacgtggaacttgcatcgccaaagaaaacgagctgtgctcaacaaccgcgtactttcggggtgataaacacatgtactctacacacatgtgtaagtataaatgtcgagaagaggaaagttccaaaagaggacttttacgggtgacgctgtgttgcgatcgcaatttctgtaatgtcttctag

SEQ ID NO: 58602 - DNA, 345 bp, Artificial Sequence
  Description of Artificial Sequence: Synthetic coding sequence
atggctggtctggccctgcagccaggcacggctcttctgtgttactcctgcaaagcccaggtgagcaacgaagattgcctacaggtagagaattgcacacaactgggcgagcaatgttggacggctcggatcagggccgttgggttgcttaccgtgatttccaaaggctgttcactgaattgcgtagatgacagtcaggattattacgtgggcaaaaaaaatattacctgttgcgataccgacttatgcaatgcaagcggggctcatgccctgcaacccgctgccgctattctcgctctgctgcctgccctcggcctgcttttatggggacccggacagctatag

SEQ ID NO: 58603 - DNA, 312 bp, Artificial Sequence
  Description of Artificial Sequence: Synthetic coding sequence
atggggtccaggtgcgccaagctaaatacaggccaaagcccaggccacagccccggacattctactggtcacggcagagggcacgaaagcagcatgaagaagttaatggcgtgcgtgtctcaagataatttttccctcagcagtgccggtgaggaggaggaggaagaagaagaggagggagaggaagaggaaaaagaagaactaccagttcaaggcaagctcctcttgctagaacctgaacgtcaggaggagggccacaaagataacgcggaagcccagcagtccccagagccaaagcgaacgccaagctag

SEQ ID NO: 58604 - DNA, 744 bp, Artificial Sequence
  Description of Artificial Sequence: Synthetic coding sequence
atgaatctgctgcttattctcaccttcgtggccgcagcagttgcggctccatttgacgacgacgataagatcgtaggtggctacatttgcgaggaaaatagtgtgccctatcaggtgagtctgaattctgggtaccatttctgcggcggatcgctgatatcagagcagtgggtggtgtctgccggacattgttacaagtcccgaatccaggtgagacttggagagcataacatcgaggtgttagaagggaatgaacagtttatcaacgcggcaaagataatccggcaccctaaatataactctcgcactctcgataatgacattctgctgataaagctgtctagccctgcagtcatcaactcacgcgtgtctgccatcagcttgcctaccgcccctccagcagcagggacggagtccttgatcagtggctggggcaatacactgtcttcaggtgctgattaccccgacgaattgcagtgcctggacgccccagtactgtcgcaggccgaatgtgaggcatcctatcccggaaagatcaccaacaatatgttctgcgtgggtttcctggagggcggaaaggattcttgtcagggggactccggaggaccagtggttagcaatggcgagctccaaggaatagtctcttggggctacggatgcgcgcaaaaaaataggccgggtgtctataccaaggtgtataactatgtggattggataaaggacaccatcgcggctaatagttag

SEQ ID NO: 58605 - DNA, 525 bp, Artificial Sequence
  Description of Artificial Sequence: Synthetic coding sequence
atggcttgtggacccggtgacctccagagcctgacatcacccttgagtagtgccagactggactatcagccaagtatagagggaccttggctccgggcttgtggacaaacaaatgtatcctgtagggtggtgaagggtaaacttgtcgaggttgggaaatggccatggcaggtcagtattctgtttttgggaacgtacatttgctccggttctctgattcaccaccagtgggtgcttaccgctgcgcactgccttcagagatttaaggatcttagcctgtacagcgttatggtgggggtccatcagagacctgagaatagcacccagcttccactcacaaggatggttatccataaagatttttctaacttgatgtcccaggacatcgccctcttgaagctgcgggactctatctcttggagcccctttgtccaaccagtctgcctgccgaatatcaagttcaaaccgtctattggctctatgtgctgggtgattggctggggcaccaccggtaagaagggatag

SEQ ID NO: 58606 - DNA, 726 bp, Artificial Sequence
  Description of Artificial Sequence: Synthetic coding sequence
atgaagtttatcctgctgtgggcattgcttaatctgacagtggccctcgcctttaacccagactacactgtctctagtacaccaccctaccttgtgtatttgaagagcgattatttaccctgtgccggagttctcatacaccccctctgggtcatcacggccgcacactgtaatctaccaaagttgagagtcatcttgggcgtgaccatccctgctgactctaacgaaaaacacctgcaagtcattggctacgagaaaatgattcaccaccctcacttcagcgtcaccagtatcgaccatgatatcatgctgataaaattgaaaaccgaggcggaactgaatgactacgttaagctggccaacctcccttatcaaaccatatcggagaacaccatgtgctccgttagtacctggtcatataacgtgtgcgatatctataaggaacccgactccctccagaccgttaacatatcagtcattagcaagccccaatgtagggacgcctacaaaacttacaatattaccgagaatatgctgtgcgtcgggattgtgcctggaagacgccagccctgcaaggaggttagcgcagcgccagctatctgtaatggtatgctgcagggcattctctccttcgcagatggatgtgtgttgagggcagacgtcggaatttacgcgaaaatcttttattacattccctggatcgagaacgtcatccagaacaattag

SEQ ID NO: 58607 - DNA, 783 bp, Artificial Sequence
  Description of Artificial Sequence: Synthetic coding sequence
atgacccgccattggccatgggaggtgtctttgagaatggagaacgagcatgtctgtgggggagccctgatagacccatcgtgggtggtaacagccgctcactgtatccaggggaccaaagagtactcagtggtgttaggtacttcaaagttgcagcccatgaacttcagccgagccctctgggtgcctgtccgggatatcatcatgcatcctaaatactggggcagagctttcattatgggcgacgtggctctagtccacctacagacccctgttaccttcagtgagtacgtacagcctatctgtttgccagagcccaacttcaatctgaaggtcgggactcagtgctgggtgaccggctggtcacaggtcaaacagcgattcagcgccaacagcatgctaaccccagagcttcaggaagctgaagtgttcataatggacaacaaacgatgcgacaggcactataagaaaagcttcttcccgccagtcgtgcccttagtccttggagatatgatctgtgcaaccaattacggcgaaaatctgtgttatggcgacagtggaggcccacttgcgtgcgaggttgaagggagatggatcctggctggcgtcctgagctgggagaaagcctgcgtcaaagcccagaaccctggagtctacacccggattaccaagtataccaaatggattaaaaagcagatgagtaatggggctttttccgggccatgcgcgtctgcatgcctgctttttctatgttggctcctgcagcctcagatgggcagctag

SEQ ID NO: 58608 - DNA, 687 bp, Artificial Sequence
  Description of Artificial Sequence: Synthetic coding sequence
atgacccggcactggccctgggaggtttcgcttcggatggagaacgagcacgtctgcgggggtgcccttatagatcccagttgggtcgttacagcagctcattgtatccagggaacaaaggagtattctgtagtccttggcacgtctaagcttcagccaatgaatttctcacgtgcactctgggttccagtgagggacatcattatgcatcccaagtattggggtagagcttttattatgggagatgtggctctagtccacctgcagacccctgtgacattttctagtacagcaaactctatgctgacccctgagttgcaggaagcagaggtgttcataatggacaataaaaggtgtgacagacattacaagaagtcttttttccccccagttgtgcccctggttctgggggatatgatctgcgctacaaattacggcgaaaacctgtgctatggcgactcaggtgggcctctcgcttgtgaggtggagggcagatggattttggctggagttctgtcatgggagaaagcttgcgtgaaggcccagaaccccggagtgtacactagaattacgaagtatacgaagtggatcaaaaagcagatgtcaaatggcgcattctctgggccttgtgcctccgcatgtttgctcttcctgtgttggctgcttcaacctcaaatgggttcgtag

SEQ ID NO: 58609 - DNA, 1179 bp, Artificial Sequence
  Description of Artificial Sequence: Synthetic coding sequence
atggcagccccactccgcattcagagcgactgggcccaagccttgcggaaggatgaaggggaagcctggttgagctgtcacccgccagggaagccctcattgtacggttctctgacatgtcagggtattggcctggacgggattccagaggtgactgcgtcagaggggtttaccgttaatgagatcaacaagaagagcattcacatcagttgccctaaggagaacgcctcgagcaaatttttggctccttatactactttcagccgcattcataccaaatcgataacttgcctggatatcagcagccgaggcggactgggggtatcctcaagtaccgacggtacaatgaaaatctggcaggcgtctaacggcgagctaaggcgggtgttagaagggcacgtgtttgacgtcaattgttgtcggttttttcctagcgggctagtggtcctctctggcggaatggacgcccagcttaaaatctggtctgctgaagacgcctcttgcgtggtcaccttcaaggggcacaagggcggtattctcgacaccgccatcgtcgatcgagggcgaaacgtggtaagcgccagcagagacggaaccgcgagactgtgggactgcggacgatcagcctgcctgggggtgctggctgactgcggtagttctatcaatggggtggctgtgggggcagccgacaattccatcaatttgggcagtcccgagcagatgcccagtgagcgcgaagtggggacggaagctaaaatgctgttgttagccagagaggataagaagctgcagtgtctcggcctgcagtcacgccagctggtgtttctgtttatagggagtgacgcttttaactgctgtacgtttctctctggcttcctactcctcgccggaacccaggacgggaacatctaccagctagatgtgcgctctccacgggcacccgtacaggttatccacagaagtggggctccggtgctctcccttctttccgttagggacggatttatcgcttcccagggtgacgggagctgcttcatcgtccagcaggatttggattacgtgaccgaacttaccggtgcagactgcgacccagtgtacaaggtcgccacttgggagaagcaaatctatacttgttgcagggacggcttagtcaggagatatcagctttcagatctgtag

SEQ ID NO: 58610 - DNA, 1128 bp, Artificial Sequence
  Description of Artificial Sequence: Synthetic coding sequence
atgttagtcccatgttttctgtacagtctgcaaaatagaaaaccttcactttacggatccctgacttgccagggcattggtctggacggaatcccggaagtaactgctagtgagggattcaccgtcaacgaaatcaacaagaagagcattcacatcagctgccccaaagaaaatgccagcagcaagttcttggccccttatactaccttctctcggatccacacaaagtcaattacctgtttggatatctcaagccgtggcggattaggagtttcaagctcaacagatggaactatgaagatctggcaggcatccaatggtgaattaaggcgagtgttagaaggccatgtcttcgatgtgaattgctgccgattctttccttctggacttgtcgtgctgagtgggggtatggatgcacagctgaagatttggtccgctgaagatgccagctgtgtggtgacttttaaaggccataaagggggaattctggacacagccatcgttgaccgcggtcggaacgtggtgagcgccagcagggacggtaccgctcgcctctgggattgtgggaggtcggcctgtctgggagttctcgcagattgtggcagttctattaatggagtcgctgtgggggctgccgataattcaatcaatctgggaagtcccgaacagatgccaagcgagcgggaggtggggacggaagctaaaatgctgctgttagcaagagaagacaaaaagttgcaatgtctgggcctgcaaagtagacagctggtgttcctgttcattggaagcgacgcctttaattgctgcacctttctctctggctttcttctgctcgcaggaactcaggacggcaacatttaccagctcgacgtgcgatcccccagagctcccgttcaggtgattcaccggtcaggggctcctgtcttgagcttactcagtgttcgggacggttttattgccagtcagggtgatggatcttgctttatagtgcagcaggatctggactacgtgactgaactgaccggcgcagactgtgaccccgtctataaggtcgccacatgggaaaagcagatctacacttgctgccgagacggactagtcagacggtatcaactgtccgatctgtag

SEQ ID NO: 58611 - DNA, 714 bp, Artificial Sequence
  Description of Artificial Sequence: Synthetic coding sequence
atgctggtgccttgcttcttgtactctctccaaaaccgcaaacccagcctgtacggctctctcacctgccagggcatagggcttgatggaatacctgaggtgacagcatcagagggatttaccgtgaatgagatcaacaaaaagagtatccacatctcctgtccgaaggaaaacgcctcctccaagtttctggcgccttacacgacattcagcagaattcacactaagagtattacctgcttggatattagctcacggggtggactaggggtttcctcctccacagacggcacaatgaaaatctggcaggcctcaaacggggagcttcgacgagttctggagggccacgtctttgatgtgaactgctgcaggttctttccaagcgggcttgtggtgctctctggcggaatggatgcccagctgaagatctggtccgctgaggacgcttcatgcgttgtgacatttaaaggccacaaaggcggtatcctcgacacagctatagtcgaccgcggtagaaatgtggtgtcagcgagtcgcgacggcactgcccgactgtgggactgcggtcgctctgcatgcctcggtgtgctcgcagattgtggctcttcgatcaatggggttgccgtgggtgctgcagataattcgatcaacctgggctctcccgagcagatgcccagtgagagagaggtggggacagaggctaagatgctgtag

SEQ ID NO: 58612 - DNA, 1128 bp, Artificial Sequence
  Description of Artificial Sequence: Synthetic coding sequence
atgctggtgccttgtttcttgtactccttgcagaacagaaagcctagcctgtacgggagcctgacttgccagggcatcgggctagatgggattccagaggtgacggccagtgagggatttacagttaacgaaatcaacaagaaaagcatccacataagctgtcccaaggaaaacgctagctcaaaattcctggctccgtacactaccttcagccgtatccacaccaaatcgataacctgtctcgatatttctagcaggggaggactgggcgtatcatcttcaacggatggaactatgaaaatctggcaggcttccaatggggagctgcgcagggtgttggaggggcacgtctttgacgtaaactgttgcaggttcttcccatctgggctggtcgttttatcaggagggatggatgcacagctgaagatatggtccgcggaagacgccagctgcgtcgttacttttaaggggcataaggggggaatcctcgacacggccattgtggatcgcggtagaaacgtggtctccgcctctagagacggaactgcaaggttatgggactgtggccgaagtgcatgcctcggagtcttggctgactgtggaagcagtataaacggagttgccgtaggggcagcagacaattccattaacctcgggagtccagaacagatgcccagcgagcgggaagtgggcacagaggcgaagatgctgctgcttgcgagggaggacaagaagctccagtgtctgggtttacagtcccggcaactcgtatttctctttatcggcagcgacgccttcaattgctgtaccttcctcagtggttttttactcctcgccggaacgcaggatggtaatatataccagctggacgtcaggagtccccgagctcccgttcaggtcattcaccggagtggtgctcccgtcttgtccctgttgtctgtcagggatgggttcattgccagccagggagacggctcctgcttcatcgtgcagcaagacctggactatgtgactgaattgaccggtgccgactgcgatcccgtgtacaaagttgcaacgtgggaaaaacagatctatacctgctgccgtgatggcctcgtcaggaggtatcagctttccgacttatag

SEQ ID NO: 58613 - DNA, 744 bp, Artificial Sequence
  Description of Artificial Sequence: Synthetic coding sequence
atgctggtgccttgcttcctatattcactacagaatcgcaaaccgtccctgtacgggagcctgacatgccagggtataggattagacgggatacccgaagtcaccgcctctgagggcttcaccgtgaatgagatcaataaaaagagtatccatatttcatgtcctaaagaaaacgcatcctctaagtttttagccccatatacgacttttagtaggattcatacaaaatcgattacctgcctagacatatctagccgcggtggtctaggggtgagtagctccacagacggtactatgaagatctggcaggcaagtaatggagagcttagaagggtcctggagggccatgtgtttgatgtgaattgttgccggtttttccctagtgggttggtcgtgctgagcgggggaatggatgctcagttaaagatctggtcagcagaggatgcttcctgcgtggtgactttcaagggccacaagggcggtatacttgacactgccattgtggaccgcggacggaatgttgtaagtgcatccagagatggtactgctagactgtgggactgcggacgaagcgcatgcctgggcgtcctggctgactgcggctcgtccataaacggggttgcggtgggcgcagccgataatagcatcaacctgggatctcccgagcagatgccttctgagcgcgaagtggggaccgaagccaagatgttgctgttagctcgcgaggacaagaagctccagtag

SEQ ID NO: 58614 - DNA, 1128 bp, Artificial Sequence
  Description of Artificial Sequence: Synthetic coding sequence
atgttggtgccctgcttcctttattctctgcagaatcgaaagccgtcactctacggaagccttacatgccagggcataggtctcgatgggatccctgaagtcacagcaagcgagggattcacagtgaatgaaattaacaagaaaagtattcacatctcctgtccaaaggaaaatgcttcttccaagtttctggcaccatacaccactttttccagaattcacactaagtccattacgtgcctggatatcagctccagagggggtctgggcgtgagctctagtacggatgggactatgaagatttggcaggcatcaaatggagagctgaggagggtcttggagggccacgtatttgacgtcaattgttgccgcttctttccatcgggtttggtagtgttgagcgggggaatggatgcgcagcttaaaatatggtcagccgaagacgcttcctgtgttgtgacatttaaaggccataagggcggaatattggacactgccattgtcgatcggggtcggaacgtggtcagcgcaagccgggatggtaccgcaagactgtgggattgtggacggagtgcatgtcttggagtgctggccgattgcggctcttccataaacggtgtggccgtaggcgcagctgacaactccattaatctgggctctcccgaacagatgccaagcgaaagagaggtcggcaccgaggctaaaatgttgcttctggctcgcgaagacaagaagctgcagtgcctaggactgcagtctcggcagttggtttttctgtttatcggatccgatgccttcaattgctgtaccttcctgagtggctttctgctgctcgccggtacacaggacggcaatatctatcaactggacgtgcggagtccgagagccccagtccaggtgattcatagaagcggtgctcccgttctgagcctcttgtccgtgagagacggcttcatcgcttctcagggtgatggttcctgcttcatcgtacagcaagaccttgattacgtgaccgagttgaccggcgctgactgcgaccccgtctataaggttgcaacatgggagaaacagatatatacatgctgcagagatgggttggtgcgacggtaccagctcagcgacctctag

SEQ ID NO: 58615 - DNA, 1566 bp, Artificial Sequence
  Description of Artificial Sequence: Synthetic coding sequence
atgaagcaggagggatccgctaggagaagaggcgctgacaaggcgaaacccccacctgaggacgttgagatgaaagaagaggctgccactggcggaggatcaaccggtgaggccgacggcaagaccgctgcagcagccgcagagcactcccagagagaactagacaccgtgactctggaggacattaaggagcacgttaagcagctagagaaagccgtgtctggcaaggaaccccgattcgtcctgagagcactacggatgttgcccagcacatctaggcgtctcaatcactacgtcttgtataaagccgtacagggattcttcacctctaataatgccacccgcgacttcctgctgccatttctggaagagccaatggacaccgaggcggacctccagttcaggccacgtaccggcaaggctgcatctacaccattactacctgaagtcgaggcttacctgcaactgctagttgtgatcttcatgatgaacagcaaacggtacaaggaagctcagaagatctcagacgacctgatgcaaaaaatatctacccagaacaggagagcactggacctcgtggcagctaagtgctactattaccacgctagggtgtacgagtttctcgataaacttgacgttgtcaggtcctttttacacgcaagactgaggacggctacgctccgccacgacgccgacggtcaggccacactgctcaacttgttgctgcgcaattaccttcactactcgctctatgatcaggccgagaagctggtgtctaagagcgtgttccctgagcaagcaaacaataatgagtgggcacgatacctctattatacaggcagaatcaaggctattcagctcgaatactcagaggctcgtagaactatgactaatgcgctgcgaaaggcaccacagcataccgccgtgggatttaaacagaccgtgcataagttgctgatcgtggtagagctcctcctgggagagatcccagaccgcctgcagttccggcagccatcccttaaacggtcccttatgccctattttctgttaactcaggccgttcggacagggaacctcgctaagtttaatcaggttctggaccagttcggggagaaatttcaggcggatggcacttacacccttatcattaggcttcgccataacgtaattaagacaggggttcgcatgattagcctgtcatactctcgcatttccctggcggacattgcgcagaaactccagctggactcaccagaggacgctgagtttattgttgccaaggctatcagggatggcgttattgaagcatctattaatcatgaaaaaggatatgtccagagtaaggaaatgatcgatatttacagtacccgcgaacctcagcttgctttccaccaaaggatcagcttttgcctggacatccataacatgagcgtcaaggccatgcgatttccccctaaatcctacaataaggacttggagagcgcagaggagcgaagggagcgagagcagcaagatctggagttcgcaaaagagatggcagaagatgacgatgacagtttcccttag

SEQ ID NO: 58616 - DNA, 348 bp, Artificial Sequence
  Description of Artificial Sequence: Synthetic coding sequence
ctgacaagtccacggagttgttcctggatagccccaaaaatgcagtcctctctccttgctcaggccattagggacggcgtgatcgaagcttctattaatcatgaaaagggttatgtccagagtaaggagatgattgacatctattcaacccgtgaaccccagctggctttccaccagagaatatcattctgtttggacattcataacatgtcggtgaaggcgatgcggttccccccaaaatcgtataacaaagatctggaatcagccgaggaacgcagagaaagagaacaacaggacctcgagtttgctaaagaaatggcagaggacgatgatgacagcttcccttag

SEQ ID NO: 58617 - DNA, 1071 bp, Artificial Sequence
  Description of Artificial Sequence: Synthetic coding sequence
atggacacagaggctgatcttcagtttcgccctcgcacggggaaggccgcatctaccccgctgttgcctgaagtggaggcctatcttcagctgctcgttgttatttttatgatgaacagtaagaggtacaaggaggcccagaaaatctccgatgatctgatgcaaaagatctccactcagaatagacgggctcttgacttggtagccgctaagtgttactactaccacgccagggtttacgaatttctcgacaaactggacgttgtgaggtcgtttctacacgccagactgcgtaccgccactttgcgccacgatgctgatgggcaagccacactcctgaaccttctgctgaggaactacttgcactactccctctacgaccaagccgagaagttagtgagtaaaagtgtcttccccgagcaagctaacaacaatgaatgggcccgttatctctactacaccgggagaattaaggcgatacaactggaatatagcgaagcacgccgaacgatgacaaacgcactgagaaaggcacctcaacacaccgccgtcggtttcaaacagacagtgcataagttgctaattgttgtggagctacttctaggggagatccctgaccgtctccagtttcgacaaccctctttgaaacgaagcctcatgccttacttcctgctcacacaggccgttagaaccgggaatttggctaaattcaatcaggtgctggatcagtttggggagaagtttcaggccgatggcacctacacattgatcataaggctgcgtcacaacgtgatcaagactggcgtaaggatgatttctctatcatactctcgtatttctctcgctgacattgctcagaaactgcagttggacagccccgaggacgccgagtttatcgtggccaaagctatcagagatggggtaatcgaagcttctatcaaccacgagaagggatacgtgcagtctaaggaaatgattgatatctacagcaccagggaaccacagctcgcattccaccagcgtatctcattctgtctggatattcacaatatgagtgtcaagggatggtag

SEQ ID NO: 58618 - DNA, 369 bp, Artificial Sequence
  Description of Artificial Sequence: Synthetic coding sequence
atggaagacacacccctcgtcattagtaaacaaaagacagaagtagtgtgtggggtgcctacccaggtggtgtgtactgctttctcaagccatattttggtggtagttacgcagttcgggaagatgggtaccctcgtgagtctcgagccaagcagcgtcgcgagcgatgtcagtaaacctgtgctgaccaccaaggtcttactcgggcaagatgagccactcatccacgtgtttgccaaaaatctggtcgcctttgtgtcccaagaggccggtaatagggctgtgctgcttgcagtggccgtcaaggacaaatcgatggaaggattaaaggcactcagagaggtcattcgggtctgccaggtgtggtag

SEQ ID NO: 58619 - DNA, 369 bp, Artificial Sequence
  Description of Artificial Sequence: Synthetic coding sequence
atggaagacacaccactagttatctctaaacagaaaacggaggtagtctgcggagttcccacacaggtcgtttgcacagccttttcaagtcacatcctcgtggtggttacccaatttggaaagatgggaaccctggtgtcactggaaccaagctccgtagctagtgacgttagtaagccagtgctcaccaccaaggtgctgttaggccaggatgagcctctgatccatgtctttgctaaaaatctggtagccttcgtcagtcaggaggccggtaatcgggcagtgttgttggcagtggctgtgaaagataagagcatggaggggttgaaagctctgcgcgaagtgatcagagtgtgccaggtgtggtag

SEQ ID NO: 58620 - DNA, 369 bp, Artificial Sequence
  Description of Artificial Sequence: Synthetic coding sequence
atggaagatacccctctggtcatttctaaacagaagactgaggtggtgtgtggggttcccacccaagtcgtctgtaccgccttctcttcccacatcttggtggttgtgacacagttcggtaagatgggcaccctcgtgtctcttgaaccatccagcgtggctagtgatgtcagtaagcctgtgctgactacaaaagtcttactcggtcaggatgagcctttgattcacgtgttcgctaaaaacctggttgcctttgtgagccaggaggccggaaaccgcgctgtgctcctagccgtagccgtcaaggacaagtcaatggaagggctcaaggccctgcgggaggttattagagtctgtcaggtttggtag

SEQ ID NO: 58621 - DNA, 489 bp, Artificial Sequence
  Description of Artificial Sequence: Synthetic coding sequence
atggaagggcttgtggtggcagccggaggcgatgtttccctgcacaacttttcagcacggctatgggaacaacttgtgcactttcacgtgatgcggctgaccgactctttatttttgtgggttggcgcaactccacatcttcggaacctggccgttgcgatgtgcagccgttacgactctattcctgtatcaaccagtttgttgggagacacctccgacactaccagcacgggtcttgctcaacgtctgggtctcggcggtaagactggtcttgcgtgtgaatgcggcgtagaatggggcctgagcaagggacacgaagccgagtgtagcacattgccgacaccacagcacacgagctgcggcccagcacgaaagacgaacaaacaggtgttcgtcagttacaatctccagaacactgactctaatttcgctttactggtcgagaatcggatcaaggaggaaatggaggcatttcctgaaaaattctag

SEQ ID NO: 58622 - DNA, 372 bp, Artificial Sequence
  Description of Artificial Sequence: Synthetic coding sequence
atggaaggtctcgtggtggctgcagggggtgacgttagtttgcataatttctccgcgaggctctgggaacagctggttcactttcacgtgatgcgattgacagactctctgtttctctgggtcggagcaacgccacacctccgaaacctcgcagtcgctatgtgttctagatacgattcaatcccagtgtcaacctccttgcttggggataccagtgacactactagcacgggtttagcacagcgccttgcccgtaagactaacaaacaagtattcgttagctataaccttcagaataccgacagcaacttcgctttactagtggagaacagaattaaagaggagatggaggcctttccagagaagttttag

SEQ ID NO: 58623 - DNA, 315 bp, Artificial Sequence
  Description of Artificial Sequence: Synthetic coding sequence
atggaggggctggtcgtcgcagcaggcggtgatgtctccctgcataacttcagtgcgaggctgtgggaacagctggtgcactttcacgttatgagacttaccgatagccttttcctgtgggtgggggcaacgccacaccttagaaacctggccgtggccatgtgctcccgctacgactcgatccccgtgagcacatccctgctgggagacacgagtgacaccacctcaactggcctcgcgcagcggctgggaatgtatcctcaactagcactgcatggacaaccaggtggagcacactcccttatggagccttag

SEQ ID NO: 58624 - DNA, 639 bp, Artificial Sequence
  Description of Artificial Sequence: Synthetic coding sequence
atggcgtcaagatatgatcgggctatcaccgttttctcaccagacgggcatctctttcaggtcgagtacgcacaagaagctgtcaaaaagggctcgacagctgttggcatcagggggttgacggcggacgcccgagtggtgataaacagggcccgtgtggagtgtcaaagccacaagcttacagttgaggacccggtgacagtggaatacattacacgcttcatcgctaccttgaagcagaagtatacccaatcaaacggacggcgaccgttcggaatctcggccctgatcgtcggcttcgatgatgacggcatatccaggctgtaccagaccgatcccagcggtacttatcatgcctggaaggcaaacgctatcggcaggtctgcgaaaactgtgcgcgaatttctagagaaaaactacacagaagacgccatcgcctcagattctgaggcaattaaactcgcaatcaaggccctgctggaggtggtccagtctgggggaaaaaatatcgagctggccatcatacgaaggaatcagccactgaagatgttctcagcgaaggaggtcgaactgtacgtgactgagattgaaaaggagaaagaggaggctgaaaaaaagaagagtaaaaaatccgtgtag

SEQ ID NO: 58625 - DNA, 753 bp, Artificial Sequence
  Description of Artificial Sequence: Synthetic coding sequence
atggcgtctcggtacgaccgggcaataacagtgttttcacctgacggccatctgttccaagtcgagtacgcccaggaagcagtcaagaaaggctcaacagcagtaggaatccgaggcaccaatattgtggttttgggagtcgagaagaaatcagtggccaaacttcaggacgagagaactgtgcggaaaatttgcgctctggacgatcacgtttgcatggcctttgccggattaacagcagacgccagagtggtgatcaatagggcacgggtcgagtgccaaagtcataagctgactgtggaggaccctgttacagtcgaatacattaccaggttcatcgccacccttaagcaaaaatacacgcagtcaaatggtaggagaccgttcggcatttctgcactgatcgtgggttttgatgacgatggcatctcaagactctaccagacagatccatcaggtacctaccacgcctggaaagcaaatgccatcggacggagtgccaagactgtgcgggagtttctggaaaagaactacactgaggacgcgatcgcaagcgatagcgaggcaatcaaactggcaataaaggccctgttggaagtggttcagtcaggtggcaaaaacatcgaactggccataattagaaggaatcaacccctgaagatgtttagcgccaaagaagtggaactgtatgtgacagaaatagaaaaggaaaaagaggaggccgagaaaaaaaagagtaagaaaagtgtgtag

SEQ ID NO: 58626 - DNA, 639 bp, Artificial Sequence
  Description of Artificial Sequence: Synthetic coding sequence
atggcatcaagatatgacagggccatcacagtattcagccctgacggccaccttttccaggtcgaatatgcacaagaagccgtgaagaagggatccaccgcagttattttcattggactgaccgctgatgccagggtggtgatcaaccgggctcgggtcgaatgtcagagccacaaactcacagtggaggatcccgttaccgttgagtatataacccggtttatcgccaccctgaagcaaaagtatacccagagtaatggaaggcgcccattcggcatctctgccctaatcgtcggcttcgatgacgacggaatctcccgcctctatcagacagaccctagcggaacgtaccatgcatggaaggcaaatgccatagggcgttccgctaagactgttagggagttcctggagaagaattacacagaggatgccatcgcaagtgacagcgaggctatcaagctagccataaaggccttgctcgaagtggttcagtcgggaggtaaaaacatcgagttagcaatcatcaggcggaatcagcctctgaaaatgttctctgccaaagaagtagaactttatgtgacagaaattgaaaaggagaaagaggaggcagaaaaaaaaaaaagcaagaagtccgtatag

SEQ ID NO: 58627 - DNA, 636 bp, Artificial Sequence
  Description of Artificial Sequence: Synthetic coding sequence
atggatgtctgcacatttgagaaggtcggcatcaggggtaccaacatagttgttctgggagtggagaaaaagtccgtggctaagctgcaggacgagagaacggttcgcaagatctgtgcactcgacgatcacgtgtgcatggcttttgcaggccttacagcggatgccagagtggtaattaatagggctcgggtcgaatgtcaatctcacaagctgacagtcgaagatcccgttaccgtggaatatatcactcggttcattgccactctgaaacagaagtatacgcagtccaacggtaggcggccttttggaataagtgcgctgattgtgggatttgatgacgatggaatctctcgcctgtaccagaccgatcccagtggaacctaccatgcatggaaagctaatgccatcggacggagtgccaagacagtccgcgagttcctggagaagaattatacagaagatgcgatcgcaagcgattctgaggctatcaagcttgccattaaggcattgctggaggtcgtgcagtccggtggcaaaaacatcgagctggccattattcggagaaatcaacctctgaagatgttttctgcaaaggaagtggaactgtatgtgactgaaatagagaaggagtag

SEQ ID NO: 58628 - DNA, 1632 bp, Artificial Sequence
  Description of Artificial Sequence: Synthetic coding sequence
atgaactgcctcgaaggccctggaaaaacctgtgggcctctggcaagtgaagaagagctcgtgtcagcgtgccagttagagaaggaggaggagaacgagggtgaagaagaagaagaggaggaggacgaggaggacctagatccagaccttgatcccgatctggaggaagaggagaacgacctcggcgatcccgctgtcctgggagcagtgcacaatacacagagagccttgctctcgagccccggagttaaagcacccggtatgcttgggatgagcctggccagcctccattttctgtggcagacactcgattacctttctcccattcccttctggcccacctttcctagcacctcctccccagctcagcactttggccctcgcctgcctagtcccgaccccacattgttctgcagtctccttacgtcgtggcctcccagattctctcacctgactcaactgcacccgcgacatcagaggatccttcagcagcagcagcacagccagacgcccagtccacccgcaaaaaaaccatggagccagcagcctgacccatatgccaacttgatgactaggaaggaaaaagactgggtgatcaaggttcaaatggttcagctccagagtgctaagccacgactggacgattattactaccaggagtactaccagaagctggaaaaaaaacaggccgacgaggagctcttaggccgtcgaaacagagtagaaagccttaagttagtgaccccctacattccaaaagctgaagcctacgagagtgtggtgagaattgaaggttccctggggcaggtcgccgtcagcacctgctttagtccacggagagctatcgacgcagtgccacacggcacccaggaacaagacattgaggccgctagttctcagcgacttcgagtcctttatcggattgagaaaatgtttttgcaattactcgagatagaagagggttggaaatatagacctcctcctccttgtttcagcgagcagcagtcgaatcaggtggaaaagctgttccagacactcaagactcaggaacaaaacaatcttgaggaggctgccgatggtttcttacaggtactgtctgtgagaaaggggaaagcactcgttgcaaggctgctgcctttcctcccccaagatcaggctgtcacaattttgttggccatcacacatcatttacctctgctcgtgagacgagatgtggccgaccaggctctacagatgctgtttaagcccctgggtaagtgcataagccatctcacccttcacgagcttctgcagggcctgcaagggctcaccctgctcccaccaggctcaagcgaacgccctgtgaccgtggtcctccaaaatcagtttggcatctcgctgctgtacgctctactctcacacggagaacagctggtttccctccattcttcactggaagaaccgaattcggatcataccgcctggaccgatatggtagtgctaatcgcttgggaaatcgctcagatgcccactgcgagcttggcagaacctctggcatttccttccaatttgctgccgttgttctgtcaccatgtcgacaagcagttggttcagcagttggaagccagaatggagttcgcttggatatattag

SEQ ID NO: 58629 - DNA, 1632 bp, Artificial Sequence
  Description of Artificial Sequence: Synthetic coding sequence
atgaactgtctggagggcccagggaagacctgcggacccctggcttcggaagaagaactggtgtccgcgtgccaactcgaaaaagaggaggagaatgaaggtgaggaggaggaggaagaggaagatgaggaggacctcgatccggatcttgacccagatctggaggaagaagagaacgacctcggtgatccagcagttttaggcgcagttcacaatacacagcgcgcattgctctctagtccaggtgttaaagctcctggaatgctgggcatgtctctagccagcctgcatttcctgtggcagacacttgactacctgtccccaattccattttggcccacgtttccctctactagcagcccagcacagcacttcgggcctcggttaccttcacctgatccgactctgttttgcagcctgctcacatcgtggccaccccgattttcccatctgactcagctccaccctagacatcagaggatcctccagcaacagcagcactcccaaacgccctcacctcccgcaaaaaaaccctggtctcagcagccagatccctatgctaacctgatgacccgcaaagagaaagattgggtgataaaagtccagatggtgcagctgcaaagtgctaagcctcgccttgatgactactactatcaggagtactaccagaagctggaaaagaagcaggcagacgaggagttgcttgggaggcgcaacagggtggagagcctgaagctagtaactccctatatacctaaggccgaagcttacgaaagcgtagtcaggatcgaggggtccctgggtcaagtcgcagtatcaacctgtttctctccaaggagagctatagatgccgtgccccacggcacgcaggaacaagacatagaagcggcttcttcacagcgcttgagggttctatatcgtatagagaaaatgtttctccaactcctcgagatagaggaggggtggaaataccggcctccccctccttgcttttccgaacagcagagcaaccaggttgagaagctctttcagacactcaagacgcaggagcagaacaacctggaggaggctgcggatggctttctccaggtgctgtcagtgcggaaaggaaaagcactggttgcaagactcttgccatttctgccacaggatcaagcagtaaccattctcctagcgattacacaccatctgccgcttctggtgaggcgagatgtggcggatcaggcccttcagatgctgttcaaaccattgggtaagtgtattagccatctcaccctccacgagctcctgcaaggcctgcaggggctaacactcctccccccaggctctagtgagagacccgtcactgtggtcctgcagaatcaattcgggatcagcctgctgtatgccctgttatcccatggagaacagttggtgagcctgcattcgtcactggaagagccgaacagcgaccacaccgcttggaccgacatggtagtacttatcgcctgggaaatcgcccagatgccaactgcttcacttgcagagcctctggccttcccttccaatctgttaccgttgttttgccaccacgtcgacaaacagctggtacagcagctagaggctaggatggagttcgcctggatatattag

SEQ ID NO: 58630 - DNA, 6707 bp, Artificial Sequence
  Description of Artificial Sequence: Synthetic coding sequence
atgcctctgttcttctccgccctcctcgtgttacttctggtggccctctccgcacttttcttaggccgatggcttgtggtgagactggccaccaaatggtgtcagcgcaagttacaggcagagctgaagataggctcctttagattcttttggatccaaaatgtgagcctgaagttccagcagcatcagcagacagtggaaatcgataacctttggataagctctaagctactaagccacgacttgccacactacgtcgccctctgcttcggcgaggtgcggataaggacggatcttcaaaaagtctcagacctgtctgcaccctttagccagtctgccggagttgatcaaaaagagctgagtttttcacctagcctcctcaaaatattctgccagttattttcaatccatgtagatgctatcaacataatggtcctgaaagtcgacacaagtgaatctctttggcacattcagattagccggtccagatttctgctggattccgatgggaaaagactcatctgcgaggtttctctgtgtaaaatcaattcaaaggtgttgaagtccggccagctggaggacacttgtctagtggaactgagcctggcactcgatctttgcctgaaggttggcatttcttcccgccacctgaccgccattaccgtggatgtgtggacactgcacgctgagctgcacgaggggcttttccagagccaactgctctgtcaaggtccctcactggcctctaaacctgtcccctgtagcgaggtgacagagaaccttgtcgagcccaccctgccgggactttttctgctccagcagctcccagaccaggtcaaggtgaagatggagaacacctctgtggtgctgtctatgaattcacagaaaaggcatctgacctggactctcaaactgctgcaattcctgtaccatcgagatgaagaccaactgccactccgttcctttactgcaaacagcgacatggctcaaatgtctacagagctcttactcgaagacgggctactgctgagccagagcaggcagcggatcgtgtgcctcaacagtctgaaagcctccgttcaggtgacgaccattgatctgtctgcctccctggtcttaaatacctgtattatccactacagacaccaggagtttagccattggttgcacctactagcactggagacccaaggatcttcaagcccagtgctgaaacagcgaaaaaaacggaccttcccccagatcttagcacctattatcttcagtacatctattagcaacgttaacattagcatccagctaggtgacaccccaccttttgccctgggctttaatagcatctcactggactaccagcaccttagaccgcagtctatccaccagcggggagtgctaaccgtggaccacctttgttggcgcgtaggatctgatagccatatccaacgtgcccctcacccacccaatatgcacgtgtggggagaggccttggtgcttgatagctttaccctgcaggggagctacaaccaaccattgggcctgtccagtacgcagtctgacaccctgtttctcgattgtacaattcggggactccaagttgaagcttctgatacgtgcgcccagtgtctcagtagaatcctatcacttatgggccctcaaagtgggaaaagtgccgtgagtcgtcactcttcatttggcgagtccgtctccctcctctggaaggtggacctgaaggttgaggacatgaacctgttcaccctgagcgccctagtgggagccagcgaagtccgtttggatactcttaccatcctgggtagtgccgagacatctaccgtgggcattcaaggactcgtcctggctctggtgaagtcagtcaccgaaaagatgcagccctgctgtaaggccccagatattcctaccccagtgctcagtctgagtatgctatccatcacctatcactcatccatacgcagcttggaggtccaatgcggagcgggtctgaccctgttatggagtccacccgatcacatgtacttatatcaacacgtgctggccacgttgcaatgccgggatttgctgcgggcaacagtttttcctgaaactgtgcctagcctagccttggaaacctccggcacgacatcagaattagagggacgggcacctgaacctctaccccctaagaggttgctcaatcttaccctagaggtctccaccgccaaactgacagcttttgtggccgaggacaagtttattacactggccgcagagagcgtttccctgtcaaggcatggtggaagtcttcaggcttattgtccggaactggcggctgggtttgacgggaattccatcttcaatttcaaagaagttgaggtgcaattattgcctgagctggaggagatgatcctgcatcgtaatcccttccctgcactgcagactcttcgcaatcgcgtgtggttgctctcatttggctccgtgtccgtggagttcccctatcagtacgacttcagccgtactctcgatgaggcagttggggtgcagaaatggctcaaaggcttgcaccagggcaccagagcctgggcatctccttcccccgtgcctctgcctccggacctgttgttgaaggtggagcacttctcatgggtgtttttggatgacgtgttcgaggtgaagctgcatgacaactatgaattaatgaaggatgagtccaaagaaagcgctaaaagactacagctgttggacgcaaaagtcgctgccctgaggaagcaacacggggagctccttcccgcacgcaagatcgaggagctgtatgcttctctcgaaaggaagaacattgagatttatattcagcgaagccggaggctgtacgggaacactccgatgcggagagcgctgctcacttggtccctggccggtctggagctcgtggctctcgccgacgcatcattccatggcccagaacacgtagtggaacaagttcaggagctagaccccggatctcccttccctcctgaaggactggatctggtgatccagtggtgtcgaatgttgaaatgcaatgtgaagtcctttctcgttcgcattcgcgattatccacggtacctgtttgaaatccgggattggaggctgatggggagactcgttggcacggagcaaagtgggcagccttgttcaaggcggcgtcagatactccaccttggattaccatggggcaacgtagctgtggagaggaacatgccgcctcttaaattctaccatgacttccattcagaaatctttcagtacacagtcgtgtggggaccctgctgggacccagcatggaccctgattggccagtgtgtggacttactcaccaaaccttcagccgacccctccccccctctgccatggtgggataaaagtcgcctgctctttcacggtgattggcatatggacattgagcaagccaacctccaccaactcgctaccgaagacccctacaataccaccgagaacatgcattgggaatggtctcatctgtcatttcactggaagccagggcagtttgtgttcaagggtgatctggatattaacgtgcgcacagcaagcaagtacgacgactgttgctttctccacttgccggacctctgtatgacactcgatctccagtggctgtgccatggtaatcctcacgaccaccattctgtgacccttagagccccagagttcctccctgaggtccccttaggccaactgcatgacagctatcgtgcttttcgctcggagaatctcaacctgtctataaaaatggacctcacaaggcacagtggcactatttcccaacctagaatattactgtattcgtcgaccttacgatggatgcagaatttctgggcaacctggacatcagtgacaagacctatctgccggggtaagctctttaataacttgaagccttctaagaagaaactgggtcagcattataaacaattatcctacactgcactgtttccccagctgcaggtacactactgggccagttttgcccagcagaggggcatccagattgaatgttcacaaggacatgtgttcacccgtggaactcaaaggcttataccacaggccggaaccgttatgcggcgactgattagcgactggtcagtgactcaaatggtgagcgacctgtctcaggtaaccgttcatctgatggctagcccaaccgaagagaatgccgaccattgtctggatcccttagtgacaaagacgcatctgcttagtttgtcttctttgacctatcagagacattcaaataggacagccgaagaggaactttccgcgagggatggtgatccgacctttcacacccaccagttgcatctggtcgatctccggatctcctggacaacaacaaacagggatatcgcgttcggcctgtacgatggctacaagaaagcagctgtactgaagaggaacctctcaaccgaggccctcaagggactgaaaattgatccccagatgcccgctaagaagccaaaacgcggtgtgcccacgagcgcctccgcccctcctagggttaacactccaagcttcagcggccagcctgacaaagggtctagcgggggagcttacatgctgcagaagctgatcgaagagacagatagatttgtcgttttcaccgaagaagagagtggtatgtctgaccagttgtgcggcattgccgcttgtcagactgacgatatatataataggaattgcctgatcgagctggtcaactgccaaatggtactccgaggggcagagacggagggatgcgtcattgttagcgccgcaaaagcacaacttctgcagtgccagcaccacccagcctggtacggggataccctgaaacaaaagacctcctggacatgtctcctcgacggaatgcagtactttgccaccacagaatcatccccgacagagcaggatgggcgacagctgtggctagaggtcaagaatattgaggaacacagacagcgtagcctggatagtgtgcaggaactgatggaaagtggtcaagcagtcggaggaatggttacgaccacaacagattggaatcagcctgcagaggcacagcaggctcagcaggttcagagaatcatctcacggtgcaactgtaggatgtattacatcagctattctcatgacattgacccagaactggcaacccagataaagccaccggaggtgctagaaaatcaggagaaagaggacctgctaaaaaaacaggagggagccgttgatacctttacgcttatccatcacgaattagaaatatcaaccaatcctgcacaatacgccatgatcctggatatcgtcaataatcttctgttgcacgtcgagcccaaaaggaaagaacactccgagaaaaagcagagagtgcggtttcagcttgaaattagctccaatcccgaggagcagcggtccagcattctgcacttgcaggaagctgtgaggcaacacgtcgcccagatccgacagttggagaagcagatgtattcgattatgaaaagtctccaggatgattctaagaatgagaacctgcttgatttaaatcagaaactacagttgcagctgaaccaggagaaggccaatttacagctggagtccgaagagctcaatatcctcattaggtgttttaaggacttccagctgcagcgggctaacaaaatggagttacgaaaacagcaggaggatgtgagtgtcgtcaggcgaaccgagttctatttcgcccaggctcgttggcgcctaacggaggaagatggccagttaggcattgccgaactagaactgcagaggtttctttattctaaagtgaacaagtctgacgacacagcagagcacttactcgaattggggtggtttacaatgaacaaccttctgcccaacgccgtttataaggtggtgctccggcctcagtcttcgtgtcagtcgggccgacagttggccttgaggctgttctccaaagtgaggccccctgtcggaggtattagcgtcaaggagcactttgaggttaatgttgttcccctgacaattcagctgacacaccagttttttcacaggatgatgggtttcttcttccctgggaggtcagtggaggacgatgaggtgggggacgaagaagacaaaagcaagctggttacgactggaattcccgtggtcaaaccacggcaactgatcgcgactgacgatgccgtaccacttggtccgggtaagggggtggcccaggggcttactcgttcttctggtgttaggcgcagcttccgtaagtcacccgaacatccggtggacgatatcgacaagatgaaggagcgtgccgctatgaacaattctttcatctacattaagattccacaagtgcccctctgtgtgagctataagggagaaaagaactccgtggactggggggatctgaacctggttttaccctgtctggagtatcacaataacacttggacctggctggatttcgccatggccgtaaaaagggacagcagaaaagcgctggttgcacaagtgatcaaagaaaaactgcggttgaagtctgcaacaggatccgaagttaggggcaagctggagacaaaatcagatctgaacatgcagcagcaggaggaggaggagaaggcccgtctgctgattggtttgtccgtgggcgataaaaacccaggaaagaaatccatttttgggagacggaaata

SEQ ID NO: 58631 - DNA, 417 bp, Artificial Sequence
  Description of Artificial Sequence: Synthetic coding sequence
atggaagcgtgggagtcctcacaacccctgctgaggtgcgaaatcccttgtcccctccccggaaccgacagagatggttcagtatccctgcccggagaggcagcctcctgcgacctggacacactagaacctgagcacgggaaccgaagagtatccgggaaccctatctcggtatgttgggcgtataaggttaccaaggtaaaatgctggtcagtccgggagcgcggtggtcgtcacatcggtggcccaagaaacacattgaagcacccagcccaccatgggatgggtaaaaatctggctaccagcctccctaccgcggcatctctggggttagggaaaggccaattgctcgtatccataagatttatggacacaactaagaagagggggcaaagcgagacatttaacatctgctag

SEQ ID NO: 58632 - DNA, 1203 bp, Artificial Sequence
  Description of Artificial Sequence: Synthetic coding sequence
atgggtgtcctgatgagcaagcgccagacggtggagcaggtgcagaaggtgagccttgccgtgtccgctttcaaagacggactcagagatcggccttcgatccggaggaccggggaactccctggtagcaggcgagggaccgtagaaggcagtgttcaggaagttcaggaagaaaaagaagcagaagcaggtacatccgtggttcaagaggagagctctgcaggcagggccgcatgggagcgcctgagagacgggagaggagtggaaccagaagaattcgataggacaagcaggtttactcctcccgctttcatccgccctacacgcaagctcgacgatgataagccccctgagatttgtctcgaacccagggagccagtggtcaacgacgaaatgtgtgatgtgtgcgaagtgtggacagcagagtctttgttcccttgccgtgtgtgtacccgtgtattccacgatggttgcctgcggagaatggggtacatacaaggcgactctgccgctgaggtgaccgaaatggcccacaccgagaccggctggtcatgccattattgtgacaacattaacctcttactgacagaagaggaaatgtattcccttactgagaccttccagagatgtaaagtgatcccagattgttcactgacacttgaggatttcctccggtacaggcatcaggcagcaaaacggggtgatcgggatcgagctctcagcgaggaacaggaggagcaggccgcaaggcagtttgcagcgctcgaccccgaacatagaggacacatcgaatggcccgattttctttcccacgagtctcttctcttgctgcagcagctgagaccacaaaatagtctgctgaggcttctcacggttaaggaacgcgaaagagctcgggctgcctttttagcaaggggttcgggctctacggtgagcgaggccgaatgccgccgagcccaacattcctggttttgcaagcggttccctgaggctccaagctgttctgtgagcatttctcatgtaggcccaatagcagactctagccctgccagtagtagcagtaagagtcaggacaagacccttttgcctacggaacaggaatctaggttcgtggattggcccacgtttctccaggaaaatgtgctgtacatcttagcagcgagaccgaatagtgccgctatccatttgaagccacctggttag

SEQ ID NO: 58633 - DNA, 1230 bp, Artificial Sequence
  Description of Artificial Sequence: Synthetic coding sequence
atgggctcacaggcggcagctgagtggagaaattgggctagctgggaagtgtcctcttctctctccggttgcagcatgggctgctttaaggacgaccgtatcgtgttttggacttggatgttctcaacgtactttatggaaaaatgggcaccacggcaggatgacatgcttttttacgttcgcaggaaactggcctatagcggcagtgagtcaggagcagacgggagaaaggctgcggagcccgaagtcgaggtggaagtatacagaagggactcaaagaagctgccaggcctgggggaccccgacatcgattgggaagagtccgtgtgtctcaacctcattctgcagaagctggactatatggtaacatgcgcagtgtgcactcgggcagacggtggcgatatccacattcacaagaagaaatcacagcaggtgtttgctagcccctcaaagcaccctatggattcaaaaggagaggagtctaaaatatcttacccaaatatttttttcatgatcgatagcttcgaagaagtgttcagtgacatgacagtgggggaaggcgagatggtttgtgtggagctcgttgcatcagacaagaccaatacatttcagggagtaatttttcagggctcaatccggtatgaagcgctgaaaaaagtgtacgataaccgggttagcgtggccgcaagaatggcccagaagatgtcttttggattttacaagtactcaaacatggagtttgtacggatgaaggggcctcaagggaagggccatgctgagatggccgtcagtcgcgtaagtactggggacactagtccttgcggtactgaagaagactcatcaccggcttcccccatgcatgagagagtgacctctttcagcacacctcctacccccgaaaggaacaaccgcccagctttcttctcaccatctttaaaacgcaaggtgcccaggaatcggatagcagagatgaagaagagccacagcgcaaacgatagtgaagagttcttcagggaagacgacgggggagccgatcttcataacgctacaaatctgcgttcccgtagcctttctggtaccggtcgttctctggtggggagctggctcaaacttaaccgggctgatgggaacttcctcctttatgcacatctgacctacgtcacactgccactgcacagaatcctcacagacatcctcgaggtgcgacagaagccaattctcatgacatag

SEQ ID NO: 58634 - DNA, 333 bp, Artificial Sequence
  Description of Artificial Sequence: Synthetic coding sequence
ggcgctcggagccccggtagcacgcatcagggcagcctggcctctggagtcctgcctattaaatgttctcatgtggaatttggcatgtggaaagggggtagatcacaccccttcctaccccactccagtcgctgtgcaggatcaggaggccaacttgactccattcttccccaccagtcgcctgcctggggaccctgggggtgtaaggatctgagttccggcttcccaagctttcttacatcttctatcttgtggaagagtgcggtcgttcgggagccccacataagtccgcaccaagctccaccatacaaaacaagtgactgcatcatgtag

SEQ ID NO: 58635 - DNA, 3753 bp, Artificial Sequence
  Description of Artificial Sequence: Synthetic coding sequence
atggccgctatggcacccggagggagcggttcaggtggcggtgtgaatcctttcctgtctgacagtgatgaagatgacgatgaggtagccgcaactgaagaaaggcgcgcagtgctcagactcggagccggtagtggacttgacccagggagcgctggctcgttgtcaccacaagaccccgtggccctcggctcatctgccaggcctgggctgcctggcgaggcttccgcagcagccgtagcactcggagggactggcgagactccggcacgcctgtccatcgacgccatcgctgcccaattgctgcgcgaccagtaccttcttacagctttagaacttcacactgaactattggaatccggccgtgagctccctaggctacgcgattacttctcaaacccaggcaattttgagagacagagtgggacaccacctgggatgggcgcacccggtgtgcccggtgcagccggagttggcggagctgggggacgagagcccagtactgcctcaggagggggacagctcaatagagcaggaagtatttcaacacttgattctcttgacttcgccaggtattctgatgatggtaatcgagagaccgatgaaaaagtcgccgtccttgaattcgagcttaggaaggctaaagaaacgattcaggccttacgagctaatcttaccaaagcggcagagcatgaggtgccacttcaggaaaggaaaaattataagagcagtcctgaaattcaggagcctatcaagcccctggagaagcgggcactgaacttcttagtcaacgaattccttttgaaaaacaactacaagctgacgagtattactttcagcgatgagaacgatgaccaggacttcgagctatgggacgacgtcggacttaacatcccaaagcccccagatctgcttcaattatacagagactttggcaaccaccaggtgaccggcaaggaccttgtggatgtggcatccggggtcgaggaggatgaacttgaagcgttgacacccattatcagtaacctccccccaactctggagaccccacagccagccgaaaacagtatgctggtacagaagctggaagacaagatcagcttattgaacagcgagaagtggagtctgatggagcagatccgcaggctcaaatccgagatggactttttaaaaaatgaacacttcgccattccagctgtttgcgattctgttcaacccccattagatcagctgccacataaggactcagaggatagtggacaacaccctgacgtcaacagttctgacaaggggaaaaatactgatatccatctgagcatctcagacgaagcggacagcactattcccaaggagaatagccccaattcttttcctcggagagagcgagaaggcatgcctcccagcagtctgagttccaagaaaaccgtgcattttgataaaccgaaccgaaaactttcgcctgctttccaccaggcactgctgagcttttgtaggatgtccgcagacagtcggttaggatatgaggtatcccgcatcgcagacagcgaaaagtcggtcatgttgatgctcggaagatgcctcccacacatcgtccccaacgtactccttgcaaagagggaagagttgatcccactgatactgtgtaccgcatgcctacatccagagccaaaagaacgcgatcaactgctgcatatcttgtttaacctgatcaaacgtcccgatgatgaacagcgccaaatgatcctcaccgggtgtgtggccttcgctagacacgtggggcctacccgcgtggaggccgaacttcttccccaatgctgggaacaaattaaccacaaataccctgaaaggagactgctggtggcggagtcctgtggcgctttggccccttacctacctaaagaaattagatcctccttggtgctgagtatgttgcaacagatgctcatggaggataaggccgaccttgtgagggaggcagttatcaagtccctcggtatcatcatgggatacatagacgatccggataagtaccatcagggttttgaactgctgttgtcagcattaggggaccccagtgaaagagttgtgtccgccacacatcaggtgttcctaccggcttacgcggcatggaccaccgaattaggtaacttacagagccatctcatccttacactactgaataagatcgagaaactgcttcgagagggcgagcatgggttggatgagcacaagttgcatatgtacctaagcgctctacagtcactgattccatcgctgttcgctctagtgctgcaaaacgctcctttttcatcaaaggccaaactccatggggaggtccctcagatcgaagttacacgctttcccaggcctatgtctccgttgcaagatgtgtctacaatcatcgggagccgcgaacagctggccgtgctgctccagctgtacgattatcagctcgagcaggaaggtacaacaggttgggaatccctgctgtgggtggtgaaccagttactcccacagcttattgagatcgtgggcaagattaatgtgacttcaactgcttgcgttcatgaattctctaggttcttctggcgtctgtgtagaactttcggcaaaatcttcaccaacaccaaggtgaagccacagtttcaggagatacttagactttcagaggaaaatattgattctagcgccggtaatggggtcctgactaaagctacagtgcccatttatgccacgggtgttcttacctgttacatccagatcaaggagtacttacatatacacaatgagatcagttgggaatgggatccatctctcaataccaaatgtgtgtcttatactcactacacccactcccttaaggaagaagatcggaagctgttggtgggttttctcgaggacgtgatgacacttctctctctgagccatgcccctcttgatagcctaaaagcaagtttcgtggagctgggagctaacccagcctaccatgaattactactcactgtactctggtacggagttgtgcacacctcagcgctagtgagatgcaccgcggctcgcatgtttgagcttctggttaagggagtcaacgagactctcgtggcacagcgcgtggtgcctgcgctgattacccttagcagcgaccccgaaatatcggtacgtatcgccaccattcccgcatttgggacaatcatggagactgtgattcaacgggagctactagagagggtgaagatgcagttggcctcatttctggaggacccccaataccaggaccaacactcgctgcataccgaaataattaagacatttgggagggtgggaccaaatgcggaaccacgtttcagagacgaattcgtaattccacacctgcacaagctggcgctcgtcaataatctccagatagttgattctaaacgattggacatagccactcatctcttcgaggcttatagcgcccttagctgctgtttcatcagtgaggatctgatggttaaccatttcctccccggtctgcgatgcctcagaaccgacatggagcacttgtcacctgagcatgaagtaattctaagcagtatgataaaggagtgtgaacagaaggtggagaacaagaccgtgcaggaaccccagggttccatgtctatcgctgcctccttggtcagtgaggataccaagacaaaatttctaaataagatgggacagctgaccacgtctggggcaatgctcgccaatgtcttccagcgtaagaaatag

SEQ ID NO: 58636 - DNA, 6054 bp, Artificial Sequence
  Description of Artificial Sequence: Synthetic coding sequence
atgacttcacgcactaagaggaggcaaaaggttaagatctcaatttctaagattaatcactcgtcctacagaaaggaacaccgcccattctgggagcaccaaccacccccacatcagaattgggctgtggggggacgatgtggcgctggcgctcgccctggactctcacaacgaagagggagagaggtgagaagggaagcccaaggtggggcttcatcccgcaggctccgcgctcggctttattttagtgagagtacctctctaccactcgatcggagggggtctcctgggccattaggcccagcgccacacggccttcgcagagctgccccacggggtccagctaggcgcacccctcggagcacagcattgacttccagaagacgagctcagaggccaagacatggtgacagactgaggctgcgttctgaggcccgtccccgtgccgcaggggactggccttgtgctcggggaggcgctgtacggccaggtcggccacatcgtcccccacgcgttgaatccgcacgaggcgctcacgccggtcgtgccgcaacggaccagctggagagagtctttctccggcttggacacgccgagacggacgaacaactccagaacatcatttccaagtttcttcctcctgtgctgctgaagttatcgagtactcaagagggggtgcgaaaaaaggtgatggagctgttggtccacttaaacaaacgtattaagagtcggccaaagatccagctcccagttgaaacactcttagttcagtatcaggaccccgcagcagtttcctttgtgacaaatttcaccattatctatgtcaagatggggtatcctaggctgcctgttgaaaagcagtgtgagcttgccccaactttattgaccgccatggaaggcaagccccaacctcagcaggattctttaatgcatttgctgatccctactctgttccatatgaaatatcctgtagagtcttccaagtctgcttcgccattcaacctggcggagaaaccgaagaccgtgcagttgcttctggacttcatgctcgatgtcttgcttatgccttacggatacgttctcaatgagagtcaatcacggcaaaactccagtagtgcgcagggcagttcatccaacagtggtggaggaagcggcattcctcaacctcccccagggatgagtttctatgcagccaagcgcgtgatcggggacaacccctggactcccgagcaattagagcagtgcaagctgggtatcgtcaagttcattgaagcggagcaggtgccagagctggaggcagtattgcacctggtcattgcttcatcagacacccgccattcagtggccacggcggctgatctggagctaaagtccaagcagagtctgatcgattggaataaccccgctatcatcaacaaaatgtataaagtgtatctgggggacatacctctaaagaccaaagaaggcgctgtgcttaagcctgagcttaaaagagaccctgtttccacacgggtaaagctgaaaatagtacctcacctcctgcggagcagacaggctgccgaaactttccccgctaatatccaagtggtttatgacggcttattcggcactaacactaattctaagctgaggaccttgtcactacaatttgtgcatcacatttgtattacatgccctgagattaagattaagccgctgggtccaatgttgctcaacggcttaacgaagttgatcaatgaatataaggaagacccgaaactcctgtcaatggcctattctgctgtcggcaaactgtctagccgtatgccacacctgttcacaaaggacattgctcttgtgcagcagttgtttgaggcactttgtaaagaagagcccgaaacccgactcgccatccaggaagccctgagtatgatggtgggggcatactccacacttgagggggcacagagaaccctcatggaggctctcgtggctagctaccttatcaaacccgaggtgcaggttagacaagtcgccgtaaagtttgcgagcaccgtgttcccttccgaccacattcccagcaggtatcttctgctgcttgccgcaggcgatcctcgcgaggaggtacacggcgaggcccaaagggtgctccgatgtctccctggaaggaatcggaaagaatcaacctcagaacaaatgccctcatttcccgaaatggtttattatatccaagagaaggcaagtcatcggatgaagacgcctgttaagtacatgactggcacaaccgttctcccatttaaccccgctgctttcggcgagattgtgctatacttaaggatgtgtctggcacatagtgccggagtagtgcccacttcccagtcgctggcagatatgcaggatcacgccccagcaataggtagatacatcaggaccttaatgagctccggccagatggccccatcctcgagcaacaaatcaggagaaactaaccccgtgcagatctacataggcctgctgcagcaacttctcgccggagtgggaggattaccagtcatgtattgtctactagaggcagtgagcgtgtacccagaaaaactcgctaccaagttcgtggacaaaaccgaatggattaaatccctgatgaacaattcaaaggaggaaatgcgagagttggccgcacttttctacagcgtcgtggtctctactgtctccggcaatgaacttaagtctatgatcgagcagctcataaaaaccacaaaggataaccacagtcctgagatacagcatggctcactcctggcactgggattcacggtaggacggtatctggccaagaagaagatgcgcatgagcgaacagcaggacctggagaggaacgcggatacacttccggaccaggaagaactcatccaatcggccaccgaaacgatcgggtcatttttggactctacatctcccctgctggcgatcgccgcatgtaccgctttgggagagattggacgaaacggcccactgcctattccaagcgagggttctggattcactaaactgcatctggtggaatccttactgagtcgcatcccctcttccaaagagacgaataagatgaaggagcgcgcaatccagaccctggggtacttccccgtaggcgacggcgattttccccatcaaaaactgctacttcagggactgatggattccgttgaggcaaaacagattgaacttcagttcaccataggagaggcaatcacttccgcagcaatcggtaccagctcggttgccgctagggatgcctggcagatgactgaagaggagtatactccaccagccggtgcaaaagtcaacgatgtcgtgccttgggtgttagatgtcatactgaacaagcatataattagccccaacccccatgtgagacaagctgcttgcatctggctgctatcactcgtacggaagttgtcaactcacaaggaagtgaagtctcacttgaaggagattcagtccgctttcgtgtctgtgctctcagagaatgatgagcttagccaggatgttgcatcaaaggggctgggcctagtctacgagctgggaaacgagcaggaccagcaagaactggtgagtaccctggtggagactctgatgaccggaaagcgggtgaagcacgaagttagtggcgaaacggtagtcttccaagggggagcgctcgggaagacacctgatggccagggtcttagtacctataaggaactctgttcacttgcctccgacctatctcagccggacctcgtttataagttcatgaacctagccaaccaccacgcgatgtggaacagcaggaaaggagcagctttcgggttcaacgttatcgcaactcgcgctggcgaacaattagcacctttcctgccccagttagtgccgaggctgtaccgctaccagttcgacccaaatctgggcatcaggcaggccatgactagtatttggaacgccttagttacagacaaatctatggttgacaagtatttgaaagaaatcttgcaggatctcgtgaagaacctcacctccaacatgtggagagtgagagagagctcttgtctggccctgaatgaccttttgcgcggacgtcccctggacgacatcatcgacaagctcccggaaatttgggagaccctgttccgcgtgcaagacgatatcaaggagtccgttcggaaggcagctgagttggcactcaagacgctgagcaaagtgtgcgtgaaaatgtgtgaccccgctaaaggcgcagctggccagcggactatcgccgctcttctaccttgtttgctagacaaagggatgatgtccacagtcaccgaagtgcgggctctttctatcaataccctggtgaaaatctccaagagcgccggtgcgatgctaaagccacatgccccaaagctgatcccagcattgctcgagtcactaagcgtgcttgaaccgcaggtgttgaactacctgtccctgcgagccacggagcaggagaaggctgccatggattccgcacgactgagtgcagccaaaagttcccctatgatggagacaattaacatgtgcttacagtatctcgacgtgtctgttctcggggaattggttcccaggctttgcgaactgatcagaagcggagttggacttgggacaaaaggaggctgcgcttctgttattgtttcattgacgacacagtgcccacaggacctgacgccctacagtggaaaactgatgtcggcactgctctctgggttaactgaccgcaacagcgtcattcagaaatcctgtgctttcgccatgggacacctggttcggactagcagagactcttctacagaaaaactgctgcagaagttgaacggctggtacatggagaaggaggagccgatatataagacatcatgtgccttgaccatacacgctataggacgctacagtcctgatgtgctaaaaaatcacgccaaggaggtgttgcctcttgcattcctcggcatgcatgaaattgcggacgaagaaaaatcggaaaaggaggaatgcaatctgtggaccgaggtctggcaggaaaacgtgcctggatctttcggaggcatcagactatacctacaggagctgatcacaatcacacagaaggcgctgcagtcacagtcgtggaaaatgaaggctcagggcgctattgctatggcctcgattgcgaaacagacatcctcactggttcccccatatcttggcatgattctgacagccttgcttcagggtctcgccggtaggacctgggctgggaaggaagaattacttaaagccattgcctgtgtcgtcacagcttgtagtgcagagctggagaagagcgtgcctaaccaacccagtactaacgaaatactgcaggccgtgctaaaggaatgcagcaaagagaatgtaaaatacaaaatagtggccatctcttgtgcagcagacattctgaaggccaccaaggaggacagatttcaggagttttcaaacattgtcattccgctcatcaagaaaaattccctggaatccagcggagtgagaacaactaagaatgaggaggagaacgagaaggagaaggaactccagcttgagtatctgcttggggcttttgagagcctggggaaggcatggcccagaaacgcagaaacccagaggtgctaccgccaggagctctgcaagctgatgtgcgagcgccttaagcttagtacatggaaggtccagttgggagtcctgcagtccatgaacgctttctttcagggtctaatgcttctcgaggaggagcacgcggatccagaggcactggctgagattctgttggaaacatgcaagagcataacatattcgctcgagaataagacttactcctccgtgagaacagaggccttgagcgtcatcgaactgcttttgaaaaagctagaggagagtaagcagtgggaatgtttgacaagcgagtgccgggttttgttaatagagagtcttgccactatggaaccagatagtaggcctgagttgcaagagaaagcagccctgctgaagaagacgctcgagaatctcgagtaa

SEQ ID NO: 58637 - DNA, 4857 bp, Artificial Sequence
  Description of Artificial Sequence: Synthetic coding sequence
atggacggccaaaccctcagaaaagccgaacgctcctggtcttgttccagggagaagaaggagggatacgctaaggatatggtgaccgacttcgacgagaaacatgacgaatacctcatcctgctccagcagcgaaaccgcattcttaaacatctgaaatctaaggaccccgtacagttgcgactggagcacctggaacagggattcagcgtttacgttaacggtgccaactctgaattaaagagttctcctcgtaaggcaattcatagcgattttagccggtctgctagccataccgagggtacccacgactatgggagaagaaccctgtttagagaggcggaagaagctctccgtcgctcgagtagaacggctccctccaaggtgcagagacggggatggcaccaaaaatccgtgcaaattcgcacggaggccggtcctagactgcacattgagcctcccgtggactactctgacgacttcgaattgtgtggggacgtgactcttcaagccaacaacactagcgaagacaggccccaggaactccgacggtccctggagctctcagtcaatctccagcgtaagcagaaggattgttctagcgacgaatacgattctatagaggaggatatcttaagcgagcccgagcctgaggacccagcacttgtgggccatccacggcacgaccggccaccctcatcgggtgactggacccagaaggacgtgcatggtgagcaggaaacagagggaagaagcagccctggtcccgatactcttgttgtgctggagttcaatcccgcatctaagtcacataagcgcgagagaaacctgagtgcaaagcgtaaagataatgccgaagtgtttgttcccactaagccagaacccaatctgaccccacaggccccagcagtctttcctgatcaggagcggatgtgtagccggcctgggtcccgacgcgaaagaccgttgtctgcaacccgaaaaactctctgtgaagccgagtatcccgaagaggacgcttccgccgtgctgcaggctatccaggtcgaaaacgctgccctgcagcgcgcactgctgagcaggaaagccgagcagccagcaagccccttacaggatgccgaggggccaccagcgaagccatggacctcgctactcgaggagaaagaagagaccctcgaactgctgccaatcaccacagccactactacccaagagccagcgggagcagcaggtggggctagggcaattaatcaggccatggaccggatagggctgctgggttcgaggcaacaacagaaacttttaaaagttcttcaagccgtggaatctgacagcgcccacctgggcagagttgtgtctcccacaaaggagcaagtctctgacaccgaagacaagcagcggatgcgggctgacgagatcaaggatgctatatacgttaccatggagattttaagcaactggggcaattcttggtgggtcgggttaacagaggtcgagtttttcgacctgaacgacacgaagctgtatgtgtcccctcatgatgtggatattcgaaataccgctactccgggagagttgggccgtctcgtgaatcgcaaccttgcaggaaagaaagactctagtccctggacctgcccgtttcatccacccctgcagctcttcttcgtgattagaaatactcgacagctgggcgattttcacctagccaaaattaaagtgcgcaactactggactgccgacggagatctcgatatcggagccaagaacgtcaagttatacgtaaatcgaaatctaatctttaacgggaagctagataagggtgatcgcgaggctcctgccgatcactctattctggtcgaccaaaagaacgagaaatcagagcagctcgaggaggctatgaacgctcacagcgaggagagtaagggcacccatgaaatggcaggtgcctctggggacaaggagctcgggctgggctgttccccacctgcggagaccctggcggatgccaagctaagttcccagggtaacgtttccggtaaacggaaaaacagcacaaattgtcggaaggattctctaagtcagcttgaggagtacctgagactctctgccgtgcctacttcaatgggcgatatgccttcagccccagcaacctctccccctgtgaagtgcccacctgttcacgaggaaccatctctgatccaacagcttgagaatctgatggggcgaaaaatatgtgagccacctggaaagacccctagttggttgcaacccagtcccacaggtaaagatcgaaagcagggtggacggaaaccaaagcctttgtggctgagcccagagaaaccactggcctggaaaggccgtttaccatctgatgacgttatcggggaggggccaggggagacagaagcacgtgataagggtttgcggcatgagcctggttggggcacaagcagaagtgtgaatacaaaggagcgccctcagagggcaacgaccaaggtccactctgacgattccgatatatttaaccagccccctaaccgagaaaggcccgctagcggtcggagaggatcccgcaaagatgccggatcctcctcacatggggatgaccaaccagcgtccagagaggatacctggtcctcaagaacaccatcaaggagtcgatggagatccgaacaggaacatactctgcacgagagctggagctcattgagcgcctttgatcgcagccatcgagggaggatctctaatactgagcttcccggagacatcctcgacgaactgctacagcaaaaatcttcgcggcatagcgacctcccacccagcaagaagggtgaacagcctggcttgtcaaggggtcaggacggatatagcggtgagaccgacgctggtggtgactttaagattcctgtgctcccatatgggcagaggctcgttattgacatcaagtccacctggggagacaggcattacgttggtctgaatggcatcgagatctttagctcgaagggtgaaccagtacagataagtaacataaaagctgatccgcctgacataaacatcctgcccgcttatggaaaggatccccgagtggtgacaaacctaatcgacggagtgaataggacccaggatgacatgcatgtgtggctcgcgccttttacaagaggaaggagccacagcattactatagactttactcacccctgtcatgttgctctgatccgaatctggaattataataaaagccgcatacactcatttaggggtgtgaaggacattactatgctgctggatacacagtgcattttcgagggggagattgcaaaagccagcggcacgttagcaggagcaccagaacacttcggcgacacaattctgttcaccacagatgacgatatactggaggcaattttctattctgatgagatgtttgaccttgatgtgggatcgctcgactcactgcaagatgaggaagccatgcgccgaccttctactgcagatggcgaaggggacgaacggcctttcacccaggccggactcggcgcagatgagcggattcctgagctcgagttgcctagctcctcccctgtgccccaggtcacgacccccgaacctggtatttatcatggaatttgtctgcagctgaactttactgcgagttggggagatctgcactatcttggactaaccgggctggaagtcgtgggaaaagagggccaggctctacccattcacttgcaccagatctcagcttcacccagagacctgaatgaactccctgagtacagcgacgactctagagccctcgataaattgatcgacgggaccaacataacaatggaagatgagcatatgtggttgattccattctcccccggacttgatcatgtcgttacgataaggctggacagagcagagtctatagcaggcctaaggttctggaactataacaagtcccccgaagatacttaccggggagctaaaatcgtgcatgtatctctggatggactttgcgtaagcccaccagaaggctttcttattaggaagggacccggaaactgtcacttcgattttgcccaggagatcctcttcgtggattacctgcgcgctcagctgctgccccagcctgcacgtaggctggatatgaggagtcttgaatgcgcaagtatggactatgaggcacctctgatgccttgtggattcatattccagtttcagctgttaaccagctggggcgacccatactatatcggcctaactggactggagctgtatgatgagcggggtgagaagatcccactctctgagaacaatatcgctgcctttcccgacagcgtaaattccctggagggcgtcgggggtgatgtgcggacccccgataaactcatagaccaggttaatgatacaagcgatggaagacacatgtggctggccccaattctgccagggctcgtgaatcgagtgtatgttatcttcgacctccctacgactgtctcaatgataaaactctggaattacgcgaagaccccacaccggggagtcaaagaattcggtctgctcgtggatgatttgctcgtctataatgggatcctggccatggtcagtcacctggtaggagggatccttcccacctgtgaacctaccgtaccatatcacaccattctgtttacagaagaccgcgacatccgccatcaagagaaacacaccaccatctcgaatcaggccgaagaccaggacgtccagatgatgaatgagaaccaaataattaccaatgctaagaggaagcagtctgtagtcgaccccgcacttcggcctaagacttgcatatcagaaaaagaaacgcgcagacggcgatgctag

SEQ ID NO: 58638 - DNA, 3354 bp, Artificial Sequence
  Description of Artificial Sequence: Synthetic coding sequence
atgctggcaggacgccctggcacccgaagtgccgtgggcgaactcggaaccgagtcttccgataatctcgatcgcgcacccctgggtccaagggaatcagggggacatcatcgacctggcagctaccttgacatgaagattcatctggaaaagaatctggaggaggagcgacagatcctcttgcagcagcagaaaatttgtaggaacagagcaagaaaatattttgtcgaatctaacagacgcaaaaaagcattcgaggaaaagcggaaagaacaggaggaaaaggagcatcagatccgggaacaaatccttcagcagaggaaacagaaattcgaggaagtaacagagaagttccaaagggctcacgtccccctgagtcaaagaaggaaagctgtgtcaaggaagccagtaccacctttagaggaggcactgaaacaaatacaggagtctaaccttaaatcagaagtgaacttacccttcagtagacggccaacaatcaactggcgggcaatcgactccgctctaccctcagcgctttccaaaaatgatcacaagcatcagaaacaactcttgtcgaagatcaattgcgagaaagagatgaacgagaacatgcgtgctacactggctacgagtaagaacgtcttccagcttaagctggaagagacccagaaattgctggaagatcagcatttatccaacttacagaaatttggggacgaagttaatcaaatcacaaattccgaaacactgagcagcatagacagcctcgaggcaactgagcatgaggaaatctacctgaccctgaataaagaacacagtacctccattcagcgcaatactatctccctaaaaccagcgaatatgcagagcactaacctgtcttgcttcgatgaggacaaattggcattctcaaagacccaacacataaataactggctcactaacctggatgctagcaatacgcagaatgtcactgccttcagcgatatcctctctaaatctaatgtgctgccatcatgggaatattttaacagcaaagaacaaaatccctcaccactgaacgggaccgtcgaacgcgcaactaatactgccaacaatagcgtacctttcgtgagcagccccccaatgttcgtgctggacaagaagtgcgaaaagacaagcgaaacttcgacaatgcggactacagacagtacatctggcgcttttaagagggaaagacctctcgtgactgaaagtcctacttttaagttctcaaagtcccagtcaacgagcgattctctgacccaggaggtggccacattcccagaccaggagaaatactctgaacttaaccaggagaatggtaccaccagcattccaacaagttgcgtcccagttgccaccccactcgttctaccatccaatattcagagtgccaggccttctgccaagaactccattcatatcaaagagatcgacgcggttcaatgcagcgacaagttagacgagctgaaggacggcaaggaggaggaaattaagtactttaattgtaataaggaagagttgcctctcttcagcgattccttccaggacgcctatattccccacaacccagattctaaagacgagaaacagaagctggctgaaacctcaagcctgtcgaatgtcacatcaaactacgacttcgtcggtcagcacaaaaagatgaagtataacatccatgaacgcaacggcgttagattcctgaagagcattcttaaaaaagagagcaaatacgagcacggctatttgaaagccctgatcatcaatcagtcattcaaattcggcaatcagaaagccgctgccataagagacagcatagagctgaccaaagagaagggcgctgaaattcctaaaaccatcaaaaaactgaggtggttcgatgagacctcaaacattgaaaataatgcagagaattctcatagtctaaagaacaaaactggcaccacacagcagcactcccagcagttccatattcagagcggagccggttctaatatcattagtgtctccacctgcgctgtgaactctgccgataccaagaaaagcagggaggacagtatctccgagaatgttacaacactgggaggatccggagctgaccacatgccactgaattgctttatacccagcgggtataactttgccaagcacgcctggcccgcatccaaaaaagaagagtctaaaattcccgttcatgatgactcaaagacaaagcagggcaagccccagcggggacgcgctaaaatcattcgaaaacccggaagcgcgaaagttcagagtggattcatctgcaccaatcggaaaggggctgtgattcagccacagtcagcttccaaggtcaacatttttactcaggcccagggaaagcttatcataccatgccccccaccacagagtacaagcaatatcaggtcaggcaagaacatccaagtctctcaatgccagcctgtaacccccgagaacccccagaacattatcacccataactcttttaacagtaaacacgtcctccctaccgagcactcactgaaccaatggaatcaggagagctcgagcccactgagtaacgcgtgctctgacctggtgactgtgattccatctttgcccagttactgtagctccgagtgccaaacctttgctaagatcaaccatagtaatggcacacaggcggtggctagacaggacgctacactatactgcacgcagaggtcacccgtgtgtgaggaaagctatcccagcgtgacacttcgaacagcagaggaggagagcgtgcccttgtggaaaagagggcctaatgttctgcaccagaataaacgggctacagggtccacagttatgcgaaggaagaggatagcagaaactaagcgtagaaacatcctggagcaaaagcgacaaaatcctggctccgttggacagaaatactctgagcagatcaataatttcggacagtccgtcctcctctcatcaagcgagcccaagcaaactactcgcggaacaagctatattgaggaggtgagtgactctacttccgaatttttgatggctgaaaacctggtgaaggccagcgtcccagaggacgaaattcttacagtcctgaacagtaaacaaattcaaaagtcaaacctgcccttaaacaagacccagcaatttaacatctgcacgctatccgccgaggagcagaaaatcttggagtccctcaacgatttgtctgagaggcttcattatatacaggaatccatatgcaagaatccgagcatcaaaaacaccctgcaaatcattcctcttctggaaaagcgtgaggatcgaactagcagctgtcgagataaacgctag

SEQ ID NO: 58639 - DNA, 2571 bp, Artificial Sequence
  Description of Artificial Sequence: Synthetic coding sequence
atgggcacgacggcaagcacagcacagcagactgtcagcgccggaacaccctttgaggggttgcaggggtctggcactatggactcccgacattctgtcagcattcactcctttcaatccacatccttacataattcaaaggctaaatctatcataccaaataaggtggcccctgtagtgatcacatataattgtaaggaggagttccagattcatgatgagctgctgaaggctcactacactctcgggaggctgtctgataacacgcctgagcattacctcgtccaggggagatatttcctggtgagagatgtgacagaaaaaatggacgtgctcggaacagtcggtagctgtggtgcgccaaatttcaggcaggtccagggcggactaaccgtgttcggaatggggcaaccctcattgtccgggttcagacgagtgttacagaaactgcaaaaggacgggcaccgggagtgtgtgatcttctgtgtgcgtgaggaacctgtattatttttgagggctgatgaggactttgtgtcttacacccctcgggataaacagaatctacatgagaatctgcagggtctcgggccaggagtcagggtcgaatctctggagctggctatacggaaggagatccacgactttgcacagctgagcgagaacacgtatcatgtatatcataatacagaagacctgtggggggaacctcacgccgtggccatccacggggaagatgacttacatgtaactgaggaggtctacaagcggcctctgttcctgcaacctacctatcgctatcaccgtctccctttgccagagcagggtagtcccctcgaagcacagcttgatgcattcgtatccgtgctcagggagactccaagtctgctccagcttcgtgacgctcacggtccacccccagctttagtgttctcctgtcagatgggagtgggacggaccaatttgggaatggtgcttggaaccctgatcctgcttcatcgaagtggcactaccagtcagcctgaagccgctcctactcaagccaaacccctccccatggaacagttccaggtgatccagtctttccttaggatggtgccacagggcaggcgtatggtggaagaggtggaccgtgccatcaccgcatgtgccgaactgcacgatctcaaggaggtcgtgctggaaaaccagaagaaactggaaggcatccggcctgagtcccccgctcaggggagcggctccaggcatagcgtctggcaacgtgccctgtggtcgttagagcgctacttttacctcattctttttaactactatctgcacgagcaataccctcttgccttcgctctgagcttttcaagatggctatgcgcacacccagaactgtaccgcttgccagtcactctgagtagtgcaggccctgtggcacctagagatctaatcgctaggggcagcctacgtgaggacgacctagtgagcccagacgcgttgtccaccgtccgcgagatggacgtggccaatttccgcagagtgcccaggatgccgatttacggtacagctcagccaagcgcaaaggctctcgggtcaatcctggcctacctgactgacgcaaagcgcaggctccggaaggtggtgtgggtcagcttaagagaggaggccgtccttgaatgcgatgggcacacttacagccttcgctggcctggtccccctgtggcacctgaccagctggagactctggaagctcagcttaaagcccacctctcggagcccccaccaggcaaggaaggcccattgacatataggtttcagacatgtcttacgatgcaggaagtattctcccagcaccgccgagcatgtcctgggttgacatatcatagaattccaatgcccgatttttgtgctcccagagaagaagacttcgatcagctgctggaggcattgcgggctgccctgtcaaaggacccaggcacaggcttcgtgtttagttgcctgtctggacaaggaagaacaaccaccgcaatggtcgtcgccgtactcgccttttggcatattcaaggattccccgaggtcggtgaagaagaactcgtgtccgttcccgatgctaagttcacgaaaggcgaattccaggttgtcatgaaagttgtgcagttgctccccgacgggcaccgcgtgaagaaggaggtggacgctgccctggatactgtcagcgagaccatgacccccatgcactatcacctgcgagagatcatcatctgcacgtacagacaggccaaggcagccaaagaagcccaggaaatgcgaagactgcagcttagaagcctgcagtatttagagaggtacgtatgcctgatcctgtttaacgcttacctgcatctggagaaagctgattcttggcagcgtccgttttctacatggatgcaagaagtagcatctaaggcaggaatatacgagatacttaatgagcttggttttccagaactcgaatccggcgaagatcagccctttagccggttgcgatacaggtggcaggaacagagctgcagcctcgaaccatccgcaccagaagaccttctttag

SEQ ID NO: 58640 - DNA, 1230 bp, Artificial Sequence
  Description of Artificial Sequence: Synthetic coding sequence
atgtctctgcacgcctgggagtgggaagaagatccagcctcaattgagcctatttcatcaattacgtccttttaccagtctacttcagaatgcgatgttgaagagcatctaaaggcgaaagctcgtgcacaggaatccgacagcgaccgcccttgctcaagcattgagtccagctccgaaccagcgtcgaccttttccagcgatgtcccccatgtcgtcccctgcaagtttacaatttcgcttgcttttcccgtaaatatgggacaaaaaggtaaatatgccagcctgatagaaaaatacaagaagcacccaaagaccgacagcagcgtaactaagatgcgccgattttaccacatagagtactttctcctgccagatgacgaggaacccaaaaaagtggatatcctactgttccctatggttgcaaaggtgttcctagagagcggcgtcaagacggtcaagccatggcacgaaggcgataaggcttgggtgtcctgggagcagacattcaacatcactgtaaccaaagaactgctgaagaagataaacttccacaagataacgctcaggttgtggaacacaaaagataaaatgtcccgtaaggttcggtactaccggctcaaaacggccggatttactgacgacgttggagccttccacaagtcagaggttagacaccttgtgctgaaccagcgaaaattaagtgagcaaggcattgagaacacaaacatcgtcagggaggagtccaaccaggaacaccctcccggaaaacaggagaagaccgagaagcaccccaaaagtctgcagggtagccatcaggcagaacccgaaaccagtagcaagaactctgaggaatatgaaaagtctcttaagatggacgactcaagcactatccagtggagtgtatccaggacaccaactatctcactggccggtgcaagcatgatggagattaaagaactcatagagagcgagagtttaagctccctgacaaatattttggacagacaacgctcacagatcaagggaaaggacagcgaagggagaagaaagatccagcgcagacacaaaaaacccctcgcagaagaggaggctgatccaacgctgacagggcctagaaagcaaagcgctttcagtatacaattagccgtgatgccccttctggcaggtacccactgcctcccttgctcccagcagctgctgctggtgctctggcccgaacggccatag

SEQ ID NO: 58641 - DNA, 3603 bp, Artificial Sequence
  Description of Artificial Sequence: Synthetic coding sequence
atggacccacccagcctggatacagccattcaacatgcacttgcgggtctctatccgccttttgaggccaccgcacccaccgtgctgggccaggtcttcaggcttctcgactccggatttcaaggcgatggactgtcatttttgcttgatttcctgataccagcaaaacgcctatgcgaacaggtcagagaggctgcctgcgccccatactcacattgtctatttctccacgagggatggcccttatgtttgcgggacgaggtggtggtgcatctagcaccacttaatcccctgctcctgcggcaaggggatttttacctgcaggtagaaccacaggaggagcaatccgtctgcatcatgataaaatgcctctccctagatctgtgcacagtggacaaaaaacctgtgcctgagccagcttaccctatcctgtttactcaggaatggcttgaggctataaattctgactttgaaggcaatcctctacacaattgcctcgtggcctctgagaacggtatcgcccctgtcccatggactaagatcacgagtcctgaatttgtggatgatagaccacaagtggtaaatgccctttgtcaagcatgggggcctctcccactggaggccttggatttaagctccccccaagagctgcatcaggccagctcgcccgataaccaagtgctgccggctcagtcgctggccaagggcaagggtagaacttacggttccaaataccctgggctgatcaaggtagaacaggcaagatgcggggaagttgcctttcgaatggatgaagtagtttcacaagactttgagggggattacgttgcattgttgggcttctctcaagaatcccgtggggagtctccatcaagggaagccggaacttcatccggctgcacaagtggtgctcttgaagagatcgcagggaccaaggagactcccctgtttcagaagattctgccgttgagcgaagctaatgagggcccatctctgggcaatcgcgcatgcaccaagcctgagtccagtgaagagagaccttataatcttggtttccgccgaaaagtgaacctaaaggctcccacgcacaacagcgagcgaccacctcagggcagctatatgaatgtgctcgaagacgctctggattgcgcctctgggttgcgagcaggagtgtcacaggagcctgccgcatccaaaatgcagggcccactgggcaatcctgaaaatatggtccagcttaggccgggtcctcgacaagcgtctagccctcgcctgtctcccgcatcaccggcagcagcggcatcggagactaaaatcgaggtcaaaaccaaagagcggaacggacgcctgcctaaacccatgccctgtccttctagaaacacaagcagccccgagcctccaactcctggtctgaagttcagctttctgaggggacagcgccaaccctcagttacccccgagaaggcctcactgcagcacaatggaccgtggaaggtgctctgttccctctactctccgaagccaaaccgggctaagagcttaggcaaagccggaacgacccagacaaaaacctctgggcctgctactgccccttctcctcttacggaggagaaggccgcactgcccgaagcatcagctgggagccccgaacggggacctaccttagaagaggaaccgccagggccagagcctcggatcggggcattaggagtcaaggtgtttagatctcggatagcctgtctgcctgggggtagagacagggccggaagacctctccttctagtgagtactaccgagggagcttgggaagcaccttggtgcacagtgtccgaagtcaccaagctgctgagctatctgtgtactattcctcgacccgaagataaggccaagggattggccgtattgattgacgctagacgtcaacctccccagccaggccttgtcagcgctttgcaggccacacaggcccaggttcccgcttcaataagggccattctattcttgggggagaaagaggcagctctccagctgcagacactccctgacgtccaggtcgaggtgcttacttcattaaaggcattgtcgcaccacgtcgacccaagtcaactgccagccgtcctggagggccctttcccatactgccacaccgaatgggtccacttctttcaaaaactcgatccctttcttgcagacctgcaccaggcttctagcctcttacaggccagtatagaggaatttgagaaggccgacccacccggaggcatgcaggaagctaccagatgtttaagcaagagtaaggagcttatggaggccgtgctcagagaccctgggttactgggactccagagagagggaggagcgacccttgcacgacttcagcatgacgctagcagacttgactttagccctgatgtgcgcagtcatctggccgctgctacggcactgtactcactagtggatgaacagctgcacgtgctggtaactgcatctaattctctgctgggcaagttggaacttcgggtgaggcttgggcgtctggaggctgcgatacaccaggtaagtgactggatggaacaggagggcagacggtgcttgcagagtctgactccgaaggatggcagcctggaaactgtcgagaaagcccatgcagagttcgagaacttttttttacaggcagcagcacagtatcggagggggctcgagctgagtaagcaggctgcccagctcggtgcaacggcaaggggcgcaggcgaggcagaacgcgcagagttcccagaattggccgctttcgctagcactcagagggcctttcaggccgagttgacacacttttacatggctgccgagaggcagcggacagacctggagactttgttacatcttcaccggttttgcaagcggatgacatggttccacatggattgtcaagatttaatggcccagctacgcctggataaaacctcccgcgttagtccaggggatcagaggcgtttgcaccggtatctccaacgcctagcaagcgagttcccggcagagaaactcgccgcagtgggcctgcaggtggcaagcttatcacgcgcaggactgggacaagaactctgggaggaggcccgtatacggcacgaggagattcgcatgctcctggagaaagccctgacgcattcatcctgtcctgaggcgcctgcggcacatagtgcaaggcctgaacggagaggagtcgctgcgaaaggccagggcgtttcagtcgaggtaaccagtaagggtagatgggatcagccacccttggacagcctcggcatggaccatttgcctaagtcttactggccgcctggaccacctcggggagagcagaacaggacatttcaggcaggaagtcccccacaagaagcgggtcaggccgcagaagccgaagacgggaaaggctcgcacaagttgcccgaccctgctcgggaacacttgctggccaccaccttctttcgccagcagccaccccgtcagtcacaggtcccaaggctgacaggcggaagcttttctagtgagggaaccgactcccagacaagcttggaggatagcccacagacatccccacttgcctcactctag

SEQ ID NO: 58642 - DNA, 1734 bp, Artificial Sequence
  Description of Artificial Sequence: Synthetic coding sequence
atggcagacgtagccggtcctagccgaccttccgctgctgcgttttggtcaagagattttagtgacgaagaacaaagcgtagtgtatgttccaggaataagtgccgaaggaaatgtgcggtctcggcacaaacttatgagccctaaggccgatgtgaagctgaagacgtcacgtgtgacagatgcgtctatcagtatggaatccctgaagggcacaggcgattcagtggatgaacagaacagttgtcggggtgaaatcaaatcagcctcgctcaaggatctctgcctggaagacaagagaaggatcgctaatctgattaaggagcttgccagagtgagcgaagaaaaggaggttactgaagaacgcctcaaggcggagcaggagagttttgagaagaagattcgacagctggaggagcagaatgagctgattattaaggaaagggaggcattgcagttgcaatacagagagtgtcaagaactgttaagcctctaccaaaagtatttgtccgagcagcaggagaagctgacaatgtcccttagtgagcttggtgccgctcgtatgcaggaacagcaagtatcatcccgcaagtcaaccctccagtgctcaagtgtggaactcgatggctcatatttgtcaatagccaggcctcaaacttattaccaaacaaagcagaggcccaaatccgccgtccaggactctgcttcagagtctcttattgcttttcggaataattctctgaagccagtgacccttcaccatcctaaagatgatcttgataaaatcccttccgagactaccacctgtaactgtgagtccccagggaggaaaccagccgtccctactgagaaaatgccacaggaagagctgcatatgaaggagtgccctcatctcaaacccaccccttctcaatgctgcgggcaccggctcgcagcggatagggtgcatgatagccatcccaccaatatgacaccgcagcacccgaagactcacccagaatcttgtagctactgtaggctgtcctgggcgtccttggtgcatggtggcggtgctcttcagcctattgaaactctgaagaaacaaatctcagaagatcggaaacagcagctgatgctgcaaaagatggaactcgagatcgagaaggagaggctccagcacctgctggcgcagcaagaaaccaaattgctcctgaaacaacagcagctccaccagtcacgcttggactacaattgtttactcaagagtaactgtgatgggtggctgctaggtactagctcatctattaaaaagcaccaggatccaccaaactctggagaaaatcgtaaggagcgtaagacggtgggctttcactcacacatgaaggacgacgcacaatggagctgtcaaaagaaagatacgtgtagaccacaacgcggaacagtcaccggggtcaggaaagatgcgtctacctcacctatgcccaccggctccctgaaagactttgtgacaaccgcgagtccatcgctccagcacacaacttcacgatacgagacttccctgctggacctagtgcagtccctcagccccaattctgcccctaagccccaacggtatccatctcgcgaggcaggggcttggaaccatggtactttccgcctgtcacctctcaagtctactcgcaagaagatggggatgcaccgcacccctgaggaacttgaagaaaatcagatcttggaggacatatttttcatctag

SEQ ID NO: 58643 - DNA, 1416 bp, Artificial Sequence
  Description of Artificial Sequence: Synthetic coding sequence
atggtgctggacagcggcgcacaggcatacgaccaggctcctcctagcccccctactagtccacctagcctgaggcaccggctgaagccttctgatagagatggcccacccctgtacccatggtcgcagtctcttgccctgcctctcgctctggccgtgcctcctgccctgcagccccagcccgagcagcaaccgttctcccagatgctgctgggtcaccgcggacacatgaggcgctcagagtccacttattcagttaacagcaccggtaggcgcggacgcggaaccttagggagaccgccacccggacgcggtagaaaccccggaggcggtactttgcgcccagcagcttcactccctcacatcgcaaagacccaacgagatgcaggacacatagcaagcaaatcgccatgcatgctggtcgcactgaggcctaccaatatggacagagaacgcgataaattcttccagagtcactatacctataacccccagtttgagtatcaggagccaatgccaaccgccgtactggagaaatattgcgaagccagcgggcaatttattcaccaggctgtcggtatcatagaggctgtgctagagaaatttggcacctacgagcatttcgaggctgccactggcggtcaactgctgaccaagtgccagatctggtccatcgtgcggaagtatatgcaaaaggaggggtgcgccggagaggtcgtggtgcagttatcagaagacctgctctctcaggcggttatgatggtggagaactcaaggcccaccctggcaattaacctcacgggggctcggcagtactggctggaaggcatgctccggcacgagattggaacgcactacctccggggagtcaataatgctcgacagccttggcacaatgccgaggggagattgcggtacggcctgcgcccagccaatcctaccgaggaagggctggcctctctccattcagtgctgttccgcaaacagccctttctgtggcgtgccgctttgctatattacacaatccatcgggctgcaagaatgtccttccgccagctgtttcaggatctggagagatatgtccaagatgccgacgtgcgctgggaatactgtgttagagccaagcggggacaaaccgataccagtctcccgggatgtttcagtaaagatcaagtgtatctcgacgggatagttaggatcttacgccatcggcagactatagattttcccctgctcacctctctgggaaaggtttcttacgaagatgtcgaccacctacgcccacatggcgtactggacaacaccagagtccctcatttcatgcaggatctcgctcggtaccgacagcagctggaacacattatggcaacaaacaggttggacgaggccgagttgggtcggttgcttccagattag

SEQ ID NO: 58644 - DNA, 432 bp, Artificial Sequence
  Description of Artificial Sequence: Synthetic coding sequence
atggttgtcttcgtcggcagacgactgccggctcttcttgggctcttcaaaaagaaaggaagtgcaaaggcagagaatgacaaacatctctccgtcgggccaggacagggcccaggcagtgccgttgacgagcaccaggataatgtgttctttccaagcggacggcctccacacctggaggagctacacactcaagctcaagagggcctgcgttccctgcagcaccaggagaaacaaaagctgaacaaggggggatgggaccacggagatacccaatccattcagtctagcaggacaggacccgatgaagacaatatctctttctgttctcagactacttcttacgttgctgagtcctctacagcggaggatgcactcagcatcagatctgagatgatacagagaaaggatagccagaaagagctagcttag

SEQ ID NO: 58645 - DNA, 2124 bp, Artificial Sequence
  Description of Artificial Sequence: Synthetic coding sequence
atgtcaagaggatactccgaaaacaacaattttcttaataataataatcagatggtcttggacatgattctctaccccctgataggtattcctcaaactataaattgggagacgatcgccagattagtgccgggtctgacccccaaggaatgtgccaagcgctttgatgaactcaagtcgtctggctctagtcctgtggataaccagtataattctctcatggccgcaggagaaagcccagtcgaaacgttggcaacatacattaagtcctccctgctggacattcatggagaatttcaggaaacccccgtaggacacgacgccgtgtcaaaaacgggccgtcatagcatcgccagtaccaggaattgcagcagcgagagcgaaaactgtactacacataacggcggagagatgactgaggagtcggaggggccaaatatggtgattcacgtctgcgatgaggcgaaaaatcttaaggaagactttacttgcccacgcgatctgctaatatctgagatgaaatattttgcggaatatctcagtatggatgctcagcgctgggaagaagttgatatctccgtgcattgcgacgtccacatttttaactggctcatcaagtacatcaagaggaacaccaaagaaaataaggactgtgagatgccgactctcgaacctggcaatgtcatctccattctgattagttccgagtttctcaagatggacagcctggtggagcagtgtattcagtattgccacaagaacatgaacgccatcgttgccacgccctgcaatatgaactgtatcaatgccaatcttttaactcgcatcgccgacctattctcgcacaatgaggttgacgacctcaaggacaagaaggacaaattcaaatctaagcttttctgtaagaagattgagagactctttgaccctgagtacctgaatcccgatagcaggtcaaatgctgcgacgctgtataggtgctgcctgtgcaaaaaattgctgaccaaggaaactgaacgaaggataccgtgcatacccggaaaaatcaatgttgaccgcagaggaaacattgtgtacattcacatcagggataaaacatgggatgtgcatgagtatttaaacagtctctttgaagagctaaagtcttggcgagatgtctattggagactttggggtactatcaactggctgacctgctctagatgctaccaggcattcctctgcatcgaattcagtcactgccagtaccactcagaaacagtagtgtaccccacagccgcaagcagcctcaataccgtcggcactggaatatacccctgttgcaaccagaaagtcctgagattcgacccaacacaattgaccaaagggtgcaaggtcagggatcacatggtgactttgagagaccagggggagggtggagatctccccagctgcccaaccgccagaatgcttgatgatctacacaagtatagagacgtcatcgtggtgccattttctaaggatacagtcagcgacgtaggggtcggactttgcgatgaaaagggtattgaatgtgacgtgttgctggaacctaatacaccgtggggtcccaaaaccggtgagctgaacgcttttttatccctgaaaaattggacattgcagctgaaacagcagtcattgttctctgaagaagaggagtacaccacaggatctgaagtaaccgaagacgaggtgggggacgaggaggaggtgtccaaaaagcagcggaaaaaggaaaagccgaagaaattcacaagacagccaaagaagcaggttagtagcccttgtgcccagcggaaagagaaagccctcgagaagagcgctagccgcgatgtgagccccttcgtgatgagcatgcagaagaacaagtgggatgctacgcgctctctgcggtttaatcaagatgcccaacgggaagacgatcaacgtcggatgacagaaataacgggccacctgatcaagatgaggctgggcgatctcgaccgtgtgaaatcgaaagaggcgaaggagactgacaagctaagaccccgtgatggcactgttagcaagagtaatcggaagagtgggctgagcagtgtcctgctcatgactgtgctcctctgctag

SEQ ID NO: 58646 - DNA, 2811 bp, Artificial Sequence
  Description of Artificial Sequence: Synthetic coding sequence
atgctcctagcccctcagggcagatctttctccaaaaagaggatgggactgaacagatggaaacggtttacacgcaagcccagtcccaagccaacttttggtcccgactctgtggagcactggatcaagcgcgtggagaaggcatcggagttcgcagttagtaatgccttttttacccggaattcagatctgccccgttccccttggggccagatcactgatttaaaaacctctgaacagatcgaagatcatgacgagatctatgccgaggcccaggagctggttaacgattggcttgatacaaagctaaagcaggagctggcaagcgaggaggagggtgacgccaagaatacagtatcttctgtcaccattatgccggaagccaatgggcacctcaagtatgacaaatttgatgatctttgcgggtacctggaagaggaagaggagagcacgacagttcagaagtttatagatcacctactccacaagaatgtagttgatagcgccatgatggaggacctcggacggaaggaaaatcaagacaagaaacagcagaaagaccccagattaaccatggagatgagacacaagcaggtaaaggagaatcgccttcggagagaaaaggagctcgagtatcagaggatcgaaaagactttgaaaaagtctgctttccttgaggctcagtgcctcgtacaggaagaaaaaaagcgcaaggcgttagaggccaagaaagaggaagaagagatccagcgcgaaatggtaaagctgcgtagagaaatcatcgaacgccgacgcacagtaaaggccgcttggaaaatcgagaagaaaagacaggaagaaaactctcaaaactcttccgagaaggtgatgtttcagtctacccacatactgccggacgaagagaaaatggtgaaggaacgcaagagaaagttaaaagaggtgctgatacagaccttcaaagaaaatcagcaatgtcaaaaacgatactttgcagcttggcataagctgatcctggatcataggattaagctgggtaaggccggtaccctgtcagattggaaaattcagcttaaggtcctgagggcctggagagactacacccgctttcagaagctcgaacgggaaacccaagcgttggaaaatgaccttagggaagagaacaggaaacaacagttagcgacggagtacaatcggaagcaggtcctgagacactgtttcacagagtggcaacactggcacggtgcagagttgctaaagcgggagttagccctgacaaaggaagagacaagaaaaaagatggacgcactgctgcaggctgcttccctgggtaaactgagcgccaatggtctgtcgggcatatccttgcctgaggaagccacggccatggttggtcctcctgtaaagaacgggcaggagacagctgtccctccactgtgggaaaagccgccactgggctcctctggctgtatgctgagcccccctctcggcagaacaacaaccgggaatttgcaaggaagcctccagaacgtgtctctctccgctccaggcaacaagcaacacaagaccctgggagctgaacccagccagcagccaggctcaaatgaaaccttgaggactacatcccagaaagcagaacctctatgcttggggcatttccacaatcgccacgtgttccagcagcagctgattgagaagcaaaagaagaaattgcaagagcagcaaaagactattctggaactcaagaaaaacctccagcttgccgaagcccagtgggcggcagaacacgccctggctgttacagaggcccagagccatctactgtctaaacccagagaagaggagcccaggacttgccagatgctggtgaactctccagtcgcctcccctggaacggaagggagaagcgacagcagaaattctcttagcgggcttcggcgaaagcccaagcaattaatgacaccccacccaattctgaaggcaatggaagaaagagctattcaaagagcagaatgccgccgaattcttgcagaaaaaaaaaagaagcaggaggaagaaaagttggcccagctgaaggcccaagaggaagaaagacagaaacgcgaagccgaggaaaaggaagcccagttggagagaaagagagaggagaagcgactgaagaaaatgaaagagcttgagaagcaaaaaagaattaaacgaaaccagcagctcgaagccatagcaaaggaacactacgagcgcgtcctgctacggaagaagggcctggaaccctggaaaagactgcgaatgcagagcaagcagaatatccaggtggccgaagaacattacagcctgtttctccagagaaagtacatgctaacctggttccaaaggagtcaggagagccttgcgagaaagatggcacaggccgaccagttttattcccaaatcttgctgaaaagagtgatacagtcgtggctacagtatgtgatagatctacaggaggaggttagaaaattttgtgtgcatttcttacagaaaaagatttttagagcatggtttaacatggtgcgggaggtgaaaatcgattcacagggaaagcatgagatcgctgcggagcattccgacaggcggatcctgtggattacgctgcgcacctggaaaaagtttgtcaaatttatgaaggaagagagagttaaggaggaaagaaggcagcagttacggaggaaggtggtcgagatcctacccgattttcaggtaccaggtaggtatcacgaactgtaccagcagtctgacacatggtctctcagtaagactagccttgtgaatgagtag

SEQ ID NO: 58647 - DNA, 465 bp, Artificial Sequence
  Description of Artificial Sequence: Synthetic coding sequence
atgtctaaaagaaaccaggtgtcatatgtgcgccctgcggagcccgctttcctggccagattcaaggagcgagttggttatagagagggaccgacggtggaaacaaaacggattcagccacaaccccctgatgaggacggtgaccattcagacaaggaagatgaacagccacaggtggtggtactgaagaagggagacttatcagtggaagaagtcatgaaaatcaaagcagagataaaagctgcaaaagctgacgaagaacccacccctgccgacggccgaattatataccgaaaacctgttaaacacccttccgatgaaaagtacagtggcctgactgcaagctctaagaagaagaagcctaatgaggacgaagtgaatcaggatagcgtgaaaaagaacagccagaagcagatcaagaacagctctctgctgagtttcgacaatgaggatgagaatgagtag

SEQ ID NO: 58648 - DNA, 495 bp, Artificial Sequence
  Description of Artificial Sequence: Synthetic coding sequence
atggatgaggaggtgtccgaccccacttccgctgctgctcagttgaggcagctgcgggaccatctgcctcccccaagttccgccagtccaagccgcgctctccccgaacctcaagaggcacaaaagctggccgctgagcgggctagagccccagtggtcccttacggagtggacctccattattggggccaagagctgccaactgcgggaaaaatcgtcaagtcagatagccaacataggttctggaagccttccgaagtcgaagaagaagttgtgaatgctgatatctcggaaatgctgcggagccggcatattacgtttgctgggaaattcgaacccgtgcagcactggtgtagggctccgagacccgacggtcgactgtgtgaacgccaggataggcttaagactttccactcctgccctaggccgagcggcagtaggggcggaactgagccatcaccgaggccatgtgggagccaggacgcccttctttag

SEQ ID NO: 58649 - DNA, 6800 bp, Artificial Sequence
  Description of Artificial Sequence: Synthetic coding sequence
atgatgcctggggagacacactctgctgcccctggtacagccgcagacctcagcaggtgccagggttgcgcatcactgcagcagaatctcaatgaatacgttgaggccctgatcacactaaaacaaaagattatcaataccgacaacctcttgacagagtaccagaagaaatgcgacgaactgcaattcgcaagaagagaaaactccaatctccaccaccaggtagaggaaatgctccaaaagatctcccctctccagaagtgccaggaggaactgggtagtctcaaggccgagctggaggaaaagaagtcaagcctgaagctctatcaggacactcatcaagagtacgcgagggtgaaggaggaatgcttaaaatccgatgctcaaaaaaagaagttggaggcaaaagtgaagaagttacaggaagccgctgtgaagcaaactcaggacttcaaacagcttaggaatgaaaagaaaatcctggagaaggagttcaagaagacccaagaacggctcgacgagttttcgaagcagaagaacgaaaaagagctgaggcacatagggacccaaatcagcagcgatagttatggctccatagacaaaaggaaagttaagctgctgctgaaggaactttggctttgtgttaacacaactcatcgcttgcccggagagggaagccgctgtgttcctgaaaaaccagctaaggccataacgagcagtcgcgtgcctggagaggacggaacacttccacccacccagggcagtccgctccgaacatcaaacgtgcagacatgtcttaccaagctctccatggagattaaggaggacttcttgtgccagaatgtggagaaacagtcgagttcaggaaccaattgctccagcgaccacgtatttaacgaaaacggaaatctggaggttctggtgcagtctcatagagatggagggagcacagaatttgttgatcacgaccattttttcgatgaggacttgcaggctgcgatcgatttttttaaattacctccaccgctcctctcgcctgttccgtcaccaccgcctatgagcagcccacacccgggtagcctcccgtcttcgtttgctccagagacttattttggcgagtacaccgacagcagtgacaatgatagtgtgcagctgagaaacagcgctgagtgtgtgtctgaggacgatactacagagtcccagaattactttggttccctccggaagaataaaggcagcggaacttgggaagaaaaacccaagagtcatgaggccatccaggctctcaatacctgggaagtgaacaaagtcactacctccggcctcgagacttttaccgccaccttacgcgagtcgtccgccacccattcactcgtgggcgaaaagcactggaccaccgcgagcaggtctatgagtgacagaaagcgtgatattctccatgagactaaaactcagatggaggtgcgggaaatggacaagtcagtccagaccgagaaaactatacacaaacttacaaggggcctgtgtatcgagcgcttaagcgcttctccagcccaggagaaggaggctgcaccgggaaaatcagagctgtgctcgagccctctgggaaagcgccctctgaatgaactgatggagagcgagggaaagacggtattgtctaagatgatgggttcaccaaaatccgagtttactaagtggacccgaatcaatgaaataacttccgagcctgataggatcaccgtgtctggccacttccacagactgtccagggaacttgaaaaggaaaaggaggacacccagggattcactctcggcgagtcccccgagtccgaggatgacgattcaggtgacggtatggatgtagccggattggacatcgagacctcattcagctcttcttctacgctggtagcattatcagtgggctccaacccccagtcttcgtccggccttgactgtggcaacgatacagacattactacaaaagtcttctcaacagaacctcatcacagcgagcacaagctgcagactaaaacactcaacactcttcacctgcaatccgagccgcctgaatgttcaatcggcggtaataatttggaaaactctttgtgcgccttgagcccagagctgggggcatccaactttaacgaccagaaaagctccgggatagaatatactaaggttgtgaaggggctgacaaaaatacactctctgcccaggtcagtgtttatgaaagccacgaaagacgggcagtgcgagtcccaggatccacgcatagagcttaccctgaacaagcccgacttcacctcccttattggctctcaggccgctctcataaaatctggtctgggcttcgtgaaaagtacttcctggcaccactccgatctcctgaggaaggggggagaggagtccctgcgggcaaagtccgagcatgagcagaaaacgagccaccaattgcagaaggctatgcccttcctgcagaatcgaggtccaacaccaaaacccgacttgttgcgcgagaataataacccagtcgaattcaaaactacggctagtgtgctcccgaatcaggtttctgtgatcacaaaacagactaggccagaaaaggtgcagtcagccaaactggagcatctgagaccacatagggtcgagcctactctggtgacggaaaactcaggcaacaaaaccgggatgagtactgtagccaagtgcgatggggagcgggacgacaccacccagaacattactgaagtcgcagcagtcaagtcgatctctcctgaggtgagtgcttccaggcgaaagctggactttaactctcccggaggtagcagccccgttgagaattctgactgctccacaaatagtcgtttgtctttttcccctgagaacatccttatccagaatcaggatattgtgcgtgaagcagcagtacagggggatggtcagaagcagaggcagccccaggccaccgaccttgatagtagcggaacccacggcagtgagatgcttccagcaactgaggttacggtgagtgggggattttccgtggaggagacctcttgtggcgacactgggaggagcggcggagaagcactggccgtcgcaaacgactcaacatccacgcctcagaatgccaacggactgtggaagctgaaatccaccactcctggaggggctctgccagagtgcttcggtactacagatacgacttttagcagtgccttctgcaggaagcacggcgagacgcaagacaccagtcagtcttctctgccgggaaccctccactgctatacgggaattagagaaggtggtgacgatacggaagtcgagtccgaggctttctcctgcagcgaggggtctgagcagcaggatgctcccgacgactcacagaaaaatctgggagatactgatgcggcagtcgctgaagttaggccatctctggaggttgggtacctgacatcagctctccaggattttaacatatcaaccttctctgaattggatagattgtcaacctccgaggtagtgatgttcctggagtcctgtcaattgggagattattcttccggggacagcgtctcggagtgcagtagcaagggtacactgtccaaggagatgaacaaagagctgaaagcaagcgagatcggagaaaagtacagaaaacagccctgtgaggaagaaaccctcggaacttgcgaggaatggatcgagtctgaagaagacgattacagtctgaaaaacacctcccagctgacgcagtgctcgctcgaaaccctgtcagaagtgctgaccaaaattaggcaagagctccagacgaattcagaggattgcaatggcaaggacactggctccctactcctcctgaatgtgaacaataatatgacgacggagaacctgaaggagaagtccccttttcgggaaaccaccggcagttcttcccacgcatctgagcccacgccgcaagccgctgcactcgatacagagggcagctcgccaattagcggtatgccacagaatgaaaatcctcagtcaaggccagaagcgaggtccgatgccggaaggcaaacggacggcggagaagaagatctgcccgaacccgtggaaccctctgcactatgtagcgactccgtcatggaaccctcgatcgagcagtctagcaactgcgaggctgagaccacgtttcaatgccaaatagccacagtcacaagcgaagtgataaatgtcctaatcaataaggaccagaatctggtgatcgaaaagggagacaactggactataatttccggcgtcgccgtgttacctcacgtggatcaggtcaccctctgtgatattccaggcgatatccctatatcacaggaccagggtgaattggaggcgggttgcatacctgtcacctccgccgagaagtcccctgaagcctcacatactggccctgctttccaggaggctccttgcgggaacaatttatcctgtccccaggaagacgtgtccagttccggtcaatccaccaactttgataagtccagattaagaaacaggcctgtaaaaccttcaatctggattagctcacaaatatacgaccagaattttgaaacacagatcgtcgcctctgaccacacttactacaacagcaagttggagccctcaggtaagaataaaaataggagcaaaatctccaataaggatcagtctaataaaccagtcaagaccagtgcctcaagccgtgtcgaaacacatcaatcggaggtcgcccaatcattcagcggggaaaaggccaacactaaaacccagagaagccagacccaaaccattttagccaatgctgacacatccacccccacggattgctccccagatacgctgtccaagataaggcaggaagtgggaccacccctgccgcctttactggcacccctgatcgctacaccccctcggactagccagcccctctccccgctaatatcttcatcttcgcccagctccccagcatctcctgtcggtcaagtgtcgccctttcgggaaacccccgtgcctcccgctatgtctccttggcccgaggacccgagacgggcttctcctccagacccctctcccagcccgtctgcagcgtccgccagtgaacgagttgttccctcccctctgcagttctgtgccgctactccaaagcatgcgctcccagtgcctggccgtctaccaccctgcgcctccggacacgccgcagttgggggacctcaggagaactcggtgaagattctggatacaatgtaccccgagctgtccgctcgtgcccgaacattaaatattttgaaaggcaatatccagctaacccgtggccctccggctgattgtaagaacttgcccggaccggcttctgcaatgatcggctttaagaccatcacaagcgccgcaaccgcctttgtgaaaacaggatcatcctccggaggggactgcaaccaggacaagagtagagatctcggtacacagcaggatagttcggggaagagaaccttgagcaccagtactctgcggagtgcaaagcggctgcgtcttgatacagggagtcccgagccagagacccgaggtgtcacggccgaaggaatccacaagaatcttcctggcaatttgcccccagccgaggtagccactaccaacgaggaacgctcatgttcaagcccagccgtcagtgctgtaagtcagttgccgcttagccctaaggaaaccgtcgaaagccacgataaggcaatcgcaaatgccctgaaaaagatcgctgagttcagcttcgacctgctgccggtcattcgatctcatgtctacgtgggtaacatctctaagaaaccagttatgcgtgaccaggaaaaggaagtagtctatgagttcagcaccacgaaaaaacacttagccgaatgcttactgcactccattctgagcgagctgaagattcagaagatctccatggatcacaactacatccacgcactgtgcagggtttatgtgggcatatgcaggcagctgggcgatcttgagagagccagactgttctgctacagccttcttaaggaggacttccctgagtcagaaaaactgactctgttcattgccaatatgtggcatgatattttcttgagtcaaagcgtgatcaataaagcaatgcagttggttgccagacagagagctaagggtgaagtactgaactgtctccgggcattcctgaattgggaaaaaaacgccccagtagatgttggctttatggtgagcaaactccttctcactatccagctttgtcccaagacagagttccaaccatccgagaaattcggcgaggatctgtccgataatacgtgggaatatatatttgccatagatctactgtgttgtcaccagaaatggatctggacccacgacaatattatttccaaggagctgtggccagttatggataagtggataaagtacagaaagggccatgcaaacattgcctatacccctgatatcatcattgccagcatcctccggcttattggccgactcggccaattgggcctgaaagagggttttccatccgcagttaagaatatatcctctgtgataggcatgttcattcaacacgcacacgatgaggacatcccctgggggatccagctggccgctgtttacgcgctgtgcgatctgtccccgtccaatccggcagaaatttccaaaatcctcgaagcttggcgaagagaagcatctaaaagcgtgcccagcgccatcgtgagctgtctggaagaagtgtcagccctttctacagaggagctcggata

SEQ ID NO: 58650 - DNA, 1362 bp, Artificial Sequence
  Description of Artificial Sequence: Synthetic coding sequence
atggatcagtttggcgacatactggaaggcgaggtggatcacagctttttcgattctgactttgaggagggcaaaaaatgcgagaccaacagtgtgtttgacaaacaaaatgacgaccccaaagagagaatcgataaggacacaaaaaatgtcaattcaaacactgggatgcagaccactgagaactaccttaccgagaaaggaaatgaaagaaacgtgaagttccctcccgagcatcctgttgagaacgatgttacccaaacggtaagtagctttagcttgccagcttcctccaggagcaagaagctgtgtgatgtgaccaccggactgaagatccatgtttcaatacccaaccgaatccctaagatcgtcaaggagggcgaagacgactactacaccgacggagaagagagctcagacgatggcaaaaagtaccacgtcaagagcaagagtgcaaaacccagtactaatgttaagaaaagcatcagaaagaagtactgtaaagtttcctcatcctcatccagctcgctgtcgtctagctcatccgggagtggcacagattgtctcgacgccggtagcgatagtcacctgtccgatagctcaccctcctcgaagtcttcaaagaagcacgtttccgggatcacactgctgtcccccaagcataaatacaaatctggaatcaaatctaccgagacacagccgagctcgaccacccccaaatgcggccactaccctgaagagtccgaggacaccgtcacagatgtttctcccttgtcaacccccgatatctcaccacttcagtcattcgaactcggcattgctaacgaccagaaggtaaaaatcaagaaacaggagaacgtgtcacaagagatttacgaggacgtcgaggatctcaaaaacaactctaagtacctaaaggctgccaagaagggtaaagagaaacacgaaccagatgtgtcctcaaaatcatctagcgtactcgacagtagcctggaccatagacataaacaaaaggtccttcacgacacaatggacttaaatcatctgctgaaggcctttttacaattagacaagaaaggacctcagaagcatcattttgaccagccaagcgtggctcctgggaagaattattcttttacccgggaagaggtgcgccagatcgacagagagaaccagaggttactaaaggagctgtcaaggcaagccgaaaagcccggatccaaatcgaccattcctcggagcgcagaccacccccctaaactctatcattccgccctgaaccggcaaaaggagcagcaacggattgaacgggaaaatctaactatatccttgtgtcacccgggttggtctgctgtgacctag

SEQ ID NO: 58651 - DNA, 342 bp, Artificial Sequence
  Description of Artificial Sequence: Synthetic coding sequence
gaagagcgagctgaatatactgcagacatcatctcaaccactgtcgcagagccttacagaacatgttttactgcaggcggaagcaagactagcccagttgaacagcaaccagaacagcagcagcctcaagacatcgtgtccctgcctctccctccactaccgcacgccactccagatcccttcaccctgtattcccacaggaccgagagcgcgggtggacacctgttcctgcctcaggatctgcgctggaaatcccccggtttgggagtatttgctgtacagtctgtatacgagttggctcgaagacataatgttagtcctttctactcgggtcccccttag

SEQ ID NO: 58652 - DNA, 1563 bp, Artificial Sequence
  Description of Artificial Sequence: Synthetic coding sequence
atggccggatgtaccaggaagttaacccatttgagaaaacgtatccacaggcctcgcaggaggacgacccggagatggaaaaggtggtttaaatttcggaagcgcaaaggtgagaagcggcctcggccaaaccacaaggctgtggctcgacgggctaagctgaaattttctacatctgaaaagctccactggcctgagcaggaacttgccaaaaaatccatccttaacgctgaggattccctgattattgataacaaacggagcataagccacttgtccagtggcgtactgaaggacattttcaccacggggacgtcgagttacaatgtacttttgcagtcaaaggaggagaaaaagtatcactcccagaagcagtcatcaagcacctactccaagcggtgccgcaaaccatccaaatcccccaacacatctagatccaaggaccctcgtagaatgaaagcacttgtcccagttacaagcagtggcacatggtactgcctcgagcgaaggcctgccgtcttcgttacttcaagcgtgagttccccagtgaagtttacccacgacatctcggttacggggaacgggatagtgttaccgcctaagcctaaaagcaaagtaaagtggtgtcacttttcaactctgccaaagcctaagccccagctgtctcgtagctttgagaagggtgacgactttagcggtaaaaagttttgcatactgactgctataaagccaacgaatctggaaaaggagaaactgagatttttcaagagcgactacacgtacaatccccagtttgagtatgcaaatcctgcccttccatctgttctcgccaagcattcccatgccagcgataggtttctgaagcagatagtagttcaccttaccgaggacttgttgagtcgggcttccatgacggtcgtgaacggatgcccaaccctgacaattaatgtttcaacagccagagagcactggctggaaggaatgctgaggcatgagatcggaacccattattttaggggcataaataacctgcaacaaccctggaattcatggacaggacgcaaaaagcacgagctgaagcctaacaacccaacagaggaaggcctggcatccatccattccgtcctgtttcgtaaggaccccttcctctggcgtgcggctctgctgtactatacagtttatcaagcttcacagatgtccttctgcgaactgttcaaggatatcggcagatttgtgaaagatcctaatacccgctgggattattgcgttagggccaagagaggttggacagatacatcccagcctggatgctttagcaaggatcaagtgtatctggatggcattctgcagatactgcgctatagagacaccatcgacttccatctcctgaccgccttggggaaggtcagttatgaagatgtggataggctcaaggggttagccgtaacagagaatatgagggtgccccacttcttacaagatcatggcagatacatggagcacttggaaaaaatcatggaggtcaacgagctgaccgatagggagctgaaagacctaatatag

SEQ ID NO: 58653 - DNA, 2748 bp, Artificial Sequence
  Description of Artificial Sequence: Synthetic coding sequence
atgccgaggggatcacgcgctcggggatccaagcgcaaacgcagctggaatactgaatgcccctccttccccggagaacggccactgcaggtgcggcgagcgggtctacgaactgctggcgctgccgcaagtctttctgaagcttggcttaggtgtggcgaaggattccagaacacctccgggaacccttcactgacagctgaagaaaaaacaatcaccgagaagcatctggaactctgtcctcggccaaaacaggagacaaccactagcaagagcacatccggcctcaccgacatcacatggagcagttccggttctgacctgtccgacgaggacaagacgctttctcagctccagcgtgacgagttacagtttatcgactgggagattgactccgatagagcagaggccagtgattgcgatgaatttgaggatgatgagggagccgtcgagatcagcgactgtgcgagctgcgcctccaaccagagcctcacctcggatgagaaactctctgagctaccaaaaccatcgtcaatcgaaatactcgaatattcttccgatagtgaaaaagaggacgacctggagaacgtccttttgattgactctgagagcccacacaagtatcatgtccagttcgcttccgatgccagacagattatggaaaggctgatcgaccccaggacaaaatccacagaaacaatcctgcacacacctcagaaacccacggccaagttccccagaaccccggaaaactctgcaaaaaagaaactcctgcgcggaggactggccgagcgactgaatgggctgcaaaacagagagagatccgcaatttctctgtggcggcaccagtgtattagctaccagaaaaccctgagtggccgtaaatctggagtcctgacagttaaaattctagagctgcacgaagagtgcgccatgcaggtggcaatgtgtgaacaattgctaggcagtccggcaacctcttccagtcaatcggtcgcccctagacccggtgccggacttaaggttctgttcacaaaagaaacagctgggtatctgcgaggtagaccacaggacacggtccgcatctttcccccttggcaaaaactgataattccttctggcagttgccccgtgattctaaacacttacttctgcgaaaaggtcgtcgccaaggaagacagcgagaagacatgcgaggtctactgccctgacattccacttcccaggcgctcaatctcattggctcaaatgttcgttatcaagggcctgacgaataacagccccgaaattcaggttgtttgtagtggggtggccacaaccggcaccgcctggacacacggccataaggaagctaagcagcgcattccaacatcaacacccctgcgcgacagtctgcttgatgtggtcgagtcccagggcgctgcttcctggcccggagccggtgtacgggtcgttgtgcaacgagtgtatagccttccttccagggatagtacccgcggtcaacaaggtgcctctagcggccacactgaccctgctggaacacgagcatgtttgctggtgcaggatgcttgtggcatgttcggagaggtccatctcgagttcaccatgagtaaggcaagacagctcgagggcaagtcatgcagtctcgtcggtatgaaggtgcttcaaaaggttacccggggacgcactgctggcatcttttctctcattgacactctgtggcctccagcgatccctctgaagacacccggtcgagatcagccgtgcgaggagataaaaacccacctcccgcctcccgctctgtgctacattctgacagcacacccaaacctaggccagatcgacatcatcgacgaggatcctatatataagctctaccagccaccagtgacaagatgcctgagagacatcctgcagatgaacgacctggggacaaggtgttctttctatgccacagtcatttatcagaaaccccagcttaagtctctgcttctccttgagcagagagaaatttggctgctggtcaccgatgttacactgcagaccaaagaggagagagacccccgactccctaagaccctcttggtctacgtagctcctctttgcgtgctggggagcgaggttcttgaagccctagctggagccgctccccactcactgttttttaaagacgcactgcgggaccagggaagaatagtgtgtgctgagcgcacagtgcttctgctgcaaaaaccattactctccgtggtatccggcgcttccagctgcgagctccccggtccagtgatgcttgattctctcgatagtgccactccagttaactcaatttgttcggtccaagggacagttgtgggcgtcgacgaatccacagccttcagctggcctgtgtgcgacatgtgcgggaacggccgtcttgagcagcggccagaagaccggggtgcattcagttgcggagattgcagccgagttgtgacgtctcccgtgttgaagcgtcatcttcaggttttcctggactgtaggagtaggccccagtgccgagtgaaggttaaactcctgcaaaggtccatctcaagtctgctgcgctttgccgctggcgaggatggttcctatgaagtgaagagcgtcttggggaaggaagtgggactcctcaactgtttcgttcagtctgtgactgcccacccaacaagctgcatagggctggaggagatcgagctcctgtctgccggtggggcatcagcagagcactag

SEQ ID NO: 58654 - DNA, 918 bp, Artificial Sequence
  Description of Artificial Sequence: Synthetic coding sequence
atggcttctcgtcagcccgaggttccggcattggaggcatctgcccctttgggcaaaatgagcctgcctattggcatctaccggagggctgtatcttatgatgacaccctggaagatcctgcacccatgactccacctcctagcgatatgggctccgtcccctggaagcccgtgattcccgagcggaaataccaacatctcgcgaaagttgaggaaggtgaggccagtctgccttcccctgcaatgaccctgtcttcggccattgactctgttgataaagttcccgttgtcaaagcgaaggccacacacgttattatgaactccctgatcaccaagcaaacacaggagtccatccagcacttcgaacgccaagctggacttcgggatgctggctatactccacacaaaggcttgaccaccgaggagactaagtacctgagagtcgctgaagctctgcacaagctgaaattgcagagcggcgaggtgaccaaggaggagcgccagcccgcaagtgcccagtccaccccaagtaccactccgcacagctcgcccaagcagcgccctcgcggttggttcacatccggatctagcaccgccctgcccggaccaaatccatcaacaatggacagcggttccggagataaagaccggaatctgtccgataagtggtctctgtttgggcctagatctttacaaaagtacgactctggcagttttgctactcaggcttaccggggtgcacaaaaaccatcccctctcgagctcatccgcgcacaagcaaatcgcatggccgaagatcccgctgcccttaaaccgccaaaaatggacatccctgtgatggagggaaagaaacagccaccccgtgcccataacctgaagccacgggacctgaatgtcctgactccaacaggattttag

SEQ ID NO: 58655 - DNA, 3213 bp, Artificial Sequence
  Description of Artificial Sequence: Synthetic coding sequence
atgtactgctgtagcgcccaggatagcaagatggattataagaggcgcttcttactcggtggttccaaacagaaagtgcaacagcaccagcagtatcccatgcctgagttgggacgcgctctctcagccccactcgcctcaacagccaccactgccccattgggatccttgactgccgcagggagctgccatcatgccatgccgcacacaacgccaattgctgatatccaacaaggcatttcgaaatacttggacgcactaaacgtgttctgccgagcctcgactttccttacagacttgtttagtaccgtgttcaggaatagtcattattctaaggctgcaacccagctgaaggacgtgcaggaacatgtgatggaggccgcttcaaggttgacaagtgccatcaagcctgagatagctaaaatgctgatggaactgagcgcgggtgccgcaaatttcacggatcaaaaagagttttctctacaggacatcgaggtactgggacgttgctttctgaccgtcgtccaggttcactttcaatttctgacccacgccctccagaaagtccaacccgtggcacactcatgtttcgctgaagtcatcgtcccagagaagaaaaactctggcagcggaggtgggctgtccggaatgggtcacactcctgaggttgaagaagcagtcagaagttggaggggggctgccgaagcgacctctcgtttgcgcgagagaggctgcgatggctgcttggcaggaatcgaggtgcagcaactgttttgcagccagtcagctgccattcctgagcaccagctgaaggagctgaatattaagatagattccgccttgcaggcctacaagattgcactggaatcactcggccactgcgagtatgccatgaaagctggatttcatctaaatcctaaggctatagaagcctcgttgcaaggctgttgctctgaggcagaagcccagcagactggtcggagacaaactcctccgcagcctatgcagtgtgaactgcctactgtgcccgtgcagattggatcacacttcctcaaaggcgtgtcctttaacgagtccgccgctgataacctcaaacttaagactcatactatgcttcagttgatgaaggaagcagggtgctataacggcattaccagtagagacgacttccccgtaaccgaagttttgaaccaggtgtgtccatccacatggcggggtgcttgtaaaacggcagtgcagctgctctttggccaagccggactggtcgtcgtcgacacagcccagatagagaacaaggaagcttacgctccccaaattagtcttgaaggaagtaggattgtcgtccaagtacccagcacgtggtgcctgaaggaagatccagctaccatgagcctcctgcagcggtctcttgatcctgagaagacactgggactcgtcgatgttctgtacaccgcggtacttgacctgaataggtggagggctggaagagaacaagccctaccgtgcattcaaattcaattgcagagggaaatttgcgacttcggtaaccaggctgaccttccttcaggcaatggaaacaagagctcagggggtctccagaaaactttttctaaactgactagtaggttcactaagaaggcctcgtgtacgagttcaagctcatcaacgaactactccatccagaatacgccttcaaagaatatctttatcgccggttgctcagaggagaaggccaagatgccaggaaatattgatacaaggttgcagtctattctcaatatcggtaattttcctagaaccacagacccttcccagtctgcccagaattccagcaacaccgttgcaaatggcttcctcatggagagaagagaaaactttctgcatggggatgacgggaaggatgaaaaaggcatgaacttgcccaccgaccaggaaatgcaggaagtgattgacttcctctcaggtttcaatatgggacagtcacaccagggcagccccctggtgacccgccataactccgctgcaacagctatggtcacggaacagaaggctggcgcaatgcagccacaacagccttcgctgccagtcccacctcccccacgcgcacctcaagccggtgcccacacccccctgacccctcaaccgggtcttgctccccagcagcaaagtcccaagcagcagcagccccaggtgcagtactatcaacacctgttgcagcctattgggccacagcagcctcctccacagccacgtgcacccggtaagtgggtgcatggttccagccagcagcctgcccaggccgtcggcgcagggctgtcacctctcggacagtggcccggtatttccgatttgtctagcgatttgtacagtttggggctggtttcatcatatatggacaacgtgatgtccgaagtcctcggacagaaacctcaggggcctcggaataacacatggcctaacagggaccagtccgacggcgtgtttgggatgctgggagaaatactgcccttcgaccccgcagttgggagcgatccggagtttgcgagatacgtggcaggcgtatcccaggccatgcaacagaagagacaggctcagcatgggcgaaggccaggcaaccccagaggaaactggcccccaatggatgatgctcaccgcacttggccttttccagagtttttcaccgagggtgatggcctccacggaggatggtcgggtgctcagggcgactctgcatcaagctccgacgagacttcaagtgctaatggagacagcctgttcagtatgttctccgggcctgacctggtggcagctgtgaaacagcgcagaaaacattcatcaggcgagcaggatacctccaccctcccttccccccctctcctgaccactgtggaagacgtgaatcaggataataaaactaagacttggcccccaaaagctccctggcagcacccctccccactgccatctacattaccctctccgtccgcgcctctgtatgcggtcacgtctccaggctctcagtggaacgatacaatgcaaatgctgcagagtccagtctgggccgcaactaatgattgttccgcagccgcttttagctacgtgcagacacctcctcagccccctccgcctcccgcacataaagccgcacctaaagggttcaaggctttccccggtaagggtgaacgacgccctgcatacctcccccagtactag

SEQ ID NO: 58656 - DNA, 4188 bp, Artificial Sequence
  Description of Artificial Sequence: Synthetic coding sequence
atgtaccccatttgcacggttgttgttgatgggctgccatccgagtcttcaagttcttcatatcccggtcccgtatcagtaagcgaaatgtcgctcctccatgcactggggccagtacaaacttggctgggtcaagagctcgaaaagtgcgggatagacgcgatgatatatactcgctatgtcctgagtttgctacttcatgactcctacgactacgatctgcaagagcaggaaaacgacatctttctgggatgggagaaaggcgcatataagaagtggggaaagagcaaaaagaagtgctcagacctaaccctggaggaaatgaagaaacaggcagctgtgcagtgcttgaggagcgcctccgatgaatcaagcggtatcgagacactagtcgaggaactctgtagccgtctgaaagacctacagtccaagcaggaggagaagattcataagaaattggagggatccccctctcccgaggcggagttgtcacctccggctaaggaccaggtcgaaatgtattacgaggcattcccccctcttagcgagaaacccgtgtgtctccaggaaataatgaccgtgtggaataaatccaaggtctgcagctatagcagcagttcgagcagctcaactgcgccacccgctagtactgacacttcgtctccgaaggactgcaactcagagtccgaggtcaccaaagagaggagctcagaggttcccaccaccgtgcacgagaagacgcaatctaagagcaaaaatgagaaagagaacaagttttcaaatggcactatagaggagaagccagccctctacaaaaagcaaattcggcacaagccagagggtaagattcgccctcggagttggtcttctggcagtagtgaagctggcagtagtagttccggaaaccagggcgaactgaaggcaagtatgaaatatgtcaaggtcaggcataaagcccgagaaatcagaaacaaaaaaggtcgaaatggccagtctagactgtctctcaaacacggcgaaaaggcggagaggaacattcacacagggtcatcgtcttctagctcttccggatccgttaagcagctgtgtaagcgaggtaaaaggcctctgaaagagataggcagaaaagaccccggttccacagaaggaaaagacctgtatatggagaaccggaaggatacggagtataaagaagaaccactctggtacacagagcctatcgccgaatacttcgtacctcttagccgcaagtccaaactcgagacaacctacaggaacagacaggatacgtcagatctaacttccgaagctgttgaggagctgtccgagtctgtgcacggcctttgcatatccaacaacaacctgcacaagacctacctggccgcagggaccttcattgacggccactttgtcgaaatgcccgctgtgattaacgaggacattgatctgacaggcacatctctgtgttccctaccagaagataacaagtatttggacgacatccacctaagcgaactgacgcatttttacgaagtagatattgaccagtcgatgttagacccgggagctagcgaaactatgcagggtgagtcaaggatccttaacatgataagacagaagagtaaggaaaacacagatttcgaggccgagtgctgcatcgtgctggacggaatggagctgcagggagaaagggcaatctggacggacagtacctcctctgtgggggcagagggactgttcctacaggacctgggcaacttggcccaattctgggaatgttgcagctccagtagtggagacgctgatggcgaaagtttcggaggagatagccctgtgcgtctctcacccattctggacagcaccgtgctgaactcacacctgctagccggaaatcaggagctgttttctgacattaatgagggatctggcattaattcatgcttctcagtattcgaagttcagtgctctaactccgtgctccccttttccttcgagactctgaatcttggaaacgaaaacacggattcatctgctaacatgctcggtaaaactcagtcccggctccttatttggactaaaaatagcgcctttgaggagaatgaacattgcagcaacttgtcaacaaggacctgttccccttggagccactcagaggaaacaagatccgataatgagacgctcaacatacagttcgaagagtccacccagttcaacgccgaggacatcaactatgttgttccaagagtctcctccaactacgtggacgaagaattgctggactttctgcaggatgaaacctgtcaacagaactcaaggacgctaggagaaattcccacgctcgtgtttaaaaagaccagcaagctagagagcgtgtgtggcatacagctggaacagaagacagaaaataaaaatttcgaaacaacacaggtgtgtaatgaatctccacatggagacggttattcgtccggtgttattaaagacatctggactaagatggcagataccaacagcgtcgccaccgtcgagattgaaagaacagatgcagagctgttcagcgctgacgtcaataattattgctgctgtctggatgccgaggctgagctggagactctgcaagaacccgataaggcggttaggaggtccgagtaccacctgtgggaaggccagaaggaatcattggaaaagagagcttttgcaagcagcgagctcagtaatgtggacggaggggattacacgaccccctctaagccttgggacgtcgcccaggacaaggaaaacaccttcatactggggggagtctatggcgaactcaagacgtttaatagcgatggtgagtgggcagtcgtaccaccgagccacacgaagggctctctgctccaatgcgctgcatccgatgttgttactattgcaggcaccgatgtgttcatgacacccggaaattcttttgcccctggtcacagacagttgtggaagccctttgtctctttcgagcagaatgatcagccaaaatccggcgagaacggattaaataagggcttcagctttatattccacgaggatctgctcggagcctgtggtaattttcaggttgaagacccgggtctggagtacagtttctccagttttgaccttagtaaccctttctcgcaggtgctgcacgtggaatgcagcttcgagcccgagggcatcgcctcattcagcccttcgtttaagcccaagagcatcctgtgctccgactccgactccgaggtcttccacccaaggatctgcggtgtggacaggactcagtacagagccatccggatttcacccaggacccattttaggcccatctcagcatctgagttgtctcccggaggcggttcggaaagcgaattcgagtcggagaaagatgaagcaaacatcccaataccgagtcaggtggacatattcgaggatcctcaggccgatttaaagcccctcgaagaggacgccgaaaaagagggtcactattatggcaagagcgagctggagtcagggaagttcctcccacgcctgaaaaaatcggggatggagaagtctgcccaaaccagtttggactctcaggaggaaagcaccggaatactgagcgttggcaagcagaaccaatgcttagaatgctctatgaacgaatcccttgaaatcgatcttgaatcaagcgaggcaaattgcaaaattatggcccaatgtgaagaagagatcaacaatttctgtggctgcaaagctggctgtcaatttccagcttatgaagataaccccgtgagctctggacaactggaggagtttccggtactgaacacagatatccagggcatgaatcgatcccaggagaagcagacatggtgggagaaggcactgtactcaccacttttcccagccagtgagtgcgaagaatgttatacaaatgcaaagggcgaatctgggctggaagagtaccctgatgccaaagagacaccatccaatgaggaacgactactcgacttcaacagggtctcctcagtttatgaggctaggtgtacaggggagcgcgattcgggagcaaagtccgacggatttcggggaaagatgtgcagctctgccagcagtaccagcgaagagacaggctcagagggtgggggagaatgggtcggtccgagtgaagaggagctcttctcaaggacacatttgtag

SEQ ID NO: 58657 - DNA, 5228 bp, Artificial Sequence
  Description of Artificial Sequence: Synthetic coding sequence
atgtggcctgcgggtgctgggacaaagctcccttgcccgagagacagcgccctgagacgtgccgcattttcaggcaaccttaccgccttgccctcccatctggtgcccgctggtcgcagtgtgagggtctttatttcagctaaccctgaagacaccggagctgaaagacaggccttgcgtgaaaatgtgtaccccaaactaagagaattctgtcgtgagaactacggcctggaattccaggtcattgacctatactggggggtcgaagaagacgaatgggattctcctgaactccaaaaaacacgtatgaagttgctggaaaactgtttaaagacctctgccggaccttgcttcgtggggctgctcggagaaaagtacggaaatatccgcattccaggggaagtggaggccagcgaatttgagatgatcctggacgcagcaatcgaagccaaactggaaactaaactgctcgaagaatggtattgccgggatgagaattctgtgcctgcggcatattatttgcggcctaaaagcgagatgctaagatctaacaggaacgccatgcaacctagtactaacgctgagaatgagaaaacctggcaagaaataagcgacgaaattaagaagatctttaaagccgcagttaaattgctccacgaaaaggggaaaatgaagcacagtcaggctaaacggtatctcttttcggccattgaagacgaatttgactttgccctgggcaaacagacgcctgccttcctcaagaagtgtgtgtgctacatccggaaaatagcaaacatcgagagatttgtgaagatccctgaaatgggcaagtatatggacattaccggtactgagccccgtattattcgcgacccagaggcacaagaaaaactgataaaactacgggacgagttcatccctactattgttgcctcctctaacttgagggtctataccagcgtgacacattgtgatatgaagctcggctattctcaagaaatcgagaatcactatattgaagggcttggtaagcagttttacgaggatatgatcgacatcattcaggccacaatccagcagaatttcgacacagagaccgacactctttatgatgaaatcctccagcactcttcactgtgcaagacttacgcaagtttctacgagtataagtgtgaaagtcttaatatagttcacaactacatactccccagtaaagccggacatattaaccccctcattatatatggcggaccttgcactgggaagaccttattgcttgcggaagtggccaaaaaggcgtatggatggctccatgaggataccggcccagaaagtgaccccgtggttatagtgaggttcttgggcactacagatatgtcatcagatctcagaaccctgctcctgtccgtctgtgaacagttggctgttaactaccgatgtctggtgcaatcctaccccaagaagatccacgatctgtgcgatctgtttattaacttgttaaatgaatcctccttacaacgcccactagtgatcatattcgacgcgctggaacagctttcggaaaacgatgatgcgcgtaagctttggtggctcccagcccacttgcctcgcttcgtacggatcgtactgagcacactgccaaataagcacggcatcctgcagaagctccggtgtttgatccatgaagaggataattacattgaactcatccctagggacaggaagatgtgtagtcaggttctgaagcaccagctgcttcgtgtcaaaaggaaagtgaccagcggccagcagatttatgttaacaacgcactcagtaaatgcaccctgcccatgttcgtaaacctgacattccgtgaagtgaggcattggaggtcacacaaagacgtggacgaaagctcactctccgtgaccgtgcacgagagcatcgaacagctgttttggtccttggagaagaagtgtggtcagaagctggtgagccgcgcactgggctatataactatggcaaaaatgggactcagcgaaatggaattggaagatgttctggcccttgacaatagtgtaatgtcggagctaaaggaaaacacccgcccttctaaccccttgcgagtgccctacttgtacatagctcgtctcaaagaaggtctctctgggtacctgattgaacgacacgtgaagaacgtgaccctgctagtgtgggcaaaccgccatctgcagctaatcgctcagaaactgtacctacaggacgacaacgaccttagggagatgcatactatattggcagactattttttaggtgtgtggtccgggggtcgtcgtaaagcattttgtttggaggatccctacctcaatggctgcttggatctcgaaaacagaagcctgttagaagaagaaaaacacttcatggagcaagcatcttttgatcgacaagctcccgatcagccctgggttttccagtgtaaccccttggagcccgacatcttcttcgttaatcatcgaaagatgtccgaactcctgtatcatttaacccggtgcggtaaaaccgacgaccttctgtacgggatcataatgaactttagttggctgtatactatgataaagattggccagtttgataaggtcctgtccgacatcgagttggcctacaactatagtcaggagaaggagctgaagtttctcgccaatacactgagatcaataaagaataaggtgacagcctttcctggcagcctcagtgccgagctccaacagcgtctcctgccagttgtgagcagcctgccaaaattacggcacttgctgctggagtgtgacaaggacgggcctaagtattgctccatcgttcccttacatagctctatggatgtaacgtattcccccgagcgtcttccgctgtctagtagccacctgcacgtgacagaaatcctaccaacatgcaaccctagtaccgttttgacagcgctcgaaaatgggtccatctccacctgggatgtcgagacacgccagctgttgcggcagattaccaccgcccagtcggtcatactgggcatgaaattgaccagtgatgagaaatacctggtcgtggccacaactaataacaccctcctcatttatgacaatgtgaattcttgcttgttgtcggaagtggaaataaaaggtaccaagcacggatcttccgccacgtacataaatggcttcacactgtcggccaaccatgctcttgcttggctcgaagcctctaaggatgtaaccgtcatcgacctcctctacggctggccactttaccagttccactgttggtatgaagtgacttgtgtgcagtgttcactagacggactctatgccttctgtggccagtacctgaataccaccacgatttttcacctcgggagtggtgaaaagctgtgtacagtcacctccgagttctctggtggctttgtgaagttcttactgattttggataccgcccaggagatggtgatggtggattccgaggggtctctatcagtgtggaacactgaggacatctcgtcacctcagctgaccgatgattttgattgtcgcagagaggacagcgaagtcgtctcaatcgaacttagcgaggatcaatcggccgtgttgatctgtaaggcgctctcaattgaactactggataccgggctgtggaaagtggctgagaagttcagagccaagcacaacgagcgttttataagcgccgtactgagtaagaacggcgattgcatcatagcaactatggagaacacttctgcagtgttcttctggagacgggacacaggtcagtgtatggccagcctgcaggagattagcggttctatagttaagcttgttaagagctcacaccataatatgttactgtctctaagcacatccggggtgctttccatctgggacatcgacattattactgcaatgagtaatatagacaaaacagggaaacccatccagagtttactgctgcctgctcgtggggaaatcatctacagtctcgacggcagcgactgtgtccacaaatggaatttctccagcggttttatagaggcggtgtttaagcatgaaggcattgtggaacattgcgttttgaccagtacgggcgatataatggttaccagtgacgacaagagctctcagtatgtatggcatacttcatctggtgaaaacctgtttcggatcaacggccagcgcatttcccagttgctcattactcacaacgatcagttcgtggtgagcctgtgtgaggaaaatgctagtagagtgtggcgactggcgaccggccatcgagtttgcaacattttgacgactcttcagaatgccttcatcactagtgctaatacttttgtcgttggaatgaccaagagtaaagtgctagcagtgtccctttggacaggatccatcacgaagaagttttgttgtgaagatggcacgactatcgtgaactttaagcttattcctgattgccctgacataatcgtctttatcacatcagcggagactgtgaatatttggtcgctgaccgatgaggtcatatgccgaagggttcagctcccaaacaattttctaaaaaatttagaggactttgagatatcacctaacgggaaactgggtataattgccagaggtgacgagaacatcaatgtgctggacctttactccggcaaattgagagtcgttcacgcaagtggcattatatggaggcagaggctgtctcgcgatggaagatacttagtgtatatctgcttccggaacggtgaagaggaggacgagaatggagctatcttttcgctcatagttatgcgcctcgcggacggcaaaaatattggcgcatgcagcctgtacaaaacccctacctttctggcgttgtcacagcgccacctgaatatcatcgtgggtttcgacgacggatctatcgggatctacacagtagttgatcgggtggatgccgcactgaaaatcaagattgcgactagcaattctaggcagatctttaataatgcaactcacacatcacgccctaagtgcaactcctactgtttcaaaattagcgtagactgcctgtggcgcgaatcaactgaggtgtttgcaagagactcgcctataactgtgagtgactctaccgagtccaatgaggcaactcccagtaaaaaacacaactcttgctatgagagagtgtgttcagcgctggaagccagaggccacagttacgccccagacaacta

SEQ ID NO: 58658 - DNA, 348 bp, Artificial Sequence
  Description of Artificial Sequence: Synthetic coding sequence
gtaagcggcggtgtccgtctgcctgcctcagaaagaaggtttctgagctgctgcccactccctgccaggccactgcttcaacggttggcctcccggcaccccgcatctctgccttgctcacagcagcttctgtggcgcagctccagagcccctcccctactgccgagcctgcccctaggtgtgctcattactgacccactaactagacaccccggacaccatcatccggctccatttcattccgcggcactacttgtccccgtcaagccccctacagcttgggagggtaagtctcgactggccagaccatgccttagccaagctctcgaggcttgtcagcttacatag

SEQ ID NO: 58659 - DNA, 585 bp, Artificial Sequence
  Description of Artificial Sequence: Synthetic coding sequence
atggctgctaaaagcactcaggatagcttaccgagggatacaggagagccctcagcattgcccgtgcaagggagagctgagggccgttcctccgaaggcaggaaggaaaggaccgcagagtgcgcactcaggggtaagcaggcctccgagccggctctccggaaacgcaacttccttcctggccctaactccgacacagttagacccgcagccgaaacagagctcgtgccatgttccttaagacatcctaggcaggacttgtgcggtgagcatccaagctttcccgtgatgcagccaagccttgagacccaagccaaacccgagcgggaccgggcagtgctgatccctcctaaaggcccttggccacctgcccagggcttggccatgaggacacattgccctactggccctccttctaaagcctattgccggggaggctcatcttccacaagcagaaaccaggttgccagcctggcgtacagaacacagaatactgcagccagccagccacgacagcccggtggcagaggaaaagaggacaccgccggttacggctcgtgttcacctagatccctagcagtgtag

SEQ ID NO: 58660 - DNA, 2817 bp, Artificial Sequence
  Description of Artificial Sequence: Synthetic coding sequence
atggattgggatgatgaatacagccacaactctttcgacttgcattgtctgcttaacagctttcctggagatctcgagttcgaacagattttttccgatatcgacgagaaaattgaacagaatgcggcatccataaagcactgtataaaggaaatccagagcgagattaacaagcaatgccctggcgttcaactacagactacaacagactgcttcgaatggcttacaaactacaactatagcacttcagaatcctccttcatctcgcacggagatcttatcaaattttttaaaactctgcaggatttgttgaagaacgagcagaaccaggaagagatgacgctggatttactctgggacctctcctgccatagcagcgtcagttttccttctacactctctgggacctcctttcacttcctgtcccgcacctccctgcattccgtggaagacaattctagtatggacgtaaaatccatgtgggatgatattagactccatctcaggcgattcctggtgagcaaactgcagagtcacaatgagatcaataattcacagcagaaaattcttctgaagaaacaatgtctacaacagttactgtttttgtatcctgaatccgaagtgattataaaatatcaaaatatacaaaacaaactactggccaacctcctctggaactgcttcccctcatacaatcgggattcaaatttggatgtcatcgctcacggttatcagtccacaatgctgaagctctacagcgtgatcaaagaagacttcaacaccctttgtgagattctcgctccttcttccatggtgaaatttataaaggagacctatctcgatactgtcactgaggaaatggccaaatttctcgagaacttttgcgaactacaattcagggagaacgccgtgcgcgtggtaaagacctcgaaatctagctccaaacaccggggtgcagttcatgctctggttaccaccgaatgtccacaaaaaggacgtaacttctctctcccactggataaggtggaattcctttcacagcttatcaagtccttcatgaagctggagaagggagtccaagaactgttcgatgaaatcctgcttagccttaagattactcgggacactagcggcatactggagaaatccgatagagaggtggtcatggaaaagccaagagcgaacgaaaccaatatcccctccgaacagtccctgcctggcaaagaggcaactctcctggattttgggtggcgatcggctttcaaggaagtctctttgccaatggctcattgtgtcgttactgccatcgaagggttcagcactaagattttacagcaggaacagaacgagaggagcagtgcagtgtcgtacgcaatgaacctggtgaatgtacagcaggtgtggcaagactctcacatgtttcccgaagaggagcagccaaaaaagattgggaagttctgttcagatattatggaaaagctggataccatgctgcctctggcactggcctgccgggatgatagcttccaggagattcgagctaacctggttgaggcctgttgcaaagtagcaaccgcagtccttcaacgcctgcaggagcgtgccaaggaagtgccgtcaaaggcccctcttaagaacctgcacacctacctgtccacggccgtttatgtgtttcagcattttaaaaggtacgataatttgatgaaagagatgactaagaagccgatatttctcgttttggtacagagataccaggaatttataaacactctgcagttccaggtgacaaattattgtgtgcgggtctgtgctacttctatcctccaggacgccgaatcccatcactgggatgactacaaggccttctatgagggcgagcggtgtagtttcagcatacagatgtggcactacttttgctggagcctgcattatgacctgtggaccattctgcctccaaaacttgctcaagaaatcttagttgaggtgctggaaaaaagcctgtctctgctggcgtcccggtatgccagggctcacccatcccgcaaaaggactccacagttgcgactggatgtgacgaccatcttgatctgcactgagaatatgctgtggtcagtctgcacctccgttcagaaattactgaacccgcaccaacatacagatgacaagatctttaaaatacacactcactgtaataacctgttcacgaccttggtcatccttacaagtccactcactgagctgtacaagacgttccaacacggcctggatgagtccgccagcgactctctaaagtccttcttcaaacagcctctgtactgggtgagctgtatctcacatttctacccgagccttttgagaacgccttcagctgggggactcaaggcggaaggccagctcaaattactgttatcccaacctcgatgcaactggaacctcctgctcgagaccctgctgcatcatgatggtctgctgcttaggatcctgctgaagagctctaagagaacttttcaagaacaagtctctgatacagagaataatctgaaccaggggccatctctcatggaagctatctttaagatactctaccattgcagtttttcaccgcagacttttgcaaacgtgttcgtcagctatatggaagaggaacaactctgggatttcctatataatatcccgggaatgaggcacctgctgttcgtgaaggaaatgttctatagatatctgtacgtgcctctcaaaatgttccgtagttgtattgatacgggcttcgctgagtccgtggttggtgaatctctgccctatattttcagcgtctag

SEQ ID NO: 58661 - DNA, 480 bp, Artificial Sequence
  Description of Artificial Sequence: Synthetic coding sequence
atgcgcaatgccagatccatccgacccgctcgagccgagtcatggcgactgtcactctgcttccttaactggcaggatgcgatcattagcaagccccactgtcctgctgggagaacttgcccaacagcggctgccagtcatgggagcagaggagccggacatagtgacaaggatcagggccgatccccgaaacatgttgtgtgccatgttgaacacaaaaagcagtgtcctgccgaatttacagactctcggggagttcataacgctgccgctagcatatcctcacaggttggctttcctgggcatctgacagcaaggactgctgcccacaaaagggaggcattggcggtgagtcccaccccaacgctccaagtgaatgcccctggcgctaagctgcgcgctcctaaggcacctagaacaccggaagcattgggacgaggccctaagcgcgctggggagtggaaaacagggtgcttttag

SEQ ID NO: 58662 - DNA, 3240 bp, Artificial Sequence
  Description of Artificial Sequence: Synthetic coding sequence
atggacgatgatgatgacagctgtttgttggatctgattggcgatccccaagccctcaattattttcttcacggcccttccaataagtcctcaaatgacgaccttacgaatgccggatattccgccgctaattcaaattcaatcttcgccaattcttccaacgcagaccctaagtcttctctcaaaggggtctcaaatcagctgggtgaaggcccttcagacggtctgcccttaagttcaagccttcagtttttagaggatgagctcgagagcagtccacttccagacctcacagaagatcagcccttcgacatcctccagaaaagcctgcaggaggcaaatattactgaacagaccctggctgaggaggcatacctcgatgcctcgataggctcttcgcaacagtttgcccaggctcagctgcatccatcctcatcggccagctttacacaggccagcaacgtgagtaattactccggacagacattgcagccaattggagtgacccacgtgccagtcggggcatcctttgcgtcgaacacggtgggagtgcagcacggattcatgcagcacgtaggcatttctgtgccgtctcagcacctttctaactcatctcagattagcgggagcggccagattcagctgatagggagctttgggaatcatccgtccatgatgacaatcaacaatctggacggtagccagatcatcttaaagggctccgggcagcaagcaccaagcaacgtgtctggcggactgctggtccaccgccagaccccgaacggcaattccctatttggtaactcatcctcgtcgcccgtggcacagccagttacggtgccatttaactctacgaatttccagactagcctgcctgtccacaatattataatacagagagggctggccccaaactctaacaaagttcccattaatatccaacccaagcccattcaaatggggcagcagaatacatacaacgtgaataacctgggaatacagcagcaccatgtgcagcagggaattagctttgcttcagcctcatcaccgcaaggctctgtcgtaggaccacacatgagtgtgaatatagtcaatcagcaaaatacacgcaaaccagtgaccagtcaggcagttagcagcaccggcggatccattgtgatacatagcccaatgggccaaccccacgcaccccagtcacaattcttaattcccacgtccctgtccgtttcatctaactctgtgcaccacgtgcaaaccattaatggccaactcttgcagacacagccttcgcaacttatcagtggccaagtggcaagcgagcacgtcatgctgaaccgaaatagctcaaatatgctgcgcacaaaccaaccttataccggtcctatgctcaataatcagaacacagcagtgcacttagtgtctggccagactttcgctgcgtccggttcaccggtgattgcgaatcacgcttcaccccagttagtggggggacagatgcctcttcaacaagcttcacccacggtcctgcatctgtcccccggtcaatcatctgtctcccagggccgacccggttttgctacaatgccttcggtgacaagcatgtctggtcccagccgctttcctgctgtgtcttcagcgagcactgctcaccctagtttgggctctgcggtccagtctggctcatccgggagcaacttcacgggcgaccagctgacgcagcctaatcgcacccccgtgcccgtgtccgtgtcccatcgcttaccagttagctcctctaaatccacatctactttctccaatactcctggaacaggcactcagcagcagttcttctgccaggcccagaaaaagtgtttgaatcagacctccccgatcagcgcacccaaaaccacagatgggttgaggcaggcccagatcccagggctgctatccactacacttcccggacaggacagtggttccaaggttatcagcgcttcactgggtacggcccagcctcaacaggagaaagtggtcggcagttcccccggacaccccgcagttcaggtggagtcccactcaggcggtcaaaagaggcccgctgcgaaacaactgaccaaaggggcattcattctacaacagctgcagcgggaccaagctcacaccgtcacacctgataaaagtcatttcaggtccctgtctgatgctgtgcagcgattgctcagctaccatgtctgccagggaagcatgcctactgaagaagacctgaggaaagtcgacaacgagtttgagaccgtggccacccaacttctgaaaagaacacaggcaatgttgaacaagtacaggtgtctccttctggaagatgcaatgagaatcaatccttctgcggaaatggtgatgatcgacagaatgtttaaccaagaagaaagggccagcctgagcagggataagcgactggctcttgtggatcctgagggttttcaagctgatttttgttgctcttttaagttggacaaagccgcacatgaaacacagtttggcaggtccgaccagcacgggagcaaagcctccagctcattacagccccctgcaaaagcgcagggcagggatcgcgcaaagacgggcgtaaccgagcctatgaaccacgaccagtttcatttggtccccaatcacatcgtggtgagcgcggaggggaatatttccaaaaagactgagtgtctcggacgggcattgaagtttgataaagtaggtcttgtgcagtaccagtccacaagcgaggagaaagcctcccgcagggagccattgaaggcttcccagtgcagtccagggcctgagggccatcgcaaaacctcttcccggtcggatcatggtacagagtcaaaactgtcctctatcctcgcagacagccacctcgagatgacctgtaataactcattccaagataaaagcctgaggaactcccccaaaaacgaagtacttcacaccgacattatgaaaggaagcggagaaccacagccggacttgcagctgactaaatccttagaaacaacctttaagaacatcttagagctaaaaaaggccggtcgtcagccacaaagcgaccctacggtatccgggtctgtagaactggactttccaaatttttctcccatggcctctcaggaaaattgcctggaaaagtttatcccagatcactcggagggcgtcgtggagaccgactccatcttggaagctgccgtcaattcaattctcgagtgttag

SEQ ID NO: 58663 - DNA, 1566 bp, Artificial Sequence
  Description of Artificial Sequence: Synthetic coding sequence
atggaagcctccgtcttaagccctaccagctgggagaagagacgtgcctggctccgccagtctaggaattggcagacacaagtcctagaggaagaggcagcggcagcattgcaggacgtacccgacccagagccgagcagcctggatgacgtgtttcaggaaggcaacccaattaataagatcgaggattggctccaggattgcggctatagtgaagaaggttttagcgaagaggctgggcaattcatatataatggcttctgtagccatggcacttctttcgaagatgaccttactctcggagctgaagccacgctcctcgccgctaatggtaaacttttcagtaggtccttccttgagacggcccgtccctgtcagctgctggacctggggtgctccctggcgagtagctccatgacaggaggtactaataaaaccagtagcagcatttccgagatactggacaaagtgcaggaagatgcggaagatgtcctcttctccctcgggttcgggcaggaagatcataaggacaccagtaggatccctgccaggttttttacgaccccgagccaggcgaaaggaattgatttccaattgttcctgaaatcccaagtgcggcgaattgaaatggaggatccatgtctaatgctcgcctcaagatttaaacaggtacagaccctggcagtcaccgcagacgcttttttttgtttgtactcatacgtgagcaagactcctgtccagaagttcactccgagccatatgttctggaactgtaatcatccaacggatgttcccagcatccgaatactgtctagggagcctgagcctcagtcccctagagacaggctgcgcaaggctatctccaagatgtgtctatacacatgccctcgagacagaccccctcccccacacaatacaccaaagaggaacagcctggaccaagtcgtcctggaagtgatggacaaggtgaaagaggagaagcagttcctgcagcaagactccgacctaggtcagttctcacaggaggatcccgtgcctccagcggagggaaagaaactgcccacatcaccttacccctgtgttttctgttgcgaggaggaaacccagcagcgcatgtctaccgtcttagccccatcacaaaccctcgacagcaatccaaaggtaccctgttgtacccacagcctgcccatagaggatcctcagtggtctactgaccccgcacaaatccgtagagagctgtgttccttacccgctacaaatactgaaactcatcctgctaaggacgagaccttctggaagaggaagagcagggctcgcaaatcactcttccagaagaatcttatggggcgtaaggtgaagtcgcttgacctgtccattacccagcagaagtggaagcagagtgtggatcgacctgaactaaggcgttccctcagtcagcagccgcaggatacttttgacttagaggaggttcagagcaacagtgaggaggaacagagccagtctcgttggccaagcaggcccaggcaccctcaccaccaccaaacttttgctggaaaggactcctag

SEQ ID NO: 58664 - DNA, 372 bp, Artificial Sequence
  Description of Artificial Sequence: Synthetic coding sequence
atgccagacgccagcttgggatctctgggcattacctggtgtttcctcgaatcccccctggaggtctcaagcggcagatttggattggcgaggctgctgggcagccaggaccatggcgatgaccctgcagaacggggaaggactgctacagacgcctggggtccgagccggtggggacagagccctggaaacggcggaggttattgcgacgccagccctccttcggcccttgcacccggagatagagcctgggccctgccggctagccccagctccggagctcccgctagtcaacattgttgccttgagaaagctggcactcgcacaaaggcaagtccagtgtggggcagggacgggaacacctggaactag

SEQ ID NO: 58665 - DNA, 1410 bp, Artificial Sequence
  Description of Artificial Sequence: Synthetic coding sequence
atgctggagtccattagagtcaccgaaaagcttcactggcctgaacaagagctggccaagaagtccatccttaatgctgaggattcccttatcatagataacaagcgctccatttcacacctctcgagtggtgtcctgaaggacatcttcacgaccggtactagcagttacaatgtcttgctccagtcaaaggaggagaagaagtaccacagccagaaacagtcgtctagcacctactcaaaacgctgtcggaagcccagtaaaagtcccaacacatcccgaagtaaggatcccaggagaatgaaggcgttagtcccagtgacctcctctggcacgtggtactgcctcgagaggcgaccagcagtgtttgtcacttcatctgtgtcctccccagtgaagtttacccacgatatatcagtgactggcaatggtattgtgctcccaccaaaaccgaagagcaaggtgaagtggtgccacttttctaccttgccaaagccaaagccacagttgtcaagatccttcgagaaaggagatgacttttctggtaagaaattttgcatcctgaccgctatcaaacccaccaatcttgagaaggagaaactgcgattcttcaagagcgactatacttacaatccacagtttgaatatgctaatccggctttacccagcgtgctcgccaagcatagccatgcgagtgataggtttctgaaacagatagtggtccatctcacagaagacctgctgtctcgcgctagtatgactgttgtcaatggctgtccgaccctcaccattaacgtcagcaccgcacgagaacactggctggaaggaatgctgaggcatgagatcggtacacactacttcagggggatcaataacctgcagcaaccgtggaactcttggactggtcgaaaaaaacacgagctgaaaccgaataatcctaccgaagagggtctggcttccattcacagcgtgctcttcagaaaagacccctttctgtggagagccgcactgctgtactacacagtctaccaggcctcccaaatgagtttttgcgagctgtttaaggatatcggtcggttcgtcaaagaccccaacactagatgggactattgcgtgagagctaagcgcggttggactgatactagtcaaccgggatgcttttccaaagaccaggtgtatctcgacggtatactgcaaatcctgaggtaccgggataccatcgatttccacctactgacagcccttgggaaggtgtcttacgaagatgtggaccgcctgaaggggcttgccgtgactgaaaacatgagggtgccccacttcctacaggatcatggacgctatatggagcaccttgagaaaatcatggaagtcaacgaattgaccgatcgggagctgaaggacttgatatag

SEQ ID NO: 58666 - DNA, 69 bp, Artificial Sequence
  Description of Artificial Sequence: Synthetic coding sequence
ccttcaagcacccagtatcatgtgttagcttgcctgcacttacttgtggtgccttgcttggcctggtag

SEQ ID NO: 58667 - DNA, 3933 bp, Artificial Sequence
  Description of Artificial Sequence: Synthetic coding sequence
atgttgctcaacggagactgccctgagtcactgaagaaagaagccgcagccgctgagcctccgagagagaatggattagacgaagccggacccggtgatgagaccactggacaggaggtaattgtgatccaggacaccgggttctcagtgaaaattcttgccccaggcatcgagccattcagcctgcaggtgtccccacaagagatggtgcaggagatccaccaagtccttatggatcgggaagacacctgccacaggacctgcttcagtctacacttggacggcaatgttctggatcatttcagcgaacttaggtctgtagaaggcctgcaggaagggtccgtactgagagtggttgaggagccatacaccgtcagggaggccagaatccacgtcagacacgtgcgagatctgctgaagagcttggatccatctgacgcatttaatggtgtggactgcaattccctgagtttcttgagcgtgtttaccgatggagacctgggtgatagcggcaagagaaaaaagggactggagatggatcctatcgattgtactcctccagagtatatattgcctggatcccgggagaggccactgtgtccactgcagccgcaaaatcgtgattggaagcccttgcagtgcctgaaggtgttaaccatgtctggctggaacccccctcccggaaacaggaagatgcacggagacctcatgtatctgttcgtgataacagcggaggacagacaggtgtccatcacagctagcaccagaggcttctacctgaaccagagtacggcttaccatttcaatcccaagcctgcgagtccacgctttctctcgcactccctcgtggagctactgaaccagatcagccccacatttaagaaaaactttgctgtgctgcagaagaaaagggtgcaaaggcatccgttcgagcggatcgccactccattccaggtttacagctggaccgcgcctcaggctgagcacgccatggactgcgtgcgtgcagaggatgcctatactagtaggcttggctacgaagagcatattcctggtcaaacaagggattggaacgaggagctacagacaacacgcgagctcccccgtaagaacctgccggagaggttgctgcgcgagagggccatcttcaaagtgcatagtgatttcaccgctgccgctacgcgaggagcaatggcggtcatagacggaaatgtgatggccatcaaccccagtgaggaaactaagatgcagatgttcatttggaacaatatcttcttttcactcggcttcgacgtcagagaccactataaggacttcggcggagacgttgccgcttacgtcgcaccaaccaacgacctcaatggcgtaagaacctacaatgctgtcgatgtagaggggctgtacaccctgggtacggtcgtcgtagattataggggatacagggtgactgcccaatccattataccaggtatcctggaacgggaccaagaacaaagcgtcatctacggaagcatagacttcgggaagacagtcgtttcccatcccagataccttgaacttctggaacgcacaagccggcctctcaagattcttcggcaccaagtgctcaacgatagagatgaggaggtcgaattgtgctcctcggtcgagtgcaaggggataatcggaaatgacggccgtcactacattttggatctgctgcggacgttcccacctgacttgaacttcctccccgtgccgggagaagagctgccagaggagtgcgctcgggcagggtttcccagagcccataggcacaaactctgctgtctgcgtcaggagttagtcgacgcttttgtagaacaccgctatctcttgtttatgaaacttgctgcgctgcagctgatgcagcagaatgcctcccagttggagaccccgtcctccttagagaacggtgggccatcaagccttgaatcaaagtccgaagacccgccaggacaggaagccggatcggaggaggagggaagctccgcatctgggctcgcaaaggtcaaggaattagcagagacgattgctgccgacgacggtactgacccacgctccagggaagtgatcaggaatgcatgcaaggcagtgggtagcatctcatctacagcattcgatatccgctttaatcctgacatcttctctcctggacgggttaggttcccagaatcttgtcaagacgaagtgagggaccagaaacagttgctgaaggatgccgcagcattccttctgtcctgccagatacctggactcgtgaaggactgtatggaacacgccgtgttaccagtcgatggagccactttagcagaggtaatgcgccagcggggtataaacatgagatatctgggtaaagtgctggagcttgtgctgagatctcccgctcggcatcagctggatcacgtattcaagattggaatcggcgagctgattacccgatccgcaaagcacatcttcaagacctatcttcagggggtcgaactttccggtctgtccgccgcaatcagccactttctgaattgctttctgtctagctacccaaaccctgtggctcatctgcctgctgatgagctggtgagcaagaagaggaataagcggaggaagaaccgccctcctggagcagccgacaacaccgcatgggctgtgatgaccccccaggagctgtggaaaaacatctgtcaggaagcaaagaactactttgattttgatctggagtgtgagacagtcgaccaagcagtggagacatatggcctccagaagattaccctgctcagggagatctccctcaagactggcatccaggtcctacttaaggaatactcctttgattcacgtcataaacccgcattcaccgaggaggatgttctcaacatctttcccgtggtcaaacacgtcaaccccaaggccagcgatgcatttcatttttttcaatccggccaagccaaggtacaacagggctttctgaaggagggatgcgagctcattaacgaagctctgaacttatttaacaacgtgtacggcgctatgcatgtagagacttgcgcctgccttaggctgttggcacgactgcattatatcatgggggattacgccgaggccctctccaatcaacagaaggccgttctgatgtctgagcgggtgatgggaacagaacacccaaatactatccaagaatatatgcatctcgccctctactgttttgcaagctcccagctgagtacggccctatcactcctttatagggctagatacttgatgttgttagtctttggggaagatcatccggaaatggccttgctggataataacataggactggtactccacggtgtcatggaatacgatctgagtcttcggttcctcgaaaatgccctagccgttagtaccaaatatcacggaccgaaggctttaaaggtcgccctcagccaccacctggtggccagggtgtacgagtctaaagccgaatttaggtcagccctccagcacgagaaagagggatacacaatttacaaaactcaactaggggaggaccacgagaagactaaagaatcaagtgagtacctgaagtgtttaactcaacaggcagttgcgctgcaaaggacaatgaatgaaatttacaggaatggctcaagtgcaaacatccccccactgaagtttacagcgcctagcatggcctctgtactggaacaactcaacgtgattaatggcatcttgttcatcccattatcccagaaggaccttgagaaccttaaggcggaggtagcaagaagacaccagctgcaggaagcatcgcggaatcgtgatagggcagaggaacctatggctactgaacccgctcctgcaggtgcacccggagatctgggcagccagccacccgctgccaaggatccgtcaccttctgtgcaaggctag

SEQ ID NO: 58668 - DNA, 1518 bp, Artificial Sequence
  Description of Artificial Sequence: Synthetic coding sequence
atggtttcgaaccactattttctgttatgtgtgaacctgccactgagggaaattcacacgcccggagctgttcaggtgtcccggcgaactataagttctaattcatttagtcctgaggttttcgtgttgccagttgacgtggagaaggagaatgcccatttctacgtggccgatatgattatctcagccatggagaaaatgaaatgtaacatactgtctcagcagcaaaccgaatcgtggagtaaagaggtttccggcttgcttgggtccgaccagcccgactccgagatgacattcgataccaacattaaacaggagtccggctcgtccacatcctcttacagcggatatgaaggatgcgcagtgctgcaggttagtcctgttacggaaactcgaacatatcatgacgttaaggagatttgtaaatgcgacgtagacgaatttgtcatacttgagctcggggattttaatgacatcactgagacctgttcctgttcttgctcctcttcaaaatccgtgacatacgagcctgacttcaatagtgctgagctgctggctaaggaactgtaccgagtgtttcagaagtgctggatcctgtctgtggttaactcacagttagccggatctctgtccgcggctggctcgatcgtggtgaatgaggagtgcgtgaggaaagacttcgagtcttcgatgaacgtcgttcaggagatcaaattcaagagccggatcagggggacagaagactgggctccccctcgattccagattatcttcaatattcaccctccattgaaacgcgacctcgttgtggcggctcagaactttttctgtgcaggctgcggaactccagtggagccaaagtttgtgaaacggctcagatattgcgagtacttgggcaaatacttttgcgattgctgccacagctatgccgaatcatgcatcccagccagaatcctgatgatgtgggacttcaaaaaatattacgtctccaatttttccaagcagctattggacagcatttggcaccagccgatttttaatctgctttcaatcggccaatctctatatgccaaagcaaaggaactggaccgggtaaaagaaattcaagagcagctgtttcatattaaaaaactgctgaagacctgccggtttgccaacagcgctctgaaggagtttgagcaggttccaggtcatctgactgacgaactccatctgttttcgttggaggacctggtcagaattaaaaagggccttctggctcctctgcttaaagatattctcaaagcatccttagctcacgtcgctggttgcgagctgtgtcagggcaagggctttatctgcgaattctgccaaaacacaaccgtgatcttccctttccagacagctacctgccgaagatgcagcgcctgcagggcctgctttcataaacagtgctttcagtcttctgaatgtccacggtgtgcaagaatcaccgctcggagaaagctgctcgagagcgtcgctagcgctgcgacatag

SEQ ID NO: 58669 - DNA, 366 bp, Artificial Sequence
  Description of Artificial Sequence: Synthetic coding sequence
atgcggagaagtctaaagacctcacacttcagcgaggaaccctccacatgtttatttttaaatcaccgcaatggctcaacagaccccacgattattctgcacatttcggagccgatgtttaatggcggaaaacgggagatgcacggcaaaagaactccacctttcctcctgtctttgaagttcaaagacgtgtgcttcggaatgccctcccttctacccattcatcgccttctaaaatctttaatttactccaggcatatgtgcctgctctgtcccaaatgcattacttttctgctcgttatggccgactttgggtgcgtgtgtgtacggcacgctgttaataatgagatgaaggccatcgcctag

SEQ ID NO: 58670 - DNA, 1518 bp, Artificial Sequence
  Description of Artificial Sequence: Synthetic coding sequence
aagtccgtccagatccgtaccgaagcaggcccacgcctgcacatcgagccacccgtcgactattcagacgactttgagctgtgtggcgacgtaaccctccaggctaataacacatccgaggacaggccccaagacactaagtccccaaccagcaccaagccctgtggattcaacttttctttgctgaacgcctgtggccactccgacccatcatcgtctgtggataaggaacgcatcctgcttaccatacaggatgtaatggagcttcgaagatccctggaattgagcgtgaatctgcagcgcaaacagaaggactgttcaagtgatgagtatgactctattgaagaggacatcctctccgaaccagagccagaggatccagcgttagttgggcatcctagacacgaccggccaccctcatccggtgactggacacaaaaggacgttcacggcgagcaggagaccgagggccgttccagccctggacctgacaccctcgtagtgctggagttcaaccccgctagcaagagtcacaaacgggagagaaacttgtctgccaaacgcaaagacaacgccgaggtgtttgtgcccaccaagcccgagcccaacctgacccctcaagctccagcagtgttccctgaccaggagcggatgtgctccaggcctggctcaaggagggaacgccctctgtccgcaacccgtaagaccctttgcgaggcagaataccctgaggaagatgccagcgccgttctgcaagcaatacaggttgaaaatgctgccttgcaaagggcactgctcagccgcaaagccgaacagcccgcttctccactccaggatgccgaggggccacccgctaagccatggacgagcctcctcgaggagaaggaggagacactggagctcctgccgattactactgcgaccaccacacaggagccagccggtgcggcaggcggtgcaagggctattaaccaggccatggatagaataggactactggggtctaggcagcagcagaagctgcttaaagtgttacaggcagttgaatctgactcagcccacctcgggagggttgtgagccccactaaagagcaggtatctgataccgaagataagcaacgcatgcgggcagacgagattaaggacgccatttacgttacaatggagatactgagcaattggggcaatagttggtgggttggactgacagaggtagagtttttcgatctgaacgatactaaactatatgtgtcacctcacgacgtcgatattcgcaacacagccacaccaggggagctgggtcgcctcgtgaacaggaatttggcaggtaaaaaggattcttctccctggacttgcccctttcaccctccactgcagctattttttgtgattcgcaatactcggcagctcggtgatttccatcttgccaaaatcaaggtgcgaaactactggactgcagatggaagcctcagcgcggcacaggctggcgtgcagtggagagaccacggttcactgtag

SEQ ID NO: 58671 - DNA, 612 bp, Artificial Sequence
  Description of Artificial Sequence: Synthetic coding sequence
aagccatacgcttgtaacgagtgtgttaagagcttctgcgtgaaaagctccctgattatccatcagaggacgcacacaggtgagaaaccctacaaatgcaacgaatacgggaagacttttcatcacaagtctactttaactgtccatcagcgaactcatggagagaagccttataaatgtaatgagtgccgcaaaagcttctacatgaagtctcatcttgcaaagcatcacagaaagtacactaagaagccttacgagtgcaaacaatgcggcaagacctttcagaagtctcaccttattgagcatcagcggacccatcccggtgaaatacctcatgagtgtaataaatgcgggaagtcgttctgctacaagtctcccctgaccattcaccagaggactcacatagaggagaagccttacaagtgtagtaaatctgtgacctatttttgcatgaagagccacttgactgtccatcagagacctcatactcggaagaatccctttgaatgcaacgaatgtagaaaaatgttttatgttaaatcaaacttaataaaccaccagcggacccataccggggaaaaaccgtacgagggtaacacttgtggcaagtag

SEQ ID NO: 58672 - DNA, 975 bp, Artificial Sequence
  Description of Artificial Sequence: Synthetic coding sequence
atggactgggatgatgagtactcacacaactcttttgatcttcattgccttctgaactcttttcctggcgatttggaattcgaacagatcttttctgatattgacgaaaagatcgaacaaaacgccgctagcatcaaacactgcatcaaggagatccagtccgagattaataaacagtgccctggtgttcagttacagaccaccacagattgcttcgaatggctaacgaactataactattccactagtgaatcctccttcatctcacacggggacttgatcaagttctttaaaaccttgcaagacctcctgaagaacgagcagaatcaggaagaaatgacacttgaccttctgtgggacctgtcctgccacagttccgtgtctttcccatctacattgtctgggacaagtttccactttctatccaggaccagtctgcattcagtggaggataactcctctatggatgtcaagtctatgtgggacgacatacggctgcacctccgcagattcctggtcagtaaattacagagtcataacgagatcaataattcccagcagaagattctgctcaagaaacagtgcctgcaacagcttttattcttataccccgaaagcgaagtgatcattaagtaccagaacatccagaacaagttgctggcaaatctgctatggaattgctttccaagctacaacagagactccaatcttgacgtcatcgcacatggctatcaaagcacaatgcttaagctgtactccgtaatcaaagaagactttaataccctctgtgagatcttggcaccgtcttctatggtcaagtttatcaaggaaacatatctggacacggtgaccgaggagatggcgaaattcttggaaaacttctgcgagttgcaatttcgcgagaacgccgtgagagtggtgaagacgtccaaaagttccagcaaacacagaggggctgtgcacgctttaggctag

SEQ ID NO: 58673 - DNA, 459 bp, Artificial Sequence
  Description of Artificial Sequence: Synthetic coding sequence
atgcctgggctcgtgttctttaagtttgcgaatctcgggggaggctggggttccagaaaaatgctggagccagggatgtgcccagccgaaatgtccctgaccccctttgtgaccagaagcctcaacctgctctgcttttctgtaacgcaccggggaaggggcaaggataaccctttgcactttttcctgcagctactagccccttctgcttccgcctcactcggactgggcagagagaccggccctttgccctcacccggactgtctcccggtctcctatctgaaaccttcgtctcggagggacccctgcttacactacagatatcctggtgtggaactgaatgtctgatggatggccaggggcctttgatccatctgcacagtcagaacatacgaatcagctttggtgcaacacagcctccactgctgctagtgtatgaaatacgttggaaccggtag

SEQ ID NO: 58674 - DNA, 558 bp, Artificial Sequence
  Description of Artificial Sequence: Synthetic coding sequence
atgcacgggctctgtatggtgccctccccccacggccaccccggtattagtggcacctgttgcgccccaggtcaggctccagataggcatcccctcagtctgtgtgcgccaacgcctggtcgcaagaggcaacaccacctggtggcctggcagccttgcccagccccatcatgtctatggccccactggacgcagcccccatccagagaagcttttgggtgtcgagctggcgcaggaagagcgcatcccgtagctgggggtactcaggaaccttggctgcacctctgttctaggaggacatgtggccagctgactctgcagcaaggctctggcccaaagagcctgacccatcgtgtcctttccccagatcgggcagtcgactctttccccttccatcctgggacttgctggcaggagctacccggaccacatccaggggctgctacgcctgcacccccagctacccccggacatgagaaggtccagaattcctccggaccctcgcataacttccttgagttaagggatagcttcctttccacgaacggcgtgagatag

SEQ ID NO: 58675 - DNA, 3003 bp, Artificial Sequence
  Description of Artificial Sequence: Synthetic coding sequence
atgcccggaaagctcaaggtgaagattgtggctgggagacacttgcccgtgatggatcgggctagtgatctgacagatgctttcgtggaagttaaatttggcaataccacttttaagaccgacgtctatctcaagtcccttaaccctcagtggaactcagaatggtttaagttcgaagtggatgacgaagatctgcaggatgagccactgcaaataacggtacttgaccacgacacctattccgcgaatgacgccattggcaaagtttatattgacattgatcctcttctgtattccgaagctgccaccgtaatttctggctggttccctatctacgatacgatccatggcattagaggagagataaacgtggtggtgaaggtagatctttttaatgatctaaacagattcaggcagagtagctgcggggtcaaattcttctgcacgacttccattcccaaatgctatagagctgtgattatccacggtttcgtggaggagttggtggtgaacgaggaccccgaataccagtggatagatcgcatcaggacacccagagcgtccaatgaggcccgtcagaggttgataagtcttatgtcaggagaactgcaacggaaaatcggtcttaaggtactcgagatgcgcggaaacgcagtggtggggtatctgcagtgcttcgacttggaaggcgaaagcggactggtcgttcgcgctattggaaccgcctgcacactcgacaaacttagcagtccagccgcattcttgcccgcttgcaatagcccctctaaggagatgaaggaaatcccgttcaatgaagacccaaaccctaacactcactcgtccgggccttcaacacccctgaaaaatcagacatacagcttctcaccttctaaatcctatagcaggcagtcgtcaagtagcgacaccgacctgagcctcacacccaaaactggtatggggtcagggtccgccggaaaagaggggggaccatttaaagccttactgcggcagcaaacccagtcggcactcgagcagagggagttccccttttttaccctgacggccttccctccgggattccttgtgcacgtcggaggcgtggtttccgcccgatcagtgaaactactggaccgcatccacaatcccgatgaacctgaaacccgggacgcctggtgggcagaaattagacaagagataaagagccacgctaaagctttagggtgtcatgccgtggttggatatagtgaaagcacctccatttgcgaagaagtttgtatcctgagtgccagcggcaccgcagctgtgttgaatcctcgcttcttgcaagacggtaccgtcgaaggctgtttagagcagagactcgaagagaatttgccaacccgatgcggtttctgccacatcccctatgatgagttgaacatgccttttccagcccatctcacctattgttacaactgtagaaaacagaaggtgcctgatgtgctgtttacgacgatcgatttgcccactgatgccacagtaataggtaagggatgtctgattcaggctcgcctgtgtcggctcaagaaaaaagcacaggctgaggcaaacgccaccgcaatttctaacctcttgccatttatggagtacgaagtgcacacacagctcatgaacaagttgaagcttaagggtatgaatgcattatttggtctgagaatccagatcacagtcggagaaaacatgctcatgggtctagcatccgccaccggagtatatctcgccgcactccccacacctggcggaatccagatcgccggaaagactccgaatgatggatcatacgaacagcatatttcccatatgcagaaaaaaatcaatgacaccatagccaaaaacaaggaactctatgaaattaaccctcctgaaatatccgaagagattattggctctcccataccggagccccgacaacgttcccggctgctgcggagccagagcgaatccagcgatgaggtcactgagctggatctatcgcacggcaaaaaggacgcctttgttttggagatcgatgataccgacgcaatggaggacgtacattcgcttttaactgatgtgcctcctcctagcggtttctactcatgcaacaccgagattatgcctgggatcaacaactggaccagtgagatccagatgtttactagtgttcgggtcatcagactgagttccttgaatctcacaaatcaagccttaaataagaattttaacgacttgtgcgagaacttattaaaatcactgtactttaagctgcggtcaatgatcccttgttgtctctgccatgttaattttaccgtgagcttgcccgaagatgagctaattcaggtgacggtcacggccgtggcaattaccttcgataagaaccaggcgcttcaaaccaccaagactcctgttgagaaatcacttcagcgcgcttctaccgataacgaggagttgctgcagttccccctggagctctgttctgacagcctgcctagtcaccccttcccgccagcaaaagcgatgacagtggaaaaagctagccccgtgggtgacgggaattttcgaaacagaagcgcacccccatgtgccaattcaacggtcggcgtggtcaaaatgactcccctgtcattcatcccaggagccaagatcactaaatatctcggtattataaatatgttctttatccgtgagacgacttccctaagagaggaaggaggtgtcagcggttttttgcacgcattcatcgcagaagttttcgcaatggtgcgcgcacacgtggccgctttgggcggtaacgctgttgtgagctatattatgaagcaatgcgtattcatggagaaccctaacaaaaaccaggctcagtgccttataaacgtgtcaggcgatgccgtggtgtttgtgagggagtctgacctggaggttgtaagcagtcaacaacccacgaccaactgccagtcatcctgcactgagggcgaggttacaacatag

SEQ ID NO: 58676 - DNA, 1215 bp, Artificial Sequence
  Description of Artificial Sequence: Synthetic coding sequence
atgctgcgtgccatcgctgaggagagagggagactgtctctgagacgtgaagtgtgcggcctcggctgttttaaggatgatcgtatcgtgttttggacatggatgttttctacttacttcatggaaaagtgggcccctaggcaggatgatatgctcttttacgtaaggagaaaactggcgtacagcggcagtgagtctggggctgatggcagaaaggctgccgagcccgaagtggaagttgaggtgtacaggcgcgacagcaagaagctgccaggactgggcgaccctgacattgattgggaagaatcggtctgtctgaatctgattctccagaagctggattatatggtcacttgtgccgtgtgcacgcgcgctgacgggggtgatatccacatacacaagaaaaagtctcaacaggtcttcgcctcaccatctaaacatcccatggactccaaaggggaggaatccaagattagctacccgaatatcttttttatgatcgattccttcgaagaagtttttagtgatatgacagttggtgaaggcgaaatggtctgtgtggaactcgttgcctcagacaaaacaaatactttccagggagttatcttccagggatccattcgatacgaggccctcaagaaggtttacgataacagggtctccgtcgcggcaagaatggctcagaaaatgagtttcggcttttacaagtactcaaatatggaattcgtccgaatgaagggcccacagggaaaaggacacgctgagatggcggtgtctagagtgtcaacaggagacaccagcccatgtggcacggaagaggatagctcaccagcttcaccaatgcacgagcgcgtcaccagcttcagtaccccgcctaccccggaacgtaataacagacccgctttcttcagtcccagtctaaagcggaaagttcctaggaataggatcgctgagatgaagaaaagccactccgctaatgactccgaagagtttttccgcgaggacgacggaggggctgacctacacaatgctacaaatctgcgcagcaggagcctatcaggtacagggagatccctagtgggttcctggctgaagctgaaccgagccgacggcaactttctactgtacgcacacctgacctacgtgactctgccactgcacaggatccttacagatattctcgaggtacgccagaagcccattctgatgacgtag

SEQ ID NO: 58677 - DNA, 2151 bp, Artificial Sequence
  Description of Artificial Sequence: Synthetic coding sequence
atggaggattgtctgcatacctcctctgagaatctttctaagctcgtgtcctgggcgcactctcatggcactatatgttccttgatcccaaatctgaagcacctgttgtctgaagggtcccatgggaatctgacagctatgtgggggtgcagcgccggtcatgcttaccattggccactcaccgccacatgccgggctgggtcacaggagcgagtgtgcttccaagacaatcgaagtttcaatagcgactcacccagcatcattggtgtcccctctgagacccagaccagtcccgtcgagcgctatccaggccgacccgtcaaagctaaactagattgcaacagaactcgggattcatgcgatttttcctattgttccgaaccgagcgagctagatgaaaccgtcgaggagtatgaagacgagaacaccctgtttgatatggtatgtgagagtagtgtgaccgacgaagattctgattttgagccgcagacacagcggccacagtctatcgccaggaagagacctggcgtggtgcctagcagtctccactcaagttctcagacacagatggtggacgaatgctccaatgacgtgatcatcaagaaaatcaagcaggagatcccagaggattactacatcgtggcaaatgccgaactgactggaggggtggacggtccagcactctctctgacacaaatggctaagcccaagccccagacacacgctgggcctagttgtgtcggaagcgctaaattgatcccacatgtgacaagtgccatttcgacagagctggacccccacggaatgagtgccagcccgtctgtgatttcccgcccaatagtgcagaaaacagctcgagtgtctctggcctccccaaacaggggtccacctggcacccatggaaccaatcaacaggtggcaatgcagatgcccgtcagtacctcacatccaaacaagcagatttccatcccactcagcgccttgcagttgccaggccaggacgagcaggtggcgagtgaggagttcctcagccacctcccgtctcaggtcagcagttgcgaggtggccctgtctccctccgtcaataccgagccagaggtgtcttcttcccagcagcagcctccagtagctcccgcaattaccactgaagctactgcccagtgcatcccagcatacagtaccaaactcaataaattcccagtgttcaatattaatgacgatcttaatgacctgtgcacttccgcggtgtcccctaataccacaaaggctacacgctatgctcttaacgtgtggcgctattggtgcatgacgaacgggcttaaggaccataccgacatcactaaaataccggcagtcaagcttaatgaactgctcgagaatttctacgtcaccgtaaaaaaatccgatggcagtgattttctcgcgacttcgctccacgcaattcggcgaggacttgacaggattttaaaaaatgcgggtgttggcttttctatcacaagctcgactttctcctcctccaccaaaaaactcaaggaaaagctgtgggttctgagcaaggccggtatgtctggagccaggagtagaaatatcgtatatttttctttgtctgatgaggaagaaatgtggcaggccggatgcctaggtgatgattcacccatcaccctgctctccaccgttgtgaagtacaatagtcagtacctgaatatgcgcaccctgcaagaacatgcggacctaatgtacggggatatcgaactccttaaggatccccaaaatcagccttatttcgcgaggacagatagtgtgaaacgcgaatcccgaagtgggagtacacgggtgtgccacggaaaaatttaccacgagcacagccgcggacacaaacaatgtccatattgtctcctatataaatacatgtacatccacagacctccaacacaaatggaagcaaagtctccattctatctgaccgctcgtaaggaggccaccgacatgggcagcgtgtggtatgaggagcagaggatgggcttaaggagtctcaggggcattgtccctaatttggccaaaaaggttaagctagaaaactgcgagaacttcacttttgtcagctttacacaggtttccagacgtctggggagccatagctgctgccaatag

SEQ ID NO: 58678 - DNA, 1605 bp, Artificial Sequence
  Description of Artificial Sequence: Synthetic coding sequence
atgaggcgacatagtgaaaccgacgtggaggagcagactcaggaactcaagacgatcacacagcttcaggaacaatgccgggcacttcaaatccagggagtcaaggagaatatggatcagaacaaggcaaccctggcgctgctccgtagtaatatccgaaggggtgcccaggactgggccctcgccaagaaatacgatcagtggactattagcaaagcttgtggcaagaatctgcccctccggctagctcactgcagatccactatggaagttgtgagggagaaattgcgtaagtatgtatttgaccgcgtgaacatgcacaacctactaattcacctggtgcgcagacgcggacagaagctggaatcgatgcagctcgagttggattccttaagaagtcagcccgatgcctccaaggaggagcttcggttactccagattatccggcagctagaaaataacattgagaaaaccatgataaaaattataactagtcagaatatacacttactctatctcgatctcttggactatctgaaaaccgtcttggccggatacccaatcgaactcgacaagcttcagaatctggtagtcaattactgctctgaattatccgatatgaaaattatgagtcaagacgccatgatgataaccgatgaagtaaagagaaatatgcggcaacgtgaagccagctttattgaggagcgcagagccagggaaaacagattgaaccagcagaagaagctgatcgataagattcacacaaaggagacgagtgagaaataccggaggggacagatggatctggactttcccagcaacctgatgagtactgaaaccctgaagctaaggcgcaaggagacttccaccgccgaaatggagtatcagtctggcgtaaccgccgtggtggagaaagttaagtctgccgtgaggtgttcccacgtctgggatatcacttcaagattcctcgcgcagcgaaatacagaagagaaccttgaactgcagatggaggattgcgaagagtggcgagtgcagctcaaagccctggttaaacagcttgagctggaagaagctgtgttgaagttcagacagaagccttctagtatttcatttaaatctgtggagaaaaagatgacagacatgctcaaggaagaggaagagcgtttgcagttagcccattcaaacatgaccaagggccaggaactcctcctgaccatacagatgggaatcgacaacctgtatgttaggcttatggggatcaatttacctgccacgcagcgagaggttgtcttatctaatacactggatctgaactctaaattggcatactgcgagggaaagctgacctacctggccgatagggttcaaatggtgtcccggaccgaggagggtgataccaaggtacgggatacccttgagagttctactctcatggaaaagtataacacgagaattagtttcgagaacagggaagaggatatgattgatactttccagttccctgatatggaccactcctatgtcccatcacgggcagaaattaaaaggcaagcacagcgtctgatcgagggcaagctgaaggctgctaagaagaaaaagaagtag

SEQ ID NO: 58679 - DNA, 5519 bp, Artificial Sequence
  Description of Artificial Sequence: Synthetic coding sequence
atgtaccatattgactgtcgcgaccagctcgagagggtgttccttcggcttgggcacgcggagacagacgaacagctacagaatataatttcgaagttcctccccccagttttgctaaagctcagtagtactcaggaaggagttaggaagaaggtgatggagctccttgtgcaccttaataagaggatcaaatcacgcccaaagatccagctgcctgtggaaaccctgctggtgcagtatcaggaccccgctgccgtctcatttgtcactaattttacaatcatatatgtgaagatgggctacccgagactgccggtcgagaagcaatgcgagctggcacccacactgcttaccgctatggaggggaaaccgcaaccacagcaggacagcctgatgcacctgctgatacctactttgtttcacatgaaatatcccgtggaaagcagcaagagtgccagcccattcaatctggccgaaaaaccgaaaaccgtgcagctacttcttgattttatgctagatgtgctgctgatgccttacgggtacgttctgaatgaaagtcagagcaggcagaatagttccagtgcacaaggttcctctagtaattcaggtgggggatctgggatccctcaacctccacccggaatgtcattctatgcagctaagcgggtgatcggcgacaacccatggacaccagaacagctggaacagtgcaagctgggaattgtcaagttcattgaggccgagcaggtgcccgagctagaagcggtgctgcatctcgttattgcttcaagtgatactcgccatagtgtggctactgcagccgacctggagttgaagtccaagcaatccctgatcgactggaacaacccagcaattatcaacaagatgtataaagtgtatttgggagacataccactgaaaactaaggagggtgccgtgcttaagcctgagctcaaacgggatccggtctcaaccagagtgaagctgaaaatcgtgccccacctgcttcggtctcgacaggccgctgaaacctttcccgctaacatccaagtggtgtacgatggattattcgggactaacacaaactccaagctgaggaccctgtctctgcagtttgttcaccacatttgcattacatgtccagagatcaaaataaaaccactcggccctatgctgctcaacggattgacaaagctcattaatgaatacaaggaagatccgaagttactatctatggcttacagtgcagtgggaaaactgtcctctcgtatgccgcatctattcacaaaggatatcgccctcgtgcagcagttgtttgaagctctgtgcaaggaggaaccggagacccgcctggctatccaggaggctctttctatgatggtgggcgcatactccactcttgagggagcccagcgcacactaatggaggccttggtcgcgtcctacctgatcaagccagaagtacaggtgcggcaggtggcagtgaaattcgcttccacagtcttccctagcgaccacataccctctaggtacctgctgctgttggccgcaggcgatcccagggaggaggtgcacggagaagcccagcgggtgctcaggtgtctgccaggcaggaatcggaaagagtctacctccgagcagatgccaagttttcctgagatggtttactacatccaagagaaagcttctcataggatgaagacgccagttaagtatatgaccggcacaactgtgctgccctttaatccagccgcttttggcgaaatcgtgctatatctccgaatgtgtctggcgcattccgccggagtggttcccacctcccaaagtctcgctgacatgcaggatcacgccccagccattggacgctacataagaacactgatgagcagtggccaaatggctccttcttcgtcaaacaaatccggcgagacaaatcctgtgcagatctatatcggactcttgcagcagttattagccggagtaggaggcctccccgttatgtactgcctgctcgaggcagtcagcgtgtatcccgaaaagctggcaacaaaattcgtggataagacagaatggattaagagtcttatgaataactccaaggaagaaatgagagagttggctgctttattctatagcgttgtagtcagcactgtgtctggcaacgaattgaagagcatgattgaacaactcatcaagacaaccaaggacaaccattcccccgaaattcagcacggcagtctactcgcattagggtttactgtgggacgctatctggctaaaaaaaagatgcgtatgtccgagcagcaagatcttgagcgcaatgctgataccttgccagaccaagaggagctcatccaatctgccacggaaaccatcggatcctttctggactcgacaagccccctgctcgcaattgccgcatgcacagccctgggagaaattggacgtaatggccctcttcccataccatctgagggctcaggctttaccaagctacatctggtcgagagtcttctgagccgcatcccctccagcaaggagaccaacaaaatgaaggagagggcaattcagaccctgggctactttcctgtgggcgacggtgatttcccacaccagaagctcctgcttcagggtctgatggatagcgtggaagccaagcaaatcgaattacaattcacgatcggtgaagccatcacctcagcagctattggaaccagttctgtagcagccagagatgcttggcagatgactgaagaggaatatactcctcccgcaggcgcaaaagtgaacgacgtggtgccatgggtgctcgatgtgatcctgaacaagcacataatttcccctaaccctcatgtgagacaggcggcttgtatctggttgctgagtcttgtgaggaagctgagtactcataaggaagtgaaatctcacttgaaggaaatccagtcagcgttcgtttcagtcctgagtgagaatgatgagctctcgcaggatgtcgcctctaaaggactcggcttggtgtatgagctaggcaacgagcaagatcaacaggaattggtatcgacactggttgagactcttatgacgggtaaaagggtgaaacacgaggtgtctggcgagactgtggtgttccagggcggtgctctgggaaagactcccgacggacagggcctcagcacttacaaggagttatgctcactggcttctgacctgagccagcccgacctggtatacaagtttatgaacctggccaatcaccacgcaatgtggaattctaggaagggagctgcgttcggcttcaacgtaattgccacaagagctggggagcagctggccccatttctgcctcagctggttccccgactgtataggtatcagtttgatcctaacttggggatacgtcaagcaatgacttccatttggaatgctctggtgactgataagagtatggtcgataaatatttgaaagaaatccttcaagacctcgtcaaaaatctcacaagcaatatgtggagggtcagagaatccagctgccttgcgctcaatgacctccttcggggaagaccgctggatgacatcattgataagttgcctgaaatctgggagacgctgttcagagtacaagatgacatcaaggagtcagtgcgtaaggcggcagagctggccctgaagacactctcgaaagtctgcgtgaaaatgtgcgatcccgctaagggcgctgccggacaacgcactatcgcagcactgctcccctgcctgctggacaaaggcatgatgagtaccgtgactgaagtgagggcgctgtccataaacacactggtgaagattagcaagagcgctggagcgatgcttaagccccacgccccaaagctcatccccgctctgctcgagagcttatctgtgttggagcctcaggttctgaattacttgtcactccgagcaacagagcaggaaaaagccgcaatggacagcgctaggctgagcgctgctaagagttctcctatgatggagaccataaacatgtgcctccagtacctagatgtgtccgtgctgggtgagctggtgccacggttatgtgagctgatcagatccggcgtggggcttggaactaagggagggtgcgcttccgtgatagtcagcctgacaacacaatgccctcaggatcttacaccttactccggaaagttaatgagcgccctactgagcggtctcaccgatcggaactccgtgatccagaaatcctgcgctttcgcaatggggcacttggtgcgtacatcccgggatagcagcaccgaaaagttgctccagaagctgaacggatggtatatggaaaaggaagagcccatctataaaaccagctgtgcactgaccatccacgcgatcggacggtactccccagatgttcttaagaaccatgctaaggaggtgcttcccctggctttcttgggcatgcatgagatcgctgatgaggaaaagtctgagaaagaagaatgtaatctgtggactgaggtgtggcaggagaatgttcccggttcattcggaggcatccgactgtacctgcaagaactcattaccattacacagaaggcccttcagagccaatcttggaagatgaaagcccagggtgccatcgctatggcttcaatagcgaagcagactagctcccttgtgcctccctatttaggaatgattctgacggctctccttcaaggtctcgctggaaggacatgggcaggtaaggaggaactcctgaaggccatcgcgtgtgttgtgaccgcttgctccgcagaactggagaaatcggtccccaaccaaccaagtactaacgagatcctccaggctgtgctgaaagaatgtagtaaagaaaatgtgaagtataaaatcgtagccatcagctgcgcggctgacattctgaaggccacaaaagaagaccggttccaggagttcagcaatattgtgatcccgcttattaagaagaatagcctggagtcttccggggtcagaaccacaaaaaacgaggaggaaaacgagaaagagaaggagctgcagctcgaatatctgttaggggcattcgagtccctgggcaaggcctggcccaggaatgcagaaacacagaggtgttacagacaagagctctgtaaactgatgtgcgagcgcctgaaactcagcacttggaaggtacagctcggtgttctgcagtcaatgaacgcttttttccagggccttatgctattggaagaggaacatgccgacccagaggccctggctgagattctgctggagacgtgcaagtccattacatattccctcgaaaataagacgtatagttccgtccgcactgaggccctaagcgtgatcgaattgctgttgaagaaactggaggaaagcaaacagtgggagtgcctgaccagcgaatgtagggtcctgctcattgagagcctcgccacaatggaacccgattcccgaccagaactgcaggagaaggccgcactccttaaaaaaacactggagaacttagaata

SEQ ID NO: 58680 - DNA, 1524 bp, Artificial Sequence
  Description of Artificial Sequence: Synthetic coding sequence
atggtggctacaggatgggccagacggtcgggcctgcacccagcaccacgtcccctgagaggtgcccaggaggctctcgcaaagaacctttggagggaggaaaggaaccgcccacttattctttcatctttgataatcaagaaattacattggccggaacaggaactggccaagaaatccattctgaatgcagaggattcactgattattgacaacaaaaggtccatctcccatctgagttcaggggttctaaaggatatcttcacgacaggcaccagttcttacaatgtcctcctgcagtcaaaagaggaaaaaaagtaccacagtcagaaacagtcatcatcaacatacagcaaacggtgccgcaagccttccaagagccctaatacatctcgttcaaaggatccaaggagaatgaaggctctcgtgcccgtaacaagcagcggcacatggtattgcctggaaagaagacctgcggtgtttgtgacctcaagcgtgtcatcgccggtgaaattcacgcacgatatcagcgtcacaggtaatggaattgtgctcccaccaaaacccaaatctaaggttaaatggtgccatttctcaactctgcctaaacctaagccacagctgtctagaagtttcgagaaaggagacgacttctcagggaaaaaattctgtattcttaccgctatcaagccaactaatctggaaaaagaaaagttgcggttcttcaagagtgactatacctacaacccccaattcgagtacgccaatcctgccctcccatcagtcctcgctaagcattcacacgcatctgaccgtttcctgaaacagattgtggtgcacctaacagaagacttgctaagtcgtgcttccatgacagttgtcaatgggtgccccactcttactattaacgtatcgactgccagagagcactggctagaggggatgctaagacacgaaattggaacccactacttcaggggaataaacaacttacagcagccatggaattcctggaccggcagaaaaaaacacgagctgaagcccaataacccaacagaagagggcttggcttccatccattctgtactgtttcgtaaagatccctttctgtggagggctgcccttctgtattacacggtatatcaggcctctcagatgagtttttgtgaactcttcaaggatatagggagattcgtgaaggatcccaacacacgctgggactactgcgttcgcgcaaaaagaggttggactgatacatctcagcccggatgcttttccaaagaccaggtctatctggatgggatactgcagattcttcgctacagggacacaattgattttcacctgcttactgcgctgggaaaagtttcttacgaggatgtagatcgcctcaaaggactcgccgttacagaaaacatgagggtccctcatttcttacaagatcacggcaggtacatggagcacttggagaagatcatggaggtgaacgaactgacagacagggagctgaaggacctgatctag

SEQ ID NO: 58681 - DNA, 576 bp, Artificial Sequence
  Description of Artificial Sequence: Synthetic coding sequence
cagtcggggtttatggatctgcccaaagaaaaggttggaagaaaggaacaggtagaaaaactcgaactggggttcatccaattgtctggcgctacggatggtatgagagagtatatcactgagtacgaaagtcagggggcagttccaaataccagacatcaggaaaaagaggacataattcgcctggctcagaaagaagaagaaatgaaggtcaaactcctggagctgcaggaattggttctcccactggtgggagaccatgagggacatggaaaattcttaactgcggctcagaaccctgcggacgaacccgcacctggcgcaccagcgccacaggaactgggagctgctgacgaacagggcgacttttatgaggtgtcactggatgactcagaggaacccgcacctggagctgcaggcgaaggctcgccgcacgataaccccaccgcccagcagattgttcagctgccgcctgtcatgcaggatactcaggaacatccagggctgccaggcaacccttgtgtcagtttcttttaccaggccgctgaaaaccgagaaatcaacattattatctag

SEQ ID NO: 58682 - DNA, 375 bp, Artificial Sequence
  Description of Artificial Sequence: Synthetic coding sequence
atggaacacatgctgctggcgaatcacacggacaaggctacttttaccggaactcagagacaaaggtcctgcagtggggcttctgtgtcacagccccgacctttgagggggaaactggtcgggtattgggaccctcactcacgccttctaagccgaggacgtgcactgggaagtgtttccgcgcctagtacccctcggggacgcggttggaaggccaccttcgatggatgtattttacatgacgacttgctgactaaggtccatggcttccaaagtcttataggcctgcagcagcacctggcttgcggagactcgggatccctaatgaaaaactgtcatgatggtaatcgcaataatcagcgcaagctgccatag

SEQ ID NO: 58683 - DNA, 1371 bp, Artificial Sequence
  Description of Artificial Sequence: Synthetic coding sequence
atgggtaactcaaggtctcgtgtgggcagatctttctgctcccagttcctccccgaggagcaggcagagattgatcagctcttcgatgcactgtcttccgataaaaactcccctaacgtgagcagcaaaagcttcagcctgaaggcactgcagaaccatgtaggtgaggcactcccgcctgagatggttaccagactgtacgacggtatgaggagagtggatctcaccggcaaggccaagggcccttccgagaacgtgagtcaggagcagtttacagcgtcaatgtctcacctgctgaaggggaacagcgaggagaagtctctcatgattatgaaaatgatcagcgcaactgagggaccagtgaaagcgagagaggtacagaaattcacagaggatctggtgggctccgtggtgcatgtactgtcccacagacaggaactgcggggatggaccgggaaagaggccccaggccctaatccgagggtacaggtcttggcggctcagctactgtctgatatgaaactccaggatgggaagcggctgctcggtcctcagtggctggactacgactgtgatagggccgtcatagaagactgggttttccgcgttcctcacgtggccatctttctaagtgtcgtaatctgcaaggggttccttattctttgttccagcttggacctcactactttagtcccggaaaggcaggtggatcagggacgcggattcgaaagcatcctcgatgtactgagtgtcatgtacataaatgcccagctgcccagggagcagcggcaccggtggtgcctgctgtttagctccgaattgcacggccatagcttttcacagctctgtggacacatcacccatagagggccttgcgttgctgtcctagaagatcacgataagcatgtgttcggcggattcgcctcttgcagttgggaggtcaagcctcaatttcaaggtgacaataggtgtttcttatttagtatctgcccaagtatggcagtatatacacataccggctacaacgaccattatatgtaccttaaccacggccagcagacaatccctaacggcctcgggatggggggacaacataactacttcggactgtgggtggacgtcgactttggaaaaggccattctcgcgcaaaacccacatgtaccacatataatagtccccagctgtctgcacaagagaactttcagtttgataaaatggaggtgtgggcggtaggcgatccctccgaggaacagctagccaagggtaacaagtctattctggacgctgatcccgaggcacaggcactcctcgaaatcagcggtcactcccggcactcagagggattgagagaagttccggacgacgagtag

SEQ ID NO: 58684 - DNA, 438 bp, Artificial Sequence
  Description of Artificial Sequence: Synthetic coding sequence
atgggcccatggccaagagattggctgggcaagggctggagattaggctcctgcgaggcaagggccggtgccaaggaggttagcgttatccgccatggcgctcccaatccagcacagtcacacctgcacgtgcaagccagggctcaggtgcactccgaagatggccattcgctccctccagtggtggacggcgaagacgaggtgttgtctctcttggtgttcgtgcaagacagtcaagagtgttgcaggcaggctgtccagggacgccaaggcagaggagtcacttgggggctgggcctgccgagctaccacttgcggactctgctctctccagtctgtgtgccggctcgggaccaaagagcacctaggaagtgttgcgaagcggtcctcgcctgcccactggttgaaactctcgttacaaccttgcttactcggtag

SEQ ID NO: 58685 - DNA, 1653 bp, Artificial Sequence
  Description of Artificial Sequence: Synthetic coding sequence
atgggctggtcagacctgcagcccgctatggggggtgaggctgagcgcttccaggcacagcttgaagtaaagctggttacaggagggtcccccgtggttttcaccggaaacctgacaagacaggtgggctccaagttggcattctctgccagcttgtcgcacctgctgtcagatcaggcaaatgtcaccgctcttcttgaacggaaggaggaaaacggtcgtcgagtggctgcactgggtgccgagctgtttgttcccggtctagtgggactgcgagcactgggtctacttcagcagcggggtcagctatggacaaacagtttgaggatacaatatagcctgctaggacaggccaagcaggctgcgcacgaatgcagcacgtcccagaaactgcgggcagacagtggctccgacggagcctatcgcttggagctgagacatgagttgcactgtacccagatccttgctttttctcataaggtgcagctgtggcatgaagaggattccggacatctacacagtcaattagaggtgtcttacggaaaacattgggataagaatagtaacaaacgtcatttgagagtttcgcagaccttcaaaaacgacagcgggccagccctgagcaaccacttcatggagttcgtgctgcaggtcccagagagacaggtggattgtagggtgcaactctaccacctctcactccgtctcccctacgtggagagttcaagtcacctgaaggtgcaatataacgggcgaccactgttcgtcgcaggcggacagtggaaagataccagcagggccaccttgtggaagtgggaaggcgcactgaaccttgattccccgtggctgatggtgtctgcggctcatcggctgtactggccacacagggctgtgttccaggctgtcctggaactgacccttgggaaagcctggactttgaaagacctcgtagtgagtgtggggtgcaggagccagggccctaatagagaaggtaagattcaggtttatacagccgctacaacctacctcagggtttccactgtgacagtcttggcacagtcgctgttccactcttggtccgagctagagagtgcctggaacgcagctgtgcagggtgagattcacgctgagaactctcgggatcggaagatactgaattgctggcttaagggaccccagcaggaattgaatctcactgctgcgtaccgccatcttgagtggccgcgtaaaacacaggtcagcctgacagccgttagaatcggagcgcaaggacagcccagaggactgcagctggagggcgagttagaagagctgcggcaggatagaactctgtacaggaaaagaggggctctcttgctcagacatccgctgcaccttcctataccacagagtttgcttctgcaagaaactttcactgccgatcgtaggcaccaaaggtacagtttagagactagggttgtcctcaacggccgtgaggaaacgcttcagacaatggtgctgggctgccaggcgggtcatccatatgtgtgcgcaggcctgatgcacccttacgatggaaaagttatcccccgtaatacagaaggctgcttggtcacgtggaaccagcatacaagccttacactgctttcacggttggaatccggggtgcaatag

SEQ ID NO: 58686 - DNA, 411 bp, Artificial Sequence
  Description of Artificial Sequence: Synthetic coding sequence
cggtcccggactggacctgtgtctctgcaaggggatcccaagcaggcgccatggagctcttcccagtccaatagtagcaggaagaccctgtttctttcgctgtgcccaccttttccaacccagccccagattcatcttcacttcacagagcatcgtgcatcttctcaccaggggggaccgttcaagctgcagatatgcctctcttccctatacagcaacttgctactgcactgtcactatagggaagtgcatcacatgtccggccaccggactgagagcgcaggtggtcacctttttctcccacaagatctccgctggaagtcacccggtttaggtgtctttgccgtgcagtctgtgtacgaactagcgagaagacacaatgtgagtccgttttatagtggtccaccctag

SEQ ID NO: 58687 - DNA, 372 bp, Artificial Sequence
  Description of Artificial Sequence: Synthetic coding sequence
atggcactactagcttcaaatggttgcttcatacgatgcaatgaggctggggatatagaagccaagtcaaaaaccgcgggagaggaagaaatgattaagattcggtcctgcgccgaacgtgaaactaaaaagaaggatgatatacccgaagaggacaaaggtaacgtgaagcaatgcgagattaactacgtgaagaagttccaaagtttccaggagcataaattgaagataagcaaggaggactccaaaattctgaagaaggcacagaaggatgggttccttcaggagaccttactggatagtcttggctacgaacatcgatggaagcgatggctgctgtattggatcaaagacatgtcacgggacggctag

SEQ ID NO: 58688 - DNA, 291 bp, Artificial Sequence
  Description of Artificial Sequence: Synthetic coding sequence
gaggtgcagttagtcgaatcaggaggagggctggtacagccagggggatcgttgcgcctctcctgtgccgcatcaggattcacattttccaaccactacacatcttgggtgcggcaagcgccaggaaagggtttagagtgggtaagttactcctccggaaatagtggttacaccaactacgccgactctgtgaagggcaggttcactatttctcgcgataacgcaaagaactcgctctatttgcagatgaactctcttagagccgaagacactgctgtgtattactgttag

SEQ ID NO: 58689 - DNA, 438 bp, Artificial Sequence
  Description of Artificial Sequence: Synthetic coding sequence
ggagagagcgaggatgtgactcaattcttgcagagccacaaaaagactctcaccaatgaaaaacttttcctgatggacggcaaaaggacttggtttctggaaatggaatccaccccaggtgaggacgctatgaataccgtcaaaatgacaacaaaagatctgaagtatgaccggtccctgatcgataaggctggatttgagagaaccgactcaaattttgagagaagccatactgtgggcaaaatgctgtcaaacagcatcatgtgctatagagacatcttctatgaacgggaaagccagctgatgcagcagacctccctgctatcctacgaaattgcgattgctacgcccacgttctcaaactattaccctgattggtccgcaccaataaacatcgttgcaaggcccagcacctccaagaagataatgacctgctag

SEQ ID NO: 58690 - DNA, 396 bp, Artificial Sequence
  Description of Artificial Sequence: Synthetic coding sequence
atgcgaaagcctcgtcgcgctggatgggagacactgtcccgaaaagccccaggcccatccgcaggcctgcggccaagcccagccacctgtgacacctgtcactttccaatactgggcgacgggaaggccaccctgccattcgctcccggaaagaccagtagggtgccctccgattcaggcgtcttttccagcgatcccagagcaaactggtcctctattaggaatttccctagtgccaagtgtgttggtattgaactgcacgagagtctgtccacttcagctgagtggctactgcggggtcgcggtggggctctgccttggatcgtgcggtgcctcgcagcaacagatttgctgcttccaggaaaaaagggagtggagtcatgtcctgtaggatag

SEQ ID NO: 58691 - DNA, 291 bp, Artificial Sequence
  Description of Artificial Sequence: Synthetic coding sequence
gaggtgcagctggttgagagcggtggaggactggtacaacccggagggtccctacgactcagttgtgcagcttctgggttcacttttagcaataggtccacacattgggtgcgtcaggcaccaggaaagggacttgagtgggtgggccactccgtcagcaaaaaaaagaagaaaaaaaagaagaaaaaaaaaaagggacgcttcacgatatctagagatgatagcaagaacaccctttacctgcagatgaactccctgaagacagaagacactgctgtttactactgttag

SEQ ID NO: 58692 - DNA, 387 bp, Artificial Sequence
  Description of Artificial Sequence: Synthetic coding sequence
atgtactgtcaggactccaacatctgtgcagtgtttgccgtgcagggcggaaaggttggcaggaaacatggcatcaagcgcggtcgcagaccctccatcagatcaccggcacaacgggctcggggaccgtggatacacgagtccaagcaccctgcgtttgccaagcaacagattaatctggaaatgcctaattcacgggctactaccgagttggcttgggtctgcagtagtaccagtcgcaagaaaaagtgggccagatccttaacgctgagtacagccccactcagcccgccaccttctctggtgcactgcgaagactgttcctgccttcccggatgtcattccggtgacctatataatcttgcacccgcagaacgaacctgctag

SEQ ID NO: 58693 - DNA, 2157 bp, Artificial Sequence
  Description of Artificial Sequence: Synthetic coding sequence
atgtcaagaggctactctgagaacaacaactttctcaataataacaaccagatggtgcttgacatgattctctatcctcttatcgggattccccagaccataaattgggaaacgattgcccgacttgtgcctggcctgacaccaaaagagtgcgcgaaaagatttgacgagctaaaatcgagcggcagttctcccgtcgacaaccagtacaacagccttatggctgctggcgaaagcccagttgagacactcgcgacctatatcaagagttctctgttagatatacatggggaatttcaggagacaccggtgggccatgatgcagtgtccaagaccggccgtcactctatagccagtacgcggaattgcagtagcgaatccgaaaactgtaccactcataacggtggcgaaatgaccgaagaatccgaggggccaaatatggtgatacatgtgtgcgatgaagcgaagaacctcaaggaggatttcacgtgtcctagggatcttctgatctccgagatgaagtacttcgcagagtacctgtccatggacgctcagcgatgggaggaggtggacatctctgtgcactgtgacgtccacatcttcaattggctcatcaagtacataaaacgcaatacaaaagagaacaaagactgcgagatgcccacactggaacctgggaacgtaatctctatcttgatttcatctgagttcctgaaaatggatagcctggtagagcagtgcatacaatactgccacaagaacatgaatgccatcgtggccactccatgcaacatgaactgcatcaacgccaacctcctgaccaggattgcggatctcttttcccacaacgaagtcgatgatttgaaagataagaaggataagttcaagtctaaactgttttgtaagaagatagaaagattattcgacccagagtacctgaatcccgactcccgctccaatgccgcaactctataccgttgctgtctctgtaaaaagcttttaacaaaggaaacagaacgtcgtatcccttgtataccagggaagatcaacgttgacaggcgagggaacattgtatacatccacatcagggacaaaacctgggatgtacacgagtatcttaatagcctctttgaagaactcaagtcctggcgggacgtatattggcgcctatgggggaccatcaactggctgacctgctccagatgttatcaggcgttcctttgcatcgaatttagtcactgccagtatcatagcgagacggtagtctaccctacagccgctagcagtcttaacacagtcgggaccgggatctatccttgttgcaaccagaaagtgctgcgctttgaccccacacagttaacaaaaggttgtaaagtgcgggatcatatggtgaccctgcgagaccagggtgaagggggtgacctgccaagttgcccaactgctcgaatgcttgacgatctccataagtatcgggatgtgattgttgtgcccttctccaaggacaccgtctccgacgtcggagtggggctgtgcgatgaaaaaggcattgaatgcgacgtcctactcgaaccaaacaccccttggggacctaaaacgggagagcttaacgccttcctgtccttaaaaaactggacactgcagctgaagcagcagagcctgttcagcgaagaagaggagtatactaccggttcagaggttaccgaagacgaggtaggcgacgaagaggaagtcagtaaaaagcaaaggaagaaagaaaagccaaaaaagtttaccaggcagccaaagaaacaggtcagtagcccatgcgcccagcgtaaagagaaggctctagagaagtccgcgagccgtgatgtgtctccctttgtgatgtcaatgcagaaaaataaatgggacgctacaaggagtctaagattcaatcaggacgctcaacgagaggatgatcagagaaggatgaccgagatcaccggacacctcataaagatgcggttgggagatctggatcgagtaaagtcaaaagaggcgaaagagtttgccggtgggatttattcccgcttggaggcccagattaaagccagcgtgcctgtgagcgccagacaatcctcaagtgaaaagaatacccggtccaagagcagattcgggcagggccgtcccgcatag

SEQ ID NO: 58694 - DNA, 942 bp, Artificial Sequence
  Description of Artificial Sequence: Synthetic coding sequence
atgcaggaagccgatgcctcaatcaagaccgccgagactaagggaaggacttggaagtaccaaaacatcgagcctggtggcggtcctcagacatccggcaagggagggtttgggtcactcgtactcgtgttcctcggccagcgcgtcggatgcaacgagaccgggtccatgaatctcgagaagctgcaaacgcggccaaacatgacgatcttcaccagaaacaatattgccacgaacttctcgtcatcgagtagctcctcctacttctccccaccccctccacctgtgctgctccccctgctacttctcttgccccaattgttcagctcttcctcaagtagcttctttttctctttctcccctagcacctccccgcttgtgtcgccctgcttctttagttcctcttccagcttctgtttttccgttagtctcctaccaagttccagccccacctctatgacaaagttcccaaaggcagtcaccactaagataaaaaccgacaaaagggacttaatcaaactcaagggcttttgtactgccaaggaaactattaacaggaccaataggcagcccatcgagtgggaaaagattttcactaattatgcctctaataaggggctgatttctcgtatctataaggagcttgggcagagcgacaagcagagaccaaataatccaattaaaaaatgggctaaggacatgaacagacacttctccaaagaagacattcaggtcgctaataagcatgaaaaaatgttgtctacatcgctgattattggcaagatgcagatcaagacaaccgtgaggtaccatctgatgccggcacgaaaagccacaattaagaagtccgaaaataaccgctgctggcagggctgtcgcggtaaaggcactttcacccactgctggagcaaatgtaaattaaagtgtaaatgcaagatgtag

SEQ ID NO: 58695 - DNA, 864 bp, Artificial Sequence
  Description of Artificial Sequence: Synthetic coding sequence
gtgtttttcctgacaggtatccccggactggagacccgtcagatctggacatctatccctttttgttgcttatacgtgatagccattagcggaaatggaatgattctgtttgtgatcatcactgagtcaagcctccacgagcccatgtatcattttctgtccatgctgtctttcatggacctcggcttgtgcctatcaacactgacaaccatgctgggtatcttctggttcaatgcccgagagatttcattcgatgcctgtatcggccagatgttcttcatacatggattcactttcatggaaagctctgtgctattggcaatggctttcgaccgctttatcgccgtgtgtaacccactgcggtacgctacgattctaactaacagtcgaattataaaggtgggctttgcgattgttctcaggggcaccaccgctctcgtgccactgctgctgctcctgaaaaggttgagcttctgccggtcgcacgtactccaccacagctattgtttccatccagacgcaatgaaactgtcttgtactgatacgtggattaatagtgcttttggcctggccatcgtgatcagcacagcgggactcgacagtgtgctgatcctcatttcctacgtgttgattgtgcgatcagtgctgtgcatcgcatccccggaggagcagaagaaggctttcggcacctgcgtgagccacatcagcgccgtggccatcttctatattccaatgattagtctcagccctgttcataggttcggtaaacacgctcccccactggttcatatgctgatcgcgaacgtgtacctcctcattccacctgtcatgaaccccattatctacagcgtgaaaaccaagtag

SEQ ID NO: 58696 - DNA, 396 bp, Artificial Sequence
  Description of Artificial Sequence: Synthetic coding sequence
atgcgcaaacccaggcgggcaggatgggagactttaagcagaaaagctccaggcccatccgccggacttagaccttctcctgcgacctgtgacacgtgtcatttccctatcctgggcgatggcaacgctactctccccttcgcccctgggaaaacatctagggtccctagcgattccggagtgttctcttcagaccctcgtgcaaactggagcagcatccgcaatttcccctccgcaaaatgcgtcggcatagaactacacgcttcactgtctacttctgcggagtggcttctgcgcggacggggaggtgctctcccttggatcgtccggtgtctggccgcaacagatctgttgctgccaggaaaaaagggggtcgaatcatgccccgtgggttag

SEQ ID NO: 58697 - DNA, 5420 bp, Artificial Sequence
  Description of Artificial Sequence: Synthetic coding sequence
atggccaccagggtggaagtcggttccattacaccccttacagcagtgcccggtttaggggaaatggggaaggaagagacgttaaccagaacctatttcctgcaggctggtgaggcttccggagcgccacctgcccgaattcttgaggctaagagtcccctgagatcccctgctcggctgctacccctgccacggctcgccccaaaaccattcagcaaggaacaggatgttaaatcacctgtgccaagcctgcgaccctccagcacaggaccttccccctccggtggcttaagcgaggagcctgcagctaaggacctggataataggatgccgggtctagttggtcaggaagtgggatctggtgaagggcctcgcacatctagcccactcttcaacaaggctgtgttcttgaggccctcctcatccaccatgatcctgttcgagacaaccaagagtgggccagccctgggcaaggctgtgtccgagggcgcagaagaggctaagctcggggtgtccgggtctcgacccgaggtggccgctaagcccgctctgccaacccagaagcccgctggcaccctgcctaggtccgcacccctctcacaggataccaaacctccagttccccaagaggaagccggacaggaccacccgcctagcaaggcctcaagcgtcgaggatacagccagaccgctggtcgaacccaggccaaggctgaaaagaaggcctgtctccgccattttcactgaatccattcagccccagaaacccggacctggggcagccgctaccgtaggcaaagtgcctcctaccccgcctgaaaagacctgggtgcgcaagcccaggccactcagtatggatctcactgcccgttttgaaaataaagaagctcttctgagaaaggtggcagacgagggcagcggccctaccgctggtgacatggctggactggagaggcctagagctgctagcaagcttgaccgggattgcctggttaaggctgaggcccctcttcatgatcccgacctggattttctggaggttgccaaaaaaatccgtgagaggaaagaaaaaatgctttcaaagcctgagatgggatcaccccgtgccttagtgggcggtagttcaggagtgactccgagcaatgatcagtctccctgggaggaaaaagccaaactggatccagagccagaaaaggccgcagaatccccctcccctaggctgggtcggggactcgagctggccgaagtgaaatcccgagtcgccgacggcgaggctgctgcaggaggcgagtgggcttctagaaggtctgtccgtaaatgcattagtctatttcgggaggattcaactctggcgttagcggtgggaagcgagtctccattggccactcctgcttctccctccgccgcacctgagcctgagaaaggcgtagtgtcagtacaggagaggatccggggatggactgccgaatcaagcgaggccaagccggaagtacgtaggagaacttttcaggccaggcccctctctgcggatctgactaagctgttctcatccagcgctagttcgaacgaggtgaagtacgaaaaatctgccgagctgagcggagaatttcctaaagagccgcgtgaaaaacagaaggaaggccactccctcgatggggcttgtattcctcgctccccctggaaacccggaacactgagggataagtcccgtcaaacggaacagaaagtgtccagcaatcaggatcctgatagttgtcgcggagggtcatctgtcgaagccccttgcccatctgacgtgacacctgaggacgatagatcctttcagactgtctgggcaacagtcttcgaacaccacgtggaaagacataccgttgccgaccagagcggacgatgtctaagtactacaccacctggtgacatggcccacgccagagtctctgaacctaggccccgacctgagatggggagttggctggggagggatcccccagacatgaccaagttaaaaaaggagaattcgcgaggatttgataacccagagacggaaaagctgggtccaacaacactgctgaatggtgagctgcgcccttaccatacaccactgcgagacaagtatcccctgtccgaaaaccataacaataacacttttctcaagcacttagaaaatccacctacctcccagcgaatcgaacctcgctacgatatcgtgcatgcagtaggtgagcgtgtacactctgaggcaatatccccagctcctgaagaaaaagccgtgacactgcgaagcctccgatcatggctgtccctgaaggatcggcagctatcccaagaggtgacccctgctgacttagaatgcggtctggagggacaagccggatccgtacagagagcatcattgatttgggaggctaggggcatgcccgaagcctccggtcccaagttcgggggtaactgccctttccccaaatggacgggcggagctgtagtctccagccacaaagctaccgtggcagtttctgaagagcactgcgcgcctggcgcaaccagtgttagagccattaaggctgccatctgggagagtcagcacgagggtcccgaaggcgctcgtagcaagcctggtgtgggtgccaggggccctcctcagggatgtccactggaccctctgtctagagccactaacggtccctctgactcacaggccagaacacatcccgacgccttcgccgtgcaaaagggccctttcatcgtagccgctcgggagggggatcccggaccagcccaggtgcctcagccggcagtgcggatgcgaaaagcaggtgccatggaccagcgcatggaccggtggcggagaaggacattgccccctaatgtaaagttcgatacattctcatctttagtcccagaggacagtccgcacgtggggcaccggaggactgactacgtgagcccaaccgcgagtgcactcagaaaaccccagttaagccattatagggtagagacacaggaagtaaatccaggggcaagcagggaccaaacatcacctgccgttaaacagggctcacccgtggagcccaaggctacctttttcgccgttacatatcagatcccgaatacccaaaaggctaaaggcgtggtcctatcaggcgctgagtctctgctcgagcactccaggaaaatcaccccccctagttctccacatagtcttacaagcaccttggtgtcattgggacacgaggaggccttggagatggctggcagtaaaaactggatgaagggtcgagagcacgaaaacgcatccatattaaaaactctgaaaccgacggacagaccatcctctctgggtgcttggtctttggatccctttaatgggaggatcattgatgttgatgctttgtggtcacacagaggctccgaagatggccctcgccctcaaagtaattggaaagagtctgcaaacaaaatgtcccccagtggcggagcccctcagacaactcctactctgcgaagcaggcctaaagatttgcctgtcagaagaaaaaccgacgtgatctcagacacctttccgggaaagatcagggatggttatcgcagctctgtactggatatcgacgcgctcatggcagagtaccaggagctgagtcttaaggtgcctggggaggcgcaagagagacggtcaccaacagttgagccctcaacactgccgagagagaggccagtgcagctggggggtgtcgagcagaggaggcggagcctgaaggaaatgcctgatactggagggctttggaagcccgctagctctgccgagattaatcatagctttacccctggcctgggcaaacagctggccgagacattggagaccgcaatgggcactaagagtagccctcccttttgggctttgccaccgagtgcacccagcgagcgataccctggcggttcaccaatccctgctgaccctcgaaagaagacaggattcgccgaggacgacagaaaagcctttgcttcaaagcatcacgtagctaaatgtcaaaattacttggccgagtctaagccaagcgggagagaggatccagggagcggcgtgcgcgtgagtcctaagagtcccccaactgatcaaaagaagggcacccctcgcaagtccacagggagaggcgaagaagattcagtggcgcagtggggcgaccaccctcgtgattgcgggagagtgcctctcgatatcaaacgagcgtatagtgaaaaagggcctccagcaaacattcgggaaggactgagtatcatgcatgaggcacgtgagagacgaagagaacaacccaagggccgtccctctctgaccggcgaaaacttagaggcaaaaatggggccatgctggtgggagtctggcactggcgactcccacaaagtgctcccacgggatctggagaaggaggacgcccctcaagagaaagagaggccgctccagcaggtatctcctgtggcgtcagtgccatggaggagtcattcattctgtaaggatagaaggtcagggccttttgtcgatcagctgaagcagtgtttttcccggcaaccgaccgagcccaaagatactgataccctcgtccatgaagcgggttcccaatacgggacctggacagagcaatgccagtctggcgaaagtctggcaactgaaagccccgactccagtgctacgagcacccgcaaacagccaccttcctccagactgagctctctgtcttcacagacagagcccaccagcgcgggagaccaatacgattgctcccgtgaccaacgatccacgtccgtggaccacagcagcaccgacctcgaaagtaccgatggaatggagggaccgcctcctccggacgcctgtcccgaaaagcgcgttgatgacttctccttcattgaccaaacctctgttctcgattccagtgctctgaaaacgcgcgttcaactttcaaaacgttcccgtagaagggcaccaatcagtcatagtctaagacgaagcagatttagtgagtccgagtctcggtcccctctcgaagacgaaactgataacacttggatgtttaaggactcgactgaggaaaaaagcccccgaaaggaggaatctgacgaagaagaaactgcttctaaagcagaacgcacgccagtgtcgcacccacagagaatgcctgcatttccagggatggatcccgctgtgctgaaggcacaactgcacaagcgcccagaagtcgacagcccaggagagacacctagctgggctccccaaccaaaaagccctaaaagtccgtttcaaccaggtgtactaggcagcagggtgctgccaagctccatggacaaggatgaaaggtctgatgagccctcccctcagtggctaaaagagctcaagagcaagaaacgccagtccttgtatgagaaccaggtcta

SEQ ID NO: 58698 - DNA, 741 bp, Artificial Sequence
  Description of Artificial Sequence: Synthetic coding sequence
atggccattcttccaaaagtcatttaccgttttaatgccatccccatcaagttgcctatgacgtttttcactgaacttgagaagactaccttgaagttcatttggaaccaaaaacgcgcatgcatcaccaagagcatcctgcggcaaaaaaagaaggcgggaggcattacacttcccgactttaagctctattatacagccactgtcacaaaaaccgcttggtattggtatcaaaaccgggacatcgaccagtggaatcggaccgagcccagcgagatcatgccacatatttataattacttaatctttgacaagccggataagaataagcagtggggtaaagattcattgagcaacaagtggtgctgggaaaactggctggctatctgcaagaagttaaaattggaccccttcctcaccccatacactaaaatcaactccagatggatcaaggacctgaatatccgccctaagacaatcaagaccctggaggagaacctcgggattaccatacaggatatcggtatgggcaagcatttcatgtctaagacaccgaaagcgatggccaccaaggccaaaattgataaatgggacctgatcaaactgaagtccttctgcacagcaaaagaaacaaccatccgggtgaaccgtcaacccaccgaatgggagaaaatttttaccacctactccagcgataaggggctgatatccaggatttataacgaactcaaacagatctag

SEQ ID NO: 58699 - DNA, 63 bp, Artificial Sequence
  Description of Artificial Sequence: Synthetic coding sequence
attatgcctctctacagcagctcaggggacaggacgcccattagtaagaatcccacgaaatag

SEQ ID NO: 58700 - DNA, 867 bp, Artificial Sequence
  Description of Artificial Sequence: Synthetic coding sequence
atgtatgtgttccagttgttcgattactactcagcgtccggcaccaccctgttatggcaagctttttgggagtgtgtggttgtggcctgggtgtatggggcagaccgctttacggacgatattgcgtgcatgattggctatagaccttgtccttggatgaagtggtgctggtccttcttcacacccctggtctgtatggggatctttatctttaacgtcgtttactatgagcctctggtgtataataacaccaatgtctacccgtggtggggcgaagcaatgggctgggccttcgttctgagtagcatgttatgcatgcctctgcatctgctaggctgtctgttacgcgcaaaaggcaccatggcagaatgctggaagcatctcactcagcctatttggggcctgcaccacttggaataccgggctcaggacgccgacgtccggggactgaccactttgacccctgtaagcgagtcaagcaaggttgtagtggtggaatcagtgatgggtcagttgtcttctcaccaccaactgacctcaggactttgggggaagcgtctgcagtactctatcctgggcgtctgggccgcaaatttggcctgcagcggcttcccaccttgtgccttggggtgggcgcagccacaggagggcacaccagatacagccccaacctcaaggctcaaggccgacgcgctgcccgctcctcctgtcttctgcgttgcggcactgacccacgtgtgcctgagcagaccggtgccccgtaggctgtcagatccaaagaaggggtttcctgatacaagaacagaagccggtggcctgggcctcagggagggaggcggtcctgccggaacgtttctgctgtgttag

SEQ ID NO: 58701 - DNA, 666 bp, Artificial Sequence
  Description of Artificial Sequence: Synthetic coding sequence
gccaggcgcagaggagccgctgctgctttgagcagagccagagtgtggggcagactgtatccccaaccaaagctccaggaggccgcacctcttcctcggaggggctgggacgggggtggccacgttggcggtggaggagacgcgagaggaccacgactggagggagagtccctgcctcaccctaggctagcaccagcagccccatccgctagcccagcactggcacacccattggtggcacatcctgccaggctggacagcagccggaaccctggcacagggatttatttcggcggttccgctgcttggcgccctggtctgtcacgcgtgagtcaggatcgttctccaaattcctccaggccactatcccttagcgggattcccgctgacgtgagcccccctgctaaaacccgggaggagaaacgcgaacccgcattgtggtcacgggaaaaagaggaaggtgctacagcactgcaagatcacggctgggaaaaagagtggcgaggcttccgtactttttcagtgcggctccatgtgccggtgtttataagtggatcccaagcactgggctcttgggcccgtatcacctgttgcccgccactctggtcacgaggatgtttctgtaaggaatcaagtggtagggagtctatggcctgcctcacctag

SEQ ID NO: 58702 - DNA, 1023 bp, Artificial Sequence
  Description of Artificial Sequence: Synthetic coding sequence
atggcgcgtgatttgataggacccgctctcccccctggatttaaggcccgtggcacagccgaagatgaagagagggatccctcgcccgtcgctggtccggctctgcctcctaattacaaatcttccagctctgacagttctgacagcgatgaagattcatcgagtctgtatgaggaggggaaccaagaatccgaggaggatgatagtgggccaaccgcaaggaaacagcgaaagaaccaggacgacgatgatgatgatgacgacgggttctttggaccagcactcccgcctggattcaagaagcaggatgatagccctccgaggccaattatagggccagccctgcccccaggcttcattaaaagcacacagaagtctgataaggggagggatgatcccggacagcaggagaccgactcttcagaggacgaggacatcatcggcccaatgccagcaaagggccctgtgaattataacgtgaccactgaattcgaaaagcgtgcccagcgcatgaaagagaaactgacgaaaggcgacgacgatagttccaaacccattgttagagagtcttggatgacggagctgccgcctgagatgaaggacttcgggcttggtccaagaacatttaaaaggagagcagatgatacatccggggacaggagtatctggacggacactcccgctgatcgggagcggaaagctaaggaaacacaggaagctaggaaatcatcatcaaagaaagacgaagagcacatactctccggcagagacaaacggctggcggaacaggtaagctcctataatgagtcaaagcgctctgaatcactgatggacattcatcataagaagctgaagtccaaggcagctgaagacaagaacaagccccaggaaaggattccctttgacagagataaggatctgaaggtgaacaggtttgacgaagcacagaagaaggcacttataaaaaagtcccgagagttgaatactagattctcccatggaaagggtaacatgttcctctag

SEQ ID NO: 58703 - DNA, 1200 bp, Artificial Sequence
  Description of Artificial Sequence: Synthetic coding sequence
atggaacgtaagaatccttcacgcgagtctcccagaaggctttctgctaaggtgggcaaaggaacagaaatgaagaaagtggctagacagctgggaatggcggctgctgaaagcgacaaagatagtggcttcagcgacgggagtagtgaatgtctgtccagtgccgaacagatggaaagcgaggatatgttgtcagcactcgggtggagccgggaggatcggcctagacagaacagcaaaaccgcaaaaaatgccttcccaactctgtctcctatggtcgtgatgaaaaatgtactagtaaagcaaggctcgagctcaagtcagctgcagtcttggaccgtgcagccctcctttgaagtcattagcgcccagccccagctactttttttgcatcctccagtcccctcccctgtaagcccctgccataccggtgaaaaaaagtctgactccaggaactacttgccaattcttaactcatacactaagattgccccacaccccggaaaacggggtttgtctttggggccagaggaaaagggcacgtctggagttcagaagaaaatctgcacagaaagattgggaccaagcctctctagctctgagccgaccaaggccggtgccgtgccttccagtccttcaactcctgcacccccaagcgccaagcttgcagaagatagcgctcttcaaggagttccgtcccttgtggcaggtggcagcccccagactctgcaacccgtgtcttcttctcacgtagccaaggctcccagtctcacgtttgcctcacccgctagccctgtgtgcgcttccgactcaaccttgcacgggctggagtctaattcccccctcagccccctgagtgccaattactcaagtcctctgtgggcggctgagcatctatgtaggagcccagacatcttctccgagcagagacagagtaagcacagaaggttccagaacacactagtagtgctgcataaatccggcctgctggagatcaccctgaaaacaaaagaactgatacgccaaaaccaggctacccaagtcgagctggaccagctgaaagaacaaacccaactcttcattgaggccactaaatcccgtgcaccacaggcatgggccaagttacaggcgtccctgacacccggatcaagtaatacaggctccgatttggaggccttctctgatcaccctgctatttag

SEQ ID NO: 58704 - DNA, 315 bp, Artificial Sequence
  Description of Artificial Sequence: Synthetic coding sequence
acctgcatttcattctttctgtttctaaaaaaatccttggcactcttgccgaggttggagtatagtggtacaatcctggcccactgcaatttgtgtctcctgggctcttccaacagccatgccagcgcatcccaagtggccggaattaccggaatgtgtcatcacgtttggctgatattcgtgttcctcgttgagacgggcttccatcatgtggcccaggcagggttagaacttttagtgtccagttctagcccagccctggccagtcagagcacagaaatcacagggatgtcacagtgcgcctggccactttag

SEQ ID NO: 58705 - DNA, 303 bp, Artificial Sequence
  Description of Artificial Sequence: Synthetic coding sequence
tgtgaaacaccgaggctgcccgaaattgcactcagggccctgcccaggccgggagtgtcatccctgggtactatcctttgcgtgccgtccgtgccagtcggacccattgtgctaacttccgctaccccagagagcagccgctttactagaccagctccttcgacagtgccagaggcacaccgccactctaggatcctgcggctggcacctgtcccttgtaggtgctaccgcccacctgccccagcccatacatccaggtctaccagtttattttatgaatcgcctagtacatttaatgtctag

SEQ ID NO: 58706 - DNA, 201 bp, Artificial Sequence
  Description of Artificial Sequence: Synthetic coding sequence
acaaggaacttatgggttttcttcttttttttcttcgagacggaatcttgcagtgtcgcacaggctggagtacaatgggctcagtcacgtcttaccacggccagtcccggatgcaaacagtttagctgtctttcactgctgtcttcttgggattatcgccatgcacctccccaccctgcaaattattgtattttcgtgtag

SEQ ID NO: 58707 - DNA, 261 bp, Artificial Sequence
  Description of Artificial Sequence: Synthetic coding sequence
gtgatttgcccgccttggcccccaaaggtgctaggcttacaggctaagtatcacctgcataaccacaaattttttgttctgcgtcgtagtctcgccttacttccaaggctggagtgttctggtgcggtactcgcacactgcaacctgtgcctgccctctagctccaactcccctgcttccgctagccgagtcgccggaatcacgggaagctgtcaccatacccgtctcatcttctgtatcttctcaagagaaggcgtttag

SEQ ID NO: 58708 - DNA, 252 bp, Artificial Sequence
  Description of Artificial Sequence: Synthetic coding sequence
atttcagcccattgtaatctgtgcctgcccggatctagtgactcatccgcaagtgccagtcgaatagccggaataacaggcgcacatcatcacacccggctgatcttcgtttttctagttgaaacagagttccatcacgtgggccaggcaggtctcaaatggcctcaggtgatccaccccccttggccccctaaatgttgggattaccgcagggagccacctcgcccagccctcttcttcaactttctgtag

SEQ ID NO: 58709 - DNA, 318 bp, Artificial Sequence
  Description of Artificial Sequence: Synthetic coding sequence
ctgctgcctagattggactgttctgggacaatctccgcccactgcaatttaccccgttttaagcgttttagctgcttgcggcttcccaccggaatcaccggggcataccaccacacatggataattttcgcatttctagttgaaacagggttccaccatgtcggacaggccggactgaagttgctcactagcgaacagctgggcaatacgaaatcccgctcccgacctccgggatggagcgcaatggccccttcttggctgaccgcctcatctgccagtagagtccatgtgatcctactgccacagccacccgagtag

SEQ ID NO: 58710 - DNA, 348 bp, Artificial Sequence
  Description of Artificial Sequence: Synthetic coding sequence
atgtctaagtgttgcgcccagagtctgaacgtcccccatcccagcgaagggtctgagaatattacccaggattatcttgagaagaattggtatttgcagcggaacactcagaatacagaaataaaaggcccaggcggaaaagtgaataaccccccacatccacggctgaccttccctggggtggtttccgaaccccctgagggcggtcgggtgcccaaagtgctgaaactcgccccatctgctaagaacctggttaaagcaaccaagtccctgacaatcccaatgatttcgattaaacacccccctggcgtgcgcctgtggtcttggggcaggagatttataacatag

SEQ ID NO: 58711 - DNA, 2436 bp, Artificial Sequence
  Description of Artificial Sequence: Synthetic coding sequence
atgaaggccaggactaggccactgcgagcctcccatgatattgttccgacgattactcaaggtagtagggacggacacaggtcgcctgccagagaccctcgaactactccggcatgtagagactctctgcagaacggccatacatccgacagcagtagcggcgagagcagcgggggtcaccggcctcgtagggggccaagccctagccatgtgcgtttcgaagacgagtcagccagagaggcagaatttaggcacctggaacggctgcagcagcgacaacggcaagtgctttccactgtgctccaggcggcagaccaggggccattaaggtcaaaaccagacttggcagactacattaatggcgctccccgactcagagatgccggacaagggacgttccatcgcctagtgggttctctggatcgtagggggcatcccgcacccccagctccaggatccgaaagaaggtgccaagcctgcgggtcctgtatagatgacccacgcccagcccaggggaaggccccaccggttccgaggacactgcaggaactccaggctgcctgcggcatggaacgggttctgggaggccttagctccccactccgtcttctcccagccgagccgcgtctgcacatggaatggatccgagaaactcacattggcgatacagtgtgcccagctgaggtggactctgcactggattctaccgataacagtgacaactgtcgcactgacagtgaggaagcgggaacgtcccaggccggatgggcctgtggcagaacgcagggcagcagccccagattacgccttcgcggaagccgtccacgcggacatagatggtcaaagaaagcagaggccgaactgccatgggggctgcaagcccaacagcatctgcccagagcagacgatgttgaagtagaaaacgaagtgaaggaggggcgtgggcacacacctgaaggaacactattcctgagggaggatgcaaagccacctgatttagaacttaaaagggtgtccttgggtccacaatggcaaccaggacccggactgggaagccaccaaccccatcctctggatagccgtactccctgccggacggcatacgccaccacagcacccatgacacctgagagctccggcccaggcggtcaggctcaagtgacagagtcacatgagtcactggagattgtttctccttcgagcctgcagcagtcacacgccgagccctctgcaccccatcaggcttggcagcctacagcatctttgtgcccagaggggtgggctcccacacctccacccagccgcaagactacgtcacccgtttctcaccgaaaagctgcccttgcaggattgctgcgcctgggcgatcagaccgaacccgttggaatcccgagacccccttctcgcagcgcggtcctgaggacctgcgagctgcctccatctcaaactcaaccttcacgtcctcaggtgcgccatcctcttctagctctctcaaccaataactgtaacaattccgctcccagggggttgcaagagccatatgggggagcggtacacgaagggagagtcgagcgaggaccgtgctccagggaaccagagcccccacttgagaactcgagagatggcggtccacaggggtttctcgggtctgccgatgtagccacaattaactctaccggaattacactgtcccttagttctgaggagtcagagtccagcaaagaatcggaaggctccctccagcgtactggatcagggagcggtggccacgtgctttcacgggctagcgcaggggctgggaccggaccagggagtccgtcagccgcaccgctagaccagaacaagaagcggtcttcatccatcgccagcaccctgggactcaaaaaactattttctgccctcggacaaagtagccggcctaaactagggaaatctcggtcttactccgtggagcagttacaacccgcaccacctgggttaacttctcagtctcgcgcaccctctcttcagtccctgcatccagtgtcaccctctcaccaaagaagaaaggcggctagcttccaaaacctccactcactgctgtcttctaagggcaaccggtcctcactgtatctagtggcgggacccggtgaccatagcgctgccggtcggccagctaaaacatcccccagacgtgccttgtccgtcgaggatgtgggagcaccatccctggccagaactgtgggtaggctggttgaggtgtttccagatggtacaagtcagctacaactgcagagaagtccgggtgggaccttcggcttttgcgtggcttcaggtaatggtaggcctgacagcgggatgcccagcccattgccacagcctcatggatggggcggattatcaaagcaagggagggctttttggctctggtctgaagcattcctggtgttcggatag

SEQ ID NO: 58712 - DNA, 3573 bp, Artificial Sequence
  Description of Artificial Sequence: Synthetic coding sequence
atggagggcactgaggccgctgctgccaagccagccggtggcagccctcaggggccaaagactgggtcaggcaccgccagccctgtagaagggacttccgccgttgaatggagcggccctgagccgcagctggataacgggcatccacctcgcccatggccatgcccgcaggagaatcgaacaagctctctgatggcaccccaacccccaagggtgtggggcgtccagctccagggcccttccgtgcttgagagcaaggtgcgtgccctgaaggagaaaatgactgttgccaagcagggagtatctccttgctctgctagccaggaatggagttcacctaaaaagccccaatgtaggaggggtaaagcaggtcgggctggcacacctagcgagggatcattccttcctggggctgtagtcgctcccaggacccagaacctccccgatggtcagctagatggctcgatcaacgaggagcagccagccagggacggcggaccacgtctcccgagacctccggcacctggtagagagtactgtaatagaggaagtccatggcctcccgaagctgaatggacactcccagatcacgaccggggacccctgctaggcccatccagcctacagcagtcacccatacatggcgtcactccaggcagaccagggggtcctgggcactgcaacaaaatcatccatatcccaagtcctcggactggtcgtagctaccctttccccgacggagtggttaccgaggccgacttggactccacatcactcacatcggaagaggtttttgttcctcggaccgccttgctgggagaacgatggcgagcgggagacctcgaggctctcggcgctggttcttctgtcctgtctctaagcgacagggttgagcgcaatagactcctgctccaagaaatgctgaacgtttccgggcagagtccccgaaaagtgggcactccggcttggactccaagctgggatactgccgcacccgagaggcctgtaggggatgtggattgggctagtggaaccagcttgcaggattctggacagaacagaaccgtggggcctaatccagagcctgtgctgagtcccaggcacgaggaggcgacccatctgttacaacgggcaaggatgaaggccaggactagaccactgagggcaagccatgacattgtgccgactattacgcagggtagcagagacggacacagatcccctgcgagagaccctcgaacgactccagcttgccgcgattctctgcagaatggacacacctcagactccagttcaggcgaatcgtctggtggtcacagacctcggagggggccaagcccctctcacgtgaggtttgaggatgagtcggcgagggaagctgagtttcggcacctggagcggctgcaacagcggcagcgacaggtcctgagcacagttctgcaggccgctgaccagggacctttgcgctctaagccagatctagctgactacattaacggtgccccaagactcagggatgccggacagggcacctttcatcggctcgtagggtctttagataggagggggcacccagcaccacccgcacccggaagcgagcgcaggtgccaagcttgtggttcatgtattgatgacccccgaccagcccagggcaaagctccccctgttcccaggaccctgcaagagttacaagctgcctgcgggatggagcgggtccttggcggtctgtcctccccattacgcctgctgccagccgaacctcggctgcacatggagtggataagagaaacccacatcggcgacactgtatgtccagcagaggtggactctgccctggactctaccgacaactccgataattgtagaactgactctgaggaggctgggacttcccaagccggatgggcatgtggacgcacccagggaagttcgccgaggttgaggctgcgcggtagccgtcccaggggccacagatggtctaaaaaggccgaggctgagcttccctgggggctgcaggcacagcagcacctgcctagggcagacgacgtagaagtagagaacgaggttaaagaaggcaggggacacacccccgagggtacactgttccttagggaggatgcaaagccaccggacttggaactcaagcgggtgtccctgggaccccagtggcagcccggacctggactaggaagtcaccaacctcatccactggactcaagaacaccctgtagaaccgcttatgcaactacagctcctatgaccccagagagctccggacccggagggcaggctcaagtaactgagagccacgaatccctcgagatagtttcacccagctctctgcaacagagccacgccgagccttccgctcctcatcaggcctggcaaccgaccgcctccctctgccccgaggggtgggcccctacgccaccacctagcagaaagaccacatcgcctgtgtcacataggaaggccgctctcgcagggctgctcaggttaggggaccagacagagccagtggggattccaaggcccccatctaggtcagccgtgctgcgtacttgcgagctgcctcccagtcaaacacaaccctcccggccacaggtgcgtcaccctttgctcgctctgagtaccaataattgtaacaatagtgcaccccgtggcctacaggagccttacgggggagccgtgcatgagggaagagtcgagagaggaccctgttcacgagagcccgagcccccattggaaaactcccgcgacggcggaccacagggattccttggctcagccgatgtggctaccattaattccaccggcatcactctctcgctaagcagtgaggagtcggaatcttccaaagaatctgagggctcactgcagagaacaggctctgggtctggagggcatgtcctgagcagagcatctgccggagccggtacaggacccggttctcccagcgcagctcccttagatcaaaacaaaaagagatcctcttcgatcgctagcacgctgggattgaagaaactcttcagtgctctaggacaatccagccgccctaaactagggaaatcacgctcctattcagtcgagcagctgcagcctgcgccacccggactcaccagccagagtcgagcaccctctcttcagtccctgcacccagtgagcccaagccatcagcggcgaaaggccgcatccttccagaacctgcacagtctcctgagctctaaagggaataggagcagtctctacttagtcgccggtccaggagaccatagtgcagccggacggccagcaaaaaccagcccacggagagccctcagtgtcgaggacgtcggagctcctagcctcgccaggacagtgggccgactagtagaagtatttcccgacggtaccagccagctccagctccagagatctcccggtgggacgttcggattctgtgtagcgagcggaaacggcagacccgacagcggcatgccaagtcccctgcctcagcctcatggatggggcggtctgagcaaacagggacgcgcattctggctgtggtctgaggccttccttgtgttcggttag

SEQ ID NO: 58713 - DNA, 405 bp, Artificial Sequence
  Description of Artificial Sequence: Synthetic coding sequence
atgattcctgtccggggtctgtggtactgttacctgcaagtgaagaaagtgcgtctgcgagaagctgaacggctgggtcctaagagccaatgtccagccgagtgcggagcagcctcttggattagctgggtcctacaacaccagcaactgctagctagcgaatgggctaccaaggatggcagaggaacatggggctcaaagcctagttgcacggttccagccttgtctgccacaagtcagctgctgcaacttggtcgcctgaacagcgatttacaatttgtccgacaacgcgctaaaaagtccgtatcttccccttctctgctgcagttctggtgctgtctgtcgagactctcattccacgctctgaatcagaagattaattccactaatattaatatcacctag

SEQ ID NO: 58714 - DNA, 1155 bp, Artificial Sequence
  Description of Artificial Sequence: Synthetic coding sequence
atgtctgccggaagcgccacccatccaggggctggtggtcgcaggagcaagtgggaccaacctgcacctgccccactgctctttctgcccccagctgccccaggaggagaagtcactagcagcggtggatcacctggcggaactacagcagcgccttccggtgcgctggacgccgctgctgctgtcgccgcaaagataaatgccatgctgatggccaagggtaagctgaagccgacccagaatgcttccgaaaagctgcaggcgccaggtaaaggtcttacctcaaacaaaagcaaggacgatctcgtggtcgctgaggtagagattaatgacgtcccactcacatgtcgcaacctgctaactagaggacaaactcaagatgagattagtcgcctgagcggcgctgccgttagtacacgaggtaggtttatgacaactgaagagaaagctaaggtcggacctggcgatagaccactgtacctacacgtccaaggacagactcgtgagctggttgatcgggcagtgaacaggattaaggaaatcatcacaaacggggtcgttaaggcggcaaccggcaccagtcctacattcaatggggcaacagttactgtgtatcaccagccagcaccaattgcccagctgagccccgcagtgtcgcagaagccaccgtttcagagtgggatgcactatgtgcaggataaactctttgtggggcttgagcatgcagttcctacttttaatgtgaaggagaaggtggagggacccggttgtagttacctgcaacatattcagatagagaccggcgcaaaagtgttcctacggggtaagggcagcggctgtatcgagcccgctagtggcagagaagccttcgagcccatgtacatatatatctctcatcctaaaccagaaggattggctgctgccaagaagctgtgtgagaatctgctgcagactgtacacgcggagtattcgcggttcgtaaatcagatcaatactgcagtgcctctccccgctgcttcttcaacctctctccgatctaccaagcattccgcgacttcatgcttcatttctacctggtcgctggcgggtatcacttactggtcgcccacctgcgcgaatacaatcccggataacaccagtgctgcgagctcatag

SEQ ID NO: 58715 - DNA, 1695 bp, Artificial Sequence
  Description of Artificial Sequence: Synthetic coding sequence
atgagtgccggaagtgctactcacccaggggcaggcggtcgacggtctaaatgggaccagccagccccagctcctctgctctttttaccccctgcagccccaggaggcgaggtgacttcatcgggaggcagtcccggaggcacaactgctgccccttccggagctctggacgccgcagcggctgttgccgcaaaaattaacgccatgttgatggcaaaaggcaagttaaaaccgactcagaacgcctctgaaaagctccaggctcccggaaaaggactgacatcgaacaagtcaaaagacgacctagttgtcgctgaggtggaaatcaatgacgtgcctttgacctgtagaaatctgctgacacgtggccagacgcaagacgaaatcagcagactcagtggtgctgccgtgagcacacggggtcgctttatgaccactgaagagaaggcaaaagtgggcccaggggacagaccattgtatttgcacgtgcaggggcaaacccgcgaactcgtggatagagccgtgaatcgaatcaaagaaatcatcactaatggggtcgttaaagccgcaaccggcacaagtcccaccttcaatggcgctactgtcacagtgtatcatcagccagcccctattgcccagctgagtccagcagttagccagaagcctcccttccaatcgggtatgcattacgtacaagacaagctgtttgttggtctcgaacacgccgtgcctacattcaacgtcaaggagaaggtcgaagggcctggttgcagctacctccagcacatccagattgagacaggcgctaaggtgttcctccgcggaaagggtagcggatgcattgagccagcctctgggagagaagcgttcgagcccatgtatatttatatctcccatcccaagcctgagggcctagcggctgcaaagaaactttgtgaaaacctgctccaaactgtgcacgcagaatattctcgctttgttaaccaaattaataccgcagtaccgctgcctggttacacacagccatcggctatctcttcagttcccccacagccaccatactacccctccaacgggtatcagtcaggatatccagtcgtccctcccccacagcagcccgtccaacccccttatggcgtaccgtccattgtgcctcctgccgtgtctttagcaccgggagtactgcctgcattgcccaccggcgtgcctccagtgccaacccaataccccattacccaggttcagccacctgctagtacgggccagtcccccatgggcggaccctttatacccgcagccccagtgaagactgcccttcccgctgggccacaacctcagccacagccacaaccacccttgccaagtcagcctcaggctcagaagaggagattcactgaagagctccccgacgaacgcgaaagcggcctgctgggctatcaacatggacccattcatatgactaacctgggcacgggcttctcatcacagaacgagatcgaaggggcaggatcaaagcctgcctccagcagtgggaaagagcgggagagagacaggcagctcatgccgccaccagccttccctgtgactggtatcaaaaccgaatccgatgagcgcaatggcagcgggacacttaccgggtctcacggggaatgcgatatagccggtggcacgggcgagtggctacgactggtctag

SEQ ID NO: 58716 - DNA, 1845 bp, Artificial Sequence
  Description of Artificial Sequence: Synthetic coding sequence
atgtctgcaggctctgccacccacccaggcgcaggaggacgaaggagcaaatgggatcagccggctccggcaccactgctgttcctgcctcccgctgcacctgggggagaggtgacctcttccggtggatctcctgggggaacaacagccgctccatccggtgccctcgatgcagctgccgcagtcgccgctaaaatcaacgccatgctgatggctaaggggaagttaaagcccacacagaatgcctcagagaaactgcaggccccaggtaaaggactgacctccaacaaatcaaaagacgacctggtggtggccgaagttgagattaacgatgtgccacttacttgcaggaatctgctcacacgaggacagacgcaagacgagatctccaggctctcgggggctgccgtctccacgcgcggacggttcatgacaacagaggaaaaggcaaaggtcggcccaggggatcgcccactctacttgcatgtgcagggtcaaacccgagagctcgtcgaccgcgcagtcaaccggattaaggaaatcatcacaaacggggtggtgaaggccgcaactggcacttccccaactttcaacggtgccaccgtgaccgtataccatcaaccagcaccaatcgcccaactcagtcctgcagtgtcacagaagccaccatttcaatctggcatgcattatgtgcaagacaagctgtttgtaggacttgaacacgctgtccccacattcaatgtgaaggagaaggtggagggacctgggtgctcatatctgcagcacatccaaatagagactggagccaaagtctttctgcgcggaaaagggagcgggtgtattgagcccgcttctggaagagaagcgttcgagcctatgtatatctacatctcacatcctaaacccgaaggcctcgctgcggcaaaaaagctgtgcgagaacctgttacagactgttcacgccgagtactcgcgttttgtcaatcagatcaataccgctgtcccactgcctggctacacccaaccttccgcgattagctccgtgccacctcagccaccttactatcctagcaacgggtaccagtctggatatcccgtggtgccacccccacagcagccagttcagcccccttacggagtcccatctatagtccctcctgcggtctcactggcaccaggggttttgccagctctgcccacgggcgtgcccccagtgcccacgcaatatcctattacacaagtccagccgccagcatcaactgggcagtctccaatggggggaccttttatccccgctgccccagtgaagaccgccttacctgctgggccacagccacaaccacaaccgcagcccccactcccttcacagccacaggctcagaagcggagatttaccgaggaactccccgacgagagagagtccggtctattgggctaccaacacggtcctatccacatgacaaacttaggcactggcttcagcagccaaaacgaaattgagggtgctggaagcaagcccgcatcctcctctggtaaagagagggaaagggataggcagctcatgcctccgccagccttccctgtgactggcatcaaaacagagtcggacgagcgtaatggcagcggcactttaaccggatcacacgactaccccgcaaaaaaaatgaaaacgacagagaagggctttggcctggtggcctatgcggcagattcaagcgacgaggaggaggaacacggaggccataagaatgcctccagctttccacagggctggtctctgggctaccagtatccatcttcccagcctagagcaaaacagcagatgccattttggatggccccatag

SEQ ID NO: 58717 - DNA, 1581 bp, Artificial Sequence
  Description of Artificial Sequence: Synthetic coding sequence
atgatccagagccaaatctcctttgaggacgttgccgtggactttacactggaagagtggcagctgctaaaccctacacaaaagaacctttatagggacgtcatgttggagaactattccaatctagtttttctggaagtctggttagataatccaaaaatgtggttaagagacaaccaagataatttaaagagcatggaaaggggacacaaatacgatgttttcgggaagatcttcaattccagcataaatattgtgcacgtcggactgcgctcccacaagtgtggcaccggggagaaaagcttaaagtgtccgtttgatcttctcatacctaagaataactgcgagcggaaaaagatcgacgagctgaataagaagctactcttttgcatcaagcctggtcggactcatggtggaattaagtactgtgattgttctacttgccgcaagtccagcaatgaggaaccttggctgaccgcgaatcatataacacacactggagtttatctgtgcatggagtgcgggaggttctttaacaagaagagtcagctcgtgattcaccagcgaacccatactggggagaagccataccagtgttctgaatgcgggaaggcttttagccaaaaatctctcctaactgtgcaccagcgaactcactccggtgagaagccacacggctgcagcgagtgtcaaaaagcctttagcagaaaatctctcctgattctgcaccagaggatacacaccggggagaagccctacggttgctccgagtgtggcaaagccttttcccgcaaaagccaactgaagcgccatcagattacacatacaatcgaaaagccctacagttgttctgagtgcggcaaggctttttcccagaagcttaagctcattacccaccagcgtgctcataccggcgagaaaccgtatccctgcagtcattgcggcaaggcttttttttggaaaagtcaacttatcacccaccagagaactcatacaggtaagaagccatatgggtgcggggaatgtcaaaaagccttcagtagaaactctctgttgataaggcatcagaggattcacactggagagaagccctatgaatgcaatgaatgtggggaggctttcattcgaaagcctcagctgattaaacatcaaattacccacacaggcgagaaaaactaccggtgttctgattgcgaagaggcgttcttcaaaaagagcgaacttatccgccaccagaaaattcacctgggagagaaaccgtacgggtgtatacaatgcggaaagacttttttcggaaaatctcagctgctcacccaccaccggacccacactggagagaagccttacgaatgttcggaatgtggtaaagccttcacacagaagtcttctttgatcagccaccagcgcacccacacaggtgaaaaaccgtatgaatgttctgaatgccggaaaacgtttagcgagaaatcctcattgattcatcaccagagaacacacactggagagaagccattcgagtgttcagagtgtcggaaggcattcgcttggaaaccccaactgcttcgccaccagcggatctag

SEQ ID NO: 58718 - DNA, 4065 bp, Artificial Sequence
  Description of Artificial Sequence: Synthetic coding sequence
atgagcagtaccgctgacctgctcgacacaattctgaaggcaatcgaggagaatataactaccgagaacagctgttccctgctgatggccctggatactcttctgaattccgattctacgaaagaaatgggatttacctgcaaaatacaggccctcagggacaaactctggatattcctcgttcaatcattttacgccgtgaggcatacggagtcatggaagttgatgagcaccgacgaccagcagaaaatccaggctgccgcattcgataagggcgatgacaggaggttgggaaaaaagccaatattcagcagcagtcagcaacggaagcaggttagtgatagtggagacatcaaaataaaatcatggagagggaataacaaaaaggaatgctggagctatctctcaactaataagaagatgaagtcagatggcctgggagcttccgggcattcgagttcaactaatcggaatagtatcaataaaactctcaagcaggatgatgtgaaagagaaggacggcacaaagattgcatccaaaatcactaaagaactgaaaaccggcggtaagaatgtcagtggaaaaccaaagaccgtcacgaagtcaaaaacagagaacggcgacaaagcgagactcgaaaatatgagcccccgtcaggtggttgagcggagtgccactgctgctgctgccgcaacgggacagaagaaccttctgaacggaaagggcgtgaggaaccaggaggggcagatcagcggcgctcgtccaaaagtgttgactggcaacctgaacgtgcaggctaaagccaagcccctgaagaaggccactgggaaggatagtccctgtctgtctatcgctggcccttctagtcgttctaccgattcatccatggaattctcaattagtactgagtgcctggacgagcctaaggaaaacggcagtacagaggaagagaagccgtccggtcacaagctctctttctgtgactcacccggacagatgatgaaaaacagcgtagactccgtcaaaaacagtacagttgccatcaaatctcgccctgtgtcccgagtgacaaatgggacttcgaacaagaagtcgattcatgagcaagacacaaatgtcaataactctgtgctgaaaaaggtaagcggaaaaggttgcagcgaacctgttccccaagcaatcctgaagaagcggggaacctcaaacggctgcactgcggcacaacagcgaaccaagagcactccctccaatctaacaaaaactcaagggtcccagggtgaaagcccgaatagtgtgaagtcctcagtctcatcacggcagagcgacgaaaacgtggccaagcttgatcataatacgaccacggagaagcaggcccctaagcggaagatggtcaagcaggtgcacacagctctgcctaaggtcaatgccaaaattgtggcaatgccaaagaaccttaatcagagcaaaaagggagagaccctcaataataaagattcgaagcagaaaatgccaccaggccaggtgattagcaaaacccagcccagctctcaacgccctctgaagcacgagactagtactgtgcagaagtcaatgttccacgacgttcgtgacaacaacaacaaggactccgtttccgaacaaaaaccccataaaccactcataaatctggcttcagaaatctctgatgctgaggccctccaatccagctgtcgccctgatccacagaagcctctgaatgaccaggaaaaggaaaagttggccttggaatgccaaaacatatcgaagctggacaaatccttaaagcatgagttagaatcaaaacagatctgcctggataagtctgagacaaaattccctaaccataaggagacggatgattgtgatgccgctaatatttgctgccattcagtggggtcagacaacgtgaattctaaattttatagcacaacagccttgaaatacatggtgtcaaatcccaacgagaattccctgaattcaaacccagtatgtgatctggattcaacgtccgcaggccagatccacctcatttcagatcgggagaaccaggtgggcagaaaggatacaaacaagcaatccagcattaagtgtgttgaagatgtgtcactgtgcaatccagaacggaccaatggcactcttaacagtgcgcaagaggataagaagtctaaggttcccgtggaaggtttgaccatcccttccaaactgagcgacgagagcgccatggatgaagacaagcatgccactgccgactccgacgtaagcagcaaatgtttctccggacagctgtctgagaagaattctcccaagaacatggagacatcagagtcaccagagtctcatgaaacacctgaaacaccttttgtggggcactggaacctgagtaccggcgtgctgcaccaacgcgaatccccagaatccgatacagggtctgccacgacctcgagcgacgacattaagccgagaagcgaagactacgacgctggtggtagccaggacgatgatgggagcaacgaccgcggaatttccaaatgcgggactatgctgtgtcacgacttcctgggcagaagctctagtgacaccagcaccccagaagagctcaagatttatgattctaatcttagaatcgaagtaaagatgaagaagcagagcaataacgacctgttccaggtcaatagcactagtgacgatgaaattcccaggaagcgtccagaaatttggtctagaagcgccattgtgcattctagagaacgcgagaatatcccacggggtagcgtccagtttgctcaggaaattgaccaggtgagttcaagcgctgatgaaactgaggacgagagatctgaagcggaaaatgtggctgaaaacttctcaatcagcaacccagctccacagcagtttcagggaatcattaacttggctttcgaggatgctacggaaaatgaatgccgggagttttcagccactaagaagtttaagcggtccgtcctgcttagcgttgatgaatgcgaggaattgggatctgatgagggagaagtacacacaccctttcaggcctctgtggattcttttagtcctagcgacgtctttgatggcattagccatgaacatcacggccgaacttgttattccagattttcccgtgagtctgaagataacatcctggaatgtaagcagaacaaagggaattcagtgtgcaagaatgagtcaaccgtgttagacctttcttcaatagattcttctcgaaaaaataagcagtcagtttctgctacggagaaaaagaatacaatagatgttctgtcatcccgcagcaggcaactcctcagagaggacaagaaagtaaacaacggctcgaacgtggagaacgacatccagcaacgctctaagttcctcgattccgacgtgaagagccaagaacgcccatgccatttagaccttcaccagagggaaccaaattccgatatacccaaaaatagttccacaaaatcactagattcattccgctcacaagtcctgccacaggaggggccagtgaaggagtcacactcaaccacaaccgaaaaggccaatatagctctctctgcgggagacattgatgattgcgacactctggctcagacgcgtatgtacgaccaccgtccttcaaagacattaagccccatctacgagatggatgtgattgaggcttttgagcaaaaggttgagtccgagacccatgtgaccgatatggactttgaggacgaccagcactttgcgaagcaggattggactctccttaaacagctcctgagtgagcaggactcaaacctcgacgtcaccaactctgtgcctgaagacctttccctagcacagtatctgatcaaccagacactactgctggcacgggattcctccaagcctcagggaattacccacatagacacactcaacaggtggtccgagctgacgagtccactggactcatctgccagtatcactatggctagcttcagtagcgaggattgttccccacagggagagtggaccatcttggaactggaaacacagcactag

SEQ ID NO: 58719 - DNA, 2364 bp, Artificial Sequence
  Description of Artificial Sequence: Synthetic coding sequence
atgggagaccctggtagtgagattatcgaaagcgttccgccagcaggtcccgaagcgtcagagagcacaaccgatgaaaatgaagacgacatccagtttgtgtccgaagggccatccagacctgtgctcgaatatatcgacctggtgtgcggcgacgatgagaacccgtccgcctattactctgacattcttttccctaagatgcccaagaggcagggtgacttcttacactttctgaacgtaaaaaaggtgaaaaccgatacagagaataacgaggtcagcaagaaccactgcaggcttagtaaagccaaggagccccatttcgagtatattgagcaaccaatcatcgaggagaaaccatctttaagtagcaagaaagaaattgacaatctagtgctgccagactgctggaacgagaaacaagctttcatgtttacagaacaatacaaatggttagaaataaaagaaggaaagcttggctgtaaggattgttccgccgttcgccacctcggctctaaagccgagaaacacgtgcatgtcagtaaggagtggattgcctacctggtgacaccaaacggcagcaacaaaacaacccgtcaggcaagcctcaggaaaaaaatcagagagcacgacgtgtctaaagcccatggaaagattcaagatcttctgaaggaatccactaacgattcgatttgcaacctggtgcataaacagaataacaagaatatcgatgctaccgtgaaggtctttaataccgtctatagcctggtcaagcacaaccgccctctctctgacatcgaaggagcaagggagctacaggagaaaaatggggaagtcaactgcctaaatactaggtattctgccacgcgtatcgcagaacacatcgcgaaggagatgaaaatgaaaatctttaagaatatcattgaggagaacgccaagatttgcatcatcatcgacgaagcatcgaccgtttcaaagaaaaccactctcgtgatttaccttcaatgtacaatccagtccgccccagcaccggtgatgctgtttgtagccctcaaagaactggtttccaccattgccgagtgtattgtgaacactcttcttacaaccctcaacgactgcggttttacaaacgaatacctgaaagccaacctgatcgcattttgttcagatggagctaacaccattctaggacgcaaatccggtgttgcaaccaaactgctagagaacttccccgagatcataatttggaactgccttaatcaccggctgcagttatctctcgacgacagcatctctgaaataaagcagatcaaccacctaaagatcttcatcgataagatctattccatctaccatcagccaaacaaaaaccagaccaaactgctcggcactgtcgccaaagaattggagaccgagattatcaagattggtcgggtcatgggaccacgctgggccgcttgctcacttcaggctgcaactgccgtgtggcacgcctacccaattctctacatgcatttttcacactcttactctggcctcgcgaagaggcttgccaacatcaattttctccaggacctggccctcatgattgatatcctggaggagttctccgttctgtccaccgctcttcagtcacggtcaaccaacatcaagaaggcccagaagctaattaaaaggacaattcgcgctcttgagaacctcaagatcggaaccggcaagtacgagtcccagatagaagacctgataaaatcagataagtttaaagacattccattcaataaaaacaacaagttcaacgctctgccacgctctatcctgctcgacaatataattcagcacatgaacttgaggttattgtccgatcgtaatcacgaggacatttttaactactttgatctcctggaaccgtccacgtggccttatgaagagattacttcaccttggattgctggagagaagaccctgttccatctgtgtaagattctcaaatacgaagtggatctaaacgatttccgggaattcgttaacaacaatattaagtctaataacgtgagtataccaaccactatttacaaggcaaagaagatcgtgtccaccattgcaatcaattctgcagaggccgagcgaggcttcaatctgatgaacatcatttgtacaagagtacgcaactcactgaccatcgatcacgtgtccgatctcatgactataaacttgctaggaaaggagcttgcagactgggacgccactcctttcgtaaagtcatggagcaattgcaatcaccggctagccaccgacacccgagtcaggcaaaaaagcaccaaggtgttccatgaaaatcagctcgctatctggaatttaaaatag

SEQ ID NO: 58720 - DNA, 636 bp, Artificial Sequence
  Description of Artificial Sequence: Synthetic coding sequence
atgcagcttggggagcatacgcaccctcaaaaaaatccaaagtcccttgcgggatgcctgctacccaacccccatccgcagttgcagttgaggggcaagcgggctgccggtttgctgctacgcagaaatccatggagacacccacaggcaccagggggatccagtacctgggccccttccctcccacctatcctcgccccacaagcctacctgaactttgccccacccacaccggttcccggtgggagcccagggaccgaggcccagccggtggcccctgctaatgccttgggatccaggtctaagctgaatctgacacagcctagctgcctgagtagtgggtcccatcttccccttccatttcctgctgggatgtgcccccatccagccaaccctacctgggctctccggaaaggtgccgaggtaccacaagggcctcctctcagtcacacccggaaggcactctgtttggccgcatcaggggttggggctctgttgcttgaggtgcctaggcatccgggatgggggcaacagtcagctgctggcttccagcaagtatttcaggaaggtgccggaacccatttcccttcagtgcgggtacaaccaggccgtggaaagctccaagggcagcgctag

SEQ ID NO: 58721 - DNA, 1488 bp, Artificial Sequence
  Description of Artificial Sequence: Synthetic coding sequence
atgaaaaagcgaaaggagctcaatgctctgatcggtctggccggtgactcgaggcgaaagaagccaaagaaaggtccctcttcgcatcgtctcctacgcacagagccgccagatagcgacagcgagagctctagtgaggaggaggaggagttcggcgtggtggggaatcgcagcagattcgcaaaaggcgactacctcaggtgttgtaagatttgttatcctctgtgtgggttcgtgatcctggcagcctgtgttgtcgcatgcgtgggcctcgtctggatgcaagttgccctcaaggaagatctggacgcgctgaaggagaaattcaggactatggagagtaatcagaagtccagctttcaagagattccaaagctgaacgaggagttgctgtccaagcagaagcaactcgaaaaaatagagtcaggagagatggggctgaacaaggtctggattaacataactgaaatgaacaagcagatcagtctgctgacatccgccgttaatcacttgaaggccaatgttaaatctgccgcagacttaatatcattgccaactacagtggagggactacagaagagtgtggcatctattggtaatactcttaactctgtgcatctggcagtcgaggcacttcagaagactgtggacgaacacaaaaagactatggaattgctccagtctgacatgaatcagcatttcctgaaggaaacgcccggaagcaatcagatcatcccatctccctcggccacgtccgagctggataacaaaacccacagcgagaatctaaagcaggatattctatacctccataactctttggaggaggtgaattccgcgcttgtgggctatcaacggcaaaacgacctgaagctagaggggatgaacgagacagtatcaaatcttacccaaagggtcaacctcatcgaaagcgacgttgtggctatgtccaaagtcgagaaaaaggccaacttgagtttcagcatgatgggagatcggagcgccacccttaaaaggcaatctctggaccaggtgaccaatcgaactgataccgtgaagatacagagtatcaaaaaggaggatagtagcaatagtcaagtatctaagctccgggaaaaattgcagctaatttcagccctcactaacaagccagagagtaataggcccccagagacggccgacgaagaacaggtggagtcctttacgtcaaaaccttctgcgttacctaaatttagtcagttcctgggggacccggtcgagaaagcggctcaactgcgtcccatatcgctgccaggggtcagttccacagaggatctccaggatctgttccgcaagacagggcaggacgttgacggcaagctgacttaccaggaaatttggacgtcattggggtcagccatgccagagcctgagtccctgcgcgctttcgactctgatggcgacggtagatattcctttctggagttgagggtggccctgggcatttag

SEQ ID NO: 58722 - DNA, 345 bp, Artificial Sequence
  Description of Artificial Sequence: Synthetic coding sequence
atgtgtggctgggaagattcccagaagccctcagtgccttctcacggacccaaaacccccagctgtaagggggtgaaagcaccgcactcctcaagaccacgcgcttggaagcaggacctggagcagagcctggctgccgcttatgtgccggtggttgtggactccaaaggccagaatcccgacaagttgcgctttaatttttacaccagccagtactctaacagtctgaaccctttctacaccctgcagaagcccacttgtggatacttatataggagggacactgatcatacgcgcaaacgcttcgacgtgccgcctgccaatctggttttatggcggtcttag

SEQ ID NO: 58723 - DNA, 324 bp, Artificial Sequence
  Description of Artificial Sequence: Synthetic coding sequence
atgtggctcagcccgtggtccacttgcccaccccaccccctgccttcttgtctgacagcctgttgcagtcccgctcatcagcccgtacggggttctgctcagccccctgcatctgacttgtgcacatgtgttacatgttgcagcggccctcatcctaactacccaccggcacacttactacccacttcctctctgcctatatgtcccggattgatttgctgcttactaacatgcttattggttgactgcttttcggctttgctgtccgcttgcgagaccagagacctgagcccatggaaggcacgccgtgtgctactgcgttag

SEQ ID NO: 58724 - DNA, 2499 bp, Artificial Sequence
  Description of Artificial Sequence: Synthetic coding sequence
atgggtaccaccgcatccactgctcagcaaactgtctctgccggtaccccattcgaaggcctgcaggggtccggcactatggactcaaggcacagcgtatccattcattcatttcaatctacctcactccacaatagcaaagccaagtcaatcatccccaacaaagtagcacccgtagtgattacctacaactgcaaagaggagtttcagatccacgatgaacttctaaaagctcattacacactggggcgactgtccgacaacaccccagagcattacctcgtacaggggaggtatttccttgtaagggacgtgaccgagaagatggacgtcctgggaaccgtagggagctgtggagcccctaatttcagacaggtgcaggggggtcttactgtgttcggcatgggccagccttctctttccggttttcgtcgggttctccagaagctgcaaaaggacgggcatagagaatgcgtcattttttgcgtgcgagaagagccagtgctgttccttcgcgcagacgaagactttgtgagctacactccgcgtgataaacagaatcttcacgaaaacctccaaggattgggtccaggtgttcgagtagagagtttggaactcgctatccgcaaagaaattcacgacttcgcacagctttcagagaacacataccacgtgtatcacaacactgaggacctatggggcgagcctcacgccgttgccatacacggggaggacgatctccacgtaacagaagaggtgtacaaacggccattattcctgcagccaacctataggtaccaccgactgccccttcccgagcaggggtccccccttgaagcccagcttgacgcttttgtctcagtgctcagagagaccccttctctattacagctgcgagatgctcacggaccgcctccagccctggtcttcagctgtcagatgggggtgggtcgcaccaacctggggatggtgctcggcacactgatactactccaccggagtggtactacctcccagcccgaagctgcccctacacaagccaagcccctgccaatggaacagttccaggtgatacagtcctttctgcgaatggtacctcaaggacgcaggatggtggaggaggtggatcgggctattacagcttgtgccgaactccacgatctgaaggaggtggtcctggaaaaccagaagaaactcgagggaattaggcccgaatctccagcacagggcagtggtagcaggcatagcgtgtggcaacgggcattgtggagtttagaacgttatttctatcttatcctcttcaactactacctgcacgaacagtaccctcttgcgtttgctctgtccttctctaggtggctctgtgcccacccagagttgtaccggcttcctgtgactctctcatcggctggtcctgtcgctcccagggacctaatcgcccgagggagcctgagggaagacgacctggtctctccggacgccctcagcactgtccgcgagatggacgttgcaaattttcggagggtcccacgtatgcccatctacggcactgcccaaccgagcgcaaaggccctagggtccatcctggcatatctgacagacgccaaaagacggctgagaaaagtagtatgggtgagccttagggaggaggcagtcctggagtgtgacggccatacttactcattgagatggcctgggccacccgtggcacccgaccaactcgagacactcgaggcccaactaaaggctcacctcagcgaaccaccaccgggaaaggaaggccctctgacttaccgctttcagacatgcctaacaatgcaggaagtgtttagccagcatcgccgagcctgccctggcctcacctaccaccggattccaatgcctgacttctgcgccccaagagaggaggactttgatcagttgctggaggccctaagggcagctctgtcaaaagatcctggaacaggatttgtgttctcctgtctatctgggcagggaaggacaactactgcgatggtggttgctgtgctggctttctggcatattcaggtagtgatgaaggtggtgcagctcctccccgacggtcatagggtcaagaaggaagttgacgccgctctggacaccgtcagcgagacaatgactcctatgcactaccacctccgagaaattattatatgtacttacaggcaggcaaaggccgcaaaggaggctcaggaaatgcgtaggctgcagctgcggagcctgcagtatcttgaaagatacgtttgcctcattttatttaacgcctatctgcatctagaaaaagcagactcttggcagcgccctttctctacttggatgcaagaggttgcaagtaaagctgggatttatgagatcttgaacgagttgggattcccagagttggagagtggtgaggatcagccattctcccgcctgcggtatcggtggcaggagcaatcctgctctctggagccttcagctcctgaggacctgctatag

SEQ ID NO: 58725 - DNA, 1428 bp, Artificial Sequence
  Description of Artificial Sequence: Synthetic coding sequence
atgccttgtccgtcacgcaacacctcctcccctgagcctcctacccctgggctaaaattctcttttcttcggggacagagacagccatctgtaaccccagaaaaagccagtctgcagcacaatggtccttggaaagtcctgtgctcactgtacagcccaaaacctaatcgggctaagagcctggggaaggctggaacgacccaaacgaaaactagcggtcctgcaacagccccaagcccattgacagaagagaaagccgctctgccagaagcctccgcagggtcaccagagcgaggacctacgctagaagaggaacctcctggccctgagcctagaattggtgccctgggagtgaaagtgtttcgctcacgtatcgcctgcttaccaggaggacgggacagggccggtagacccttactccttgtgagcacaacggagggcgcatgggaggcgccttggtgtaccgtcagtgaagtcacaaaactgttgagttacctctgtacaatccccaggccagaggacaaagccaaagggttggctgttctgatagatgcgaggcgtcagcccccacaaccgggtcttgtgtccgccctgcaggctacccaagcgcaggtcccagcatccataagggctatactcttcctaggggagaaggaggccgcactgcaattacagacgttgcccgatgtacagaaactcgacccgtttctcgctgacttgcaccaagcatctagtctgttgcaagcctctatcgaagagttcgagaaagctgatccccctgggggtatgcaggaagcaacccgttgcctctcgaagagcaaggaactgatggaggccgtcctccgggaccccggactgttgggacttcaacgtgaaggcggagcgactctggcaagactgcagcacgatgcaagccgacttgatttttcaccagatgtcagaagccatttggcagcggctactgccttgtattctctcgttgatgagcaactccacgttttagttaccgcttcgaactctcttttgggcaagttggaactccgagtgcgactggggcgactcgaggcagcaattcaccaagtctctgactggatggagcaggaggggcgtcgctgtctgcaatcgctgaccccgaaggacggctcattggagactgtagaaaaagcgcatgcggaattcgagaatttcttccttcaagcagcagctcaataccggcgaggattagagctgtcgaaacaggccgctcagctgggagctacagcaagaggggcaggggaggcggagcgggctgagtttcccgaactggctgccttcgcctcgacacaacgcgcatttcaagctgaattgactcatttttacatggctgcggagcgacaacggacggatctggagaccctcctacaccttcacaggttctgcaaaaggtag

SEQ ID NO: 58726 - DNA, 480 bp, Artificial Sequence
  Description of Artificial Sequence: Synthetic coding sequence
atgcaccaaacccacgccatccagcgcctggaggtcctgccaagcttttccaacgagtcccctacaagcagggaaacttcagagtcttggacgaaccaggatgacatcttttacgcgtatgcttccatgtcacccggtgctgagcacaggggcaccacacaattactgagatttcagctggctccaataaagaagctcgagggtagtctgcagacccactttttgctgtcctccctccacccacgtatgaccttccctggtcgtgccggtggaggcgaggccggaagccggccacctcgaagaccttgggctgggattctcatcctgcagctcccttctacaaggggcggacggaggtccggccacggggctgtaagatcttgggggccatggaaggtggtcgccgaacagccagtcggaggtaccgatccgcctgcacacggtggccgtgggcgtccctctcccaacgaaaacacatag

SEQ ID NO: 58727 - DNA, 3108 bp, Artificial Sequence
  Description of Artificial Sequence: Synthetic coding sequence
atggttgtgtttgttggacgcaggttaccagcactgttgggcctattcaaaaagaaaggctcggccaaggccgagaacgataagcacttgagcgtcggcccaggccagggcccaggtagcgctgtggacgagcatcaagataacgtgttttttccctccggcaggcctccccacctggaggagctgcacacgcaggcccaggaaggcctgcggtccctccagcatcaggaaaaacaaaagctgaacaagggaggctgggaccacggcgatacgcagtccattcaatcttctcgcacaggacccgacgaggataatattagcttctgctcccagactacctcttacgtggcggagtccagcacagccgaagatgctcttagtatccgatccgagatgatccagcggaaaggcagcacctttagacctcatgactcctttccaaagtccggcaaatctggcaggcggaggcgcgagagacggtcaaccgtactgggcctgccccagcacgtccagaaggagctgggactgcgaaatgaaagggaagctcccggaacgcccagggccccaggagccagggacgctgtgcgcattcctaccgttgatggtaggccgagaggcactagcggcatgggggcacgcgtgagccttcaagcacttgaggcagaggccgaggcaggagctgaaaccgaggccatgctgcagaggcacatcgatcgggtttacagggatgacacatttgtggggaggtccacgggcacacgcgcaccccctctgacgcggccaatgtccctggctgtccctggcctcacagggggagcaggacccgctgagcccctttcccctgcaatgtccatttcaccccaggctacctatctgtcgaagctgatcccacatgccgtcctcccacctaccgtcgacgtggtcgcgcttgggaggtgctctctccgcacgctgtctcgctgttcacttcacagtgcttccccagcatcagtgcggtcactaggcagattttcttccgtgtcaagtccacagcccagaagcaggcatccttcaagttcctcagatacctggagccacagccagtcaagcgatacgatcgtttctgacgggtcgaccctaagttcaaaagggggttcagagggccagccggaatcctcaacagcctcaaactcggtggttccgcctccccaggggggatctggtcgcggtagtcccagcggtggaagcacagcagaagcatcagataccctgtcaatcagatccagcggacagctgagcggaaggagcgtcagcctgagaaaactgaaaagaccacctcccccaccacggaggacacatagtcttcaccaaaggggcttggctgtgcccgacggaccgctgggtctgccaccaaaacctgagcggaagcagcaaccccagcttccacggcctcccactaccgggggatcagagggagccggagcagccccatgcccccctaatcctgcgaactcctgggtgccaggcttatctccaggcggatctcggagaccccctagatccccagagcgaacactgtctccttccagcggatattcttcacagtcgggaaccccaacactgccacccaaaggtcttgccggtcccccagcatccccgggtaaagcacaaccacctaaaccagaaagagttaccagtctcagaagtccgggtgcctccgtttcaagtagtctgacatccctatgctcctcctccagtgatccagcgccttcagaccgcagcgggcctcagatattgactcccctgggcgatcgattcgtgattcctccccatccaaaagtccctgcgcctttttcgccccctcctagcaaacctagatctcctaatcccgcagcgcctgccctcgcagcccctgcagtggtgccgggacctgtgagcacgacggatgcctctccccagagcccacccacccctcaaaccaccctgacaccattacaggaaagtcctgtgatcagtaaggaccagtctccaccaccttcccccccacccagctatcatcctcccccacctccgacaaagaagcccgaggttgtagtcgaagcgcctagcgcctctgaaacagctgaggagcccctccaggaccccaactggccgcctcctcccccaccggcaccagaggagcaagacctgtccatggcggatttccctccccctgaggaagctttcttcagcgtagcctcccctgaacccgctgggccttccgggtcccccgagctcgtttcgtcacctgcagcgtcctcaagtagtgccacagccctgcaaattcagccccctggatcccctgacccaccaccagctcctcctgcaccagcccctgcgtcctctgccccaggccatgttgctaagctgccacaaaaagagccggtggggtgttccaagggcggtggacccccacgggaagatgtcggggcacctttagtcacaccttccctgcttcaaatggtcaggttgcgttctgtgggggctcctgggggagccccaacccctgctcttggaccatccgccccacagaagcctttgaggagagccctgagcggcagggcatcccctgtgccggctccctcgagcggcttgcacgcagcagtaagattgaaggcatgtagcttagccgcatccgaggggctgagctctgcccagccaaatgggcctccagaggccgaacctcggcctcctcagagtccggcatcaactgctagtttcatcttttctaagggcagccggaagctgcagctcgaacggcctgtgtctcctgagacccaggcagatctgcagcggaacttggtggccgagctgaggagtattagcgagcagcgtcctccacaggccccaaaaaagtctccaaaggcccctccccctgtggccagaaaaccaagcgtgggcgtgccgccaccagcctctcctagctatccgagggcagagcccttaaccgcgccaccaacgaatggcctgccccacacccaggaccggactaagagggaattggcggagaatggaggagtcctccagttagtggggcctgaggaaaagatgggtctgcctgggtccgactctcagaaggagctagcctag

SEQ ID NO: 58728 - DNA, 240 bp, Artificial Sequence
  Description of Artificial Sequence: Synthetic coding sequence
atgatttttacccccttcctgcccccagctgacctgtcagtgttccaaaacgtcaagggccttcaaaacgatcctgaggagtgggtggccgtttctgatgctacagaagatccatctggcggaacagggttaccaagagagcctgctcttctgaggggaagttggagaagccgtttccagagagctctcgcatgctttacgaaatgctttaggggaggatatagggcactcggcatttag

SEQ ID NO: 58729 - DNA, 228 bp, Artificial Sequence
  Description of Artificial Sequence: Synthetic coding sequence
atgatcttcaccccattccttcctccagcagacctgaacgtgaagggattgcaaaatgatcccgaggaatgggttgccgtttcagatgcgactgaggatcctagcgggggtacaggactcccacgggagcccgctcttctaagaggctcgtggcgatcacggttccagcgagcgctggcatgctttaccaagtgctttaggggtggataccgagctcttggcatttag

SEQ ID NO: 58730 - DNA, 2217 bp, Artificial Sequence
  Description of Artificial Sequence: Synthetic coding sequence
atggaggactgcctacacacctctagcgagaacctctctaagctggtctcctgggcccattctcacgggacgatctgcagtttgataccaaacctgaagcacttactgtcagaggggtctcacggtaatctgacagctatgtgggggtgcagcgctggacacgcatatcactggcccttgaccgcgacatgtcgggcaggatcccaggagcgggtgtgcttccaggacaataggagctttaactctgatagcccaagcattatcggagttccgagtgagacccagaccagcccagtggagcggtaccctggaaggccggtaaaagccaagctggattgtaatcgcaccagagactcttgtgatttcagctattgcagcgagccatccgagttggatgaaaccgtagaagaatatgaagatgaaaacaccctgttcgatatggtgtgcgaatcatcggtgacagacgaagatagcgatttcgagccgcagacgcaacgccctcaatctatcgctcgcaagcgccctggcgtcgtgccaagttctctgcattcctcgagccaaactcagatggtggatgagtgcagtaacgacgtgatcattaaaaagatcaaacaagagatccctgaggactactacatcgtggcgaacgccgaattgacgggaggggtggacggcccagcgttgtccctgacacaaatggctaaaccaaaaccccagactcatgccggacctagctgcgtcggctctgccaaactgatccctcacgtgactagcgccatttcgactgaattagatccccacggtatgagcgcaagtccatctgtgatctcacgacccatagtccagaagaccgcacgcgtctccctggccagtcccaatcgcggtcctccaggtacacacggtacaaatcagcaggtagctatgcaaatgcctgtctcaacatcccatcccaacaagcagattagtattcccctgagcgcccttcaactgcccggacaggacgagcaggttgccagtgaggagttcctcagccacctgccaagtcaggtttcgagttgtgaagtcgccctctccccttctgtcaatacggaacccgaggtgagcagcagccagcagcaaccacctgtggcccctgcaattaccaccgaagctaccgcccagtgcatccctgaccaggacgagcgcgcagccgagctatctcgtgagcagaacgagaaaaccatccggtcgacccagactgctctgagaaatttccgtgagttccttatcagtaaatatccctccgagacacgcgaaatctacgtcatcccatgtaaggagctcgatgcgtatctagcctccttttttgtagatgccaggcagaaagatggatccgaatacgaaccaaattccctggccaactatcagtgcggcctagaacgttacttaaaagagcacaggtatggctattcaattacccgagataaggagttcaaacgtagccaggaggccctcaaacagaagcagatcgagctgaggtgtaaaggaaaggggaataaaccacacaagtctatgaaactgacttttgccgatgagctgattttgcggaaaaggggcctgctgtctcgctataaccctgaggggttactgaatctcgtttggttgaataacaccaaagccttcggtcactgcactggctttcatggcagcactctgaaatggggtgacataaggctgcgcgtgacagagacagggttggaatatctggaatggatgggacaggacactggtgacttgaacgccaagaccaagcgcggaggcactgattcgcgagtgtatgcaacccagcatgcgcctcaaacctgcccggtgcaggactacaaagaatatgcgcagcgcagaccccctgccatgcggtacgaagacgcccctttctatctcagtatcaagcccgtggtaaatttggccgcactccactggtacaattgccaggctctcggaaaaaacaaattagccaaaatggtgaaaacaatgtgtgagaagggaaacatacctggcagaaagacaaatttttcagtttaccagtcctgctcaactctctcggaggcccagagtaaccagttggtccttatctgtaataacctttcccaacaggccgctcagtctgtcgcaggacatagcaataatggtaatttcatagtgtccgcaagttatgacagctcctcagacactgcctag

SEQ ID NO: 58731 - DNA, 390 bp, Artificial Sequence
  Description of Artificial Sequence: Synthetic coding sequence
atgaaagctcaaggcgctatagctatggcttcgattgccaagcagacctcctccctcgtgcccccttacctgggaatgatcctgaccgcattgctccaaggtctagccggtcgtacatgggccggtaaggaggaactactaaaggccattgcctgcgtggtaaccgcgtgttccgccgagctcgaaaagagcgtgcctaatcagccatcgaccaacgagattttgcaggccgtcctcaaggagtgctctaaggaaaacgtcaaatataagatagtagcgatctcatgtgccgcagatattctgaaagcgactaaggaggacaggttccaggaatttagtaatatcgtaatccccctgattaaaaaaaagacccttgagaatttggagtag

SEQ ID NO: 58732 - DNA, 390 bp, Artificial Sequence
  Description of Artificial Sequence: Synthetic coding sequence
atgaaggcccagggcgctattgcaatggcaagcatcgccaaacagacatccagcttggtgcccccatatctcggaatgattctaacagcgctcctgcagggcctggccggaaggacttgggcaggcaaagaggaattgctaaaagctatcgcttgcgtcgtgacagcctgttccgccgaactcgaaaagtctgtgccaaaccagccaagcaccaacgaaattctgcaagcagtgctcaaagagtgttccaaagagaacgtcaagtacaagattgtggccatctcctgtgccgcagatattctgaaggctactaaggaggatcgcttccaggaatttagtaatatcgttattccccttatcaagaaaaagacgctcgagaatctggagtag

SEQ ID NO: 58733 - DNA, 465 bp, Artificial Sequence
  Description of Artificial Sequence: Synthetic coding sequence
atgtgcaccgtggcccacacttgcattgagcacatgtgcacctacatgagacttcacccactcgctcatccccacacatgcgccctggcaccaatttgtactcatgtgcacacattggctcacatgtgtatctgtaggaatgcccctctccacttatgtgataccccagctcacctacacactccgatctgtattcaggcacaaactcacagccacacattcgcccatacggccaccaacctgcacaagcaacatctgtataccgatacctatccttttgtgcccatacagtgcactcttacccacctacacacagctgtgctggcacatacatttgcccatacccacctgcacacctgcactcacactacgcacctctccgtgcagcacacctatctgtgcgcatatatgcacatctgtacatgcacacagcagtggcataccctgctgtatcactccccttag

SEQ ID NO: 58734 - DNA, 126 bp, Artificial Sequence
  Description of Artificial Sequence: Synthetic coding sequence
cggaagaacggccaacagcagcctcggggtagacccggatcagctagacctccggcacagcccccagaatgtggtgcagaccaacgcgtcaccctgcttacgggcgatccagtatccgctgcctag

SEQ ID NO: 58735 - DNA, 372 bp, Artificial Sequence
  Description of Artificial Sequence: Synthetic coding sequence
atggtcgacggcagaactcgcactattattaacgacattttcttcaccgagcccacgcctgaaatgtcctcactgcccgtacgttctcatagctcactctcgctcaatctggtgagcttgatggtcatttgtagaggaattattaagttagtgatccacttccgcatgtactgtcccccacggcttaaggctaagcatatagaacccaccctgcggccagttcccctgaaggaactccgcatatcacactggcctaacgaatgtattaggcactctgcatccgtgcctatggctaccggagccaacggcctcgagaccaaggatgagaccaagaggaatgcagaaaagtgcgcgtgcagcgtctttttgtag

SEQ ID NO: 58736 - DNA, 372 bp, Artificial Sequence
  Description of Artificial Sequence: Synthetic coding sequence
atggtggacggacgcacaagaacgatcattaacgatatcttcttcaccgaacccacgcccgaaatgtcctccctccctgtaagatctcactcatctctgtcgctcaatttggtgagcctgatggtcatctgccgcggaatcataaagttggttatacacttccggatgtactgcccgccacggctgaaggccaaacacatcgagcctacattacgccctgtgcctctgaaagagctccgcattagtcattggcccaatgaatgcattcggcattcagcgtctgtgccaatggctactggggcaaatggcctggagactaaagatgagaccaaacgaaatgcagaaaagtgcgcctgtagtgtgtttctgtag

SEQ ID NO: 58737 - DNA, 423 bp, Artificial Sequence
  Description of Artificial Sequence: Synthetic coding sequence
atggactgcaagtcaccaaaacgggcaaacatatgtccgcatctccccggtgggggactcttctctactcctcctagccaggctgcatggagaacactcttaaccgccttgtgttttccaggccctacatgcacggggccaatgagggagggccctcgagctgtctataaccctccccgagcccacagaaactcaagcgacaattgcgtcatgaaacacctgctatgcgctggcgataaaaatgggacccgacgtcacgctctgccctccccgctggagggcagctttcagcccggacggcagatccctccaccacagaccccaagtactgacccacagaccctgcctctgtcatttcggtcccttcttagatgtcatcaattgtgcgctgcgagtctgcctccatccctgaaactcccttag

SEQ ID NO: 58738 - DNA, 423 bp, Artificial Sequence
  Description of Artificial Sequence: Synthetic coding sequence
atggactgtaaatcccctaaacgtgcaaatatttgtccccatctcccgggtggaggactattttccacacctccatcccaggccgcttggcgcactctgcttacagcattatgctttccagggcctacttgcaccggtccgatgcgggagggaccccgtgcggtgtacaatcccccacgcgctcataggaacagcagcgacaattgcgtgatgaagcacctattgtgtgccggtgacaagaacggaacccggaggcacgctctaccatctcctcttgaggggtcatttcagccgggtagacagattccccctcctcagacgccctcaaccgacccccagaccctgcccctgtcttttaggtctctgctcagatgccaccagctgtgcgccgcaagtcttccgccttccttgaaactaccatag

SEQ ID NO: 58739 - DNA, 651 bp, Artificial Sequence
  Description of Artificial Sequence: Synthetic coding sequence
gcatggaccgttagtggccttctttccgcagctttcgagcccgaggtgccagcatccctgtcacagaagagcgaccatcgatctagcctgcctagtagcccatcgctacccctctccaaaacacttgcagttgcgtacgacccagaggattcatcagcagccaattggtgttttggcctttgtgccgttccgggacctgcctctctcgaccttggtcgcccttggccggtggaagaagcccaggttaaagccggtggatgctgctggctatcatctcttctgctggaggtaagcgctagcctcaggatggggagaaccgacccgctgactgggttgcagtctctggagggtagcatcgggcaggggaacggcggacacgtcacgtcgtgtagggccccatgtcatcggcctaaagagcaactgtgccctctgtccgtgggcggaccagggggagaggtggatcgtcacctgcccccaactggaatatggcagcaagaaccaggcttattgtgtaaaaaggggcgacccaagggggagcagtggcccattaagactcttgagaataaacacccatttccaaggtggctgcagatcatcacctcctgcaagtccacaccaggcgagcagctgaccttcatctctctctcgtag

SEQ ID NO: 58740 - DNA, 720 bp, Artificial Sequence
  Description of Artificial Sequence: Synthetic coding sequence
ccacagatgagcgcggtttacaccccaccctcagtgtcgacacatcaaatgccaaggaacccaaatcctcagcaacggcctcagatgtcagcggtgtatacccctcgatcagctcccactcggtgtccacagatgtctgccgtatacacccctccatcggctccgaccgatcagatgcctcgcaatcccaatgctcagcaaaggccacaaatgtcggctgtttacacaccaccctccgctccaaccgatcagatgcctagaaaccctaaccctcagcagaggccccagatgtcagcggtctataccccaccgagtgcccctaccgatcagatgcctcgcaatccaaacccacagcagagaccacaaatgtccgccgtctacacccctccctccgcgccaactgatcagatgccgcgaaacccaaaccctcagcagcggccacagatgtctgcagtctatgcgccaccttcagcgcctaccgaccagatgcccagaaatccaaacccccaacagcgtccacagatgtccgccgtctacgctcccccttccgcccctaccgatcagatgcctcgaaatcccaatcctcagcaaagacttcaaatgtctgctgtctatgcgccaccaagcgcgccaacagaccagatgccccgaaacccaaatccacagcagcgccctcaaatctctgcccctcgatgccaactgagcatccgccatagatag

SEQ ID NO: 58741 - DNA, 240 bp, Artificial Sequence
  Description of Artificial Sequence: Synthetic coding sequence
atgaagctcgccaaaactgctgtattagatcccgctacttatacctcattcagccctgggctctcaacttgtagttcctcccaaccccctggcgaccggcgtaaagggctgctcggctgcgtgggcagcggccactgtcctctgcctacacccgctcagtttccaaaggtgcagagaccccctacattacttggcggaaagaatacgtccacacaaaccacactgcaccccgtgatctag

SEQ ID NO: 58742 - DNA, 369 bp, Artificial Sequence
  Description of Artificial Sequence: Synthetic coding sequence
gatcccggaagcctccgttgccccgtgtgcctgtctatggagggctgcctggaaggcaccaccgaggaaatatgcccaaagggcacaactcactgctacgacggtctgcttcggttgcgagggggtggcatcttttccaaccttcgcgtgcaggggtgcatgccccagccggtctgcaacctgcttaacggaactcaggaaattggccctgtcgggatgacagagaactgcgacatgaaagatttcctccaactgaaacccgttggcttgctggaagaacacaacgttggtgagaaggaaagggggcagggccagcaccaatgtgtccagctggattggcagaagcgagccgctacaggcgtgagctag

SEQ ID NO: 58743 - DNA, 456 bp, Artificial Sequence
  Description of Artificial Sequence: Synthetic coding sequence
atgcacgccggtaaacgctcgcctctgacacaatccatctcttgtgtgtgtttaccagaactcggcgcactctgggaaattgagtctgccagggtaaacctgcgggtatctgggagggaagccagccgagagatggaaagttctcccaggccgcatcgaattgcgggtgtgaagaggttccttaagcacgcgggaaaatggagcctaagatggtttctgagtcctcgttggatacttcaattccggagatgggcacgcaaatggagtcggttcacacggtcttcgttccaagtgagatgggccgcagtgcccgcaggaaagtgctcccagcaccagggcttgagtgctgtggccactgcctcacctggcgtgttttgggagatggagtttgatgtgtcctccccattgaccgagggggctggctctcctatgagctcgaaacatgccggagaatag

SEQ ID NO: 58744 - DNA, 366 bp, Artificial Sequence
  Description of Artificial Sequence: Synthetic coding sequence
atgattgacagccctagaaaggagggggcactgtccccaccactcggcggttggcgcttgggcgatcggagatgtgcaggaggcaagcggaccgaacgaaggactcccgaaaagttgtggggcattagaggggagaaggagggtgtaaagcgtgagggacgccttagccggggtggcggtgctggggctggggcaggtgcgggtggcgtgaccgcccctcgacccccactccctgctctccatagcgccgctccagggctgcccccaccaccaccaccacctcctcctcctcctccgcttcccccaccgcctggcgtggcgggttgtggccagaacagaagccccaatagagccgcaggagaatag

SEQ ID NO: 58745 - DNA, 726 bp, Artificial Sequence
  Description of Artificial Sequence: Synthetic coding sequence
atggcaccggctacagacacagcctggctccctcctcatccagaaattcagctgagactgttatgcccgggtgaaacctacgggaaactcatgggcggatcacccagcgccggacccacaacacagagccagccccatgcattacggccaggcctacgcggacgcggagggtggtggcctcaacctttctggattcattcacccccacttacacattccgtcggcacgtttatttgtctggacgggctggtgtgtgctcttacagcacctgggcttggagtgggcctgacccctgccccttggcggcctccagggcagtccagaatgctcgagggacatggcccatggcccacccctggttcccgacctggacccacctgcgtctgtctgctgactcctgcctcctctagcctgcggccttgcctgtcagacaggggaacatgcccgggtgcacctcagggtgctgtcggtacatgcagagcctccccacagtctccttgccacaggcatcccagcctcagatcggggttggagtggacccaacctcctgaccaggatcaaggcctcctgacacctggatcgccgccactagtctccggagtcacacagaccccttggacttcccctttttgccccccacgcccaacaccttgggtgggcgcagcttttacggcagcgaatccatgcccaccggctccaaccgcatcatctgtcacaggtctttag

SEQ ID NO: 58746 - DNA, 714 bp, Artificial Sequence
  Description of Artificial Sequence: Synthetic coding sequence
atgcccgtgcaccctgcctggctgggcagtgcctgcctgccacatgcctcgcacggcccagcccctcagagctcagttggcggattactggtctctgtgaaaagtccacccggagacgttcatgctgccagagcttgtgctccgggaaggcatagcggtgagggcccacctcaagggaacctctcaccttcctgtcctgccgaagccggacatggatgtgcatctactggtaggcaggtgggggtgtccggagccggtagcagtccatcgggacccgcaccatgcgtcaaatgtagtgcctgggtgggaacttgtttccccctgagcctcctgcaggccgcaggcggtcctgcaggttcccctaatggcttttgtccggagccatgggccccagatcatgctccgacgctgcacggcctcaacaagtcactctgtcagggaccgcgttcgggcggagctcaacggaaaccgagagcacatacaggtgagggagtgagtggactgggccttactcaaccgagactaagcagtagcctgagaattagttggcacctcctcgcatgtgtcgcaacgcaagttgggtgcgcgtgtagattacgagagaagaccttgggcgaggattacgtgtcagcttttctaccatctacagggcctagctgggctcattgtgatcagacaatgtgcaaaagcactagggaaagtggtagatcttag

SEQ ID NO: 58747 - DNA, 966 bp, Artificial Sequence
  Description of Artificial Sequence: Synthetic coding sequence
atggtgagtcagtcaacagtcagacaagactccccagttgaaccctgggaaggaatttccgaccactctggcattatcgacgggtcaccaagattgctcaacactgaccatcctccctgtcaactggatataagactgatgcggcataaggccgtgtggatcaaccctcaggacgtccagcagcaaccgcaggacctccagtctcaagtacccgcagcaggaaacagcgggacccacttcgtcacggatgctgcttcaccttccggcccatcccccagctgcttgggagattcattagcggaaacaaccctctcagaagacacaaccgactccgtcggtagcgcctcaccgcatgggtcttcagaaaagtccagctccttctctctgtcctccaccgaagtgcacatggtgagaccagggtattcacatcgcgtaagtcttccaacttctccaggtatcctcgctacttctccctatccagaaaccgactccgcgttcttcgagccttcccaccttacatcagcggctgacgagggtgcagttcaggtgagtagaagaaccatcagtagtaactcgttttcaccagaagtctttgttctcccagtggacgtggagaaagagaacgcccacttttatgtggctgacatgatcataagtgccatggagaagatgaaatgtaatatcttgtcccagcagcaaactgaatcctggtctaaagaggtttcaggccttctaggctccgatcaacccgactcagaaatgacatttgacacgaacatcaagcaagagagcggttccagcacctcttcatactcaggatatgaagggtgtgccgtactccaagtttctcctgtgaccgagaccaggacataccacgacgtcaaagagatttgtaagtgcgacgtggatgaatttgtcattttggtctccctcatgtcccagaccagcatattgcagaactactag

SEQ ID NO: 58748 - DNA, 1788 bp, Artificial Sequence
  Description of Artificial Sequence: Synthetic coding sequence
atggtgagtaaccattacttcctcttgtgcgttaatctgcctttgcgcgagatacacacacccggtccttcaccgagttgcctgggtgatagcctagctgagactacccttagtgaggataccacagacagtgtgggatctgcctcgccccacggcagttccgaaaaatcaagcagtttcagtctttcgtccactgaagtgcacatggtgcggccagggtactcacaccgggtatccctgcccacgagccctgggatcctggcaacatccccttacccagaaaccgactccgcattcttcgaaccgtcccaccttacttccgcagccgatgaaggtgccgttcaggtcagccgacgtacaatttccagcaattcgttttcaccagaagtctttgtgctgcccgtcgacgtggaaaaagaaaacgctcacttctatgtcgccgacatgatcatttcagccatggagaagatgaaatgtaacatcctgagccagcagcagactgaatcctggtccaaagaggtctccgggcttttgggatcagatcagccagactcagaaatgaccttcgacacaaacataaagcaggagtccggatcatcaacctccagctatagcgggtatgagggttgcgccgtactgcaggtgtcgccggtcaccgaaacacggacataccacgacgttaaggagatctgcaagtgtgatgtcgacgagttcgttattctggagctcggagactttaatgacatcacagagacctgttcttgtagttgcagctctagcaagtccgttacctatgagcctgactttaactcagcagagctgcttgcaaaagagctgtacagggtgtttcaaaaatgctggatactctccgtggtcaattcacaactcgctggctcattgtcggccgctggatcaattgtagtgaacgaagagtgtgtgagaaaggatttcgagtcgtccatgaatgtggtgcaggagatcaagttcaagagccgaattcgagggacagaggattgggcccctcctagatttcagattatttttaacatccatcccccactgaagcgtgacctggttgtcgccgctcaaaacttcttctgtgcgggatgtggcacgcctgttgagcccaaattcgtcaagcgccttagatattgcgagtacctgggcaaatacttttgcgactgctgccattcctacgcggagagctgcatcccagctagaatcctgatgatgtgggatttcaaaaagtattacgttagcaacttttctaagcagctgctcgattcgatttggcatcaaccaatctttaatttactctcgatcggccagagcctgtacgcgaaggccaaggaactggaccgcgttaaagaaatacaggagcagttatttcacatcaagaaattactgaagacatgcagatttgctaactccgctctcaaagaatttgaacaggtgcccggacacctaaccgacgagctgcatttgtttagtctggaggatctggtacggattaaaaagggtctgctcgctcccttgttgaaggacattctgaaagcctctttggcacatgtagccggatgcgagttgtgccagggaaaaggtttcatttgcgagttctgtcagaatacaactgtaattttcccctttcagacggccacttgtaggagatgctctgcatgtagagcctgtttccacaagcagtgttttcaatcaagcgaatgtcctcgatgcgccaggataacagccagacgtaaactcctggaaagcgtcgccagcgctgcgacttag

SEQ ID NO: 58749 - DNA, 1908 bp, Artificial Sequence
  Description of Artificial Sequence: Synthetic coding sequence
atggtgagccagagcactgtccgacaggatagccctgtggaaccttgggagggtatatctgatcatagcggtattatcgatggctcgccgagactgcttaacacggaccacccaccctgtcagctggatatccggctgatgcggcacaaagccgtgtggatcaaccctcaggacgtccagcagcagcctcaggacctccagtcacaggttcccgcagccggtaatagtggcacacactttgtaactgatgcagctagcccgtcagggccatcacccagttgcctgggagacagtctggcggaaaccactttatcagaagataccaccgatagcgtcggttctgcttccccccacggcagttccgaaaagtctagttctttttccctctcttcgacggaggtacacatggtcagaccgggatactctcacagggtgagcctccccacgagcccaggtatcctggccacgtcaccctacccagagacagattctgccttctttgaaccgtcccaccttaccagcgccgctgacgagggtgctgtccaggtttccagaaggacaatatctagcaattctttctctccagaggtatttgtgcttccagttgacgtagaaaaggagaatgctcacttctacgtggcagatatgattattagtgcaatggagaaaatgaagtgcaacatactatcacagcagcagactgagagttggtccaaggaggtttcaggtctgctcggatctgatcaaccggattccgaaatgacttttgataccaatattaaacaggagagcggttcaagcactagtagttattcaggctacgaaggttgtgccgtgctgcaagtttctcccgttaccgagacccgcacataccatgatgtgaaagagatttgcaagtgtgacgttgacgagtttgtgattctagagctaggggatttcaatgacattacagagacctgtagctgcagctgcagctcttccaagagcgttacttacgagcccgattttaatagcgccgagctgctggccaaagagctgtaccgtgtgttccagaagtgctggatcctgtccgtggtcaattcacagcttgcaggctctttgtccgccgcagggagcatagttgtgaacgaagagtgtgtgcgcaaggattttgagtcatctatgaacgtggtgcaggaaattaaatttaagtctcgcattcgagggaccgaggattgggccccaccaaggttccagatcatcttcaatatccacccacctttgaagcgggatctcgtcgtagctgcacagaattttttttgcgccggatgtggcactcccgtcgaacccaaatttgtgaagcgtttgagatactgcgagtatctggggaaatatttttgtgactgctgccactcttacgccgaaagctgcattccagcccgaatcttgatgatgtgggactttaaaaagtactacgtctctaacttcagtaagcagctgctcgattcaatctggcaccagcccatatttaacctcctcagtatcggccagtccctgtacgccaaggcaaaagaactagaccgggtaaaagagatacaggaacagctcttccatattaaaaaattgttaaaaacatgccggtttgccaactcttgcgtgaaagagagagccctatttgtgaatttcgcacgtattagattgtcttcctctcatttcaggcagcaacacgtcgaagatgtgcagagggccggtttagcttttacaaattcagctagctcccctccatccgcccctggagtgagaggatcacagcggggagaaaatttttggaaggtctggcctctccagcaacatgacgcaccagagtattgcgaaaaagattgttctacgtgcctgatgatcacccccatttgcgtgtactattggtag

SEQ ID NO: 58750 - DNA, 1908 bp, Artificial Sequence
  Description of Artificial Sequence: Synthetic coding sequence
atggtgagccagtccactgttagacaagactcaccagtcgagccttgggagggtatttcagatcactccggtatcatcgacggcagccctcgtttactgaatactgatcatccgccatgtcaactcgatattagacttatgcggcataaagctgtgtggattaaccctcaagacgtacagcagcaaccacaggacctgcagtcccaggttcctgccgcaggcaattcaggaacacatttcgtaacagatgctgctagcccttctggtccttcaccatcctgtttaggtgactctctggcagagacaaccctgtctgaggacacgacagacagtgtggggagcgcaagcccccacgggagcagcgaaaaaagctctagcttcagcctctcatctactgaggtgcatatggtgcgcccaggatacagtcaccgcgtgtccctaccaacctccccaggaatcctggcaacatctccatacccagaaacagattctgctttcttcgagccaagccacctcacttcagcagccgatgaaggggctgtgcaggtgtcacgtaggacgattagcagtaattccttcagtcctgaagtctttgtgctgccagttgacgtcgaaaaagagaacgcccatttctatgtggctgatatgatcatatctgccatggagaaaatgaagtgcaatatactgtcccagcagcagacagaatcctggtcaaaggaggtgtctggactcttgggctcagatcagccagactctgaaatgaccttcgacactaatattaagcaggaatccgggtcgagtacgagctcctattcgggatatgaggggtgtgccgtactccaggtgagccccgtgaccgagactcgcacttatcacgacgtcaaggaaatctgtaaatgcgacgttgatgagtttgtgatactggaactgggtgatttcaacgacatcacagagacttgctcatgcagctgcagttcctccaaaagcgtcacctacgaacccgacttcaactccgcagaattactggccaaggagttgtatagagtgttccagaagtgctggattctctcagtggttaactcacagctggctggtagcctgtctgctgccggatcaattgtagtcaacgaggagtgtgtgcgtaaagatttcgagtcttccatgaatgttgtgcaggagattaaattcaagagtcgcataagggggactgaggattgggcgcctccgagattccagatcatcttcaatatccatcctccactgaaacgtgatctggtggtcgctgcgcaaaacttcttttgcgcaggatgcggcacacctgtggagcccaagtttgtcaagcgcttgcgctattgtgaatatctggggaaatacttttgcgattgttgtcactcatatgctgagtcatgtatccctgctcgtatcctgatgatgtgggattttaagaagtattacgtgtccaactttagcaagcagcttctagactccatctggcatcagcctatcttcaaccttctgagtattgggcagagcctgtacgctaaggccaaagagcttgatcgtgtgaaggagatccaggaacagcttttccacattaagaaactgctgaagacatgcaggttcgcgaattcttgtgtgaaggagcgggcactgtttgttaattttgccagaatccgcctttcttcaagtcacttccgtcagcaacatgtggaagacgtgcagcgggctggtctggccttcaccaatagtgcttccagcccccctagcgccccaggtgtacggggaagccagcgaggcgaaaatttctggaaagtttggccactccagcagcacgatgcccctgagtactgtgagaaggattgttccacttgcctcatgattacgccaatttgcgtgtattattggtag

SEQ ID NO: 58751 - DNA, 396 bp, Artificial Sequence
  Description of Artificial Sequence: Synthetic coding sequence
atggattccactcaccctcagcactgtgcctgcaacagccagataagacctaggtgggattgtgttgcccactgtttcctttgggcacccggattaccttcacgcgatgatcctggagccgacaagggagaggcctccgggggtgtcggaaccgtgagcttgactctgtctcagcctcgggaacgctctttgcaggtgaaaaaagttttcgtcaaaggcatgaagaaggagcgggcactgggggaaggagccgcatggtggcagagccagcggcttgtatcgcccggaaagcacgaccgcgtttctacccaccgcaaatcacaatctgtatttaccggcgtctctgctggtgacaagcaatttactactacgttctcaatcgtgtttactatctag

SEQ ID NO: 58752 - DNA, 1023 bp, Artificial Sequence
  Description of Artificial Sequence: Synthetic coding sequence
atggccagagatctgatcggtccagctctgcctcctgggttcaaagcaagaggcaccgcagaagatgaggaacgtgacccgagtcccgttgctggtcccgcacttcccccaaactacaaatcaagctcttctgacagcagcgactcagacgaggattctagctcattatacgaggagggtaaccaggaaagcgaggaagacgattctggccctaccgccagaaaacaaaggaagaatcaagacgatgatgatgacgacgacgacgggttcttcggccctgcactcccgcctggcttcaagaagcaagatgactcaccccctcgcccaataattggtccggctttacccccagggttcatcaagagcacacaaaagagtgataaaggacgagacgatccagggcaacaagagactgacagcagcgaagatgaggatataatcggtccgatgcctgccaaagggccagttaattataacgttaccactgagtttgaaaagagggcgcagaggatgaaagaaaagcttaccaaaggtgacgatgatagcagtaaacctattgtccgtgaatcctggatgactgagctcccccctgagatgaaggactttggcctgggaccccgtacctttaagcgtagggccgacgatacaagcggggaccgatctatttggacggacacgccagcggatagagagcgcaaagcaaaagaaactcaggaggcccgtaaatcctccagcaagaaagacgaagagcatattctgagcggtcgggacaaacggctcgccgagcaagtttcaagttacaatgagtcaaaacgctcagaatcgttaatggacatccaccataaaaagctgaagagcaaagctgctgaagataagaataaacctcaggaacgtattccatttgatcgtgacaaagatcttaaggtgaaccgcttcgacgaggctcagaaaaaggccctgatcaaaaaaagcagagaattgaataccagatttagccacggcaaggggaacatgttcctatag

SEQ ID NO: 58753 - DNA, 423 bp, Artificial Sequence
  Description of Artificial Sequence: Synthetic coding sequence
atgtggccttttagattgcggtgccctatttacttcaagactcgcctactttactctagtagccaagacggcttcttgtccagctccacgaattattataaccatagaacctatccaggcctcgtgaattggttgttcgtgctgactgagccggaactaaccggagagcttggggatgatgaccgaaaggggatgcacacagggggaatcatccgctggcttggccgtcctagttcccaacttaagccaatctttcacgcagaggagcggagggtgcccccacccccagagaggctcgtgggacgggctagtcctagggagcaggccaccgtgtttaagcgcatctgtgcacccctgcacgctgaggtgttctgtcgcgcagggctgtgcgcctgtcacccagattgtacagcagctggatag

SEQ ID NO: 58754 - DNA, 408 bp, Artificial Sequence
  Description of Artificial Sequence: Synthetic coding sequence
atggtggccacttggggcggaagacagctgcttccgcagtgtagtgggcctcccctgacacctggatctcccgcaccttccgtggcacaggcatctaggccagcgcctcccagccccaggaagactagccccggacctccacagccttcagcctccccatccctgcccttttctccattgctcgcaggctgcagtcgactgctgccggtgctggccccaagcctgagttccgtgcaccgctgtcctctgggggctcgagccagccgtttgccgtggaaactcgaggccggaacgtcttcttcaggagacaggcccctctgtctccatagtggacagcggggtgcctgcttaacagacgagcaaggatccacactgtccccacgacagaggagaggtcccggaaaatag

SEQ ID NO: 58755 - DNA, 474 bp, Artificial Sequence
  Description of Artificial Sequence: Synthetic coding sequence
atgctatccgtgtcgcggccttgcttcagccagggtgcctttctcgggaggaccctgggcagtgtgtgggcgcaggggggatcccgcctcccactctgcttctggtaccgcatcaggtgcggccgacccgcagttgtgcacatcggaggggagggcgctcgatgggagaaaggggcaagggggcgaaaggaacatcggctacgacgatccgatctgggctcccggcctgtcccttttctggcacaggggatccccgatatcgtgattcggttgctttgtcttagtgcaggaagcgcgtcttctcatcaggcaagcgaccctcttagctctgctgccgcaactcttgccgctgagcttgactgggcactcgtgtcccagaaatcttcagaagatcttgcacccccaagccttctactgaactgtattagctttctgattacacagtgcccgcacccccgatggcttccaggttag

SEQ ID NO: 58756 - DNA, 627 bp, Artificial Sequence
  Description of Artificial Sequence: Synthetic coding sequence
atgagccccaccaaagactctcatccatccccgcacttcccacgcgactcaggtattcacgctccaacacctcccgacagcggggcactgacactgagcccacccgtcagccagggtccaggtgtggggcctcgaaccggaaggggcaaccgactctgccgacccccagggaggtccgctgctcgcagcttttgtctattacccggacctcctctggggacgggtgcattaggctcaccccgagctgcccagggcctgggtttccgaggctctgggcagagagctcggcacaattccttcacctcacccagcccacccggagctcaccatcctctggggacacacaccagggccctcccccctccactggcccgatgcccatgcgctgcactattggcaggaagggaatgccatggcggtcctagcccagccgctccaagacccctgcccggtacttccctgacatggcctagtagggctccactgcctcggcctccacccagggagagacagggcccaggggaccgatctccctccccatccgccccttcttgtccgggagtcggcgctagcagcccaagacgcagaaagcctagggaagccgctgggctcacacccgatggctag

SEQ ID NO: 58757 - DNA, 1248 bp, Artificial Sequence
  Description of Artificial Sequence: Synthetic coding sequence
tacgatgcggtaccgatccagtcttcagttgtcctctgcagctgtccttcacccagcatggtccgcactcaaactgaatcatccacccctccgggaatacctggcggatcccgtcagggccctgctatggacggcaccgctgcagaacccaggcccggagccggatcccttcagcacgcccagcctcctccccagcccagaaaaaagagaccagaggattttaagttcggaaagatcctcggagaaggcagtttctccaccgttgtgctggcccgagagcttgcaaccagtagagaatatgccataaagatcctggagaaaaggcacataattaaggagaacaaggtcccttacgtcactcgcgaaagagatgtgatgtccagacttgatcacccgttctttgtgaaactgtatttcacctttcaggatgacgagaagctgtattttggtctgtcatacgctaagaacggggagctgttaaagtacattcgtaagatcggtagctttgacgaaacctgtacacggttctacactgccgagatcgtgtctgccttggagtaccttcatggtaaaggcataatccatcgggacctgaaaccggaaaatattcttctgaacgaggacatgcatatccaaattactgactttggaacagctaaagttctaagccccgaatctaaacaggctagagcgaattctttcgtgggcaccgcacagtatgttagtcctgagttgttgacagagaaaagcgcttgcaaatcatctgacttgtgggctctcggctgcattatttatcagctagtggccggattgccaccattcagagccggaaacgaataccttatctttcagaagatcatcaaattggaatacgattttccagaaaaattcttcccaaaagccagagacctggtggagaagctgctagtccttgatgccaccaagaggctgggatgcgaggaaatggaaggttacgggcctctcaaggcccatcccttctttgaaagcgtgacttgggagaatcttcatcagcagacgccccctaagctaactgcttaccttccagcgatgtccgaggatgatgaggattgttatgggaatgtgagctggcccggatggcgggctaggcaggtggcattggggccaccatgcactgggctccatgcccgagcacctgaccccagagtgatctgctcacgaaaggggagggtatccgttcctctgcggcaggcttgttggtggctgtag

SEQ ID NO: 58758 - DNA, 1734 bp, Artificial Sequence
  Description of Artificial Sequence: Synthetic coding sequence
atggccgatgtggccggtccctccagacccagtgccgctgccttctggtcccgtgatttttctgacgaggagcagtccgtggtgtatgtgcccggaatctctgcagaaggcaatgtgagaagccggcataagctcatgagcccaaaagcagacgtgaagctgaaaacctcaagggtcaccgatgcctctatctcaatggaatccctcaaaggaacaggagacagtgtggacgaacagaattcatgcagaggtgagatcaagtctgccagtttgaaggatctgtgtctggaagataagagacggatcgctaatctgattaaggagttggccagggtgtcggaggagaaagaagtaacagaggagagactgaaagcggaacaggaatccttcgagaaaaaaattcgacagcttgaggagcaaaacgaactgatcattaaagaacgtgaggcaattaagctgcaatacagagaatgccaagagcttttatccctttatcagaagtatctctcagagcagcaagaaaagctcacaatgtctttgagcgagttaggggctgctcgcatgcaggagcagcaagtctcatcaaggaagagtacactgcagtgttccagcgttgagcttgatggaagctatctgagtattgccagaccacagacatattaccagaccaagcaaagacctaaatccgccgtccaggacagcgcgagcgagtcactgatcgcgtttaggaataactcccttaagcctgttactttgcaccaccctaaagatgacctggacaagatcccgtctgaaaccactacttgcaattgcgagtcaccgggacggaagcctgcggtgcccaccgagaagatgccacaggaagaacttcacatgaaggaatgtccacatctgaagcctacacccagccagtgttgcggtcacaggctcgccgctgatcgcgtccatgacagtcatccgacaaatatgactcctcagcatcccaagactcaccccgagagttgttcgtattgcagactgagctgggcaagcttagttcacgggggaggcgctcttcagccaatcgagacgctcaagaagcaaatttctgaagatcgtaaacagcaactgatgctgcagaagatggaactcgagatcgagaaagaaaggcttcagcacctgctcgcccagcaagaaacaaaactgctactcaaacagcagcagcttcatcaatctaggctggactataactgtctgttgaagtcaaactgtgatggctggctgcttggcacttcttctagcatcaagaaacaccaggacccccctaattctggtgaaaatcggaaagagagaaaaaccgttgggtttcattcccacatgaaggacgatgcacagtggtcgtgccagaaaaaagatacctgccgcccacagcgtggtactgtgactggtgtgcggaaggatgcaagcacaagcccaatgcccaccggttctttgaaggactttgtcacaacggcttccccttcgcttcaacacaccacttcacgctatgaaacctctcttctggatctcgtccagtcactgtcaccgaacagtgcgccaaaacctcagagataccctagccgggaagctggcgcttggaatcatggaaccttcaggcttagcccgcttaagagcacccggaaaaaaatgggcatgcaccgtacgccggaggagctcgaggagaaccagatcctggaggacattttcttcatttag

SEQ ID NO: 58759 - DNA, 600 bp, Artificial Sequence
  Description of Artificial Sequence: Synthetic coding sequence
atgttgcctgtgcagcgacgcaagctggatccactcctcaagaagtaccggcaccacaagaaagctacgagaactaagagacggagaaaagaaaagatggaagcccagtgttcacctgttccccctacaccgagtacccccccacagagcgaggaagatgaggccgtcgataaaaaacctactcttctgagcgcccaggaggacacacccgatttgcttcacgaggacaggctccagtatcttcaagaagaaggatcaggcgtgatgcaccaggagtgtcagattcaaagttgtgagctgtctgttgctcagaagcccaggccctccagccctgctgtgacttccctagcatcccctccactgtgcttcggaagtttcctgtcctgtgtatgccagacattctcaaggtcccgcaagcagaaacctccacggcgaaagggcaataatcaagccgaggccggaggggatgcagaggtgctcagaccaggcccagcaaaacctgagctatccctcagtaaaacttgttctcacttgaagagcattgagctctcctttgttttttccttcatcgtgctttcagtgtgccattgcagctcatag

SEQ ID NO: 58760 - DNA, 6617 bp, Artificial Sequence
  Description of Artificial Sequence: Synthetic coding sequence
atgcctctgttcttcagtgcactgttagtgctcctgcttgtggccctgagcgctttgtttctgggacgctggctggtcgttaggctggctaccaaatggtgtcaacgaaaactccaagccgagctcaagatcggttcctttaggttcttctggatccagaacgtttctctcaaatttcagcagcatcagcaaactgtggagatcgataacctgtggatcagctcgaaactgctaagccacgacctccctcattacgtggcactctgcttcggagaggtgaggatacgcacagacctccagaaggtgagcgacctgagcgcgccattctcccagagtgcaggagtggaccagaaggaactatcgttctccccctctctgctcaagatcttctgtcagctgtttagcattcatgtcgatgctatcaatattatggtgttgaaagttgatacctccgagtcgctttggcacattcagatttctagatcccggttcttactcgattcagatgggaagcggctaatttgtgaggtctccctgtgcaaaataaactcaaaagtcttgaagtctggccagctggaagatacgtgtctggtcgagcttagcttagccctcgacctctgtctgaaggtcggaatttccagccggcatctgacagcaattacggtagatgtatggacattgcatgccgaactccatgagggactcttccaatctcaattactgtgccagggcccatcacttgcttctaagccagttccctgttcagaagtcactgaaaatctggtagagccaacactgccgggattgttcctcctccagcagctgccagatcaggttaaggtcaagatggagaacaccagcgtcgtgctgagtatgaactcccagaaacgacacctaacttggacactaaagcttctgcagttcctgtatcaccgcgatgaagaccagctccctttgagatcctttactgccaactctgatatggcccagatgagtactgagttgcttctggaagacggcctacttctctcgcagtcccgacagcgtatagtgtgtctgaactctttgaaagccagcgttcaggtgacaaccatcgacctgtcggcctccctggtactgaacacgtgcattatacattatagacaccaagaattctcccactggctccatctcctcgccctggaaacacaggggagctcttcaccggtcctaaaacagagaaaaaagaggacctttccacaaatccttgcccctattatctttagtacgtctatatccaacgtgaacatctctatacaactcggtgatactcctccatttgcccttggcttcaatagtataagcttggattatcagcatctgcgaccccagagtatccatcagcggggagtgcttaccgtggaccatttatgctggagggtggggtccgacagtcacatccaacgggctcctcaccctcccaacatgcatgtgtggggtgaagcattggtcctagatagttttactctccagggatcgtacaatcagcccctgggactctcctctacccagagtgacaccctattcctcgactgtaccatcaggggcctccaagtcgaggccagcgacacttgcgctcagtgcctcagtagaatcctgtcccttatggggccacagagcggcaaaagcgcagtgagtaggcactccagttttggcgagagtgtaagcctcctgtggaaggtcgacttgaaggtggaggatatgaatttgttcactttaagcgccctcgtgggtgcctctgaggttcgcctggacaccctgactatcttaggttccgccgagactagcactgttggcatccaaggcctggtgttggcgcttgttaaaagcgtgacggagaagatgcagccatgctgcaaggccccagatatcccaacgccggtgctcagccttagcatgcttagcatcacttaccacagcagtatccgctccctggaagtgcagtgcggagcaggactcacactgttgtggtcaccacccgatcacatgtacctataccaacatgtgctggcgacgctgcagtgcagagacctattgagggcgaccgtcttcccagaaactgtaccttccttggcgctggagacctcagggactacatctgagctggaaggaagagccccagagccccttcccccaaaacggcttctcaacctgacattggaagtctctactgccaaattaaccgctttcgtcgccgaagataagttcatcaccttagctgcagagtctgtctctctgtctaggcacggcggttcgctacaggcttattgtcccgagttggcagctgggtttgacgggaattccatattcaattttaaggaggtcgaagtgcagctgctgccagaagtagaattcccctatcagtacgattttagtcgcaccctagacgaagccgtgggtgttcagaagtggttgaaggggctgcatcaaggtactagggcctgggcaagtccatctcccgtcccactgccccctgatctcctgcttaaagtggaacatttttcatgggtttttctggacgatgtgttcgaggtaaagctgcacgacaactatgagctgatgaaggacgagagcaaggagtcggccaagcgattacaactcctggatgcgaaggtggccgctcttagaaagcagcatggcgaactcctgcccgctaggaaaatagaagaactgtatgccagcctcgaaagaaagaatatcgaaatctacatccagcggtcccggagattgtacgggaataccccgatgcggcgagctctgctgacctggagcctggctggcctggaattagttgctctcgcagacgcatctttccacggacccgagcacgtcgtcgaacaggttcaagagctggatccgggatcaccattccccccagaaggcttggaccttgttatccaatggtgccgcatgttaaagtgtaacgttaaatcctttctggtaaggataagggattatccccgttacctgttcgaaattagagattggagactcatgggtcgtctcgtgggaaccgagcagagtggccaaccttgttcccgcaggcgtcagattttgcatctggggcttccttggggtaacgtggccgttgagaggaacatgcctcccctgaagttctaccatgatttccatagtgaaatctttcagtacacggtggtgtggggtccatgctgggatccggcttggaccctaattgggcagtgtgtggaccttctgaccaaaccaagcgcggacccaagtccccctttgccctggtgggacaaatcacgcttacttttccacggtgattggcacatggacatcgaacaagctaatctgcaccagctggccaccgaggatccttataacaccacagaaaatatgcactgggagtggagccatctatctttccactggaaacccggacaattcgtctttaagggcgatttagatattaacgtgaggacagcttccaaatacgacgattgctgttttttgcacctgccggatctgtgcatgacgctcgaccttcagtggctgtgccacgggaatccccacgatcaccactccgtgactctgcgggcacccgaatttttaccagaagtgcccctcgggcagctgcacgattcttatagggccttcaggtcggagaacctcaatctcagtatcaagatggaccttacccggcattcagggacaatatctcaaccacgcatcctgttatatagctctacgctgaggtggatgcagaacttttgggctacatggaccagcgttacacggcctatctgccgaggcaagctgtttaataacctcaaacctagcaagaaaaagttaggtcagcactataaacagctcagttacaccgccctgtttcctcagctacaggtgcattactgggccagtttcgcacagcaaagagggatacagatagagtgctcccagggtcacgtgtttacacggggaacccagcggctgataccacaagcaggaacagtgatgcggagattgatatctgattggtcagtgacccagatggtgtccgatttaagccaagtaacagtacatctcatggcttccccgactgaagaaaacgcagaccactgtttagacccactcgtgaccaagacccatctgctctctctctcctcattgacttaccagcgccatagcaaccgtaccgctgaggaggaacttagcgccagagatggtgacccaacattccacacgcatcagctgcacctggtcgacctgagaatatcctggacaaccacaaatcgggatatagcgttcgggctttacgacgggtataaaaaggcagcggtgctgaagagaaatctcagtactgaagctcttaagggactcaaaatcgacccacagatgccggcaaagaagccgaagcgcggtgtccccacgagtgcatcggccccacctcgggttaatacacccagtttctccgggcagcccgacaaaggcagttccgggggagcctacatgctgcaaaaactgatcgaagagaccgacagatttgtggtgttcactgaagaagagtccggaatgagcgaccagctttgcggcatcgccgcttgccagacggatgatatttataatagaaactgtctgatcgagctggtaaactgtcagatggtgttacgcggagcagaaactgagggttgtgtaattgtgtctgccgctaaggcccagttgctgcagtgtcaacaccatccagcttggtacggtgataccctcaagcagaagacctcttggacctgccttctcgacggtatgcagtactttgctaccactgagagttctcccactgagcaggacggccgacagctgtggctagaagtaaaaaacatcgaggaacacaggcagagatctcttgatagtgtccaagagctcatggagtcgggacaggctgttgggggaatggtgacgactaccactgactggaaccagcccgcagaagcccagcaggcccagcaggtgcagcgaataatcagccgttgcaattgccgaatgtactacatctcctatagccacgatatcgaccctgaacttgctactcaaatcaaaccacccgaggtgttagagaaccaggaaaaggaggacctgctcaagaaacaggaaggggctgtggacacattcactctgatccaccatgagctcgaaatctccaccaatccagcccagtacgctatgatactagatatcgttaacaatctcttgcttcatgtcgaacctaagaggaaagagcacagcgagaaaaagcaaagggtgcggttccagctcgagatttcctctaaccccgaggagcagaggtcctccattctgcacctgcaggaggccgtcaggcagcatgttgcccagattcgccagttggagaagcagatgtacagtattatgaaaagcttgcaggatgatagcaagaatgagaacctattggatcttaaccagaagcttcagctgcagttgaatcaagagaaggccaatttacagctcgagagcgaggagctgaacattttgattagatgcttcaaagactttcagttgcagagggccaacaaaatggagctgcgtaagcagcaggaagacgtctccgtggtgcgtcgaaccgagttctactttgcccaggcccgatggaggctcactgaggaggatggacagcttggaatcgcagagctggaactgcaacgttttttgtactctaaggtgaacaagtcagatgatacagccgagcatctgctggaactcgggtggtttaccatgaataacctgcttcccaatgccgtctataaagtggtgctgcgaccccaaagttcctgtcagtcggggcgacaactagctcttaggttattttcaaaagtccgccctcccgtgggcggtattagcgtcaaagagcacttcgaggttaatgtagtgcctctcactattcagctgacccatcaattttttcacaggatgatgggattctttttccccggaaggtctgtggaggacgatgaggtcggagacgaagaggataagtccaagcttgtgactacgggtattcctgtcgttaagcccaggcagcttattgccacggatgacgccgtgcctctagggccagggaaaggcgtggcacaagggctgacccgtagttccggagtgcgaagaagctttcgaaaaagtccagagcaccctgtggacgacatcgataagatgaaggaaagagctgctatgaataacagctttatctatatcaagattccgcaggtgccactgtgcgtctcatacaagggtgagaagaatagcgtagactggggggacctgaatctggtcctcccatgccttgagtaccacaacaatacgtggacttggctggacttcgccatggcagtgaagcgcgatagccgaaaggccctggtcgcacaggtgatcaaggaaaaactaaggctgaagagcgccacagggagtgaagtgagaggcaagcttgaaaccaagtccgaccttaacatgcagcagcaggaggaagaggagaaagcacgactgcttattggcctgagtgtcggggataagaatccaggcaaaaaaagtatattcggaaggcgcaaata

SEQ ID NO: 58761 - DNA, 2130 bp, Artificial Sequence
  Description of Artificial Sequence: Synthetic coding sequence
atggaccagaaattatcaaaacttgtggaagaactcactacctcaggagaaccgagacttaaccctgaaaagatgaaggaactgaaaaagatctgtaaaagcagcgaggagcaactttctagggcctacaggctcttaatagcccaacttactcaggaacacgcagaaatcagattgagcgcctttcagatcgtagaggagctgttcgttagatcccaccagtttcgcatgctggtcgtgtccaatttccaggagttcctcgagctgacgctgggaacagaccctgcacaacccctccctcctcctcgggaggccgctcagagattgagacaagccacaacacgggctgtcgaaggctggaatgaaaagttcggggaggcctacaaaaagctcgctctcggttatcatttcttgaggcataacaagaaggtcgacttccaggacactaacgctcgatcccttgcagaacgcaagcgggaggaggaaaagcaaaaacatctggataagatatatcaggaaagggctagtcaggctgaacgtgaaatgcaggagatgtcaggcgaaatcgaatcctgtttaactgaagtcgagtcatgcttcagactacttgtcccttttgactttgatcccaaccccgaaacagaaagcctgggcatggcctccggcatgtcagacgccctgcgatcctcatgcgcaggacaggttggtccatgccgctcaggcacgcccgatccccgtgatggggagcagccatgctgcagccgggatctcccggctagcgccggtcatcctcgggctggtggcggtgcccaaccgagtcagaccgccacgggcgaccctagcgatgaggatgaggacagcgatctggaggagtttgttcggtctcacggcctggggagtcataagtacacgctggatgtggaactctgctcagaaggccttaaggtccaggagaacgaagacaatttggcgcttatccatgcagcccgtgacacactgaagttgatccgaaataagttcctgccggctgtgtgtagctggatccaaagattcaccagagtgggaactcatggtggttgcttgaaacgcgcaattgatctaaaggccgagctggagttagtgttgcgcaagtataaggagctggatattgaacccgagggaggagagcgtcgaaggactgaggcccttggggatgcagaggaggacgaagatgatgaggatttcgtcgaagtgcccgagaaagagggctacgagcctcacatccctgatcacttgagaccagagtacggtctggaagccgctccagagaaggacaccgtagtccgctgcttacggactagaacgaggatggacgaggaagtgagcgaccccacaagtgctgcagcccagttacgtcagctgcgggatcacctgcctcctcccagctctgcctctccctctcgggctcttcctgagccacaggaagcacaaaaactggccgctgagagggccagggctcccgtagtgccatatggagtggacctgcattactggggtcaggagctccccactgctggcaaaatcgtcaaatcggattcccaacacaggttctggaaaccgagtgaagtggaggaagaagttgtaaacgcagatattagcgaaatgcttcgctccagacatattacattcgccggtaagtttgagccagtccagcactggtgcagggcccctaggcccgatggcaggctctgcgagagacaggatcggcttaagtgtcctttccacggcaaaatcgtacccagggacgatgaaggcaggcctctggaccctgaggacagagccagggaacaaaggagacagctgcagaaacaggaacgcccagagtggcaagaccccgagctaatgcgggatgtcgaagcggcaacagggcaagatctcggcagtagtagatattccggcaaaggtcgaggcaaaaaaaggcggtacccaagcctgacgaatctgaaagcccaggcagacaccgccagagctcggattggaagaaaggtgtttgctaaggccgctgtgcgccgagtggttgcggctatgaatagaatggaccagaagaaacatgagaagttttccaatcaatttaactacgcgctcaattag

SEQ ID NO: 58762 - DNA, 1989 bp, Artificial Sequence
  Description of Artificial Sequence: Synthetic coding sequence
atggtaagccagtcaactgtgcgacaagacagccccgtcgaaccctgggaaggcataagcgaccattctgggattattgatggcagccccaggcttttgaacactgaccacccaccatgccaactcgatattcgcctgatgcgacacaaggcagtgtggattaatccccaggatgttcaacagcaaccacaagatctgcagagccaggtgcccgcagctgggaattcgggcacgcattttgtaacggatgcagccagcccttccgggccttctcccagctgcctgggagactctttggctgaaaccactcttagcgaggatacaacagattctgtggggtctgcttcgccacatggcagctctgaaaagtcttccagcttttccctgtcatccaccgaagtgcatatggtaagacctggctactcccatcgcgtttccctgccaaccagcccgggaatccttgcaacttccccatatcccgaaaccgattccgctttcttcgagccaagccacttgacttctgccgctgacgagggagctgtccaagtgagtcggcgtacaatcagcagcaatagcttctctcctgaagtgttcgtactccccgtcgatgttgaaaaggagaacgcacacttctatgtcgcagatatgataatcagtgctatggaaaagatgaagtgcaacatcctgagccagcagcagacggagtcttggtctaaggaggtgagcggcctgctgggttcggatcagcccgatagtgagatgacttttgatactaatatcaagcaggagagtggttcctctacctcgagctactccggctatgaagggtgcgcagtgctgcaggtttccccagttacagagaccagaacataccatgatgtcaaagagatatgcaagtgtgacgtggacgaatttgtgattctggagcttggagattttaacgatatcaccgagacatgctcctgctcctgcagttcatctaagtccgtgacctatgaacctgactttaattctgccgaacttctggctaaggagttataccgggtgtttcagaagtgttggatccttagtgtggtcaactcccagcttgcaggatcactgtcagccgctggaagtattgtggtaaacgaggagtgcgttcggaaagatttcgaatcctcaatgaatgtagtccaggagatcaagttcaaaagcaggattagaggcactgaggactgggctcccccacgatttcagataatctttaatattcacccacctctgaagagggatcttgtcgttgctgctcagaatttcttctgtgcaggctgcggcactcccgtcgagccaaaatttgtcaaacgcttacgatattgtgaatacctcgggaaatacttctgcgactgctgtcattcttacgctgaatcttgtatccctgcgagaattcttatgatgtgggatttcaagaagtactatgtcagcaatttttccaaacagttgctcgacagtatctggcaccaaccgatcttcaacctgctgtcaataggccaaagcctgtatgccaaagcaaaggagctggacagagtgaaggagatccaggagcagttattccacatcaagaagctgctcaagacctgtaggtttgcgaattccgcactcaaggaattcgagcaggtgccagggcacctgactgatgagcttcacctcttctccctggaggatctagtgagaattaagaagggtctgcttgcacccctactcaaagacattctgaaggcaagcttggcacacgttgcaggatgtgagctctgccaagggaaaggcttcatatgtgaattctgtcaaaacacaaccgtgatctttccgttccagacagcaacatgcagacgatgctccgcttgtagagcatgctttcacaaacaatgttttcagagcagcgagtgtcctcgctgtgctagaatcaccgctcgtcgcaaacttctggagtcagtcgcttcagccgctacttag

SEQ ID NO: 58763 - DNA, 552 bp, Artificial Sequence
  Description of Artificial Sequence: Synthetic coding sequence
aatatgaatcggtacagttttatgcttagcggcaaccatctactgtttcacttgttgctgtggcctgcacagactgccaggctgcttaagcatatcttccctactggatcttgcaagctgcgcgatgtagccgaacacctgctccagtgtccacagacaggccacgagtgctgcaaggctcagaaccgcgcaaacctggtggaggggtggttctcacagaacacacaacggggtcccagccatgatggggtggcagagtttcacatgtccctaacggtcagttgcccagacccaacaccgagtactgacccgcaggggcgtcataaccgcgaacccatactcggcagggacgacgatttcatgtgtaagcaggttaaattcaggatgtgtgtagtgggacgcgatggcaatgcccaaagtagtgtgcgatacaccggtccattataccggagaaaaattagaacagaattcctgttcgtagtgtttctactagaaacacgggagttgaaaccccaggtcaacaagaacgttcagggcacgagacccagctag

SEQ ID NO: 58764 - DNA, 171 bp, Artificial Sequence
  Description of Artificial Sequence: Synthetic coding sequence
atggccatcctgaagatgggtccaaagattgtgctggagtggtcaggaggacatcccagcaaggatccctccagctattacctgatcatcctgcacaaggatactagttcaacgctagtggattgtcacttccagcatcacaaccttcacaaagtggggttcctgtattag

SEQ ID NO: 58765 - DNA, 600 bp, Artificial Sequence
  Description of Artificial Sequence: Synthetic coding sequence
ggccgtgcagccaggcggcatcatgattcatgcgaggacgccgcactccctggacgtagtgacctgtgcagggcgcttcatcccgcacgacccgcagccagaggcggtcgccctgcagatggagggtgccctgctgtccctgccgaaggattgtggagacacttgcagcaagtgggcgcagccactcacccacacctcatgcgaggcccaagcctgtcttgggctattcctgctactcatccactgggtgccgcacccttgggcaaccccggaccgggagagcctatctggctgccctgcgttggaggtgccgaagtccgcgcacaattggggtctttctacagctgggagagtaagtctagtctgccatcaactccactttcactgttagtcagctgtgggggatccgcgctaactacccacgcctttcctccaatcggcggtcctattccttcaaggtttccagccgcaaacaaatacctgccttcctctgccagagtacagggatctgtgggaatcagtatttaccctgcgacggataaggcgacctacctgtcgacatggtcagcccatagtggcagacgagagcggcctaaatag

SEQ ID NO: 58766 - DNA, 216 bp, Artificial Sequence
  Description of Artificial Sequence: Synthetic coding sequence
atgaaaatcgtgcatgtcaacgtaatgggagtaggcggatggggagcagttttcctcgacatgtggcatgttactcaagaaagcaaacggcctattatttctaagatgccagcttggatcttcccttgtcatcctctcgacgaacaaacttatcacatggccctgaatgcagccacatttccaaagaatgcgacttggattgggcctctgtggtag

SEQ ID NO: 58767 - DNA, 147 bp, Artificial Sequence
  Description of Artificial Sequence: Synthetic coding sequence
atgtctgacttccctgtgcactctaaatatttcctaataagttccctacaggtgctgaaaatgcacaaaaaagattttacttcacaggttttgttgaggatctactttgatctcatatgcatgctggtaaaactccatgtgctgtag

SEQ ID NO: 58768 - DNA, 861 bp, Artificial Sequence
  Description of Artificial Sequence: Synthetic coding sequence
atgtccctgccaataggtatctataggcgtgcggtttcttacgacgacaccttggaagatccagctcctatgacaccccctccctcagatatggggtccgtgccttggaagccagtgataccagaacgaaaatatcaacaccttgctaaagttgaagaaggggaagcctccctgccttctccggcaatgactctatctagcgctatcgactctgtagacaaggtgcccgttgtgaaagccaaggctacccacgtaatcatgaacagtctgataactaagcagacgcaggagagcatccagcattttgaaaggcaagcgggtctccgggacgcagggtacacaccccacaagggactcacaactgaagaaacgaaatatttacgtgtggctgaagccttgcacaagctaaaactacaatccggggaagtgacaaaagaagaaagacagcctgcctcagcacagtcgactccttctaccacccctcattcctcccctaagcagcgcccaagggggtggttcacaagcggctctagtacagctctgcccggaccaaaccctagtaccatggatagtggctccggggataaagaccgaaacctgagcgataagtggtcactttttgggcctagatcactgcagaagtatgactcaggttcctttgccacacaagcttacagaggggcacagaaaccttcgccactggagctgattagggcgcaggcaaatcgcatggccgaggaccccgctgccctgaaaccccctaaaatggacatccctgttatggaaggcaagaaacagccaccaagggcccacaatctgaagccgagggacctgaacgtcctgactcctaccgggttctag

SEQ ID NO: 58769 - DNA, 3240 bp, Artificial Sequence
  Description of Artificial Sequence: Synthetic coding sequence
atggatgacgatgacgattcatgtctgctggatctcatcggggacccccaagctttaaactactttctgcatgggccttcaaacaaaagcagtaatgacgacctgacgaacgcgggttacagtgcagcaaatagcaacagtattttcgccaattccagcaatgcagatcctaaatccagtctgaagggtgtatctaaccaactcggcgaggggccaagtgacgggttgcctctgtctagtagtctgcagtttcttgaggacgagctggagtcatctccactgcctgacttgactgaggaccagccttttgatatcctgcaaaaaagcctgcaggaagccaacatcacagagcagacattggccgaggaggcgtacttagatgcaagtatcggttccagccagcagtttgcccaagcacaacttcatcccagctcaagtgctagttttacccaagctagcaacgtttcaaattattccgggcagacgttgcagccaatcggcgtaactcacgtacctgtcggcgctagtttcgcttctaatactgtgggtgtgcaacacgggttcatgcagcacgtgggcatttccgtgcctagtcaacacctgtcgaattcttcccaaattagcggaagcggccagatccagctgattggcagctttggcaatcacccttcaatgatgactataaacaatcttgatgggagccaaataatcctcaagggttctgggcagcaggcacctagcaacgtgtcaggtggcctcctggtgcatcgtcagacacctaatggaaattctctgttcgggaatagtagctcttctcccgtggctcaacccgtgactgtcccgtttaatagtaccaatttccagacaagtttgcctgttcacaacatcattattcagcgcggattggctcccaacagcaacaaggtgccgattaatattcagcccaaaccaatccaaatgggccagcaaaatacctacaatgtaaataatctgggtattcagcagcaccacgtccaacagggcattagcttcgcatccgctagcagtccgcagggcagcgtggtgggaccacacatgtcagtgaacatagtgaatcagcagaacacacgcaagccggtgacatctcaggccgtgagttcaactggcggttcaatcgtcattcactcacctatggggcagccacatgcccctcagtcacagttcttaatccccacctcattgagcgtttcctctaactcagtacaccatgtccagactattaacgggcagttactccaaacccagcctagccaattgatatccggtcaggtggcctctgaacacgtcatgctaaatcgaaacagctccaacatgttgagaacaaatcagccctacacaggtcccatgctgaataaccaaaacacagctgtacatctggtaagtggtcagacatttgccgcatcaggtagcccagtgattgctaatcacgcttcacctcaactggttggaggtcaaatgcccttgcagcaggcctcgcctacagtactgcatttaagtccgggtcagagctctgtatcccagggccgaccaggatttgctacgatgcctagcgtgactagtatgagtggcccaagccggtttccagccgtgagctccgcatctacggcccatccatcgttaggctcagcagtgcaatccggcagcagcgggagcaatttcaccggcgaccagctgacccagccgaaccggactccggtcccagtatcagtgtcccaccgcctccccgtctcatctagcaaatccaccagcaccttttcaaatactccgggtaccgggactcagcagcagtttttttgccaggcccaaaaaaagtgtttgaaccagacgtcaccaatctccgcccctaagacaaccgacggcctgaggcaagcacagatacctggcttactgagtactacactgccaggacaggattctggctctaaagtcatttctgcctccttggggaccgcacaaccacagcaggagaaagttgtgggatcttcccctggccaccccgctgtacaagttgagtcacacagcggaggacaaaagcgtccagcagccaaacagctaacgaagggcgcttttatactgcagcaactccagcgggatcaggcgcatactgtcaccccggataagagccacttccgaagcctgtctgatgcagtgcagcgattactcagctatcacgtgtgtcagggctctatgcctacggaggaagaccttcgcaaggtcgacaacgagtttgagactgtcgctactcagttgctcaagaggacgcaagctatgctcaataagtacaggtgccttttgctggaagatgcaatgcgcataaatccatcggcagaaatggtgatgatcgaccggatgtttaatcaggaagagcgcgcttccttatctcgggacaagcggctggctcttgttgaccccgaaggttttcaggccgatttttgttgctcatttaagttggacaaagcggcacacgaaacgcagtttggccgatctgaccagcacggtagcaaggcgtccagcagcctccaaccaccggctaaggcacagggacgcgatcgcgcaaaaaccggcgtgaccgagcccatgaaccacgatcaattccatctggtgcccaaccacattgtagtcagcgctgagggaaatatatcaaaaaagacagagtgcctgggtagagctctgaaatttgataaggtgggcttagtgcagtaccagtcaaccagtgaagagaaagcttctcgtagggaacccctgaaagcaagccagtgtagcccgggtcccgagggacataggaaaacctcaagtaggtcggaccacggcacagagtctaaactctcgagtatactggccgattcacacctagagatgacgtgcaacaacagcttccaggacaagagtcttagaaactcccccaagaatgaagtcttgcacacggacattatgaaaggatctggggaaccccagcccgatctgcaactaacaaagagtcttgaaaccacattcaagaatatcctggagctcaagaaagctgggagacagccccaatccgatccgaccgtgtccgggtccgttgagctcgactttcccaacttcagtcccatggcctcacaagagaattgtcttgagaaattcatccctgatcactccgagggcgtggtggaaactgacagcatcctcgaggccgctgtaaacagcattttagaatgttag

SEQ ID NO: 58770 - DNA, 3240 bp, Artificial Sequence
  Description of Artificial Sequence: Synthetic coding sequence
atggatgacgacgatgattcttgtctgctggatctgatcggggaccctcaggctctcaactattttttgcatggtccctcaaataagtcttcaaacgatgacctcacaaacgctgggtattctgcagctaattccaactccatttttgctaacagctcaaatgccgaccccaaaagttccctcaaaggtgtatctaaccagctgggcgaaggaccatccgatggtctgccactcagtagttccctacaattcctggaggatgaacttgagtcttctcccttgcccgacctaactgaggaccagccatttgacattctccagaagtcgctgcaggaagccaacatcacggaacaaaccttagctgaggaggcctacctggatgcctcaatcggaagttcccagcagtttgcacaggctcagcttcacccgagttcaagcgcctcctttactcaggccagcaacgtctccaactattctggacagacactgcagcctatcggtgtgacacacgtgcccgtgggagcctccttcgcttctaataccgtcggtgtacagcacggattcatgcagcacgtgggaatttccgtgccatcacagcatctttctaactcgtcccaaatatcgggaagcggacagatccagctcattggtagttttggcaatcatccctccatgatgactatcaacaatttggatgggagtcaaattatcttaaagggctctggccaacaggccccttccaacgtctccggcggactactggtgcaccggcagacccccaacggcaatagcctttttgggaattcaagctcctcccctgtagctcagccagtgacagtcccgttcaatagtactaattttcagacctccctgcctgtgcacaatatcatcatccagagaggactggctccaaatagcaataaagtaccaattaatattcagcccaaaccgatacagatgggtcaacagaacacatataatgttaacaacctcggaatccaacaacatcatgtccagcagggcatatcgttcgcgtcagcctcaagtccacaggggtccgtagtcgggcctcacatgagcgtcaatatcgtgaatcagcagaacacacggaagcccgtgacctcacaggctgtctcttcaacaggcggaagcatcgtcatacactcgcccatggggcagcctcatgccccacaaagccaatttctaatcccaacgagcttgtccgtgagttcaaactctgtgcatcacgtgcagacgattaatggtcaattactgcagacccaaccatcacagctgatatctggccaggtggcatctgagcatgtgatgctgaatcggaacagtagtaatatgctgaggacaaaccagccatacacagggcctatgctgaacaatcaaaataccgctgtgcatctggtctctgggcagactttcgcggcttccggctccccagtgattgctaaccacgcttctccccaactggttggcggtcaaatgcctcttcagcaggcaagccccaccgtccttcacctatctcccggtcagtcatccgtgtcgcagggcaggccaggctttgcgactatgccatctgtgacctctatgagcggaccaagcagatttcccgctgtgtcaagtgcttcaacagcccatccttctttaggttctgcggtccagtctggcagtagcggatctaattttaccggggatcagctgacccagccaaataggaccccagtgcctgtctctgtttcccatcgcctgcccgtttctagcagcaagagtacttctactttttccaataccccgggaaccggtactcaacagcaatttttttgccaggcccagaagaaatgcctgaaccaaacctcccctatctctgccccaaagactacagacgggctcagacaggcccagatcccgggactgctgtccacaacactgccgggacaagacagcggctcgaaggtgatctccgcctctcttggcaccgctcagccccagcaggagaaagttgtgggctcatctcccggacatcctgccgtccaggtagaatcacattccggcggtcaaaagaggcccgctgcaaaacaactgaccaaaggagcattcattctgcagcagctccagcgcgatcaagcacatactgtgactcctgataagtcccactttagatccctgtctgacgctgtccagcgcttgctgagctaccacgtgtgccaggggtcgatgcccacagaagaggacctgcgaaaagttgacaatgaattcgaaacagttgcaacacagctgctaaagcgaacacaggcaatgttgaataagtataggtgccttttgctcgaggatgccatgcggatcaatcctagtgccgagatggtgatgatcgatcgaatgttcaaccaggaagagcgcgcatcccttagcagggacaagagactcgccctcgtggacccagagggcttccaggctgacttctgctgtagttttaagttggataaagctgcacacgagacccagttcggccgatctgatcagcatggaagtaaagcttcctcttcgttgcagccccctgctaaagcccagggtcgtgacagggccaaaaccggggtcactgagcccatgaaccacgatcagtttcatctggtccccaaccatatagtcgtcagcgccgaaggcaacattagtaaaaaaaccgagtgcctgggcagagccctgaaatttgacaaagtcgggctggtgcagtatcaatctacttcagaagagaaagctagtcggagggaacccctcaaggcatcgcagtgctcaccaggcccagaaggccaccgcaaaacatcctcccggtcagaccatggcactgaatcgaagctgtcatccattctggccgatagccacttagaaatgacttgcaacaatagttttcaggataaatctttgagaaatagccccaagaatgaggtcctgcataccgatatcatgaaaggaagcggcgagccccaacctgacctccagctcacaaagtccctagaaactaccttcaaaaatatcctggaactcaaaaaggcagggcgtcaaccccagtctgaccctaccgtctctgggtccgtggaacttgacttccctaactttagccccatggccagccaggagaactgcctagagaaattcatccctgatcacagtgagggcgtcgtggagactgactccattctcgaggccgctgtgaatagtatactggaatgctag

SEQ ID NO: 58771 - DNA, 792 bp, Artificial Sequence
  Description of Artificial Sequence: Synthetic coding sequence
atgtggccccaaccttgtctgccgccacatcccaccatgctcgaagagacccagcagtcaaaactggcagccgctaagaagaagctgaaggaatatcagcagcgtaactccccgggagtgcctgccggagtgaaaatgaagaaaaaaaatacaggctcctctcccgagaccgccacgtttggtggttgtcatagtcccggtgcctcacgctaccaggaactcgagctggcattagactccagcagtgccattatcaaccagcttaatgagaacatagagagtctcaagcagcagaaaaaacaggtggagcaccaattagaagaggagaagaaaactaacagcgaaatccacaaggctcagatggaacagctggaggccattgatatccttaccctagagaaggcagacctcaagaccacactataccacaccaagcgcgcagcacggcacttcgaggaagagtccaaggaccttgctggtcgactgcaatatagcctgcagcgaatccaggagctggagcgcgcattatccgctgtttctacacagcaacaggaggaagatagaagctcctcgtgcagggaggcagtcctgcagtggcgtcttcaacagacaattaaggagcaagcgctgctgaacgcacatgtgacccaggttacagaatctctaaagcaggttcagctggagagggatgagtacgctcagcacataaaagaggaaagagcacgatggcaagaaaggatgtggaagatgtccgtgggcctgtcaccgcacccaaggcaccctcagcagtag

SEQ ID NO: 58772 - DNA, 60 bp, Artificial Sequence
  Description of Artificial Sequence: Synthetic coding sequence
tggatttttatttttaagtgttccgtgatgtacgtgcacttcttttttgcttttttttag

SEQ ID NO: 58773 - DNA, 618 bp, Artificial Sequence
  Description of Artificial Sequence: Synthetic coding sequence
atgaacagttggccatggttgttcgattctaatttctgcagtgctgttgagattatcctggaaccagaaaagaaaattcccaattctactcttcacttctgcgaggaattagtccccaacagtgggtcattgttcggcaagaacatttgctgcgggaaacaatgttgcatatgcgaccttaaaagcctgcttgagcttgacagggacggggagtttcagcctgagagacccaagaactcctgtccagcgcttctcaacgccattagtaggcgcacgagtatcttccccccaccaacatccctcttgctgccagtgactcttgcttcctctcagtgctgttgggctacaagtggatccgctgggggaagagggatcgctcctactccgggtggccagccatgcggcagcagccgaaagagcgggagtagctgtgcatggaggtggagtccttctggtggcagtccctggccctgcagccgagctggcggagcctggcgcagattggggacaagcttggacactcaccctgctgggtctagagcctgccgagccgtacaccaactggccggtgagtctccaaccccaagacaagctagacgtcccccattcccaacatag

SEQ ID NO: 58774 - DNA, 219 bp, Artificial Sequence
  Description of Artificial Sequence: Synthetic coding sequence
atggagaagtggaaactgggtagacaaattcaaccaccttggcccctagctcacgcaagaggatcctggatggctctgccacgttccgagcaactggggacaggcggtgatcaggactggcagctgcagggccacacacgggcaactgaaacaaaagaaaatttccaaaaggaaagcatggtcaaaagtctgcgcatgcagcgacgccagggggaatag

SEQ ID NO: 58775 - DNA, 312 bp, Artificial Sequence
  Description of Artificial Sequence: Synthetic coding sequence
atgaagctgaaatccttgtttggcgagattacctttaccttcggcatttcaaaagagaagctgaagatactggacgatcttacactgctccctcttctggtcaagcagtacaaaatgctgtggagctacaagttacctggttccggaattgttatttggagtaccttccacgccgtgatggacagtgagtggcgtcgtcagaacgcagaactgaatctaattacaaataagcattttctaaagaacctgcagtccaaacacctggatgttaagatcctgaagaccaagaataagctggtggaaggtatttag

SEQ ID NO: 58776 - DNA, 69 bp, Artificial Sequence
  Description of Artificial Sequence: Synthetic coding sequence
gatggcaagatcatgcttcatgtgtgctgcatctccctgtgttcagtgctcgtgtggaagtttccctag

SEQ ID NO: 58777 - DNA, 237 bp, Artificial Sequence
  Description of Artificial Sequence: Synthetic coding sequence
gtgcttctgtttatattctatctgcttattttcatgttctccttctttgagactagatcccatagtgtcacacaggctggggtccagtggcacgaccattcctcacttcaacctcagctcccaggtttgaagcagtcacccacgtcggcctcccagagtagttgggatcacgggtgtgctccaagacacccgatacacctcccccagacacccaaggtactgggcctacaagtgtag

SEQ ID NO: 58778 - DNA, 297 bp, Artificial Sequence
  Description of Artificial Sequence: Synthetic coding sequence
ctggaatgtagcggcactgtgctagcacattgcaacctgtgcctgctggcttcacaagctgcagggataacaggcacctcacaccacgcgcagctgatattcgtgtttttggtagaaacctggttccatcatgtcgggcaggctgggctggaattattgaccagcggcgacccaccagcatccgtctcagagaacgctggcatcacaggggtgagccatcgggcatggcccggaccccagttcttcaacctggagcagggcttttctatgctcgtgaggctcgtgagtaactcttag

SEQ ID NO: 58779 - DNA, 453 bp, Artificial Sequence
  Description of Artificial Sequence: Synthetic coding sequence
agaaaccgcattcagtataatcaatcacagaaagacatcctgcagtcatggtttcagcacgaccccttccccgacaaggccgcacgagaacagctggcgaaggagatcggagtccccgagtctaatatccaggtttggtttaagaactaccgagtgaagcagcgcaagctggattacaaatgcttcagtgagaaagatcagactcagggacacgaccagtctcagcacctgacccaagaatatctacccaaggaagctcggcagaagcagacattcataacatggacacaaaaaaaccgtctggtccaggctttcgagcgcaacccattcccggacatagcaaccaggaagaaactcgctgaacagacaggcttacaggagagcaggatccagatgtggtttcagaaacagaggagtctgtatctgaagaagtcacggatggagcccatgtag

SEQ ID NO: 58780 - DNA, 3651 bp, Artificial Sequence
  Description of Artificial Sequence: Synthetic coding sequence
atggccgcaatggcacccggaggcagtggcagcggcggtggcgtcaatccttttttgtctgattccgatgaggacgatgatgaagtggcggcaacagaggagaggcgggcagtgcttcgcttgggggctggttctgggctggatcccggttcagctggatcattaagcccacaagatccagtcgctctggggtcaagcgctcggccagggcttcccggtgaggcctccgcagcggcagttgcactgggcggaaccggggagacccccgcacggcttagcatcgatgctattgcggctcagctgcttcgggatcagtatctgctcacggcactggaactccacacagagctgttggagtccggcagggaactgccccgacttcgcgactacttctctaacccagggaatttcgagcggcagtccggtactccacctggcatgggcgctccaggcgtgcccggagcagcaggggtgggaggggctggtgggcgtgaaccgtccacagcctcgggcggagggcaactcaaccgcgcaggttctattagtacgctcgatagccttgattttgcaaggtactcagatgatgggaaccgcgagacagacgagaaggtcgccgtgctcgaattcgagttacggaaggctaaggagacaattcaagccctgcgggctaatctcaccaaagcggctgagcacgaggtccctctgcaggagcggaagaattataagagctcgcctgagatccaggaacctattaaacccctggagaagagagcccttaattttctggtgaacgaattcttgctcaagaataactataagttaacgtctatcacgttttcagatgagaacgacgaccaggattttgagctatgggacgatgttggcctgaatattcccaaaccccctgatctgctccaactctatcgcgactttgggaaccaccaggtcacgggcaaggacctggtcgacgtggctagtggcgtggaggaggatgagctggaggccttgacccccataatctccaacctgccgcctactctcgagactccccagccagccgagaattccatgctggtccagaagctcgaggacaagattagcctcctcaactccgagaagtggtcgcttatggagcagattagacgactgaagagcgaaatggacttcctgaagaatgaacactttgcgatcccagccgtctgtgattccgtgcagccgcctctggatcaactgcctcataaagattccgaggattctggacaacatcctgacgtcaacagtagcgacaaaggcaaaaacacagatatccacctcagtatctcagacgaagctgactctaccatccctaaggagaattctccaaatagtttccccagaagagagcgcgaagggatgcccccatctagcctttctagcaagaagaccgtccattttgacaaaccaaatcgcaagctcagcccggcattccaccaagcactcctgtctttttgcagaatgagcgcagactcccgtctcggatacgaggtctctcgcatagcagatagcgaaaagtcggtgatgttaatgctgggacggtgtttgcctcatattgtccctaacgtcttgctcgctaaacgcgaggaactgataccattgatactctgcaccgcctgtctccatccagagccgaaggagcgcgaccaattactccacatactcttcaatcttataaagcgcccagacgatgagcagcggcaaatgatcctaaccggatgtgtggcctttgctagacacgtgggccctacaagagtggaggcagaactgcttccacagtgttgggaacagattaaccataaatacccagaacgtaggctgctcgtggccgagtcctgtggggcactcgccccatatttaccaaaggagatacgaagttctctcgtgctatccatgttacagcagatgttaatggaagataaagccgacctagttcgggaggctgtcatcaagtccttgggcattatcatgggctatatcgatgaccctgacaaataccaccaaggatttgagctcctgctctcggctctcggggaccctagtgaaagggtagtcagtgcgacccaccaagtcttcctgccagcttatgccgcatggacaaccgagctgggaaatctgcagtctcacctgatcctaaccctgttaaataagatcgagaagctgttgcgtgaaggcgaacacggcttggacgagcacaaattgcatatgtatttgtcagcactgcagtctctaataccctccctgttcgcactggtcttacagaatgcacctttttcaagcaaggcgaagttgcatggcgaagttccacaaattgaagtcacccgctttcccaggccaatgagtccactgcaagacgtatccacaatcattggaagcagagagcaactggcagtgctgttgcagctgtacgattaccagcttgagcaggagggaaccaccgggtgggagtcactgctgtgggttgttaatcaactcttgccgcaacttatagagattgtcggaaagattaacgtaaccagtacggcatgcgttcatgagttttctagatttttttggcgtctgtgtcggaccttcggcaaaatatttacaaacaccaaggtgaaaccacagtttcaggagatcttgcggttgagcgaagaaaacatcgactctagcgcaggaaacggcgtattgaccaaggctacggtaccaatctacgcaactggtgtcctgacttgttacattcaggaagaggacaggaagttactagtgggattcttagaggacgtcatgactttacttagcttgtcacacgctccgctggatagcttaaaagcgtctttcgtggagctgggcgctaaccctgcatatcacgagctgctactcacagtattgtggtatggtgtggtccatacctcagctctggtgcgctgtactgcagcccgtatgttcgagcttaccttgaggggaatgagcgaagcgcttgtggacaagcgggtggctcctgccctcgtgacgctatcaagcgaccctgagttcagtgttaggatcgcgactattccagccttcggaactattatggaaaccgtcatacagcgtgaactccttgaaagagtcaagatgcagctcgcctcattccttgaagatcctcagtatcaagatcagcatagcttacatacagagataatcaagactttcggcagagtcgggcctaatgccgagcctcgtttccgggacgagtttgttatcccacatttgcataaacttgccttggtcaataatctgcaaatagtcgattccaagaggttagatatcgcaacccatctcttcgaggcatactctgcactcagttgctgctttatttcagaggatctgatggttaaccattttctgcccggtctgcgctgtcttagaaccgacatggagcatctgagcccagagcatgaggtaatcctgtcctcaatgatcaaggaatgcgagcagaaggtcgaaaacaaaacagtgcaggagccgcagggctcgatgtcaatcgccgcatccctagtcagtgaggacaccaagaccaaatttctgaataagatgggccagctgaccacctctggcgctatgctggcaaacgtgttccaaaggaaaaagtag

SEQ ID NO: 58781 - DNA, 435 bp, Artificial Sequence
  Description of Artificial Sequence: Synthetic coding sequence
atggagagggcaagcggtctgtcaccaggcggtggtttgggagcgactagcagacagatgtcgcctggcacacaactcgctaacccacccgaccacggagataaagattgcctagggagaataagccccggatctgggaaacagattcaggcggctggtcagctacccggaccgcctacctctctggctcctgcccaggggaggctgcggagtttgactccatgggggctgcagacgcccgagcactcagaacctgagggcatcggacaccttcaggccgctactgaggccgtgctcccgcatagcacacagaatctgataactaagcggaatctcatggtgcaagccagggtgcagtggcgcgaccttggttccctcaaaccaccacctccaaggtttaagcagttctcttgcttttcgctgccctctagttag

SEQ ID NO: 58782 - DNA, 177 bp, Artificial Sequence
  Description of Artificial Sequence: Synthetic coding sequence
ccgggaggggctgctgcagccgcttctgtgatggccccacgccgtggaaggtgtttttgcacttcaatctgcggaggaagaggagcaaggccgcagctgcctaggacctgtggcgatggtacccagcactgtggccgtggaaaaccagctttagccgctgctgaggagtggccatag

SEQ ID NO: 58783 - DNA, 294 bp, Artificial Sequence
  Description of Artificial Sequence: Synthetic coding sequence
atgggatcaatcccatccaagccttgtaacaaccccgagggacccctgctgcagggtatggaagctgccgattggaccggaatcggagtatgccttccaccaggcggtgcccgagggcacatttactgttgcacgagattatgtcatcagcgcgcagcgtctgctcacaggtctctgttactgcccaggactgtacagaccggcggtacggaacgggaaaaacctggacccggacaaagaaagcggggtgcccattgctccgcctgcaagagaagctccacccggccatcctag

SEQ ID NO: 58784 - DNA, 504 bp, Artificial Sequence
  Description of Artificial Sequence: Synthetic coding sequence
atggatctgatcaaggttctgtacgtgaaaaagcccctcattttcccaatgtatctgatctataaacacgaaaacctaattctggaaagaaatccccttgacgtcaggagcgtcgtcatggtgtccgttatacccctgacttttgacattatgagagaactgaccctggaaaagaatcccatgaacgtgaagaacgtggttaagccaagcgacatcgtggtaccatatgagaatatgacagagttgatactcgaacggaatcccatgagcgtccgcattatagggaaatgtctcgtgatgccgattatctttgtggccattaaggagctgaccccagaacggaacccaatatcgaaagactgcgggaaggccttcaggtcaagttctttctgtcagcaacacaagtcgacacataccggcgaaaagccctacgaatgtaagaagtgcggtaagacattcaggttttacagcagcctccccaagcacaaacggacccacacttag

SEQ ID NO: 58785 - DNA, 408 bp, Artificial Sequence
  Description of Artificial Sequence: Synthetic coding sequence
atggtagccacatggggaggcagacagctgttgcctcagtgtagtggccctcccctgacacctgggagcccagcaccctcagtggcacaggcttcacgacctgcccctccatcccctcgcaagacttcccccggtccaccacagccctcggctagcccttcgctgccctttagcccactcctggccggttgcagtcgcttgctcccggtgctcgccccaagtctgagctctgtgcacaggtgtccgttgggggcaagggcatctagactaccctggaaactggaagctggtacttcgtctagtggggacagaccattatgtcttcactccgggcagcgaggtgcctgtttaaccgatgagcaggggtccaccctgtctcctcgacagagacggggacccggaaaatag

SEQ ID NO: 58786 - DNA, 5528 bp, Artificial Sequence
  Description of Artificial Sequence: Synthetic coding sequence
atggaactcatgttcgccgagtgggaagatggtgagcgcttctccttcgaggatagcgatagatttgaggaggatagcttgtgttccttcattagcgaggccgaatctctgtgccaaaattggcgaggttggcggaagcagtccgcaggccctaacagcccgaccggcggagggggaggtgggggatccggcggaacccgaatgagggacggccttgtaattcctcttgtggagctttccgctaagcaggtggcgttccacattccttttgaagtggttgaaaaggtctatcctcccgttccagagcagcttcaattaagaatagccttttggagtttccccgagaatgaggaggacataaggctctactcctgtctggctaatgggtccgccgatgagtttcagcggggagatcagctcttcagaatgagggcagtgaaagatcccctgcagatagggttccatctgtccgctaccgtggtgccgccacaaatggttccacctaagggtgcatacaatgttgcggtgatgtttgaccgatgccgggtgacgagctgctcctgtacatgtggggctggagcgaagtggtgcactcacgtggtggcactttgccttttccgcattcacaacgctagtgccgtgtgcctgcgggctcccgtttctgaatccctcagtcgcttgcagcgcgaccagctgcaaaagtttgcgcagtatctcatttctgagttgccgcagcagatcctacctaccgcacagagattgctggacgagctcttgtcgagccagtctactgcaataaacactgtgtgcggggctcctgaccctactgcaggacccagtgcaagtgatcaaagcacctggtatctcgacgagagtacacttaccgacaacataaaaaagacattgcacaaattttgtggaccttcaccagtggtgttctccgatgtgaatagcatgtatctttccagcaccgaaccccctgccgcagccgaatgggcatgcttgctccgacctcttagagggagagagcctgagggcgtctggaatttgttatctattgttagagagatgtttaagcggagagacagcaatgctgccccactcctcgagattcttacagaccagtgtctgacctacgaacagatcaccgggtggtggtacagtgtacggacaagcgctagccacagctctgcttcaggtcacacaggccgatccaacggtcaaagcgaggtcgccgcacacgcttgcgctagcatgtgtgatgaaatggtaaccttgtggcggctggctgtcctagatcccgctttgtcaccacagagaaggagggagctctgtactcaattacgccaatggcagctgaaggtgatcgagaacgttaagagaggacagcacaagaagacgctggagagactcttccccggattcagacctgccgtcgaagcttgttactttaattgggaggaggcgtatccactgccaggcgtgacctattcgggcacagatcggaagctggctctgtgctgggctcgggcactgccctcccgcccaggggctagtcggagcggagggctcgaagagtccagagataggccacggccactccccactgagcccgcagttcggccaaaagagccagggactaagcggaaaggattaggggagggagtaccatcatctcagagaggaccacggaggctaagcgctgaaggtggcgacaaagccctgcacaaaatgggacctggcggtgggaaggcgaaagctctgggtggcgctggatctggatccaaaggttccgctgggggtggaagcaagcgaaggctcagtagcgaagacagctccttggaaccggacctggccgagatgagcttggacgatagcagcttggcattgggggcagaagccagtactttcggcggatttcctgagtctccccctccatgccccctgcatgggggttcaaggggtcctagtacgttcttacccgaaccacctgatacgtacgaggaggacggaggcgtgtacttctcggagggcccagaaccacctacagcatcggtcggcccacctgggctcctcccaggggatgtgtgtacacaggatgatttgccctcaacggatgaatcggggaatgggcttccaaagacaaaggaggcagcgccagctgtgggagaggaggacgacgattaccaggcctattatctcaacgcgcaagatggtgccggaggagaagaggagaaggccgaagggggagccggagaagaacacgacctgtttgcgggtttgaagcccctggaacaagaaagtcggatggaggtgctatttgcctgcgccgaggccctacatgcgcatggttacagttcagaggcctccagactgacagtcgagttggcccaggacttactcgctaacccaccagacctgaaggtcgagcctccgccagcaaagggcaagaagaataaggttagtacctcccgccagacatgggtggccacaaatacactttccaaggcagcgtttctgctgactgttctatccgagcggccagagcaccacaacttagcttttcgggtgggaatgtttgcgctcgagttgcagagacccccagcgtccactaaagctcttgaagtcaagctggcataccaggaatccgaggttgccgctctgctgaaaaagattcctcttggccctagcgaaatgagcactatgagatgccgcgctgaagagctcagggaaggcaccctgtgcgattatcggcctgtgctccccttgatgctggcatctttcatctttgacgtcctatgtgctcccgtggtgagtccaaccggctctaggccgccttcccgcaactggaactcagagactccaggagacgaagagctgggatttgaggcggctgtcgctgcgctcgggatgaaaaccactgtgagcgaggctgagcaccctttgctgtgcgagggcacgcggcgtgagaagggcgatcttgcccttgctctcatgattacctataaggatgaccaggctaaacttaagaaaatcttggacaagctacttgacagagagagtcagacccacaaacctcagactttgtcctctttctacagctcgtcgaggcctactaccgccagccagagaagccccagtaaacatgggggaccaagtgcacccggagccctgcagccattgaccagcggcagcgccggtcctgctcagccgggatccgtggccggtgcaggccctggccctaccgaggggtttaccgaaaagaacgtcccagagtcatcgcctcactccccttgtgagggtcttccgagcgaggctgcccttaccccgcgaccagaaggtaaggtgccttcgcgcctcgccctggggagccgcggaggatacaacggtcgcggatgggggagcccaggaagaccgaagaaaaaacataccggtatggccagtattgatagttcggctccagagaccacatccgattcttctcccaccctcagtagacggccattacggggaggctgggctccaacctcctggggcagaggtcaagattccgactctatcagttccagtagctcagactcactgggctcttcgtcatcctctggttcccggagggctagcgcgtccggtggcgctagagcaaagaccgtcgaagtaggaagatacaaaggccgacgaccagagagccatgcccctcatgtgccaaatcagcccagtgaagcagcagcccatttctacttcgagttggccaagacagtcctgattaaagccggtggcaattcttccactagcatcttcacacatccgtctagttctggaggccaccagggaccccaccgaaacctgcatctatgtgcattcgaaatcggcctgtacgcattgggccttcataatttcgtgtccccgaattggctttctcgcacctactcttcccacgtatcttggattacagggcaggccatggagatcggatctgccgctctgacgatcctcgtggaatgttgggatgggcatctgactcctcccgaggtcgcgagtctggccgatcgcgcatcaagagctcgcgactccaacatggttagagccgcagctgagctcgccctctcttgcctgccgcatgctcacgccctgaacccaaacgagattcaacgagccctggtccaatgcaaagaacaggacaatttgatgctcgaaaaggcctgcatggctgtcgaggaggccgcaaaggggggtggtgtgtaccccgaggtgttgtttgaagttgcacatcagtggttctggctttacgaacagaccgcaggagggagcagtaccgcacgggaaggcgctacctcttgctctgcttcaggcattagagctggcggtgaggccggaaggggaatgccagaaggcagagggggtcccggtactgagccagtaactgtagctgctgcagcagtgacggcagccgctaccgtggtgccagtaataagtgttggctctagcctgtatcccggtcctgggctgggtcacggtcactccccgggtctccatccttatacagccctgcagccgcaccttccttgctccccacagtatctcacgcatcctgcccaccctgcccatcccatgcctcacatgccccgtcccgctgtgttccccgtgccaagctctgcgtaccctcaaggcgttcacccagcttttttgggtgctcaatatccgtacagcgtcacccccccaagcttggccgctactgcagttagttttccagtcccgtcaatggctccaattacggttcatccttaccacacagaacccggacttccgctgccaacctcagtggcttgcgaactatggggccagggaactgtgtcaagtgtgcacccagcctctacattccccgctattcagggagcttcccttccggcactgaccactcagccgtctcccctggtgagtggcggtttccccccaccagaggaggagacacactcccagcccgtgaacccccattcactgcaccacctacatgccgcttaccgagtgggaatgctggccctcgagatgctgggaagacgcgctcataacgaccacccaaacaattttagtaggtctccgccatacaccgacgatgttaaatggctgcttggtttagccgctaagttgggcgtgaattatgtgcaccaattctgcgtcggcgctgccaaaggtgtgctgtccccttttgttctgcaggagatcgtgatggaaactctccagcgcctgagccccgcacacgcccacaaccatctccgtgcgccagcatttcatcaactggtgcagcgatgccagcaggcctacatgcaatacatccatcacagactgattcatctgacacccgctgattatgatgattttgtgaacgctatacggtctgctcgcagtgcattctgcctgacaccaatgggaatgatgcagttcaacgacatcctccagaatttgaaacggtccaagcagacgaaggagctctggcaaagagttagcttagaaatggccacgttcagccctta

SEQ ID NO: 58787 - DNA, 87 bp, Artificial Sequence
  Description of Artificial Sequence: Synthetic coding sequence
gacgcggtgatcctgttctcggtttggcggctgaagaagaagagccgggttttgttttttatatatattatagccattagtgtgtag

SEQ ID NO: 58788 - DNA, 111 bp, Artificial Sequence
  Description of Artificial Sequence: Synthetic coding sequence
atggaagaaactgaatccgggtcagggcgaaaggagcggaggtggctaggggcagtcgcccatgtctgcaaccctagtaccctgggtggtcaggtcgggcgaatcatctag

SEQ ID NO: 58789 - DNA, 495 bp, Artificial Sequence
  Description of Artificial Sequence: Synthetic coding sequence
atgggccagaagaagactatgggcacagagagatctcggggtggcaagaggggccctcagcctggcgcagaacggcctgaagagcccggagccaccttcagcaaaaaaccacccgagggcgcacgtgctccgagatgcctcagccggcctactgcccctaagtctggcgcatgtcttgccaggagaagaccaccgggatctccttgtagcatacgtgatgctccgtttcacacaggagatgaccggtttctggcccgagaaaattttcctaatgttctccagccactgcccagaatgtttgctgttcagcaggctgccgacttcgagagccagtgccctcgtagatgggacagcaggaagcggcctagcgagggcctgccatctgctgggtggggccgttggaggggccgtccaatacatttaggcctgtgggtctccggtagcgtgcggcgaaaggtgtctggcagtcatgtgtctcggagtctccacctgtag

SEQ ID NO: 58790 - DNA, 1143 bp, Artificial Sequence
  Description of Artificial Sequence: Synthetic coding sequence
gtacatcaggagatccacaccattgagaagactttcgagtgttcccatggcaaaaagtccttttgtcaggagagtcacttcaccgagcatcaccggacttgcacgagggagaaaccctgtgaaagtagcgattgtaagaaaagattttgccactcttccgtccttagagtgcatcagcggacccacacgggcgaaaagccgtacgagtgcaaagaatgccgaaagagtttccacgttaagcctaacttgaccaaacatcagaagacccatatcggggagaagcctttcaaatgcaccgcgtgtgggaggacttttttccagcagtccacattaaacgtgcatcagagaacccatactggggagaagccctgcggctgtaacgaatgcgaaaaatctttctataacaaagacgccctgataattcatcagcggactcacaccggagaaaaaccttacaagtgtaacgaatgtgagaaatcctacctcaagaaaagccatttgaacattcacctccgcaaccacaccggtaaaaggccacacgtttgcaacgagtgcggcaaagcgttttctatgaaatccacccttacagtgcatcagcgcacacacggggagaagccatacaaatgtaacgaatgtagaaaatccttctacatgaagagcgctctgtcgcaacaccaaagaatccacatctgggaggagcactgtgaatgtaaagaatgcgggaagacttaccagaggtcgcatttggcaaaacatcacagaaaatacacgaagaaaccatatgagtgcaagcagtgtggcaagacctttcagaagtcacacctgatcgaacaccaacgaactcaccctggtgagattccgcatgagtgtaacaaatgcgggaagagcttttgctacaagagtcctcttacaatccatcagcggacacacatcgaggaaaagccctacaaatgttctaagtccgttacgtacttctgtatgaagtctcacctgaccgttcaccaaaggccccacactcggaagaacccgttcgaatgcaacgagtgccgcaaaatgttctacgtcaagtctaatctcatcaaccatcagcggacccacactggcgaaaaaccttacgaggggaatacctgcggaaaatcttag

SEQ ID NO: 58791 - DNA, 585 bp, Artificial Sequence
  Description of Artificial Sequence: Synthetic coding sequence
atgcccgctccacgattcctatactctctacgcaactacgagccaatgaaacctcttttctttattaactaccctgttagtgacatggaattgccggtacgctcgtccacagtgactcttcttcctgccccactgcctcgcagaggcagcgtgaagacgttcctggcccctagcaagtcatactttccggaagaggaaagagccctcttaaagagcagccacgctttttgtaccgggctctggccatggagaagggactttcagctgccacagtgccaccttgccttgggcctgctcccaggggagcgctctgtgaggctcccgagatttttagccgtgttgaaagaactgtcagcgaccgcctcttttacgcttgcttcagaagccatcccattcctgtctagctttccatttccatggaatctccttctaccttccgttttccaggccctcccacagaagtggcaattcaaggcggacttcctcctcgagtgtactctgtccgtgaaggaagcattccaccaagagtgcggagccggtgtgtctctcgcaaatggcctgaataaagggctgcggacaggatag

SEQ ID NO: 58792 - DNA, 6311 bp, Artificial Sequence
  Description of Artificial Sequence: Synthetic coding sequence
atgagtgtgcccggaacgcctggggctatggaaccagccggagaggaggagaggcccccacctgcagctgaaggggaggatgatgaggaagaagttgccgcagcagcccaaacatctggaccagcacacggcaggagcgcctcatcacttgaagatgccgatgaccaggaggaggagatggaggctatggtgatcgggggaggctgctgtaaggaacaggaactgacgtacgagctacagcagggttatcgtatactgggcgaatttctccaggagaagcatcggggacttaccgctcccttcctccagcctctgggtggagtggccaccgcagaggaagaggtcgctgaaggcccacgaagcggcggaagggggggacgggctttcccgcagcagcccggacaaggcatgtgcctgctgcagatggaagagaagttcgcgtctggccagtacggtggcatcaccgagttcgtggcggattttcgcttaatgctggagacctgttatcgcctgcatggagtggaccactggatcagtaagcaggggcagaaactggaaatgatgctcgagcagaaacttgccttattgtcaaggcatcttagagaaaagactacgatcgccgtgaccagccggggatattacggactggaggatgaaaaaggaactgcgtgcacctccacacgtcggcgttcaacgccaaggagcctggcgggattaactagcggggtttttgagtcaatcatggtccaggttttgcgccaggaggagcagctgcgcgctaaggaggaaaagcggctcagagagcaagaaaggaaagaagctgaagaagcttctcaaaaagagatagaagagtgggaacggaaactgctggcgcaggccgctcccacctgcatggaaacaatgtgggaaatcccagcaatcggccatttcctctgcttagcccagcagattcttaatttacccgaaatcgttttttacgagctggagagatgtctcctaatgccacaatgtaacgccttcctgagtaaaatcatgaccagcctactctcgccgccacatcggagaccaaccctgcacaggcgaccaacgcttccctaccggacctgggaggctgcgctgcgccagaaggtgcagcaatggtatactgcagtcggccaaactgaaaatcccgacaactgtgccgaaaaactcggtctctgcccgcaattttttaaggtgctgggagaggtgaatcccctggaggaaaagccatttcatgaactccccttttaccagaaggtgtggctcttgaagggcctgtgcgatttcgtatatgagacccagaaagaggtacaggacgcggtgttgggtcagccaattcacgaatgtcgtgaggttattttagggtacgattatctcgaaaatgcctacgttcacttcccccaattctgcggcgctgacgtgcgaatctataagcaacgcccatttcaggcgccagaattcccgatcccaccgataaaaattcagagggtccctagaataaagctggagaagctgaagtgcgactacgtgagcacttcgaatggagaacatcggtgttcacgggacagcctcccaagttcattcaagaaggagcaagagaataacttcgatcccgcatgctgcccagctaagatgatccttgataatcatgatataagcgttgagatgggagtgaagagcaattacgagatccggatccggagaccgtgcgagatcaagaaaactgactgttgcaaagagaaccttgaaaagccgagaagccctggggaagtgactggattcggagaaccactcagtcccggtgaaatcagattcatagagaatcaagagaagtatggagaggcctccaggataaaaatagaaccctccccactgaaggaaaatacattgaaaagctgccagatccacgtcaatgggtcacactctgatcatcctgagattaactgtcacaaggtggttcgcgacattctgcttgagcagtctttgcagagccataaaaagctgaaactgacaaaaatgcgagcaaaaaagaaaaagaaaaagaagaaaaagcttaaggacgtacttaacgaaaatctccagagaaaaagagaagggctgcatagtctggcattcaagtcctacaaacccgagattcagaataagctgctgatcattaagaagaaggccaagcacaagaaacataaatctggaaagaagagtgtgtctaagaaggccattaccaagaagcgcaagactgtcatcaagtctccaacggttcctgaattccagctgatctgtactaatcttgacgaactgcgagaactgatcactaagattgaaaatgagctgaaggatctggagaactcacggaaaaagtccggcaaatggtaccatcggagacaggccgtgaaagagttgcacagcactctcatacgattgttgaacgagctgctcccatgggaacctaagctgatgaaagcatttcaacgcaataggtctcgcctgaagaaggattacgatgattttaggcgccaacccgatcatgacaccttcaatcgcgagctttggacgacagatgagggggagggtgacctgggcaaggatagtcctaaaggtgagattagcaaaagtatcgactctacggaaccactggatatcctcgaaaaagaccacttcgatagcgacgacatgaagctgtccgagatcgactttcccatggccagatcaaaactgctgaaaaaagagttacccagcaaagacctgccaaagacgctcctgaagactctgaagcgccagagcaagcagacagactatgtggatgacagtactaaagagttgtcacctcgtaaaaaggccaagcttagtacgaatgagacaacagtggaaaatctagagagtgacgtccagatcgactgcttctccgaaagcaagcatactgagccttcatttcccgagagcttcgcctctctagatagcgtgcccgtgagtacccttcaaaaggggaccaaacccatacaggcgttattggcgaaaaatattggcaacaaggtgacactcaccaaccagctgcctcctagtaccggcaggaatgccttggctgtggaaaaacccgtgctctctcctccagaggcctctcctattaagcctgcgctgacatgccacacaaataccaagggaccgttacaaatggtatacaagatgccttgcggtcagtggctcccaattgacttgcaaaacagctctgtcaagatacaggtccaacctatggtcgacccaaagacaggggaaaagattatgcagcaggtcctcatcttgccaaagaactttgtcatccagcataaagaaggaaaagcagtggccaaggaagtcccaccattgcagcagaagggaaccgagcagcactgcagtagcttcccacaaacaactaatatcaattctagcctcgcctccgtcttcgtgaattccccaggcaccgtgtcgacccagctgcccaacacagctttcaataagacaataacgcctttatcgaatatatcctcggctcggcctcagcccctaagccctgttacttctgtatctaacttgttaacaccctcagtgaaaacctcccaaagcgaagctgggaaagccaagaacgctgtgagcgccgcaaccttttccctccccagcgcaagtccgacgattagctcgacagggcagccgctcagcagcactaccacactcaacgggagtacgaatcccggttcctcctttaactgtttcgctcagcagactgcggacagcagtgaggccaagcaggaactgaagacagtgtgtattagagacagccagtcaatcctggtcaggaccagggggggaaataccggggtcgtaaaagtgcaaactaatcctgatcagaatagtcccaatactgtgagttctagttccgtatttactttcgcacctcagcttcaggcgttcttagtgccaaaatcaactacctcttcttccgctttctctccggttgccggaaccaccacaacaagcagcctcagtcctttttcacaaaccccaacaagtgtgtctattcccgcttccttcgccccttcgatggggaaaaacctgaaactcactcttgggcacacaaccgggagtggggacttgggacacgttatcgataagacctcccatatgccatcttcacctctcaaaagttccatttgtagcagcacgttgctaccatccaccacaagctccagtgttagcgtgatctccatcagcgccgcaaacttcgggcagaacaacgccaacattattcacacgcccacaaaacagcagcaggtcgattacataactaagagctacccggtgacacggagtgaagccacagctgcaactaacggtgacgttataagcggcaccccagtgcagaagctcatgctggtttcagcaccatcgatcctgtccagcgggaatggaactgccataaacatgacaccagcattgacaagtaccggggtgagtgcccagaaactggttttcatcaatgcacccgtcccttctggaacctccacacctacgttggtcgccgaaagcctaaagcagacactccctccgcctctgcataaggcttatgtaaagacccctgaacagcctcagatcgtcctaatcccctccactgtgggcacaccaataaagataaattcctcacccgctgtgtctcagattaaggacgtaaagatcggacttaacattggccaggcaatcgtcaacacctctgggactgtccccgctattccttccattaatattcttcagaatgtcacaccaaagggcgaagacaagtctagtaagggctacattctgccactctccacaagcggcaattcagtacctgtgagctccaactttgtctctcagaatattaccccagttaacgagtccgtggtttcttccgctagagccgtgaacgtgctgagtgtgacaggtgcaaacctaagcctcgggtccttccctgtcacctctgcaagtgccagtgcgggagcccagcccccagtgctggtgtcaggcaacgacaccagcagtcggattatgccaattctgtctaatcgcttatgttcatccagcctcgggaacactgttgctattagcacagtgaagaccggtcacctcgcctccagcgtcctaatctccacaacacagcccgtggtgtcacctaagtgtttaacaagtgctcttcagattccagtcacagtcgctttgccaacacccgcaacgacatcccctaagattattaacaccgtgccccactctgccgcagtgcctggcgcaacacgctctgttagcatctctaaacggcagtctcgcacctccctgcagttccatagtccaggtatttctaccacggtgcctacaaatgtgaatacgaacaagccgcagactgagttgtctagtctcagcaccagcccagggaagatcacaaatacttcaaactttgcaagcctgcccaatcaacaagccttggtcaagaccccatcatactcctctgcccctggaggcactacaattcacaccgctagcgcgccttctaatgtgacttccttagtgggcagccagttctctgaaccttgtattcaacaaaagattgtaataaacactagcacccctctagccccagggacacagatcatgattaacggcactcggtttattgttcctccccaggggctgggcgctgggagtcatgtgctgttgatttctacaaacccaaaatacggagccccactggtgctgaatagcggccaggggatccagtccacacctatcgataattcagcccaaaaaattacattagcctccaacaatagcttgagtggccagcctctgcagcacccgctacgatcgcccaccaagtttatcaacagcttcggcaatgcatccagcatccccaccgtacatacctcaccccagttaataaacacaaccgcaaaggtccccgtaccgccacccgtgccaactgtgtctctgacgtcagtaatcaaaagccctgcaacactgcttgccaagaccagcctggtcagtgccatctgcccctctaacccgcctctgccttcctctacgtctgtatttcacctcgatccacctgtgaagaagctactcgtctcaccagaaggagcgattctcaatactattaatacaccagcatccaaagtcagctccttgtctccgtccctgtcccagatagtcgttagcgcctctcgatcccccgctagcgtgtttcccgcattccagagttcaggtttggagaaacctgacagggcagcgtcata

SEQ ID NO: 58793 - DNA, 342 bp, Artificial Sequence
  Description of Artificial Sequence: Synthetic coding sequence
atgcataccgtcccctggggcgtcgacttcgcactgatcgccatgaagaactttatcagtcagtggagttccttctttcggagcggaatgggcaagtcacaaacaggatacctgcctcgggtgcctagagaacagccctttgcggcaggcctgtgggggttggctgccgcactgtcacacctagccgtcaacgccttcagtctgctgtgccctcctttgccgaagacgtcatgctcccttaatccccatggtgacgtggagagcaggaaggtccacgcaacggttgaaaacgtctacatctccgcactaaaccttccgtgggtgcgagtcaagtggtgttag

SEQ ID NO: 58794 - DNA, 66 bp, Artificial Sequence
  Description of Artificial Sequence: Synthetic coding sequence
cgcggtgctgaccgcgaacgctttgccagatgtgtcatccttgtgacacaggaagccgatgcatag

SEQ ID NO: 58795 - DNA, 243 bp, Artificial Sequence
  Description of Artificial Sequence: Synthetic coding sequence
atgtgcctcatcagtctatgtgtgagcttcacaagtgtgaacaagcgcgaacagaataaacccaagatcctcatcttgttgaagaaacgtctttcaggatgtttcatcaaggaggccagggggactcgcctgaaagggaaccagctcgcagttacgaaggcccgagacgatgggggactggctgaagatggagactccggtggagggaaagtgataaggttttggatctactttgaggggtag

SEQ ID NO: 58796 - DNA, 417 bp, Artificial Sequence
  Description of Artificial Sequence: Synthetic coding sequence
gcgggaggcagaccccaccagcctgcctctctccctcccggtaacccacaacttgctgccctgtctctggagcagctgaaatctcaggcaccaatggacacaaaacccgcttatcagaatccccgacgcaaagccgagcactcagtatccgtgcacctggacgaacaagattggaatccaactatgcacaagtcattgctggggaacgatcagacacagtctgaggtgcagtccgggacactggaggctggtgttgacagagtcatttcccagactgtggatcccaaactaaaccacatcctgcggccaccagttgaaggagctatacacgagttcctagaagccaggaagaagtcctccagtgcttcctccccgacaagggctcaacgtgcacgtaccctgcagctctacccctag

SEQ ID NO: 58797 - DNA, 84 bp, Artificial Sequence
  Description of Artificial Sequence: Synthetic coding sequence
tgttgggggttctactacattctgtacctgttgtatatcatctatctttacaatatttatattttaaagacacggtcctattag

SEQ ID NO: 58798 - DNA, 108 bp, Artificial Sequence
  Description of Artificial Sequence: Synthetic coding sequence
atcgtgctgttgctgtttatctgctttctatctaaattgaatttcacagtactcgaaaagttccctaaatctacctttctgtgcaagattcaacatgaatcactttag

SEQ ID NO: 58799 - DNA, 570 bp, Artificial Sequence
  Description of Artificial Sequence: Synthetic coding sequence
atgtgtgctaagcggcttcggggtcctttccgaatcttcctgccactgaggaagtatagcttctttcccagccaggtcgcgcaaccctttgctagtgcagccgtagctcaagctctgctcagctccccagggaccaatctgcaacaaacactcgtgggcggactgagacttcgtcacggcagcgtaggaggagcacagtgggtagtgaaggccgcttgcccctgggagcctcaggatgtggcctgctgcggcggattcacagtgaccgccagaattgctgcttgtgtcctcttatgcttatgtgaacacatgtacacgccaagcgcacacgcacgcatgacattcgggaccgagcacctcttactttggcctgcacagcgcagggcagaccccagaacagctgccccaatcagacttcatcaggggcaactggaccccagccgagacccagaaaacctgcgggcttgggctgttggctcctgtcgagcaggcgtggagttacacgggtctccagttcacctgcacatgcgagccggacagcacataagcatgtttgcgggagtcgcttag

SEQ ID NO: 58800 - DNA, 3285 bp, Artificial Sequence
  Description of Artificial Sequence: Synthetic coding sequence
atggctgctcgagcacctccagcagcaccagccgctgaggaacccggtaacccaggaggccctcctcggcgaaaaaaaagcagaagtggggctagtggactaaggcgcgcattctcatggcttcgcggtaaaaggagaaagaaaaaagcagccggtgctgagggcgcagagccagccgctccacgcgctaagaaggccgaagacaaggcaaagcgagctaagggaaagggaaggggaagtgctaaagcagaaaatgacaaacaccttagcgtagggccaggacagggacccggatcagccgtcgatgagcaccaagacaacgtttttttcccctcaggacgcccaccccacctggaagaactccacacccaagctcaggagggattacggtctctgcagcatcaggagaaacagaaactcaataagggaggctgggaccatggagacacacagtccatccagagcagtcgcactggcccagacgaagataatattagtttttgtagccaaaccacctcctacgtggctgaatcctctaccgctgaggatgcgctgtctataagaagcgagatgatccagcggaaggggagcacattcagaccccatgacagtttcccaaagagtgggaaatcaggcagacgcagacgggaacgcagatccactgtcttaggtcttccccagcacgtgcaaaaagagctgggcttgaggaacgaaagagaagcacctggtactcctagagcccctggcgctcgcgacgccgtgcgcattcccacggtcgatgggaggccgaggggcacttcagggatgggagcacgggtttccttgcaggcactggaggcggaggccgaggccggtgcagagacagaagcgatgctgcagcggcatatagatcgcgtctaccgagacgatacttttgtaggtaggtcgacgggtacccgagccccaccgctcactcgacccatgagcctagctgtccccggattgaccgggggagcgggtcctgctgaacctctgagcccggctatgtctatttccccccaggcaacatacctgtccaagctgatcccacacgctgttcttccccctactgtcgatgttgtggcgctggggagatgttccctacggacgttatctagatgtagcctgcacagcgctagtcctgcgagcgtgagatctctcggcaggtttagtagcgtaagctctcctcagcccaggtcgcgacacccctcttcttccagtgatacatggagtcattcacagagctctgacactatcgtgtccgatgggagcacactatcctcaaagggaggctctgaggggcagcccgaaagttccactgcgagcaacagcgtcgtcccccctccacagggtggctcaggacgcggttccccgagcgggggttcaaccgcagaagctagcgacacgttgtcaatccggtcttccggccagctctcaggcagaagcgtttctctacgaaaactgaaaaggccacctccacccccacgacgaacccactcattgcatcagcggggattagcagtacctgacggaccactaggtctgccccctaaacccgaaaggaaacagcagcctcagctgcctcgccctcccacaacagggggtagcgagggtgcgggtgcagctccgtgtccacctaaccccgcaaattcatgggtgcctggtttatcacccggtggctctcgcagaccacccaggtccccagaaagaactctaagcccttcttccggatatagtagccagtccggcactccgactctgccacccaaaggtcttgcaggacctccagctagccctggaaaggcacagcctcctaagcccgaacgagtcacctcccttcggtccccaggcgcttccgtgtcctcttccctgacctccctgtgttcatcatccagtgaccccgctcccagcgatcgcagtggcccacagatattgacgccacttggggatcgatttgttatccccccacaccccaaggtgccagctccatttagcccccctcccagcaaacctaggtcacccaaccccgcagcacccgcactagctgccccagcggtcgttcccggtccagtaagcactactgatgccagtccacagtctccacctacacctcagacgactctcacacctctgcaagagtctccagtgatttctaaggatcaatctcctccaccttctccccctccatcatatcacccacccccaccccctaccaagaagccggaagtcgtggtcgaggccccttccgccagcgagactgctgaggagccactccaggatcccaattggcccccacccccacctccagcccctgaggagcaggatctttcaatggccgattttcctccacctgaagaggctttcttctcggtcgcgtctcctgaacctgccggtccctctggtagccccgaactcgtcagttcgcccgctgcatcctcaagtagcgccaccgctcttcagattcagcctcccggttcaccggatcctcctccggcacccccagccccagcccctgcctctagcgctcccggtcacgtcgccaagctcccccagaaggaaccggtcggttgcagcaagggtgggggaccacctcgggaggacgtgggcgcacccttagttacgcctagcttgctgcagatggtccgcctacgctctgttggagctcctggaggagctcccacccccgctctcggtccttcagcacctcagaagccactgagaagagccctcagcggcagggcttcccctgttcctgctccatccagtggtttacacgccgctgtcaggttgaaggcctgcagcctggccgcttcagagggtctctcatcagctcagcccaatggcccaccagaggcagagccaagaccccctcagagcccagcatccactgcttccttcatcttctccaaggggtcccgcaaactgcagttggaacgcccagtgagccccgaaacgcaagctgatcttcagcgcaacctggtggccgagctccggtcaataagcgagcaaaggcctccccaggcccctaaaaaatctccaaaggcgcctcctccagtcgcacgcaagccttctgtgggtgtacccccaccggcatcgccttcttacccgagagcagaaccactgacagcccctcctacaaacggactgccacatactcaggaccgtaccaagagggagctggctgaaaatggcggagttctccagctggtgggacctgaagagaagatgggcctgcccggaagtgattctcagaaagaactggcctag

SEQ ID NO: 58801 - DNA, 942 bp, Artificial Sequence
  Description of Artificial Sequence: Synthetic coding sequence
atggagtattattactgtcccagtctccttaagcttctaaggtacctgtgggaccaactgaagcagtgtttctctcggcagccaacagagcctaaagatacggataccctggtgcatgaagccggttcccagtacggaacatggactgagcagtgccaaagtggagagtctctggcaacagagagtcctgacagcagcgcaacttccacgagaaagcagccgcctagcagccgcttgtcatctctgtcaagccagactgagccaaccagcgccggagatcaatacgactgcagccgtgaccagcgaagcactagtgtcgaccacagttcgactgacctcgagtcgaccgatggcatggagggccctcctcctccagatgcatgccccgagaagcgcgtggatgatttttccttcattgatcagacgagtgtgctggactcgtctgcccttaagactagggttcagcttagtaagcgctcacgcaggagagcacctatctcacactcactccgcaggtcccgtttctcagagtctgagtctcggtcacccttggaggatgagacagataacacttggatgttcaaggacagtaccgaggagaagagtcccaggaaagaggagagtgatgaggaagaaaccgcctcaaaagccgagcggacgcccgtgtctcatccccagaggatgccagctttccccggaatggacccagctgtgttaaaagcccagctccacaagagacccgaagtggactcaccaggtgagacaccaagctgggcaccacaaccaaagtctccaaagtctcctttccagcccggagtgctgggctctagagtcctaccttcatctatggataaggacgaaaggtccgacgagcccagcccacaatggctgaaagaacttaagagcaaaaagcgccagtctctctatgaaaaccaggtatag

SEQ ID NO: 58802 - DNA, 1170 bp, Artificial Sequence
  Description of Artificial Sequence: Synthetic coding sequence
tgcgagaaatcaacattttttaaacaccagaaacgtacccataccgtggaaaaaacatttgagtgctcacacggcaagaagtcattctgccaggagagtcatttcaccgagcatcataggacctgtacacgcgaaaaaccatgcgaaagtaacaagtacggcaaaaccttccaccagaaacgatcatttatacaccatcagaggacacataccggagaaaagccgtacgaatgcaaagaatgtagaaaatccttccacgtcaaaccaaatctgacaaaacatcagaagactcatattggcgagaagccatttaagtgcaccgcttgcggcaggacctttttccagcagagcactctgaatgttcaccaagggaaacatacggaagagaaaccgtacaagtatactgaatgtgaaaagagtttttacaaaagtgtattaattattcacgagcggactcataccggagagaaaccctgcggatgcaatgagtgcgagaaaagtttcgaagttcttactactctggtgatccaccagaggactcatacaggcgaaaagccttataagtgtaatgaatgcgagaagtcatacctcaatctaaaaagccacctgaatatccacctgcgaaaccacaccggcaaacgacctcatgtctgcaacgagtgcggcaaagctttttccatgaagagcaccctgacagtccaccagagaacacacatgggaaagccgtacaaatgcaacgagtgcaggaaatctttttacatgaagtccgcactcagccaacatcagagaatccacatttataagaagccctatgagtgtaaacagtgtgggaaaacatttcagaaatcccaccttatcgagcatcagagaactcaccccggagagatcccacacgaatgcaacaagtgtggtaagtcattttgctacaaaagcccactcactattcaccaacgaactcacatagaggaaaaaccctacaagtgtagcaaaagtgtcacatacttttgcatgaaaagccatctgaccgtgcatcagagaccccacaccaggaaaaacccatttgagtgtaacgaatgccgtaaaatgttctatgtcaagagtaatctgataaaccaccaaagaacccacaccggggagaagccttacgaaggaaacacatgcggaaagtag

SEQ ID NO: 58803 - DNA, 96 bp, Artificial Sequence
  Description of Artificial Sequence: Synthetic coding sequence
atgtccgaaaagacgggtgagccggctgcagagaacagagacaaggaagcaagtgtagcaggggctcagattacactccagacacagaccccttag

SEQ ID NO: 58804 - DNA, 2157 bp, Artificial Sequence
  Description of Artificial Sequence: Synthetic coding sequence
atgtccagaggctacagcgagaataataatttccttaacaacaacaaccagatggtacttgacatgatcctctatcccctgatcggtattccccagaccatcaattgggaaaccatcgcgagacttgttcccggactcacccccaaggaatgtgcgaaacggtttgatgaactgaaaagctcaggaagcagccccgtggataaccagtacaactctctgatggctgccggagagtcaccagtggagaccctagcgacatatatcaagtcctccttgttggacattcatggggagttccaggaaactccagtcggccatgacgcggtatcaaagactggacgacattctattgcctccacccgcaactgctcttctgaatcagagaactgcactacgcataacgggggagagatgaccgaggaatcagaaggcccaaacatggttattcatgtgtgtgacgaggccaaaaacctgaaagaggattttacatgccccagggatctgctgatctccgagatgaagtactttgctgagtacttatcgatggatgcacagaggtgggaggaagtagacatcagcgtgcactgcgatgttcatatattcaactggctgattaaatatataaaacgcaacactaaggagaacaaggattgcgagatgcccactttggaaccgggaaatgttattagtattctgattagtagtgagtttctgaagatggacagcctggtggagcagtgcatacagtattgccataaaaacatgaacgcaatcgttgccaccccttgcaacatgaactgtattaatgcaaatctgctgacacgaattgccgatctttttagccacaacgaggtggatgacttgaaagataagaaggataagttcaagagcaagctgttctgtaaaaaaattgagagacttttcgatccagagtacctgaatcccgacagtcggtccaatgccgctacgctttatcgatgctgtctgtgtaaaaagcttttgactaaggaaactgagagaagaatcccctgcatacctggtaaaattaatgttgataggcgaggcaatatcgtttatatccatataagggataagacctgggatgtccatgaatacctaaatagtctgttcgaggagttaaaaagttggagggacgtctattggcggctgtggggcaccatcaactggttgacatgctcacgttgctatcaagccttcctatgtatcgaattctctcactgccagtatcattctgagaccgtggtgtatcctaccgctgcatcctccctgaatactgtgggtaccggcatctacccttgctgcaaccagaaggtactgcgcttcgaccccactcagcttaccaaaggctgcaaagtgcgggatcatatggtaacactgcgggaccaaggcgaggggggagacctccccagctgtccaaccgcacgcatgctagatgacctgcacaagtacagagacgtgatagttgtgccattcagcaaagacactgtatcagatgtaggcgtgggactgtgcgacgaaaagggcattgagtgcgacgtgctcctggagccgaataccccctggggtcccaagacgggggagctcaacgcatttctgtctcttaaaaactggaccctgcaactgaagcagcagtctttattttctgaagaggaggaatataccacaggctcagaggtgaccgaggacgaggtgggcgacgaggaggaagtgagcaagaaacaacggaagaaagagaaaccaaagaagttcacccgccagcccaagaagcaagtaagcagtccctgcgcacagcgcaaagaaaaagccctggagaagagcgcttccagagatgttagcccattcgtgatgagcatgcagaagaataagtgggatgccactcggagcctgcgtttcaaccaagacgcccaacgggaggacgatcagcgaagaatgaccgagatcaccggacacctgatcaaaatgaggctaggagacctcgaccgagtgaaatccaaagaggctaaggaatttgccggaggcatttactcaaggctggaagcacaaatcaaagcatctgttcccgtctctgcacgccagtcttcctctgaaaagaacacaagatcaaaaagtagattcggccagggcagacctgcctag

SEQ ID NO: 58805 - DNA, 5129 bp, Artificial Sequence
  Description of Artificial Sequence: Synthetic coding sequence
atgcgggcaggctggactcctagaggcttctccgccttccacgcttccctgcttcctggtcgccacccatacctggcccacctgggccctagggataggggagcgaggatcgggagtagagcttacagccaaggatgctgttcttgtctgtggctaacctacaaaggcaagaaagaaggcagcaccaagggcgaactcggcccagctgctgtcacagatctggaaatcccgtcctacagtaggggctttctaccttgtacaccgagatttcccaccacatggtgtagagggccaggttgcttctgcggtacagctgtgattgcagggaacctgggcgatttggcccgaatagtggggcctagtcaccatgcaagccagctcctgcttctgcaagagcaggattccggaaaccacccaacgatggccgaaagtctctccgagatctctgatagcttggatgtcctagaggccggagatgagggtaagaagaagtgtaaatttaaggcattgaagagtttctttgtgaaaaagaaagagaaagaagccgaggacacacaggaagaagagatgctggaactgagcctgtcctcctcgaatattaatatctcatcactccaaccagttcgtgaaaaccagccgacaaaggctagagctaaatcctctatgggctccaaagcgttgagccacgactctatattcatgcttggacctgaacccgagagaagcgcaagcaaaatgtttcccagcatggatccacagcgaggacgtcctcagcagcggtcccatatttctcgcacactgccaaaacctcggagtaaggtccctggcgtcgtgagtggagccatgtcaggcgcagtacttcaaaatgtcccaaccagcgcggtttgggtggcaggccctaaaatcactgaaaatccacctagccgacgcaggaggctctctatcattccaccggtgattcagcccgaaatcatttctaaaaacttggtcgagatctctctcgatgatgagtcacccaaaaacccacagaaaaaggccttgccccacaagtccctgacagccactcagagtttctcagagctgagtagcggcccagattgctcgcagtccctgacggctttcgcgacattagcttcgacttcctctacccagctccccatcgggttctctacccctgcgacaactcaaggttgcctggattcatccgctgcacgccacaaaatgacacttaaccccagaaaacaaaagaagaacctacaggtaattattcggggactgcccgtttggtttagccactttcaaggaattcttgaagggtctctgcagtgcgtgacccagaccctggagactcccaacctagatgagcccctgcctgtagaacccaaggaagaggagccaaatctgcctctggtctctgaggaagaaaagtcaatcacgaaaccaaaggaaatcaacgaaaaaaaactcgggatggactctgccgactcttctagccagaaacaaaataacaaaacagagatgtacgataaaaagaccaccgaccaggctcctaacactgacgctagcaggtcccaaggctatcctatgtctgccgcatatggcagacggtggagacgcaagggtgccagcgttagcggactatccggatgtgagtttaaagggaggtccctgaaacagagcagcgaaggctatggactgggtgatcgggcaggatcgagccccactaacaagaccgcgaggaatgttccatttagtcatctcagcctggagaaggacaatatggagcaaccaaccacgtcacaacccgagaccacgaccccccaaggactgctcagcgacaaggacgatatggggaggaggaacgctgggatagacttcggaagtcgcaaagcctcagctgctcagccaatccccgagaatatggacaattcgatggtgtctgaccctcaaccttatcatgaagatgcagcaagtggagctgagaaaacggaggctagggcgtccctgagcctgatggtggaaagtttgtcaacaacccaggaagaagcaatcctctcggttgcagccgaggcccaggtgttcatgaacccatctcacattcagcttgaagatcaagaagctttctccttcgatcttcagaaagcgcagagcaagatggaaagcgcccaggacgtgcagaccatttgcaaggagaaaccttctggcaatgtccaccagacattcactgccagcgtgttgggtatgacttccacaaccgccaagggtgatgtgtatgccaagaccctgcctcccagatccttgttccagagcagccgaaagccagacgccgaagaggtgagttccgattctgagaatatcccggaagaaggcgacggttccgaggaactcgcacatggtcactctagccagtcccttggcaagtttgaagatgaacaagaggtgttcagtgagtcaaagagtttcgtcgaggatctgagctcatccgaagaagagttggatctgcgctgtctaagccaggcactggaggagcctgaggacgcagaagtgttcacggagtctagctcatatgtggaaaaatacaacacgtctgatgactgttcgtcgtcggaagaagatctgccactaaggcaccccgcacaggccctgggtaaaccgaagaatcagcaggaagtgtcttctgctagtaataacaccccggaagaacagaacgactttatgcaacaactgccctccagatgcccttctcagcctattatgaacccaacggtccagcagcaagtgcccaccagcagcgtcggcactagcattaaacagtcagattctgtggagcccattccccctcgccacccgtttcagccttgggtgaaccctaaggttgagcaagaagtaagttccagtcccaaatctatggcagtagaggagagcattagtatgaagcccctgcccccaaaactcctatgccaacctttgatgaaccccaaagtgcagcagaacatgttctcagggagtgaagacattgccgttgagcgggtcattagcgtggaacctctgctgccccgatacagtccacagtccctgactgatccacagataaggcagattagcgagtccactgcagtggaggaggggacatacgtggagcctctgccccctaggtgcctgtcccagccatctgagcgacctaagtttctcgacagcatgtccacttcagccgagtggagtagtcccgtggccccaactccctctaaatatacttcccccccatgggtgaccccaaaattcgaggagctgtaccagctgtcggcacacccggagtccacaaccgtggaagaggacatttcaaaagagcagctgttgcccagacatctgagtcagctgacggtgggcaacaaggtgcagcagctgtccagcaactttgagcgcgcagcaatcgaggctgacatatccggttccccactcccgccacagtacgcaacccagttcctgaagagatcaaaagtacaggagatgactagtcgactcgagaaaatggcagttgagggtacaagcaacaagtcgcctatacctagaaggcctacacagtctttcgtaaaattcatggcccagcaaattttcagtgagagctccgcacttaaacgcggatccgacgtggcccctctgcctcccaatttgccctcaaagagcttgagcaaaccagaggtcaaacatcaggtgttctctgacagtggcagcgcaaacccgaagggcggaatctctagcaagatgctcccaatgaagcatcctttgcagtcactggggagaccggaagaccctcagaaagttttcagctatagtgagagggcgcctggaaaatgctcttcttttaaggagcagcttagccctagacagctgagtcaagcacttaggaaacccgagtacgagcagaaggtaagccctgtatcagcatcttcgcctaaggagtggagaaacagtaagaaacaactgccaccgaagcacagtagccaggcctccgaccggtctaagtttcagccacaaatgtcctccaagggccctgtaaacgtgcccgtaaaacagtcctcaggagaaaaacacctgccctcatcttcaccattccagcagcaggtgcactcatcttccgtgaacgcagctgctagacgatccgtgttcgagagtaacagcgacaactggtttttgggtcgcgacgaggccttcgcaattaagacaaaaaagttcagtcaagggagtaaaaacccaatcaagtccatccctgcacccgcaacaaaacctggtaaatttacgattgcgcctgtgaggcagacctctacatcagggggtatttacagcaagaaagaagacctcgagagcggggatggaaacaacaatcagcatgccaatttatcaaaccaggacgatgtggaaaaactgttcggcgtccggctcaaacgagcccctccttctcagaagtacaagtcagaaaagcaggacaactttacccaactggcaagtgtcccatcagggcctatcagttcctcagtagggcgaggacacaagatcaggtctacaagccagggactcctggacgccgctgggaacctgactaagatttcgtatgtggcagataagcagcagtctagaccgaagtctgagtccatggctaaaaagcagcctgcttgtaaaacccctggcaagcccgcagggcaacagtcagactatgccgtatccgaacccgtgtggattaccatggctaagcagaaacagaagagttttaaggcccatatttcggtcaaggagttgaaaacgaaaagcaatgccggagcagatgccgaaaccaaggagcctaaatatgagggtgctggctctgcgaatgaaaaccagccaaagaagatgtttaccagcagcgtgcataaacaggaaaaaactgctcagatgaaaccacccaaaccaacgaagtccgtgggctttgaggcacagaaaattctgcaggtcccggcaatggaaaaggagaccaaacgctcctccacactcccagcaaagtttcaaaacccggtggaacccattgaacctgtgtggttcagcctggcccgaaaaaaggcaaaggcctggagccacatggctgagataacacagta

SEQ ID NO: 58806 - DNA, 5420 bp, Artificial Sequence
  Description of Artificial Sequence: Synthetic coding sequence
atggctacaagggtggaggttgggtcaataactccactgaccgccgttcccggtctgggcgaaatgggcaaggaagagacactcacacgcacgtactttctccaggcgggagaggcatcaggagctcccccagctcgaatcttagaggcgaagagccccctccggtcgccagcgaggctcttacccttgcctaggctggcccctaagccttttagcaaagagcaagatgtgaagagccctgtgccgtccttgaggcctagctctacagggccaagccctagcggtggactcagcgaggaaccagctgccaaggacttggataatcgcatgcccggattggtcggccaggaagttgggtctggtgaaggaccacggaccagttctcctttgttcaacaaagccgtgtttctgaggccgtcatcttctacaatgatcctttttgaaaccaccaagagcggtcccgctctgggcaaagctgtgtcagagggggctgaggaggccaagctgggcgtgtctggcagccggcctgaggtggccgctaagcccgcactgcctacccagaaaccagccggtacattacccagaagtgctccgctgagccaggacactaaacctcccgtgcctcaggaagaggccggtcaggaccaccctccatccaaggcctcaagcgttgaggatacagcaagaccactggtcgagcctcggccacgattgaagagaaggccagtgagcgctattttcacagagagcatacagccacaaaaaccaggaccaggggcagctgcaacggtcggcaaagttcctcccacccctcctgagaaaacttgggtccggaaaccaaggcccttgagcatggacctgactgctagattcgaaaacaaggaggccctgctgagaaaggtggctgacgaaggctccggccctacggccggtgacatggctgggttggagaggccccgtgccgcaagtaagttggaccgcgactgccttgtgaaggccgaggctcctctccatgaccctgacctcgactttctggaggtggccaaaaaaatccgagagagaaaagagaagatgctgtccaaacctgagatgggaagccctcgagctcttgtcggagggagcagtggcgtgacaccctcgaacgatcagtctccttgggaggaaaaggcaaagctggacccagaacccgagaaagccgcagaatctccaagccctagactcggtaggggccttgaactagcagaagtcaagagcagggtggcagacggagaggcggcagccggaggcgagtgggcaagccgccgtagcgtccgcaaatgcatcagtcttttccgtgaagattccaccctggcccttgccgttggatctgagtcgcctctggctactcccgcttctccttccgctgctcccgagccagagaagggagtcgtgagcgtgcaggagcggattcgaggatggacggcagaatctagcgaagccaagcccgaagtcagacgtcgaacattccaggctaggccactgagcgccgacttgacaaagctgtttagtagctcggcctctagcaatgaggtgaaatacgaaaaatcagcagaactctctggtgagttcccgaaggagcctagggagaagcaaaaagaggggcactcgctggatggcgcttgcataccaagatcaccttggaaacccggtacactaagggacaagtctagacaaaccgagcagaaggtgagttctaaccaggatcccgattcttgccgcggaggttcaagcgtggaagccccttgccctagtgacgtcacacccgaagacgacagatccttccagacagtgtgggctactgtgtttgagcaccacgttgaacggcacactgtggccgatcagagtggtaggtgcctcagtaccacccctcctggtgatatggcacacgcacgcgtcagcgagcccagacccagacctgagatggggtcctggctgggtagagatccaccagacatgactaagttaaagaaggagaattcaagaggatttgataacccggagactgaaaagctggggccaaccactcttctgaatggcgagctccgcccttaccatactccccttagagacaagtatcccctttcagaaaatcacaacaataacacatttttaaagcacctggaaaatcccccaacatcccagcgtatagagcccagatacgatatcgtgcatgccgtgggcgagcgcgtgcacagtgaggcaatttcaccagcacctgaagaaaaagcagtgacgctgcgctctttgaggagttggttatcactcaaagatcgccaattgtcccaggaagtgacacccgctgatctggaatgtggacttgaaggtcaggctggctcggtacagagggcttcccttatctgggaggcccgtggaatgcccgaagctagtggccctaaattcggcggaaactgcccatttcccaaatggaccgggggtgccgtcgtgtctagccacaaggctacagtagctgtaagtgaggagcactgcgctccaggcgctacctcagtacgcgctatcaaggctgccatttgggagagccagcatgaaggacctgagggggcacgaagtaaacctggtgtgggcgctcggggacctcctcaggggtgccctctggatccactctctagagccacaaacggcccaagcgactcccaggcgagaacccatccggatgcatttgcagtccagaagggacccttcattgtggcagcacgcgagggggacccgggacccgctcaggtaccacagccggctgtcaggatgagaaaggcaggggcaatggaccaacgcatggacaggtggcggaggaggacactccctcctaatgtgaagttcgatacattcagttcactggtgccagaagattctcctcatgttgggcatcgcaggacagactatgtgtcaccgaccgcgtcggccctcagaaaacctcagctgagtcactatcgggttgagacccaagaagtgaaccccggagctagccgagaccagacttccccagccgtgaaacagggaagtcctgtggagcccaaggcaacattcttcgccgttacttaccagattccaaacacacagaaagcaaagggcgttgtgctgtctggcgcagaatctctgctggaacactccagaaaaatcactccaccttcatcacctcactccttgacctctacattggtttctcttgggcacgaagaggctctcgagatggccggatccaagaattggatgaaaggacgggagcatgagaatgcgtcaattcttaaaactctgaaacctacagacaggcctagcagccttggcgcttggtccttggatccctttaacggccgaatcatcgacgttgatgcactctggtctcaccgtggatccgaagacgggccacggccacagtcaaactggaaggagtcggctaacaagatgagtccctccggtggggctccccagaccactccgacactgaggtctcggcctaaagatcttccggtccgccgtaagaccgacgtcatcagtgatacttttcctggcaaaatccgcgacggataccgcagcagcgtgctggacattgacgccttaatggccgaatatcaggagctctcactgaaggttcctggggaggcacaagaaaggaggtcacctactgtcgaaccatccaccttgcccagggaacgacccgtccagctgggtggggtcgagcagcgcagacgatccctgaaggagatgcccgataccgggggactctggaagccagcatcgtcggctgaaatcaaccattcattcactcccggactgggaaaacagctcgccgagactctggagaccgccatgggcactaagtcctcacctcccttctgggctctaccaccttctgctccctccgagagataccccggaggctcccctattccggctgatccccgaaagaagaccggctttgctgaagatgaccgaaaagccttcgcaagtaaacaccatgtcgccaaatgccaaaattacctcgcagagtctaagccgagcggcagggaggatcccggaagcggtgtacgagtgtcacctaagagtcctcccacggatcagaaaaagggaactcccagaaagagcaccggacggggagaggaggactcagtggcccagtggggggatcatcctcgtgactgtggtcgggtgccccttgacatcaagcgagcttactcagaaaaaggcccaccagctaatatacgggaaggacttagcatcatgcacgaagctcgggagcggagacgagaacaacctaagggtagacccagtctcacaggcgaaaatctcgaagcaaagatgggcccttgttggtgggaatccggcaccggggattcacacaaagtgctcccacgagacctcgaaaaagaggatgccccacaggagaaggaacggccactgcagcaggtaagtcccgttgctagtgtgccttggcgctcccactccttttgcaaggaccgaagaagtgggccttttgtggatcaactgaagcagtgtttttctcggcagcctacagagccaaaggatacagacaccctggtgcacgaagctggcagtcagtatgggacttggacagaacagtgccagagtggtgaatccctggctacagagagccccgattcatccgctacaagcacccgtaaacagccaccgtcttctcggctaagttcactgagctcccaaacagaacccacatccgccggtgatcaatatgactgcagccgagaccagaggtcaacttccgtagatcacagtagcaccgatctcgagtctactgacgggatggaaggacctccaccccctgatgcctgccccgagaaacgggttgatgattttagctttatcgaccagacttccgtgctcgattcctcagctctgaagactagagttcaactgagcaagaggagccgtcgaagagcacctatctctcactccctgaggaggagtagattcagtgaaagtgaatcgcgctctcctttggaagatgaaactgataacacttggatgtttaaggacagcacggaggagaagtcccctcgaaaggaagagtctgacgaggaggagacagcatcaaaggccgaacggacaccagtgagtcacccccagcgaatgccagcgtttcctggcatggatcccgctgttctcaaagcgcagctgcacaagcgccctgaagttgactccccaggcgaaaccccttcttgggcccctcagccaaagagtcccaaatcacctttccagcccggagttttgggcagtcgagtgctgccgtcaagcatggacaaggatgaaaggagtgatgagccaagcccacaatggctcaaagaacttaagagcaagaagagacaatcactctatgaaaaccaggtgta

SEQ ID NO: 58807 - DNA, 4230 bp, Artificial Sequence
  Description of Artificial Sequence: Synthetic coding sequence
atggaatccgatcggctcatcatctctcttccacgcgtgaaatggacggaagctgcattgactatggcttcacagctgcaggagaagtgtattgcttttatcgtcgacaacttctcaaaaattatccaatctgagaacttcgccctgctgttgcagtcacaggctatgtcctctactgccgaccttctggatactattctcaaggcgatcgaggagaatataactactgaaaatagctgttccctgctgatggcattggatactctgttaaattctgactccaccaaagagatgggctttacttgcaagatccaagcactccgtgataaactgtggatattcttagttcaaagtttttatgcagtgcgtcatacagagtcttggaagcttatgtctacagatgaccagcaaaaaattcaggcggcagcgttcgataaaggggatgatcgcaggctgggtaaaaagcccattttcagttcatctcagcagaggaagcaggtatccgactcaggcgacattaagatcaagtcctggaggggtaataataaaaaggagtgttggtcttacctgagcacgaataaaaagatgaagagcgacgggctgggagcttcgggacatagcagttcaactaataggaactccatcaataagaccctgaagcaggatgatgtgaaagagaaagacgggaccaagattgcatccaaaattacaaaagaattgaagacaggaggcaagaacgtgagcgggaagccaaaaacagtcactaaatcaaagacagagaatggagataaagcaagattggagaacatgtcccctaggcaggttgtggaacgcagcgcaactgccgctgcggctgccactggtcagaaaaacctgctgaatggtaagggagtgagaaaccaggaggggcagatctccggtgcgagacctaaagttcttacagggaatctgaatgtgcaggctaaagccaagccacttaaaaaagccaccggtaaggactctccatgtctttctattgcaggacccagtagccgatctaccgactctagcatggagttctccatcagcacagaatgcctcgacgagccaaaggagaacggatctactgaagaggagaaaccctctgggcataagctgtcattttgcgacagtcctggccagatgatgaagaacagcgtggattctgtaaaaaactccactgtggccattaagtctcggccagtatccagagtaactaacgggacatctaataagaagagcatacacgagcaggacaccaatgttaataatagtgtgctgaaaaaagtatcagggaaaggctgttcagaaccagtacctcaagccatcctgaaaaagagaggcacttcaaacggttgcacagccgctcaacagcggacaaagagtacaccatctaatctgaccaaaacacaaggctcccagggcgagagcccaaactctgtgaagtcgtccgtatcaagccgccagtcagacgaaaacgttgccaaactggaccacaacactaccacagagaagcaggctcctaagaggaagatggtgaagcaggttcatacggcccttcctaaggtcaatgctaagatagtggctatgcccaaaaatcttaatcagtctaaaaagggggaaactctgaataacaaggactcaaagcaaaaaatgccacctggccaggtgatcagcaagacccagccgagttctcagcggccactgaagcatgaaacgtccacagtgcagaagtctatgttccatgacgtgcgggacaataacaataaggactccgtatctgagcaaaaaccccataaaccgctgataaacctcgctagtgagatctcagacgccgaggccctgcaatcctcttgcagaccagacccccagaagcccctcaacgaccaggagaaggaaaaacttgccctcgagtgtcagaacatcagcaaattagataaatctctgaagcatgaactggaaagcaagcaaatatgcttggacaaatctgaaactaaattccctaaccataaggagacagatgattgcgatgcggctaacatctgctgtcattcagtggggagcgacaacgtgaactctaaattttacagcacaactgctctgaagtatatggtcagtaatcccaacgagaacagcctgaatagcaatccagtgtgtgacctggatagcaccagcgctgggcagatccacctcattagcgatcgagagaatcaagtcggcagaaaagacacaaataaacagagctccattaagtgtgtcgaggatgtgagcctgtgtaatccggaaagaaccaatgggactcttaacagtgcccaggaagataagaagtccaaggtacctgttgaaggcctgaccattccaagtaaactctctgacgagtctgccatggacgaggataaacacgcaaccgcggattctgacgttagcagtaaatgcttcagcggacagctgagcgaaaagaattccccgaagaacatggaaactagcgagagccccgagagtcatgagacaccagagactccctttgtggggcactggaatctgagtaccggagttttgcaccagagggagagtcccgagagcgacactggctccgctaccacttctagtgatgatatcaaacctcgcagtgaagactacgacgcaggtgggagccaggacgatgacggatcaaatgatcgcggtatcagcaagtgtggaacgatgctttgccatgactttctggggcgatcaagttcggacacgtcaaccccagaggagctgaagatttatgattctaatctccgcattgaagtaaagatgaagaagcagagcaataatgacctctttcaagtgaactcaacctcagacgatgaaattccccgtaaacggccagagatttggtctaggtctgctattgtacattcccgagagcgggagaacatacctcggggaagtgttcaatttgctcaggagatagaccaggtctcatccagtgccgacgaaacagaagatgagcgctccgaggcggaaaatgtagctgaaaacttctccatcagtaacccagctcctcagcagtttcaggggattataaacctggcattcgaagacgccaccgaaaatgagtgccgcgagttcagtgccactaaaaagttcaagaggtcagttttattgtcagtagacgagtgtgaggaactcgggtccgatgaaggggaggtgcataccccctttcaagcatccgtcgattcattctctccctccgatgtgttcgacggaatttcccatgagcaccacggccgtacatgttacagccgattctctagagagagcgaagataacatcctggagtgtaagcagaataaaggcaacagcgtgtgcaagaatgagagtactgtgctcgacctgagctctatcgattcctcccgaaaaaacaaacaatctgtgtctgccacggaaaaaaagaacactattgacgttcttagctctaggagtcgccagctgctgcgcgaagataaaaaagtgaacaacgggtccaatgttgagaatgacattcagcagcgctcgaaattcctggatagcgacgttaagagccaggaacggccatgccaccttgacctgcaccagagagagccaaattccgacatccctaagaactcatccaccaaatccctggactcttttagaagccaggtgctaccacaggagggcccagtgaaagaatcccactctacaactaccgagaaggccaatatagccctcagcgcaggagacattgacgattgcgatacacttgcgcagactaggatgtacgatcacaggccgtccaagacattgtcaccaatttatgagatggacgttatagaagcatttgagcagaaagtggagtccgaaacgcacgtaacagatatggatttcgaggatgaccagcactttgcaaagcaagactggacgttgctgaaacagctgctctccgagcaagacagcaaccttgacgtcacaaacagtgtacccgaagatcttagcctggctcagtatctaattaaccaaaccctgctgctggccagagatagttcaaagcctcagggcattactcatattgacaccctgaatagatggtccgaacttacttctcccctcgactcctcagcctctatcactatggcatccttttcctccgaggactgcagcccccagggggagtggactatcctcgaactagagacacagcattag

SEQ ID NO: 58808 - DNA, 369 bp, Artificial Sequence
  Description of Artificial Sequence: Synthetic coding sequence
tcccacatcatgctgaataatggaacaaagacggatatgttgggtctgggaacctggaaaagccctcccggacaagtagctgaagcagtaaaggtggctataaatacagtttataggcacatagattgtagtcacgttcaccagaataaggatcaggagcaactcaaggaacaggtcgtgcgcagggagtggttgtttatcatctccaagccctggggcatatgccatcgaaaatgcctcgtcaggggcagttgtaggaaggtgctgtccgggttggaattagactatctcgatctgcacctgatacattggccaaccggctgtcacccagggaaagagtttagttttctcgacgagagtgggaattag

SEQ ID NO: 58809 - DNA, 3339 bp, Artificial Sequence
  Description of Artificial Sequence: Synthetic coding sequence
tagtattatctgaacgcccaggatggcgctggtggcgaggaagagaaggccgagggcggtgctggagaggaacacgatttgtttgctggactgaagcctctcgaacaggaaagtcgtatggaggtgttgttcgcctgcgctgaagccttacacgctcacggctacagctctgaggcttcgcgtctgacagttgagctggcccaggatttgctggctaaccctccagatcttaaggtggaacctcctcccgctaaaggaaagaagaacaaagtttctaccagtcgccagacctgggtcgccacaaataccttgtccaaagcagcctttctgttaactgtgctttcagagaggcccgaacatcacaacctggctttccgagtggggatgtttgcattggagcttcagaggcccccagcatccactaaggcactggaggttaaactggcatatcaggaatccgaagtggctgctctgcttaagaagatccctttgggcccaagtgagatgtcaaccatgaggtgccgcgctgaagagttgagggaaggtaccctgtgcgactaccggcctgtgctcccgttaatgctggccagctttatttttgacgtattgtgtgctccagtggtgtctcccaccggctcaagacctccttcacggaattggaatagcgagacccctggtgacgaagagctcggcttcgaggccgcagtggctgccctcggaatgaaaacaaccgtgtccgaggctgaacatccgttactttgcgagggcacccggagggaaaaaggggatctggccttggccttgatgattacatataaggatgatcaggctaagttgaagaagattctggacaagttacttgacagagaaagccaaactcataagccgcagactttgagttctttttattcaagctcgcgcccaaccacagctagccagcgcagcccttccaagcacgggggaccaagtgcaccaggggcactgcagcctctgacctcaggctccgccggtccggcacagcctggaagtgtcgctggggcagggcctggtccaacggaggggtttactgaaaagaacgtccctgaatccagcccacattcgccatgtgagggactgccatccgaagccgctctgaccccccgaccagaaggaaaggtcccctccaggttggccttgggctccaggggcggttataatgggagagggtggggcagccccggtcggccaaagaagaagcacacaggaatggccagcatagatagtagcgcccctgaaacgacttctgactcttctccaaccctcagcagacggcctctccggggtggctgggcaccgactagctggggcagaggccaagactccgacagtatatcgagctcctcaagcgactcacttggcagttctagctcctccggcagtaggcgggcttcagcatcagggggagcgagggctaagactgtagaagtgggaaggtacaaggggagacgccctgaaagccacgcccctcacgtccctaaccagccgagcgaagctgccgctcatttctactttgaattagctaaaaccgttttgatcaaagctggcggaaatagctccacatccattttcacacacccttctagcagtgggggtcatcaggggcctcaccggaacctgcacttgtgtgcatttgagatcggcctgtacgcgctgggattacacaattttgtcagcccaaactggctgtcacgtacctactcctctcatgtaagttggatcactgggcaggccatggagatcggttctgccgcactgactatactagtcgagtgttgggacgggcacttaacgccccctgaggtggcctccctggccgatcgggcttcccgtgcgagggactcaaatatggttagggcagcggctgaactggcactctcctgtctgcctcatgcccatgccctaaatcccaacgagattcaaagagctctcgtgcagtgcaaagaacaggacaacctgatgcttgagaaggcctgcatggctgtggaagaagcggcaaagggcggaggggtgtatcccgaagtgctcttcgaagtcgctcatcaatggttttggctttacgaacagacagctggtggctcaagcaccgctagagagggtgccacttcctgcagtgccagtggaatcagggctgggggtgaagcgggaagaggcatgcctgaggggaggggcggtcctggcacagaacctgtcacagttgccgcagccgcagtgaccgccgctgccacagtggtccctgtcataagcgtggggtcatctctgtacccgggacccggactgggacacggacattcacccggattacacccctacacagctctccagcctcatttgccctgcagcccccagtacctgacgcacccagctcacccagcccaccctatgccacatatgcctcggccagccgtgttcccagtcccaagttccgcataccctcagggagttcaccctgcctttttgggggcacagtatccatactcagtgactcctccctcactagccgcaacagctgtgagctttcccgtgccttcaatggccccaatcactgtccatccgtaccataccgaaccaggtctgccgctgcccacatccgtcgcctgtgagctgtggggacaaggaacggtatcctcagtgcatcctgccagcacgttccccgcaatccagggcgcttccctccctgccctcaccacacaaccctctccgctcgtgtcagggggatttcctcctccagaagaggaaacacactcgcagccagttaaccctcactccctccaccatctacacgctgcctacagagtgggtatgctggcccttgagatgttgggcaggcgggctcacaatgatcaccctaataatttcagccggagtcccccttatactgacgacgttaagtggttgttaggcctggccgctaaactcggtgtgaactacgtccaccagttctgtgtgggcgcagcaaagggtgtcctctcccccttcgtcctgcaagagatcgtaatggaaaccttgcagaggctctcacccgctcatgcacacaatcacttgcgtgctcccgctttccatcagctcgtgcagagatgtcagcaggcctatatgcagtatatccatcaccggttgatccacctgactcccgcagattatgacgactttgttaatgcgattcggtccgcacggtccgcattttgtcttactccgatgggaatgatgcaattcaatgacatccttcaaaacctcaagcgatcaaaacagaccaaggagctgtggcagagggtgagcctggaaatggccacattttctccctag

SEQ ID NO: 58810 - DNA, 660 bp, Artificial Sequence
  Description of Artificial Sequence: Synthetic coding sequence
cttgagaaagaggagaagaaccccaacacagaattttacttgaagaacctggtcttgacaactctaaatctctttgtgggcggtacagagactgtttccacaactctgcactatggatttctcctcctgatgaaacatccggaggtggaggcaaaagttcacgagattgaccgcgtgatcggcaaaaaccaacagcctaaattcgaagacagagctaaaacactgtatacggaagccgtgattcacgaaattcagcgctttggcgaccttctgcccatgggggtctcccggagggtgaaaaaggacaccaaatttcgggattttttcttgtcaaaaggcattgaagtgttccccatgttagggtctgttctgcgtgatctgaggtttttcagtaaccccagggattttaacccacagcattttttaggagagaaggggcagttcaagaagcgcgacgcttttgtcccattttccattcgtagaagaaattgcttccgcgaaggtctggcaaggatggagttgttcttgtacctgacgactataatgcagaattttcgttttaagtctaggcagagccccaaggacatagtagtctcccctaagcacgtgggatttgtgaccatcccacgcaactataccaagtgctacctgccgtgctag

SEQ ID NO: 58811 - DNA, 132 bp, Artificial Sequence
  Description of Artificial Sequence: Synthetic coding sequence
acagacttcctgcgcactcagcccacccggactagagtgaataagcagccattgcttttaacactctccctgtttaagctaagcctgcagctcgatgctcgcattactttcggcgctgagtcccctggatag

SEQ ID NO: 58812 - DNA, 375 bp, Artificial Sequence
  Description of Artificial Sequence: Synthetic coding sequence
atgaccttgaatgaacacgctgccttcaagcaccttttcaataaggctcacttggcgccacccttgatccacttgacgctgtcgggccactcaacctgctttcgggaacaccgtgttgggggaaaagtcactgaccagcaggatcctaaggctgaagaatttttcctggtgcagaataagatgaagtctcttccctgtctacccctatctacccagacacagcaaccgtcggatttttccattttttccccaccattcccccctttttatagtacaaagccccctctcagctcgtggcctgtactaaacgaactactcgggactccacctagatggggaggtggacgggctgagggcctgctcacttcccaatag

SEQ ID NO: 58813 - DNA, 621 bp, Artificial Sequence
  Description of Artificial Sequence: Synthetic coding sequence
cttggcatcagcctgggaatcgaccaggacagcgccgcattcctcctgtctacaatggccatcgccgaagtttttcgcagaatcggcgctggctttgtgctcaacagggagcctattagagtgatttacatcgagttgatttgcgtcatcctgttgactgtgtcactgtttgccttcacctttgctcgagagttctggggcctaatgtcttgctcagttttctttgggttcatggttggcacaaccggcggaacacacattcccctcctggcggaggatgacgtagtgggcatcgagaagatgtcatccgctgccggagtgtatatctttatccagtctatcgccggactggccggtccccctttggccggtctgttggtggatcagtctaagatttacagcagagcgttttactcatgtgccgctggaatggccttggcggctgtatgcctcgccctggtccgaccctgtaagatgggtctatgtcagcaccatcatagcggggaaaccaaagtagtgtctcacaggggaaaaaccttgcaggatattcctgaagattttctagaaatggacctcgctaaaaacgagcacagagtccacgtccagatggagccggtatag

SEQ ID NO: 58814 - DNA, 582 bp, Artificial Sequence
  Description of Artificial Sequence: Synthetic coding sequence
atgaacatctttatgaccttcgtgatcaatgttttgcgcaagaaccttttccatggattcatggtgatcacccaggcaccggttaggattctcccatcccaggaaaggattcgcaccccctgccactcccccgcaattctgttgtccagttgccgcgtcttgagcggtaacaattgtatcatggcagcgcttaccagtgtgattaagcggaatcttttgttcttccgtctggacctgttcccactgtggttaatcttcttatacatcgtaaagatgggggatttcccatctgcaccaactcacctgaacaccgcagccatatgtacttgcctgctgcccatacctctcggaacccacagtgatctcttatctgtgtcatgcagctggttccatctgttcgaaaagggcccacctctctcctataagcacctcgtgagacaagtgcatccgctcatgaacgccgatacagctgcaggagggtttgtctatacatgtaaagacaagctgagatctcttcttttcggcgaagtcaaagaggatggtaacgggtgctttatctgcatgtccctggaacagtgctag

SEQ ID NO: 58815 - DNA, 99 bp, Artificial Sequence
  Description of Artificial Sequence: Synthetic coding sequence
gataccgagaacagcccaggcgaactctctctcagtcggaagactgaggcgcagcgaggcgaagcgatccatccgcaatcgcattctcgggacggctag

SEQ ID NO: 58816 - DNA, 915 bp, Artificial Sequence
  Description of Artificial Sequence: Synthetic coding sequence
atggtcgccactggttgggcgaggaggagcggccttcatcctgcaccacggcctctcaggggggctcaagaggctctggctaagaatctttggcgcgaggaacgcaaccgtccccttatcttaagctcactgattataaaaaaactccactggcccgagcaggaactggccaagaagtccatcttaaatgccgaggattcgctcatcatagacaacaagcggtctattagtcacttgtcctcaggcgtgcttaaggacatcttcacgactggtacctcgtcatataatgttctgctgcagtctaaagaagagaagaagtatcattcgcagaagcagtcttctagcacttattctaaacgctgcagaaagcccagtaagagtccaaacacttctcggtcaaaagatcctcgcagaatgaaagctctggtgccagttacctctagcggcacttggtattgtctggagcgacggcctgccgtctttgtcacaagctcagttagctccccagtgaaattcacccacgatatctccgtgaccggcaacggcattgttctgccaccaaagccgaagtccaaagtgaagtggtgtcacttttctacgttacctaagccaaaaccccagctgtccaggtcctttgagaagggtgacgatttcagcggcaaaaaattctgtatcctgaccgcaatcaaacccacgaatcttgagaaggagaagcttagattctttaagagtgactacacctataaccctcaattcgagtacgccaatccagccttaccctctgtgctcgcaaagcactctcacgcgagcgacaggtttcttaagcaagtgaaatgccatttcaacagcggtagttcttttctttgtaccaaaaccattatctgcgacctcatctctaaaaacaaggacatctag

SEQ ID NO: 58817 - DNA, 402 bp, Artificial Sequence
  Description of Artificial Sequence: Synthetic coding sequence
atgggacaagatgccggtcgcctgcagaggcgctctagggtggggtttggggaaaacggggcttgcagaaaagaacgacagaagttggccctggagggatctaaaaaggggccatggaagggacgctccggagatcgcaagggcaattctaagggtcaggaggagctcgggcgaggtgccagagtgaacacagaatggccgatgcctcgcatgagggactggaaagagcgcagggggccaagcagagaagaagcccataagtccctcgggagacaaggcatgggtctccagcggggtgaaggggtgcgggctgttgcggctagggtgctttgccacccatgtcctctgtcgcgtgggctgcagcataacaggggagacagatttgtgtgggggcaggtttag

SEQ ID NO: 58818 - DNA, 255 bp, Artificial Sequence
  Description of Artificial Sequence: Synthetic coding sequence
atggtgctggcatcatttactcagaacatgaatatcaagtgttgcgaattcgtgtgccaggttgtgcagaagtatattatcaacaacttggtcaagaagaggaattgcgaaccatcatggagtgtgtacagtatcctctgtctgtacgtgattttcagctccaacaggtttatcataatcggattcacaaagagatctcgcaagaagtcagagggggagatcgcttccacggcgttacaagctacttcaggatag

SEQ ID NO: 58819 - DNA, 156 bp, Artificial Sequence
  Description of Artificial Sequence: Synthetic coding sequence
ttgaagccgggtttttttctgagcttttttatctccatgacttacctgtttagtttcttctttttcggtaagtcttttagatctcttcttggggaggggtttagtttatgtctcagcttgtctctgacacatacccacacccacacgcacagttag

SEQ ID NO: 58820 - DNA, 438 bp, Artificial Sequence
  Description of Artificial Sequence: Synthetic coding sequence
ggcgagtccgaggatgtcacccagtttcttcagagccacaaaaaaacgttgactaatgaaaaactgttcttgatggacggtaaaagaacctggtttctggagatggagtcaactcctggagaggacgccatgaatacagtaaaaatgacaacaaaagacctcaagtatgataggtctctaatcgataaggcaggattcgagcggaccgatagcaacttcgaacggagccacaccgttggcaagatgctgtcaaactctataatgtgttacagggacatcttttacgagcgagagagccagctcatgcagcaaaccagtctgctttcttacgagatcgcgatcgccactccaactttcagcaactactacccagactggtccgccccaatcaatattgtggctagaccatccacaagcaagaagattatgacatgttag

SEQ ID NO: 58821 - DNA, 3144 bp, Artificial Sequence
  Description of Artificial Sequence: Synthetic coding sequence
atggcccattgcggacagctcacgaactggctatgtctagcctgggaaagaaaggaatcacccgatttcctgtctatattcctcagatacattgaccttacccctaagttgcacaagatctgctccgataaaacaattacccagaaaacacattgcttgctgccccttatctcaagcgcccttagctcaattgttctgatccagggatggtggcagaagacagcacataagtatgcctacaaaggcgctaagcatatcgagcaacagaatccacagtccagacaccgacctcgaccagcaggggcactcccgcagataagccgagacagccggcaaagatgtcttcttctcaggttcctggtaaggccgagggggttttcattctcgttcgcggagccagcagccgcttttcctggggctacggcaatggctgccagcctgtctgagagactgttctctttggagcttctagttgattgggtgaggctggaggccaggctcctgccctcccccgctgcagcagtggaacaggaagaagaagaagaagagaaagagcagggggaagcaagtagtcctagaggtctttgtccagccgtcgccttcagattactcgactttcccacactcctcgtttatccaccggacggacctggggctccagcagcggaaccctggcccggagtcatccggttcggtcggggaaagagctgcctgttcagactccaacctgccacactccattgccgactcctcagaacgccgctcgcaacgctgctgctgcagctgcctccaggaaggccaacgccgaccccacagttattgggtgcctgtgacatctctctcgctactgccgctcacagagtggtgggccctgcagcaagcggttgtagccatcgtcaccggggacggtttcctttacacaaccgtgtgggagaacgcactggcgacattgctctggcatacagactgactgatttaggtagccgtctgctgagtcagctcgaaagacccctgaccttcacaagaacaggcggaggagcagaagtgagcccacagacacaacaggaaaggcagcagctccagcagcccgcaagccagccctcaccgaaggaagctgataagccacttggtgagctggaaataccagaggcgcagaaggacctgaaagaaatggtgaagtccaaagctgagtgcgacaacgtgggcagtgtggagaatgggaaaacgaattctgtggtaacgtgtagcggcgctggaaacgggaggaatgtgagctctctgaacgaggaagtaaccgagcttgatatggagactaatattttttgcccccctcccctctattacaccaacctgacccaggagaaacctcctccagcccaggctaagatcacaattgaaccccagatgaacgccccagaggagatggatgatgcctccccagagaagaagagagttaaccctccggcacatcgcagttgtctgaaacatccctcctccgccgcacatgagcaccccccaatgttagtgaatcctcctcacatccagaacatcggcgcaacaaatcagacgtgccagactgagcagaacaggataaataccatccgtcagttgccactcttgaatgccctgctggtcgagctttctctgctttacgaccagcccgtgacatcccctgcccacattcatccacacttagcatggctgtaccgaacagaagataaaaagtctccagaatcctctgccaagtccacgtgtcgctctgaggccaaaaaggacaagcgctccgtgggaggctgcgaaaagtcagtgtccctccagtataagaagaaccagattgaaaactacaaagaggataagtacagcgagaagagcagcggggcattgcataagagggtcccaaaggggagattgttatatggcctgacaaataccctccgcctgcggctcaaactgacaaatccggatatgttggtcgtgcacgaaaaaagggaactgtaccggaagaggcagtctcagatgctgggcacgaagttccgaattccatctagcaaggttaaattgctgtcctccgctgaacagagtcagaagccacagctgcccgaagataagtatcttgactccgacgcttcttttacagagaacagcgacacctcaaggcaaatctccggtgttttcgacgagccctcaacctccaaggagacaaagcttaaatacgctactgagaaaaagactgtggattgctccaaaaatcgcataaacaacgtatcactcgaggaggtcgtgagccctgctaattctattatccccgagaggttgacccccacaaacattcttggcggtaacgtagaaatgaaaatccagagtccctgcgtcttccaacaggacgcggtcgtggaccgaatcgttgataaagagatcgatattagacaggttaaaaccacggacaacgatatcctaatggccgacatctctgataaacgtactgggaagaactcatgctacgagaatatctccgagttaaaatactcggatgaccttagttccccctgttactctgaagatttttgtacttctgaagacacctccaggtcttttaaggcacatgattccagcagcagaactgagaatcctaagcattcgcagtatacaagtaaatccagcgatactggggtgtcaaaaaagaagaatagcagcgataggagcagcattctgagtccccctttctcagccggatccccagttcactcctatcgaaaattccacattagcaagacacaggataaatcactcgaggaggcttcctcaattagcgcaagcgacctctcgtctacccattggaccgaacagaaggagaatcagattgaccagaacagtatgcacaacagcgagattactaaaagggcacaggacatttcagtgaagacccgttcctcatggaaaagcctggaaaaatcacagagtcctcagacttcgcaagtatcatcatacctgccaagtaatgtatcagaacttaatgtgctcgattcatcaacctctgaccactttgaggaaggaaatgacgacgttgggtctctgaatattagtaagcagtgcaaagacatatgcgaactggtgatcaacaagttacccggatatacaatgtag

SEQ ID NO: 58822 - DNA, 561 bp, Artificial Sequence
  Description of Artificial Sequence: Synthetic coding sequence
agatctctcttaaaggaactcgaaaacacaaaggatcacactcttctgctggaaaagaggcttaagaagcttagtagagaaggcagttcacaccatctgcctaggcaagttaggcccggaccagtctacaaaccggctcccgctcgtaatcaccggccacgaggtggccgaggaaaggccagtcctacgagcttccacgtgtcacctcgagccccattagctccccttgcgtcaatgccatcatctgtgccgaaaactagcattgagagtttgggctcacccagctcactgagctctagccaggcttcggagcccctgtgccctttgaagcaccccagtcatagaccacctgctagcacgctgtccccaaacctgacatccagcaccgagagcctgggcctgctgtcacgggaaactccacatgcaggaagacgtcggcaggggtcgcggttcccacaaccgggatgcgccaacgctgctggtcgtacacggcatcaaaaccctcgccattctcatggtcaccggatttctgatatccacgaacagcttgggatttcttag

SEQ ID NO: 58823 - DNA, 405 bp, Artificial Sequence
  Description of Artificial Sequence: Synthetic coding sequence
atgagagaacctatatatatccatagcacgatggtgtttcttccctgggagcttcacacgaaaaagggaaagatggcgctgcttgccagcaacggatgctttatcagatgtaatgaagctggcgatattgaggcgaaatccaagacggctggggaagaagagatgataaaaatccgatcctgtgctgagcgtgaaactaaaaaaaaggacgatatcccagaggaagataaaggaaacgttaagcaatgtgaaattaattacgtcaaaaaatttcagtcgttccaggaacacaagcttaaaatttctaaggaggattctaagattctcaagaaagcgcaaaaggacggtttccttcaagagacattgctggaccgggttgctgtgatagcatgcctccacctctag

SEQ ID NO: 58824 - DNA, 447 bp, Artificial Sequence
  Description of Artificial Sequence: Synthetic coding sequence
atggaacacatgttgttagcgaaccatacagataaggccactttcactgggactcagcgtcagcgaagctgctccggcgcttcagtgtcccagccaaggcctcttaggggcaaactggtgggatactgggatcctcacagtcggctgctgagccggggacgagcgctaggcagcgtgtctgcgccttccaccccaagggggagaggatggaaagccacctttgacggttgcattctccacgatgatttgctgacaaaggttcatggcttccagtcactgattggccttcagcagcatttagcatgcggggattccggatcgctcatgaaaaactgccacgatgtgcggaaaagcttgtcagaaaggggctggggagccgcatgttgggggggaggcggtgtggcctctagagaaaaacttcatcccttggccgaaagtggcacctag

SEQ ID NO: 58825 - DNA, 1296 bp, Artificial Sequence
  Description of Artificial Sequence: Synthetic coding sequence
atgtggccgcagcctcatctgccaacacatccgcatctgcctacccacccccatctccccactcatcctcacctgccaacccatcccatgatgagtaaagagaccagacagtcaaagttagctgaggccaaagagcagctcaccgatcaccatcctcaaacaaacccctcggtgggaactgcagcttcagacaccaaaaaaaaaaaaattaataacgggacaaaccccgaaacgaccacctcgggcggatgccacagcccagaggatgaacagaaagcgagtcaccagcaccaggaagccctgcgaagggagctcgaggcacaggtgcacacaattcggatcttgacctgccaaaagactgaacttcagatggctctgtactactcccagcacgccgtcaagcagctggaaggtgaggctagggatctgatctctcgcctgcacgactcctggaagttcgcaggagagctggagcaagcactcagcgctgtcgctacccagaagaaaaaggccgatcggtacatcgaggagctgacaaaggaaagagacgctctgtcactggagctctatcggaatacaatcacagacgaagagttgaaagagaagaatgcaaaactgcaggagaaactgcaactggtggagagcgaaaagtccgagattcagttgaatgtgaaggaactgaaacggaaactggagcgagccaagctcctgctgccccagcagcagctgcaggccgaggccgaccatctgggcaaggagctgcaaagcgtttctgcaaaactacaggcccaggttgaggaaaatgaattgtggaataggctcaatcaacagcaagaagagaaaatgtggcggcaggaagagaaaattcaggaacgagaggaaaagatccaggaacaggaggaaaaaattcgggagcaagaggaaaagatccgagagcaggaagaaatgatgcaggagcaggaagaaaagatgggagagcaggaagaaaagatgcaggagcaggagaaaatgagacggcaagaggagaaaattcgggagcaagaggaaaagattcgcgaacagaaggagaagattcgcgaacaggaggagaagatttgggaacaagaggaaaagatccgggaacaagaggagatgatgcaagaacaggaggaaaagatgtgggagcaagaagagaaaatgtgtgaacaggaagagaaaatgcaagaacaggaagagaagatgcggagacaagaggaaaagatgcgagagcaggaggttcgactgcgccagcaggaggaaaagatgcaagagcattag

SEQ ID NO: 58826 - DNA, 1701 bp, Artificial Sequence
  Description of Artificial Sequence: Synthetic coding sequence
atgaaaatgcaaaagggtaacgtgttgctcatgttcggcctgttgctgcatctagaagccgctacaaattccaacgagacctcgaccagcgccaacacaggcagttccgtaatcagctcaggcgcatcaactgcaaccaactcaggctcttccgtcacctcttccggagtctctactgctacaatcagcggatctagcgttacctccaacggagtttcaatagtcaccaatagcgagttccacacgacctccagtggcataagtaccgctaccaatagcgaattcagtactgtatcctctggaatttctatcgccacaaactctgaaagctccactacatcgagcggagcttctaccgccaccaactccgagtcttcaaccccaagcagtggagcctcaaccgctaccaactccgatagtagcactactagcagtggtgcctctacggccacaaattccgactcgagcacaacatcgagtgaagcttcaacagcaaccaatagtgaaagcagcacaacctctagcggggcttctacagtcaccaatagtgagtcttcgaccgtgtctagccgggcatcaaccgcgactaattccgagagctccacaacttcatctggcgcttctacagcaaccaactctgagagtaggactacaagtaacggcgctggaaccgccaccaactcggaaagctccaccacatcctccggcgcaagcactgccaccaatagtgaaagctccaccccctctagcggcgcaggaacggccacaaacagcgagagctcaactacctcatcgggggctggtactgcaaccaactcagaaagctctaccgttagctccggcataagcaccgttaccaacagtgagtcctcgaccccaagctccggggctaatacagccacaaattccgaatccagtactacctcttctggggctaacactgcgaccaattcggattcttctacaacaagcagcggggcttccaccgctacgaatagtgagagtagcactactagctctggcgcttccacagctactaactccgaaagtagcacgacttcatctggcgcaagtaccgcaaccaattctgggtcctctaccaccagctcggggaccagcaccgcaacgaacagtgaatcatcaacagtctcttccggagctagcaccgccaccacgtcagagtcctccactacgtcatctggggcatccaccgccacaaacagcgagtccagcaccgtgtctagtggtgcaagtaccgccacaaacagcgaatcttcaacgacatcctctggtgccaataccgccaccaatagcgggagctcggtgacttctgccggttcaggtaccgccgcactcacaggaatgcatactactagtcattcagcttccactgcggtgtctgaggcaaagcccggaggctcactcgtgccatgggaaatttttcttatcaccctggtgtcagttgtagccgctgtggggctgttcgccggactttttttttgtgttcggaattcactcagtctgcggaacaccttcaacacagccgtataccacccccacggtcttaatcatggattgggcccaggtcccggtgggaatcacggagccccacatcgacccaggtggtcaccaaattggttttggcggagacctgtgtcttccatcgccatggagatgtctgggaggaactctgggccttag

SEQ ID NO: 58827 - DNA, 183 bp, Artificial Sequence
  Description of Artificial Sequence: Synthetic coding sequence
aaggggtgggtgtctcacctatttctggctcccactaattttgaggagttcactgctcctgccactccaccacactgtagccagtgcctgaggtccaactgctctacttgggccacagccgcaatcatagaacggtctctccaggtgcctttcctctatctcagtaccccaggtggacactag

SEQ ID NO: 58828 - DNA, 399 bp, Artificial Sequence
  Description of Artificial Sequence: Synthetic coding sequence
atgtcgcagccttggctgtactctcaatgtataatctcgggtaaacccagtgaagaggccgctggagaaaacgggtccatcagtgccgctttgcggcctttgctgctcgtggcagacgtgccggtactcggttatctgtgtcctagctccgtcagttcaggtgtttgcgaagctaagctgctcggatggggtcttggaggcgtctccgctgccccagaggctaagactaaagcagaggccgaagctgaggctgaggcgaccttggtcagaagaaagctccaggttgaaaagctggtggacagagatctggatctgaccgtaatactcatggtaccaatgccttcagcacggaggcctccagcgctcgcaacaactggatcttgctccccccctggatag

SEQ ID NO: 58829 - DNA, 1395 bp, Artificial Sequence
  Description of Artificial Sequence: Synthetic coding sequence
atgcggcgtcattctgagacagatgtcgaggaacaaacccaggagctcaaaaccattacacaactgcaggagcagtgtagggccctccagatccagggcgtcaaggaaaatatggatcagaataaggcgactctcgccctcctgcgaagtaatatcagacgcggtgcacaggactgggcactcgccaagaaatacgatcagtggaccatctccaaagcatgcggtaaaaatctgccgctaagactggcgcattgcaggagcaccatggaagttgtccgcgagaagctccgaaaatacgttttcgaccgagttaatatgcacaacctgttgatacacctggtgcgcaggagaggccagaagttggaatcaatgcaactggagctggattctttaagatcgcagcccgatgcctcgaaggaagagctgcgtctgttgcagattatacgccagctcgaaaacaacatcgagaagactatgattaagatcataaccagccagaacatccacctactgtacctagacctgttagattatctcaagaccgtcttggccggataccccattgagctggataaactccaaaacctcgtcgtaaactactgctccgagcttagcgacatgaagattatgtctcaagacgctatgatgattacggatgaagttaagcggaacatgaggcaacgggaggcatcattcattgaggagcgtcgggctagggaaaaccggctgaaccaacagaagaaactgatcgacaaaattcatactaaagagacctccgagaaatatcggagaggccaaatggaccttgacttcccctcgaacctgatgagtaccgaaacactgaagttacggagaaaggagacctctacggccgaaatggagtaccaatccggagtgacggccgtggtggagaaagttaagtccgcagtacgctgctctcacgtgtgggatatcacgagccgcttcctggcccaaagaaatactgaagaaaacttggagctccagatggaagactgcgaggaatggagggtgcaacttaaggccctggtcaagcagctggaacttgaggaggccgttctcaagtttcggcagaagccgtcctctatctccttcaagtcagtcgagaaaaaaatgaccgatatgttaaaggaagaggaggagcgtctgcagctggcccatagcaacatgactaagggccaggagctcttactaaccatccagatggggattgacaatctgtatgtgaggttgatgggcatcaatctgccggctactcaggtcccaggggtccgcctatcgtgtcatacccctggaccatgggctggtccagaggggaggcaggcgcagagactgattgaaggcaagctgaaggctgccaagaaaaaaaaaaagtag

SEQ ID NO: 58830 - DNA, 381 bp, Artificial Sequence
  Description of Artificial Sequence: Synthetic coding sequence
tcgggctctccagcgggtcttcttaaaggtgattctaaaaagcccagccagcgtcgcgttaagcggcagccatattctacaactaaggtcacctctggctctaccttcaacgagaacactcggagatacgccgtgcacacgaaccaatgccgtcgccctcatggttcccgagtaaagaagaagagataccctcaggaggacgacttccaccacactgtgttttccaatttggagaggctggataagctgcagccaactctcgaggcctccgaggagagcctggtgcataaggatagaggcgatggtgaacggcctgtaaacgctcgagtggttcaggtcgcccctctccgactggaatctcgcattagcattggcgagtag

SEQ ID NO: 58831 - DNA, 1314 bp, Artificial Sequence
  Description of Artificial Sequence: Synthetic coding sequence
atgtggcctcaaccacacttgcctacgcacccccacctacctacacacccgcacctgccaacacacccccatcttccaactcaccctcaccttcccactcatcccatgatgagcaaggagacacgccagagtaagcttgccgaagccaaggagcagctcacagatcaccacccccaaaccaatccttctgtggggaccgccgctagcgacactaagaagaaaaagatcaacaatggaactaaccccgaaaccacaaccagtggcggttgtcactctcccgaggacgaacagaaagctagtcatcagcaccaagaggccctacgcagggagctcgaagcccaagtgcagaccatcaggattctgacgtgtcagaaaaccgaactacaaatggcgttgtactattcacagcatgccgtgaaacaactggaaggtgaggcgagggacctgatctcccgattgcacgattcttggaagtttgcgggagagctggagcaggccctctccgctgtggcaacccagaaaaagaaagctgatcgctacattgaggagctcaccaaggagagggacgcactgagcctcgagctgtacaggaacacaatcaccgacgaggaactgaaagaaaaaaacgccaaactgcaagaaaagctgcaacttgtcgaaagtgagaagtcagagatccagttaaacgtgaaagagttgaaaagaaagctggagcgggctaaattactgctgccacagcagcagctccaggcagaagcagaccatctaggaaaggagctgcagagcgtgagcgctaagctgcaggcacaagttgaggaaaacgagctgtggaacaggttaaaccagcagcaggaggaaaaaatgtggaggcaggaagaaaagattcaggaaagagaagagaagattcaggagcaagaggagaagattcgcgagcaggaggaaaaaattcgagagcaggaggagatgatgcaggagcaggaagagaaaatgggagaacaagaggaaaagatgcaggaacaggagaaaatgaggaggcaagaagagaagattagagaacaagaagaaaaaatccgtgaacagaaggaaaagattcgggaacaggaagagaagatttgggagcaggaggagaagatccgcgagcaagaggagatgatgcaagagcaagaggaaaaaatgtgggaacaggaggagaagatgtgtgagcaggaagagaagatgcaggaacaggaagaaaaaatgcggagacaggaggagaagatgagggagcaggaggttcggctgagacagcaggaggagaagatgcaggaacactag

SEQ ID NO: 58832 - DNA, 597 bp, Artificial Sequence
  Description of Artificial Sequence: Synthetic coding sequence
taaacgagtcgccaaacatgggttgccacgaacaccttatctaaagcagccttcctcctgacagtgctctcggagagacctgagcaccacaacttagcatttagggtggggatgtttgccttggaactgcagcgtcctccggcttccaccaaggctctcgaggtgaagctggcctatcaggaatccgaggtcgccgctctgctgaaaaagattccactgggccctagcgaaatgtccacaatgcggtgcagggcggaggagttgagagagggaacactctgcgattaccggcctgtccttcctctgatgttggcctcttttattttcgatgtgctttgtgccccaggttcaaggcccccaagccggaactggaacagtgagacacccggagacgaagagctcgggttcgaagcggcagtagcagcattggggatgaagactaccgtaagtgaagctgagcatccactcctatgtgaagggactcgcagggagaaaggcgacctggccctggccctaatgatcacttataaggatgatcaggccaaactcaaaaaacctggacagcagtctgagacattatctctaaagaaaaagtag

SEQ ID NO: 58833 - DNA, 4188 bp, Artificial Sequence
  Description of Artificial Sequence: Synthetic coding sequence
atgtatcccatctgcacagttgtggtggacggcctgccttctgagtctagctcgtcctcctacccaggcccagtgtccgtttctgagatgtcactgctgcacgcgctgggacccgtgcaaacttggctcggacaggagctggagaagtgtggcattgacgcaatgatctatactcgatacgtgctgtctttgctgctgcatgacagctacgattacgacctgcaggagcaagaaaatgatattttcctgggctgggaaaagggggcttacaaaaaatggggcaaatccaaaaagaaatgctccgacctaaccttggaagaaatgaagaagcaggcagctgttcagtgcctgaggtcagccagcgatgagagcagcggcatcgagaccctggtggaagagctttgtagccggctcaaggacctccaatcgaaacaggaggagaaaatccacaagaaactcgaaggaagccccagccctgaagccgagctgtcgccacctgccaaagatcaggtcgagatgtactacgaagcgtttccacccctctctgagaagccagtatgcctccaagagatcatgacggtgtggaataagagcaaagtgtgctcatattccagctcgtcttcaagtagcacagcaccaccggcaagcacagacacctccagtcccaaagattgtaatagtgagtctgaagtcacaaaggagcgctcctcggaggttccaaccaccgttcacgagaaaacacagtctaagtccaaaaacgagaaagaaaataagttttccaatggtaccatcgaagagaagcctgccttgtataagaagcagatacggcacaaaccagaaggcaaaatccgcccaaggtcttggagcagcggctccagcgaagccggatcctcaagctcaggcaaccagggagagttgaaggccagcatgaagtatgtgaaagttagacacaaggcccgagagataagaaataagaagggtagaaacgggcagagccgcctgagcttgaagcacggtgagaaagccgagcgcaacatccataccggcagcagttcatcctctagcagtgggtccgtaaagcagttgtgcaagaggggtaagagaccgttaaaagagattgggagaaaagaccccggatccacagagggaaaggatctgtatatggagaaccgcaaggatacggaatacaaagaggagcctctgtggtacacagaacccatcgcggagtactttgtgcctctgtcgaggaagagcaaactggagaccacatatcgcaatcgccaggatacctctgatctgacctcagaggcagtggaggaactttctgagtcagtccacggactgtgcatatcgaacaacaatttacacaagacatacttggctgccggaaccttcattgatggccacttcgtcgaaatgccagctgttatcaatgaagacatcgatctaacaggtacgtccttatgtagcttgcctgaggataacaagtacctcgacgacattcacctgagtgagctgacacatttctacgaagtggatatcgatcagtccatgctggatcccggagcgagtgagactatgcaaggcgaaagtagaatcctcaacatgatccgacaaaaatcgaaggaaaatactgatttcgaggctgagtgttgcatcgtgctagacggcatggagttacagggagaaagagcgatatggacggactctacctctagtgtgggagccgagggcctgtttttgcaggacctgggcaacttggcacagttttgggagtgctgttctagtagctccggggatgccgatggggagagctttggaggagattctccagtaagactttcacctattctggacagtacagtattaaatagccaccttctggcgggaaatcaggaattgttttccgacataaatgaggggagcggtatcaactcatgcttctccgtattcgaggtgcagtgctctaacagtgttctacctttcagtttcgaaacattgaacctcgggaacgaaaacaccgactcatcagcaaatatgttgggaaaaacacaaagcaggcttctgatttggaccaaaaattcagcttttgaggagaatgagcactgctccaacttgtcgactcgtacatgttcaccttggtcccattctgaagagactcgttccgacaacgaaactctaaatattcagtttgaggaatctacccagtttaacgctgaggacattaattacgtcgttcccagggtttcatctaattatgttgacgaagagctgctggactttcttcaggatgagacatgccaacaaaatagccggacactgggggagattccaacattagtattcaaaaagacctccaaactggaaagcgtgtgtgggattcaacttgagcagaagactgagaacaaaaattttgagaccacccaagtgtgcaacgaatcaccccacggcgacggctactcttcaggggtgattaaggacatttggaccaaaatggctgataccaattcggtggcgacggtcgaaattgaaaggactgatgctgaactgtttagcgccgacgtgaataattactgttgctgtctggacgctgaggctgagctggaaacattgcaagaacccgacaaggcagtgagaagaagtgagtatcatttatgggaagggcagaaagagagtcttgagaagcgagctttcgccagcagcgagctgagcaatgtagatggaggcgactacactaccccctccaaaccctgggacgtagcgcaggacaaagagaacacttttatactggggggtgtctacggggaactaaagacattcaattctgatggggaatgggccgtggtccctccttcacacacaaaagggtccctgctacaatgtgctgcctccgacgtggtcaccattgccggaaccgatgtatttatgactccaggtaatagctttgcaccagggcataggcagctgtggaagcccttcgtgagcttcgaacagaatgaccagccaaaaagcggagagaacggtctgaataaaggtttctcctttatcttccacgaagatctgctgggagcctgcggcaatttccaggtagaagaccccggactggaatactctttcagcagcttcgacctctccaacccattctcacaggtactccacgtagaatgttccttcgaacctgaagggattgcctcattcagcccgtcctttaaacccaagtcaatactgtgttcggattcagactccgaggtgttccatcccaggatttgtggggtggaccgcacgcagtatcgagcaatccggatttccccgcgtacccacttccggcctattagcgcatccgagctgtccccaggaggaggaagcgaatcggagttcgaatcagagaaagacgaggctaatatacctatcccatcccaagtagatatctttgaggaccctcaggcagacttgaagccactggaagaggatgcggagaaggagggccactactacggcaaatccgagttagagagtgggaagttcctgcctcgcctgaaaaaaagcggcatggaaaagtccgcgcagacgagtctggattcccaggaagagtcaaccggcatactgtccgttggaaagcagaaccagtgtctcgaatgctctatgaacgaaagtctggagattgacttagagtcaagcgaagctaactgcaagattatggcacagtgtgaggaggagattaataatttctgcggctgtaaggcaggctgtcaatttcccgcatacgaagacaacccagtgagcagcgggcagctggaggaatttccagtcctgaatacagacatccagggaatgaacaggtctcaagaaaaacaaacatggtgggagaaggccctgtacagcccattgtttcccgctagcgagtgtgaagagtgttacaccaatgctaagggtgagtccggcctcgaagagtatccagacgctaaggaaaccccttctaacgaggaacggctgctggatttcaacagggtctcaagtgtctacgaagctagatgcaccggtgagcgcgacagcggggctaaatctgacggattccgtggtaagatgtgtagctctgctagttccacctctgaggagaccggtagcgaagggggaggagagtgggtcggaccatccgaggaggaactctttagtcgtacacacctctag

SEQ ID NO: 58834 - DNA, 366 bp, Artificial Sequence
  Description of Artificial Sequence: Synthetic coding sequence
atggagttcgtgctttcatgggtattccttgtggctatcttaaagggcgtgcaatgcgaagtccagctggtacagtcggggggaggcttggtccaccctggcggatctctccggctgtcttgcgccggatctggcttcaccttcagcagttacgcaatgcactgggtgaggcaggctccgggtaagggacttgaatgggtttctgcaatcggcacagggggtggcacctattatgctgactctgttaagggacgcttcaccatcagccgggataatgccaaaaactccttgtatctgcaaatgaactccttgagagctgaggacatggcagtgtattactgtgccagggacacagttaggggatag

SEQ ID NO: 58835 - DNA, 777 bp, Artificial Sequence
  Description of Artificial Sequence: Synthetic coding sequence
cgctccctgcttaaggaattggaaaatacgaaggaccacacgttgctactggaaaagcgtctcaaaaagctgagcagggaaggaagcagccaccatctgcctaggcaggtccgccctggtccagtgtataaacctgcgccagcgagaaaccaccgcccacgcggaggaaggggaaaagcatcccctacatccttccacgtctctcccagggcgcctctcgcccctctcgcaagtatgccaagttcggtccctaagaccagcattgaaagcttaggatccccgtcctcattgtcatcctcacaggcctcagaacctttgtgcccactcaaacatcccagtcatcgccctcctgcgtcaaccctgtctcccaacctgacgtcatccactgagagcctgggatacctgagttcactgtcaagtagtcagcctccagaacccctgagacccctggagtgtcccagtcacaagccctgtggcagaagcctgccgaggcgacgcaacccgggttgggtttcctggagcgactcaatgcaggccgattctgagacggacgctatcatctgccctatgtgtaaggctcctgaacggtcttgccctcacacttggtgggtaccttcatcgccacgagtgattcgcggagtaggaaggtgctcagacccaaatttagggttatcctggcgacaggaagccgctcgggcatggtgccattgtacatcgtcacagtacccatttaagcaccctaacctgccgacccatctgcccaaggctagcttctag

SEQ ID NO: 58836 - DNA, 2253 bp, Artificial Sequence
  Description of Artificial Sequence: Synthetic coding sequence
gattacgctcacacacttacctgtgttacagaacgcgagaagttcattgtgcccataaaggcccgaggagctcgagcaatcctggatttccccgataagctcaatttctctacatgcccggtgaagtacagcactcagaaaatccttctggttagaaatatcggaaataaaaacgctgtattccatattaaaacctgtcgtcccttttccatagagccagcaatcggaaccctcaatgtgggagagtctatgcaattagaggtagagttcgaacctcaatctgtgggtgatcactccgggagactgattgtttgttatgacactggggagaaggtgtttgtgagtctgtacggcgcagccatcgatatgaatatcaggctggataagaactctttgacaatagaaaagacatatataagtctggcgaatcagcgcactatcacaatccataacagaagtaacataatcgcacattttttatggaaagtgttcgccacacagcaggaggaagaccgggagaaataccgggcatgtgacgatttaatcaaggaagagaaagacgaaacagacgaattttttgaagagtgtatcaccgacccactgcttagggaacatctaagcgttctgtcgcgtactttcgctaatcagcgcaggttagtgcagggagactccaaactctttttcaacaatgtctttactgtcgagccactggaaggagatgtctggcctaatagcagcgccgaaatcaccgtgtattttaaccccctggaagccaagttgtaccagcagactatctactgcgacatcttagggcgtgaaatcaggcttcctttgcgaatcaagggcgagggaatgggacctaaaattcattttaactttgaattgctggacataggaaaagtgtttacagggagtgcccactgttacgaagcgattctgtataacaaagattctattgacgcattatttaatatgacaccacctacaagtgctctgggcgcatgctttgtgttctcccccaaggagggaatcattgagcccagcggcgttcaggccattcagatatcattttcgtccacgatcctgggcaacttcgaggaggaattccttgtgaatgtcaatggtagccccgagcccgtgaagctgacgataagggggtgcgtcatcgggccaacttttcatttcaacgtcccagccctacactttggcgacgtgtccttcggcttccctcacacattgatttgttctctaaacaacacatctcttattccaatgacctataaattgcgcatccctggtgatggccttggacataaaagcatctcttactgtgaacagcatgtcgactataaacgcccttcctggacaaaagaggagatcagctctatgaagcctaaggagttcaccatatctccggattgcgggaccatccggccacaaggattcgccgcaatacgagtgaccctgtgttctaatacagtgcagaaatacgagctggctttggtggtcgacgtcgaaggcatcggcgaagaagtactggctttactgatcgcggcaaggtgcgtggtccccgctctgcacctggtgaacactgaggtagattttgggcactgttttttgaagtacccttacgagaaaacattgcagctggcagatcaggacgacctgcctggtttttatgaagttcagcctcaggtttgtgaagaggtccccacggtcttattctcttcaccaaccccatcaggcgtcatttcccccagctcaactattcacatcccccttgtgcttgagacccaggttacgggggaacaccggagcacagtgtatatcagcattttcggctcacaggacccccctctcgtgtgtcatctcaaaagtgccggtgaagggccagtcatctacgtgcatcctaaccaggtcgatttcggaaacatctacgtgcttaaagactctagcaggatcctgaatttatgcaaccagtctttcattccagcattcttccaggctcacatggctcacaagaaaagcttgtggacgatagaacctaatgaaggtatggtgccgccagagactgacgtccaactggcccttaccgcaaacctgaacgacacattaacatttaaagattgcgtgatcttggacattgaaaattccagcacctacagaatacctgtccaagcctctgggacaggttctactatagtgagcgataaacccttcgccccagagctgaatctgggagcacatttctag

SEQ ID NO: 58837 - DNA, 294 bp, Artificial Sequence
  Description of Artificial Sequence: Synthetic coding sequence
gaggtgcagctggttcagtccgggggaggacttgttcagccaggaggctccctgcggctctcgtgtgctggctcagggttcacatttagttcatacgcaatgcactgggtgagacaggccccagggaagggcttggaatgggtgtccgccattgggacaggaggcggaacatattatgccgactccgtcaaaggaagatttactatttccagagataatgctaagaattcactttatttgcaaatgaatagtctgagagcagaagacatggccgtgtactactgcgcgagatag

SEQ ID NO: 58838 - DNA, 714 bp, Artificial Sequence
  Description of Artificial Sequence: Synthetic coding sequence
tgaacataccaccgaattcctatgcccgacttctgcgcgcctagagaggaggacttcgatcagctgttggaagccctccgggctgctttgtctaaggatcccggaacagggtttgtgttcagttgcttgtctggacagggcagaaccaccactgcaatggtcgtggccgtgcttgcattctggcacattcagggctttcctgaagtcggagaagaagaattagtgagtgtccctgacgcaaagttcacaaagggggaatttcaggtcgtgatgaaggtggtacagttattgcctgatgggcacagagttaagaaggaggtcgacgcggctctcgatacagtctccgaaactatgacgcccatgcactaccacttgcgcgagatcatcatatgcacttatcgacaagctaaggctgccaaggaagctcaggagatgagacgtctccagctccgaagtcttcagtacttggaaaggtacgtgtgtttaatactgttcaatgcatacctgcacctcgagaaagccgatagttggcagagacccttcagtacatggatgcaggaagtggcgagcaaggccggtatctacgagatcctgaatgagctcggatttcctgaattggaatccggcgaggatcagcccttcagccggctgcggtaccgctggcaagagcaaagttgttctttggaaccgtcagcgcctgaagatctcctctag

SEQ ID NO: 58839 - DNA, 648 bp, Artificial Sequence
  Description of Artificial Sequence: Synthetic coding sequence
tatggagtttgtagcgtcgggctggaatggctggcttacctcctggtcccatattcgctaggggctagcgccacctctttgttaggcctgctgggactgtggctgccaagaccagtaccgcttgtggccggagctggagtgcacctgttgcttacttttatactgttcttttgggcgcctgtgcccagggtgcttcagcacagctggatcctgtatgttgccgctgccctgtgggtggtgggttccagccttaataaaaccggtctttccaccctcttaggtatcctgtacgaggacaaagagcggcaagactttatcttcactatttatcattggtggcaagcggtggccatcttcacggtgtatttgggatcttctctccatatgaaagcgaaacttgcgctgctcctcgtcaccctggtggccgctactgtctcttaccttcgtatggagcaaaagttaagaaggggagttgctcctcgccagcctcgcattccaagaccgcagcataaggtgcggggttaccgttacttggaggaggataacagtgatgagtcagatgccgagggcgatctgggcgacggtgaggaggctgaagctgaagctcctccagccggtcctcgtcccggacccgagcctgctggatag

SEQ ID NO: 58840 - DNA, 3828 bp, Artificial Sequence
  Description of Artificial Sequence: Synthetic coding sequence
atggactgggacgatgagtactctcacaattcctttgatttgcactgcctgctgaactcttttccaggggacctcgagtttgaacaaattttttctgacattgatgagaaaatcgagcagaatgccgcatctattaagcactgtattaaggaaatccaatccgagatcaataaacagtgccctggtgtgcagctgcagacgactacagactgctttgaatggttgacaaactacaattacagtacaagtgagagtagctttatatcacacggagatctaataaagttctttaaaacgctgcaggatcttctaaaaaacgaacagaaccaggaggagatgacgcttgacctgctgtgggatctcagctgccactcttcagtcagctttccttccactctgagcggtacgagctttcactttcttagccgaaccagcttacactcggtcgaggataattccagcatggacgtgaagagtatgtgggatgacatcagacttcacctccgaaggttcctggtttcgaagctccagagccacaatgagataaacaacagccaacagaaaatcctgctgaaaaaacagtgcctgcagcaattgctgttcctgtatccagagagcgaggtcatcataaagtaccagaacatccagaataaactgctggctaacctgctttggaattgtttcccttcatataatcgtgacagcaatcttgatgtcattgctcacggttaccaaagcacaatgctgaaactatatagtgtgatcaaagaggactttaataccctgtgcgaaatcttggcacccagctcaatggtcaagtttattaaagaaacttatctcgatacagtgaccgaggaaatggccaaatttcttgagaacttttgtgagctacagtttcgggaaaatgccgtgagggtggtgaaaacatctaaaagcagtagcaagcaccgcggtgccgttcacgctttagtcactaccgaatgtccccagaagggacggaatttttccctcccacttgacaaggttgaatttctgtcccagctgatcaagagttttatgaagctcgaaaaaggcgtccaagagttattcgacgagattctcttgagcctgaagattactcgcgacaccagtggcatactcgagaagtccgatagagaggtcgtgatggagaaacccagagcaaacgagactaacatcccgagcgagcagagcctgccaggaaaggaggccacactgctcgatttcgggtggcggtcagccttcaaagaggtcagtttgccgatggcacattgtgtggtgacagcaatcgaaggcttttcaaccaagatcctgcagcaggagcagaatgaacgaagtagcgctgtgtcttacgccatgaacttggtgaatgtccaacaagtgtggcaggactctcacatgtttcccgaagaagaacagcccaaaaaaattggcaaattctgtagcgacatcatggaaaagttagacacgatgctgcccttggcactggcatgccgagatgacagcttccaggagataagggctaatctcgtggaagcctgctgcaaggtggcaacagctgtactgcagcgactgcaggagagagccaaggaggtgccatccaaggcgccactaaaaaatctccacacctacctgagcacagccgtgtacgtgtttcagcacttcaaacgatatgacaaccttatgaaagagatgaccaaaaaaccaattttcctggtgcttgtccagaggtaccaagagttcataaacactttgcagtttcaggtgacaaactattgcgttagagtgtgtgccacctcaattttacaagacgcagaatcccatcactgggatgactataaagcattctatgagggtgagaggtgttcattctcaatccagatgtggcactacttttgttggtcattgcattatgatctgtggactattctgccacccaagcttgcccaagagattttggtagaggttctagagaaatctctgtctttactcgcttcacgatacgctcgcgcacatcccagtcgaaagagaacccctcagcttcgcctcgacgtgaccactattctcatctgtaccgaaaacatgctgtggtcggtatgcacatctgtgcagaaacttcttaatccacatcagcatactgatgacaagatatttaaaatccacacgcattgtaacaatctcttcactaccctggtgattctaacatctcccttgactgagttgtataaaacctttcagcacggcctggacgagtcggcgtctgacagcctgaagtcttttttcaagcagcctctttactgggtgtcctgcatcagccatttctatccctccttgctgaggactcctagcgcaggagggctgaaggcggagggtcagctgaagttgttgctgagtcagccccgttgcaattggaaccttctcctggagaccctgctgcaccatgatggcctgctgcttagaatccttcttaaaagtagtaaacaggtgagcgacacagagaacaacctgaatcaaggcccatcactgatggaggcgatttttaagatcttgtatcactgttctttctcgccgcagaccttcgcaaatgtgtttgtgtcctatatggaggaggagcagctgtgggacttcctttacaacatcccggtgtcaacatgtgtggaatatgaactcgaagtgataagatgcttgcggcttgccctgactgacgccatcaaggacactgttcaacagatcgtgtccgttatgtcttctcggaggaattgtgagactaacttgaacaagcacattgttcccgattgtctcttggaatcaatgcccaaagagtggaattactcaccgaaggaaacaaatcgcaaagagtcttgcaagtctttcacccggttgactgcccaggctgtgtccatcgtcatcagcaaattgcccaccgtgatcgcttgcctccctccacctgtaaaatacttcttttttctctctgagaggaaaatgagcaagaagttcgtggaactgaagaaagctggcctgcttgtgtggaacctcatagtgattatttgccgtatatttgaggacggtaatactgtggagttactcaccggcgcatccttggataggtggagtaaagaaaaactaggcttaatctgtatgtgcctcaagtccatcatgggcgaccagacgtcaatacacaatcagatgatccagaaagttatacaaagcattgagcagcagaaaccaaattggatcgaacgacagctcctgaaagctcgcaaattgtcaactgaatgcgcatttatgactatcgagaagtcgactgcactccaagagggcgacgtcgccctagaactcactgagcagaagatcaacaccatggtgttggatctgtgccacaaacccggaggccgtgagtatctccggcaaatctaccatataatgcagctcaatgaagaatatcttaaggaacagctattcagtatgaatagttccgaggaaaaacccctccccatacgccctcttaaaaccactttacggtcaattgaagaccaaccaagtgcattcaatccctttcatgtgtataaagctttttcagagaatatgttagatcagtcagcaatcaccaagtggaactggaattgggctaagttactccctaactacttacgcctggataagatgactttctccgtcttacttaagaatcgctgggagatgaaaaaggatgaaacacttgaggaggaggagaaggccatactagaacatctgaagcagatttgtacccctcagaatagcagcgccagtgacaatatcgaggagcagtag

SEQ ID NO: 58841 - DNA, 132 bp, Artificial Sequence
  Description of Artificial Sequence: Synthetic coding sequence
cgtctgcgcagccgccctcaagcaggcggagccggaagcgcagctgcctgtggcccaggtcagggcaggtttcgacgagccgctccacgcccttcgtcctcacgagtatgcgggcagcgaactagccgatag

SEQ ID NO: 58842 - DNA, 585 bp, Artificial Sequence
  Description of Artificial Sequence: Synthetic coding sequence
atggtcacctggtcacattctaattcaaacaaggaactgaagcaggagaatagtgccctggccgaacaactccaggtcgtgctcatcgataaagcgggaatgcaatgcgatttggaggaactcaaaaagaaacttgaactcacggaactgactctacagcaactcagctcctggtgcgaagctccagacgcgaatcagcagctccaacaacctaccgacgagagggctcaactggaggcacatctgggccaagttatggagtggcttaaatacctgcaaatggagagggaacagtacgcggagtaccttcatggtgagagtgcaatgtggtggcagaggatgcgggagatgagcgagcaggtgcataccctgcgggaggagagggttcatagcatgagcagagttcaggagctagagacgatcttggctgagctgcgtaaccagctgaatccctgcccacggtccctgcagcaggggccacccaagtggtcgcggtcctacaagcagcggctaagcacctgtggacgctcgtggcgcatatggcaagactccttcaaaccgaagtggaagaagatgagagcttag

SEQ ID NO: 58843 - DNA, 879 bp, Artificial Sequence
  Description of Artificial Sequence: Synthetic coding sequence
atgatgttttactggcttctttcgatagtggggagacagcgtgcatctccaggatggcagaattggtcttcagcgcgaaattcagccagtgccgcagaggctcggtctatggcgctgcctacccaggctcaggtggtggtctgcggaggcggtatcaccggcacgtctgtggcacatcatcagtcaaagatgggatggaaggacatagttctgctggagcagggccgactggctgctggctcgacaagattttgcgctggaatactcagcactgccagacatctgacaatagaacagaaaatggcagactattccaacaagttataccaccagctggagcaggaaactggtatccgcaccggctatacccgtaccgggtccatctttctggcccaaacgcaagatagactgatctctctcaaaaggataaatgccggactgaacgttatcggcatccccagtgagataatctcccccaagaaagtagcggagctgcaccacctcctgaacgtgcacgatctggtgggagcgatgcatgtacctgaagacgcagtggtgtcatccgctgatgttgccttggccctggcatccgctgcctcgcaaaacggcgtacagatctacgaccggacaagcgtgctccaggtgatgggaaaaaagggacaggtgacgggtgtggaaacagataaggggcagattgagtgccaatatttcgtaaactgtgctggacagctgctttggatgctcatggaagaatttatatttggcacaggaagagtagcctcatgcctgggcgctttgaggcgcacccagaaccaattcagcctgcgcgcacggactagctggcggtttagaatctaccggggattaggttccctgtag

SEQ ID NO: 58844 - DNA, 1989 bp, Artificial Sequence
  Description of Artificial Sequence: Synthetic coding sequence
atggtgtcacaatctactgtgagacaggacagtcccgtggaaccttgggagggcatttccgaccactccggaatcatcgatggctccccccgacttctgaacactgaccacccaccgtgccagcttgacatcagattaatgcgacacaaggccgtctggattaatccccaggacgtccaacaacagccgcaagacctgcagtcacaggtgccagccgctggtaacagtgggactcactttgtcactgacgccgcaagcccctctggacctagtcctagctgtctcggcgacagcctggcagagacaacactttctgaggacacgacggatagcgtgggcagcgcttcccctcatggatcttcagaaaaatccagcagcttcagcctgtcctctaccgaagttcacatggttaggcccggatactcgcaccgcgtgagtctcccaactagcccaggaatcctggcaacgtcaccttatcccgagacagacagcgctttcttcgagcctagtcatctcacttccgcggctgacgagggggcagtccaggtgagccgtcgcactattagtagcaactctttctctcccgaagtgttcgtgctgcccgttgatgtggagaaggaaaacgctcacttctatgtcgcagatatgatcatcagtgctatggaaaaaatgaaatgcaatattctgtcccagcagcagacagagtcttggagcaaggaggtcagcgggctgttgggttcagaccaaccagacagtgagatgacttttgacacaaacattaaacaggagagtggcagcagcacctcgagctattcaggctacgagggctgtgctgttcttcaggttagccccgtcactgaaacacgcacctaccatgatgtgaaggagatctgcaaatgtgacgtcgatgaatttgtgatactggaattgggggacttcaacgacatcaccgagacctgctcatgttcctgttccagctccaagtcggtcacgtacgagccagattttaactcagccgagctgctggccaaagaactctatcgcgtttttcaaaagtgctggatcctgtccgtagtgaacagccagctagcaggatccctgagcgctgcaggctcgatcgttgtgaacgaggaatgcgtccgaaaggactttgagagctccatgaacgtggtgcaggagatcaaattcaagagcagaatcagggggacggaagactgggccccacctagatttcagatcatcttcaacattcaccccccactgaagagggatcttgtagtagccgcacagaactttttctgcgccggatgtggcacacctgtcgaacctaaatttgtgaagaggttacgctactgtgagtacttaggaaagtatttctgcgactgctgtcatagttatgcggagtcctgcatcccagccagaatcctcatgatgtgggactttaagaaatattacgtgtcaaacttttcaaagcagcttctggatagtatttggcaccagccaattttcaacctcctatcaattggccaaagtctgtacgccaaagccaaggagctggacagggtgaaggagatccaggagcagttgttccacatcaaaaagctgctgaagacctgccggtttgcgaattccgccctgaaagaatttgagcaggtaccagggcacttaaccgacgagctccatctgttctcgctggaagacctggtccggatcaagaaagggctgctagcacctctcctcaaagacattttgaaagcctctctggcccacgtcgcgggttgcgaactctgtcaaggcaaaggatttatatgtgagttttgccagaataccaccgtgatcttcccttttcaaaccgcaacatgtaggagatgtagcgcatgccgggcatgcttccacaagcaatgctttcagtcatccgaatgtcctcgatgcgccagaatcactgccaggaggaaactgcttgagtcagttgccagcgcagccacgtag

SEQ ID NO: 58845 - DNA, 297 bp, Artificial Sequence
  Description of Artificial Sequence: Synthetic coding sequence
gtgtgcggtagcacacaagaaaaaactgtattcaggttagaagctatgctggaacggactgccggagtacagtctaaggaggccgctctggaggaagaagccgtgcttaaggtggaggatattatggccgaggtagaggtggtggtggaggtggaagtcgtggttgaggtcgagcctgatgtcgggtggcagaaagaaggccaaagagctcagcccggacccggaccatccactcctggccctagcatggacagtctcgaggttctgcacctggagctaggatccgtcaacgcctag

SEQ ID NO: 58846 - DNA, 459 bp, Artificial Sequence
  Description of Artificial Sequence: Synthetic coding sequence
atgctcttttcattcgaacacaaagcagtggctctctcagccactcgcagggccacacctagaccccagccctgggtgctgggtctgcaaggtcgcggtggagagggagacgccaggacttgcggcgcagggagggaacgcggactgccaggccctgcactcgacactgagcctaggtgggacccgcgtagactctgcgaggccttacgggcacctgggcgtcgactggaaggggcaggacaaccccctgcaacctctggagggcctgccactagcgggagatccaaggagccctggggacacatctcgggatgtggcgacccacctggcgcttttaggggatctggtcgtatctgtcaaggcactagcggtgctcgcccatgtttttgtagggcccctggctacccctggatggccgctctgtgcccccgacgcaggcctggccgacattctggctag

SEQ ID NO: 58847 - DNA, 441 bp, Artificial Sequence
  Description of Artificial Sequence: Synthetic coding sequence
cctgggcctcccggacggcctggaaaacccggattccctaagcccggaggtcctggaggaccggcaattcctggcgcaccagggagacctttcgtgccaggaatacccggatggcctggcgcaccggctgcacctggctttccaatgccttccggcccacggagcccgggtggcccatggggcccagggggtcccattggtcccatttctccaggtccgggaatccccggtggtcccggtggacctagggggcctgggaggccggcaggacccacttctcccttcgggccatacggcccactctcacctggcttcccaggctctccagggaccccagggttcccaaccgccgacggtccagggggaccagggaaccccggatctccctggagccccggtctcccctaccccaggggcccagcaggaccaggtggcccatag

SEQ ID NO: 58848 - DNA, 84 bp, Artificial Sequence
  Description of Artificial Sequence: Synthetic coding sequence
gttcctcctctgcactcaagcctgggagaccgggctcggtttttaagaccctgtttgaaaaaaaagacgaaaaagaagaggtag

SEQ ID NO: 58849 - DNA, 3063 bp, Artificial Sequence
  Description of Artificial Sequence: Synthetic coding sequence
cagctgcggaggtctgaattggagcatagcgtggacctggaggaggccctgggcagactggaagcagccgaggagaggagtaccggtctatgtcaggtaaacgctcttctgcgcgaacagttggagcacatgaagaaggccaatgatgctctcggccgtgagctggccggaatgacgggctctgtgcagcgcctgcagggcgagttggagttgcgtcgttgggcacagaggcaggaaccctcacggactcggagcgggggactcggccaacctagggaccttctgctcctatggaggcaagcagtggtgctaggcacggatttggcagaactgcgcgtggctacagaaagaggcctggccgaccttcaggctgatacagctcgcactgccagacggctgcacactgcttgtctaaatctggatagtaacttgagactgtctgcctcttccaccgcctccacactagggcagcaactgcgcgataaagcgggagagatgcttcaactccagggtaggtgggacgccgaaaaggttgctctccaggcacgcctcagtgaacagacgctcctcgtcgagaagctgactgagcaaaacgagcagaaagccaaaaccatcgccgctttaagaacagacctgcagaacctcgtcgggggacaggatgggggtggatgcgtcgccggagtgtgtcacccctgcagtggggtttccccagcaaccggctcacttgtcgcacaagaagacgctcggtgtctcgagctggctgggtcatctattaccgaacttggcgaaccgcgacggccactgagaagtccacagcgcgctacttcgccccaccagggcgcatcgcctccacatatttgtagccctgccacccttgaccccgctttgcaggcgatgagggctgcaattgaacggcgatggcgacgcgagcaggaactctgcttgcagctcaaatcatcccaggctttggtggccagcctccaagagcagctaagcgagagccggagagagctgtgggctgcacaaaaacttcagcaggaaagggccagggaacaagcaagggaaagagaggcgcttagaggtcagctggaagcacaaagactggaagtgcagcagtgccgcgcttcatgtaagctgctgggtcgagagaaggccgctctggaaatggtcgtggaggagcttaaagggaaggcagatgctgcagatgccgagaaacaggggctggaggcagaagccgctgaactacagaggagtctgctgctgcaggctgaaagacgagaggaactcgcacttaggagagagcggagctgccgagctttagaaacttcgcaaggaagactgcaacagctcgaggagaaggtctccggactgcgagaggaactcgcatccgtgcgcgaagccctgtccacagcccagcttcagagggatgtggtggagtccgagagagaggggttacgctcggcactggcccgagctgaatgcagcaacgccgatcttgaactcttagtgcgcagactcaaatccgagggtgtggaacagcgcgacagcctcgccgcaatggctgccctgatggagggactggcacaggacaaaagtgccttgaaccatctggcactacagctggagcaagagcgggatcagctacgtgagcagcgcaagaccttggagcaggagagagccagggcgggagaacagctggcacaggccgagcagcagttggctttagaaagggctgaacggagaggactgcaacaggcctgtggcaggctggagcagcggcaggaacaacttgaaggacaggcagcactccttggacgcgagaaggctcagttacaggagcaggtgggacaggtgacttgtcagaagcaggcactggaggagcagctggctcagagcctgcaggatcaggaggcccagatggggaccctccagcaggcactccagggcaaggacgctttgtcggaagagagagcacagcttctggccaagcaggaagctctggaaagacagggaaggttagcagctgaggaagcagccgacctcagagtagagcgcgacagcttggaatcttctctgctggaggctcagcagctggcaaccaagttacaggagcagttagaagaagaagctaggtccgctggcctcgctagacaggctcttcaagtggagatggagcaactgcagtcagactgggaggtgcaagaaatgaagctaaggcaggatacagtgagactgcaacggcaggttgcgcagcaagagcgcgaagcccagcgggcactagagtctcaagctctggcacaccgagaagccctcgcacagctgcagcgcgaaaaggagactctctccctgactctggcagaggaaaaggaggttgccaggtgccaactggaacaggagaaggagctggttacaaagagcgccgcagagagagaggcactgaaaggagagattcagagcttgaaacaggagagagatgagagccttctacagctcgaacataagatgcagcaggccctgtcgctcaaagagacagaacgcagtctgttaagtgaggagctcagccgcgctcggagaacactagagcgcgtgcagcaggaagctcagtctcaacaagagcaggcccaggcaactatctctgccactaccgaagagcttaaagcccttcaagctcagttcgaggacgctattacagcccaccagcgcgaaacgaccgcactgagagaatccctgcaggacctggcagccgagcgaggagacgtagagcgcgaagccgagaggttgagggctcagctgaccgtggcacaagaaggccttgcagccctgcgccaggagctccagggggtggaggagtcaagggagggattacatagggaagctcaggaggcaaggcgagctctgagtgacgaggccagggagaaagatgtgttattgctgtttaactccgagctcagagcaacaatctgtagagccgagcaagaaaaggctagcttcaaaagaagcaaagaggagaaggaacagaaactgctaatcctggaagaggcacaggccgcactacagcagtag

SEQ ID NO: 58850 - DNA, 1395 bp, Artificial Sequence
  Description of Artificial Sequence: Synthetic coding sequence
tgagccttgtgctgggcgagggctcttccctcccgcccaggcgctagcaggagtggcggtttagaggagtcgcgtgaccggcctaggccacttcctaccgaacctgccgtcaggcctaaagagcccggaacaaagcgaaaaggcctgggcgagggcgttccctctagccaacggggacccaggaggctttcggctgagggaggtgacaaggcgctccataagatgggcccaggaggaggtaaggctaaagctctcggaggggcagggtctggctctaaaggatcagcaggcggtggaagcaagcgcaggttgagttcagaggactcatccctggaacccgatctggccgaaatgtctctggatgattcctctctggcactgggcgctgaagcctccaccttcggaggcttccccgaatccccaccaccatgccccctccacggtggaagcaggggacctagcacatttcttcctgaacccccagacacttacgaagaggatgggggtgtgtacttcagcgagggacccgagcctcctaccgcctctgttggcccaccaggtctcctacctggtgatgtatgtacacaggatgatctaccctccacagacgaaagtggaaatgggctgcctaagaccaaagaggccgctcctgcggtgggagaggaggacgacgattaccaagcatactatcttaacgctcaggacggcgctgggggagaagaggaaaaggcggagggcggagcaggggaggaacacgatttgttcgctgggctcaaaccccttgaacaggagagcagaatggaggttctcttcgcttgtgcagaagctctgcacgctcacggctactcatcagaagcgtctcgcctgaccgtcgaattagcacaagatctgttagcgaacccacccgacctgaaggtggaacctcctccggcaaaggggaagaagaataaagtgtctacttcaaggcagacctgggtcgcaacaaacacactgtcaaaggctgctttcctgctgacggtcttatcggagcggcctgaacatcataaccttgcatttcgagtcggaatgtttgctctggaactgcagcggccacccgcttccacaaaagcattggaggtgaaactggcttaccaggagtccgaggtcgctgccctactaaaaaaaatccctctcggtccctctgaaatgagcaccatgagatgtagggccgaagaactgagggagggtacactgtgtgactaccgacccgttctccccctaatgttggccagctttatattcgatgttctctgtgctcctgggtcacggcctccatccagaaactggaatagcgagactccaggcgatgaggaattaggattcgaagccgcagtagctgccctgggcgaaagctag

SEQ ID NO: 58851 - DNA, 3909 bp, Artificial Sequence
  Description of Artificial Sequence: Synthetic coding sequence
tagccttcggctagtgatcagtctacctggtatttggatgaaagtaccctgactgataacataaagaagacgctgcacaagttttgcgggccttcgcctgtggttttcagcgatgtcaattccatgtatctctcgagcactgagcccccagccgctgcagagtgggcctgcttgctcagaccattgagggggagagagccagagggagtctggaacctcctgtccattgtgcgggagatgtttaaacgtagggacagcaacgcagcacccctactcgagattctgaccgatcagtgtctcacatacgagcagatcacgggatggtggtactcggtacgtacatctgcgagccattcaagtgcaagcggacatacaggacgctcgaatggccagtccgaggtcgcggcacacgcctgcgcctcaatgtgcgacgagatggtgacactttggagactggcagtgttggatcccgcacttagcccacaacggcgaagggaattgtgcacccagctccggcagtggcagctcaaagtcattgagaatgtcaaaaggggtcagcacaagaaaacactcgaacgactgtttcccggttttagacccgcagttgaagcctgctattttaattgggaagaggcatatccactgccgggagtgacctactcagggacagatcgcaagttggccctctgctgggcgagggctctcccctcacgcccaggagctagtagaagtggcggtttggaggagagcagagatcgcccacggcctttgcccaccgaacctgccgtaaggcctaaagagccaggcaccaagcggaagggtctgggagaaggtgtgccaagcagccagagaggcccacgaagactcagcgctgaagggggtgacaaggccctgcataaaatgggcccagggggtggaaaagctaaggctctgggtggggcaggctcgggatccaagggctcagcgggaggtgggagcaagcggcgactctcctctgaggacagcagtctcgagcctgatctagcagaaatgagcctagatgattcaagtttggcactgggcgcagaggcctcaacatttgggggtttccctgagtcaccccctccttgcccgttgcatggaggcagcaggggcccatctacctttcttcccgaaccacccgatacatacgaggaggatggaggtgtttatttttccgagggcccagagccacccacggctagcgtgggccctcctggattactgccaggagacgtatgcacccaggatgacctcccctcaactgatgagagcggtaacgggctcccaaaaaccaaggaggccgctcccgcagtcggtgaggaggatgatgactaccaagcctactacttgaatgcccaggacggagccggaggagaggaggagaaggcagagggcggtgcaggggaagagcacgatctgttcgcaggactcaaacccttggaacaagagtcaaggatggaggtgctcttcgcctgtgctgaagcattacacgctcacggatacagctcggaggcttcacggctaacagtggaattggctcaggatctgctagccaatccccctgatttgaaaggaaaaaagaacaaggtgtcaacaagcaggcagacttgggtggctacaaataccttgtccaaagccgcttttcttctgaccgtcctgtcggaacgtcccgaacatcacaacctagcatttagggtggggatgtttgctctcgagctgcaaagaccacccgcttctacgaaagctctagaggttaaactagcgtatcaggaaagcgaggtggccgctctcctgaagaaaatcccactagggcctagcgaaatgagcactatgcgatgcagggcagaagaactccgcgaaggaaccctgtgcgactacaggcccgttctgcccctgatgttggccagctttatttttgatgtcttatgcgccccaggcagccgccctcctagcagaaactggaactctgagacacccggagacgaggaactgggctttgaagcagccgtcgctgctctcggtatgaagaccactgtgagcgaggcggaacatcccttgctttgtgaaggcactaggagagagaagggtgacctggcactggccctgatgattacgtacaaggatgatcaggcaaagctaaaaaaaatactggacaaactgctcgatagggagagccaaactcacaaacctcaaacactgtcttctttctactctagctcccgtccgaccaccgctagtcagagatctccaagcaaacacggcggtccaagcgccccaggcgctttgcaacccctgactagcggcagtgccggacctgcccagcctggctccgttgctggggcagggccaggcccaaccgagggtttcaccgagaagaatgtacccgaatccagccctcattccccttgcgaaggtctgccttctgaagccgctctcaccccgcgtcccgaaggtaaagtcccttcccgcttggcactaggttcaagagggggatacaatggacgaggctggggctcccctggccgtcctaagaagaagcacactggcatggccagcattgactcctcggcacctgagacaacctcggactcatccccaaccttaagccgcaggccattgcggggaggctgggcacccacatcatgggggagaggccaagacagcgacagtatctcttccagctcttcagactctttgggctccagctcctcttccggtagtaggagggccagcgcctccggcggagccagagccaagaccgtggaggttggcagatataagggcaggcgcccagagtctcacgcaccgcatgttcctaatcagccctctgaggctgctgctcatttctacttcgagctggctaaaacagtgctcattaaagccggagggaacagctctacatccatctttacccatccctcatcctccggtggccatcagggcccacaccgaaatctgcacctgtgtgcctttgaaatcggtctgtatgctttgggactccataacttcgtttcccctaactggttgagcaggacttactccagccacgtctcttggattacggggcaagcgatggagattggctccgccgctctcactattttagtggaatgttgggacgggcatctcacccctcctgaagttgcgtcactggcagacagagcatcccgagctagagactctaacatggtgagggctgccgctgaactggctctcagctgtctcccccacgcacacgcattgaacccaaacgagattcagagggccctggtccagtgtaaggaacaggacaacctgatgctggagaaagcctgtatggccgtggaggaggccgctaagggtggaggggtttaccccgaagtgctgtttgaggttgctcaccaatggttctggttgtacgagcagacagcgggaggcagtagcaccgccagagaaggggcaactagttgtagtgcatctggaattcgggcaggcggtgaagccggaagaggcatgccagaggggcgtggagggccagggacagaacctgtcacagtggcagccgcagccgtgaccgcggctgcgacagtagtgccggtgatctctgtaggaagttcactgtacccaggaccaggactgggccatggtcattcaccaggtcttcacccctacacggcactccagccgcacctgccctgcagcccgcagtacttgacacacccggctcatcccgcacacccaatgccacatatgcctcggccagccgtctttcccgttccttcatctgcctatccgcaggttcggcctgtcttttgctggggcgtgcgacacggcaaaattctcggaatccacagaggactggaatgggtgctgtgggagtacaattggagcgtaggggagagctggtag

SEQ ID NO: 58852 - DNA, 327 bp, Artificial Sequence
  Description of Artificial Sequence: Synthetic coding sequence
ccctcctgcgtcccggtgctgaaaggagcccacgccgcagattcatccaggtctaagtggcccgctctgatggggaccgggagaaaatcttttggagcatttctgtttcatcatagtttctcctggggctggaaattgatcagtatttcattcggcgacctcaatccattccccgtgcggcagatcagaaaccgccgagcatatcacctggaaaaggtgcgtctagagctcacagagctcgaagctatccgggaagacttcctgcacgagcgcgatacctctccggacaaaggagagctagtgtctgacgaggaagaagacacttag

SEQ ID NO: 58853 - DNA, 3930 bp, Artificial Sequence
  Description of Artificial Sequence: Synthetic coding sequence
atgctcttgaatggcgattgcccagagtctttgaagaaggaggcagctgccgcagaaccccctagagagaatggcctcgacgaggcgggacctggagatgagacgacaggtcaggaggtgattgttatccaggacactggattttctgtaaaaattctggctccaggaatcgagccattttccctgcaagtatcaccacaggagatggtccaggagatccaccaagtgttgatggatagagaagatacttgccaccgtacctgtttttcgctgcacctggacggaaatgtccttgatcacttctccgaactacggtctgtggagggtttacaggaagggagcgtactgcgcgtcgtggaagagccctacacagtcagggaggcacggatccatgtgaggcacgtgagagacctcctgaagtcactggaccctagtgacgcttttaatggagtcgactgtaactcattgagcttcctgtccgtattcaccgatggcgatctgggagacagcggcaagcgcaaaaaaggtctcgagatggaccccatcgactgtacaccacccgaatacatcctgccgggtagcagagaaagaccactctgcccactccagccacagaatcgggactggaaacctctgcagtgtctgaaagtccttaccatgtcaggttggaatccacccccaggcaacagaaagatgcatggggacctgatgtatctcttcgttattacagccgaggaccgacaagtgtctatcacagccagcaccaggggtttctacttgaaccaatccacagcataccattttaaccctaaacccgctagtccaaggttcttgagccatagcttggtggagctcctaaatcagatcagtccaacattcaaaaagaattttgcagtgctgcagaagaagagagtccagagacacccatttgagcgtatcgctactccatttcaagtctacagttggacagctccgcaggcggaacacgccatggactgcgtgcgggcagaggacgcttatacaagccgcctcgggtacgaggagcacatccctgggcagacacgcgactggaacgaagaattacagactaccagggagctgccacgcaagaatctccctgaacgattgctgcgggagagagctatctttaaagtgcactccgactttacagcagctgctaccagaggcgcaatggctgtcatcgatggcaatgtgatggccatcaaccccagcgaagagaccaaaatgcaaatgttcatttggaacaacattttctttagcctgggcttcgatgtgcgggaccactacaaggattttggcggtgatgtcgctgcctacgtggcacctaccaacgatctgaatggagttcgcacatacaacgccgttgatgtcgaagggctgtacaccttgggcactgttgtagtcgactatcgcggataccgagtgacggcccaaagcatcattcccggaatcctagaaagggatcaggaacaatccgtcatctacggctcgatcgactttggcaagacagttgtgagccacccacggtacttagaactcctggagcggaccagcagaccgctaaaaatcctaaggcatcaggtcttaaatgacagggatgaggaggtggagctgtgtagctccgtggaatgcaaaggaatcattggaaatgatggaagacactatatactcgaccttcttagaacctttcccccagatctcaactttctcccagttccaggcgaggagctgcccgaggagtgcgcgagggcaggatttccccgagcccaccggcataagttgtgttgtctgcgccaggaactggttgatgccttcgtggagcacaggtacctgctctttatgaaactcgccgcactgcagctcatgcagcaaaatgcttctcagctcgaaacaccaagctcactggagaatggtgggccatctagtctggaaagtaagtccgaggaccctcccggacaggaggcgggaagcgaagaggaagggtccagcgcatctggcttggccaaagttaaagaactggcggagaccatcgcagcagatgatggcacggacccgagatcccgcgaagttattaggaacgcgtgcaaagccgtggggtctatctcctccaccgcctttgacatccgatttaatccagatatttttagccctggcgtccggtttcccgagtcatgccaagatgaggtgcgcgaccagaaacagctccttaaggacgcagctgcctttctgctttcatgccagataccagggctcgtcaaggactgcatggagcatgccgtcctgcccgtcgacggggctactctggccgaagtgatgaggcagagaggaatcaatatgcgctatttgggaaaggtgctggaactggtgctgcgcagtccagccaggcaccaactcgatcatgtattcaagatcggtattggcgaattaatcaccaggagcgctaagcatatatttaagacatacctgcagggcgttgagctgtctgggctgagcgctgcgatttctcactttttaaactgtttcctgagtagttatcccaaccctgtcgcccacctaccggcagatgagctagtcagcaagaaacgcaacaagagacgaaagaaccgaccgccaggggctgctgacaatacggcatgggccgtcatgaccccgcaggagctctggaaaaacatttgtcaggaggcgaagaattatttcgacttcgatcttgagtgcgagactgtcgaccaggctgtcgaaacgtatggtctgcaaaaaattaccctgcttcgggaaatctcccttaagacgggaattcaagtcctgctgaaagaatattccttcgattctagacataagcccgcattcaccgaagaggatgtgcttaacatattccccgtcgtcaaacacgtcaacccaaaggctagcgatgcttttcacttctttcagagtggacaggctaaggtgcaacagggattcctaaaagaaggatgcgaactaatcaacgaggctcttaacctttttaataacgtttatggagcaatgcacgtcgagacttgtgcttgtttgagactgctggccagactgcactacatcatgggagattatgcagaggctttgagtaatcagcaaaaagccgttctgatgtccgagagggttatgggcacagagcaccccaataccatacaggagtacatgcacctggccctgtactgttttgctagttcacagttgagcactgcgttgtctctattatatcgggctagatacctcatgctgctcgtcttcggggaggatcacccggagatggcgctcctcgacaataacatagggctggttctccacggcgttatggagtacgacctctcgctgagatttttagagaatgcgctggccgtgtccaccaaataccacgggccaaaagctctaaaagtcgcccttagtcatcatctggtggccagagtgtacgaatccaaggcagagttcaggagtgccctgcaacatgaaaaggagggatacacaatttataagacacaactgggtgaagaccacgagaagaccaaggagtcatctgagtatctgaaatgtctgacccaacaggctgtggctctgcagaggactatgaacgaaatctatcgtaatggtagctctgctaatatccctcccttaaaatttactgctccatctatggccagcgtgctggaacagctgaacgtgataaacgggatcctgttcattccgctttcccagaaagacctggaaaacctaaaggctgaagtggctcggaggcatcaactgcaggaagcttcacgtaaccgagacagagccgaagaacccatggcgaccgagcccgctccagccggagccccaggtgaccttgggtcccagccacccgcagctaaagacccttccccatccgtgcaggggtag

SEQ ID NO: 58854 - DNA, 459 bp, Artificial Sequence
  Description of Artificial Sequence: Synthetic coding sequence
gaaggatcgatggatagcctctacgaaccaattcccgagcagcaggcgaaccaagagaatatgagcagtcggactgatagcccaattcctccatttggggaatcagaacaaactccaaacaatttattcgtcggcgtgagcaacctcgagaatgcgaagccaaaaaagagaaagctatttcgtcggtttatgtccgaaaacaaaatattcgagggcaaaacagttaacgataagatctggcaggagcactccaaacacaaaaatgactctcacatcagaagaccttgccaactgaaagatctgaatgaaaacgactttctgtctaataatatccatacatatcagggaaagactctccaggggacctcatatcaggtgacatctgagtgctggtctccattccattaccagagacatgtcgagaccaccgtagacgagctcgctcaggaattcatgtag

SEQ ID NO: 58855 - DNA, 840 bp, Artificial Sequence
  Description of Artificial Sequence: Synthetic coding sequence
atgccccaggaagagctgcatatgaaagagtgcccccacctcaaaccaacacctagtcagtgttgcggacatcgcctggccgctgatcgggtgcatgactctcaccctacaaatatgactccccagcaccctaagacccaccccgagtcatgctcatactgccggctgagttgggctagcctggtacacggcggaggcgcattgcagcccatcgagaccctgaagaaacagatatccgaagaccgcaagcaacagctgatgctgcagaagatggaactagaaattgagaaggagcgtctgcagcatcttcttgcccagcaagagaccaagctgctgctgaagcagcagcagctgcaccagagccgcctggattataattggctcaaggcacaggctctgtttaagtcaagagaactggtagcagaaaaacaacttacaaaaccacaggaacttaagttggatatgaatgggtcagattccggaccctccctgctgaaatccaactgcgacggttggctactgggcacctccagtagtataaaaaagcatcaggaccctcctaactcaggagaaaatcgtaaagaacgaaagaccgtcggcttccatagtcatatgaaggatgacgcacagtggtcttgccaaaaaaaagacacatgtaggcctcagaggggtacagtgactggtgtccggaaagatgcaagcacctctccaatgccgactggatccctcaaagatttcgtgaccactgccagcccaagccttcagcataccacatctcgtcccggaatctctacaaaaatttgtttcctcagtaaccacttcttcattctgttttcctag

SEQ ID NO: 58856 - DNA, 399 bp, Artificial Sequence
  Description of Artificial Sequence: Synthetic coding sequence
atgagctttgaatacaggcactacaaacgggaggctaaaatctgcacttgtcgcggaggttgggcccacgtccttctgtgcatcggggtgagccaaggagcttgcgccgaacatttgccccacagacctgccgtagagaaagacgtgcccggagccggtgaggtgcttttcatgtgtagttggagaatttttcctgtggcttctgcttctccctcctctagtattagtggcttggccggtcactcagtctttttagtacctgggcttgctgctcatcccggatctcattctgatcagcctcccggagtcccttctaggcgtaaaagtagactcgagagatggagccccagtgtctctaggtccacttctccgcctacggaggccccattctgcctgtag

SEQ ID NO: 58857 - DNA, 1254 bp, Artificial Sequence
  Description of Artificial Sequence: Synthetic coding sequence
atgaaggccctagtgcccgtcactagcagtggaacatggtattgcttagaacggaggcccgcagtatttgtgacttcctccgttagttctccagtcaaattcacccacgatatctctgtcaccggaaatggcattgttcttcctccaaaacccaagtcgaaggtgaagtggtgccatttctccacattgcctaaacccaaaccgcagttatctagatcatttgaaaagggagacgatttctcaggtaaaaaattttgcatcctgacagccatcaaacctaccaaccttgagaaagagaaactgagatttttcaagtccgactatacctacaaccctcagttcgaatacgcaaacccggcactcccttccgtgctcgcgaaacattctcacgcatccgatagatttctgaagcagtcaatcaatataatggagctgacgctgcagaagtatgggtcatacgagaaatttgaacaggctaccggtggaagtctgctgagcaagacaaggatctggagccacgtaagaaagtatatgatgaaggaaggttgcttgggagagatcgtcgtgcacttaactgaagatctgttatctcgggctagcatgacagtagtcaacggatgccccacactcacaatcaacgtgtcaacagcacgagaacactggctggagggaatgttacggcacgagatcggaacacactactttcggggtatcaacaatctccaacagccctggaattcctggaccggtcgtaagaagcacgagctcaaacccaataaccccaccgaggaaggattggcatctatacactcagtgttgttccggaaggaccccttcctgtggcgcgcagccctactgtactacaccgtttaccaagcctcccaaatgtctttctgcgaactgtttaaggatattgggaggttcgtgaaagacccaaacactcgctgggactattgtgtcagggctaaaagagggtggacagacacttctcagcctggctgcttctctaaagaccaagtgtacttagatgggatcctgcagattctgcgctatcgcgataccatcgactttcatttattgaccgcactcggaaaagtgagctacgaggatgtcgaccgtttaaaggggttggcggtgacagagaacatgcgagttccacactttttgcaggaccacgggaggtacatggagcacctggaaaagattatggaagtcaacgagctcactgaccgcgagctgaaagacctgatctag

SEQ ID NO: 58858 - DNA, 627 bp, Artificial Sequence
  Description of Artificial Sequence: Synthetic coding sequence
atcactcccacaccaccccctcctcccagaagcagggagaaagagtctcctagggtcgccgcacgcgtagtcgtgcccgtcaggtcgagagaacgagttctgaccagcatgggcctgaccggcgtggagggaagagggtgcagatactctggatgtaagatgtggcctgtccgggctgtctctatcttttccaccttaattgggcgtcgccttgcatggaggcggggatcagaaggcggtaccgcctgcaccaagggcctggtactgccggcaggagatgagccagggccaggacccgaacttttccccgaatccgccctcgtgcaggcaggctccgccccacccccaccgccaccccctcccccaccgcctctgtgtctgctcctcctgagggcagagagcgagggagccgtgttaatgacccacccgagagcatgggagcagagggggggaggcttgagagaggctcgcggaggtttgggcgctgcaaggtctcctagagaacaggaacaacgcgaagaagaagagctggccaggcgtcctagagcaccaagtgccccaagccgacggctggagcctgacgcatcaaatccagggtggcctgccgctgaaccatggccgggttag

SEQ ID NO: 58859 - DNA, 537 bp, Artificial Sequence
  Description of Artificial Sequence: Synthetic coding sequence
atggtctcccagtcaacagtcaggcaagattcccctgtcgaaccatgggaaggcatcagtgatcattccggaatcattgacggctcacctcgtttgctgaacacagaccatccaccatgtcagctggacattaggctgatgagacataaagccgtgtggataaacccacaggatgtacagcagcaaccgcaggacctacagtcgcaggtgcccgctgccggtaactccgggacccacttcgtgacagatgcggcaagcccctcaggtccctcaccgtcttgtctgggtgactctttagcagaaacaacactcagcgaggataccacagattccgtcggaagcgccagcccacatggttcgtcggaaaagagcagttcattctctttatccagcacggaagtccatatggttcggcctggatactcccaccgtgtgtcccttcccacatcacctgggatcctcgctacgtcaccttaccccgaaactgactcagctttctttgagccttctcatctgacttctgccgcagatgagtag

SEQ ID NO: 58860 - DNA, 207 bp, Artificial Sequence
  Description of Artificial Sequence: Synthetic coding sequence
gtggccgctgtcaccgaacgcacttccggcaacctgtctgcctcttccgttaagtgtgatcacaagtaccgcgtgcctggaagcgctagagatcggagccattatgttgatagggccggtttgaagttgttggcctcatcctccccaccggcagccaccagccaacagcactggaatgacagacgtactcctcttaacattcactag

SEQ ID NO: 58861 - DNA, 1554 bp, Artificial Sequence
  Description of Artificial Sequence: Synthetic coding sequence
atgttggagagcattagggtgaccgaaaaactgcactggcccgagcaggagctcgctaaaaaatccattttaaatgctgaagacagcctcatcattgacaacaaaagaagtattagccatttgtcaagcggggtgttgaaggacatctttactactggaacctcttcatacaacgtgctcctgcaaagcaaggaagagaaaaaataccattcacagaaacaaagctcttccacctacagcaaaaggtgccgaaagcctagtaagagtcccaataccagcagatctaaggatcccagacggatgaaagcactggtgccggtgacgagcagtggcacttggtattgcctggaacgccgaccagcagtgttcgttacctcttcggtttcttcccctgtgaagttcacccatgatatttccgtcactggaaatggaatcgtgctcccccctaagccaaaatctaaagtgaagtggtgtcatttttccacattacccaaacccaagccacagctgagtcggtcctttgaaaagggggatgatttttctggcaagaaattttgtatactgactgctattaagcctaccaatctcgagaaggagaagctgcgcttcttcaagtctgattacacatacaacccacagtttgagtacgctaatccagctctcccttccgttctggcaaaacattcgcatgcatctgaccggttcctgaagcaaagcatcaacattatggagttgacgctccagaaatacggtagctacgagaagtttgagcaagcgacgggtgggagcctgctgtcaaaaaccagaatttggagccacgttcggaaatacatgatgaaggagggatgtctgggcgagatcgtggtgcatctcactgaggacctgctgtctcgtgcgagcatgactgtggtaaatggctgccccacgctgacgatcaatgtcagtacagcccgtgagcactggctggaagggatgctgaggcatgagataggcacccattacttccgtggtatcaataacctccagcagccttggaactcatggaccggacgcaaaaagcacgaattaaagccaaataaccccaccgaagagggactggcttctatccactccgtgttgtttcgcaaggacccgttcctgtggagagcagcactgctgtactatacagtttatcaggcttctcagatgagtttctgcgagctctttaaagatataggcagattcgtgaaggatcccaacacccgctgggattattgtgtgagagccaagagagggtggacggatacttcccagcccggttgctttagtaaggatcaggtttaccttgacggaatattgcagatattgcgctaccgtgacacaattgactttcacctgctgactgccctagggaaagtctcctatgaagacgttgacaggctcaaagggctagcagtaacagaaaacatgcgggtgccccacttcctgcaggaccacggcaggtatatggagcatctggaaaagatcatggaggtcaatgagctgaccgatagagagctgaaagacttgatttag

SEQ ID NO: 58862 - DNA, 438 bp, Artificial Sequence
  Description of Artificial Sequence: Synthetic coding sequence
ggggaatccgaggatgtaactcagttcctccaatcacacaaaaagaccttaactaatgagaaattattcctgatggacgggaagaggacctggttcctcgaaatggagagcactcccggagaggatgcaatgaacacagtcaagatgactacaaaggatcttaagtacgaccgcagtctgatcgataaagcagggtttgaacgcacagacagcaacttcgaaaggtcacataccgtcggaaagatgctcagcaacagtatcatgtgctaccgggacatcttttatgagcgggagagtcagctcatgcaacaaaccagtctgttgagttacgaaatagctattgccaccccgacattttcgaactactatccggactggtctgcacccataaatatagtcgccagaccatccacttccaagaagatcatgacttgctag

SEQ ID NO: 58863 - DNA, 1695 bp, Artificial Sequence
  Description of Artificial Sequence: Synthetic coding sequence
atgttgatgtggcctcagccccacttacctactcacccgcacctccctacacacccccaccttccaacccacccacacctccccacacatcctatgatgtccaaggagacccgacagtccaaactggcagaggcaaaggagcagttgacagatcatcatccccagactaacccaagtgttggtacagccgcatcagataccaagaagaagaagattaacaatggtactaatcctgagaccacaacatctgggggttgccatagtcccgaggatgaacagaaagcatcccatcagcaccaggaggccctaaggagagagttagaagctcaggtgcacactattagaatcctaacctgccagaagacagaactccaaatggcgttatattactcgcaacacgcggtgaagcaactcgaaggagaggcgagagatctgatttctagactgcatgactcgtggaagtttgctggagaactcgagcaggctctgtccgccgttgccactcagaaaaaaaaggcagaccgctacattgaggaattaaccaaagagagggacgcactgagcctggagctgtatcgcaatactattaccgacgaggaactcaaggaaaaaaatgccaaattacaggagaaattacagttggtagaatctgaaaaatctgaaattcaattgaatgttaaggagctgaaaagaaaacttgaacgcgcaaagttattacttccacagcagcagttgcaagctgaggcggatcacctaggtaaggaattgcagtcagtgagcgctaagctccaggcgcaggttgaagaaaacgagctttggaatcgactgaatcagcagcaggaggagaagatgtggcggcaggaagagaagatccaagagagggaagaaaagattcaggagcaagaggagaaaatacgggaacaggaagagaagatgcgccgacaggaagaaatgatgtgggagaaagaagaaaagatgcggaggcaggaagaaatgatgtgggaaaaggaggaaaagatccgggagctcgaagagaagatgcatgagcaggaaaagattcgagagcaggaggagaagaggcaggaggaggagaaaattcgtgaacaagagaagagacaggagcaagaggctaaaatgtggaggcaggaggagaagatccgggaacaggaggagaaaattagagagcaggaggaaatgatgcaggagcaggaagaaaaaatgggcgagcaagaggaaaagatgtgggagcaggaagaggaaatgcaggaacaagaagaaaagatgcggagacaggaagaaaaaatccgggaacaggagaagaagatccgagagcaggaagagaaaattcgtgaacaggaagagatgatgcaagaacaggaggagaagatgggggagcaagagggaaaaatgtgcgaacaggaggctaaaatgcaggaacaggaggagaagatgcgccgacaagaagagaagatccgggagcaagagaagaagatcagggagcaagaagagaaaataagggagcaagaagagatgatgcaggaacaggaggaaaagatgtgggaacaagaggagaagatgtgcgagcaagaagaaaagatgcaggagcaagaggaaaaaatgcgacggcaggaggagaaaatgagagaacaagaagtccggttgaggcagcaagaggaaaagatgcaggaacactag

SEQ ID NO: 58864 - DNA, 744 bp, Artificial Sequence
  Description of Artificial Sequence: Synthetic coding sequence
ggtatagtgggcggacacaacgcccctccgggaaagtggccgtggcaagtgtctttgagagtctattcttatcattgggcttcatgggcacacatttgtggtgggagtttaattcacccacagtgggtgctgacagctgctcactgtattttctggaaagacactgacccaagcatttatcgaattcacgctggcgacgtatacctctacggcggtagaggtctattgaacgtctccagaatcatcgtgcaccctaactacgtgactgccggtctgggcgctgacgtcgccctgctgcagctggaaccccacgatctaagtaacgtaagaacagtgaagctgagtcccgttagtttggagctgacacccaaggaccaatgttgggtcacaggctggggtgcaattagaatgaaggagtccctacccccaccatataggttacagcaggctagtgtccaagttctggagaacgcggtctgtgagcagccataccgaaatgcgagcggacatacaggggaccggcagctcattctggatgatatgctgtgcgcgggaagcgaaggcagggacagttgctacggagactccgggggtccacttgtttgcagacttcggggaagctggcgtctggtgggagttgtgtcttggggatacggttgcaccctgagggacttcccaggcgtgtatacgcacgtgcagatctacgtactttggatccttcagcaggttggcgagctgccctag

SEQ ID NO: 58865 - DNA, 540 bp, Artificial Sequence
  Description of Artificial Sequence: Synthetic coding sequence
atgggcagctggcactgggagtggtatggcgcacccacctctacgctgagcctgggatgtctgcttcttccaggcgagaagtggacattccttattctgccgtcacactacggcactaccacccacgctcactcccttcaggggtgtgttgagcgccaatggcaggattccaagcagcttgccatcagccctgggcctacactgctgcgctctgaatacgtcgggtccttatctcctgtttgctcctctttgacccaggtacaccgggtgccctgggggcaacacagagcctgccccgtcatgctgctggtcttcaccaagtggctgcagcgctacttacacttcgagaagcctgctgagcccgcatccgtcgggcaggatcctgacttcttcggcaagagcgagggcgaacgcgcaacttgtttgctttcacgcagctgcttgtatctcgcctcagtatgtaatttgcgcgaaaatgattcctgcatgggcaggagtggcggaacagggaaatccgacctcccaggcagttgccgatag

SEQ ID NO: 58866 - DNA, 84 bp, Artificial Sequence
  Description of Artificial Sequence: Synthetic coding sequence
tttcccagttttgacattagtttcttcctctttatttatttgtttaacagctcacattcaccagacagggtgagcctgtgttag

SEQ ID NO: 58867 - DNA, 1161 bp, Artificial Sequence
  Description of Artificial Sequence: Synthetic coding sequence
atgggcgtgggttgcttcaaggacgatcgtattgtgttttggacctggatgttttcgacctatttcatggagaaatgggctccaaggcaagacgacatgctattctacgtgcgtcgcaagctggcctactctggttccgagtcgggagccgacggccgaaaagctgctgagcctgaagtcgaggtcgaggtataccggcgagattccaagaagctgccaggcttaggtgatcccgatatcgattgggaagagtcagtctgcctaaacctaatcctgcagaagcttgactatatggttacatgtgccgtgtgtacccgcgctgacggcggagatattcatatccataaaaaaaagagtcagcaggtgttcgcgtctcctagtaagcaccccatggacagcaaaggggaagagtctaagatcagctatccgaacatattctttatgattgatagctttgaggaagtgttttcagacatgactgtgggggaaggcgagatggtttgtgttgaattggtggcctccgacaagactaacacattccagggggtcatctttcagggctcaatcagatatgaggccttgaaaaaagtatatgataatcgcgtctctgtggcggctcgcatggcccagaagatgtcattcggtttctacaagtactctaatatggaattcgtgcgtatgaaaggaccacagggcaaaggacacgccgagatggcagttagtcgcgtgtcaaccggcgatacctctccatgcgggacagaagaagacagctcaccagcctcacctatgcacgaacgggtcacctctttttctacaccgcctacacccgaaagaaataaccgtcctgccttcttttcaccaagtctgaagcgaaaggtgcccaggaaccgtattgcagagatgaaaaaatcccactcagcaaacgactctgaagagttcttcagggaagatgatggaggcgctgatctgcacaacgccaccaacctgagatcccgaagcctatcgggcacgggccgaagcttagtcggctcttggctgaagctgaaccgggctgatggtaactttctcctgtatgcacatttaacctacgtaactcttcccctgcatcgcatcctgactgacatcctggaagtcagacagaaacccatactgatgacttag

SEQ ID NO: 58868 - DNA, 393 bp, Artificial Sequence
  Description of Artificial Sequence: Synthetic coding sequence
tggaaaccacagcattcttttttctttttgctgctcctctggctgccagacactactggcgaaatagtaatgacacaatcccccgctacactgtccctgtctccaggagaacgggctaccttgagttgtcgcgcttcacagtccgtgtcttcttcatacttgtcatggtatcagcagaagcccggacaggcaccacgcctattaatctacggcgcaagtacacgcgctacaggtattcccgctcgattttcaggctccggctccgggacagactttaccctcaccatctccagcctgcagcccgaggacttcgccgtctattactgccaacaggattacaatttaccaccaaccgtgatccaacacgagaccaagacctcaactcgaccctag

SEQ ID NO: 58869 - DNA, 696 bp, Artificial Sequence
  Description of Artificial Sequence: Synthetic coding sequence
atggcaaagtgggtgcctgcactgctgctccgtcgagtcccacttttttctctccgcttccgtccagcctccagtaccttcttgccagttctcgctgccactgagcctgcagtgagcgttccgagcggcgatctctctatgcccgttaaaacacgggctgagggagaagatgatgggttcggcgaggcaggagacccaagacgcctcctggagaggccttggaggtttagagggtgcttacctggtaaaggtaaccgtgacgttggctttgaaggaactgaaggcccaacatctacaaggccggaatgggtgtggtcctgccgctgttgtctgggttgccgagcgagtactcgggagcgggtgacttctcctgtcagggctgcaggaccacaacccaggttcacggacagagaaaccgaggccgcagccggaaccctggctcacatggggtttgctcctccgacttctttctcccactttactgaccaagaactgcgggactgttcctctctggaatgtctgggggttgttgagggagacccacacgtactttgctctactctcagtctcagccgcccatccccgtccgcaacactgactctgctgctcgcctccagctgcctgctggcacctgctcctccaagtttcatcctcctgctcttcacgctgatcgcccctgatctgccgcacagctag

SEQ ID NO: 58870 - DNA, 276 bp, Artificial Sequence
  Description of Artificial Sequence: Synthetic coding sequence
atggaaatcgcgcattatgccaaagtgtttaccgcagacggccacctcggttgctacatcctggctaccatgaattaccactcagctaaacactgcggtagctgcctccagtctcagctgtgcaaacggctcaagcaggaggaccgactttcaccaggtttccagggtcagctgggccagcacagcgagactagttcccttaaaacagtcataggccctctggctccctcttgtcatctggctgatatgaagaattggagatggcaacagtggtag

SEQ ID NO: 58871 - DNA, 492 bp, Artificial Sequence
  Description of Artificial Sequence: Synthetic coding sequence
atgtgcactgtgggaggcaatgtaagtgaggatgcatgttacggagaacccctagaatttcccgagaataccaagaaccgcgctacgctggggtcatcctcgcccacagctggccacacaccgcagcgcaaggaaatcaggatatcgaagatgtaccttcacattccaatccactgttcaacaacttacaatgggcgtgacttggagagcaccagtgtcccaatcaacaggaggaccgataagaaaaacgtggtgagaagacactccgggtattgtagtgcacgcgaggagcggaaccctgtgatttcagccgcatggatgtcccttgaggaactcggcaaatctgctcgctgtagaaaaacaaataccccagggagccacaccagtgtcggcgcaaagaaagccgaattaaaagctgttgtcatggactgttggttacccgagtccggcgaaggcgtgcgcgttcgagcgcgaagggagaacaaactgtag

SEQ ID NO: 58872 - DNA, 489 bp, Artificial Sequence
  Description of Artificial Sequence: Synthetic coding sequence
cacaaaaatacctacatcaggacgtacatccacatctgcgtctatatccgcacatatatccacatttgcgtttacgcttacgtctatacatatatgtgtgtgtgcgtgcgcatttacatatacgtttgcatgcgtacgtatatacacatttgcgtgtacgcttacgtttataaatatatgtgcgtgtgtgtgagaatttacattcatacatgtatgtacatctacacctatatctgtatgtatatcatgtgtatatacgtcagaacctacatctatgtatacatctgcacatgcatacacatctgtgtgtatatgtacgtgcatatctacggttacatttgcacctacattcatagatacggctatatctgcacctatatccacatttacgtgtatacgtgcaagtacatccatatttacggctatacctgtatgtatattcacatatacggatacacatacatgtacatgtacgtgtgcatcttctag

SEQ ID NO: 58873 - DNA, 345 bp, Artificial Sequence
  Description of Artificial Sequence: Synthetic coding sequence
gttctctgcctgttttttttcttcttccttcggcgaagcctggctctgctaccacggcttgaatgttctggggctatctgggcacattgcaagctctgtctccctggctccaggcattctccggcatcaccctctagagtggctggcacgacaggcacctgtcaccatgctcagctgatctttgtattcctggttgaaacagggttccatcatattggccaggctggtttggagctactgactagcggggacccccctgccctggcctcccagagtgctggaattaccgggatgagtcacagagcccaacctatgtgggatctgagcggcctgatcagactatag

SEQ ID NO: 58874 - DNA, 273 bp, Artificial Sequence
  Description of Artificial Sequence: Synthetic coding sequence
ggaggtgccaaggaagaacccaagcggagaagcgctaggctgagcgcaaagcccccagcgaaggtggaagcaaaaccaaaaaaggctgcagcaaaagacaagtccagtgataaaaaagtccagacaaaggggaaacggggagccaaggggaagcagactgaggttgccaaccaggagactaaagaggatcttccggcagagaatggcgaaactaagacagaagagtcccctgcctcagatgaggcaggagaaaaggaggccaaatctgactag

SEQ ID NO: 58875 - DNA, 1026 bp, Artificial Sequence
  Description of Artificial Sequence: Synthetic coding sequence
tgagctgagaggttcgtccccgcactgtcattaggggattggcctcggtcccctttggcccctagatgctgggcccgtcccggaccagtgtcctttccgggactgagatttagccctggaacggcggctctgtccgctcctgcaaccccttcacccggttcacctctgaggcccagagcgtcacctcagcctcccgctggaggacctggtccagggagcgccggaggagaccccgctccaggcggagccggtcctatggaactgatgtttgcagaatgggaggatggcgagcgattttcttttgaagacagcgaccggttcgaggaagattctctttgtagtttcataagtgaggccgagtccctgtgtcagaactggaggggatggcgcaaacagagtgcgggaccgaacagcccgactggcggtgggggtggcggaggaagtgggggtactaggatgagggatggactggttataccccttgtcgagcttagtgctaagcaggtggccttccatatcccgtttgaagttgtggagaaagtgtatcctccagttcctgagcagttacaactgaggatcgcgttttggtcatttccagaaaacgaggaagacatccgcctgtactcatgtctggccaacggatctgcagacgagttccagaggggggaccagctgttcaggatgcgagcggttaaagaccctctccagatcgggttccatctgtccgccaccgtggttcctccccaaatggtcccaccgaaaggggcttacaacgtggcggtgatgtttgaccgctgcagggtgacttcttgcagctgtacctgtggtgcaggcgcaaaatggtgcacacacgttgtagctctgtgtctcttccgcatacataacgcctctgctgtttgtctgcgtgcccctgtgtctgagagccttagtaggctccagagagatcagctgcagaaattcgcacagtatctgatcagcgaactccctcagcaggtgggcgaggtgggaaccccttcatgtaattag

SEQ ID NO: 58876 - DNA, 426 bp, Artificial Sequence
  Description of Artificial Sequence: Synthetic coding sequence
atgctccacagcatgaggttcttaagaactgatagtgcgtccgcagaccctggaaatttaaagtatagctcctcccgtgaccgtggcggttctagctcatacggactgcagccttccaattcagccgtcgttagcaggcagcgtcacgacgacacacgggtgcatgccgacattcaaaacgatgagaagggcggatacagcgtgaatggtggatccggagaaaacacttatgggagaaagtccctgggccaagaactcagagtcaataacgtgacatcaccggagttcacctcagtccagcatggtagtcgagcactggccacaaaggacatgcggaaatctcaggagcggtccatgtcctactgtgatgaatctcggctgagtaacctgctgcgtcggatcacaagggaggatgatagggactag

SEQ ID NO: 58877 - DNA, 321 bp, Artificial Sequence
  Description of Artificial Sequence: Synthetic coding sequence
ttggagtgttccggcagaatatccgcccactgcaaccttcatctcctgggctccagcgattcccctacatctgcctctcaggttgtcgaaatcacaggtacctatcaccacgtgtctctcaacttcgtgttcctggtccagatggggttcaaccacgtggtccaggcaggcctcgagctgctgacatccggtaacccaccaagttccgcatctcagagtgctgggattacaggggtctctcaccacgcctggcccttccccttcaattttgccgaacgtcagggactaactatgctgccaaggctggtcagtaattcttag

SEQ ID NO: 58878 - DNA, 324 bp, Artificial Sequence
  Description of Artificial Sequence: Synthetic coding sequence
atggggcgtgatgcaactaggattggcgagagactgcagggtgaggggaattttcagctgaatttcgtcaccataagcagcaaactgaaagtgagctggacagagtcaggaaagggggttactcaggagcgacggtatagcacagagaccggtgcgggtggagaggcccagatcttgaaagcagcctgcttcctgagcggcgaggcctggtcccttcgacaggtgttctcgccagctcatcgactgccgggtaataagctgtccgctatcggcgtgcatagtgagtcagagacaagtctctcagggtgcgtcggagcaggttag

SEQ ID NO: 58879 - DNA, 354 bp, Artificial Sequence
  Description of Artificial Sequence: Synthetic coding sequence
taggcgggtcggagggggagaactactcctcaaacgttagaatttcccggagctcagacactggccatttccaggggatgcaggtgcgcatcacctcgaagaggcagaggcggatggtggtctttgacagcgcgagttctttacatcactaataaggccggaacttttccgtttttgttggggaaatacctagaggaaaagttattgggaaactgggtggaaacgagatttagacacattgactgggccggtctggagctcctgtcttcaagtaatcgcccaagtttgacaagccagtccgcacggattactggtgtaaatcacagggccaggccttacttcctctccaaatag

SEQ ID NO: 58880 - DNA, 240 bp, Artificial Sequence
  Description of Artificial Sequence: Synthetic coding sequence
atgaagctcgctaagacagccgtcctcgaccctgctacatacactagctttagccccggactatctacctgttccagttctcagccacctggagaccgcagaaaggggctcctgggctgcgtgggcagcggacattgcccactgcccacccctgcccagttcccaaaggttcaacggccacccactttactcggaggcaagaacacctctacccagacaacattgcaccccgttatctag

SEQ ID NO: 58881 - DNA, 783 bp, Artificial Sequence
  Description of Artificial Sequence: Synthetic coding sequence
gtttgcggatccacacaggagaagacggtcttcaggctggaagccatgttggagagaaccgcaggggtgcagagtaaggaagcagcactcgaggaggaggccgttctcaaggtggaggatattatggctgaagtggaggtagtcgtagaggtggaacctgacgtggggtggcaaaaagaaggccaaagggcacagccaggacctgggccatccaccccgggtcctagtatggatagccttgaagtactccatcttgaactcgggagcgtcaatgccccaggccatagagctacaaataagcaaaaaaaaaaaaaggaaaggaaggagaatccaaacctgtggaaacctggatccaccctgcagaagccaccgcaattgtggcggtgcttattggcgagacaaaatgagatgtctgcttgggtgggcaagcacgctgaggtactcctgtgctacgtcatggatctgcaggtcgaggaactgagccaccccggataccgctggcaaatgatatctttccatcctaatctgtattttcacagcgaaataatcatgaaagaacattgtgtggggatactggggtatcgagttagccatagcacagctgttcagagattctgggaccacgagggacaggcctcatcgtgtagacagtacacctcctatttgagctccttctcctgtttggccgaacatgactgccctggcttcggtcgcattgcggaatcaacacggtcctccgcacgcgcttgtggaagcatattttgtagtaccactcaggggtag

SEQ ID NO: 58882 - DNA, 288 bp, Artificial Sequence
  Description of Artificial Sequence: Synthetic coding sequence
tctttgccagaggccctcgttcagcctggtggctcgcttaggttatcatgtgcggcttcaggcttcacctgcagcaatgcttggatgtcatgggttcggcaggctcccggaaagggactcgagtgggtaggcagaatcaagagcaaggccaacggaggcacgactgactatgctgcccctgttaagggtcgctttacaatatcacgcgtcgatagcaagaacaccttataccttcaaatgaattctctcaaaacagaggataccgccgtgtactactgcactacatag

SEQ ID NO: 58883 - DNA, 657 bp, Artificial Sequence
  Description of Artificial Sequence: Synthetic coding sequence
taacatgttgtcgctctgtgcctctttcggatacataacgcgtccgccgtctgcctccgcgctcctgtgagtgagtccctgtcgagacttcagcgcgatcagctgcagaaattcgcccagtacctaatctccgaacttcctcagcagatccttcctactgcccagcgcctgctcgacgagttactgagctcccagtcaaccgccataaatacagtatgcggcgcacccgaccctactgctggacccagtgcgtccgatcagagtacctggtatttggatgagtcaaccctaaccgataacataaagaagaccctccacaagttctgcggaccctcccctgtagtgttttccgacgtcaatagcatgtatttgagctccacggagccccctgccgcagcagagtgggcatgtctacttaggccactgcgcggtcgcgaaccggaaggggtgtggaacttgttgtccatcgtccgcgagatgttcaaacggagagattcaaacgccgctcctttgctggaaatcttaaccgatcagtgcctgacatatgagcagatcacgggctggtggtattctgtccgcacttccgcatcccatagcagtgcctccgggcatacaggacggagcaacggccaaagcgaagtggccgctcacgcctag

SEQ ID NO: 58884 - DNA, 120 bp, Artificial Sequence
  Description of Artificial Sequence: Synthetic coding sequence
cagaaaggtggagtggaagggaaatggcaggcagatgctgtcctgtcctggtgccctttggcttttgccgttgtcccctccaaacagcttagcgagctctggtatatatgttccgactag

SEQ ID NO: 58885 - DNA, 2157 bp, Artificial Sequence
  Description of Artificial Sequence: Synthetic coding sequence
atgtcgcggggttactctgagaataataacttcctgaacaacaataatcagatggtcctcgatatgatattgtaccctctgattggcataccccagacaattaattgggaaaccattgcccgacttgtgcctggattaactccaaaagagtgtgctaagaggtttgatgagctaaagtcatctggcagctcccctgtggacaaccaatacaatagcctaatggccgctggcgaatctccagttgagactcttgccacatatatcaagtcatcattgctcgacattcacggtgagttccaggagactccagtgggacatgatgccgtgtccaagaccggcagacacagcatcgcgagcacgcgcaactgctcctctgagagcgaaaattgtacaacccataatgggggagaaatgaccgaagaatcagaaggcccaaatatggttatccacgtatgtgacgaggccaagaacctgaaagaggatttcacctgtcctagagatctgctcatttcggaaatgaaatactttgctgaatatcttagcatggatgcacagcgttgggaggaggtggatatctcagttcattgtgacgtgcacattttcaactggctgatcaaatatattaagcgaaacaccaaagagaacaaggactgcgaaatgccaactctggagccagggaacgtcatcagcatcctgatttcttccgagtttctgaaaatggactcattggttgaacagtgcatccagtactgtcacaaaaacatgaatgccatcgtggctaccccgtgtaacatgaattgtattaatgccaatcttcttacccggattgccgatctgttctcacataacgaagtcgacgacctaaaggataagaaagacaagtttaagtctaaattgttttgtaagaagattgagcggctgttcgatccagaatacctaaatcctgatagccgctcaaatgctgcaacattgtacagatgctgcctatgtaaaaagctcctcacaaaggaaacggagagacgtattccatgcattccgggaaaaatcaatgtggaccggcgtgggaacattgtgtacatccatattcgtgataagacctgggacgtccatgagtacctgaactcgttgttcgaagaactgaaaagttggcgggatgtctattggagactgtgggggaccattaactggctcacatgtagcagatgttatcaagcttttctgtgtattgaattttcgcactgccagtaccactctgagacagtggtatatcctacagctgccagttcactaaacacggtgggaaccgggatctacccttgctgtaatcagaaagtgttgagattcgaccccacccagctcacaaagggctgtaaggtcagggaccacatggtaaccctaagagatcaaggtgagggtggggacctgccaagctgccccaccgctagaatgctcgacgacctgcacaaatatagagatgtgatcgttgtgcccttttcaaaggacaccgtgtctgatgtcggagttggtttgtgcgacgaaaaaggcattgaatgcgacgttcttctagaaccgaacaccccttgggggccaaaaactggggaactgaatgccttcttgtctctcaaaaactggacacttcagctcaaacagcagtcccttttctctgaggaagaggaatacaccactggctctgaggtgactgaagacgaggttggtgatgaggaagaagtaagtaagaagcaacgaaagaaagaaaagcctaaaaaattcacccgccagcctaagaagcaggtctcctccccttgtgctcagcggaaagaaaaggcgctcgagaaatccgctagtcgcgacgtaagtcccttcgtaatgagtatgcagaagaacaagtgggacgctaccagatccttgagattcaatcaagacgcacagagggaagatgaccagcgaagaatgacagaaattacgggccacttaatcaagatgcggctgggtgatctggatagggtgaaatctaaagaagccaaggaatttgcaggcggaatttactccaggttagaagctcagattaaagcttccgttcccgtgtccgccagacagtcttcttctgaaaaaaacacccggagtaagtcgaggttcgggcagggcaggcccgcatag

SEQ ID NO: 58886 - DNA, 537 bp, Artificial Sequence
  Description of Artificial Sequence: Synthetic coding sequence
gagctgagttcccaaaagactggcggaaatcttgacaggcacactgcctcaaagccaaccgctctgctacagcctggcccaggctggcaacgtggcgctgcttgttgtttacagatccttcccgagtcacgagtgtgtttccctaccgggctcccactggctcggaaagtcactaaacttagctgggtaggttataaactgcaaggaagagagcttcagtggcctgtctaccgcgaagaactggaactggagcgcctgctctggcgtaggcgtcccggagatcgggacttgagaaggactggggatttacgactcggggagagagatctgttgcttatcagaggaggagatctgagacacatcgggggaggtggtaatatcctgctcgggggactaaacttactgggaggcggactcggtcagggggcatccactgccgtggcagtgattagctggcccagcatatgcccacctccaagcatgtgtttcagcgctttctccgcaagctctggattttccaactcaacctacgcatag

SEQ ID NO: 58887 - DNA, 1713 bp, Artificial Sequence
  Description of Artificial Sequence: Synthetic coding sequence
atgcttatgtggccacagccccatctaccaacccaccctcatctgcccacccacccacatctccccacccacccacacttaccaacacaccctcacttgcccactcacccgatgatgtccaaggagactcgccagagcaagctggcagaagcaaaggagcagctcactgatcatcatcctcagaccaatcccagcgtgggtacagctgcctctgacaccaagaagaaaaagataaataatgggactaatcccgaaacaactaccagcggcggatgccactcacccgaagatgagcaaaaggcctcacatcagcaccaggaggccctccggagggaactcgaggcccaggtgcagaccatccgtattctgacatgccagaaaacagaactccagatggcactctattacagccagcacgcagttaagcagttggagggcgaggcacgcgacctgatttcccggctgcacgatagctggaagttcgcaggagagctagagcaggcactgagtgcagtggctacccagaaaaaaaaagccgatcgatacattgaagagctgaccaaggaaagggatgctcttagcctcgaactataccggaatacaattactgatgaggaactaaaggaaaagaatgcaaagctgcaggaaaaattgcagctagtggaatctgaaaaatcagagatacagctcaacgtgaaggaacttaaacgtaagctagagagagctaaactgctgctcccgcagcagcagctccaggcggaagcagaccatttagggaaagagttgcaaagcgtgagcgccaagctgcaagcccaagtggaagaaaatgaactctggaacagactgaatcaacagcaagaggaaaaaatgtggaggcaagaggagaaaatccaggagagggaagaaaaaatccaggagcaggaggagaagattcgagagcaggaagaaaagatgcggaggcaagaggagatgatgtgggaaaaggaggagaagatgaggaggcaggaggaaatgatgtgggaaaaagaagagaaaattcgggaactggaagaaaaaatgcatgaacaggaaaaaattcgggagcaggaggaaaagcgccaagaggaggaaaagatcagggaacaggagaaaagacaggagcaggaagcgaaaatgtggaggcaggaagagaaaattcgggagcaggaggagaaaatcagagaacaagaagagatgatgcaggaacaggaggaaaagatgggcgagcaggaagagaagatgtgggagcaggaggaggagatgcaggagcaggaagagaagatgaggaggcaggaggaaaagatccgggagcaagaaaagaagatccgggagcaggaagagaagatacgtgagcaggaggagatgatgcaggagcaggaagaaaaaatgggtgaacaagagggcaagatgtgtgaacaggaagccaagatgcaggaacaggaggaaaaaatgcgcaggcaggaggagaagattcgcgaacaggagaagaaaataagagaacaagaggaaaagatccgagagcaggaggagatgatgcaggagcaggaggagaagatgtgggaacaggaagagaaaatgtgcgagcaggaagagaaaatgcaggagcaggaagagaagatgcggaggcaagaggagaagatgagagagcaggaggtccggctccggcagcaggaagaaaagatgcaagaacactag

SEQ ID NO: 58888 - DNA, 399 bp, Artificial Sequence
  Description of Artificial Sequence: Synthetic coding sequence
ttcacgcaaacctatcgtagatctagacagcacgaacagttgccaggccagcgccacatggatctgttgactggatacagtaagttgatccagtctcgccttaaattgctgctgcatcttggatcacagcccccagtcggcaagactttctttttcagttgctggtgccatcccttgttccatggtagcaagacaacgcctaacgtatggtataaattttccgagaccgctcttagcatcctaaactcgtgccaagctagtcagctgggggtaaggaaaatgccaggagacatgagttcttcaccacgcgtccgcgaatttagcgctcttgtagcaattaaagaaaaaatccatattctccccacgaatgcaaaggttggcagtaaatttggcagttag

SEQ ID NO: 58889 - DNA, 447 bp, Artificial Sequence
  Description of Artificial Sequence: Synthetic coding sequence
atgaatttcacccttatggttagcatggagcacactacaactatggcctccgccacgccggcaccctggccacaccgctctcagaggtgccggcaagccgtccccggacatcctgcctcggggtgctgcggcaccggtacctttaggacccagaggcggccaggcgacaagtcccggcgtgcgggtagcaggggcaggggggctggcccaggtcgacatgacagggacagcgcccacgcaggttccatgcgaggagcaagactggttcccgcactagtgagactgcaactccgaccccctgcattgcggggagagcggactccaattagcatgccaccggctcggcctccagcgggtgttgccttcccaggtgcctcggccggtccatcaaggaccaggcgcggtgttgccacagcagggggaaggcgggcacctgccgtgatctag

SEQ ID NO: 58890 - DNA, 1599 bp, Artificial Sequence
  Description of Artificial Sequence: Synthetic coding sequence
atggatcagttcggcgatattctggaaggcgaagttgatcactcctttttcgattctgactttgaggaaggcaaaaagtgcgagaccaacagcgtttttgacaagcaaaacgacgatcctaaagagaggatagacaaggatactaaaaatgtaaattccaataccggcatgcagaccactgagaactacctgacagagaagggcaacgagaggaacgttaaattccccccagaacacccagtggaaaatgacgtaacccagactgtatcctcctttagccttcccgcttctagccgtagtaaaaaactgtgcgatgtcaccactggcctgaagatccacgtgtcaattccaaatcggatccccaagatagtgaaagaaggggaggacgattactatactgacggtgaggagtcctctgacgatggtaagaagtatcacgtaaagtctaaatctgccaagccctcaactaacgtgaagaagagcatccgcaaaaaatattgtaaagtgtcgtcatcctctagtagttcattatcttcttcctccagcggctccggcaccgactgtctcgacgccggttcagattcacatctctctgactcctccccatccagtaaatcatccaaaaaacacgtgtcaggcatcaccttgctcagtccgaagcacaagtataagtctggcatcaagtccactgagacgcaacccagctccaccacccctaagtgcggtcactatccggaagagtcagaggacactgtaacagatgtgagccctctaagcaccccagacatctccccgctacaatctttcgagctgggcatcgcaaacgatcagaaggtcaaaattaagaagcaagaaaacgtcagccaggaaatctacgaggatgttgaagacttgaagaataattcgaaatacctgaaagcggctaagaaagggaaagaaaaacatgagccagacgtaagttctaaatcctcctccgtgctggattcatcgcttgaccacaggcacaaacagaaggttctccacgatacgatggacctgaaccacctgctcaaagcttttctacagctggataagaagggccctcaaaagcatcattttgaccaacctagcgtggcccctggaaagaactactcgttcaccagagaggaggtccgccaaatagatagggagaaccagagactgttgaaagaactgtctcgacaggcagagaaacctggaagcaaatcgaccattccacgctccgctgatcatcctcccaagttgtatcattccgctctgaaccggcagaaggagcaacagagaatcgagagagagaacctggccctgttgaaaagactggaggctgtgaaacccaccgttggaatgaagaggtcggaacagttgatggattaccaccgtaacatggggtaccttaattcctcaccactgtctaggcgcgctcgatcaactctaggccagtattcgccactcagggcctctcgcacatcatccgctaccagcggcctgtcctgccgttcggagagatccgcagtcgacccatcctctggacaccccagacggagaccaaaaccacccaacgtgcggacagcctggctgtag

SEQ ID NO: 58891 - DNA, 2085 bp, Artificial Sequence
  Description of Artificial Sequence: Synthetic coding sequence
atggacttgcataagcagtgggaaaacacagagacaaactggcacaaagagaaaatggagctgctcgaccagtttgacaatgaacggaaagaatgggagtcacaatggaaaataatgcaaaaaaaaattgaagaattgtgtcgcgaagtgaaattgtggaggaaaattaacatcaacgaaagcgccaagatcatagatttgtaccatgaaaaaactattccagaaaaggttatcgaaagctcccctaattacccagacctaggacagagcgagtttatcaggaccaaccataaggacggactccgcaaggaaaataagagggagcagtccttagtgtccggaggcaaccagatgtgtaaggagcagaaagcaacgaaaaagtcgaaggtaggatttcttgaccctttggcaaccgacaatcagaaggagtgtgaggcgtggcccgacctaaggacatccgaggaggactcaaaaagttgctctggggcactgtcaaccgccttggaagaacttgctaaagtttccgaagagctctgctctttccaggaggaaattcggaaacgcagtaatcatagaagaatgaaaagcgactcctttttgcaggaaatgcccaatgtgacaaacatccctcacggcgaccccatgatcaataatgaccagtgtattcttcctatttccctggagaaggagaagcagaagaatcgcaagaacctcagctgcacaaacgtactgcagtccaactctacaaaaaagtgcggtatcgatacgatcgatctcaaacggaacgaaactcctccagtgccgccaccaagatctacttcgcggaatttcccatcatccgactctgagcaggcttatgagcggtggaaggaacgcctcgaccataattcatgggtgccgcacgagggtcgtagcaagaggaactacaaccctcactttccacttagacagcaggagatgagcatgctttatccgaatgaggggaaaacaagcaaagacggcatcatttttagcagcctcgtcccagaagtaaagatagactccaaacctccctcaaatgaggacgtaggcctgtcgatgtggagctgtgacatcggcatcggcgcaaagcgctccccctctacaagctggtttcagaagacatgtagtaccccatctaaccctaaatatgaaatggtgattcctgaccacccggctaagagccatccagacttgcatgttagcaacgattgttccagctcagtcgcagagtccagttcccctctgcgaaatttttcatgcggcttcgaaagaacaaccagaaacgagaagcttgcggctaagactgacgagttcaacaggacagtgtttcgcaccgatagaaactgtcaggctatacagcagaatcacagctgttcaaagagctctgaagatctgaaaccttgtgataccagtagcacccacacaggctcgatcagtcaatcgaacgacgtgtctgggatctggaaaaccaacgcccacatgcctgtgcccatggaaaatgtgccggataaccctactaagaagtccactacaggcctggtgcgacagatgcaggggcatctgtctccacggtcctaccgtaatatgctgcacgaacacgactggaggccgtcaaatctgtcagggcgacccaggagcgcagaccctagatccaactatggggtagtggagaaactgctgaagacttatgagactgctactgagagcgcattacagaattctaagtgctttcaggacaactggaccaagtgtaattccgatgtctctggtggcgctactctcagccaacaccttgaaatgctgcaaatggagcaacagttccaacagaaaaccgccgtgtggggcggtcaggaagtgaagcaaggcatagaccccaaaaagataactgaggagtcgatgagtgtgaacgcatctcacggcaaggggttttcacgccctgccagacccgctaatcgcaggctcccctcaaggtgggcgtctcggtccccgagcgcccctccagcactgcgaaggacgacccacaactatacaatctctctacggagtgaagctctgatggtgtag

SEQ ID NO: 58892 - DNA, 447 bp, Artificial Sequence
  Description of Artificial Sequence: Synthetic coding sequence
atgagcgttcccaaactggttaaccatgggtgggagacagaaccttgtaatccagaccctgctcttctgctcaccggagccgttccaggtgagggggagacgactttggagcgcgctctgcccagagtggttggtgaacaggaattagggtcgtggcgggaaagggcaaatagtacacccgagagacggctgtcccctgctttaaagcatgtgtccgccagaccaacatcgattcccgagacacccggagagcgtggtgccaggaccagacgggatagagccggaagagcccgaaagggagaaggagcagctgcctcaaccctgtccagcttacggggagctgcccctgaggctggccgtggggctgaagcaccggagtggtctgtgagcggcggagccgacgcagtgcctttggaaggggcacctgccgtgaggtcgaagagctag

SEQ ID NO: 58893 - DNA, 306 bp, Artificial Sequence
  Description of Artificial Sequence: Synthetic coding sequence
atgctggtcggcaatcgtgccagggagagggagctgaagcaggatagacgaggtctggagatcgcctgggacctcatgaagaggcaggactgctttcgcgaggccgcacacgggtcagcctcagagcaggtagcacttgagcctatcctctgctgtgatgaagttgccagtcaggaacaccatgaggggggaaaaggcagtcctcggcgagagtctacagtacaggtgcccggtggagaccatggcaccctcgagctgccctggtgtgtttatttccaaatcgtttctggaatcactctgcgatag

SEQ ID NO: 58894 - DNA, 213 bp, Artificial Sequence
  Description of Artificial Sequence: Synthetic coding sequence
atgtcactcccaatcggcatctacagacgtgctgtctcatatgacgacacgctggaggacccagccccaatgacaccccctccgtccgatatgggctccgtcccatggaagcccgtcatcccggaacgcaagtaccaacatttagccaaggttgaagaaggagaggccagcttgccatctcctgctatgacattatcttccgccatcgactag

SEQ ID NO: 58895 - DNA, 3702 bp, Artificial Sequence
  Description of Artificial Sequence: Synthetic coding sequence
atgggaacccgagctttctctcacgactccatattcattccagacgggggagcagagtccgagcaaacagtccaagcgatgagccaggacaacattctggggaaagtgaaaacattgcagcagcagctggggaaaaacattaaatttgggcaacgtagccctaatgctattccaatgaacaaggccaatagtggcgaagccagtcttgaggaggatctttttctgaccagtcccatggaaatcgtgacccaacaggacattgtgctttccgacgctgagaataaaagctcagacacaccttccagcctaagtccgctgaatctgccaggagccggatccgagatggaggagaaggtagcacccgttaagcctagcaggcccaaacgtcatttttcgagcgctggcacgatcgaatccgtcaatcttgatgcaatccctttggctatcgcccgactggataattctgcagcaaagcataaactcgcagtgaagcccaaaaagcagcgcgtttctaagaagcaccggcgactcgcacaggacccacagcacgaacagggaggactggaatccaggccttgtttagaccaaaatggccatcctggcgaagataagccaacctggcacgaggaagagccaaacccgctggactccgaggaggagcggagaagacaagaggattactggcgggaattggaggcgaaatgcaagagacaaaaggcggaagctgccgaaaagagaagactggaagagcaacgacttcaggccttagagcggaggctatgggaggaaaacagaaggcaggaactgctggaggaggagggggagggccaggaaccccctttggaagcagagagggctcccagggaggaacagcagcgttctctggaagcacctggatgggaggacgccgaacgcagggaacgggaagagagggaaagactcgaagctgaggaggagcgcaggcggctgcaggcacaggcccaggccgaggagaggaggcgtctcgaggaggatgccagactggaagagaggcgtagacaagaagaagaagaaggacgctgtgccgaggaactgaaacggcaggaggaggaggaagcagaaggctgggaggagcttgagcagcaggaggctgaagtgcaaggacctcccgaagcactggaggaaaccggcgaggggcgaaggggagcagaggaagaagacctcggcgaggaagaagaagaagggcaagctcatctggaggattggagaggtcagctgagcgaacttctgaatgattttgaggagcgcttggaagaccaggagcggctcaagccagaagggcaacgggaacactccgaagaacccggtatttgtgaggaacagaaccccgaggcagagcgacggagggaacagcagggtcgcagtggtgacttccagggggctgaccgcccaggaccagaggaaaaacgggaggagggagacacagagccactgctcaagcaggagggacccgttgaggccgctcaacctcctgtcgagaggaaggaggccgctgctctcgaacaggggaggaaagtcgaggaactcagatggcaggaggtcgatgagcggcaaactatgccgcgaccctatacattccaagtttccagtggtggcaagcagatcctgtttccaaaggtcaacctttcacctgtcactcccgctaaggacaccggactaactgccgctccccaggagccaaaggcacccaaggcaagccccgtccagcatgctctgccgtcatctttgagcgtgccgcataccgcgatcctagttaccggggctcaactatgtggtcctgctgtgaatctgtcccagattaaggatacggcctgcaaaagcctcctggggttggaggagaaaaagcacgctgaggctccagccggtgagaaccctcctagaggccctggtgacgcaagagcagggtcaggaaaggctaagccgcgacaagagagtccttccagtgcaagcgctctggccgagtgggcttccattcgttcaagaatcctgaaaaatgccgaaagtgaccccagatccagcgagcgcgaccaactacgccctggagacgagtcaacgcccagaggacgctgtgattcccggggaaatcaacgtaaaactcctcccgtgaacgctaagttttcaataatgccagcatggcaaaaattcagcgatggcggaaccgagactagcaaacaatcgacggaagctgaatctattcggaagcgcccaatgctgggcccttccgaggaaacagctccgcaaccccctccggctggcgtgagggagttgggaaaggggccagagaagagcgagatgcatagggagcccgcagacacaactgaggggtgtaagtttgccaaggatctacccagttttttggttccgtccttgccctaccctccccagaaagttgtggcacacactgagttcactacctcaagcgactctgagactgctaatggcattgctaaaccagatccggtcatgcctgggggtgaggaaaaagcgtctcctttcgggattaagctccgcaggaccaactacagcttgagattcaattgcgaccagcaagctgagcaaaaaaagaaaaaacgccacagttcaaccggcgactctgcagatgccggaccacccgctgccggatccgccagaggcgaaaaagagatggagggagtcgctctgaagcacggaccatctcttccgcaggagcgaaaacaggcgccaagcacaagacgagatagtgccgagccatctagctctcgctctgtacctgtggcacaccccggtccgccacctgcctcctcacagacgccagcccctgagcatgacaaggctgccaacaaaatgcccctggctcaaaaaccggcattagctccaaaaccaacatcacagacacctccagcgagccccctgagcaaactgagccggccttacttggttgagctcctatcacgacgggctggcagacccgatccggagcccagcgagccatcaaaggaagaccaggagtcatctgatcggcgacctccttccccacccggacctgaagagcggaaagggcagaaacgagacgaggaagaggaggccaccgagcgaaagcctgcctctccacccctcccagcaacacagcaggagaagccctcgcagacacccgaagccggaaggaaggagaagcccatgcttcagtcaagacactcgctagacggcagcaagctcaccgagaaagtggagacggcacagcctctctggatcactttggcgctacaaaaacagaaggggtttcgggaacagcaagctactcgagaagaacggaagcaggcgcgagaggccaagcaagctgagaagctgtccaaagagaacgtgtctgtctcagtccaacccggttccagctctgtgagccgagcaggctctttgcataagtccacagcgctgcctgaagagaagcgcccagagaccgcagtatcccgactggagcggagagagcagctcaaaaaagctaacacccttccaactagcgtgaccgttgaaatcagcgatagtgctccacccgctccactcgtaaaggaagtcactaaaaggttcagtaccccggacgcggctcccgttagcacagaaccagcttggctggccctagccaagcggaaagctaaggcttggtccgattgcccccagattatcaaatag

SEQ ID NO: 58896 - DNA, 198 bp, Artificial Sequence
  Description of Artificial Sequence: Synthetic coding sequence
atgagtctgccaatcgggatttaccggcgtgctgtgtcctacgacgacactttagaggaccccgctccaatgactcctcccccttccgacatgggctccgtcccctggaagccagttataccagaacgaaagtatcagcacctggctaaagtggaggaaggggaggcatccctgccctctcctgctatgacattgtag

SEQ ID NO: 58897 - DNA, 288 bp, Artificial Sequence
  Description of Artificial Sequence: Synthetic coding sequence
atgtcgctccccattggaatctatcgacgcgctgtgtcatacgacgacacactcgaggatccagctcctatgaccccgcctccttccgatatgggctcagttccgtggaaacccgtgatccctgagaggaagtaccagcacttggccaaagttgaagaaggagaagccagcctaccgagcccagcaatgaccctgagttccgccatcgattctgtggacaaggtccccgtcgtaaaggccaaagccacgcacgtgattatgaattcactgatcactaagcagacctag

SEQ ID NO: 58898 - DNA, 2130 bp, Artificial Sequence
  Description of Artificial Sequence: Synthetic coding sequence
atggatcagaaactttcaaaactcgtggaagagctgactactagtggcgagccacgtcttaatccagagaagatgaaggagttgaagaagatatgcaagagttccgaggaacaactgagcagagcctatcggctcctgatcgcccagctgacacaggaacatgcagaaatccgactttctgccttccagatcgtcgaagaactttttgtccgtagccaccagttcagaatgctggtggtgagcaactttcaggagttcttggagcttaccctgggcaccgatccagctcaacccctgcctccccctcgcgaagccgctcaacggctgcgccaagctacaacacgggcagtggaggggtggaacgagaaatttggggaggcgtataaaaagctggccctcggttaccacttcctcaggcacaataagaaggtagattttcaggatactaacgccagatctttggccgagaggaaaagggaggaagaaaagcagaaacatctcgataagatttaccaggagcgagcatctcaagcagagagggagatgcaggaaatgtcaggcgaaatcgaatcatgccttactgaggtggagagctgttttcgcctgctggtgccctttgatttcgaccccaatccagagacagaatcgctgggtatggcttccggtatgagcgacgccctccgttcctcttgcgccggtcaggtagggccatgtcggtctggcacccctgacccgagagacggcgagcagccatgctgctctagagacttgcctgcatccgctggacaccctcgcgctggcggaggcgcacagccttcccagaccgccactggagacccttctgacgaggacgaagactccgatctcgaagagttcgtgcgcagccacggattgggttctcacaagtatacgctggacgtagaactgtgtagtgaaggactgaaagtgcaggagaacgaagacaacctggccctcatccatgccgctagagataccctcaagcttattcgaaataaattcctgccggctgtgtgctcatggattcagagatttaccagagtgggtacccatggcggatgccttaagcgcgcaatcgatctcaaagctgaattggaattagtgctcaggaagtacaaagagcttgacattgaaccggagggcggagaaagaaggcggaccgaagcgctgggggacgccgaggaagatgaagatgacgaagacttcgtcgaggtgcccgagaaggagggctatgagccacacatccctgaccacctgcgcccagagtacggactcgaggcagcccctgaaaaagacaccgtcgttcgctgtctccgaactcgaacacgcatggacgaggaggtgagcgatccaacttctgctgccgcacagctgcgccaactacgtgaccatttgccgccaccaagttccgcctcaccatctcgggctctcccggagccacaggaggctcaaaaattggctgcagagcgtgccagagctcccgtcgtgccttatggggtggatctccattactggggacaagagctgccaaccgccggtaagatcgtcaaatctgactctcagcaccgcttctggaagccgagtgaagtggaagaagaagtggttaatgccgatatctcagagatgctgagatctaggcacatcacttttgccggaaaatttgaaccggttcagcactggtgccgcgcacctcgacccgacgggagactttgcgagaggcaagatagacttaagtgccctttccacggtaaaatcgtgccacgggacgatgaggggagaccactcgaccccgaagatcgagccagagaacaacggagacagctgcaaaaacaggaacggccagagtggcaggatccagagcttatgcgggatgtggaggctgcaaccggacaggacttggggagtagcaggtactccggcaagggtaggggcaagaaacggagataccctagtttgaccaatttgaaagcccaggccgacacggcaagggcgcgaattggccgaaaggtctttgccaaagctgcagtgcgtagggtcgtggcagcaatgaaccggatggaccagaaaaagcatgaaaagttctccaaccagttcaattatgctctgaattag

SEQ ID NO: 58899 - DNA, 168 bp, Artificial Sequence
  Description of Artificial Sequence: Synthetic coding sequence
gaggtgtctaatcccttcgacggactcgaagaactgggaaaaacattggaggactacactcgtgagttcattaatcggatcacacagtcggagttgccggcaaagatgtgggactggttcagcgaaacttttcggaaggtaaaggaaaagctcaagaccgactcctag

SEQ ID NO: 58900 - DNA, 228 bp, Artificial Sequence
  Description of Artificial Sequence: Synthetic coding sequence
atgtacccaatctgcactgtggttgtcgacggccttccaagtgaaagtagttcctccagctaccccggacctgtatcagtgtccgagatgtcactgttgcatgctctaggacccgtgcagacctggttgggtcaggagctggaaaaatgtggaatcgatgcaatgatctacacccgatacgttttgagcttgcttctgcacgactcctacgactatgatctgcagtag

SEQ ID NO: 58901 - DNA, 918 bp, Artificial Sequence
  Description of Artificial Sequence: Synthetic coding sequence
atggcttcccgccagcctgaggttcccgctctcgaagcatctgcccctttaggcaagatgtcccttccaatcggtatctatagacgtgctgtttcttacgatgatacactggaggaccccgcacctatgactccaccccctagcgacatgggctctgttccgtggaaacccgtcattcccgaaaggaagtatcagcacctggctaaagtcgaggagggagaagcctccttacctagtcctgcaatgacgttgtcatccgcaattgactctgtggataaagtacccgttgtgaaagcaaaggctacccacgtcataatgaatagcctgatcaccaaacagacacaggagtccatacaacatttcgaacggcaggctgggctgagggacgccggatataccccccacaaaggccttactaccgaggagaccaagtacctgcgagtagccgaggccctgcataagcttaagctgcagtccggagaggtaacaaaagaggagcgacagcctgccagcgctcagtccacaccgtccaccacccctcacagttcacccaagcagagaccgcgaggatggttcacctcagggtcgtctaccgcccttcccggtcctaaccctagtacaatggacagtggctctggtgacaaggatcgaaacctaagcgacaagtggtctctgttcgggcctaggtctttacagaagtatgatagtggctccttcgctactcaagcgtaccgaggcgctcagaaaccaagccctttagagctgatcagagcgcaggcgaacagaatggccgaggacccagcggctctgaaacctcccaagatggacatccctgtgatggagggaaaaaagcagcctcccagggctcataacctgaagccacgcgatttgaatgttttaacgcctacagggttttag

SEQ ID NO: 58902 - DNA, 2130 bp, Artificial Sequence
  Description of Artificial Sequence: Synthetic coding sequence
atggatcagaagctatccaagttggtggaggagctcaccacatctggagaaccacgacttaatccagaaaagatgaaggaactcaagaagatatgcaagtcaagcgaggagcagttatcacgcgcttataggctgctaatcgcgcagctcactcaagagcacgctgagattaggctgagcgcattccaaatagtcgaggaactatttgttcgaagccatcagttccggatgcttgtcgtgtccaattttcaggaattcctggaactcacactggggactgatccagcccagccccttcctcctccgagagaggccgcacagagattacgtcaggccaccacgagagcggtggagggatggaacgagaagttcggagaagcctacaagaagttggctctggggtatcactttctgcggcacaataaaaaagtcgatttccaggatactaacgccaggtccctcgccgagagaaagcgggaagaggagaagcagaaacatcttgataagatctaccaggagagggcctctcaggccgaacgggaaatgcaggaaatgagcggcgagatagagagttgtctgacagaagtcgagtcttgtttcagactccttgtgccctttgactttgaccccaatcccgagaccgagtcactcggtatggcttcaggcatgagcgacgcactgcggtcgtcttgcgccggtcaggtgggtccctgccggtcggggacccccgatcctcgcgacggggagcaaccatgttgctccagggatttaccagcctcagccggacaccccagggctggaggaggcgcacaaccaagccagacagcaacaggcgatccatcagatgaagacgaggactcagatttggaagagttcgtgcgatcacacggccttgggtcacacaagtacacgctcgacgtcgagctgtgtagtgaaggtctgaaggtacaggagaatgaagataacctggctttgatccatgccgcacgagatacattaaagcttatccggaataaattcctgcccgctgtctgcagctggatccaacggttcaccagggtaggaactcacggaggctgcttgaagcgtgccattgacctgaaggctgagcttgaattggtgctgcggaagtataaggagctggacatcgaacccgaaggaggtgaacgtcggcgaaccgaagctctgggcgacgctgaggaggacgaggacgacgaagattttgtggaggttcccgaaaaggaaggttatgagccacatatcccagaccacctgcgccctgagtacggtctggaggccgcaccagagaaggatacagtggttcgctgtcttcggactagaacgcggatggacgaggaagtgtctgaccccacatccgcagccgctcaactcagacagttgagggatcatctgcccccaccgtcatccgccagtcccagccgagcgttgcctgagccacaggaggctcaaaaactagcggcagaacgtgctcgcgcacctgtcgtgccttatggagtggacttgcattactggggccaggaattgcctactgccggtaagatagtgaagtcggattctcagcaccggttctggaaaccttcggaagttgaagaagaggtcgtcaacgccgacatcagcgagatgctcaggtcaagacatataacgtttgcaggtaagttcgagccagtccagcattggtgtcgtgcccctaggccggatggaagattatgtgagcgacaggatcgcctcaagtgccccttccatggcaaaatcgtgccaagagacgatgagggtagacccctcgaccctgaagacagggccagggagcagagacggcagctgcagaagcaagaacgacctgagtggcaagaccccgagctgatgagagacgtggaggcagcaacaggccaagatctggggagcagccgctacagcggcaagggcaggggaaaaaaaaggcggtaccccagccttaccaaccttaaagcccaggccgatacagcaagagctcggattgggcgaaaggtcttcgccaaagctgcagtacgcagagtggtggccgctatgaatcgcatggatcaaaagaagcacgaaaagttctctaatcagtttaactatgctctgaattag

SEQ ID NO: 58903 - DNA, 783 bp, Artificial Sequence
  Description of Artificial Sequence: Synthetic coding sequence
atggacgaagaagtctcagatccgactagtgctgccgctcagctgcgacagctacgggatcacctcccccctcccagttccgcttccccttctcgggcactccccgaaccccaggaggctcagaaactggccgcagagcgagcgcgtgctcctgtcgtcccatacggtgtcgaccttcactattgggggcaggagttacccacagctggaaagattgtcaaatctgatagtcagcaccggttctggaagcccagtgaagtggaagaagaggtcgtaaacgctgacatatccgagatgctgaggtctaggcatattacgttcgccggaaagttcgagccagtgcaacattggtgccgcgcaccccgacctgacggacggctgtgcgagcgtcaggatcgccttaaatgcccctttcacggcaagatcgtgcctagagatgacgaaggacgccctctggatccggaggaccgagcgagagagcaacgtagacagctgcagaaacaggagcgcccagaatggcaggatcctgagcttatgcgagacgttgaagctgcaactggacaggatctggggagcagccgttactcaggtaagggacgcggtaaaaagcgtaggtatcccagcctcactaacctgaaggctcaggcagacacagcccgtgcaagaattggcagaaaagtctttgcaaaagccgcagtcagaagagttgtcgcagccatgaataggatggatcaaaagaaacatgaaaaattcagcaaccaatttaactatgctttgaattag

SEQ ID NO: 58904 - DNA, 783 bp, Artificial Sequence
  Description of Artificial Sequence: Synthetic coding sequence
atggatgaggaggtatctgatcctacgagtgcggcagcccagcttcgacagctgcgtgaccatctcccccctccatcaagcgcctccccctctcgggctcttcccgagccacaggaagcccagaaactagccgctgagagagcacgggctcccgtcgtgccatacggtgtcgatctccactactggggacaggagcttccaacagccggaaagatcgtcaagtctgattcacagcatcgattctggaaacccagtgaggtagaggaggaggtcgtcaacgcagatatttcagagatgttgcgcagccgccacattacttttgcaggcaaatttgagcctgtacagcactggtgccgcgcacctcggcctgatgggaggctctgcgagcgccaggaccgacttaaatgcccattccacgggaagattgtcccccgagacgatgagggacgtcctcttgatcccgaggatcgagccagagaacagcgcaggcagctacagaagcaggagcggcctgagtggcaggaccctgaactcatgcgagacgtcgaagccgctaccgggcaggacttaggaagttcgcgttactctggcaagggaaggggaaagaaaagaagataccctagcctcactaacctcaaagcccaggccgataccgcacgagccagaataggccgaaaagtcttcgctaaggccgcagtaagacgggtcgtggccgcaatgaacagaatggaccagaaaaaacatgaaaaattctccaaccagtttaactacgctctgaactag

SEQ ID NO: 58905 - DNA, 3828 bp, Artificial Sequence
  Description of Artificial Sequence: Synthetic coding sequence
atggactgggacgatgagtacagtcacaactcattcgatcttcactgtttactgaacagtttcccaggcgatctggagtttgaacaaatcttctctgatatcgatgaaaaaattgaacagaatgcagcttccattaaacattgcatcaaagagatccagtcagagataaataagcagtgtccaggagtgcagcttcagacaaccactgactgttttgagtggcttactaactataattactccacatccgaatcttccttcatttctcatggtgacctgatcaagttttttaaaacgctgcaagacctgctgaagaacgaacagaatcaggaggagatgactctggacttgctgtgggatcttagctgtcacagcagcgtgagtttcccttccactttgagtggcactagctttcacttcctgagccgaacatctctgcactcagttgaggataacagttctatggatgtcaagtccatgtgggacgacatccggttacatcttaggcgttttctcgtcagtaagcttcagtcccacaatgagatcaacaactcccaacagaaaatcctactaaagaaacagtgtttacagcaactgctgttcctgtacccagagtccgaggttatcataaaatatcagaatatccagaataaactccttgctaatctgctgtggaactgcttcccctcctacaatcgggattcaaacttggatgttatcgctcacgggtaccagagtactatgctcaagctatattccgtgataaaggaggacttcaacactctctgtgagattctggcccctagctcgatggtaaagtttattaaagagacatacctcgacaccgttaccgaggaaatggctaagtttctggagaacttttgtgaattgcagtttagagagaatgctgtgagggttgtgaagacatccaagagtagctcaaagcatcgtggcgcagtgcacgctcttgtaaccacagagtgcccacagaaggggagaaatttcagtctgcctcttgacaaagtcgagttcctgtcacaactgataaagtcattcatgaagctggagaagggcgtacaagagctgtttgacgaaatccttctctctctaaaaattactcgggatacaagtggcatattggagaagtccgaccgggaagtggtgatggagaagccaagggctaacgaaactaacataccctccgagcagagtctgccaggtaaagaggccaccctgctggattttggatggcgcagtgctttcaaagaagtgtccttgcccatggctcactgtgtcgtgactgccatcgagggattctcgacaaaaattctccagcaggaacagaacgaaagaagttcggcggtgagctatgctatgaacctcgtcaacgtgcagcaggtgtggcaggactcgcatatgttccctgaggaggagcaaccaaaaaaaatcgggaagttttgctctgacatcatggagaagctggacactatgctcccactagcactggcatgccgagatgatagttttcaggaaatcagggccaatttggttgaggcgtgctgtaaagtggctaccgctgttctgcagcgacttcaggagagagcgaaagaggtcccctctaaagcacctctgaaaaacctccacacatatctgagcacagctgtgtacgtttttcagcactttaaaagatatgacaacctaatgaaagaaatgacaaagaaacccatcttcctcgttctcgtgcagcggtaccaggaatttataaacacgctgcagttccaagtcaccaactactgcgtgagagtatgtgccaccagcatcctgcaggatgctgagtcccaccactgggacgactacaaagccttttacgagggggagaggtgttcattttccatccaaatgtggcattacttttgctggagtctgcactatgacctttggaccatcctcccacccaagcttgcgcaggagatattggtggaggttctcgaaaagtccctctctctgctcgctagtcgttatgcccgtgctcatccctctcgcaagcggactccgcaactacgcctggatgtcaccaccattctgatttgtaccgaaaacatgctgtggtcagtctgtacctctgtacagaagttactcaatcctcatcagcataccgacgacaaaattttcaagattcatacacattgtaataatctgttcacgaccctagtgatccttacgagccccctcacggaattgtacaagaccttccaacatgggctcgatgagtccgcttctgattcactgaaatccttcttcaagcaacctctttactgggtgagctgcattagtcacttctatccttccctcttacgaaccccgagcgccggtggactgaaagctgaagggcagttaaaactgcttttgtcgcagcctagatgtaactggaaccttttacttgaaactctgctgcaccacgatggcttattgctgcggattctgctgaagtcctccaaacaggtttcggatacggagaataatctcaaccaagggccatcattgatggaagctatttttaaaatcctgtatcattgcagttttagcccccagacatttgcgaacgtctttgtgagctacatggaggaggagcaactgtgggattttctttacaacatcccagtgagtacctgcgtggaatatgagctcgaagtgatccggtgtcttagactggccctgactgacgctatcaaagacacagtgcagcaaatcgtcagtgtcatgtcaagcagacggaactgcgaaacaaatttgaacaaacatattgtgccggattgtctgctggagtctatgccgaaggagtggaactattcccctaaagaaacgaaccggaaagagagctgcaagagctttactcgcttgacagcacaggccgtttcaatcgtgatttccaagctccccacggtgatagcctgcctccccccaccagtcaagtactttttcttcttatctgagaggaaaatgtctaaaaagttcgtcgagctgaagaaagccggactgctggtgtggaacctaatcgtgatcatatgtcgcatcttcgaggatggcaataccgtcgagctactgaccggggcatccctcgaccgctggtcaaaggagaagttaggcttgatttgcatgtgtctgaagtccatcatgggcgaccagacttccattcataaccagatgatccagaaagtgatccagtccatcgaacagcagaagcccaactggatagagagacagctgttgaaagcccgtaaactgtcaaccgaatgtgcctttatgactatcgagaagtccaccgcactgcaggaaggggacgtagctcttgagttgacagagcagaaaattaatacaatggtcttagatctgtgccataagccaggcggtcgggagtatctgcgacagatctatcacataatgcagcttaacgaagagtatctgaaggaacaattgttctctatgaattcatcggaggagaagccgctgccaattaggccattaaaaactactttgagatctattgaagatcagcctagcgctttcaacccgtttcacgtttataaggcctttagcgaaaatatgctcgaccaaagtgccattacaaagtggaattggaactgggcaaaactcctacccaactatctgcggctggacaaaatgactttttcagtactcctgaagaatcgctgggaaatgaaaaaggatgaaactctggaagaggaagagaaagcaatcctagaacacctcaaacagatttgcacaccccagaatagctctgcatccgataacatagaggagcagtag

SEQ ID NO: 58906 - DNA, 288 bp, Artificial Sequence
  Description of Artificial Sequence: Synthetic coding sequence
atggcttcctcacactggaacgagacaaccacctccgtgtaccaatatttgggcttccaggtgcaaaagatatacccgttccacgataattggaatactgcctgttttgtgattttgctcttgttcatattcaccgtagtgtccctagtggttctagcctttctatacgaagtgctggattgctgctgttgtgttaaaaataaaacagtgaaagatctgaaatccgaacccaatcccctccgctccatgatggacaacatccggaaaagagaaacggaagtggtgtag

SEQ ID NO: 58907 - DNA, 354 bp, Artificial Sequence
  Description of Artificial Sequence: Synthetic coding sequence
atggagacaaaaaagctgattggcaagccgttgcagcccgctcggcctgtgagacacctaacctctcctcccggagccgttttcccctttaactttcagaatgagtacccctgtaacacccagtgcatccagagcggggtgtcacgctgtaaaactaatggaatgcaggcattcagccaaggtctcaacgaacagcagcagcaacaaagccctgttaagaaagagcgtataaagtatagccgtgacttcctgctgaaactgtcttccgtgtcgatttgtaggaagaaacctgatttcctccctgaccaccccattgtcctacagaagcctgagaataaccagtcatttaaatag

SEQ ID NO: 58908 - DNA, 339 bp, Artificial Sequence
  Description of Artificial Sequence: Synthetic coding sequence
ctgcaggaccggatcgcaacattttttttcccaaaggggatgatgttgacgactgccgcattaatgctctttttcttacacttaggtatctttatcagagatgtgcacaatttttgcatcacttatcattacgatcatatgtctttccactacactgtggttctgatgttcagccaggttatctctatttgttgggccgcaatggggtcgctgtatgccgaaatgacggaaaacaacgctcaacgtagccatgtgctgcagccacccgtgctgggagtctctgggcacagagtcccaggcggagcacctcttaggccaggagagagcgaacaaggttag

SEQ ID NO: 58909 - DNA, 6707 bp, Artificial Sequence
  Description of Artificial Sequence: Synthetic coding sequence
atgcccctattcttttccgctttactggtcctgctattggtggctctctccgcattgttcctggggaggtggttggttgtccggctcgcaacaaagtggtgtcaacggaaactacaggcggaactgaagattggatcttttaggttcttctggatccagaatgtcagccttaaatttcaacagcaccaacagaccgtagaaattgataacctctggatatcctcaaagctcctttctcatgacctgccgcactacgtggccctctgttttggcgaggtacgcatacgcacagacctacagaaagtttccgatctgtcagccccattttctcagtctgcaggcgttgaccagaaggagctgagtttcagccctagccttctgaaaatcttttgccagttgttttccattcatgtagatgcaattaatatcatggtgttgaaggtcgacacatcagagagtctgtggcacatccagatttctcgcagcagatttttattagatagcgatgggaagcggctgatttgcgaggtgtctctgtgtaaaataaattctaaagtgcttaagtctggccagctcgaggacacctgcctggtcgagctgtctctcgctctcgatctgtgtctgaaggtgggcatttcaagcagacacctgacagccattactgtagatgtatggacactccatgctgagctgcacgagggactattccagtcccagctcttgtgccaggggccatccctggcaagtaaacctgtgccgtgctctgaagtgacagagaatctggtggaaccgactttgccgggtctatttttgctccagcaactgcccgaccaggtaaaggtgaagatggagaatacatctgttgtgttatctatgaactcccagaaacggcacctgacttggacgctgaaacttctccaattcctgtaccacagagatgaagaccagctacccctacgatcatttaccgccaactcagacatggcacagatgtccaccgaattgctactggaggacggcctgttactgtcgcagagccgacagagaatagtctgcttgaattcccttaaggccagtgtgcaagttacaaccatagacttgagtgcaagcttagtcttgaatacctgcattattcattataggcaccaggagttcagtcactggctccatctgctggccctggaaacacagggatctagttctccggtgctcaagcagagaaagaagaggacatttccacaaatcctggctccaatcattttttcaacatctattagcaacgtaaacatctccatccagctcggtgacacacctccttttgctctgggtttcaacagtatatcgctggactatcagcatttgagacctcagtccatccaccagcgaggagtgctcaccgtggatcacctatgctggcgagtcgggagcgattcccacatccagagggccccacacccgcctaacatgcacgtgtggggcgaggcattagtgctggattccttcacactgcagggcagttacaaccagcccctagggttgtcaagcacccaaagcgataccttgttcttagactgcacaattcgcggactccaagtggaagcatctgatacttgcgcgcagtgtctgagcaggattctgtccctgatgggaccccagtccggcaagtcagcggtgtctaggcactcaagctttggagagagtgtttccttgctctggaaagtcgatttgaaggtcgaagacatgaatctgtttactctttctgcactggtgggcgcaagcgaggttagacttgataccctgaccatcctggggtccgccgaaacatccaccgttggaattcaaggattagtgctggccctggtcaagagcgtgacagaaaaaatgcagccctgttgtaaagcccctgatatacctacacctgtattgagcttgtctatgctttccattacctaccatagctctatccgcagcctggaagttcagtgtggggcagggcttaccctactgtggagtcccccagatcatatgtacctgtaccagcacgtattggcgacgctccagtgtcgggatcttttgagagcgaccgtcttcccggagaccgtgccaagcctggcactggaaacctctggcactacaagcgaactggagggcagagcaccggagccattgccgcctaaacggttactgaatctcactcttgaagttagcacggctaagctgacagcctttgtggccgaagataagtttataaccctggcagcagaaagtgtgtccctctcccgccatggtggatctctccaggcatattgccccgaactcgccgcagggttcgatggaaacagtattttcaattttaaggaggtggaggtccagctgctgcccgaactagaagagatgatcctgcatagaaaccctttccctgctctgcaaacattacggaaccgcgtgtggctgttgtcttttggcagtgtgagcgtcgaatttccttaccagtacgatttctccaggacactcgacgaggccgtgggagttcagaagtggcttaagggactgcatcaaggaacacgcgcatgggcttctccaagcccggtccccttgccacctgacctgctgcttaaggtggaacattttagttgggtctttttggacgatgtgtttgaagtcaagctgcacgacaactatgagctgatgaaagacgagtcaaaagagagtgccaaacgattgcaactccttgatgccaaggtggccgctctgcgaaaacagcacggcgagttattaccagctagaaaaatcgaggagctctacgctagcttagagaggaaaaatattgagatttacattcagaggtcccgccgactttacggcaatacccctatgaggagggccctgctgacttggtctttggccggactggagctagtggctttagcagatgcctcattccatgggcctgaacacgtcgttgagcaggtgcaggaactagatcctggcagcccattcccgcctgagggattggatctcgtgatccaatggtgcaggatgctaaagtgcaatgtgaagtcttttcttgtcaggattagagattaccctcggtaccttttcgagataagggactggagactcatgggtcgccttgtgggcaccgaacagtcaggccagccttgctctcgaaggcgccagattctgcatctcggtctgccctggggcaacgttgccgtcgaaagaaatatgccacctctgaaattctatcacgactttcacagtgaaattttccagtacactgtcgtatgggggccatgttgggaccctgcttggaccttaataggccagtgcgttgatctacttacgaagccttctgccgatccgagccccccattgccttggtgggataagtccagactcctcttccacggtgactggcacatggacatcgaacaggcaaatttacatcaactggctactgaggatccttacaacaccacagaaaacatgcattgggaatggagccatttgagcttccattggaagccagggcagtttgtgtttaagggagacctggatataaacgtgagaactgccagtaagtacgatgattgctgctttctgcatttgcctgatctgtgcatgacgctggatctccagtggctctgccacgggaaccctcatgaccaccacagcgtcactcttcgggctccagaatttctgcccgaggtacctcttgggcagctgcatgactcatatcgagcctttaggtcggagaatctgaacctatcgatcaaaatggacctgactcgacactcaggtactatctctcagcccagaatcttactatactcttcaaccttgaggtggatgcagaacttctgggccacctggacctccgttacgaggcccatctgtcgcggaaaactgtttaacaatctcaagccaagtaagaaaaaattgggccagcattacaagcagctgagctacaccgcgcttttcccccaattgcaggtgcactattgggcttcattcgcacagcagaggggcatccagatagaatgctcccagggccacgtgttcacacgaggaacccagcgtctcattccgcaggcgggaacagtgatgcggaggctcatctcagattggtctgtgacgcagatggtgagcgacttatctcaggtgactgtgcacctgatggcaagcccaaccgaggagaacgcggaccattgcttagaccctcttgtgactaaaacccacctcctaagcctttcgtctctcacctaccagcggcactccaatcgaacagctgaagaagagctaagcgctagagacggggacccaacttttcacacgcatcagttgcacttggtcgatttgaggattagttggacaacaactaatcgagacatcgcctttgggctgtatgatggatataaaaaagcggcagtgctcaagcggaacctttcaaccgaagctctcaagggcctgaagattgatcctcagatgccagccaaaaagcccaagcgcggtgtacctacctcagccagtgcccctccacgcgtcaatacaccctcatttagtggccagcctgataagggctcatccgggggagcttatatgctgcagaaactcattgaggagaccgacagattcgtggtctttaccgaagaagagagcggaatgtcggatcagctttgtgggatcgccgcttgtcagactgacgatatctataatcggaattgtctcatcgagctggtcaactgtcagatggtgctgcgcggagccgaaaccgagggctgcgtcattgtttctgctgctaaggcacaactcctccagtgccagcaccaccccgcttggtacggtgacacactgaaacagaagacgtcctggacttgccttcttgacggaatgcagtactttgctacaaccgaatcatcacccacggagcaggacggtcgccagctgtggctcgaggtgaaaaatatagaagaacacaggcagcgcagcctggattcggtgcaggagttaatggagagcggtcaagccgtagggggtatggtgaccactacaacagattggaaccagcccgctgaagcacaacaggcacagcaggtccagcgtatcattagccgctgcaattgccgtatgtattacataagctactcccatgatattgatccagagcttgccacacaaattaaacccccagaagtgcttgaaaatcaagagaaagaagacttacttaagaagcaggagggggctgtggatacgttcactttaattcatcacgaactggagatttcaaccaatcctgcccagtatgcaatgatcctggacattgtgaataatctcctcttacatgtggaacccaagcgcaaagagcactccgagaaaaaacaaagagtgcgctttcagctcgagatctcttctaatcctgaagagcaaaggagttcgattctgcacctgcaggaagcagtgcggcagcatgttgcacagatccgccagctggagaagcagatgtatagtataatgaagtccctgcaggatgatagcaaaaacgagaatctgttggacctgaatcaaaaacttcagttgcagttaaaccaggagaaagcaaacttgcagctggaatctgaagagctgaacatccttattagatgttttaaggacttccagctgcagcgcgcaaataaaatggagctccgcaagcagcaggaagatgtctcagtagttaggaggactgaattctacttcgcacaggcgagatggcggctgactgaggaggatggacagctgggcattgccgagctagaattacagcgattcctatactccaaagtgaataagagcgacgataccgccgagcacctcctggagctgggctggttcaccatgaacaacctcttgcctaatgcagtgtataaggccatattgcgaccccaatcctcctgccagtctgggagacagctggcactacggctcttttcgaaagttcgtccaccagtggggggaatttctgttaaagagcatttcgaggtgaacgtcgtgcccctcactattcagttgacgcatcagttcttccacagaatgatggggttcttttttcccggtcgtagcgtcgaagatgacgaggtgggagacgaggaggacaaatcaaagctagtgaccacgggtatccccgtagtaaaaccacggcagttgattgcaacagatgacgcagtcccactcggaccagggaaaggcgttgcacaggggctgactcggtcctcaggtgtgcgccgttctttccgcaagtcacctgagcatcccgttgacgatatcgataaaatgaaggaacgcgcagccatgaataattctttcatctacatcaagatacctcaggtgccactgtgcgttagttacaagggggagaaaaactccgtcgactggggcgatcttaatctcgtgctgccttgcttagagtaccacaataatacatggacctggcttgacttcgccatggcagtgaaacgggacagtcggaaggccctagtggcccaggttataaaagagaaactgcggctgaaaagcgcaacaggaagcgaggttcggggaaaactagagactaaatctgatttgaacatgcagcaacaggaggaagaagaaaaggcaaggttgcttataggattaagcgttggagataagaacccgggaaagaaatcaatctttgggcgacgaaaata

SEQ ID NO: 58910 - DNA, 3876 bp, Artificial Sequence
  Description of Artificial Sequence: Synthetic coding sequence
atgcccccaaattttccagaattcgcagagagaatagaagctagtctgtcagaagtctctgaagcgggagcctcgaaccctagtttacaggaaaaaaaggagtccagctcggcgctgaccgaatcatccggccacctggaccacagagagcctcagagtgagagcgtgacactcgaacacgtcagcaagtccattggcatccccgaagtgcaggactttaagaatctgtccggagactgccaggacttccggttccagcagcacagcgctaaccctccgcacgaattccagcccgtagagtctgaagcagttgcaacctcgggaaacaccgatgtcatgcaggaatcacgttttagcagcgctacttggcccagagccactaagtctttggctaaaggcggattctccgaaaaacagcaccctctgggagacacagcttgtacagttgagatgcccccactgagtccctgcctgagcgaggagctcctcgatcccgaactccacgttttaattacccctagcctgcgggaaaagactgaaagcgagttgaaatttgaagaggatgaaaggtggataatgatggaggcggaaggggagtgggaggaagagaagctaagcgacagggaaaaaacttttttgatggctgatgaaaaaaattccctggctgacatcttcgaagagcgcgagcaggccaataccgcagttgttgaggatgggtcggattgcctcgccgctgtcctgagaaccttcggtcatctgtcactgggacagatctgctgccccgacgacccgcagcccgctaaggatcaactggcgaccgtgcccaaggatattccgcttgattgcgactgcgtgctcaccggtgaagacatcctgggcgaggtggccaaccgcaccgctcagggtctggagggcctggtaagcgactcagcttgtacagtcggaactatcgacgctgagcagctctcggatactgattcggttcaaatgtttcttgagctggagaaggagtgtctctgtgaggaaggtgtgacacccctggtggagttacaaaaccagatctcttccgaaggtctcgccgcaagtcaggatgccgagaacttgctagtcatctcgcacttcagtggggctgccttggaaaaagagcagcacctgggcctgctacatgtcagggcgaaggattatgacacgcgcctcgactgtggttacttcaatactttggattcctcacaagtacccaacgctgtcgagctaatcgctcatgtcgacatcatgcgagacacctcaaccgtgagtaaggaggaatgtgagaaggtgcctttttctcctaggacggcggaattcaagagcaggcagcccgcagatctggactccctcgagaaactggacccaggaggccttctgaatagcgaccaccgagtgtctcatgaggagaagctgtctggctttatcgccagtgagttggctaaggataatgggagccttagccagggtgactgctcccagacagaaggaaacggtgaggagtgcatcgagcgggtcactttcagttttgcattcaatcacgagctgactgatgtgacatctggaccggaggtggaggtgttgtatgagtcaaatctgcttacagacgaaatccacctggagtctggaaatgtcaccgttaaccaggaaaacaactccctcacgtccatgggaaacgttgtcacatgcgaattaagtgtggagaaggtgtgcgacgaggacggggaggctaaggagttagactatcaggcaacactcttggaggatcaggcaccggcacacttccaccgcaatttcccggagcaggttttccaagatttacagaggaagagtcccgagtcagagattctttcgttgcacctgctggtggaggagctcaggctgaatcccgacggtgtcgagaccgttaacgatacaaaaccagaacttaatgtagcgagcagcgaagggggagagatggaaaggcgggatagtgactctttcctgaacatctttccagaaaaacaggtcactaaggccggtaacacagagccggtccttgaagaatggatcccagtgttgcagaggccatccaggacggcagcagttcccacagtgaaagacgccttggatgctgcactccctagtccggaagagggcacttccatagcagccgtgcccgcacccgaagggactgccgtcgttgctgccttagttccttttccacacgaagatatactggtggcttccatcgtttccctggaagaagaggacgtgaccgctgcagcagtttccgcccctgaaagggctacagtgcctgcggtgacagtgtccgtgccagagggtacagccgcagtggctgccgtgagttcccccgaagaaaccgctcctgctgtggccgctgccatcacgcaagaaggcatgtctgctgtagccggtttctcccccgagtgggccgctctggccattacagtacctatcacggaagaggatggaacccctgaaggtccagtgacccctgccactactgttcatgcccctgaggagccggacaccgccgcagtccgcgtgagcacccctgaggagcctgcgtctccagccgctgccgtccctacacccgaggagcccactagccccgctgccgctgtgcctacgccagaagaaccaacgtcacctgcggcagctgtccctcctcccgaagaaccaacctcacccgcagcggcagtgcccacccctgaggagccaacgtctcccgctgcagcagtccccaccccagaggagccgacatccccagccgctgcagtaccaactccagaggagcctacttcccccgctgccgcagtccccacccccgaagagcccacttcaccggctgcagccgtgcccacgcctgaggagcccacgtcacctgccgctgctgtccccaccccagaggagccagcgtctcctgctgccgctgtccctactccagaggagccagccagcccggctgcagcagtgccaacaccagaagagcccgcatttcccgcacccgcagtgccaactcccgaggaaagcgccagcgctgcagtggctgtgccgaccccggaggagagcgcatctccagcggcagccgtgcccacgccagctgaatctgctagctttgccgcagtcgtcgcaactctagaggaacctacctcacccgcagctagcgttccgacaccggcagctatggttgccactttggaggagtttacttctcccgcagcctctgtacccacctccgaagagccagctagtttggccgctgcggtcagcaatccagaggagccaacatccccagcagctgccgtgcccacactggaggagccgaccagctccgccgcagctgttctgacacccgaggaactgtcttccccagcggcttcagtgcccacccctgaggagcctgccagcccagctgcggcagtgagcaacctggaagaacccgcttctcctgccgctgccgtgcctacacctgaagtagctgccattccagcggcttctgtaccaacccccgaagtacccgcaattcccgcagccgcagtacctcccatggaggaagtgagccctattggagtcccctttcttggtgtttccgctcacaccgactccgtgccgatttctgaagaaggaacaccagtcctcgaggaggccagcagcaccgggatgtggatcaaagaggacctcgattccttggtgttcggcataaaggaagtgactagtaccgtgctgcacggcaaggtgcccctggctgcaacagcgggactgaatagcgatgaggtgattgttcatttcgattccggaaaggggctcaagtcaaaggttcgatttgccggactcacctggtggtag

SEQ ID NO: 58911 - DNA, 207 bp, Artificial Sequence
  Description of Artificial Sequence: Synthetic coding sequence
atgtgcttgtattgttgggacatcgaaccatcgcaggtaaacccagaggggccacggcaacaccatccctccgaggttaccgagcgacagttggcaaataaacggatccagaatatgcaacacctgaaaaaggagaagcggcgactcaacaagcgattctcccgcccatcccccattcctgagccaggcctgctgtggtccagctag

SEQ ID NO: 58912 - DNA, 1584 bp, Artificial Sequence
  Description of Artificial Sequence: Synthetic coding sequence
atggttaggccgggatactctcatcgcgtgagccttcccacaagcccaggaattttggctacctccccatatccagagactgacagcgcattttttgaaccctctcatctgacctcggctgctgatgagggtgccgtgcaggtgtcccgccgaacaatcagcagcaattccttctccccggaggtatttgtgctccccgttgacgtggaaaaggaaaacgcccatttctacgtcgccgatatgatcatcagcgcaatggaaaaaatgaaatgcaatatcctttcccagcagcagaccgaatcctggtccaaggaagttagcggcctccttgggagcgaccagccagattccgagatgacattcgatacaaatatcaaacaagagagcggcagctctacctccagttactctgggtatgagggctgcgctgtcttacaggtaagtcctgttactgaaactagaacctatcatgatgtgaaagaaatctgcaaatgcgatgtggacgaattcgttatcctcgagctcggggacttcaacgacattacagaaacctgttcatgctcatgtagctctagcaagtcggtgacctatgagccggactttaattcggcagagttgctggccaaggaactttatagggtgtttcagaaatgctggatactgtctgtcgtgaacagccagctggccggatcactcagcgcggctggctctattgttgtcaatgaggaatgtgtgcgtaaggactttgagtcctctatgaatgtggtgcaggagatcaaatttaaaagtcgtatccgcggaaccgaggattgggcaccgccacgttttcaaatcatctttaatatccacccccctctgaaacgggatctggttgtggccgctcaaaacttcttctgtgcagggtgtggaacccccgtcgagcccaagttcgtgaaacgcctgcgttactgcgaatatttgggaaagtacttctgtgattgctgccacagctatgctgaatcatgcatacctgcaagaattctgatgatgtgggactttaagaaatactacgtctccaacttcagtaaacaacttcttgatagcatttggcatcagcctatcttcaaccttctgtctataggacagtccctatacgctaaggcgaaagagctggatagggtaaaagaaatacaggagcaactattccacattaagaaactactgaaaacctgtcggttcgcgaacagcgctcttaaagagtttgaacaggttcctgggcacctcaccgacgaactgcatctattctccctggaggacctagtgagaataaagaagggtctgctggctccccttctcaaggacatccttaaggcctcgctggcacatgtggccggttgcgagctctgccaggggaagggcttcatctgcgagttctgtcagaacaccacagtgatttttccttttcaaactgctacctgtagaaggtgcagtgcgtgcagggcctgctttcacaagcagtgcttccagagcagcgaatgccctcgatgtgctagaattaccgccaggaggaaactgttggaatcagtcgctagtgccgcaacctag

SEQ ID NO: 58913 - DNA, 462 bp, Artificial Sequence
  Description of Artificial Sequence: Synthetic coding sequence
gtgaggggtgcctcagctcgtcccccattgctgggctccgaggagccgctatccccggcttcccacccagtccgcgagggcggagggggagtcagccccccacctggccagcccccttgccccggagggaggtgggggggacagccatctgctaggccagccgctccatcaggccgagaggttggcgtttctgccccaagacctgcaagccgcccagttagggaggtgaggggtgcaagcgctcgtcccccactgctagggagtgaggaaccactatgtccagcgtcacgcccagttcgcgagggtggcggaggagtcagtccgcctcccggtcagcctccacgccctggaggcagaggtgcgagcgctagacccccattgttgggttccgaggagccactgtgtgccgcaactaccccatcagggaggtgcgcacaacagttaatcgaaaacggaccttag

SEQ ID NO: 58914 - DNA, 1290 bp, Artificial Sequence
  Description of Artificial Sequence: Synthetic coding sequence
atgggcctgccgtcctggactagacggtctcgcaaccacgatgtctccggagcacctctgccgctggaatgtaaccacgtgggcgaagcgcttccacctgagatggtgacgaggctgtacgatggtatgagaagggtggacctgaccggtaaggcaaagggcccaagtgagaacgtcagtcaggagcaatttaccgcctccatgagtcatctgctgaaagggaactcagaagagaagagtctgatgattatgaagatgatctctgctactgagggcccagtaaaggccagggaagtccagaaatttaccgaagatctggtcgggtcagtggttcatgtgctcagtcatcgccaggaattacgcggttggacaggcaaagaggctccgggacccaatccacgtgtacaagttctcgctgctcagctcttaagtgatatgaagctgcaggatggaaaaagactgctgggcccacagtggctggattatgactgtgacagagctgtgattgaagattgggtgtttagagtgccccacgtggcgatttttttatccgtagtcatctgcaaagggtttctgatcctctgttcgtcactggacctgaccactctggtccccgaacgccaggtggatcaggggcgtgggtttgagtcaatcctggacgtactctctgttatgtatatcaacgctcagctgcctagggagcagcggcataggtggtgtctgctattctcttccgagctgcacggccactcattcagccagctatgcggacacatcactcaccgcggtccctgcgtagctgtgctcgaagatcacgataaacacgtgttcgggggatttgccagctgtagttgggaggtgaaaccccaattccagggagacaatcggtgctttttattcagcatctgcccgtcaatggctgtctatactcacacggggtataatgatcactacatgtacctcaaccacggacagcagacaatccccaatggactcggtatgggcggtcagcacaattacttcggcctttgggttgacgtggactttggcaaagggcatagccgcgctaagccaacctgcacaacctataatagtccccagctgagcgcccaggaaaacttccagttcgataagatggaggtctgggccgtgggggatcccagtgaagagcaattggctaaagggaacaaatcaatactggatgccgatccagaggcccaggccttacttgaaatctccggccacagccgccacagcgaggggctgagagaggtgcccgacgacgaatag

SEQ ID NO: 58915 - DNA, 2493 bp, Artificial Sequence
  Description of Artificial Sequence: Synthetic coding sequence
atggacgatgacgacgacagctgtttgctggacctgattggggaccctcaggccttgaactactttctgcacgggccatccaacaaatcttcaaatgatgatctgacaaacgccggatacagtgcagccaactccaattcaatcttcgctaacagctctaatgcagaccccaaaagtagtctcaaaggggtgtccaaccaattgggggaaggcccttctgacggacttcctctgtcttccagcttgcaatttctggaggacgaactagaatcaagtcctctgccagacctgaccgaagatcaaccgtttgacatcctgcagaagagcctgcaagaagcaaatataaccgagcaaacactcgctgaagaggcctacctggatgcttccatcggcagctcacagcagttcgcccaggcccagctgcacccatcttcctcagccagcttcacccaagcgagtaatgtgagcaactattcagggcagactttacagcctataggtgtgactcacgtaccagtgggcgcatcattcgccagtaacacagtaggcgtccagcacggctttatgcagcacgtgggaatatcagtcccctcccagcacctgagtaactcctcccagatctctggcagcggacagatccagcttataggttccttcggaaatcacccttctatgatgactatcaacaatctcgatggctctcagatcatccttaagggtagcggacagcaggcaccctctaatgtctcaggcggactattggttcatcgtcagactccaaacgggaactctttgttcggcaacagttcctcatcacccgtggcccaacccgttacagtgccgtttaactctactaactttcaaaccagccttccagtgcacaatataatcatacagaggggactggcgcctaacagcaataaggtacccattaacatccagcctaagcctattcagatgggtcaacagaacacatataatgttaacaatctaggaatacaacagcatcatgtgcagcagggaatatctttcgcatcagcatccagcccacaggggtccgtggtgggaccccacatgagcgtgaacatcgtgaaccaacaaaacacgcggaaaccagtcacatcccaggctgtaagctcgactggaggcagcatcgtgattcacagccctatgggacagccacacgctccccagtcgcagtttctgataccaacatccctgagtgtgtcatccaatagcgtgcatcacgtgcaaacaataaacggacagctcctgcagacgcaaccaagtcaactgatatccggacaggtagcctccgagcacgtaatgttgaaccgcaattcatcgaatatgctgaggacaaaccagccatataccggtcccatgcttaacaaccagaataccgcagtgcatttggtgtctggacaaacattcgcggcatctggatcacctgtcatcgccaaccatgctagtccacagttagttggcggtcagatgcccctgcagcaggcctcaccaactgttctgcacctctcgccgggtcagagcagcgtttcccaggggaggcccggatttgccacgatgccgagcgtcaccagtatgagcgggccaagcagatttcctgctgtgtcctccgcctctacagctcatcccagcctggggtccgcggtacagagcgggtcttccggtagcaactttaccggggaccagcttactcagcctaatagaactcctgtgcccgtgagcgtgagccaccgccttcctgtttctagcagtaaatctacctcaacctttagtaacacccccggtaccgggacacagcaacaattcttttgtcaagcacagaagaaatgcttaaatcagacaagtcctatcagtgccccaaagaccactgatggtttgcggcaggcccagataccagggctgctgagcacaacgctgccagggcaggacagcggatctaaagtgatatctgcctcactcggaacggcccagccacagcaggagaaggtggtcggctcctccccaggacaccccgctgtccaggtggaatcccactcggggggtcagaagaggcccgctgctaagcaactcacaaagggagcattcatacttcagcagcttcagcgtgaccaggcccacaccgtgacacctgacaagtcccacttccgctccttgtcagatgcagtccagcgcctcctttcttaccacgtttgccagggttccatgcccaccgaggaggacctcaggaaagttgataacgaattcgaaaccgtggctacccaactgctcaaacgtacacaggccatgctgaacaaataccggtgcttgctgcttgaggacgccatgagaataaatccttccgccgagatggtcatgatcgaccggatgttcaatcaggaggagagggcgtccctgtctcgggataaacgtttggccttagtcgaccctgagggcttccaagctgatttctgctgttacctatattcctag

SEQ ID NO: 58916 - DNA, 1368 bp, Artificial Sequence
  Description of Artificial Sequence: Synthetic coding sequence
atggtcgaacagggagacgccgcacccctgctgcggtgggctgagggcccagccgtaagcctgccccaagcacctcagcctcaggccggagggtggggtagaggagggggtgggggagccagaccagctgcagagccaccccgacgccgtgagccagaggaacccgctgcccctgaagtactcctgcagcctggtaggctggagctgggagatgtggaagaagaccaggttgtggccgtttttgttgtgaccttcgaccccagaagcgggaatatggtcgaatggtgtctgccccaggatatcgatttggagggagtggagtttaaatccatggcgtccgggagtcataagattcagagtgacttcatttacttcaggaagggaccattttttggtttggcgtgtttcgctaatatgcctgtagagtcagagctggagcgcggagcgcgtatgaagtctgtcggaatcctgtccccctcttatacgctgctgtaccggtacatgcacttcttagagaatcaggtgagacaccagctggaaatgccgggacactattcccatctggctgccttctatgaagacaagaaaggcgtgttgcacgcaggaccgggtcgcggaagcagtttgccgccagtgtactggctcccctctattcatcggtatatgtacccggagatgaaaatcactcacccagctggctgtatgtctcagtttattaaattttttggtgagcaaattttaatcctgtggaaatttgccttactgcgaaaacgaatcctaatattctctccacccccagtgggcgtggtgtgctaccgagtatactgctgctgctgcctggctaatgtctcgttgccaggaatcggcggaactattccagagagcaagccttttttttatgtaaacgtggctgacatagagtcactggaggtggaggtgtcttatgtggcctgcacaacagaaaaaatctttgaggaaaaacgggagctgtatgacgtctacgtggataatcagaacgtgaagactcaccacgatcacctccagcctcttcttaagattaactctgcagaccgcgaaaaatatagaaggctcaacgagcagcgtcagatgctcctgtactctcaggaggtggaagaggattacaacccctgcgaggaagacctatttgtgctattttttctggagcagaacaacagaatctttcaaacgctattggaggtctcagcgagccaggacaagacattgaccgccgagcacgcgagaggcatgggacttgacccgcaaggggaccgatcttttctgctggaccttctcgaagcttacggaatcgacgtcatgctggtcattgataatccttgctgcccatag

SEQ ID NO: 58917 - DNA, 2235 bp, Artificial Sequence
  Description of Artificial Sequence: Synthetic coding sequence
atggaagactgtctgcacacatctagtgagaatttgtcaaagctagtgtcctgggcccattctcatgggaccatctgttcactgattcctaatctgaagcacctgcttagcgagggcagccacgggaatcttactgccatgtggggctgtagtgcgggacatgcctatcactggccgctcaccgctacttgtagagccggttctcaggaacgcgtgtgcttccaagataatagatcatttaatagcgacagcccaagcattatcggggtcccttccgagacacagacctccccggtagaacggtaccccggaaggcccgttaaggctaaattggattgtaataggactagagatagctgcgactttagttactgcagcgagccttccgagctcgacgaaacggtggaagagtacgaggacgaaaacactcttttcgatatggtctgcgagagttccgtgacagatgaggacagcgattttgaaccccagacccagcgccctcaatccatagcccgtaagcgacccggagtggttcccagttcactacacagcagctctcagactcaaatggtggatgagtgctctaacgatgtcatcatcaagaagattaagcaggagatacccgaggattattacatcgtggcgaatgcggagcttaccgggggtgtggacgggcctgccctgtcgctgacacagatggctaagccgaagccgcaaacacatgccggaccaagctgtgtaggttccgcaaagctgattccccatgtgacctcggctattagtaccgaattggacccacatggaatgtccgcatctccttcagtgatctcccggccaatcgtgcaaaaaacagctagggtaagcctcgcctctccaaaccgcggaccacctggcactcatggaaccaaccaacaggtcgctatgcagatgcccgtgtcaacttcacatcctaataagcaaataagtatcccgttaagcgcgctccaactgcctggccaagatgaacaagtggcatccgaggagttcctgagccaccttccatctcaggtgagcagctgcgaagtggcactgtccccgagtgtgaacaccgaacccgaagtgtccagttcacagcaacagccacctgtagcccctgccatcactacagaggcaacagcacagtgcattccggatcaggacgagcgagctgccgagttatcccgcgagcagaacgaaaagaccatccgctctactcaaaccgcactgagaaacttcccctacagcacgaaactgaataagtttccagtgttcaacatcaatgatgacttgaatgatttatgtacgagtgctgtaagccccaatacgactaaggccacgaggtatgcccttaatgtctggcggtattggtgcatgactaacggactcaaggaccacactgatataacgaagattcctgcggtgaagctcaacgagttgttggagaatttctatgtcacagttaagaagagcgacggtagtgactttctggcaacctccctccatgctattcgacgcggacttgacaggatactgaaaaacgcgggtgtaggatttagcatcacatcctcgacatttagctccagcaccaagaaattgaaagagaagctctgggtcttgtccaaagcagggatgtctggcgcaaggagtagaaacatcgtgtacttcagcctgtccgacgaagaggagatgtggcaggcaggatgtctgggggacgacagtcccataactctgctctccactgtagtcaaatacaacagtcagtatttgaacatgcgcacactgcaggaacacgctgacctgatgtatggcgatatcgagctcctcaaagacccccagaaccaaccttactttgcccgtacagacagcgttaagagagaaagtaggtccggatccacaagagtttgccatgggaaaatttaccacgaacattccagaggacacaagcaatgtccctactgccttttgtacaagtacatgtacattcaccgcccaccgactcagatggaggccaagagccctttctacctgaccgctcgcaaagaggcaaccgacatgggcagtgtgtggtatgaggagcagcggatggggctccggagcctgagaggaattgtgcccaatctggcaaaaaaagtcaaattggagaattgtgagaatttcaccttcgtgtccttcacccaagtaagccggagactggggagccactcttgttgtcagtag

SEQ ID NO: 58918 - DNA, 111 bp, Artificial Sequence
  Description of Artificial Sequence: Synthetic coding sequence
aaggaaaaaaaggaggagcgaaagaaagagcggaaaaaggaggaaaggaagaaggaacgtaagaaggagaggaagaaagaaaaagaacgcaagaaagaaaaagagaggtag

SEQ ID NO: 58919 - DNA, 462 bp, Artificial Sequence
  Description of Artificial Sequence: Synthetic coding sequence
gtgcggggtgcatccgctaggcccccattactgggatctgaggaacccctgtgtccagctagccggccagtgcgggagggtggcggtggcgtcagccccccacctggacaacctcccaggccgggaggacggtggggaggccaaccccctgccaggccagctgcaccatccgggagggaagtgggcggagggcagcctccttgccccgcatctcgacctgtcagagaagtccggggtgcctctgcgaggcctccactgctcgggtctgaagaaccactctgtccagctagccggccagtgagagaaggagggggtggggtgtcacctccacccggacagccaccccgacctggacggggtgcctcagccaggcccccactgctcgggtcagaggagccactatgccccgctactaccccctccgggaggtgcgcccagcagctcatagagaacgggccttag

SEQ ID NO: 58920 - DNA, 267 bp, Artificial Sequence
  Description of Artificial Sequence: Synthetic coding sequence
atgcccggagtcgtgtcggccgcaggaacacaggtccgacgattagacgaggtacctgcaagccttaggctgcagcatcacctgcagctcagggagggactggccgtccctctccccccattggtgatccagtcacccgcagcacaccatgtggctgggggatcattctctgactttacactggatatcgccttgggtgctagacgtatccgacttgctctcgtcagacaagtgactcaagacggcccagtggcgtttctggcttag

SEQ ID NO: 58921 - DNA, 456 bp, Artificial Sequence
  Description of Artificial Sequence: Synthetic coding sequence
atgctccgatggttcgtgcagcagcctacgagctgttcacacgcacagcccctccccccaccgcatgggacagcttccctgtccccgctggtgccttcgtgcggaagcgcagcttggccctctttacattacctagggtctccagcggactcaggctgctctaggggacaacgggcactgccagctgtttggcccccatcctgctattcccagtgcccacaaggacggccaccccaccccgtgcctagaagcccaagaagaggatctcgagacctgggtaaagagccaggtgaggaggccgctccctggccatcaccgtgtgacagccgactgcacagacaccctatgccgagaacgccactgtctgctagtgctggttgcgacccaagtttaatccagccctccccacaccctactcccccacaacaggggtgtgtgaccccattccacagatag

SEQ ID NO: 58922 - DNA, 2757 bp, Artificial Sequence
  Description of Artificial Sequence: Synthetic coding sequence
atgaacgagaacatgcgggctacgttggcaacttccaaaaacgtgtttcagctgaagcttgaggagacccaaaagttacttgaggaccagcatctgagcaacctgcagaaattcggggacgaagtcaaccaaatcaccaactcagagacgctctcctcgatcgacagtttggaggccacagaacacgaggaaatttacctgactctaaacaaagagcattccacttcaatccagcgaaatacgatctccttaaaaccggctaatatgcaaagcactaatctgtcatgctttgatgaggacaaattggctttttcaaaaacgcagcatatcaataactggttgaccaatctggatgcatccaatacgcagaatgtcaccgccttctccgatatcctgagcaagtcaaatgtcctaccgtcctgggagtactttaattccaaggagcagaatccatcccctctgaacggtactgttgagagggcaactaacacagcaaataatagtgtgcctttcgtctcctcacctcctatgttcgtgcttgacaagaagtgcgagaaaacttccgaaacttcaacgatgagaactaccgatagtacatctggggcatttaaacgggagcggccactagtcaccgagagccctacattcaagttctctaagtcacagagcacgtctgatagcttgacacaggaagtagccacatttcccgaccaggagaagtatagcgagctgaatcaggagaatggtaccaccagtattcctacctcctgcgtgccagtggccactccactcgtgcttccatcaaatatccagtctgcccgaccaagtgcaaaaaacagcatacatataaaagagattgatgccgtgcagtgttcagacaagctggatgaactgaaggatggtaaggaagaggagataaagtatttcaactgcaataaagaagaattaccactgttctcagacagtttccaggacgcctacatccctcacaaccccgattccaaggacgagaaacagaagctggcggagacttcatccctttcaaacgtgacttctaactacgacttcgttggtcagcacaagaaaatgaagtacaatatccatgaaagaaatggggtccggttcctgaagtccattctgaagaaggagtccaagtacgaacatgggtatctcaaggccttaattatcaaccagtcattcaaatttggaaaccagaaagccgcagccatacgtgactctatagaactgaccaaggaaaagggagccgagattcctaagacaatcaagaaactgcgctggtttgacgaaacctcgaatatcgagaacaacgccgaaaatagccatagtctgaagaacaaaacaggaaccactcagcagcacagtcagcagtttcacatccagtctggagctggctctaatataattagcgtgagcacttgcgcagttaattctgcggacaccaagaagagtcgggaggactcgatttctgaaaatgtaactacgcttggcggatctggtgccgaccacatgccattaaattgcttcatccccagcgggtacaacttcgcaaagcatgcatggcccgctagtaagaaagaggaatcaaagatccccgtccatgacgactcaaagactaagcaaggaaagccgcagcgcggacgcgcaaaaattataagaaaacccggaagcgcaaaggtccagagcggcttcatttgtaccaaccgtaagggcgcagttattcagcctcaatcagcgagcaaggtcaatatttttactcaggcccagggcaagctgattatcccatgtccccctccacagtcaacaagtaacattcgttctgggaaaaatattcaagtgtcccagtgtcagccagtcactcctgagaaccctcagaacatcatcacacataacagcttcaacagtaagcatgttctgccgacagagcactctctgaatcagtggaatcaagagtcttcctctcctctgtccaatgcgtgtagtgacttggtcacggtcatcccctcactgccctcttattgctctagtgaatgccaaaccttcgccaaaattaaccacagcaatgggactcaggccgtggcccgacaggacgctaccctttactgcactcagagaagccctgtatgcgaagagagctacccatctgtgactctgaggacagccgaggaggagagtgtgccgctctggaaaaggggaccaaatgtactgcaccaaaacaaacgggctaccggttccactgttatgcgcaggaagagaatcgccgagaccaagcgcaggaacattctcgagcagaagcgtcaaaacccgggaagtgtgggccagaaatattccgagcaaatcaataactttggacagtcagtcctgctgtcttcatccgaaccgaaacagaccacccgcggaacttcctatatcgaggaagtcagcgattcgacaagcgagttcctgatggccgagaatctggtgaaggcttccgtgccggaggacgagatcttaacggtactcaacagcaagcaaattcagaaaagtaaccttcccctgaataagactcagcagtttaacatttgtaccttgtctgccgaagagcagaagatccttgaaagcctaaatgatctgagtgaacggctgcactacatacaagagtcaatctgcaaaaacccgtccatcaagaatacccttcaaatcatacctctcttagagaagcgggaggataggacgtcatcatgtcgagataaaaggtag

SEQ ID NO: 58923 - DNA, 459 bp, Artificial Sequence
  Description of Artificial Sequence: Synthetic coding sequence
ttgccgcttttctgtagctctggtattcttcagaaggagttttggaggaatcgcattcagtacaaccagtcacagaaggatatcctgcagagctggttccagcacgacccttttcccgacaaagcggctagagagcagttagccaaagagatcggtgtccccgagagcaacatccaggtttggtttaaaaactatagggtcaagcagagaaagctcgattacaaatgcttttctgagaaggatcagactcaaggccacgaccagagccagcatctgacccaggagtatctgcccaaagaggcccgtcagaagcagacattcatcacctggacccaaaaaaaccggctagtccaggccttcgagagaaatcccttcccagatattgcgacccgcaagaaactcgcggagcaaactggcctccaggaatctaggattcaagtgagctccatgtgcgtttag

SEQ ID NO: 58924 - DNA, 3930 bp, Artificial Sequence
  Description of Artificial Sequence: Synthetic coding sequence
atgctgcttaacggcgattgcccagaatctctaaagaaagaggccgcagctgcagagcctccacgggagaatgggctcgacgaggcaggcccaggagatgaaaccaccggtcaggaggtgatcgtgattcaagataccggtttttcagtgaagattctggccccaggcattgagccgttctccctgcaggtgagcccccaggagatggtccaggagattcaccaggtgttgatggaccgggaagatacctgtcacagaacatgcttctctctccatctcgacggcaacgtcctcgatcattttagcgagttgcgaagtgtggagggactccaggaaggatctgtgctccgtgttgtggaggaaccatacaccgtgagggaagcaagaatacacgtgcgacacgtgagagacttgctgaaatcactggaccctagtgatgccttcaacggcgtggattgcaatagcttgagctttctgtcagtgttcacagatggagacctcggcgatagtggaaagcggaaaaagggacttgaaatggacccaatcgactgcactcccccagagtacatactgcctggctctcgggaacgtccactgtgccccctgcagccccagaatagggactggaaacccttacagtgcctcaaggtcctaacaatgagcggctggaacccccctcctggcaatcgtaagatgcacggcgacctgatgtatctgttcgttattaccgcggaggataggcaggtgtcgatcaccgcttctacccggggtttctacctgaatcaatcgacagcctaccattttaatccaaaacctgcttctcccagatttttatcccactccctggtagagctgctgaaccagatttcacccacattcaaaaagaacttcgctgtgcttcagaagaagcgggtccagcggcaccccttcgagagaatcgccacgccgtttcaggtgtatagttggacagcgccacaggcagagcacgccatggattgcgtgcgggctgaagatgcctatacctcgaggctaggatatgaggagcacatcccaggtcagacccgcgactggaatgaggaactgcagacaacacgagaacttccaaggaaaaacctgcctgagcgcttgcttcgggaaagggctatctttaaggtgcattcagacttcacagccgcagcaacacgcggtgctatggcagtgatagacggcaatgtgatggccattaaccccagcgaagagactaagatgcaaatgttcatatggaataatatattctttagtctcggtttcgacgttagagaccattacaaagactttggaggcgacgttgccgcttatgtggcacctaccaatgatttaaatggggtgaggacatacaatgcggtagacgtagaaggactttacacacttggaaccgtagttgtcgattacagggggtatcgcgtgaccgcccaatccattatccctgggattcttgaacgtgaccaagagcaaagtgttatctatgggtctatagactttggcaagactgtcgtgtcccaccccagatacttagaactcctggaacgaacatctcgcccactgaagattttgcgccaccaagtcctgaacgatcgagacgaagaggtcgaactctgctcaagcgtcgagtgtaagggaatcattggaaatgatggcagacattacatactcgacctgctgcggaccttccccccagacctcaattttcttcctgtgcccggagaagagctgcctgaggaatgtgccagagctggtttcccgcgagcacaccgccataagctgtgttgtctgagacaggagcttgtggacgctttcgtcgaacacagatacctgctctttatgaaactggcggctttgcagcttatgcagcagaacgcctctcaactcgagaccccatcaagcttagaaaatgggggtcctagttccctggagtctaagtctgaagaccctcccggtcaagaagccggaagcgaggaggagggctcctccgctagcggcctcgctaaggtgaaggaactggccgaaaccatcgcagcagacgatggcaccgatccacgatcccgagaagtgatcagaaatgcatgtaaagccgtagggtccatctcaagcaccgcattcgacatccgatttaatccggacatcttcagtcccggagttcgcttccccgagagttgccaggatgaggtgagggaccaaaaacagctgttaaaggatgcagctgcctttctcctgtcctgtcaaattcccggacttgtcaaagactgcatggaacatgccgtccttcccgtagacggcgcaactctcgccgaggttatgcgccagaggggtatcaatatgagatacctgggcaaagtcctggagctggtcttgcgttcaccggcaaggcatcagttagaccacgtctttaaaatcggtatcggtgagctgattacccgctccgctaagcacatttttaagacgtacctgcagggcgtggagctaagcgggctgtcagccgctatatcgcactttctgaactgtttcctctctagctacccaaatcccgtagcacacttacccgcagatgagctggtcagcaagaagaggaataagagaagaaaaaaccgccctcctggcgctgccgataacactgcctgggctgttatgaccccacaggagctttggaaaaatatttgtcaagaagctaagaactattttgattttgatcttgaatgcgaaactgtagaccaagctgtggagacatacgggctccagaagatcactctgctgcgtgagatttccctgaaaaccggaatccaggtcttgctgaaagaatactcttttgactctagacataagccggctttcactgaggaggacgttctgaacattttccctgtggtgaaacacgtcaacccgaaggccagcgacgcctttcacttcttccagtctggtcaagccaaggtgcagcagggattcctaaaggaaggatgcgagctcattaatgaggcgttaaatttgtttaacaacgtgtacggggctatgcatgtggagacatgcgcatgtctccggctgctagcacggctgcattatatcatgggagactatgccgaagcgctatccaatcaacagaaggcagtcctgatgtctgagcgcgtgatgggcacagagcatcctaataccatccaggaatatatgcacctggccctgtactgtttcgcatcctcacagcttagcactgctctgtctctcctttacagggctcgatacctcatgctgctcgtctttggtgaggatcaccctgaaatggctctgctagataacaatattggactcgtgttgcacggggtcatggaatacgacttatcacttagatttctggagaacgccctggccgtatctacaaagtaccatggaccaaaggcgttgaaggttgccctgtctcaccatctagtggcccgagtgtacgagagcaaagccgagtttagaagtgctcttcaacatgaaaaggagggttatacaatctataaaacgcaactgggcgaggatcacgagaagaccaaggagtccagcgaataccttaaatgcctgacacaacaagcagtcgcattgcaacggaccatgaacgagatctaccgaaacggatccagtgcaaacatccctccattaaagtttactgccccaagtatggccagtgtacttgagcagcttaacgtaattaacggaattctgtttatcccgctgtcacagaaagatttagaaaatctgaaagctgaagttgctcgccgacatcagctgcaagaagcttcgcgaaatagggacagagccgaagaacctatggccacagaaccagccccagcaggcgctcctggggacctgggctcacagccacctgcagctaaggacccctcgccttccgtacagggttag

SEQ ID NO: 58925 - DNA, 3681 bp, Artificial Sequence
  Description of Artificial Sequence: Synthetic coding sequence
atgggtgaacagaaagtgtctcgacaatttaaacagtgtcataggacaacgtcgtgggccaaaagcaaactgtttagcagactgagcagcatgttcctgcagcagctggggaaaaatatcaagttcggccagcgcagtcccaacgccattcccatgaataaggcaaattctggcgaagccagcctggaagaagacctgtttctgaccagcccaatggagatcgtgacccagcaggacatagttttgtcagacgcggaaaataaatcgagcgatacaccgagctccctaagcccattgaatctgccaggcgctggcagcgagatggaggagaaagttgcccctgttaagccctcacgcccaaaaaggcacttcagcagcgccggtacaatagagagtgtgaatttagacgcgattccactcgccatagcaaggctggataattccgcagcgaaacacaaactggcagtaaaacctaagaagcagcgggtgagcaaaaagcaccgcagactagcacaggacccccaacacgagcagggtggtctcgaaagcaggccctgtctagaccagaacggccaccccggagaggataaacccacctggcatgaagaagagcccaatccccttgattccgaggaagagagaagaagacaggaggattactggagggagcttgaggcaaaatgcaagcgacagaaggccgaggccgctgaaaagcggaggctcgaggagcagcgcctccaggctttggagaggaggctgtgggaagagaaccggcgacaggaactcctggaggaggagggcgaggggcaggagccgccactggaagcggaaagggcacccagagaagagcaacagaggagtttggaggcccctggatgggaagacgccgaacgacgagaaagggaggaacgcgaaaggctcgaagccgaggaagagaggagacgcctgcaggcccaggcccaggctgaagagagacggcgactcgaagaggatgcaagactcgaggagaggcggcgtcaagaagaagaagaaggcaggtgcgcggaagaactgaagagacaggaggaagaggaggccgaggggtgggaggaactcgaacagcaggaggccgaggtgcagggaccaccagaggcattggaggagacaggtgaagggagacgcggagcagaggaggaagatctgggagaagaggaggaggagggccaggcgcacttagaagattggaggggacagctgtctgagcttctcaacgattttgaagagaggcttgaagaccaagaacggctgaagcctgaagggcaacgagagcattctgaggagcctggtatatgcgaagagcagaaccctgaagccgagagacggagggagcagcaagggaggtccggggattttcagggggcagaccgacccggaccagaggaaaagcgcgaggaaggcgataccgaacctctcttaaagcaggaggggcctgtggaggccgctcagccacctgtggagcggaaagaggcagcagccttagaacagggtcggaaagtggaggagctgcgctggcaggaggttgatgaacgccagacaatgcctagaccttatactttccaggtgtcgtctggaggtaaacaaattctgttcccaaaggtgaatctgtcccccgtgacccccgcaaaagataccggactgaccgcagcaccgcaggaacccaaagcgccaaaagcctcacctgttcagcatgcccttccctctagtctgtccgttccacatactgcaatcctggtgaccggggctcaactgtgcggaccggctgtaaacctgtcccaaataaaagacactgcatgcaaaagcctgttgggactagaagaaaagaaacacgcagaggcccctgccggtgagaaccctcctcggggaccaggcgatgctcgggctggatccggcaaagcaaaacctagacaagagagtccaagcagcgcatcagccctcgctgagtgggcctccataaggagtcggatcctgaaaaatgcggagtccgaccctaggtcttctgagcgcgaccaactaagacccggagatgaaagcactccacggggaaggtgcgatagccgcggtaaccagcgaaaaacgccgcctgttaacgccaaattctctatcatgcccgcatggcagaaattctctgatggcggtactgaaacaagcaagcaatctaccgaggccgaatctattcggaagcgacctatgctcggcccaagcgaggagacagctccacaaccgcctcccgcaggagttcgagaactgggcaaaggccctgagaagagcgagatgcatagagaaccagcagacactacagaggggtgcaaattcgctaaagatctgcccagctttctggtccctagcctgccgtaccctcctcaaaaggtggtggcacatactgagttcaccacctcctctgactctgaaacggccaatggtatcgcaaagcccgaccccgtgatgcctggtggagaagagaaggcttccccctttgggatcaaacttcggagaactaattactcccttcgctttaactgcgaccaacaggccgagcagaagaagaaaaaacgtcactcatccacaggagactctgcggatgccggacccccagccgctgggtccgcgagaggcgagaaggaaatggagggtgtcgccctcaaacatggcccatctctaccccaggagcgaaaacaggcaccatcaactaggagggattctgcagaacccagcagctcacgcagcgtgccagttgcacacccgggtcccccacctgcttcaagccagacacccgcaccggagcacgacaaagccgcaaacaagatgcctctcgcacaaaaacccgctctggcacccaaacccacctcacagacaccccctgcaagtcccttgtccaagcttagtagaccctacctagttgaactactttcaaggagggcgggacgtcccgatccagaacccagcgaaccatcaaaagaggaccaggaaagttctgataggaggccgcctagcccccctgggccagaggagcggaagggacagaaaagagacgaggaggaggaggctacagaaaggaagcccgcttcaccccctctccctgccacacaacaagaaaagccctcccagacacccgaagccggtagaaaggagaaaccaatgctgcaaagtaggcacagcctggatggcagcaaactgactgagaaggtcgagactgcccagccactctggatcaccctggcccttcagaaacaaaagggattccgggagcagcaggctacaagggaggaacgtaagcaggctcgtgaggccaaacaggcagaaaaactgtcaaaggagaatgtgtctgtctcagttcagcctgggtctagctctgtgagccgagccggatccctgcataagagtaccgctctccctgaggagaagcgcccagagacagctgtatctagattggagcggagagaacagctgaagaaggctaataccctccctacttccgtcactgttgagatcagcgattcagcgccacccgctcctctagtgaaggaggtcacaaagcggttttccacaccagatgctgcacccgttagcacagaacccgcttggctggctcttgcaaagcggaaagccaaagcgtggtccgactgtcctcagataataaaatag

SEQ ID NO: 58926 - DNA, 2538 bp, Artificial Sequence
  Description of Artificial Sequence: Synthetic coding sequence
atggcccaggtctggcgtagagtcagcgagcatttctgggaaagcgagacgacaacctctaaatccacctccggattgactgacatcacatggagctcctcgggttccgacctgagcgatgaagacaagactctgtctcagctgcagcgtgacgaactgcagtttattgattgggaaattgactccgaccgtgccgaagccagcgactgtgatgagttcgaggatgacgagggcgctgtggagatctctgactgtgcgtcctgcgcgagcaaccaaagcctgacaagcgatgaaaagctatccgagctcccaaaacccagcagcattgagatccttgaatattctagcgattcagaaaaggaagacgacctggaaaacgtgctgttgatagatagcgaatctccacacaagtatcacgtccagttcgcttcggacgcacggcagattatggaaaggctgatcgatcctaggacaaaaagtacggaaacaatcctccatactccacagaaacccacagcaaaattcccacggacgccagagaacagcgcaaagaagaagttgctgcgtgggggactcgccgaacgattaaatggccttcagaaccgggaacgaagtgctatatccctgtggcgccaccagtgtatatcatatcagaaaaccttgagcggaagaaagagcggcgtgctcacagtgaaaatcctcgagctgcacgaagaatgcgctatgcaggtggctatgtgcgagcagttgctcggatcccctgccacaagctcaagtcagtctgttgctccacgacccggtgcgggtcttaaggttctgtttactaaggaaaccgcaggttacctacgcggtagacctcaagatacagtccgcatattccctccctggcagaagttgataataccttcgggtagttgccccgtcatcctcaatacgtatttttgcgaaaaggtggttgccaaggaggatagcgagaaaacctgtgaagtatactgcccagatatccccctgccaagaagaagcatttctttagctcagatgttcgttataaagggactaactaataattccccagagatacaggttgtttgctctggagtcgcgaccactggcacagcttggacccacgggcataaagaagcaaagcagagaattcccacatccactcccctgagggactctctgctagatgtcgttgagtcccagggggctgcttcatggccaggtgccggtgtccgcgtggtggtgcagcgggtatatagtttgccaagcagagatagcactcgtggccagcagggagctagcagcggtcacacggatcccgctggcacaagagcttgtctgctggtccaggacgcatgtggcatgttcggggaggtgcaccttgaatttacaatgtcaaaagcccgacaactggaggggaaaagctgctctctggtggggatgaaagtactgcaaaaggtgacacgcggtagaacagcaggtatttttagcctgattgacaccttgtggccacctgctatcccccttaaaactcccggacgcgatcaaccatgcgaggagataaaaacccatcttccgcctcccgctctgtgctacattctgaccgctcaccctaacctcggccagatcgatatcatcgatgaggaccccatatacaagttataccagcctcctgtcacacgttgtctgcgggatattctgcagatgaacgatctaggcaccaggtgtagcttctatgcaaccgtgatttaccagaagcctcagctgaaaagcctactgctcctggagcagcgcgaaatttggcttctcgtaacagatgtgacactccagaccaaggaagagcgcgatcccaggctgcctaagacattgttagtatacgtagccccactatgtgtgctcggatcagaggtgctagaggcgctagcaggcgcagcgccacacagcttgtttttcaaagacgcactgcgggatcagggacgtatcgtctgtgctgaaaggaccgtgctgctgctccagaagcccctacttagcgtggtgtccggagcatcgagctgcgaactgcccggtccagtaatgctggactccctggactctgcgacacctgttaacagcatttgctcagtacagggtacagtcgtgggagttgatgaatccacggccttctcctggccggtctgtgacatgtgcgggaatgggcgactggagcagaggcccgaggacagaggagccttttcctgtggcgactgctcccgggtagtcacttccccagtgctgaagaggcacctgcaggtgtttctggattgtcgtagtcgaccacaatgtagggtgaaggttaaactgctgcagaggtcaatctcctctctgctcagatttgctgcgggtgaagatggaagctatgaagtgaagtctgttttggggaaggaggtgggactgcttaactgttttgttcagagtgtgaccgctcatcctacatcatgcataggactcgaagagattgagctgttaagcgcaggaggggcatcagctgaacattag

SEQ ID NO: 58927 - DNA, 324 bp, Artificial Sequence
  Description of Artificial Sequence: Synthetic coding sequence
atgctgtctaaggggcgtagtccacgcagaaagcaggtgcagacacagcgaaaggctgccctggtactctccgttaccccaatggttccagtgggctccgtgtggctggctatgtccagtgtgttgtcagctttcatgcgcgagctccccggatggtttttattcttcggtgtctttcttcccgtcacgctcttgttgctcttgttgatcgcatatttcagaattaagctgatcgaagtaaacgaagagctgagtcaaaactgtgaccggcagcacaacccgaaggacggctcatctctgtatcagcgcatgaaatggacatag

SEQ ID NO: 58928 - DNA, 876 bp, Artificial Sequence
  Description of Artificial Sequence: Synthetic coding sequence
atccggcctttcagttctgtcaacagtttggttctgaacgaggcttccacactggctaaacggctgtccacctttaccacgtttattaggcctttttcatcgatgaaaagcccggtccttaatgaagctcgggctctcagtaagcggtttgctacgtttacagccctgattagatcttgtgcgagcatgaactctcctgtactgaatgaggtgaggtttgctggaaaggggttcagcacttttaccgctttcataaggtctttctcttctgtaaatagcctcgttctcaaccaggacaaatttgccgcaaaagggttcctgaccttcactgccttaattcgcccaattacaagcgttaacgctgccgtgtcaaacgaagtgagggaactgtcgaaaggttttccaacattttcagcatttattcgttctttttctacggtgaactcactggttctgaacgagttccgttttgcagcaaagaggtttccgaccattaccgctctgataaggcacttctcctcagtgaattctagtatgagcaatgaaattgaagatttgtcaaaaggcttccccaccctcactgccctgatccggcctttttctcgcgtgaactcactggtgtctaaaaaggccagggcgttgtccaaaggctttcctgcattggccacattcattaggcctttctccagcgttaacagcctggtcttcaatgaggtgcgctttgtggctaagggcttcccaactttcacgacgctgatgacccattcgtcctccgttacctctctggtggtcaacgaatttaggttcatggataaggggttcctgaccataacggccttcatccggcctttttcctctgttaactacctggtctag

SEQ ID NO: 58929 - DNA, 672 bp, Artificial Sequence
  Description of Artificial Sequence: Synthetic coding sequence
aagccgtatgcatgcaacgagtgtgtgaaaagtttttgcgtgaagtcatccctgatcattcaccaacggacacacaccggcgagaaaccatataagtgtaatgagtatggcaagacattccaccacaaatcgaccctgacagtgcatcagcgcacacacggagaaaagccctataaatgtaacgagtgtcggaagtccttttacatgaagtccgcgttgtcacagcatcagagaattcacatctgggaggaacattgtgagtgtaaggagtgtgggaagacataccagaggtcccacctggcgaagcaccacagaaagtatacaaaaaagccctatgaatgtaagcagtgtgggaagacttttcagaagagccatctcattgaacatcagcggacacaccccggagagataccacacgaatgcaacaaatgtggcaaatccttctgttacaagagcccactgactatccatcaacgaacccacatagaggaaaagccatacaaatgcagtaaatccgtcacctatttttgcatgaagtcccacctgaccgtccatcaacgacctcatactcgtaagaacccttttgagtgcaacgagtgtcgcaagatgttctacgtgaagtcgaacctgattaatcatcaacgtactcacaccggcgagaagccttattag

SEQ ID NO: 58930 - DNA, 621 bp, Artificial Sequence
  Description of Artificial Sequence: Synthetic coding sequence
atgaaggccggatttcatttgaatccaaaggccattgaggcgagtctgcagggttgctgtagcgaagctgaggcacagcagaccggacgccgacagacccctcctcagcctatgcagtgtgagctcccaacagtcccagtccaaatcgggtctcattttctgaagggagtgtctttcaacgagtccgcagctgataaccttaagctcaaaacacacacgatgttgcagctcatgaaagaggccggatgttataatggcatcacctctagagacgattttccagtgaccgaggtgctcaatcaggtctgtccctctacatggagaggggcttgtaaaaccgcagtgcagctcctgtttgggcaagcgggactggttgtggtggacaccgcccagattgagaacaaggaggcttacgcaccccaaattagtctggaaggcagccggattgtggtccaagtgccgagcacttggtgtctgaaggaagatcccgcaactatgtcactgctgcagcgcagcctggaccctgaaaaaaccctgggactggtggacgtcctgtacaccgcagtcctcgatcttaaccggtggcgagcgggtcggctagtatacttatcctttttctag

SEQ ID NO: 58931 - DNA, 3945 bp, Artificial Sequence
  Description of Artificial Sequence: Synthetic coding sequence
atggaaaagcacaatgccctgagatgtttgcctggtcggaataggaaggagtcaacctccgagcagatgcccagcttcccggagatggtgtattatatccaggagaaagcttcccatcgaatgaagacccctgttaagtacatgactggtaccactgtgctaccctttaatcccgctgcattcggggagatcgttctgtacctcaggatgtgcctggcacacagtgctggggttgtccctacttcccagagcctcgcagatatgcaagaccatgccccagcgatcgggcgttacatccgcacattaatgagcagtggtcagatggccccatcttcatctaacaagtcaggggagaccaacccggtccagatatatattggcctgttacaacagctattggctggagtgggaggcctcccagtgatgtactgtctgctagaggccgtcagtgtctatcccgagaaattagccaccaagtttgtcgataaaacagagtggattaagtcgttgatgaataacagtaaggaggaaatgcgggagcttgccgctctcttttacagtgtggtcgtctctactgtctctgggaacgaacttaaatctatgatcgaacaattgattaagacgaccaaggacaatcacagccccgagatccaacacggctctttacttgcattgggctttaccgtgggcagataccttgcaaaaaaaaaaatgcgtatgtctgagcaacaggaccttgagaggaacgcagacaccctgcctgaccaggaggaacttatccagtccgccacggagacaattggatcattcctggactcaaccagccccctgctagctattgcggcttgcaccgccctgggagagatcggcaggaatgggcctcttcccataccaagcgagggatctggcttcaccaaacttcacctcgtggaaagcctgcttagccgaattcctagctcaaaagagaccaacaaaatgaaagagcgcgcaatccagactctggggtacttccctgtgggcgacggcgattttccacatcagaaacttcttctgcagggcctcatggattccgtcgaagccaaacaaatagagcttcagttcactatcggggaagcaatcacatccgctgccatcgggacaagctccgtggcagcaagagacgcctggcaaatgacagaggaggagtatacccccccagctggggcaaaggtcaatgatgtcgtgccgtgggtcttggacgtcatccttaataagcatattatatctcccaacccgcatgtgaggcaggccgcttgtatttggcttctgtccctagtcagaaaattgtccacgcacaaggaagttaagagtcatcttaaagagatccagtccgctttcgtcagcgttctttctgaaaatgacgagctatctcaagacgtggcaagcaagggtctcggtcttgtttacgaattgggaaatgagcaagatcagcaagagctggtcagtactcttgtggaaaccctaatgaccggtaagagggtgaagcatgaggtcagcggcgagacagtcgtctttcaggggggtgccctcggcaaaactccagatggccaaggccttagtacctacaaggaactctgctcgcttgcatccgatttgagtcagcctgacctggtttataagttcatgaacctggctaaccatcatgcaatgtggaatagtaggaaaggggctgcttttggtttcaatgtgatcgcgacccgggcaggggagcagttggccccattcctcccccaactggtgcctaggctgtacagataccagtttgatcccaacctcggcattcgtcaggcaatgaccagcatctggaatgcccttgttacagacaagtctatggtggacaaatatctcaaggagattctgcaggatctggtgaaaaatctgacttcaaatatgtggcgggtccgagagagttcttgtctggccctgaatgacctactcagaggcaggcctcttgacgacatcattgacaagctacctgaaatctgggaaaccctttttagggtgcaggatgatatcaaagaatccgtcagaaaggctgctgaactggcattgaagaccctgagcaaagtttgcgtaaaaatgtgcgatcctgccaagggggcagcaggacaacgcacaatagctgccctcttgccatgtctgcttgacaagggtatgatgtctaccgtgaccgaggtaagagccttgtcaatcaataccctggttaagatatctaagtctgctggagctatgctaaagccacatgcacccaagctgatcccagccttgctggagagcctgtccgttcttgaacctcaggtgctcaactacctgagcctgagagccacggaacaggagaaagctgccatggacagcgctaggctctctgctgccaagagttcaccaatgatggagaccattaatatgtgtctgcagtaccttgacgtatctgtgctcggtgagctggtaccccgtttatgcgaacttattaggagcggagtgggcctgggcaccaagggagggtgtgcctcggtaatagtgtctctgactacccaatgccctcaggacttaacaccctacagcggcaagcttatgtcggccctcctgagtggccttactgatcgaaatagtgtgatacaaaagtcctgcgccttcgccatgggccaccttgtacggacctctcgagactcttccactgagaaactcctgcaaaagttgaacggctggtacatggaaaaggaggaaccaatttacaaaacaagctgcgctttgaccattcatgctatcgggagatactcaccagatgtgctgaaaaaccacgcaaaggaagtgcttcccctcgcattcctcggcatgcacgaaatcgcagacgaggagaagtccgagaaggaggagtgtaacctgtggacagaggtgtggcaggaaaatgtacccggaagctttggagggatcaggttgtatcttcaggaactcattacaattacccagaaagctctgcagagccagtcctggaagatgaaagcccagggagccatcgcgatggcgtccattgccaaacaaaccagctcccttgttcccccttacctggggatgatcctgacggcactcctgcaagggctggccggaaggacatgggcgggtaaggaggagttgctgaaggccatcgcgtgtgtcgtcactgcctgctcagccgagcttgagaagagtgtgcctaaccaaccaagcaccaatgagattctacaagctgtcttaaaggagtgtagcaaggagaacgtgaaatacaagattgtggccatcagctgcgcggctgacattctgaaggcaactaaggaagaccgcttccaggagttttccaatatcgtcatccccctgataaagaaaaacagccttgagtcatctggcgtgcggactacaaagaacgaggaggagaacgaaaaagagaaggagctccagctggagtatctgctcggcgctttcgagtcgttgggaaaggcttggcccaggaacgcagaaacccagcgctgctacaggcaggaattgtgcaagctgatgtgtgagagactgaaactaagtacctggaaggtgcaactgggggtacttcagagtatgaacgcgttctttcagggcctgatgcttctggaggaggagcatgctgaccctgaagctctggctgagattctcttggaaacatgcaagtccattacctacagtctggagaacaaaacttatagcagcgttaggactgaggcactttctgtcatcgagctgctgctaaagaagctggaggagagtaaacagtgggaatgccttacatcagagtgtcgggtgttgctgatcgagagtctcgctactatggaaccagattctcggccagagctacaggaaaaggcggcactgctcaagaaaaccctagagaacctggaatag

SEQ ID NO: 58932 - DNA, 618 bp, Artificial Sequence
  Description of Artificial Sequence: Synthetic coding sequence
atggaggacggcggacagcgagaggaggagacgcgcagaaatgccacatgtggcgctgctgccaaaagtgagaataggggtaagaggcacgcatcagcaggaaagaaaggcgcaggcggaacctcccccactgcacccagcacgaagaggcccctccctggactgagtgcgccactgggtgccggtagcgcctctagccctccccttagggcaccggtgccaaggagtgagtgccccggacggcgtaggccagtgctggccgctcgctccgacgccctggaatcatcgcctatctccctgcccgcaacgcccgtcaggaggcctttgctgtcttactccgcacctacccacttgggaacccctggaggcgcaagggggcacttgcagggcgaggggctcagaggccagggcaagccacctgtgtggcgcgttcgcagagccctcccccctggctggacccagcaagcggaagcccaggagcagggctctgcaacgcgagcagggctgggagccaggcgaggggtcggtactgcctcatggggttggacttgggctacatgcggtcggaagggcgctcggaacagaaaacgaagcgatgagagacccagacctccatag

SEQ ID NO: 58933 - DNA, 1353 bp, Artificial Sequence
  Description of Artificial Sequence: Synthetic coding sequence
atgaatagagtcagtgaggagaaggaggtcactgaggaacggctgaaagccgaacaggaaagctttgagaaaaaaattaggcagttagaagagcagaatgaactgataatcaaagagcgggaggcactgcagctgcagtatcgtgaatgccaggagctgctcagtttataccagaagtatctctctgagcaacaggagaaattgacaatgagcttgtccgaactcggagccgcaaggatgcaggaacagcaagtcagcagcaggaagagcaccctgcagtgtagttccgtggagctggatggcagttacctgtccatagctcgaccacagacgtattaccagaccaagcagcgacccaagtccgcggtgcaggattccgccagtgagagtctgatcgcctttcgcaacaattctctcaagcccgtaacgttacatcaccctaaagatgatctcgataagatccctagcgaaacgactacctgtaattgtgagagtccagggaggaaacccgctgtacccaccgaaaagatgccccaggaagaactccatatgaaggagtgtcctcacttgaagccaacaccctctcaatgctgtggacatagactggcagccgacagggtgcacgacagccatcctaccaatatgactccgcaacaccctaaaacccacccagaatcttgtagttactgccggttatcatgggcctcactggtgcacggaggcggtgccctccagccaatcgaaactttaaagaagcagattagcgaggataggaagcagcagctgatgcttcagaagatggagctagagatcgaaaaagaaaggctgcaacacctgctggcccaacaggagaccaagctgctgctcaaacaacagcagctccatcagtcccggctcgactacaattgcctgctcaaatccaattgcgatggctggttgctgggcaccagctcatctatcaagaagcatcaagatcctccaaattctggagaaaatcgaaaagagcgcaagacggtagggttccacagccatatgaaagatgacgctcagtggagttgccaaaaaaaggacacctgtcgcccacagagaggcacagtgacaggtgttagaaaagacgcgtccacaagccctatgcccaccggctcgctcaaagactttgtcaccactgcgtcaccgtctttacagcacacaacgtccaggtatgaaacctctctgcttgatcttgtgcagtccctcagcccaaactccgcccctaaaccccagcgatatccttctcgtgaagccggagcttggaatcacgtgaatcttcaggaggtgagctcccctagtcgccgaggaggccttcacctttag

SEQ ID NO: 58934 - DNA, 1257 bp, Artificial Sequence
  Description of Artificial Sequence: Synthetic coding sequence
atgaaaaagcgaaaagagttgaacgctctgattggcttagccggagactcacgcaggaaaaaacctaagaaggggcctagttctcataggctgctgcgtactgaaccacctgacagcgactctgagtcaagctccgaagaagaggaggaatttggagtcgtcgggaaccgcagtcggttcgctaaaggcgactaccttagatgttgtaagatttgttatccgctctgtggcttcgtcattcttgctgcctgtgtggttgcctgtgttggcctcgtgtggatgcaggtcgcattgaaagaggacctcgatgctctgaaagagaaatttcggactatggaaagtaaccagaagagcagctttcaagagatccccaaactcaatgaagaactcctgagtaagcaaaagcagttagaaaaaatagagtctggcgagatgggtctgaacaaggtctggattaacattacagaaatgaataagcagatctccctgctgacctcagccgtaaaccatttgaaagcaaatgtgaagtcggctgctgatttgatatcgttgccgacaaccgtggagggactacagaaaagcgtggcaagcatcggaaatactctcaactctgttcacctggctgttgaggctctgcagaagaccgtcgacgaacacaagaaaactatggaacttcttcagagcgatatgaaccaacactttctgaaggagacaccaggctccaaccagatcatcccttcccccagtgcgaccagcgagctggataataaaacgcactctgagaatctcaagcagatgggcgaccgcagcgctacgcttaagaggcagagtctggatcaggtcacaaataggaccgacaccgtgaagattcagagcattaagaaagaagattcatccaactcccaagtaagcaagcttagagagaagttacagctcatcagcgctttaaccaacaagcctgaaagtaaccggcctccggaaaccgccgatgaggagcaggtggaaagctttacatctaagccttcagctctgcctaagttctcccagttcctcggcgatcctgtggagaaagctgcacagcttagaccaatctcactgccaggtgttagctccactgaaggccaaactcagttgttgctgtctcctgcctggcgcaatgccgtgaactttggctcttctcagtgggggatcccaggcaaggtcatcctctctaacgtatggaataggaggcagatgccctggggaaattctctatag

SEQ ID NO: 58935 - DNA, 1203 bp, Artificial Sequence
  Description of Artificial Sequence: Synthetic coding sequence
atgggggtgcttatgagtaagagacagacggtggaacaggttcagaaggtgtctctggctgtcagcgcattcaaggacggtctgcgtgacagaccttctatccgcaggaccggggaacttcccggatctcggcgaggtacagtggaaggctccgttcaggaagtgcaagaagagaaagaggcagaggcgggtacgagcgtggtccaggaagaaagctcagccggtagagccgcttgggagcgcctccgcgacggaaggggcgtcgagcctgaggaattcgaccgaactagccgcttcactccaccagccttcatcaggccgactcgcaaactggacgatgacaaaccaccagagatctgcctagaacctcgcgagcccgtggtgaacgatgagatgtgtgacgtttgcgaggtgtggaccgctgagagtcttttcccctgccgtgtctgtacccgggtctttcacgacgggtgtctgaggcggatgggctacatccagggtgattcagccgcagaggtgactgaaatggcgcacacagaaacagggtggtcctgccactactgcgacaatatcaatctgctgctgaccgaggaggaaatgtacagtctcactgagacatttcaacggtgcaaagtgatacctgactgctccttgacactcgaggattttctgcggtacaggcaccaggctgccaagcgcggtgaccgggaccgagccctcagcgaggaacaggaggaacaggctgctagacaatttgcagccttagatccggagcacaggggacatatagagtggcccgattttcttagccacgaatccttgttactgttacaacagttgagaccacagaatagccttcttagactgctaaccgtgaaagagagagagcgggctagggctgccttcctggcccgaggcagtggaagcaccgtttccgaagccgaatgtcgcagagctcagcatagctggttttgtaagcggtttccagaagctccctcttgctccgtgagtatcagtcacgtggggcctatcgcagacagctcaccagcttcctcctcttccaaatcgcaggacaagacacttctgcccaccgagcaagagagccggtttgtagactggcctacctttctgcaggagaatgtcctatatatccttgcagctcgaccaaatagtgccgcaattcatctgaagccccctggttag

SEQ ID NO: 58936 - DNA, 210 bp, Artificial Sequence
  Description of Artificial Sequence: Synthetic coding sequence
atgatggtgctcacacctttctggttaggacgcgattgtcctagtaggggccagccgacattacgggagggcaaggggctctccgtcccgtttacctgcaagctgaacaacccacagagatacctcctctacttgacacacacccccaggcgtcagtactcaccagcctggtatcttcccggtaagctgggaattacccttacggtgtag

SEQ ID NO: 58937 - DNA, 1173 bp, Artificial Sequence
  Description of Artificial Sequence: Synthetic coding sequence
tgcgaaaaatcgaccttctttaagcaccagaagaggacacacacggtagaaaaaacctttgagtgcagccacgggaaaaagtctttttgtcaggaaagtcacttcactgaacaccaccgcacttgtaccagggagaagccctgtgagtcaaacaaatacggtaaaaccttccaccagaagcgctcttttatccaccaccagagaacacacaccggagaaaaaccatacgaatgcaaggaatgccgtaagtcttttcatgttaagccaaaccttacgaagcatcagaaaacacatatcggcgaaaaaccatttaaatgcacggcttgcggccgtactttcttccagcagtccacattaaacgttcaccaggggaagcacacagaggaaaagccttataaatacacggagtgtgagaagtctttttataagtccgtactcatcatccacgagaggacacacacaggagagaaaccgtgcgggtgcaatgagtgtgagaaaagtttcgaggtactgactactctagtcatccatcagcggacccacaccggcgaaaaaccatacaaatgtaacgagtgcgagaaatcatacctcaatcttaaatcacacctaaatatccacctgcggaatcacacaggaaaaaggccacacgtctgcaacgaatgtggcaaggcctttagcatgaaatcaaacttcactgatcatcagcgcactcattgcggggagaagccatacaagtgcaacgagtgccggaagtcattctatatgaagagtgccctgagccaacatcagcggatccacatttacaagaaaccctacgagtgcaaacaatgcggaaaaacgtttcaaaagagccacctgatagagcaccagcggacccacccgggtgagatcccgcacgagtgcaacaagtgtggcaaaagtttctgctacaaaagccctcttacaattcaccagcggactcatattgaggaaaagccttacaagtgctcgaagagcgtcacctacttctgtatgaagtctcaccttaccgtccaccaacggcctcacactagaaagaaccccttcgaatgtaatgaatgtcgtaagatgttctatgtgaaatccaacctaatcaaccaccagcgcactcacacaggggaaaagccctatgaaggcaatacgtgcggaaagtag

SEQ ID NO: 58938 - DNA, 6279 bp, Artificial Sequence
  Description of Artificial Sequence: Synthetic coding sequence
atggttctgaaggttgacaccagcgagtccctgtggcacatccagatctccagatcccggtttctgttggactccgatgggaagcgcctcatttgcgaggtaagcttatgcaaaattaactccaaagtgcttaaaagcggacagctggaggacacgtgtctggttgaacttagtctcgctttggatctgtgcctcaaggtcgggattagttcgagacacttgaccgccatcacagtagatgtgtggaccctccatgccgagctccatgaaggcctcttccagtctcagttgctctgtcaagggccatccctggcttccaagcccgtaccttgctctgaggtgacagaaaaccttgtcgaacctactctgcccggtctctttttgttacagcagctgcccgatcaagtgaaggtcaagatggagaatacatctgttgtactgtccatgaatagtcaaaagagacaccttacctggactttgaagctgctacagtttctctatcacagagatgaggatcagctcccactccgttcctttacggccaattcagacatggcacaaatgtcgactgagctcctgctcgaggacggccttttgctaagtcagtcccgacagcgcattgtgtgtcttaacagcctgaaagcctccgtgcaggtgaccactatcgacttatccgccagtttggttcttaacacatgcattatacactatcggcatcaagaatttagccattggctgcatctcctggcccttgaaacacagggcagctcctcacccgtgctcaaacaacggaagaagcgtacatttccccaaatcctggcgccaattattttctcaacaagtatctccaacgttaacatttcgattcagctaggggacaccccaccctttgctttgggattcaattctatttctcttgactaccagcatttgagaccccagtcaatccatcagcggggagtgctaacagtggatcatctgtgttggcgagtgggctccgattcacacatccaaagagccccacatccccctaatatgcatgtgtggggggaagctctcgttttggactcctttaccctacaggggtcctataaccagcccctgggactgagttcaacccaatccgatactctgtttctggattgcacaattcgcggattgcaggtagaggcaagtgacacgtgcgctcagtgtctctcccgcatccttagcctgatgggccctcaatccggcaagtctgcggtctccagacacagtagcttcggtgagtccgtgagtctgctctggaaagtcgacctgaaagtcgaggatatgaacctgtttacactgtctgcgcttgtgggggcttctgaagttcgactcgacaccttgacaattctgggctcagccgagacctctacagtgggcatccaaggccttgttttagcactcgtgaagtctgtgactgaaaaaatgcaaccgtgttgtaaggccccagacattcctacgccagtgctctctctgtctatgctgagcatcacataccactcctcaattcggagcctagaggtccagtgcggggctgggctcacattactgtggagccccccagaccatatgtacctgtaccaacacgtccttgccaccctgcagtgcagggatctcctcagggctacagtgtttcccgagaccgtcccatccctggctctggaaacttcaggcacaacatcagaactggagggacgggcacctgagcctctgccgccaaagaggctgctaaacctgacacttgaggtttccactgccaaactcaccgccttcgtggcagaagataagtttattacactagctgcggaatcagtctcactgtcacgccatggagggtccctgcaggcatactgtcccgagctggcagcagggttcgatggcaattccattttcaattttaaagaggtggaagtgcagttattgccagaattggaggaaatgatcttacatagaaaccccttcccagctttgcagacactgcggaacagagtctggctactcagctttggctctgtctctgttgaattcccgtatcaatatgacttcagtcggactctggatgaggcagtgggagtgcagaagtggctgaaaggactgcaccagggaacccgggcttgggcttctccttcaccagtgcctctgccaccagacctattgctcaaagttgagcacttttcttgggtttttttagatgatgtgtttgaggtaaaattgcatgacaattacgaactaatgaaagacgagagcaaagaatccgccaagcgactgcagctgctggatgctaaagtggccgctttgcgaaagcagcatggggagctgctgcccgctcgcaagatagaagagctatacgcctctctggagcgaaagaacatcgaaatctacattcaacggtctcggagactatacggaaacacccccatgagacgcgctctactgacgtggtcgttggcaggactggaattggttgcgttggccgacgcctccttccacggtcccgagcatgtagtggagcaagtccaggagttagatcctggtagtccattcccccctgaaggacttgatttagttatccagtggtgcaggatgctgaaatgcaacgtgaagtctttccttgtccgcattcgtgactatccgagatacctgttcgaaatccgggactggcggcttatgggacggctggtgggcaccgaacagagtggccagccttgtagtcgtcggagacagattctacacctcgggttgccttggggtaatgtggctgtggagagaaacatgcctccactcaaattctatcacgatttccactcggagatctttcagtacactgtagtgtgggggccatgttgggatcccgcttggacactgatcggtcagtgtgtcgacttgttgaccaagccatccgccgacccatccccgcctctgccgtggtgggataaaagcagactgctctttcacggggactggcatatggatatcgagcaggccaatctacaccagctagccacagaagacccctacaatactaccgagaatatgcactgggagtggtctcacctgtctttccattggaagccgggacagtttgtcttcaaaggagatctcgatatcaacgtgcggacggcaagcaagtacgatgattgttgttttctgcacctacctgatttatgtatgacgcttgacttacagtggttatgtcatggtaatccccatgaccaccactccgttactctgcgggcacctgagtttctgcccgaagtgcccctagggcaattgcacgatagctacagggcttttcgctcggaaaacctgaacttgagcatcaaaatggacctaacacggcatagcggcacaatcagtcaaccacgcattctgttgtactcaagcacactgaggtggatgcaaaatttctgggcgacctggactagcgtgactaggcccatatgccgtggcaagctgttcaacaaccttaagccttctaaaaaaaagcttggccagcattataagcagctgtcatacactgctctgttcccacagctccaggtgcactattgggcgtctttcgcacagcagcgtggtatccagatcgaatgttcgcaaggccacgtattcactagaggcactcaacgcctgattcctcaggctggtaccgtaatgcgcaggctgatatccgactggtccgtaacacaaatggtgtctgatctgtcgcaggtgaccgtgcatctgatggcctcacctacagaggaaaacgcagaccactgccttgatccccttgtaaccaaaacacacttactgagcctgtcatcccttacatatcagcggcacagtaatcgcaccgctgaggaggagttgtccgcacgggacggcgaccccacattccacacacaccaactgcaccttgtggacttgagaattagctggacgacgactaatcgcgatatcgcctttggactgtatgatgggtacaagaaggccgcagtgcttaagcgtaacctgagtactgaagctctcaagggtctgaagattgacccacagatgcctgctaaaaagccgaagcgaggggtgcccaccagcgcttcagctccacctagagtcaacacgccaagctttagtggccagccagacaagggaagctccggtggcgcttatatgcttcagaagctcatcgaggaaactgatcgatttgtggtttttacagaggaagagtctgggatgtccgaccagctgtgtggtatcgcggcttgccagactgacgacatttacaatcgtaactgcttgatcgagttagttaattgccagatggttctccggggagcagaaactgaaggctgcgtgattgtctctgcagcaaaagcacagctgttgcaatgtcagcaccacccagcatggtacggagacaccctcaaacagaagactagctggacatgcctactggatggcatgcaatacttcgctacgacagagtcttcacccaccgagcaagatggcagacagttatggctggaggtgaaaaacatagaggagcacaggcagcgtagcctggattcggttcaagaattgatggaaagtggtcaggctgtgggcggtatggtgacaaccactacagactggaaccagcccgcagaagcacagcaggctcaacaagttcaaagaattatctcacggtgcaattgcaggatgtattacatctcatacagtcacgacattgatcctgaactggccactcaaattaagcctcctgaagtcctggagaaccaagagaaggaggatctcctgaaaaagcaggaaggcgcagttgatacgttcacactgatccaccatgagctcgagatatccactaatcccgcacagtacgccatgatccttgatattgttaataatctgctgcttcatgttgaaccgaaaagaaaggagcactctgaaaaaaagcagcgcgtcagattccagctggaaatctcttcaaaccccgaggagcagcgcagcagtatacttcacctgcaggaagccgttcgccagcacgttgcccagatacgtcaactcgagaaacagatgtacagcatcatgaagtcgctccaggatgacagcaagaatgagaatctgttggatctgaaccagaagctgcagctgcagctgaaccaggagaaggccaatctgcaactggagtccgaagaactaaacatcctgatcaggtgctttaaggattttcaactgcagcgggcaaacaaaatggagctcaggaaacaacaggaagatgtgagcgttgtccggaggacagagttctacttcgcgcaggccaggtggagattgactgaagaggacggccagctggggattgccgagctcgagctccagcgcttcttgtactctaaagtgaataaaagcgacgacacagccgaacacttgttagaactcggatggtttacgatgaacaatttacttccaaacgccgtatataaagtggtgctacgaccacagagcagttgtcagtccggtcgtcagctcgcccttagactgttcagtaaagtgcggcctccagttggtggaatatccgtgaaggagcacttcgaagtgaacgtcgttccacttacaatccagctaactcaccaattcttccacaggatgatgggcttcttctttccaggaagatcagtggaggacgatgaggtcggcgacgaggaagataaatctaaactcgtgactacaggtattcctgttgtgaagcctaggcagttgatagccacggatgacgcagttcctcttggtcccggtaagggggtggcacaggggctgacacgaagctcaggcgtgcgacggtcattccggaagtcacctgaacacccagtggacgatattgacaaaatgaaagaacgtgcagccatgaacaactcgtttatctacattaaaattccccaggttcctctttgtgtgtcctataagggggagaagaattctgtggactggggcgacctgaaccttgttttaccctgtttggaatatcataataacacttggacgtggctcgatttcgccatggcggtcaagcgagactctagaaaagccttagtggctcaagtcatcaaagaaaagcttaggctgaagtcagctacgggttcggaggtgcgcggtaagttggagacaaagtccgacttgaatatgcagcagcaagaggaggaggaaaaagcacgcttgctcattgggctatcggtcggcgataaaaaccctggcaaaaaatccatattcggcaggcggaagtag

SEQ ID NO: 58939 - DNA, 2571 bp, Artificial Sequence
  Description of Artificial Sequence: Synthetic coding sequence
atgagtggagaactgcagcgcaagatcggactcaaggttctggagatgcgcggaaatgcagtggtggggtacctgcagtgttttgacctggaaggagagtccggccttgttgttcgtgctattgggacagcgtgtactctggacaagctctccagtccggctgcctttctgccagcgtgtaatagcccgtctaaagagatgaaggaatcccccctggtccacccacctagtcatggatgcaggtctacacataatagtcctatccacactgctacgggctcacgattgacccagaattttagcgttagcgtgcctaccctgatttacactggtatggggagcggctctgccggtaaagaaggagggccattcaaagcgctcctgaggcagcaaacccaatccgctctggagcagcgagagttccctttcttcaccctgacggcctttccacccggatttctggtgcatgtcggcggtgtcgtttcggcacggagcgtaaaattgctcgacagaattcacaatccagccttcgtcggaatcatgggaaacacaaggagttacaaactgttagactggaacagctttaatagtgatgaacctgagacccgggacgcctggtgggcagagattaggcaggagattaaatctcatgctaaagctctgggctgtcacgccgtagtgggttacagcgagtctacctctatctgtgaagaagtgtgcattctgtccgccagtggcacagcggcagtgcttaatcctaggttccttcaggatggcactgtggaggggtgccttgaacagcgcttggaggagaacttaccaacaaggtgtggcttctgccacataccatatgatgaacttaacatgccattcccggctcatctcacatattgctacaactgccgaaaacagaaagtgccagatgtcctgtttaccaccatcgaccttcctacagatgcaacagtcataggtaaaggctgcttgatccaggctaggctgtgcagactgaagaaaaaggcgcaggccgaggcgaacgccactgccatcagcaacctacttccatttatggagtatgaagtccacacacagctgatgaacaagcttaaattgaagggtatgaacgcactgttcggacttagaatccagatcaccgtgggcgagaacatgctcatgggtctggcttcagcaacaggcgtgtacctcgccgcattgcctacccctggaggcattcaaatagccggaaaaacgcccaacgatggctcatatgagcagcacatcagtcatatgcaaaagaaaattaacgacaccatcgccaagaataaggaactgtatgagataaatccccctgagatcagtgaggagattataggcagccctattcccgaaccgaggcagcgcagtcggctgttaagaagtcagagcgagtcctctgacgaagtcacagaacttgacttgtctcacggtaaaaaagatgccttcgtcctagaaatcgacgacactgacgcaatggaggatgtccacagtttgttaacagacgtgccacccccatctggattttactcctgcaacaccgagattatgccgggtattaacaactggacttcggaaattcagatgttcaccagtgtccgagtaattcgtctaagctctctcaatcttaccaaccaagccctgaacaagaatttcaatgatctctgtgaaaatctgctgaaaagtctgtacttcaagctacggagcatgattccatgctgtttgtgtcatgtgaactttaccgtgagcctgcccgaagatgagttgattcaagtcacagtcaccgccgtcgctatcaccttcgacaagaaccaggcactgcagaccaccaaaacacccgtggagaagtcactccagagagcttccactgacaatgaggagctgctccaatttcctcttgaactgtgctcagattcactgccaagtcatcccttcccccctgcaaaggagcacctggagagtgcgtcatctaattcagggattcctgcagctcagcgcgataggtgctctagttggattgaactgatcaagctgaaggctcaaactattaggagaggttccattaagactaccatgacggtcgagaaagcatcccccgttggagacgggaatttccggaaccgctctgcacccccatgtgctaattcaactgtgggggtagttaaaatgacacctcttagctttatcccaggggctaagatcaccaaataccttggcatcatcaatatgttttttataagagaaactacgtctctgagagaagagggcggtgtttctggctttctgcacgcttttatcgctgaggtcttcgccatggtgagagcgcacgttgcggcattggggggtaacgcggtggtgagctatatcatgaagcagtgcgtcttcatggagaaccccaacaaaaatcaggcacaatgtctgatcaacgtgtctggggacgccgtggtttttgttcgcgagagtgatctggaggtcgtgtcatctcagcagcccaccactaactgtcagtctagttgcacagaaggcgaagtgacaacttag

SEQ ID NO: 58940 - DNA, 1545 bp, Artificial Sequence
  Description of Artificial Sequence: Synthetic coding sequence
atgatggaagacttggggcgtaaggagaaccaggataagaagcagcagaaggacccccgattaactatggagatgcgacacaagcaggtgaaggaaaacaggttacggagagaaaaggagttggaatatcagagaatcgaaaaaacgctcaagaaaagcgccttccttgaggctcaatgtttagtgcaggaggagaaaaagaggaaggcattagaagccaagaaagaggaagaggagatccaaagggagatggttaagctgcggagggagatcatcgagcgtcgtcgtacagtgaaggccgcatggaaaattgaaaaaaagagacaggaggagaactcacagaactcttccgaaaaagtcatgtttcaaagcacacatattctgccagatgaggagaagatggtgaaagagcgcaagagaaagctaaaagaagtcctcatccagactttcaaagagaaccagcaatgtcagaagcggtattttgcggcatggcacaagctgatactggatcacagaatcaagttggggaaagctggaacactgagtgactggaagatccaactgaaggtcctgagagcctggcgcgactacacccggtttcagaaattggagcgtgagacccaggctctggagaatgatctcagagaggaaaaccgaaagcagcaactggctactgaatacaatcgcaagcaggtgcttaggcactgtttcacagaatggcagcactggcatggagccgaactcttgaaacgagagttagccttgacgaaagaagaaacacggaagaagatggatgccctgctgcaggcagcttccttgggaaaactgagtgctaacggcttgtctggtatctccctgcctgaggaagccacagctatggtggggcctcctgtaaaaaatggccaagagacagcagtccccccactgtgggagaagccgcctctagggtcctccggctgcatgctctcccctccacttgggaggactacaacggggaatcttcagggatcgctgcagaacgtgtcactgagtgcgccaggtaacaaacagcacaaaacactgggggctgagccatcacaacaacccggttccaatgagaccctgcggaccacttcgcagaaggccgaacccctctgcctggggcacttccacaatagacacgtgttccaacagcagctcatagagaaacaaaagaaaaaactccaagaacagcagaagacgattctggagttgaagaagaatctgcaactggctgaggcacaatgggcagctgaacatgctctggccgtgaccgaagcacagagtcacctgctcagtaagcctcgcgaggaggaacctaggacatgccagatgttggtaaattctccagtagcttccccaggcactgagggaagatctgatagtcgcaactctctcagcggactcaggcgcaagcctaagcagctgatgaccccccaccccatccttaagggcagggccgttagtgtggttgcactcgtcgtagtaatattctcccctcgcgttgagtgtgtccactgggactag

SEQ ID NO: 58941 - DNA, 2283 bp, Artificial Sequence
  Description of Artificial Sequence: Synthetic coding sequence
atgggtgaccctgggtctgagatcatagaatcagtgcctccagcgggaccagaggctagtgagtccaccaccgacgaaaacgaggatgacatccagtttgtgtctatcctgttcccaaagatgcctaaacggcagggagattttctgcacttcctcaatgtcaaaaaggttaagaccgacacagaaaacaacgaagttagtaaaaaccattgtcgcttgtccaaagcaaaagagccgcatttcgagtacatcgagcagcccattatagaggaaaaaccatcactctcgagcaagaaggagattgataacctggtgctacccgactgttggaacgagaaacaggccttcatgttcacagaacagtataaatggctggaaatcaaggaaggcaaactcgggtgcaaagattgctccgctgtgcgccacctcggctctaaagctgagaagcacgttcacgtgtcaaaggagtggatcgcatatctcgttacgccaaacgggtctaataaaacgacaagacaggcatctcttcgcaagaagatccgggagcacgacgtgtctaaggcccacggaaagatccaggatctgctgaaggaaagcacaaatgactctatctgcaacctggtacacaagcagaataacaaaaatattgatgcaaccgtgaaggtgttcaatacagtctatagtctggttaaacataatcgaccattatctgatattgagggagcccgagaactgcaggagaagaacggggaagtgaattgcttgaatacccggtactcagccacccggattgccgaacatattgctaaagaaatgaagatgaaaatcttcaagaacatcatagaggaaaacgcaaaaatctgcattataatcgacgaggcttctaccgtgagtaagaagacaacactcgtgatttatttgcaatgtaccattcaaagtgccccagctccagttatgttgttcgtagccctgaaggagctcgtctcaactatcgctgagtgcatcgttaatacactcttgactacacttaatgattgcggctttactaatgagtacctcaaggcgaatttgatagcgttctgttcagacggagcaaacacaatactcggtcgaaaaagcggtgtggcaacaaaattgctggagaacttcccagagatcattatatggaactgtttgaaccacagacttcagctatcgctcgacgacagcatctctgaaatcaaacagatcaatcacctgaaaatctttattgataaaatatattcaatctaccaccagccaaataaaaaccagactaagttgctcggtactgtggccaaggagctggagacagagataatcaaaatcgggcgtgtcatgggacctcgctgggcagcctgttccctgcaagctgcaacggcagtctggcacgcctaccccatactctatatgcatttttcccactcatactccgggcttgccaaacggttggccaatatcaattttctgcaggatttagccttgatgattgacatattggaggaattctccgtgctgtcgacggcgttgcaatccagatccaccaacattaagaaggcccagaagctaatcaaacgcactattagagccctggaaaatctcaagataggcaccggcaagtatgaatctcagatagaggatctgataaaatccgataaatttaaagacattccttttaataaaaacaataagttcaacgctctgcctagatccatcctgttagataacattatacagcatatgaatctcaggcttctgtcagacaggaaccacgaggacattttcaactattttgacctgttggaacctagtacatggccgtatgaggaaatcacgtcaccctggattgcaggtgaaaaaacattgttccatctttgcaaaatcctcaaatacgaggtcgacttaaacgacttccgggaattcgtcaacaacaacatcaagtctaacaatgtgagtatccctactactatctacaaggcaaagaagatagtgagtaccatcgcgatcaattctgcagaggccgagagaggatttaacctgatgaatatcatctgtacccgggttcggaacagtctgacaatcgaccacgtgagcgacttaatgaccataaatcttctcggcaaagaattggctgattgggatgcaacgcccttcgtaaagagttggagcaactgtaaccaccgtcttgccaccgacacgcgagtcaggcaaaaatctactaaggtatttcatgaaaatcagctcgccatctggaatctcaagtag

SEQ ID NO: 58942 - DNA, 1230 bp, Artificial Sequence
  Description of Artificial Sequence: Synthetic coding sequence
atgaccctgtctagaggtaaagtggatttcgccacaatccagtgtggacagtgcctcatggaaacaattcagctgtccaatcacctgcaggtcccttgcgagtggtttgtgcagtcccagaagcccgtggataagctagaaaagcacatgccgaaataccttcgtcaaaagctgcgtgccgagcttaaacctaaaacacggattttcgagatacagccaatcagtggagtgttggatcccggagagaaatcaaacgtgcaggtcaaatttatgcccaaagaagaaaaattttattctcaaacattggtgttccaaattgcccaatccgcccaaaagctcaccctgttagcgagggggcaggggctagagccacgactggagttctcaccttctgtacttgatctggggcctctcctgctgtgtgccccaggggacgaagctgaggtgatcgtgaagaatccttgcaattttccaatcgagttctatagcttggagtttgaccagcagtacttgattgaagaaaaaattctccggaagctgaaaggttatgattcctacaacacactgttattgcctcctagaaatcccggagaaaagttgcccccagagctctacgaatactttaaggagatcaagaaatccaaggaagagcagatgagagctaagtacttggagaatttagcacaggaaaacgaggaggaggacatcaccagctcagatcagggaacctccaacagcactaaaaggacaagcttgagccgaggcatttctgtgacctctaatttagaagagtggcacgccctcctggttgagtctaagacctaccttgaagaagaggaggacgaggagtccctcgagaaaattattttccagactgacaagctccaatctatcgattcccacagcatggaggaggttggagaggtggaaaacaaccccgtgtcaaaagcgatcgcgcgacacctgggcattgacatctccgcggaaggccgactggccaagaatagaaaaggcattgcgattatcatccacggtacacctctgtcggggaaatctgccaacgccgtgtctgttgcaaagtattacaacgccgcatgcctgtcaattgacagtatcgtgcttgaagccgtcgccaacagcaacaacattcctggaattagagcgtgcgaactgtgtatccgcgcagccattgaacagtccatgaaagaaggagaggaagctgccgaatag

SEQ ID NO: 58943 - DNA, 375 bp, Artificial Sequence
  Description of Artificial Sequence: Synthetic coding sequence
atggcagtatatacccatactggctataacgaccactacatgtacttgaatcatggtcaacaaaccatacccaacggattgggtatggggggtcaacacaactacttcggactatgggtggacgtggactttgggaagggtcactccagggccaagccgacatgcactacttacaacagcccacaactgtcagctcaggagaactttcagtttgacaaaatggaggtgtgggctgtcggggacccttccgaagagcaacttgccaagggaaataaaagcattctggacgctgaccccgaggcacaagccctcctcgaaataagcggtcacagtaggcacagcgaagggctgcgggaggttcctgatgatgaatag

SEQ ID NO: 58944 - DNA, 2607 bp, Artificial Sequence
  Description of Artificial Sequence: Synthetic coding sequence
atgggaattactgaatcaagcgacaccccttcaagcctctcaccactgaacctgcctggtgccggttcggaaatggaggaaaaagttgccccagtgaaacctagcaggccgaagaggcactttagcagtgctggcacaattgagagtgttaacctagatgcaattcccttggctattgcacgtctcgataatagtgcggcaaagcataaattggcagtgaagcccaagaaacagcgcgtctctaagaaacataggcggctggcccaagacccacagcacgagcagggaggccttgaaagcaggccgtgtctggaccagaatggtcatccaggtgaagataaacccacctggcatgaggaagagcctaaccctttggacagcgaggaggaacgacgacgccaggaggattattggcgagagctggaagcaaaatgtaaacggcagaaggcagaagccgcagagaagcgcaggcttgaggagcaacgcttgcaagcgctggagcggagactgtgggaagaaaaccggagacaagagcttctggaagaggagggcgagggccaggaaccaccgttggaagccgaaagagcccctagggaagaacagcagcgctccctggaggccccaggctgggaggacgctgaacgtagggagagagaggagagggaaagacttgaagccgaggaggagagaagacgtctccaggcccaggctcaggctgaagagcggcgacggctcgaggaagatgccaggctagaagaacgaagaaggcaggaagaggaggagggaaggtgtgcagaagagctcaagcggcaggaagaggaggaagctgaaggctgggaagaattggagcagcaggaagccgaggttcaggggccaccagaagcactggaggaaaccggcgagggccgacggggagccgaagaggaggatctgggcgaggaggaggaagaggggcaagcccacctggaagattggcggggacaactgtctgaacttctaaatgatttcgaagagagattggaggaccaggaacgtctgaaacctgaggggcagagggaacacagtgaagagcccggtatttgcgaagaacagaatcctgaggccgagaggcgaagggagcagcagggacggtcaggtgatttccagggcgctgaccgcccaggtcccgaagagaaacgcgaagaaggtgacaccgagccactgctgaaacaggagggtccagttgaggccgcacagccccctgtggaacgaaaggaagctgctgctctcgagcagggaagaaaagttgaggaattacggtggcaagaggtggacgaacggcagacaatgcctaggccatatacctttcaggttagctccgggggaaagcagatcttgtttccaaaggtaaacttatctccggttacgcccgcaaaggataccggactgacagccgctcctcaggaacccaaggcgccaaaggcatcccctgttcagcatgctctgccatccagcttatcagtgcctcatactgcgattttggtcactggtgctcagttatgtggcccagccgttaaccttagtcagatcaaggacacagcttgtaaaagtcttctcggcctggaggaaaagaaacacgcagaggcccctgcaggcgaaaaccctcccaggggccctggtgacgctagggccggatctggaaaagccaagcccagacaggagtccccttcttccgcatccgcacttgccgaatgggcctccattcggagtaggattctgaagaacgcagaaagtgaccccaggtctagcgagagagaccagctgagaccaggagatgaatccacgcccagagggcgttgcgactcaagagggaaccagaggaagaccccgccagtcaatgctaaattcagcatcatgccagcctggcagaaatttagcgatgggggaacagaaacaagtaaacagtccacagaggccgaatcaatacgtaaacgtcccatgttgggaccttctgaggagacggcccctcaaccccctccagccggtgtgagggaactcggcaagggaccggagaaaagcgaaatgcaccgagaaccagccgacacaaccgagggctgcaagtttgctaaggatctccccagcttcctggtccctagcctgccgtacccccctcaaaaggtggtggcccacaccgagttcaccacctcatccgattctgaaaccgcaaacggaatagccaagccagatcctgtgatgccaggaggcgaggagaaggcctcgccgttcggcatcaaactgcggagaaccaattattcactcaggttcaactgtgaccagcaggctgagcagaaaaaaaaaaaacggcattcttcgacaggagacagcgcagacgcgggacccccagcggcaggatcggccagaggcgagaaagagatggagggtgtggctctgaagcacggtcctagcctgcctcaggaaagaaagcaggcaccgtctacccggcgtgattcggccgaacccagcagctccagatccgtgccggttgcacaccctggaccaccaccggcatcatcccagacacccggacctcccgtgcgccctcatcagcatccgcatttccccaattag

SEQ ID NO: 58945 - DNA, 309 bp, Artificial Sequence
  Description of Artificial Sequence: Synthetic coding sequence
gtcctgctgtgctgccccggatggagtgccgtcgtccggagttggctcaccgctaccagcgcatcatggcagctcgccggaataacaggaatgtgccatcacgcacagcttatctttgtattctttattgagaccgagttccaccacgtaggccaagccggacccgaactgctgactagcggagacccctctgcaagcgccagccagagcgcaggaatcaccggtgcaagccatcctcggagagctaatttctgcatctttggccgagatggcgtaagcccatgttggccaggctggagctccacatag

SEQ ID NO: 58946 - DNA, 396 bp, Artificial Sequence
  Description of Artificial Sequence: Synthetic coding sequence
tcagcctgcatgtgcgtgtgcgtgtgtgtgtgcatgtacatttacatctacatctacattttcttttttttctttttttttttttttttgaacatttttaagcaggctccccctcgacagaatcaagtacgtcgcccaggagcagtggcgcacacttgtaacccatcgaccgtgggaggacatggaggacagattacgaggggccaagaatttgagacttctctggccaatatgggggagacacctagtctactcaagatacagacctggcctggggtggttgcccatgcgtgtaatccttcctattccggcggtaggctgagacaagaaaactgtctgaacctcggcggagggggttgtggggagatcgcccttcagccaggccagcaggagtag

SEQ ID NO: 58947 - DNA, 309 bp, Artificial Sequence
  Description of Artificial Sequence: Synthetic coding sequence
gaagtgggccgttggctcgaacctggaaagcagcgcctgcaatgcgccgagatggcccctctccatagctctttgggcgataaggcgaggccatgtctgactaagaagaagaagatgctggacatgaaccctacactggtgtgctataggcaaggcttggcattgttacctagactaggctgcagtggcgcaatactggctcattgcaacctgcggcttctcgggtcaagtgattctcctgcgtccgctagcagagtcgccggtatcacaggtgctaggcatcacgcacagttaatcttcgttttttag

SEQ ID NO: 58948 - DNA, 288 bp, Artificial Sequence
  Description of Artificial Sequence: Synthetic coding sequence
ttcttcttttttctgcgatggtccttggcactcctgcctcgcgtggaatgctctggaatgatctctgcccattataacctccacctgcctggctcttcagatagtcccgcttctgcttccagggttgccggaacaacaggcgtccatcatcatgcgtggctgatcttctgtatcttttctcgggacggggtacttctctgttgtccaggatggagcccaactcctggcttgaagcggagcagttgcctgggctttcgcaaatgttgggattacaggcacgagccatag

SEQ ID NO: 58949 - DNA, 345 bp, Artificial Sequence
  Description of Artificial Sequence: Synthetic coding sequence
tggtgcacacccctgatacctgcaaccgaggttgagaccggcagatgggtggaacctcgatcgtctcgactcgggttttttttggtggagcttctgtccttcgacttgggcaaccgggctagactccatctcaaaaaaaagaaaaaaaaaaagtccctgggcaaaatctacttcttcctccgatggtctctggccctgctgccgaggcttggctgttccggggctatctctgcacattgcaaactccatttgctgggttcacatcactctccggcttcagccagccgtgtggccggaatcactggggcaaggcatcatactcgtctgatcttttttttcctttag

SEQ ID NO: 58950 - DNA, 396 bp, Artificial Sequence
  Description of Artificial Sequence: Synthetic coding sequence
tctgcatgtatgtgcgtctgcgtctgtgtatgcatctacatctatatctacatctacattttttttttcttcttttttgagtttttgaccaaacttataaagcagctggtgatgattaaaaatcaagtgcggaggcccggtgccgtggcccacacatgtaatgcaagcaccgtcggcggtcacgggggtcagatcacgcgcggtcaagagttcgagacgtcactcgccaacatgggtgagacacccagtctgcttaagatccaaacatggccaggcgttgtcgcgcatgcatgcaacccatcatactccgggggacgtctgcgacaggaaaactgtctaaacctggggggtggcggatgtggagaaatcgctctccagcctggacagcaggaatag

SEQ ID NO: 58951 - DNA, 384 bp, Artificial Sequence
  Description of Artificial Sequence: Synthetic coding sequence
atcctcgctcactgtaacctgcatcttccaaactcatcagatagcccagcctcagcctctcaagtggcaggaatcacaggtacttgctaccacacccagctgatcttcgtgtttctcgtcgaaactgggtttcatcatgtggggcaggacggccttgaactcctcacctccggggacctgccggcatcggcttcccagagcgctggcatcactggggttacacactgtgcacagcctagtagtctccttaccagcgagggtagaaaagaaacagtgtccacatttttcttctttttcctgcatgaaaccgtttcccacagtgtcgcccaggctcgggtccagtggcataacctgtcatcgctgcagcccccaccaagtaggtag

SEQ ID NO: 58952 - DNA, 288 bp, Artificial Sequence
  Description of Artificial Sequence: Synthetic coding sequence
ttcttcttcttcttgcgctggtcactagctcttttgccgagggtggagtgttccggaatgattagtgcacattataatctgcatcttccgggaagtagtgactcacccgcttctgcaagccgggttgccggtactacaggggtgcatcaccatgcttggctgatcttctgcattttctctagagacggggtgctgctgtgctgtcctggctggtcacctacccccggactgaaaaggagcagttgccttgggtttcgtaaatgctgggattacaggcacgaaccgtag

SEQ ID NO: 58953 - DNA, 96 bp, Artificial Sequence
  Description of Artificial Sequence: Synthetic coding sequence
gccaaaccaagactacaccagccaggccagtccggcgagacaccaagtttgcttaagattcagaagctcgccaggagggggggtgtacacttgtag

SEQ ID NO: 58954 - DNA, 264 bp, Artificial Sequence
  Description of Artificial Sequence: Synthetic coding sequence
tctgtggcccaggccggtgtgcagtggcacaatctgggttctctccagcccccaccccctagattcaaccgcttctcttgtctctccattccgtccagctgggactaccgccactcccctcccctactggcagacttctgtatctacctcgtcgagactggattccaccacgtgggccaagcaggactagaactactcacctcgtcagacctaccaacaagtgctagccagtcggcaagaatcacaggcgtgtctcatagatag

SEQ ID NO: 58955 - DNA, 195 bp, Artificial Sequence
  Description of Artificial Sequence: Synthetic coding sequence
cctcgcagatggtctcttcaggtgtacccaacagccccaaagcgccagagacctagtcggatgggacatgacgataatggcagttttgtcgaaaaaaagaggggcaagtgcggcgagaagaaggaacgctctgattgctactacgtttgcgtagagcgcagccggcacagacgactgcactttgtactgtattag

SEQ ID NO: 58956 - DNA, 456 bp, Artificial Sequence
  Description of Artificial Sequence: Synthetic coding sequence
cggttctacatagggtgcgacctatgtacgaactgttactacggagagtgtgttggaattgccgaaaaggaggccaagaagatggatgtgtacatttgtaacgactgtaaatgggcgcaggaaggctcatcagaagaactatattgcatttgccgaactcccgctggctcttgcagattctttatcggccacgatcgatgtcaaaattggtatcatggttgttgtatcggaattctgcaaagtgaagcggagctcatcgacgaatatgtgtgcccacagtgtcagtcgacagaagacgcgatggctgtgttgacgcccttgacagagaaggacgatgaagagcttaagagagtactttgttccctacagacccataagatggcacagccttttcttgagcccgttgatcccaatgacgctccagattactatggcgtcatcaaggaacctatgtag

SEQ ID NO: 58957 - DNA, 411 bp, Artificial Sequence
  Description of Artificial Sequence: Synthetic coding sequence
ggtacaataagtgctcactgtaatctgtgccttttagattcctccgacagccccgctagcgcttcaagagtggccggtatcattggcgcacaccaccatgcacagctgatctttgtgttcctggtagagatgggcttccaccacgttggccaggccggattgaaactcctcacatccgacccaccagcttcggccagtcagagcgccggtattactggcgtgagccatcacaattggctgcatggaggccctgatcgcgtcaagagaccgcctgtgttcttcttttggtttttcttcttcgaaatggagtcttactccgttgcccaggccggagtccaatggagagacttgagttcgctacagccacctccgcctcgtcacactatactgctaccccagccgccagaatag

SEQ ID NO: 58958 - DNA, 279 bp, Artificial Sequence
  Description of Artificial Sequence: Synthetic coding sequence
ttgaccccggacggatttttcttcagggtgcatatgctggtccttgactcatccagctgcaataagccttgccctgagtttaagcccggtagcagatacatcgtgatgggtcacatttatcataagcgtggacagctgccaactgccctgttacaggtccttcgcggacacctttgtccaggggacggcctgctccggtccagctcaagttatgtcaaacggttcaaccctaagcgcgaagggcagatccagggcgcaattcatacacagtgtatctag

SEQ ID NO: 58959 - DNA, 378 bp, Artificial Sequence
  Description of Artificial Sequence: Synthetic coding sequence
tccttttttttcttcttacgacaatccctgagtctgagcgccagactagaatgttccggaacaatatcggcccactgcaagctgaggctgctcggttctcaccattcaccagcttcagtgagcagaattaccagaagcggagtacaagatcagcggggtcagcatagtgagaccttgagcctcctgaagatccaaaagttagccggacatggaggacggcacctccagagtcaactactgggcagggttcgacaagaaaaccggctgaacccaggtggtaaaggctgctcagagcctaggccctgtcactgcaccagtgcttggacaacctctcgtaaaataaaaaaaaaaaagagaaaaaggaagaaaaagaagtag

SEQ ID NO: 58960 - DNA, 399 bp, Artificial Sequence
  Description of Artificial Sequence: Synthetic coding sequence
tgcatgtgtgtgtgcgtatgtgtctgcatctatatctacatctatatctacattagccagcctatttatatttttctactgcttttactgttgctcttcctgcgtcagtctctgatgattaagaaccaggttcgcagacctggtgccgtcgcccacacgtgcaacccatcaactgtcggaggccatgggggtcaaattaccagagggcaggagttcgaaacctccctggccaatatgggggagaccccaagcttgctgaagatccagacttggccaggagtcgtcgcccacgcatgtaacccctcttactctggtggtcgcctcaggcaggaaaattgcctcaaccttggcggagggggatgtggcgaaattgccctccagcccggacagcaggagtag

SEQ ID NO: 58961 - DNA, 111 bp, Artificial Sequence
  Description of Artificial Sequence: Synthetic coding sequence
ggaagagacgactggcaggctgcccctccggctgcacctgtccgagacccacttggcgaggctagctgggccccagaatgcggcggagacctggagaatctctatgtatag

SEQ ID NO: 58962 - DNA, 321 bp, Artificial Sequence
  Description of Artificial Sequence: Synthetic coding sequence
ttcttcctgagcttcctccactcctttttcctccgccagtcatttgcactggttgcccaagcaggagtccagtggcataacctcggatctctgcagccaccacctcctggcttcaaacagttttcctgcctgagtctgttgtccagctgggactacagacacgtacctccctgtcccgcaaacttcgttttcctggttgaaatgggtttcctccacgtgggacaggctggactcgagctgagaacaagcggcgatcccccaacactggcatcacagtcagctgggatcacaggtgtgagccacagggcgcagcctagttag

SEQ ID NO: 58963 - DNA, 276 bp, Artificial Sequence
  Description of Artificial Sequence: Synthetic coding sequence
tttttcttgagatggtcacttaccctttcatcaagactggaatgcagcggcgctaccagcgcccactgcaacgtgagactacctggaagtcgacactctcctaccagcgctagtcgtgtcgctggtacaacaggtgcaaggcatcttagtcggctcatttttattttcagccgggacggggtgtcaccttggtcccggagccctgacctcgccatccgcccacctcggccacctaaaaaactcggcctgcaagcccctgctactatgccaggttag

SEQ ID NO: 58964 - DNA, 381 bp, Artificial Sequence
  Description of Artificial Sequence: Synthetic coding sequence
aggcaccaggcacagcttatatttctttatgatctgtttctgtacgtttactttctgaaggaccgagtcctgctctgtcatccagggtggtctgcaatgacgcgttcacgtctcaccgccacctccgcgtctcaggttgcaggaacgattggaatgtgccatcacgccaggttgattttctttttttttttcgtcttcttggtggaaacgggatttcactgtgtctcacaacatggtcttgaactgttaaccttagaccctccagcttctgcatcccagagcgccagaattatcggcctgaatcactgcacacaacctaccttctgcattttctctcgtgatggtgatagcccctgctggcccgactggtcaaggacctag

SEQ ID NO: 58965 - DNA, 327 bp, Artificial Sequence
  Description of Artificial Sequence: Synthetic coding sequence
cagatcaagagcaagtttttcttcttcctgaggcggagtctggccctgagtccaagactcgagtgctccgggggtattagcgcccattgcaaacttcgactgcctggtagtaggcacagtcccgcttccgcaagccaggtggccggtaccacaggagcacgtcattatgcgaggctgatttttttgttcctcatcgagacagggttccactatgtcggccaggctgggttggagctgctcaccagcggtgatctgcctaccagtgccagccagtccgccggaatcacaggagtcagtcactgcacacagccagaagacatcttttag

SEQ ID NO: 58966 - DNA, 369 bp, Artificial Sequence
  Description of Artificial Sequence: Synthetic coding sequence
tgggattatagctttttctttttcctgaggcagtcccactccgtgcctcaagccggtgtgcaatggtgtaacctgtcctccttacaacctccgcctagcagattcaaaaggttctcatgcttgtcactgctgtcatcctgggactaccgccatacacctccttgtcccgctaacttttgtatctttagaactttcttcttttttctgcgctggtccttcgcactctctcctcgccttgagtgcagcggtgccatcctggtgcattgcaatctctgtcttccagggtcgtccgatagctgcctttcactgcctatttcatgggactacaggtgtgctccaccctgtctcgctaacttttgtatcttctag

SEQ ID NO: 58967 - DNA, 372 bp, Artificial Sequence
  Description of Artificial Sequence: Synthetic coding sequence
tgggattactcattcttctttttcctacggcagtcgcatagcgtaccccaggccggagtgcaatggtgtaacctttcaagcttgcaaccacccccatctcggtttaaacgcttctcttgcctgagccttctgtcaagctgggactacaggcatacacccccttgtccggctaatttcctgtacacattcgagctattcttcttttttctcagatggtcttttgccctttcaccccgtctggaatgttccggtgcaatcctggtgcactgcaacttgtgcctgccaggctctagtgactcatgcctgagcctgccaatctcttgggactataggtgcgcccctccttgtctggcaaatttctgtatattttag

SEQ ID NO: 58968 - DNA, 372 bp, Artificial Sequence
  Description of Artificial Sequence: Synthetic coding sequence
tgggattactccttttttttttttttacgccagtctcattccgttccccaggcgggtgtgcagtggtgcaacctgtccagtctacagccacccccttctaggttcaagaggttcagctgcctctcactcctctcaagttgggattatcgacacacaccgccttgccccgcaaacttcctttacacattcgaactctttttcttcttcctgagatggtctttcgctctgtccccccgactggagtgtagcggcgctatcctggtacactgtaacttgtgtctgcccggttctagtgattcttgtctgtcattacctatttcctgggattataggtgtgcccctccctgcctcgccaatttctgcattttttag

SEQ ID NO: 58969 - DNA, 81 bp, Artificial Sequence
  Description of Artificial Sequence: Synthetic coding sequence
ttcctgatggataaaagctcgttaacgggggcattgtgcagcattaccctggcaagcccctgcggtacacccggaatttag

SEQ ID NO: 58970 - DNA, 318 bp, Artificial Sequence
  Description of Artificial Sequence: Synthetic coding sequence
gaaacagggaggtgggtggaaccaagatccagtcgcctcggcttcttcctagtggaactgctcagtttcgatcttggcaatagagccagactccacctgaagaagaaaaagaaaaagaagatacctgggaagcattgcgtgtgttttatgaggtggtccctcgccctcttgccacgcctgggatgctctggggcaatcagcgctcactgcaagctgcatttgctagggagtcaccactcgccagcctccgctagtcgggtagcgggaatcaccggagcaagacaccatactagactgatcttctttttcttcgtttag

SEQ ID NO: 58971 - DNA, 228 bp, Artificial Sequence
  Description of Artificial Sequence: Synthetic coding sequence
tgttttagtcacagcttcttcttttttttcttttttctgagatggagtctcgccttatccccacggctggaatgttccggggctataagtgcccactgcaaactcaggctgctgggtagccgtcattcacccgcttctgccagcagggtcgctggaaccacaggagcctgtcaccacgccagactgttcttttgtatattctccagagatggagtctccccatgctag

SEQ ID NO: 58972 - DNA, 324 bp, Artificial Sequence
  Description of Artificial Sequence: Synthetic coding sequence
gtgctaaatggagctcaagccggagtgcagtggagagacttaggatctctgcaaccaccaccgccttcccacctccccaggccgtccaaagtgcccagggtgcaacccctccccggtcggcatcctgtgtgggaagtcagaggagtcagcgcttggccaccaatcgtgtgggacgtcaggtcacctagtgcttggctgcccagtttggagagcgaggagagactgtgccccgcagccatcccatcccgaaaatggggggctccagttcctcggcgacctatttgggacgtgagaagcgtgtccgcccagccccctcggttatag

SEQ ID NO: 58973 - DNA, 288 bp, Artificial Sequence
  Description of Artificial Sequence: Synthetic coding sequence
ttcttcttctttttgagatggtccctcgctctcctgccccgagtggaatgttccggcatgatttccgcccactataacctgcatctgcccggatcatccgactctcccgcatccgcctctcgcgtggcaggaacaacaggggtgcatcaccatgcctggctgattttctgtatttttagccgagatggtgtgctgctgtgttgtcccggatggtctccgactcccggtctcaagcgttcatcctgtctgggctttcgaaagtgttgggattaccgccatgagccatag

SEQ ID NO: 58974 - DNA, 399 bp, Artificial Sequence
  Description of Artificial Sequence: Synthetic coding sequence
tgcatgtgcgtttgtgtttgtgtgtgcatgtacatttacatctacatttatataagccaaccaatatacatcttcctgctgctgcttctgttgctgttcttacgtcagagccttatgatcaaaaatcaggtccggcgtccgggagcagtggcacacacttgcaacccttctacggtggggggtcacggcggacagataacccgcggtcaggaattcgagacgtcgctcgctaacatgggcgaaaccccctcattactgaaaatacaaacctggcccggagtcgtggcacatgcatgcaatccgtcatactcaggcggtaggctccgacaagaaaactgtctgaatttgggcggtggcggttgcggcgaaatagccctccagccgggtcaacaggaatag

SEQ ID NO: 58975 - DNA, 282 bp, Artificial Sequence
  Description of Artificial Sequence: Synthetic coding sequence
agcgtggcccaggctggggtccaatggcacaatctgggttcactgcaacctccaccccctagattcaacagatttagctgtctgtctatcccctcatcatgggattacaggcactccccccctcggcttgctgactttttgttcctcgtggagaccgaattctgtcacgtaggacaggccgctttagaattgctgacttctggggatttgccaacgagcgcgtctcagtcagcacgaatcactggtgtcagtcaccgtacaagaccttcactgttttactag

SEQ ID NO: 58976 - DNA, 423 bp, Artificial Sequence
  Description of Artificial Sequence: Synthetic coding sequence
ggaactatttcagcccactgtaacttatgtctgcttgactcctccgatagccccgctagcgcctcgcgcgttgccggtatcattggggctcaccatcacgcacagttgattttcgtattcctggtagaaatgggctttcaccacgtcggtcaagccggactgaagctcctcacatccgatccacctgtgtcagcgtctcagtctgctggtatcactggtgtcagtcaccatagagagccccagcacccgttcctcctgtccgtcgagagtcgggaccgcccattttttttcttcggctttttctttttcgaaatggagtcttacagcgtggcccaagctggggttcagtggcgcgatctgtcatccctccaacccccacctccaagggctcaggccatcttaccccctcaaccccctaaatag

SEQ ID NO: 58977 - DNA, 396 bp, Artificial Sequence
  Description of Artificial Sequence: Synthetic coding sequence
tgcaacctttgtcttctcgggtcctctgatagcccggcatccgcaagccaaatcgccggaattaccggagcccatcaccacacatggctgtttagcgtgttcctggtggagtccggtttccatcacgtagggcaggcagggctggagctgttaaccagtggagatcctgcctctgcctcccattcagctggcatcacaggcgtcagccactgtgcttggcccagacttgaggcaaccagtgtgcctaatttctttttcttctttttcttcttcttcttttttctcaggcggagcctagccgtggcgcaggccggtgtccagtggcgtaacctgggaagcctgcaggctccaccgccaggggtacatgctatattgctgccacagcccccagaatag

SEQ ID NO: 58978 - DNA, 153 bp, Artificial Sequence
  Description of Artificial Sequence: Synthetic coding sequence
cctagcttcctgcttttttttctcccctctttcctgcccttttcgctcagtagcctgagtttcctccctttcttgctttcctttctaacaggctcacatcttttcagtattacgcacacacatacgcatacccacactcatacccatacgtag

SEQ ID NO: 58979 - DNA, 423 bp, Artificial Sequence
  Description of Artificial Sequence: Synthetic coding sequence
ggtacaattagtgcccactgtaacctatgtttgttagactccagtgatagcccagcatcagcttcacgagtggccggaattattggggcacaccaccacgctcagctgatcttcgtcttcctggtggaaatgggttttcaccacgtagggcaggcaggcctcaagcttctgacgagtgacccgcctgtgagcgcatctcagagcgcagggatcacaggtgtaagtcaccatagagagcctcagcatcctttccttctgtctgtggaatcaagagacaggcccttctttttcttcgggttcttctttttcgaaatggagtcttactcagttgcacaagcaggcgtccagtggcgcgacctgtcttctctccaaccccctcccccacgagctcaagctattttgcccccacagccaccaaaatag

SEQ ID NO: 58980 - DNA, 396 bp, Artificial Sequence
  Description of Artificial Sequence: Synthetic coding sequence
tgcaacctgtgtttattgggaagtagcgattcaccagcctctgccagtcagattgccggtatcactggtgcccaccaccacacttggcttttttctgtattccttgtggagtcaggcttccaccacgtgggtcaggccggactcgagctgctgaccagcggcgacccggctagcgcgtcccactcagccggaatcaccggcgtctcacattgcgcctggccccgtctcgaagctacctccgtccccaatttcttcttttttttcttcttcttcttcttctttttaaggcggtccctggcagtggctcaggccggagtgcagtggaggaaccttggcagccttcaggcaccccctcccggtgtccacgcaattcttctcccccagcccccagagtag

SEQ ID NO: 58981 - DNA, 279 bp, Artificial Sequence
  Description of Artificial Sequence: Synthetic coding sequence
ttcttttttttcttctttgagactgactgtcggagcgtcacacgcttagagtgttcaggaattatttctgctcactgcaagctttgcttacctggcagctccgactctcctgcatccgcttcacaggcagccagaactatcggaacctgtcaccatacccagctgattttcgtcttcttcgtggagaccggtttccatcacgtcgggcaggacggcctgaatctgagtttagtaattcatccacctcggcctcctaaggtgctgggcctgcaggtgtag

SEQ ID NO: 58982 - DNA, 228 bp, Artificial Sequence
  Description of Artificial Sequence: Synthetic coding sequence
tgtttttctcacagtttctttttctttttcttcttccttcgatggtccctcgcattgagccccaggctggagtgctccggcgctatctcggcgcattgcaagctgaggctgctcggtagtcggcactctccagcttccgcctcacgtgtggctggaacaactggcgcttgccaccatgctcgtctgttcttctgcatcttctcacgcgatggggtaagcccttgctag

SEQ ID NO: 58983 - DNA, 177 bp, Artificial Sequence
  Description of Artificial Sequence: Synthetic coding sequence
cctgggggagccgctgccgcagcatcagtgatggcgcctcgcagaagccgatgtttctgtacaagcatttgtggaggtcggggtgccaggccccagctgcctaggacctgtggcgacggcacccagcactgtggtcgcggaaagcccgctcttgcggctgcagaggaatggccctag

SEQ ID NO: 58984 - DNA, 372 bp, Artificial Sequence
  Description of Artificial Sequence: Synthetic coding sequence
gtttgtgtctgtgtgtgcgtttgcgtgtgcgtgtgtctctttatttacttttccgtgttctggagttttctgtatttatttgttttcctgttgaagatctacgaaaagaggccatgtgctgtggcgcacgcctgtaaccccccaggcgtggttgcccacgcatgtaaccctagcactttaggcggtcgcggaggccagatcagttggagtcaggaattcgaaacaagtctagctaacatgtcgaaaacgccttcgcggaaaaaacgcaaagggtggtccggagtggtggcccacgcatgcaatcacagctacagtggactgcgtcaggaaaattgcctcaatccggtaggtggcggttgtgtccaaccatag

SEQ ID NO: 58985 - DNA, 288 bp, Artificial Sequence
  Description of Artificial Sequence: Synthetic coding sequence
tttttttttttcctcaggtggtctctcgctctcctcccaagggtggaatgctctggtatgatatcagcacattacaatttgcacttgcctgggagtagcgactcaccagcaagcgcctctcgggtggctggtacgactggagtacaccatcacgcatggctgatcttctgcatcttctcgagggacggggtcttactgtgctgcccagggtggtccccaactccaggactcaagagaagttcctgtttaggttttcggaaatgttgggactacaggcatgagccttag

SEQ ID NO: 58986 - DNA, 261 bp, Artificial Sequence
  Description of Artificial Sequence: Synthetic coding sequence
ggaactattagcgcccattgtaacctctgccttctagggtcaagtgactcccctgcctccgcgtcacaggtcgcagccggtattaccggcgcatgtcacctcgcacagttaatctttattttcttgattgagacaggattccatcacgccgtccaagccggtcttaaactgcttacgctgagtgatctacctgcctccgccagtcaatctgttggcattaccggtgcctctcacagagccgaccccaaggtcttcctgtag

SEQ ID NO: 58987 - DNA, 66 bp, Artificial Sequence
  Description of Artificial Sequence: Synthetic coding sequence
aatcgtaaaaaggaaggaaaaaaaaatcaaagtcctccaccaactgtgtcccccctggccacttag

SEQ ID NO: 58988 - DNA, 303 bp, Artificial Sequence
  Description of Artificial Sequence: Synthetic coding sequence
tttttgcggaggtctctggcattatcccccaggcagtggcatgacctaggaagcttacagccaccccctcctggatttaaacccttctcctgtctgtccctgttatctagctgggattatcggtgcgccccaccatgtccagccaatttttgtattctggtggaaatgggttttcatcatgttggacaagccggtctggagcttctaacaagcgacctaccgacctctgcatcacagcgagcgggaatcaccggggtgaatcaccacgcctggccacgggacgccttctcaatcagctactag

SEQ ID NO: 58989 - DNA, 282 bp, Artificial Sequence
  Description of Artificial Sequence: Synthetic coding sequence
agtgtggcccaagctggcgttcagtggcacaacctcggtagcctacagcctcctcccccacgattcaataggttttcctgcttgagcatcccctcatcgtgggattataggcactcccctcctttgttagcagattttttgtttttagtggagactgagttttgccatgtcggccaggccgcactcgagctgctgacctcaggcgatctcccaaccagtgcgtcccaatctgcccgaattacaggcgtgagccacagaacccgaccttcattgttctattag

SEQ ID NO: 58990 - DNA, 111 bp, Artificial Sequence
  Description of Artificial Sequence: Synthetic coding sequence
aagagaaagaaaaaagagcgaaagaaggaacgcaagaaaaaagagcgcaagaaggagaggaagaaggagagaaagaaagaaaaagagcggaagaaggaaaaagaaaggtag

SEQ ID NO: 58991 - DNA, 234 bp, Artificial Sequence
  Description of Artificial Sequence: Synthetic coding sequence
atcaattgttattctttttattcactctttctgttcgtttgcatcacagatggcgtaagcctatctccccgacctgagtgctcaggtgcaatttcagcgcactgtaggctgcgtccacggggaagtcgacactctcctgcatcagcaagtcgcgttgccggtactactggtgccagacacctggctcaattgattttctgcatattcagtagggacggggtgtcactttgttag

SEQ ID NO: 58992 - DNA, 222 bp, Artificial Sequence
  Description of Artificial Sequence: Synthetic coding sequence
cggagagaaagacctctccccgaacctcatagccagttctttttctttttcttcttttactatacactctcattccgagtgcacgttcacatcgtgcaggtctcctatatttgcatccacgtaccctgttggtgtgccgctcccactaacgtgtcctcctccattcggtatatatctcaatgttatcccagtccactgccgaggccacatcacagcccctag

SEQ ID NO: 58993 - DNA, 123 bp, Artificial Sequence
  Description of Artificial Sequence: Synthetic coding sequence
tctcctccacccccaggagggggagaaaaacctctagccccacccccaggctgggttgaaccccctaaatggttgggtctgcagggccctagcggcggacctggggcagggccaggcctttag

SEQ ID NO: 58994 - DNA, 318 bp, Artificial Sequence
  Description of Artificial Sequence: Synthetic coding sequence
tatttctacttccttcgacagtcccttactttgagccctcgtctggaatgttctggcactatttccgctcattgcaatctatgtctgcctgggagcagtaactctccagcctcagcctcacaagtcgcgggaatcactggagtgtgtcaccatacacagttgattttcgtgttcttggtagaaatgggtttctgtcacgttggccaagctggactcgagctgttgacttcggggaacccccctgccctggcttttcaatcggccggaattacaggcatgagtcatcacgcctggccgggtcacatgttctttaaatag

SEQ ID NO: 58995 - DNA, 216 bp, Artificial Sequence
  Description of Artificial Sequence: Synthetic coding sequence
ttaacatcattccgtgtggtacatactatccccatgatcaaatcctttttcaactacctgtcacccaagcatttgaagttccaggtggattgtaacaaaggggtaaccggaacaatctatgagtacggggcactgacgcttaacggcgaggaatacatccagtttaagcagttcgccggtaagcatgtgctgttcgttaatgtggcagcctactag

SEQ ID NO: 58996 - DNA, 168 bp, Artificial Sequence
  Description of Artificial Sequence: Synthetic coding sequence
gtgatcggatgggtgtggtggctaacaccggtgataccagctctctgggaagccgaggccggaggcagccccgagatcaggtctagcaggcccgcttggcccacctgggggaatccgtccctgcttaaaatccaaaaattggccagacgcggtggagcccacctctag

SEQ ID NO: 58997 - DNA, 366 bp, Artificial Sequence
  Description of Artificial Sequence: Synthetic coding sequence
ctcccccctgctgaccttttcatatttatctttatcgacaaggtatctctgctgagcccacggctagagtgtaatggaacaataagcgctcactacaagctgcacctcccttttaagcgtttctcttgcttgagcctgctaaaaaccggttttcatcacgtaggccagctgattttcgtgttccttgtagagatggctttccaccatgtgggccaagccggattggagttattgaccagtggtgatctgtttgaggtcgagtttcattcgtgttgcttggggtggagtgccatggcacggtcaaggctgacagcaacaagcgccagtagggtgcaggcgattctcctccctcaacccccagagtag

SEQ ID NO: 58998 - DNA, 420 bp, Artificial Sequence
  Description of Artificial Sequence: Synthetic coding sequence
atctgccaccatacacaactgattttcgtgtttctgggcttttatttgttcatatacctgttcattgatggcgtgctgttatgttgccctggttggtctgcagtggtgcagtcctggctcacagctacttctgcctcacaagtcgcgggaattaccggaatgcaccatcacgcccagctcatcttcgtgttccttgtcgaaatgggcttccaccacgtgggccaagccggactggagctgctcacgtccggagaccccccagcttcagcgagccagagcaccggcattacaggggtgtcgcactgcacaagacccaacttttgcatcttttcccgtgatggggtctctccttgctggccgggttggagccgcacaccggatctggtgatctcagctcatctcggtctccctaagtgctag

SEQ ID NO: 58999 - DNA, 228 bp, Artificial Sequence
  Description of Artificial Sequence: Synthetic coding sequence
tgcttctctcattctttttttttctttttcttttttctcaggtggagtctggcgctgagcccacgcctcgaatgttctggcgcaatttccgcccactgcaaactgcggctcctcgggtcgagacacagcccagcgtccgctagtagggttgcgggaacaactggcgcttgccaccatgccaggctgttcttctgcattttcagcagagacggcgtgtccccgtgctag

SEQ ID NO: 59000 - DNA, 303 bp, Artificial Sequence
  Description of Artificial Sequence: Synthetic coding sequence
ttcctgcgtcgaagtttggctttgagtccaagacagtggcacgatctaggaagtcttcagcccccagcccctggtttcaagccattttcatgcctgtcgctccttagctcgtgggactacaggtgcgctccaccttgccccgctaacttctgtattttggtagagatgggctttcaccacgtcggtcaggctgggctcgagctgctgactagcgacctacccgctagtgccagccagcgggctggcattacaggtgtaaaccaccatgcgtggccgcgtgacgcctttagtatttcttactag

SEQ ID NO: 59001 - DNA, 1251 bp, Artificial Sequence
  Description of Artificial Sequence: Synthetic coding sequence
atgaaaatgcagaaaggcaatgtcctgcttatgtttgggctgcttctccacttagaagcagctaccaattcgaatgaaacttctaccagcgcaaatacaggttccagcgtgatctcttccggggcttccacagctaccaactccgggagttctgtgacatcttctggagtgtctaccgccactataagtggatcttccgtaacaagcaatggtgtgagcatcgttacaaacagtgagttccacacgacctcctccggcatttcgaccgctaccaatagtgagtttagcactgtgtccagcggcatctcaatcgccaccaacagcgaatcgagtactaccagctcaggtgcctcaaccgccactaactctgagtcctccacccctagctcgggcgctagcaccgctactaacagcgattcatctacaacgagcagtggagcttcaactgctactaacagcgatagcagtaccactagttccgaggctagcactgcgaccaacagtgagtcttcaactacaagcagcggtgcctctactgcgactaactcagagagtagcacaactagctcaggagcgtctaccgccactaacagtgaatcttcaactacctcctccggtgccagcaccgccactaatagtggctcttccacaacgtctagtggaacaagcactgccaccaattctgagtcttccactgtgtccagtggtgcttcgacggctacaacttcagagagtagcacgacatccagtggagcttcgactgcgacaaactcagagtccagtactgtgtcgtcaggagcttccaccgccacgaatagcgagagctccacaacgtcatccggagccaacacagcgacaaatagtgggtcgtcagtcaccagcgctggaagtggcactgctgcattgaccggtatgcacaccacttcgcattccgcatcaacggcagtcagtgaagcaaagcctggaggcagcctggtgccctgggagattttcctgattacgctagtctcggtcgtggccgctgttggtctgtttgccggactttttttctgtgtgcggaatagtctaagcctgagaaacacatttaacaccgctgtttaccatccacacggcttgaatcacgggctaggccctggccctgggggaaaccatggcgcaccccatcgccctcgatggagccctaactggttctggcgtagacctgtgagctcaatagctatggagatgtccggccgaaactccggcccttag

SEQ ID NO: 59002 - DNA, 372 bp, Artificial Sequence
  Description of Artificial Sequence: Synthetic coding sequence
tgggactactccttcttcttttttttacggcagtcccacagcgttccccaggccggagtgcagtggtgtaatctaagtagtctccaacctcccccaagccggtttaaacgcttctcctgcctgagcctgttgagtagttgggattatcggcatacacccccttgcccagccaattttctgtatacattcgagctcttctttttcttcctgcgatggtcattcgctctgtctcccaggctcgaatgcagtggggctatcttggtgcattgtaatctctgtctccccggaagcagcgattcatgtctctcacttcctatttcttgggactacaggtgcgcccctccatgcctagcgaacttctgcattttctag

SEQ ID NO: 59003 - DNA, 309 bp, Artificial Sequence
  Description of Artificial Sequence: Synthetic coding sequence
gtgctgctgtgttgtcccggatggtcagctgtggttcgaagctggctgactgcaacttctgcctcttggcaactggcaggtatcacaggtgtgtgtcaccacgcacagcttattttcgtttttttcatagagactgaattccaccacgtgggacaagccggaccagagctcctgacatccggagatccttcagcgagcgcaagccagtccgcgggaataaccggcgcttcacatcccaggagagcgaatttctgtatcttcggccgagacggggttagtccatgctggcccggatggtctagcacatag

SEQ ID NO: 59004 - DNA, 381 bp, Artificial Sequence
  Description of Artificial Sequence: Synthetic coding sequence
cgacaccaggctcagcttatttttctgtatgatctgtttttgtacgtatatttcttaaaggaccgtgtgttgctctgccacccaggttggtctgccatgacgcgctccagactgacagctacgagcgcgagccaagtagctgggaccattgggatgtgtcaccatgcaaggcttattttcttcttctttttcgttttcctcgtggaaatgggctttcattgcgttagtcagcacgggctggaacttctcactctggatccccctgcgtctgcctcacagtctgcccgtatcattggactgaaccattgtactcaacccactttttgtatcttcagccgtgatggggacagcccgtgctggccagattggtctaggacctag

SEQ ID NO: 59005 - DNA, 153 bp, Artificial Sequence
  Description of Artificial Sequence: Synthetic coding sequence
ccatcctttctgctgttctttctgccctcctttctacctttttcactgtcttcgctgtctttccttccgttcctgctttcgttcctgactggctcctttggccaagataaagtcttttctataactcatactcacacacatacacatacctag

SEQ ID NO: 59006 - DNA, 372 bp, Artificial Sequence
  Description of Artificial Sequence: Synthetic coding sequence
tgtgtgtgtgtttgcgtttgcgtatgtgtgtgcctgtttatatatttttctgtgttctggagctttctgtacctgttcgtctttctgttgaaaatctatgaaaagcgcccatgtgccgtagcacacgcttgcaacccccctggcgttgtcgcacatgcttgtaacccttcgacccttggtggccgagggggacagatctcttggagtcaggagttcgagacctctctcgcaaacatgagtaagactcctagtcggaaaaagcggaaaggttggtccggtgtcgtggctcatgcttgtaatcatagctattctggtctccggcaggaaaactgtctgaatcccgtgggcggtggctgtgtgcagccacgttag

SEQ ID NO: 59007 - DNA, 279 bp, Artificial Sequence
  Description of Artificial Sequence: Synthetic coding sequence
ttcttcttctttttcttcgagacggattgtcgctccgtcaccaggctagaatgttcaggcatcatttccgcacactgtaagctgtgcctccctggctcatcagactcccccgcatcagcatcacaggccgctcgcaccatcggcacctgccaccacacccagctcatttttgtgttttttgtggagactgggttccaccacgtgggccaggatggtcttaacctcagcttagtgattcaccccccacggcctcctaaagtacttggccttcaggtctag

SEQ ID NO: 59008 - DNA, 384 bp, Artificial Sequence
  Description of Artificial Sequence: Synthetic coding sequence
atcttcttcttcttgcggcaaggactcctactcagcccaagactgctagagtgcaatggtactatcagcacacactgcaacctccatattccaggctcttctgattcccccgcttctgccagccaagtggccggaatctatagaagtagggaccagcctgatcagcacggagaaactccaagtctcctgaagattcagaaactggtggggagagggggattccacttcttttcccaattactgggacgcccaagacaggagaacggagtgaaccccggaggacgcgcttgttccgaactgaggcttaggcattgtacaccagcctgggccacagaagcacgcctgtgtctgaagaagaagaagaagaaaaaaaaaaagaagtag

SEQ ID NO: 59009 - DNA, 312 bp, Artificial Sequence
  Description of Artificial Sequence: Synthetic coding sequence
tttttttttttcctccgaaggagtctggcactaagccctaggctcgaatgttcaggcggtattagcgctcattgcaaactgaggctcttaggtagcaggcacagcccagccagcgcatcacaggttgctggcactaccggcgctcgacattatgcccgacttatttttttattcctcattgagacgggattccattacgtgggccaagcagggctcgagctgctcacttccggtgacctgccaacttccgcgtcacagtccgcgggtattacaggagtgagccactgtacccagccagaagatatcttctag

SEQ ID NO: 59010 - DNA, 243 bp, Artificial Sequence
  Description of Artificial Sequence: Synthetic coding sequence
gctcaccacctgcgatctggcgctggagaccagcccggtcagcatggtgaaacgccaagtttgttgaagattgagaaattagccgaacatggtggttcatgcttctcctttcaggtactgggccgtttacgccaggagaactgcttaaacccaggcggagggggatgcagtgagccaaggttatgtcattgcacccccgcatgggcaacagagcaaggaagcgtgtctcgtaagaaagagtag

SEQ ID NO: 59011 - DNA, 420 bp, Artificial Sequence
  Description of Artificial Sequence: Synthetic coding sequence
atctgccatcatacccagcttatctttgtattcctgggcttttatcttttcatctacctcttcatcgatggagtgctcctctgctgccccggttggtccgcagtcgtgcagagctggctcactgctacgagcgccagccaggtggctggaattacagggatgcatcaccacgcgcaactgattttcgtctttcttgttgaaatgggcttccaccatgtggggcaggctggcttagagctcctcacctccggcgaccctccagctagtgcgagtcaaagtaccggcattacaggggtgtcccattgcacccggcctaacttttgcatcttcagcagggacggcgtgagtccctgctggcctggctggtccaggacgcctgatttagtcatctccgctcacctggggcttcccaaatgctag

SEQ ID NO: 59012 - DNA, 318 bp, Artificial Sequence
  Description of Artificial Sequence: Synthetic coding sequence
tatttctattttctgcggcaaagccttacactgtcaccaagactggagtgcagtggtatgattagcgcgcactgtaacctatgcctccccggtagtagcaactctccagcttcagccagtcaagtcgccggaatcacaggcgtgtgccatcatactcagctgattttcgtcttcctggtggagatgggattctgccatgtcgggcaggcatcccttgagttgctcaccagcgggaatccacctgctctggcatttcagtccgctgggattactgggatgtcgcaccacgcttggcccggacatatgttcttcaagtag

SEQ ID NO: 59013 - DNA, 462 bp, Artificial Sequence
  Description of Artificial Sequence: Synthetic coding sequence
gtccgcggagcaagcgccaggccacccctgttggggtctgaggaacctctgtcccccgctagtcgacccgttagagagggaggagggggtgtgtccccgccacctggacaacctccatgcccaggcggacgttggggcggacagcccagcgctaggcctgccgctcccagcggccgagaggttggagtgtcggctcccaggccggcatctcgcccagtgagagaggtgcggggagcatccgcacggcctccgctcctagggagtgaagaacctctgtgtccggcatccagaccagtcagagagggcggaggaggcgtgtcaccgccaccgggtcagccaccacgccctggcggtcgcggagcttctgcacgccctcctctgctgggctcagaggaacccctgtgtgcggctaccacacccagtggaagatgtgcccagcagctaatcgagaatggcccatag

SEQ ID NO: 59014 - DNA, 348 bp, Artificial Sequence
  Description of Artificial Sequence: Synthetic coding sequence
atgaatgtttgctgtagctcccatcccgttaatgaaaaagtctggaagccctcaagccgtaaatggagctcaaaagtatggtctatggatgagtttgatctccagacagcctgctactggtttatgacccggtgccagaaggaggccggaaaatttggcacccatcggggtaagcctatgtgttttgtgaggagtctgctccgcgtccagctgctgccaagaacattccctgccaactccttcgtgatttcgttttttcctagcctgatttatccgctgcaggtttatcaactgcattttgagagctctgacaagcaacgagcgatgcagttcgtcaccgaaggctag

SEQ ID NO: 59015 - DNA, 318 bp, Artificial Sequence
  Description of Artificial Sequence: Synthetic coding sequence
tacttctactttctccggcagtcccttactcttagcccaaggctggaatgctcagggacaatctcagcccattgcaacctgtgccttcctggctctagcaactcacccgcatccgcctcccaggtggccggtattacgggcgtttgccatcacacgcaactgatttttgtcttcctagtggagatggggttttgccatgtgggacaagccggactggaacttctcacttccggtaatccgccagccttggcctttcagagtgccggtatcacgggaatgtcacatcacgcctggcccggtcacatgtttttcaaatag

SEQ ID NO: 59016 - DNA, 111 bp, Artificial Sequence
  Description of Artificial Sequence: Synthetic coding sequence
aagcgaaaaaagaaagaacggaagaaagagcgaaagaagaaggaaaggaagaaggaacgaaaaaaggagcgcaagaaggagaaagagcgcaagaaggaaaaggagcgttag

SEQ ID NO: 59017 - DNA, 420 bp, Artificial Sequence
  Description of Artificial Sequence: Synthetic coding sequence
atctgtcaccatacccagttgatatttgtattcctcggcttctacttatttatctacctgttcattgatggcgtgctgctgtgttgtcccggatggagcgcagtggtccagtcgtggttaactgccaccagtgcatctcaggtggctggcattacaggtatgcaccatcacgctcagctgatatttgtgttcctggttgaaatgggatttcaccacgtgggacaggcaggcctggagctcctgacctcaggcgaccccccagcttctgccagccaaagcacaggaatcaccggtgtgagccactgcactcggccaaacttttgcattttctccagagatggagtctccccatgctggcccggatggagtcgaacaccagacctggtgatctcggcacatcttgggctacccaaatgctag

SEQ ID NO: 59018 - DNA, 111 bp, Artificial Sequence
  Description of Artificial Sequence: Synthetic coding sequence
aaacggaagaagaaggaaaggaagaaggagagaaaaaaaaaggaacggaagaaggagcgcaaaaaagaacgcaagaaggagaaggaaagaaagaaagaaaaagagagatag

SEQ ID NO: 59019 - DNA, 108 bp, Artificial Sequence
  Description of Artificial Sequence: Synthetic coding sequence
agcccaaacaagctgttgttcgaccctcgcgtggggggtcgagtgtcccatgtgttcttcctgttccctccatttgtgctgctgcctggccctccgggactgccctag

SEQ ID NO: 59020 - DNA, 303 bp, Artificial Sequence
  Description of Artificial Sequence: Synthetic coding sequence
tttctcagacggtcacttgcgctgagtcccagacagtggcatgacctgggttccctgcagccacccgcacctggattcaagcccttttcctgcttgagtcttctgtcgagttgggactaccgctgcgcaccgccttgcccagccaacttctgtattcttgtcgagatgggcttccaccatgtcggacaagccggactggaactcctgacttctgacctgcctgcttccgcttctcagcgggctggcattacaggcgttaaccatcatgcctggccacgtgacgctttctcgatctcctactag

SEQ ID NO: 59021 - DNA, 399 bp, Artificial Sequence
  Description of Artificial Sequence: Synthetic coding sequence
tgcatgtgcgtctgcgtctgtgtatgtatctatatctacatctacatttacatttctcagccgatctatatctttctcttgctactcctcctccttttcctccgccagagtctgatgatcaaaaaccaggtaagaagacctggggcagtggcccatacgtgtaaccccagcactgtgggagggcacgggggacagattacgaggggacaggaattcgagactagccttgcgaacatgggcgagacaccctccctgttaaagatccagacatggcctggcgtggtagcccacgcctgtaacccgtcatatagtggaggacgcctgagacaggagaattgtttgaacttgggcggtggtggctgtggcgaaatcgccttgcaaccaggccagcaggagtag

SEQ ID NO: 59022 - DNA, 111 bp, Artificial Sequence
  Description of Artificial Sequence: Synthetic coding sequence
ggacgggacgactggcaggctgcccctccagccgcacctgtcagagatccactaggggaggcaagctgggcacccgaatgtggtggagatctggaaaacctgtatgtttag

SEQ ID NO: 59023 - DNA, 228 bp, Artificial Sequence
  Description of Artificial Sequence: Synthetic coding sequence
tgcttcagtcatagcttctttttcttttttttctttctccggtggtctttggccctgtcacccagactcgaatgctcaggcgcaatcagcgcccactgcaaacttagactactcggctctaggcactctcctgctagcgcaagccgcgtcgccggtacgacaggcgcatgccaccacgctcgcctttttttttgcatattcagccgcgatggtgtgagcccgtgttag

SEQ ID NO: 59024 - DNA, 336 bp, Artificial Sequence
  Description of Artificial Sequence: Synthetic coding sequence
ttcttcttcttcttcttcttgcgtcacacactagccttgcttcctcgcctggagtgttcaggggcaattctcgcacactgcaacatccctcttagcagtagctctaattctcccgctagcgcatcccaagtcgcaggcattaccggcgtgtgtcatcacgcccagctcatcttcgttttcttcatcgagacggagtttcatcatgtgggtcaggcagggccagagctgcttacaagtggtgaccctagcgcttccgccagccaaagcgcgggaattactggagcatcacatcgggcacagccactgtctatcctgttcttcttcttcgaagcctag

SEQ ID NO: 59025 - DNA, 462 bp, Artificial Sequence
  Description of Artificial Sequence: Synthetic coding sequence
gtgcggggagcctctgccagaccaccactactcgggtcagaagagcccctgtcacccgcaagccgacctgttagagaaggaggaggaggtgtgtcaccccctcctggccagccaccttgccctgggggaaggtggggcggtcagccgtcagctagacctgcggctccctctggcagggaagtgggcgtgagtgcccctcgccctgcttcgaggccagtgagagaagttaggggagcctctgcacgcccacctctgttgggaagtgaggaacccctatgtcctgctagtagacccgttcgggaagggggaggcggagtgtccccccctccaggtcagcctcccagacccggaggcaggggagccagtgctcggccaccgcttctgggcagtgaggagccattatgtgctgcgaccacgccatcaggtagatgtgcccagcaattgattgagaacgggccttag

SEQ ID NO: 59026 - DNA, 273 bp, Artificial Sequence
  Description of Artificial Sequence: Synthetic coding sequence
cagtggtccgatttggggagcctgcagccccctccgccagggtttaaacgcttctcttgtctaaatctgcctacctcatgggactaccggcacgtgcctccgcgtccagccaacttttgcttttttatcgagatgggcttcctgcacgtgggccagactgggctcgagcttcctaccagtggggatcccccagcctctgcaagtcaatcagcagggattacaggggtttcacaccacgcctggcctcactttattattcttctcatgatctag

SEQ ID NO: 59027 - DNA, 387 bp, Artificial Sequence
  Description of Artificial Sequence: Synthetic coding sequence
tggagagccccagtgatacctgccacaagagaggccgaggccggtgagtggtgcgagccccgttccacgaggatccaggagaaggacatagcttttctggcctttagcttgggggacagggttaggctgtatctacagaagaaaaagaaaaaaaaaaagaagaatcagagtcgattgtttctcaggctgagcctcgccttgtctcccagactcgaatgcagcggagccattagtgcccactgtaatctgcaccacctggggagttctgactctccggctagcgcgtctcgcgtagccggaatcacgggcgcacggcaccacactcggtttatcttcgtgttcttagtcgaaacatcatgctggaacctgctggtaagcaattcctag

SEQ ID NO: 59028 - DNA, 357 bp, Artificial Sequence
  Description of Artificial Sequence: Synthetic coding sequence
tggtgtgcccctgtcgccccagccacccgcgaggttgaggtgggagggtcacttgaaccaaaccgttctcgcttgcagagcgcgaagattgctcctctgcactattccctggggaacagaaccaggctatgtctgaagaaaaaaaaaaagaaaagtctgtttaataaggtgtgtctgttcctcaggagaagtctgaccctctcgcctcgactagagcattcgggtatgatttccgcgcactgcaatctgcggctacctggctccagctacagccccgtatcggctagccaagtggctggcatcacgggggcttgtcatcacacacaactcatctttgtatttctggtggaaacctag

SEQ ID NO: 59029 - DNA, 318 bp, Artificial Sequence
  Description of Artificial Sequence: Synthetic coding sequence
tacttctacttcctccgtcagtcgttaaccctgagccccagactggaatgtagcgggaccataagcgctcattgtaacctttgcctccctggaagttcgaattcacccgcatccgcgtcccaagtagcaggaatcacgggcgtatgtcaccatacgcaacttattttcgtgtttctggtggaaatgggcttctgccacgtcggccaggctggtctagaactgctcacttccggcaatccccctgcgctggcattccagtccgccggaataactggaatgtcccaccatgcctggccgggacacatgttcttcaagtag

SEQ ID NO: 59030 - DNA, 354 bp, Artificial Sequence
  Description of Artificial Sequence: Synthetic coding sequence
gatagagttctcttatgtcacccagggtggagtgctatgacgaggtctagactcacagctaccagtgctagtcaactggcaggaattacgggcacacatcaccatgtgtggctgagcttcgtgttcctcgttgagatgggcattcatcacgtcggccaaacaggcctcgagctccctacctctggcgacctcccaacgagtgccacacaatccgccggaattaccggggtgggccactgcagccgtccagaagaggtattgttcttccgcgatggggtgtctccatgctggtctggctggtcccaaacaccaggacttaagccctcctcacatctgggtctgcctaaatgttag

SEQ ID NO: 59031 - DNA, 111 bp, Artificial Sequence
  Description of Artificial Sequence: Synthetic coding sequence
aaggagaagaaggaggagagaaaaaaggagaggaagaaaaaagaacgcaaaaaagagcgcaaaaaagagcgaaaacgggaaaaggagcgcaaaaaggaaaaagagcgatag

SEQ ID NO: 59032 - DNA, 306 bp, Artificial Sequence
  Description of Artificial Sequence: Synthetic coding sequence
ttccacctgtttctcttcatctgtttctttctattcctgcggagatccttggcgctctctccccgtctcgaatatagcgggacaatctcagctcactgcaaactgcgcctgcccggatctcgctatagtgcctccgcttctagggtggcagggactacaggcgctagacaccacgctcgactcatcttctgcatcttttatagagatggggtctccccctgctggtctcggattccggacctcatctgtctgccgtggcccccaaaggtgctgggcttacaggctcccgctacaatcccaggatag

SEQ ID NO: 59033 - DNA, 423 bp, Artificial Sequence
  Description of Artificial Sequence: Synthetic coding sequence
ggcacaatcagcgcacactgtaatctctgtctcttggattcttccgatagccctgcctcagctagccgggtagccggtataatcggcgcacaccaccacgcccagctcattttcgtgttcttggtggaaatggggtttcaccatgtgggccaggcaggcctgaaattactgacttcagatcccccagtgtcggcctcgcagtcagcaggaatcactggtgtgagccaccaccgtgagccacagcatccttttctgctctcagtggaatctcgggaccgcccattcttcttctttggtttttttttcttcgagatggaaagctattcagtcgcccaggccggtgtgcagtggcgcgatttatctagtctccaacccccacctccacgagctcaggctattctgccaccacagccccctaagtag

SEQ ID NO: 59034 - DNA, 387 bp, Artificial Sequence
  Description of Artificial Sequence: Synthetic coding sequence
tggagggcccctgttattcccgcaactcgggaggcggaggcaggcgaatggtgtgaaccccgttctacccggatccaggagaaagatatagccttcctcgctttttcactgggcgaccgggtgcgactatacctacagaagaaaaagaagaaatcaaaaaacaacaagactagcctgttcctcagactcagccttgcactgtctccacgacttgaatgctccggcgctatctccgcccactgcaatttgcaccacttgggctccagcgattcacccgcttccgccagccgggtggctgggattaccggtgccaggcaccatacacggttcattttcgtgttcctagtggagacgagctgttggaatttgctggtctcgaactcctag

SEQ ID NO: 59035 - DNA, 306 bp, Artificial Sequence
  Description of Artificial Sequence: Synthetic coding sequence
tttcatttgttcttgtttatttgcttctttcttttcctcaggcgctcactcgcacttagccccaggcttgaatactccgggaccattagcgcacattgcaaactgaggttgcccggaagcaggtactcagctagcgcaagccgcgtggcaggcaccacaggagccaggcatcatgcaaggctgatcttctgcattttttaccgagatggagtctcaccatgctggagcaggataccagatcttatctgcctcccttggccccctaaggtgctcgggctccaggcaccagccacaatacccggttag

SEQ ID NO: 59036 - DNA, 111 bp, Artificial Sequence
  Description of Artificial Sequence: Synthetic coding sequence
aagcgcaagaaaaaagagaggaaaaaggaacgccgtaaaaaagagcgaaaaaaagagcgaaaaaaagaaagaaaaaaagagaaggaaagaaagaaagagaaggagaggtag

SEQ ID NO: 59037 - DNA, 279 bp, Artificial Sequence
  Description of Artificial Sequence: Synthetic coding sequence
tttttctttttcttcttcgaaacagattgtcgttccgtgacacggttggagtgtagcgggataattagcgctcattgcaagctttgtttgccaggcagcagcgattcccccgctagcgcgagccaggcagcaagaacaatcggcacctgtcaccacacccagctcatcttcgtgttttttgtcgagaccggattccaccacgtgggtcaggacggcctaaatctgagcctggtgattcatccaccacgccctccaaaagtgttaggcctgcaggtctag

SEQ ID NO: 59038 - DNA, 111 bp, Artificial Sequence
  Description of Artificial Sequence: Synthetic coding sequence
aagagaaaaaaaaaggaacggaagaaagagaggaagaagaaagagagaaagaaggaacggaaaaaggagaggaagaaagaaaaagagcgtaagaaagaaaaggaacgttag

SEQ ID NO: 59039 - DNA, 333 bp, Artificial Sequence
  Description of Artificial Sequence: Synthetic coding sequence
tgcaccagatacttttacttctacctcttttgtttcatcttcatttacctcttctttttcttgaggtggtcactggcactttcgccccgactggagtgcagcggcgctattagcgctcactgcaagctgcacctgccgggttcttgtcactatccagcctccgcttctcgagttgctggaaccaccggagccagacaccacgcctggctgatattctgcatgttcagcaaggaccgggtatcaagatggtcccagtcccccgatattgccatctgcctcccctggccacctaaagtgctgggcctccaggcccctgccaccacaccgggatag

SEQ ID NO: 59040 - DNA, 357 bp, Artificial Sequence
  Description of Artificial Sequence: Synthetic coding sequence
tggtgtgctcctgtcgctcctgccacccgggaggtcgaagttggtggatctctcgaaccaaaccgctcgcgactccagagcccaaaaatagcaccactgcattatagtctaggtaacaggaccagattgtgtctgaagaagaaaaagaaaaaaaagaaaattaataaggtgtgcttgtttctgagacgctcactgaccttgagtccacggctggagcattcaggcatgattagtgctcactgcaaccttagattgcccggatcaagctactcccctgtgtcagcgtcccaggtcgctggaattaccggcgcttgccaccatacccagctgattttcgtctttttggtggaaacctag

SEQ ID NO: 59041 - DNA, 177 bp, Artificial Sequence
  Description of Artificial Sequence: Synthetic coding sequence
ccaggtggtgctgctgccgcagcatcggtaatggccccacggaggggcagatgcttctgcacatccatctgtggtggcagaggtgcacggccacagctgcctcgaacctgcggtgatggaactcaacattgcggcagagggaaaccagcactggccgcagctgaggagtggccttag

SEQ ID NO: 59042 - DNA, 129 bp, Artificial Sequence
  Description of Artificial Sequence: Synthetic coding sequence
aaagaggaaaatgaggaggagaaggtgaaagagaaggagaagaataagaagcgcaaaaaacgcaagaagagccagagccggagggtgtaccaccaggagaagacacatattctgtgggtctcaacgtag

SEQ ID NO: 59043 - DNA, 309 bp, Artificial Sequence
  Description of Artificial Sequence: Synthetic coding sequence
gtgctcctctgttgcccaggttggtccgccgtggtgcgctcctggctgactgctacatccgcctcttggcaacttgcaggcattaccggggtgtgtcatcacgcacagttaatattcgttttcttcatcgagaccgagttccaccacgtgggccaggctggcccagaattattaacctccggggaccctagcgcatctgcttctcagtctgcaggaataacaggggcttctcaccctcgcagagctaatttttgcatctttggccgtgatggagtgtccccatgctggccgggttggtccagtacttag

SEQ ID NO: 59044 - DNA, 333 bp, Artificial Sequence
  Description of Artificial Sequence: Synthetic coding sequence
ttttttttcttcttcggaaatggagtgtggctgtgtcatccaggatggtctgcggtggtgcaatctagactgacagctacatccgcctcttggcagctcgccggtattaccggcgtctgtcatcacgcccagttaatttttgtcttcttcatagagacggaattccaccatgtgggccaggccggaccggaactcttgacatcaggagatccatccgctagtgcaagccagagcgcaggaataacaggcgctagccatcctaggagggccaacttctgcatcttcggcagagatggagtttccccctgctggcctggctggtcatccacgtag

SEQ ID NO: 59045 - DNA, 75 bp, Artificial Sequence
  Description of Artificial Sequence: Synthetic coding sequence
cgagagacagaacggaccattaccgatgatggatggatggatggttggatggacggctggatggatggctggtag

SEQ ID NO: 59046 - DNA, 372 bp, Artificial Sequence
  Description of Artificial Sequence: Synthetic coding sequence
ttcatcttcctgagatggtccctgtccctgagtccacggcttgagtgcagcggcaccattagcgcacactgcaacctgtgccttcctggcagttcgcatagcagcgctagcgccagccaggtcgcgaggatcactgatgtcgggtacgctcccggacagcacggcgagactcccagtctcctgaaaatccagaagcttgctgggtatggagtggcaaacgtttactcacaactgctcggccgactccggcaggaaaacggcgtgaaccccggaggagggacctgctccgagccccgaagccgccactgtacccctgcctgggcaacagccaggctccggctgaaaaaaaagaaaaaaaagaaaaaaaagtag

SEQ ID NO: 59047 - DNA, 459 bp, Artificial Sequence
  Description of Artificial Sequence: Synthetic coding sequence
tcacgtttttacataggatgcgacctatgcacaaactgctattacggcgagtgcgtggggatcgctgagaaggaggcaaaaaagatggatgtgtacatttgtaacgactgcaaatgggcacaggagggttccagcgaggagctgtattgcatctgtaggactccggcagggagctgtcggtttttcatcggccacgaccggtgccaaaattggtaccatggttgttgcatcggcattttgcagtctgaagctgagcttatagatgagtacgtatgccctcagtgccagtccaccgaggatgtcatgaccgtgcttactccactgaccgaaaaggatgacgaggaactgaaacgcgtgctgaggtcactgcaggctcataaaatggcgagacccttccttgagcccgtggacccaaatgatgccccagactattacggtgttatcaaagaacctgtgtag

SEQ ID NO: 59048 - DNA, 123 bp, Artificial Sequence
  Description of Artificial Sequence: Synthetic coding sequence
tctccacctcccccaggtggtggcgagaagcctctcgcccctcctccaggatgggtagaaccgccaaagtggctggggctgcaagggccttcgggcggacccggtgccggacctggtctgtag

SEQ ID NO: 59049 - DNA, 96 bp, Artificial Sequence
  Description of Artificial Sequence: Synthetic coding sequence
gccaaaccacgacttcaccagccaggccagtctggagaaaccccgtctttgttgaaaatccagaagctcgccaggcgtgggggtgttcatctgtag

SEQ ID NO: 59050 - DNA, 417 bp, Artificial Sequence
  Description of Artificial Sequence: Synthetic coding sequence
ggaacgatcagtgcccattgcaacttgtgccttctggattcctctgacagccccgctagcgcaagtcgcgtggcgggtattattggcgcacatcaccatgcccagctgatcttcgtctttcttgttgaaatggggttccaccatgtggggcaggctggcctgaagctgctgacatcagaccctcctgcttctgcctctcagagcgcgggaattaccggcgtcagtcaccataactggttgtttttctccatctttctgaaaaatagtcaagagacagctagattcttcttttggttcttctttttcgagatggaaagctatagtgtcgcacaggcaggtgtacagtggcgggaccttagcagcttgcagccaccacccccacgacacacaattctgctgccgcaaccaccagagtag

SEQ ID NO: 59051 - DNA, 108 bp, Artificial Sequence
  Description of Artificial Sequence: Synthetic coding sequence
agtccgaacaaactattattcgacccaagagtcggcggacgcgtatcccatgtgttctttctgtttcctccattcgtgctcctgcccggtccacctggcctcccctag

SEQ ID NO: 59052 - DNA, 369 bp, Artificial Sequence
  Description of Artificial Sequence: Synthetic coding sequence
ttcattttcctgcggtggagtctgtctctgtcccctcgcttggagtgcagcggtacaatttctgcgcattgcaatttgtgtctgccaggctccagccattcgtccgccagcgcttctcaggtagcacgcatcactgacgtcgggtatgccccaggccagcatggagagactcccagcttactcaaaattcaaaagttagctggctatggcgtcgccaatgtttactctcaactgctgggcagattgagacaggaaaatggcgttaacccagggggaggcacttgtagtgagcctcggagcagacactgtacccctgcgtgggccacagcccgattgagactcaagaagaagaagaagaaaaagaagtag

SEQ ID NO: 59053 - DNA, 462 bp, Artificial Sequence
  Description of Artificial Sequence: Synthetic coding sequence
gtgaggggcgctagcgcaagaccgccactgcttggcagcgaggagccactgtctcctgcttcccggcctgtgcgcgagggcggaggaggtgtctctcccccaccagggcagccgccttgtccgggagggagatgggggggacaaccgtcagccaggcccgcagcccctagcggtcgggaagtcggcgtgtccgcccctcggccagctagtcgtcctgtgcgagaagtgagaggggcttctgcccgaccaccccttctgggctctgaggaaccactgtgcccagcttctcgacccgtgagagagggtggcggaggagtgagccccccaccgggacagccccctagacccggaggccgaggcgctagcgcccgacccccacttcttgggagcgaggaacctctctgcgcagctaccaccccatcagggaggtgtgctcagcagctgatagagaacgggccatag

SEQ ID NO: 59054 - DNA, 213 bp, Artificial Sequence
  Description of Artificial Sequence: Synthetic coding sequence
atctctgcccactgcaacctctgcctccttggaagcagcaactcacttgccagtgccagtcaggtggcaggcatcactggagcccaccatcaggcacagctcatcttcgtgttcctagtcgagaccgaattccaccacgttggacaggccggacttaagctgctgactaatgaatggctgcctgtctgtctgcccaaatgttgggattactag

SEQ ID NO: 59055 - DNA, 366 bp, Artificial Sequence
  Description of Artificial Sequence: Synthetic coding sequence
tgcgtttgtgtgtgcgtatgcgtttgtgtgtgtgtgtttatatatttctcggttttttggtcctttctgtacctctttgtcttcctcatctgggccaaggagcaagactctgtaagcaagaaaaagaaaaagaagcctggggtagtggcccatgcatgtaacccctctaccttggggggtcggggaggacagattactaaacaggagtttgagacaagcctttcaaatatggctaagccccctaaggtcctggggctacaaaattggccaggaatggtagcctctacatgcaatccatcttacggtcggcttaagcaagaaaatcaccttatacgcggtgggagaggctgctctgagcctaggtag

SEQ ID NO: 59056 - DNA, 276 bp, Artificial Sequence
  Description of Artificial Sequence: Synthetic coding sequence
accttctttttttttttttttgaaacggactgccgctccgtaactcgactagagtgtagcggaatcatctcagcgcattgcaaactctgcctgcccggaagctctgacagcccagcgtcagcctctcaagcagccagaactatcggcgcttgccatcacgcacagcttatctttgtgttctttgaaactggcttccaccatgtgggccaggatggactgctggacctagtgatacatccccctcgtccgcctaaagtccttggccttcaagtttag

SEQ ID NO: 59057 - DNA, 372 bp, Artificial Sequence
  Description of Artificial Sequence: Synthetic coding sequence
tgggactacagctttttcttttttttgcgccagtcccattccgtgccacaggcgggagtgcagtggtgtaatctttcctccctccagccaccaccctcgcgctttaaacgattttcctgcctgtctcttctgtcatcctgggattataggcatactcccccttgccctgctaacttcctgtacacctttgagttgttcttcttctttcttaggtggtcattcgcgttgtctcctagacttgagtgtagtggagctatcttagtgcattgcaatctgtgcctgccaggatccagcgatagctgcctctccttgcccattagttgggattataggtgcgcccctccttgcctagccaacttttgtatattttag

SEQ ID NO: 59058 - DNA, 765 bp, Artificial Sequence
  Description of Artificial Sequence: Synthetic coding sequence
aaggtcagccatgtctatttttttttacaccgtcatggaaatcatcctatttctcaatctttcccacacctttctagactgtctatcccccagagcagacactgtcatcccggaccattctccatgtcctgttgggcgcacctgcctgacggcgctgtggcagggcaaagagggagcagcctgccctctcgcggaggaagagcggaagctcccttaactagtagaacagggagattggccggacagggtgcacccccaacttcactccccgactgggtcgcagccggacggagaaggtcttcattgcctagatggggcggatgcagggctgaacgtttgctcacgtcacagacaggccagcttcctgggggtggcgcaccccattttagtgatggcgttgtggcccgtcagagggtctcaagccttctgcgtaggggcggacgagcagagacactgctgacctctcagacaggttcccggcctggtcggggagcccctcacatccccgatggggctgcaggacagcgccgaagccctcatctccgcagatgggccgctggccagaggaggtctagtctgccccgatgggacggcggacgggcagaaacacttctgacatttcagactggccagcccggtcgcggagcgccacatatccccgatgatggccgacccggtcgggacactccccatttccctgatggcgttgccgctgggcagaggttacagtctaggcactttggcagacctcggcaagccgcttag

SEQ ID NO: 59059 - DNA, 456 bp, Artificial Sequence
  Description of Artificial Sequence: Synthetic coding sequence
atggaaagaaagaaccctagcagggagtcaccccgacgactttcggccaaggtcgggaaagggaccgagatgaagaaggtagccagacagttaggcatggcagctgccgagagcgacaaggattcggggttctccgatggtagcagcgaatgtttatctagcgctgaacaaatggagtccgaagacatgttatcagctcttggttggtcgagggaggacagacctcgacaaaactccaagaccgcaaagaacgcatttccaacattatctccaatggtcgtcatgaaaaatgttctggtgaaacaaggaagcagttcctcacagttgcagtcttggactgttcaacccagtttcgaggtgatatcggctcagccccaactgctgttcttacaccccccagtgccgtcacccgtgagtccctgccatacaggcgaaaagaaatcggattctcgctag

SEQ ID NO: 59060 - DNA, 408 bp, Artificial Sequence
  Description of Artificial Sequence: Synthetic coding sequence
atggaacgaaaaaatcccagcagggagtctccaagacgactctccgctaaagtggggaagggcaccgaaatgaagaaggttgctcggcagctgggtatggctgctgccgagtctgacaaagactcggggttttccgatgggtctagtgagtgtttgagcagtgccgagcagatggaatctgaggacatgctctccgccctgggctggagcagagaagaccggcctagacagaacagcaaaactgccaaaaacgcctttcctaccctgtcgcccatggtggtcatgaagaatgtgttggtgaagcagggctcttcaagttcccagctgcagtcttggacagttcagcccagtttcgaggtgataagtgctcagccccagctgctcttcctgcacccacctgtcccttag

SEQ ID NO: 59061 - DNA, 426 bp, Artificial Sequence
  Description of Artificial Sequence: Synthetic coding sequence
atggaaaggaagaaccccagcagagagtccccccgtcggctgtcggccaaagtcggcaaggggaccgaaatgaagaaggtagctcggcagctgggcatggccgcagcagagtctgataaagatagtggattcagcgatggctcctctgaatgcctgtcatcagcagagcagatggagagcgaagatatgttgagcgcacttggttggagccgcgaggataggccgaggcagaattccaagaccgccaaaaatgctttccctacgctgtcgcccatggttgtgatgaagaacgtgctggttaaacagggttctagctcaagccaattgcagagttggaccgtccagcctagcttcgaggtgatctccgctcagcctcaactcctattcctgcatccacctgtgccatcacctgtctccccctgttag

SEQ ID NO: 59062 - DNA, 474 bp, Artificial Sequence
  Description of Artificial Sequence: Synthetic coding sequence
atggagcgaaaaaatccatcccgtgaaagcccaaggcgtttaagcgccaaagtgggtaaggggactgaaatgaaaaaggtagctaggcagctgggaatggccgctgccgaatccgacaaggacagcggtttcagcgacggctcaagcgagtgtctgagcagcgcagagcaaatggagagtgaggacatgctgtccgcattgggctggtctcgcgaggaccgacccaggcagaactcaaaaaccgctaaaaacgccttccccaccctgtcaccgatggtcgtgatgaaaaatgtgctcgttaagcaagggtccagctcttcacagctccagtcctggacggttcagccttcctttgaggtgattagtgcacagccgcagctcctattcctccatcctcctgtgccctctccggtgagtccatgccacaccggcgaaaaaaaatccgacagtagaaattacctgccgatcctgtag

SEQ ID NO: 59063 - DNA, 1752 bp, Artificial Sequence
  Description of Artificial Sequence: Synthetic coding sequence
atgacgttctatctcttcggtattcgcagttttcccaaactgtggaagtccccatacctgggactggggcctggacactcatacgtgagcctgtttctggccgatcgatgcgggattaggaaccaacagaggctgttctccctcaaaactatgtcaccccagaacacaaaggcaaccaacctcatagccaaagccagatatttgcggaaggatgaaggctctaacaaacaggtttatagcgttccccacttcttcctcgccggagccgcaaaggagaggtcacaaatgaactcccagacagaggaccatgcactggctcccgtgaggaacaccatccagctccctacacagcccctaaactctgaagaatgggacaaacttaaggaggacctaaaagagaacacggggaagacatcttttgagtcctggataatatcccagatggcgggatgccattctagcattgatgtagcaaagagtctgctcgcttgggtcgcggctaagaacaacggcatcgtctcttatgatttgctcgtcaaatacctctacctctgcgtgtttcacatgcagacatccgaagtgatagacgtcttcgaaattatgaaggccagatataaaactctagaaccgagaggctattcactgctgatcaggggcctgatccacagcgatagatggagagaggctctgctcctgctggaggacatcaagaaagtcattaccccatccaagaagaactacaatgattgcattcagggggcacttctgcatcaggatgttaatactgcctggaacctgtatcaggagctgcttggtcatgatatcgtacctatgcttgaaacactgaaggccttttttgatttcggcaaggatatcaaagatgacaattattcaaacaagctccttgatattttaagctacctacgcaacaatcaactgtacccgggagaatccttcgcccattccatcaaaacatggttcgagagtgtcccaggaaaacaatggaagggccaatttacgaccgtgcgcaagagtggccagtgctctggatgcggtaagacaatagaaagcattcagctgtctcctgaggaatatgaatgtctcaaaggaaaaatcatgagggatgtcatagacggcggagaccagtaccgaaagacgaccccccaggagctgaagcggttcgaaaacttcataaagtccagacctccatttgacgtcgtcatcgatggcctaaacgttgccaagatgttccccaaagtaagggagtctcagctcttgctgaacgttgtctcacagctggcgaagcggaacctaaggttactagtcttgggccgaaagcacatgctgagacgcagctctcagtggtctcgggatgaaatggaggaggtgcagaagcaggctagttgcttctttgccgacgacattagcgaagacgacccatttcttctctatgcaactctccattctgggaatcactgtagatttattactagggatctcatgcgtgatcacaaggcctgcctgccggatgctaaaacccagagattgtttttcaagtggcagcagggacaccaactggcgattgtgaaccgatttcctggttccaaacttaccttccagagaattctcagctacgatacagtcgttcaaacaactggggatagttggcatattccttacgacgaggatctcgttgagcgttgcagttgcgaggtgccgaccaaatggctctgtttacaccagaaaacttag

SEQ ID NO: 59064 - DNA, 309 bp, Artificial Sequence
  Description of Artificial Sequence: Synthetic coding sequence
gatattgtcatgacacagagtccactcagcctgcccgtgacaccgggagagcctgcctctatttcttgccgctcaagtcagtccctgctgcactccaacggctacaactacctagattggtacctgcagaaacctggccagtcaccccaactccttatctatctgggcagcaatagggcctccggggtgccagatagattttccgggagtggcagtggtaccgacttcaccctcaaaattagccgcgttgaggcagaggatgttggcgtttactactgcatgcaagcgctccagacacccccaacttag

SEQ ID NO: 59065 - DNA, 348 bp, Artificial Sequence
  Description of Artificial Sequence: Synthetic coding sequence
aagatgagtccttctcagctcattggcttccttctgctgtgggtgcctgcgagtagaggggaaatcgtactgacccaatctccagactttcagtcagtgacaccaaaagaaaaggtgaccatcacgtgtcgagccagccaatccattgggagttcccttcactggtatcagcagaagccagaccagagcccaaaattgttgatcaaatatgcatcccagagcatcagcggcgtcccaagccgcttctcggggtcaggcagcggaactgattttaccttgaccatcaactcgttggaagctgaggatgcggctgcttactactgccatcagtcatcttctctcccatag

SEQ ID NO: 59066 - DNA, 396 bp, Artificial Sequence
  Description of Artificial Sequence: Synthetic coding sequence
atgggtcccgctgtcctcgggcaggggcaggaaggccagcccgaagctcgggcttgttctggacttctccagcctcctaagagaccaatagtgtttaaggaaaaattgacgatgaagacggacagcctaatggaggaaaagctggagtgtagtctgtggtgctgtctctccgatccttccatcccagggaggtgttgtgtcctggaaaggcggattgtcccgtggatgcagcaggaatcatacagctcgagtagccctatctggtctgtggattctgacgaacccaaccttaccagcgtattggagcgcctagaagatacaaaagaaaatagttccgtgcggaaagagactaaactcttctccctttttctaatgaatataattttccgcaattag

SEQ ID NO: 59067 - DNA, 411 bp, Artificial Sequence
  Description of Artificial Sequence: Synthetic coding sequence
atgggagactcccgcagggacgtgctccacgagccagctatcgctcttctgtcgtccccacagacacagtcacggctgcagatcgacgcatttattgctcggagatgctgggggtctcagtgggatattaccggatacattcatcagcaggacttcccaacagcggtattcattgggttctctaatgaatttaacatctgcattccacatcccttcactgaatggctgcagtgcgtcagaaagtacagtcagtcctggggagttagaaagggccagaggcatattcgctatggaatgtgttccgaacggactcatcacctgagtcgcacttattcgagcctcctggaacgcgaggagaagctcgccttttacggggtgctgactatgtgtcagatctggtgtgagacctag

SEQ ID NO: 59068 - DNA, 315 bp, Artificial Sequence
  Description of Artificial Sequence: Synthetic coding sequence
gaggacatcgtaatgacccaaacacctctttcccttccagtgacacccggagagcctgcttcaattagctgtcggagttcacagtccctcttggattccgatgatggcaatacctacttggactggtatctacagaagcccggacagagcccccaactgcttatatatacgctgtcttatagggcaagcggcgtacccgaccggttcagcggcagtggttctggtacggacttcacgctgaagatctcacgggtagaagccgaggacgtcggggtgtattattgcatgcaacgcatcgaatttccctctacctag

SEQ ID NO: 59069 - DNA, 345 bp, Artificial Sequence
  Description of Artificial Sequence: Synthetic coding sequence
atgggcactcgcctgttatgctgggtggtgttgggctttctggggacagatcatacgggagcaggagttagccaatccccacgctataaagtagcaaagagggggcaggatgtggccttgcgatgtgacccaatcagtgggcacgtttccctattttggtaccaacaggccctaggccagggcccagaattcctcacctattttcaaaatgaagcccagctggacaagagtggattgcctagcgaccgcttttttgctgaaagacccgagggcagtgtctccacattaaagatccaacgtacccagcaagaggattccgctgtgtacctctgtgccagttcctag

SEQ ID NO: 59070 - DNA, 372 bp, Artificial Sequence
  Description of Artificial Sequence: Synthetic coding sequence
atgtgcggccaatgccagagctcgtctgggcacatggaggaagaagcccatcctgaactctgtcctcactggcctctccaatttagtcctcagagtcactgtcgccaagcttatggacgggacacccacgctggagggcctggtgctagagtggacagcggacaccatttgggcctgtttcccggactcctatctacctgcccggatgggctgtgcgtgttcccagtgccctcccctacgttctccactagtctgcatgtgttaatggagtgtaaggtccatcagcccggacccctgcctgggcgtggcagtgccgacgctgggctacggggtttacctcagggcagaacactgtgcgtcctaactgcttag

SEQ ID NO: 59071 - DNA, 528 bp, Artificial Sequence
  Description of Artificial Sequence: Synthetic coding sequence
atgcatggggagaagtcacatggtcggggtcaggccggtagacaggtgcctctcaaacagcaatccgtcagtggggagtctcagcagggggctagacagggcgctggtcagagtacatgttatctgagttctgctttcttatgtaatggaagtttcccggcaggaagtatgagcctgtgggacccccagcccaagcaagcattcccttctgtcctatggtgctcctgggccggtgtccctggtaggagaacagggcagcgtgacccacgagttcaagaaagacggggtgacttcgtttcgaagttgggtgctgccgtgggtggagagcccctcgccctgtttggcccacattcatggcctgggatgggtcaccgggtgcccggactgggagccggattcctgctatttgcagggttcgcactggaaccatgggactcgtatcacgtcgtcttcgaaggctggaccatcgacatgcggcgtaatgagcccgaacggactaggtccctttccgcccctggccctctgtag

SEQ ID NO: 59072 - DNA, 1671 bp, Artificial Sequence
  Description of Artificial Sequence: Synthetic coding sequence
atgcacccgatggcactccacatggtgctccccgctcacttgccttttctctcaccagaggtcctacggttactggaagtgcacgttaaaaaatggatgcactttcagaggtgggggttacccagacgcgtggaagaatcgctacggcagctgatgccgaatccaccgctgtactatcagccaggcaatgaccagccagtttctttcaacttgaataatacgagccaggtctctctccataggagcgagaccattagtttgcagacttggtgcagttgtgtggccggacagcctattcaaacgttctgggtgagtgagtggtctactatgaatccagagcagcggcatcactgtcagcagacaccaaaccccatggcccttgctctgccctcccctgcacttaaggcactatcaggcccacatccccagagcggcggacaggacaatgactcaggtagtgacctgcagcagaagtactcacaattgttttgcggcctgccgtctctccattctgaatctctggtcgccacatttatgggaagccagggtctgcctaaaattgaaaacgtgcccaagcccccattgaaggatccgttcctctttaacgacctgagctttccacagctgctccccaaaacatcaccacaatctgcaccacccagctccccgctgtccccaaactgggtgtccccctccgaccaccaacgcgcacaaattaacgtgccctttttgacacttgctgagtacgaggccctcgaatggcacctgctccaaaggcaactgcaacttcagtggggttggcctgctgccttacagcggtcccagcatacccagtgtctcatgcaacatgaaccttgtgggaaagcccaatcccctgagactacgacagcctcacagacagggaagtccataagcgtcctgacccgagagctgttatttttccctgaacacgcaagaaagctgttggagttccacattcagaagcagagtatacgccatcgctggggtctgccacaaaagattcagcagtcaatccagttgctgctgacctccaccgaccagcaaacagttagtagcagctccaccgctctggccaacgtgtccattcctcagccagtggccctggaggcaaacggcgcatgtgacgttctgtcccccatagccgctcctgtaagcatcccccgtccgcatctcttgacgcaggttaaggccattttgcagagtcacattgattccaaatgcggacagatccaccaggggaaaataccagcctgtgtacatagatcatgggattgtaggatttccggggtgctggcagtcgccccatttccatgcatcccagagagccaatttctcgtgctgcagaccgcttcagatcccgatctccaccacaaggtcatgccttggatgccaacagcgctggaccaacagcagcaggccctgcctggcacagtgacagagcacccaaagctcctcagagttctctcagtcgaagccattgaaaagctggaaacgacattgaggcacaagcacctcgcctttctcagcgggctcccagctctttattatgtggccctaccccgtgctctggctccagccgtgacctcacagtctgtgataactgaaatggagccaagcccagtcgagatacccgcagagcccctaatatag

SEQ ID NO: 59073 - DNA, 624 bp, Artificial Sequence
  Description of Artificial Sequence: Synthetic coding sequence
atggggatgaggctgcagctgttgcgggatagaagaatctcctcgaggggcccagggctgcatcgggctaaagccgatccccagcagcagaagcgtctaaccacaggtttgatgacccaggctgaaacccagaaagaagctcagcaacgtcaggcagctatgagaaagacagccctgtggcatacaggacacctccagcctaaaacccacacccataccgggatgcacacacagacacatcgagaacgggagagaaatactcaacgcctgcgtgacagagagcgcagggagaacggaaggcatacccatagacatactcatacccttacccacactcatacgcatcgggatacgcacactgccagctatcggagagggattgagacccacaccacacggcaaccactgcgattacgtggatccgctcatgacgagaacgaccctcgagtacgggaacaaccacgaggcacccaggccgacctttcctcgaggtccaggatggccgctcggttactagggaggctgacacctaccaataccgtgcgcgcaggcctacggctcggctctagagcagctagtcctgacccagcctgggggttcctcatcgtcgtcgggcctctgtag

SEQ ID NO: 59074 - DNA, 381 bp, Artificial Sequence
  Description of Artificial Sequence: Synthetic coding sequence
atgggaatgaggctgcagttactgagggaccgtcggatcagcagtcgcggtccaggcttgcaccgcgctaaggccgatccacagcaacagaagagactgacaaccggactgatgacacaggcagagacacagaaagaggcccaacagcgacaggccgcaatgcgcaaaaccgctctctggcatactgggcacttacagccaaagactcacactcacactgggatgcatactcagacccaccgagaaagagagcgcaacacccagaggttgcgagatcgagaaaggagggagaatggcagacacacccacacacatacagaaacccacacccaaagacacactgaggaagcgcttaagcacacaccacccggtaatccatag

SEQ ID NO: 59075 - DNA, 693 bp, Artificial Sequence
  Description of Artificial Sequence: Synthetic coding sequence
atgcggctcgcagggccactgcgaatcgttgtgctggtggtctcagtgggcgtgacatggatcgtcgtgagtatccttctaggtgggcctggatcagggttccccaggatacagcagctgtttactagccctgaatcatctgtgaccgcagccccacgcgctagaaagtacaaatgcggactgcctcagccgtgcccagaagaacaccttgcattcagagtcgtcagcggcgctgccaatgtgatcggcccaaaaatctgcttggaagacaagatgttaatgtcaagcgttaaagataacgtcggccgtggactcaatattgctcttgtcaacggtgtttcaggagaactgattgaggcccgagcattcgatatgtgggctggggacgtgaacgaccttttgaaattcatcaggcccctgcatgagggcacgttggtctttgtggctagttatgacgatccagcaacaaagatgaatgaagagacacgaaagttgttttccgaacttggcagtagaaacgctaaggagctggccttcagggactcttgggttttcgttggcgctaagggcgtgcagaataagagtccctttgagcagcacgtaaaaaactccaagcactccaataagtacgaaggatggcctgaggctctcgaaatggaaggttgcatcccaagaagatccacagcttcctag

SEQ ID NO: 59076 - DNA, 840 bp, Artificial Sequence
  Description of Artificial Sequence: Synthetic coding sequence
atgggaaaggggaatgaagattcagatctccactgctcctccatacagtgcagtactgaccagccacccttccagcagatatccttcaccgaaaaaggcagcgacgaaaagaaaccattcaaagagaaaggaaaaactgcgtttagccactcttcagaaaagcacattcagaggcaggccggttctgagccaaatcccaacaaagagaatagtgaagagaccaaactcaaggccggaaatagtacagctgggtcagaaccagaaagctcctcttatcgcgagaattgtagaaagcggaaaatgtcaagcaaggactcttgtcaggatacggctggcaactgcccggaaaaagagtgctccctgtctcttaataaaaagagccggtcatccaccgcagtgcacaacagcgaaattcaggagacctgtgatgcgcatcacaggggtcattctcgcgcttgcactggccattctaagcggcacaggtcgagggcgcttggagttcaaacgccttcaattcggaaatctttggtcactagcgtccgggctatgtctgaagctgtataccaggacctggctcaggtttgggcccaacaaatccattctccactgacttgtgagcagctgactctgctgacccgcctacggggtccactctgtgcgcaggtgcaaaccttgtactcaatggcaactcaggctgcatacgtattccccgcagaatcctggcttgtgcccgcaactctgcctggacctggggaaagcgccttggacagggaggcccacccttttccaggccaagagatcacggagactgtgagtggcagcgatgaagccaagctatag

SEQ ID NO: 59077 - DNA, 849 bp, Artificial Sequence
  Description of Artificial Sequence: Synthetic coding sequence
atgggcaagggaaatgaggaccccgatctgcattgcagctccatccagtgctctaccgatcagcctccttttcagcagatctcctttactgagaagggcagcgatgagaagaagcccttcaaaggaaagggcaaaaccgctttttctcacagtagcgaaaaacacacccagcgtcaggctggttcagatcccaatccaaacaaagaaaattctgaagagaccaagctgaaggctggaaacagcaccgccggttccgagcctgagagtagctcgtatcaggaaaactgccgcaaacgaaaaatttctagcaaagacatctgtcaggaccgcgcaggtaactgcccagaggaggaatgcaacctgaccctgaacaaaaaatcccggagcagcactgccgtgcataactcagaaatccaagaaacttgcgatgcccatcatagaggttcatccagagcttgcactggcaggagcaagcggcaccggtcccgggctttggaggtgcaaacaccctctctacggaagtccctagtaacatctgtgcgtgctatgtcagaggccgtgtaccaggatcttgctcaggtttgggcgcaacagatccattcccccctgacttgcgagcagctcactctcttaacaaggctccggggtccactctgcgcccaggtccagacattgtattcgatggccacacaagcagcttacgtctttcccgctgagagctggctcgtgcctgccacactgccaggacccggagattcagcgctagatcgcgaggcccaccccttccctggacaggaaatcaccgagcctgttagcggctcggatgaagcaaaactcggagcaccatag

SEQ ID NO: 59078 - DNA, 903 bp, Artificial Sequence
  Description of Artificial Sequence: Synthetic coding sequence
atggccgcaacagaggacgaacgcttagccggttctggagagggggagcggttagacttcctacgcgatcgacacgtgcgcttttttcaacggtgtctacaagtactcccagagagatattcaagtttggaaacaagccgcctgacaatcgccttctttgctctgagtggccttgacatgttagactcgttggatgtggttaacaaagatgatatcattgaatggatttattcattacaagtcctccccacagaggacagatcaaacctcaaccggtgtggattcaggggctcgtcctatctcggcatcccttttaacccctctaaggccccaggcactgcccatccctacgatagcgggcacatcgccatgacgtacactgggctgagctgcctggttatccttggtgatgatctgagcagggtgaataaggaagcgtgtctggccggtctcagagcgctccaactggaagatggctctttttgtgcagtccccgagggttccgaaaacgacatgcggtttgtctactgcgctagttgcatctgttacatgctcaataactggtccggaatggacatgaaaaaagccataacctatatcaggcgctctatgcttttgaagatctttcaatatacaaacttcgaaaaaaatcgcaattatattctgtcgactcaggaccgcctggtgggtggtttcgctaagtggcctgattctcaccctgacgccctacatgcttattttggaatatgcgggctgtcgcttatggaagagtctggcatctgcaaagttcatccagcgttgaacgtatcaacccgtacaagcgagcggcttctggacctccaccagagctggaaaacgaaggacagcaaacagtgttccgagaacgttcatatctcaacctag

SEQ ID NO: 59079 - DNA, 1134 bp, Artificial Sequence
  Description of Artificial Sequence: Synthetic coding sequence
atggccgctaccgaggacgagcgcctcgccggtagcggcgaaggggagcgtctcgacttcctgcgtgaccgccacgtaaggtttttccaacgctgccttcaggtcttacccgaacggtacagctccctggagactagcaggctcaccattgcgtttttcgctttgtcaggactagacatgcttgactcacttgatgtggtgaataaggacgacatcattgagtggatctattcactgcaggtgctcccgaccgaggaccgttctaatttgaaccgttgcggcttcagaggcagttcatatcttggcattcctttcaatccttcaaaagccccaggcaccgcacatccatatgactcaggccacattgccatgacatatactgggctctcgtgcctcgtcatactcggggacgacctgtcccgagttaataaagaggcgtgcttggctggactaagagcactgcagctggaagacgggtctttctgcgccgttccagagggttctgagaatgatatgcgattcgtttactgtgcttcatgtatctgctatatgctgaacaactggagcggaatggatatgaagaaggccataacctacatccgtcggagcatgagctatgataacgggttggcccaaggagccggtttggagtcgcacggcggatctaccttttgtggtatagcctcactttgcctgatgggcaagctggaagaggttttcagtgagaaggagctgaaccggatcaagagatggtgtatcatgcggcagcagaacggatatcatggcaggcccaataagcctgtggacacttgttattcgttctgggtgggagcaaccctgaagctcctgaagatatttcagtatactaatttcgagaagaatcggaactatatcctatccactcaggaccgcttggtgggaggctttgccaaatggccagattcccacccagatgcgctgcatgcatactttggtatttgcggcttgtccttgatggaagaaagcggcatttgcaaggttcaccctgcccttaacgtgtctacacgaacttcggagaggctgctggatctacatcagagctggaagaccaaagattcaaaacagtgcagcgagaatgtccatatcagtacctag

SEQ ID NO: 59080 - DNA, 1011 bp, Artificial Sequence
  Description of Artificial Sequence: Synthetic coding sequence
atgtgggtgagaacaaccctgacaattgagaggtggactaaggagaaaaccgaacccaaggcgagatcctgggacgaaagccggtgtcgcggagactgtaaggaacctgataagtgttgttggagacacaaacagtgcacaggacacatcatttacccgtttgcaagtgattgtgtccggcactctctacatctgcactcggtgaaccactgcaattgcaattcccggttaaaggacagctccgaggattcttctagctcgagaggcgcaggccctacatgctcccacgttatcgaaagcccgtgctttgaactgactccggaggaggaacatgtggagagattccgatacggctggtgtaaatcatatcgacctgtcagtgttgccgtgatccaccatcctttgtaccacgagtgtggcgctgatgaccttaacgaagaggaggaagaggaggaggaggaatccaagcccccaataccaactcaagtcggccctgcgaccgcctcccccgacctgggaacatccatggccacagggaccccagacagcacagctccgatcacgatctggaggtcggagagtcccacaggcaagggccagggtagcaaagttatcaagaaggtcaagaagaaaaaggagaaagagaaagataaggaggagatggacgagaaagcaaaattaaaaaaaaaggcgaaaaaaggacagctgaccaagaaaaaaagcccagtgaagcttgagcccagtccgcctgacgtgagccgctcattaagcgcgcgacagctggctagaatgtctgaaagttctcctgaatcccgtgaggaattggaatcggaagactcctacaacgggcgagggcagggcgagctgtcatccgaagacatcgtggaatcgagctcacctcggaaacgcgaaaataccgtgcaggccaaaaaaaccggtgccaaaccctcgcaagctcgcaaagtcaataagaggaaatcaccaccaggctccaatcccaacctgagttag

SEQ ID NO: 59081 - DNA, 1095 bp, Artificial Sequence
  Description of Artificial Sequence: Synthetic coding sequence
atgtgggtcaggacgacactgaccatcgagaggtggactaaggaaaaaaccgagcccaaagcccgttcctgggatgaagccttgtcggacgtgaatagactgccctcctgggagcggggtcacttgctggctggcgtggcctcatctacggatgtgagcactttctcggaagccggagactgtaaggagccagataagtgttgttggcgacacaaacagtgtaccgggcatattatctacccctttgcctccgattgcgttcgccacagccttcatctccatagtgtgaatcactgtaactgtaactctcggctcaaggactccagtgaggatagtagctcatcccgcggagctggaccaacttgctctcatgtcatcgaaagtccatgttttgagctcaccccagaggaggaacacgtggagcgatttcgttatggctggtgcaagagctatcgtcccgtcagcgtagccgtgattcaccatccgctgtaccatgagtgcggagccgacgacctgaacgaagaggaggaggaagaagaagaagaatctaagccgcctatccccactcaggtaggacctgctactgccagtcccgacctcggcacatcaatggcgactggcacccctgattctactgcacccattacaatctggcggtcggagtccccaacaggcaaaggccaggggagcaaggttatcaaaaaagtcaagaaaaaaaaggagaaagagaaggacaaagaggaaatggacgagaaagcaaaactgaaaaagaaggccaagaagggacagcttacaaagaagaaatcccctgtcaaacttgagcccagcccacccgacgtgagccgcagtcttagcgctagacagctcgctaggatgtcagagtcctcacccgaatcccgtgaggagctggagtctgaagatagctataacggcagggggcaaggggaactctcatctgaggacatcgtggagtcatcttctccaagaaagcgtgaaaacaccgtccaggccaaaaagacaggagctaagccctcacaggcccgtaaggttaacaagagaaaaagccctccaggatctaatcccaacctgtcctag

SEQ ID NO: 59082 - DNA, 462 bp, Artificial Sequence
  Description of Artificial Sequence: Synthetic coding sequence
atgagcatcacctatgtgaatcggttgccaagctgggaaagaggccatctcttagcaggtgtggcatcctctacagatgtgagcacgttctctgagggagactgtaaggagcccgacaaatgctgctggaggcataagcaatgtaccggccatatcatatacccattcgcttcagactgcgtgaggcacagcttgcacttgcactccgtgaaccattgcaactgcaactccaggcttaaggatagcagcgaagacagcagttcttctcggggtgcaggaccaacctgttcacacgtaatagaaagcccatgcttcgagcttaccccagaagaggaacatgtcgaaaggtttaggtacgggtggtgcaaatcctacaggcctgtctcagtcgccgtgattcaccaccccctgtatcatgaatgtggagccgatgatctcaacgaagaggaggaagaggaatag

SEQ ID NO: 59083 - DNA, 1017 bp, Artificial Sequence
  Description of Artificial Sequence: Synthetic coding sequence
atgtctattacttacgtgaatcgcctaccaagctgggaaaggggccaccttctggctggtgtggcaagcagtaccgacgtcagcaccttctccgagggtgattgtaaggagccggataagtgctgctggaggcataagcagtgtactggacacatcatctaccctttcgcttctgattgcgtgagacacagcttgcacttacactctgtaaatcattgcaattgtaactccagattgaaggattcttctgaggactcatcctcaagccggggagcaggcccaacctgttctcacgtgattgagtccccatgttttgagctcacccccgaagaagaacacgtggaacggtttagatatggctggtgcaaatcatatcggccagtctccgtggcagtcatccatcatccactttatcacgaatgcggcgcagacgaccttaatgaggaagaggaggaggaagaagaggagagcaagccacctatccctactcaagttggaccagctacggcttctcccgatctgggcacctccatggccacaggtacaccggacagcactgcaccaatcacaatttggcgcagtgagtcccccaccggcaagggccagggctccaaggtgattaagaaggtgaagaaaaagaaggagaaggagaaagataaggaggagatggatgagaaggccaaactaaagaagaaggcaaagaagggacaattaaccaagaaaaaaagtccagtgaaactagagccttctccccctgacgtgtctcggagcctcagcgcacggcagctggcacgcatgagtgaatcaagtccagagagcagggaggagcttgaaagcgaggactcatataacggaaggggtcagggcgaattatcttcggaagacatcgtggagagctcgagccctcggaagcgggagaacactgtacaggctaagaagactggagcaaagccgagccaggcccgaaaggtaaacaagcggaaaagtcctcccggatctaaccccaatttgtcctag

SEQ ID NO: 59084 - DNA, 303 bp, Artificial Sequence
  Description of Artificial Sequence: Synthetic coding sequence
atgggcatttccgaagagggaaacctcctgagtacggttagccctactgtgaaagctctgtttggcaagacacgtgtttcaccaatctttcccttctcccctcgtagccccttccaacccttgataccccgtaccccagggtcgccctgggggccagtcggcccagcatcaccattgggtccgggatttcctataggtcctatgggtccaggcaaaccagttggtccaaaggggccaatgctgcccttggggccttccggcccagtaggaccaacgtctcctttgttccctttctgtccatag

SEQ ID NO: 59085 - DNA, 315 bp, Artificial Sequence
  Description of Artificial Sequence: Synthetic coding sequence
atgatgtctactgagcaaatgcagccccttgagctgtcagaggaccgcttagacaagctggacccaaggtgcagccacctgggcgtattctctgagcacctcattaaaaggtacgatgtacaggaacggcatcctaagggcaaaatgatccctgtactgcataatacggaccttgagcaaaagaaaccacgtcgcaaagacactccagctctgcacatgtctccctttgctgcaggagtgaccttgttaagggatgaaaggccaaaggccattgttgaggatgacgagaaggatggggacaagatcgcgatttag

SEQ ID NO: 59086 - DNA, 2400 bp, Artificial Sequence
  Description of Artificial Sequence: Synthetic coding sequence
atggctcggacggctccagttgagccacccctgcggcactcagctccgcctagccctgcagcgggagaaccccgtactagtgttgaggccgcagtggctcctagacgagtcctcttcgccgacgaagccctcggcctgcctctagcccagttgaggagataccgtccatgggggggtcctggggcaggtaaaatggccgctgcagcaggacaagatggcggtgggggagggggagccgatgaggatgatgatggcgaagacggtgatgaaggtgaggaggaggaagaagcatgtccagaaccaagtcccctttgcccagtgcccgctgggggaggcttctacctagttccaactttcagccttcccccagctcccggtaggctcgaacgactgggtagggtgatggttgagttggaggccctgttgcccccaccaggcgcagtgcccggaggggctggtgtgtgggtgcccggaggcagacctcctgtgctgagaggtctcgtgcgcgttctgaatcggtcgttcgagaaggccgtccacgttagggcaagccatgatggctgggcctctttttgtgatcacccagcaagatacgtgcccagatctcccccttgggccggagcgggaggcaccggcgctggtgatccaattctcgatcctggcttgggactgggtcccggtcaagcctccgctagtagtccggacgatggcggacgaaccgaccgcttcgcatttcagctgccctttgctgagggcgcaggggatggggcaaggctcgattttgtagtgaggtacgagacccctgagggcaccttttgggccaacaaccatgggcgtaattatactgtgctgcttagaattgcgcctgcacccacacctacggatgccgaggggcttccacagcaacaacagctacctcagctggaacctcagcctgaatgccagggtcccgtggaggccgaagcccgacagctgaagagctgcatgaaacccgtcaggagaagacccgctgaggaagagctaaaaacaaagaatatggatgataacacgttcgctatggcagagcatccggacgtccaagagagcgtgggaccactcgtggccccaactcccctcagaccttggcctcaaatgacattgcaggtttctgacgttccgatgacagggaatcccgcagaggagggcgatgtaccaagaagcagtcctcctgttgctttcacggaagttctgcaagcaccagccatcaggatacctccgtcttccccactttgtggccttggcggaagcccaagagatcaagcctccgggccagacgcatccgagggggctacaggaccattcttggaaccaagccagcagcaggcggaggcaacatggggggtgagctccgagaacggtggaggactcgaggctgtctccggaagcgaggaactgttgggtgaagacactattgaccaggagctggagcagctgtacctgagccacctgagcaggctgcgagcggctgttgctgccggtggagcgggaggagggggtgaaggatcaaccgacgggggtatgtccccgagccaccctctggggattctgactgaccgggatttaattcttaagtggccagggccagagcgtgcactgaacagcgcactcgccgaagaaattacactgcattacgccagattgggacgcggagtggagctgatcaaagacaccgaggatccagacgatgagggggaaggggaggagggcctttccgtgaccccttccagccctgagggggacagccctaaagagtctcccccagaaattctgtctggcgcaaggtcagtggtcgcaactatgggcgatgtctggctgccatgggccgaaggctcagggtgtgatggcccagtcgtgcttggtactgaggggcagtttatcggggatcctgaaaagggcatgggcaaagacactagctcgctgcatatgaatagagtgatcgccggtgttacggagagtctcggggaagctggcacagaggcccagattgaggtcacgtctgaatgggctggatctctagaccctattagtgggaaggagccagcaagccccgtgctgttgcaagggcagaacccaacattgttatcacctctgggtgcagaagtgtgcttgtcttccgttgcccgtcctcacgttagtagtcaagacgaaaaggatgcgggaccgtcactggaacctccaaaaaaaagcccgactctggccgtgcccgcagaatgcgtctgcgccctccctcctcagctacggggacctctgacccaaactttgggagttttggccggactcgttgtggtgcccgttgccctcaatagcggggtgagtcttctggtgctcgctctatgcctgtctctggcttggttcagctag

SEQ ID NO: 59087 - DNA, 468 bp, Artificial Sequence
  Description of Artificial Sequence: Synthetic coding sequence
atgatgagcacggagcagatgcagccactggaattgagcgaagatcggctcgacaagctcgatccgaggtgtagtcatcttgacgatctgtcggaccagtttattaaagattgcgacctgaagaagaagcctcggaaaggtaagaacgtccaagctacactgaacgtcgaaagcgaccagaaaaagcctagaaggaaggataccccagctcttcacattccgccatttatccccggagttttttccgagcatctgatcaaaaggtacgatgtccaggagcggcatcccaaaggaaaaatgatacctgtattacacaacactgacctggaacagaagaagccgagaagaaaagacacccctgcattacacatgtcccctttcgctgctggcgtaacactactcagagatgagcgcccaaaggctatcgtagaggatgacgagaaggatggtgacaaaatagcgatatag

SEQ ID NO: 59088 - DNA, 1842 bp, Artificial Sequence
  Description of Artificial Sequence: Synthetic coding sequence
atggctacgattccagactggaagctccagctcttggcccgtcggcgacaggaggaagcctctgtccgagggcgagagaaagcggagcgcgagcgtctcagtcagatgcctgcctggaagagaggattattggagagacgtagagcaaagctggggctgagccccggtgagccttctccagtactgggcactgttgaagcaggcccacccgaccctgatgagtccgccgtgctcttagaagccattgggccagtgcaccagaacagatttattcgtcaagagcggcagcaacagcagcagcagcagcagaggagcgaagagctcctagcggaacgaaaaccagggccactggaggcacgcgaacgcagaccctcccccggagagatgagggatcagagccccaaagggagggagagccgagaggaacgcttatcccccagggaaactcgagaacgaagactgggtatcggcggtgcacaggaactgtccttgagacctctggaagctcgcgactggcgtcagtcacctggagaagtcggggatcgcagcagccgcctgtcagaagcttggaagtggcgcctctcacctggagagaccccagaaaggagccttagactggcggaaagtagagaacagtcacccaggcgcaaagaggtcgagtcgggccttagtcccggtgagagcgcgtaccagaagctaggcctgaccgaagcacacaaatggcggcctgacagtcgcgaatctcaagaacagtcactggtccaactggaggccacagaatggcgactgagaagcggagaggaacggcaggactatagcgaagagtgcggcaggaaggaggagtggcccgtccctggcgtggcgccaaaagaaactgcagagctatcagagaccctcacaagggaagcacagggtaactctagtgcgggtgtcgaggccgcagaacagaggccggtagaagatggtgagagagggatgaagcccacagaggggtggaaatggacgctgaatagcggcaaagccagggagtggacgccaagggatattgaggcccagactcaaaaaccagagcccccagagtcagcagagaagttgcttgagtcccccggagtagaggcaggggagggcgaggccgagaaagaggaggcaggcgctcaggggagacctcttagagccttacagaactgctgttcggtgccctctccattaccccctgaagatgccggtacagggggactgcgccagcaggaagaagaggccgtggaactgcagccacctccgcctgctccattgagcccccctccaccggcacctaccgccccacagcccccaggagatcccttgatgtctagactcttttacggcgtgaaggcaggtcctggcgtgggggcacctcggaggtcagggcataccttcacagtgaatcccagaagatcagtgcctcccgcaacccctgccacaccaacctcccctgcgaccgtggatgccgcagtccctggagcagggaaaaaaagataccctactgccgaggaaatactggtcctgggcggatatctgcgcttaagccggagctgtttggcaaagggctcccctgaacggcaccacaagcaactgaagattagcttcagtgagacagccctggaaaccacctaccaatacccgagtgagagttccgtgctcgaggaactgggccctgaaccagaagtgccttccgcacccaatccaccagccgcacagcccgacgacgaggaagacgaagaagaactcctcctgttgcagcctgagcttcagggagggctgagaaccaaggccctgatagtggacgagtcatgcagacgatag

SEQ ID NO: 59089 - DNA, 1842 bp, Artificial Sequence
  Description of Artificial Sequence: Synthetic coding sequence
atggccaccatccctgactggaaactgcaactgctggccaggcggcgacaagaggaagcgtctgtgagaggccgagagaaggccgagcgcgaaaggctaagccagatgcccgcttggaaaaggggcttgctagaaagaagacgggctaagctaggcctttcgcccggagagccgtcccccgtgttagggacagtcgaggcgggtccccctgatccagatgaaagcgccgttctcctcgaggccatcggtccagtgcatcaaaatagattcatcagacaagaaagacaacagcaacagcagcagcagcagaggtcagaggagcttttagctgaacgcaaacccggacctctcgaggcccgtgagagacgtcccagtcctggcgagatgcgggaccagtcacccaaggggcgagagtcccgggaggagagactgagtccacgcgaaacacgtgagcgacgtctggggatcggaggtgcccaggagctgagtctgcggccactggaggcaagagattggagacagtcaccaggagaggtgggtgaccgatcctcccggctgtccgaagcatggaaatggagattatcacccggtgagactcccgagaggtcattacgcttggccgagtcccgtgagcagagcccccgtaggaaagaagtggagagcggcctctcccccggagaatctgcctatcagaaactgggactgactgaagctcacaagtggcgacctgactctagggagtcccaggagcagtctttggtccagctcgaggccaccgagtggaggctccggtctggggaagaacgtcaagactattcagaggagtgtggccgtaaggaggagtggcccgtgcctggagtggcccctaaagaaacagcagaattgtccgagactctcactagagaagcacagggcaatagttctgctggggtggaagcggctgagcagcggccagtggaggacggtgaaagggggatgaagcccaccgagggatggaagtggaccctgaatagcgggaaggcccgtgagtggacgccgagggacatcgaggctcagacacaaaaacccgaacctcccgaatcagccgagaagctgctagagtctcccggtgtggaggctggtgaaggtgaggctgaaaaggaagaggcaggcgcacaggggcgacctctgagagctctccaaaactgctgcagtgtgccttcgcccctcccccctgaggacgcagggacggggggtttaagacagcaagaagaagaggctgttgagctgcagccaccgccaccagctccacttagcccgcctccccctgcacccaccgcccctcagcccccaggtgaccccctcatgagccgtctattttatggggttaaagctggcccaggagtcggcgctcctcgcaggagcggacacacattcacggttaatcctcggaggagcgttccccctgcaacgccggctactccaacctcccccgcaaccgtcgacgccgcagtcccgggtgctggcaagaagcgataccctacggccgaggaaatactggttttgggcggttatctacggctgtccaggtcatgtctcgcaaagggttcacctgagcgccatcataagcaactgaagatttcctttagcgaaacagccctggagactacatatcaatacccgtctgagtcctcggtgctggaggagttaggccctgaaccagaagttcccagtgctcctaatccaccagccgcacagcccgacgatgaagaagatgaagaggagctgctgctcctgcagcctgagctccaaggcggtttgaggacgaaagctcttatcgtggacgagagttgcagacggtag

SEQ ID NO: 59090 - DNA, 1842 bp, Artificial Sequence
  Description of Artificial Sequence: Synthetic coding sequence
atggctacgataccggattggaaactgcagcttttggctaggcgtcggcaagaggaggcttcagtaagaggtagggaaaaagccgagagagagagattaagccagatgcctgcatggaagcgaggcctcctggagagaaggcgagcgaagctggggctgagtccaggtgagccgtctcctgtgttggggactgtcgaagcaggccctccagaccccgacgagtccgcagtcctccttgaagccattggccctgtccaccagaataggttcattagacaggagaggcaacagcagcaacagcaacagcaacggagcgaagagctcttggccgagaggaaacccggacctctggaagctcgtgaaagacgccctagccccggagaaatgcgtgaccagtcccccaaaggtagagaaagccgggaggaacggctctcacctcgggagacccgcgagagacgactgggcatcggaggagcacaggaactgagtctgcgccctctcgaagcgagagactggcgccaaagtccaggtgaggtcggggatagaagctcaaggctgtctgaagcttggaagtggcggctatctcccggtgagaccccggagagatctctcaggctggcagaaagccgagagcaaagcccaagacggaaagaggtcgaatcccgcttatcacccggagagtccgcttatcagaagctcgggctgacggaagcccacaaatggaggcctgatagccgggagagccaggaacagagtctggtgcagctagaagctaccgagtggagactgcggagtggagaagagcgccaggattatagcgaagagtgcgggcgaaaagaggaatggcccgtaccaggagtggctccaaaagaaaccgccgagctttcagagaccctcactagggaagcacagggaaattccagtgcaggcgtggaggcagcagagcagcgtccagtcgaagatggcgaaagaggtatgaaacctacagagggttggaagtggactctgaatagtagaaaagccagggagtggacccctagggatatcgaagctcagacacagaaaccagaaccaccagagtcagccgaaaagctcctggagagcccaggtgtggaagccggagagggagaggctgagaaagaggaggccggagcccaggggagaccactgagggccctccaaaactgctgttctgtgccttctccgcttccacccgaagacgcaggcacgggaggactccgccaacaggaggaggaagccgtggaactgcagcctccgcctccagcaccccttagccccccacctcctgcccctacagccccacagccccctggggatcccctcatgtcccgcctgttctacggggtcaaggcaggcccaggagtgggagcccctcgccgaagtggacatacttttacggtgaacccgagaaggagtgtccccccagccacccctgctacacctacgagtccagccaccgtggacgccgcagtgcctggagctggtaagaaaaggtacccgactgcagaggagatcttagtgctggggggttacctccgcctctctagaagctgcctggctaaaggaagtcccgagaggcaccacaagcagttgaagatcagcttttcagaaaccgccctggagacgacctaccagtatccctccgagagcagcgtgctagaagagctgggtcccgagccagaggttccctctgctccaaacccacctgccgcacagcccgacgatgaagaagacgaagaggaactgctcctgctacagccggaactgcagggcggactccggacaaaagccctgattgtcgacgagtcttgtaggcgatag

SEQ ID NO: 59091 - DNA, 231 bp, Artificial Sequence
  Description of Artificial Sequence: Synthetic coding sequence
ctgaagataagctttagcgagaccgcccttgagacaacctatcagtaccctagtgagtcatccgtgctggaggaactggggcctgagcctgaggttccttctgcacccaaccctccggcagcacagcctgacgacgaagaggatgaggaagaactgcttctgctgcagcctgagctgcaggggggactccgcaccaaggcgttaattgttgacgagagctgcaggcggtag

SEQ ID NO: 59092 - DNA, 1842 bp, Artificial Sequence
  Description of Artificial Sequence: Synthetic coding sequence
atggctacaatcccggactggaaactccagcttctggcacgaaggcggcaagaggaagcgtccgtacgaggcagagagaaggcggaacgcgagaggctgagccagatgcccgcatggaagagggggcttttagagaggcgccgagcaaagctcggcttgagccctggcgagccctctcccgtgctaggcacagtggaagcaggtcctcccgatcccgacgagtctgcagttcttctcgaagctattgggcctgtgcatcagaaccggttcatcagacaggagcgccaacagcagcagcaacaacaacagaggagcgaagaacttctggctgagaggaagcctggccctcttgaagcccgagagcgaaggcctagccccggagagatgagggaccaatctccgaaaggacgggaatctagggaagaacgtctctctccacgcgaaacaagggaacgtcgactgggcatcgggggtgcccaagagttaagcctccgccctctggaggcacgggactggaggcagtctcctggcgaggttggggaccggtcttcccgccttagtgaggcgtggaaatggaggttgagccctggagaaacccctgaaaggagcttgcgcttggcagagtcccgcgagcagagccccaggcgcaaagaagtcgaaagcagactctctcctggtgaatccgcgtaccaaaagctcggactgactgaggcccataagtggcggccagattccagggagtcacaggaacagtccctcgtccaactggaggctacggagtggaggttgaggtcaggagaggagcggcaggactatagcgaggaatgcggtcggaaagaggaatggccagttccgggagtggcccctaaagaaacggctgagttgtccgagaccctcacaagggaagctcaggggaattcctctgctggcgtggaagcggcagaacagcggcctgtggaggatggggaaagaggaatgaaacccacagaaggctggaaatggactctgaactcccgcaaggccagagagtggacaccaagagacattgaggcgcagacgcagaagcccgaacctcctgagagtgctgaaaaactcctggagagcccaggcgtcgaagccggagagggcgaggccgagaaagaagaagcgggagcccaagggagacctctgagggccctccaaaattgctgttccgtcccaagccccttgccccctgaggatgcaggaacggggggtcttcggcagcaggaggaagaggccgtggagttacagccccctcctccagctcccctgtcaccccctcccccagccccaacagctccccaacccccaggggatccactcatgagccgtctgttctacggggtgaaagctgggccaggggtcggagccccacgacggagcggccacactttcaccgtaaacccaaggcgtagcgtgccaccagccacccccgcaacccccacttccccagccacggttgacgccgcagttccaggtgctggcaagaaaagatatcccactgctgaggagatcttagtgctgggaggttatctccggctttcaagatcctgtctcgctaaagggtccccggagaggcaccataaacaactcaagatctctttttctgagactgccctggaaactacttaccagtacccctccgaatcatctgtgttagaagagcttgggcctgaacccgaagtcccctcagcaccgaacccacccgctgcccaacccgacgacgaggaggatgaggaagagctgttgctgttacagcctgagctgcagggtggcctgagaactaaggctctcatcgtggacgaaagttgtaggcggtag

SEQ ID NO: 59093 - DNA, 231 bp, Artificial Sequence
  Description of Artificial Sequence: Synthetic coding sequence
cttaaaatctcattcagcgaaacggccttagagacgacatatcaataccccagcgagtcgtcagttttagaagaattaggtccagagccggaagtaccgagtgccccaaatccacccgcagcccaaccagacgacgaggaggatgaagaagaactgctccttttgcagcccgagctccagggcggtttaagaacaaaggccctgatagttgatgagtcttgtcgcaggtag

SEQ ID NO: 59094 - DNA, 1134 bp, Artificial Sequence
  Description of Artificial Sequence: Synthetic coding sequence
atggcaacaatccctgactggaagctccagcttctggccagaagacggcaggaagaggccagcgtgcgcggacgggaaaaagcagagagggaacgcctgagccagatgcctgcgtggaaaaggggacttctagagcggagacgggcaaagctgggattatctcccggagagccgagcccagtgctgggaactgtggaggccggtccacctgaccccgatgaaagcgctgtactcctggaggccatcggcccagtgcaccaaaaccggttcattcgacaggaacggcagcagcaacagcaacagcagcaacgctccgaagagcttctggcagagcgtaaacccggacctctcgaggctcgggaacggaggcctagcccgggtgagatgcgcgatcagtcgccaaaaggcagagagtctcgagaggaaagactgtctcccagggagacccgagaacgtaggcttgggatcgggggtgctcaggaactgtctctgaggcccctggaagcacgcgactggcgccagagccccggtgaggtgggcgaccggtcctctcggctctccgaggcttggaagtggcggctctccccaggcgaaaccccagaacgatcactacgcctggctgagtctagggaacagtctccccgacggaaagaggttgaatcaaggctttctccaggggaatcagcttatcagaagctagggctgactgaagcccataagtggcggcctgatagcagggagtcccaggaacagagcctagtccaactggaggcgactgaatggcgactgaggtcaggcgaagagcgacaggactactctgaagagtgcggccgaaaggaggaatggccagtacccggtgttgctcctaaagaaacagccgagctttcagagacattgacccgcgaggcgcagggcaatagctctgctggggtagaggctgcagagcagaggcctgtggaggatggcgaacgcggtatgaagcccactgaaggttggaagtggacattgatcatgagtttggctggcaaaggcaaccaacacctcgttacgtgttttccgcacccagtctcgggtggtagggctaattgtccaattagcacccttatacaaagtccttggtgcggctggggatag

SEQ ID NO: 59095 - DNA, 1134 bp, Artificial Sequence
  Description of Artificial Sequence: Synthetic coding sequence
atggcaacaatccctgattggaagctgcagttgcttgcgcgtcgcagacaggaagaagctagcgtacggggaagggagaaagccgaacgagagcggctgtcgcagatgccagcttggaagcgagggttactcgaacggcgaagggccaaactggggctgtcaccgggagaaccttctcctgttctgggcaccgtggaggcagggccaccagatcccgacgagtctgcagtgctgttagaggcaattgggcctgtgcaccagaacagatttattaggcaagagagacagcagcaacaacaacagcagcaacgcagtgaggagctgctggcagagagaaaaccaggtccactggaggccagggaacgcagaccctccccgggagagatgcgggaccagtctcccaaaggcagggagtctcgggaggagcgtctttcacccagggagacgcgagagagacggctcggtattgggggtgcccaggaactgtctctccgccctttagaggccagggactggcgccagtcccccggagaagtgggcgacagatcttcaagattatctgaggcttggaagtggcgcttgtcccccggagagacacctgagaggtcacttaggttggccgaatctcgagagcagtctcctcgcaggaaagaggtggaaagcggattgtcgcccggagagagcgcttaccagaaactggggctgacagaagctcacaaatggaggccagattcaagagaatcacaggagcaaagccttgttcagctggaggccactgagtggcggctcaggagcggagaggaaagacaagactacagtgaagagtgcgggcgaaaagaggagtggccggttcccggagtggcgcctaaggagacagccgaactcagcgaaacactgacacgcgaagcacaggggaactcctcagcaggcgtggaggctgccgagcaacggcctgtggaagatggagagcgtggaatgaagccaactgaaggatggaaatggacactcataatgagcctcgcaggaaaggggaaccaacacctggtcacctgcttcccccatccagtctctggcggaagggctaactgccctatctccactttgatacagagcccttggtgtggatgggggtag

SEQ ID NO: 59096 - DNA, 2310 bp, Artificial Sequence
  Description of Artificial Sequence: Synthetic coding sequence
atggcttctgcagagttgcagggtaagtaccagaaactggcccaggagtatagcaagctgagggctcaaaaccaggttctgaaaaaaggtgtcgttgacgagcaagctaactctgctgcccttaaggagcagctgaagatgaaagaccaatctctgcgtaaactccagcaggagatggactcactaacattcagaaacctccaactggccaagcgagtcgaactgttacaggatgaactggcactcagtgagcctagagggaagaagaataagaagtctggagagtcctcaagtcagctttctcaggagcagaagagtgttttcgacgaggatttacagaagaagattgaagagaacgaacggttacatatccagttttttgaggctgatgagcaacacaagcacgtcgaggccgaactccggtctcggttggccacgttggagaccgaggccgctcaacaccaggccgtggtggacggcttaacccgaaaatatatggaaaccattgagaagctgcagaacgataaggctaagctcgaagtgaaaagtcagaccctggagaaagaagcaaaggagtgcaggctcagaaccgaggaatgtcaacttcaactgaaaacactacacgaggatttgtccggcaggttggaggagagcctctcgatcattaacgaaaaggtacccttcaacgatacgaaatacagccagtataatgctctgaatgtcccactgcacaatagacgacatcagctcaaaatgcgggacatcgccggtcaggcactggcatttgtccaggatctggtgaccgccctgctgaacttccacacgtatacggaacagagaattcagattttccccgtggattctgcaattgatactatcagtcctctcaaccaaaaattctcacagtaccttcatgagaatgcctcgtacgtgcgccctctggaagaaggcatgctacacctttttgaaagcatcacagaagacacggtcacggtcctggagactactgtgaaattgaagacattctccgagcacctgacctcctatatttgcttcctgagaaaaatcctgccctatcagctgaagagccttgaagaagagtgcgaatctagcttgtgcactagtgccctgagagcgcgtaacctggagctatcccaggatatgaagaaaatgacagcagtctttgagaaactgcaaacctatatcgctctgctggctctgccgtccactgagcctgacggattattacgtacaaactacagctccgtcctcaccaacgtgggagccgcactacacggctttcatgacgtgatgaaagacatcagcaaacattacagccagaaggctgcaattgaacacgaactccccacggctacccagaagctgataactacgaatgactgcatacttagcagcgttgtggctttaactaacggagctggcaaaatcgcaagtttcttcagcaataacctggattacttcatagcatccttatcatacggaccgaaggctgcttcaggattcatttcccctctatccgctgagtgcatgctgcagtataagaagaaagctgccgcttatatgaaaagtctgcgtaagccgctgctggaatcagtgccttacgaagaggcccttgcgaatcggcgaatcctattgtcttccactgagagtcgcgagggccttgcccagcaggtacaacagtccctggagaaaatatccaagctggagcaggaaaaggagcactggatgctagaggcacagctcgctaaaatcaagctggagaaagagaatcaacgaatcgccgacaaacttaaaaacaccggcagcgcgcagcttgtcggcctggcgcaggaaaacgccgcagtctcaaacactgccggacaagacgaggctacagccaaagcagtgttggagcctattcagagtacgtccctggtacctgatgtggaatctagagaggacttaatcaagaaccattacatggccagaatagtggaactcacctcacaattgcagttagccgatagcaagagtgtgcatttttacgctgagtgccgcgctcttagtaaacggctggccctggccgaaaagagtaaagaggcccttaccgaagagatgaaactggcctctcagaacataagtaggcttcaagatgaactcaccacaacaaaacggtcttatgaggatcagctcagtatgatgtctgaccacctttgttcaatgaacgaaactttgtctaagcagagagaggaaattgacactttgaagatgagttccaagggcaattctaagaagaataaatcacggtag

SEQ ID NO: 59097 - DNA, 2343 bp, Artificial Sequence
  Description of Artificial Sequence: Synthetic coding sequence
atggcatccgcggagctgcagggaaagtaccagaaactcgcccaggaatactcgaagctcagagctcaaaatcaggttctgaagaaaggcgtggtggatgaacaagccaattcagccgctctcaaggaacaactgaagatgaaggaccagtctctcaggaaactgcagcaggagatggactcactcacctttcgtaacctgcagttagccaagcgggttgagctgctccaggatgagttggcattgtcagagcctcgtgggaagaagaacaaaaaaagcggggaatcctccagtcagctgtcgcaggagcagaagtccgtgttcgatgaagacctccagaaaaaaatagaggagaacgaaaggctgcatatacagttctttgaggccgacgagcagcacaaacatgtggaagctgagttgaggagccggttggccacactcgaaacagaggctgcccagcaccaggccgtagtcgacggcctcactcgtaaatatatggagaccatcgaaaaactgcagaacgacaaggccaagctagaggtgaaatcgcagacattagagaaggaagcgaaagagtgcagactgaggaccgaggagtgtcaattacagttaaagactctgcatgaagatctgtccggacgtcttgaggagtctttaagcatcatcaacgagaaagttccatttaacgacacaaaatactcccagtacaacgcactgaatgtgcccctccacaatagacgacatcagctgaaaatgcgcgatatagcaggtcaggctctcgccttcgtgcaggatttggtcactgccctgcttaactttcatacatacactgaacagcgtatccagattttcccggtagattccgccatcgatacgatttcacctctcaaccagaaattctctcaatatctgcatgagaacgccagctatgtgcgccctttggaagagggcatgctgcacctgttcgagagtatcacagaggacactgtcacagtcctagagaccaccgtgaagctgaaaactttcagtgaacacctgacatcttacatttgctttttgagaaaaatcctgccatatcagctgaagagcctcgaggaggaatgtgagagtagcctgtgtacttctgctctgagggcaaggaatttggagcttagccaggatatgaagaaaatgactgcagtatttgagaaacttcaaacctatattgcacttctcgccttgcctagtacagaaccggatggactccttcgcacaaactattcctcagtgctcacaaatgtgggggctgcactgcatggatttcacgacgtcatgaaagatattagcaaacattacagccaaaaagctgcaatagagcatgaactgcccacggcaacacaaaaactgattacaactaatgactgtatcctgtcttctgtcgtcgcactaactaatggagccggtaaaattgcttcattttttagcaacaatctcgattactttattgcttctctaagctacggtcccaaagccgcttctggctttatcagccctctgtccgctgagtgcatgttgcagtataaaaagaaggccgcagcatatatgaagtctctacggaagcctctgctcgaatcagtgccctatgaggaggccctcgcaaatagacgtatcctgctgagctcaactgaaagccgagagggcttggctcagcaggtccagcagtcgctggagaaaatatcgaagctagagcaggaaaaggagcactggatgctggaggctcagctggccaagattaaacttgagaaggagaaccagcggattgccgacaaactcaagaacaccggaagcgctcaactagttggcctcgcccaggagaatgccgctgttagcaatacagcaggtcaggatgaggccacagccaaagccgtcctggagcccattcaaagtacaagccttattgggacccttacccgcacttccgattccgaggtgcccgatgtggaatccagggaggacctcatcaagaatcactacatggccaggatcgtggagttaacatctcagctgcagctggctgattccaaatccgtccatttttacgcggagtgtagagcgctgagcaagagactggctttggctgaaaagtcaaaagaggcactgacagaggaaatgaaactggctagccagaatatttctagactgcaagacgagttgactactaccaagcgctcttatgaggatcagttatcaatgatgagcgatcacctgtgtagtatgaacgagacgctttccaagcagcgggaggagatcgacacactgaagatgtcttctaaaggtaattcaaagaaaaataagtcccgctag

SEQ ID NO: 59098 - DNA, 2217 bp, Artificial Sequence
  Description of Artificial Sequence: Synthetic coding sequence
atggcgtctgccgaactgcaagggaaatatcagaaacttgctcaggagtattcaaaactcagggcacagaatcaggtgctgaagaaaggagtcgttgacgaacaggcaaatagcgccgctctcaaggagcagctgaagatgaaggatcagagtttgcggaagcttcagcaggaaatggacagcctgacattcaggaacctccaattggccaaacgcgtggagctgttgcaggatgagcttgcattatccgagcccaggggtaagaagaacaagaagagcggggagtcttcgagccaattatcgcaggaacagaaaagcgtgttcgatgaggatctgcaaaagaaaatagaggagaacgagcgcctgcatatccaattttttgaggccgacgagcagcacaaacacgtggaggcagagttgaggtcaagattggccaccctggagaccgaagcagcacagcatcaggccgtggtggacggtcttacgagaaaatatatggagaccatcgaaaagctgcagaacgataaggccaagttggaagtaaaatcacaaaccctggagaaggaggctaaggagtgtcgcctgaggaccgaggaatgtcagctgcagctcaagacactccatgaagacctgagcggacgactagaagagtcactgtctatcattaatgagaaggtccccttcaatgatactaagtacagccagtataacgcccttaatgtgccacttcataataggcgccatcaactaaagatgcgggacatcgccggacaagccctggcctttgtgcaggatctggtgaccgctctgctgaactttcatacatatacggagcagagaatccagatattccccgtggacagtgctatagacacaatctcacccctgaaccaaaagttcagccagtatctgcacgagaatgcaagctacgttcggccattagaggaaggcatgctacacctcttcgaaagtataacagaagacactgtgacggtactcgagactaccgtgaaactgaaaacctttagcgagcacctaacatcttacatctgtttcttgcggaaaatcctcccatatcagctgaagtcactagaagaagagtgcgagtccagcctctgcacgtccgcactgagggcccgaaacctggagctctcacaggacatgaaaaaaatgacagctgtgtttgaaaagctacagacctacatagccctcctggcacttcccagtaccgagcccgacggtctccttcggactaattattcatctgtgctgacaaatgtgggcgcagcattgcatggctttcacgacgttatgaaagacattagcaagcattatagccagaaggctgcaatcgaacacgagctgcccaccgcaacacagaaattaattactaccaacgactgtatcctgagttccgtcgtggctctgacgaacggagccggaaagattgcttcgttcttctccaacaacctggactatttcattgcctcactttcatatgggccaaaggctgcctccgggtttatctcccctctgagcgccgaatgcatgctgcaatacaagaagaaggcagccgcttacatgaagtccctgcggaaggtgcagcagagcctggagaagatcagcaagttggagcaggagaaagaacactggatgctggaagctcagcttgccaagattaaattagagaaggagaaccagcggattgccgataagcttaagaataccgggagtgctcagctggtcgggctcgctcaagaaaatgccgcagttagcaataccgcaggtcaggacgaagccacagctaaggctgtcctagaacccatccagagcacgtcgttggtgcccgacgtggaaagccgagaagatctgattaagaatcactatatggctaggatagtggaactcacgtcccagctgcaactggctgactctaaatctgtacatttctatgccgagtgccgcgcactttccaaacgcctggcattggctgagaaatcaaaggaagcactgaccgaagaaatgaagctggcctcacagaatataagtagattgcaggatgagctcaccaccacaaagaggtcctatgaggaccaactatccatgatgtctgaccatctttgttcgatgaatgagactctcagtaaacagcgagaagagatagatacgcttaagatgtcctctaaaggaaactcgaaaaaaaataagagtagatag

SEQ ID NO: 59099 - DNA, 465 bp, Artificial Sequence
  Description of Artificial Sequence: Synthetic coding sequence
atgccaagtcgcacggcccgttacgccaggtactcacccagacagaggcgccgtcgcatgctggctgaccggagtgtcaggtttccgaacgatgtgctgttcttagaccacataagacaaggcgatcttgaacaagtggggagattcatcaggaccaggaaagtgtcacttgcaaccattcacccgtccgggctggccgctcttcacgaggcagtgctgagtggcaatctggaatgcgtcaagttgctggttaagtacggggctgacatccaccagagggatgaggcagggtggacgccactacacattgcctgctcagacggctaccccgatattgctcggtatctaatttctcttggggctgaccgcgacgcgactaatgatgacggcgacctgccaagcgatctgattgatcccgattataaggagctggtggaactctttaaagggaccacaatggattag

SEQ ID NO: 59100 - DNA, 1278 bp, Artificial Sequence
  Description of Artificial Sequence: Synthetic coding sequence
atgatgggaaaattacctctcggagtcgtgagtccatacgtgaagatgtcgtccggaggctataccgatcccctgaagttctacgccacaagctattgtaccgcctacggcagagaagatttcaagcctcgggtgggatcgcatgtcgggaccggctacaaatcaaacttccagcctgtagtttcctgccaagcatctcttgaagctctagacaaccctgctaggggggagcaggcacaagaccacttccagtcggtggcctctcagagctatagacctctcgaggtaccggacggtaaacatccactgccttggtcaatgagacagaccagttccgggtatggtagagaaaagccatctgctgggccacctactaaggaagtgaggaaggtccattttgatacgcaggaacacggaccccaggcaattaccggtcttgagccaagggaggtccctttactgcaccagcagcagggccaggacccactggaacgggagaacttccgccacggcccaagatttatgacttcagaatacaatagcaagtacctgcgtgaccccctggatcagccagatttcctgcaaaaaaagtcaatcggggctaaggaaggaagcggctttaccaaacagtcacaccagagtccaattgtgttccagccaccgtcacaggcccttcccggagatcccgctctgctgccaggacagtcagttacaaagagcgatttcctacccaaaacccatttacacggagacgaattcctgccagtcttggccaggggtagcaaacgggagaccgccttttcccggggaaatgagcggattctgaaccccagagtacctcctccatgccccgagcccagcagtgtctcacaccagcagtttcagcctctgcaccgcatgcagcagacaaatgtcgcactcctgggaagggaaaccgtagggaagaaggaaccaacgggtttttcactgaacaatcccatgtatgtcaggagcccatgcgatcctgatcgggaccagcggtacctgactacttacaaccaggggtactttgagaacattccaaagggcctcgatcaggaaggctggacccgcggaggcatccagcctcagatgcctggagggtacgccctttcacagccggtgtcatgtatggaagcgactcctaatcctatggagagcctgagacacttacacccacatgtcggtagaacgctgacctctgctgatccattttatcagaatacaccgcactctagccggtgtgtggcacatagctag

SEQ ID NO: 59101 - DNA, 1218 bp, Artificial Sequence
  Description of Artificial Sequence: Synthetic coding sequence
atgatggggaagctgccattgggggtagtctctccgtacgtgaaaatgtccagcgggggatataccgacccgctcaagttctacgccaccagttattgtaccgcgtatggacgtgaagacttcaaacctcgcgttggcagccacgtcggtacaggctacaaatccaattttcaaccagttgtgagctgtcaggctagcctggaggccctggataatcccgctagaggcgagcaggctcaagaccacttccagtcagtcgcaagccagagttataggccactggaggtcccagacggaaagcatccacttccatggagcatgcggcagacaagcagcggttacgggcgagagaagccttcggccggtcccccaactaaggaagtccgaaaagttcactttgacacccaggaacacggcccacaagcaatcaccggactggagccccgagaagtccccctcttacaccaacaacagggacaggaccctctggaacgggaaaattttcggcatggccctaggttcatgacatctgagtacaatagcaaatatcttagggacccactcgatcagcccgatttcttacagaagaagagcataggagcaaaggaggggagtgggttcaccaaacagtcgcaccaatctcctattgtcttccagccgccaagccaagccctcccaggagacccaggtgacgagtttctgcccgtgttggcacgcggatctaaacgcgaaactgcttttagtcgcggaaacgagagaatccttaaccccagggtgccgccaccttgccctgaacccagcagtgtgagccatcagcagttccagcccttacaccggatgcaacagacaaatgtggctctgctgggtagggagaccgtagggaagaaggagcctacaggcttcagcctgaacaatcccatgtacgtcagaagtccatgcgaccctgaccgggatcaacgctacctgaccacgtataatcagggctattttgaaaatatccctaagggtctggaccaagagggatggaccagagggggaatccagcctcagatgcctggaggatacgccttaagccagcccgtgagctgtatggaggccaccccgaaccctatggagtccctgagacatctccacccgcacgtcggtagaaccctgactagcgcagatccattctaccagaatactccacatagctcccgttgcgtagcacattcatag

SEQ ID NO: 59102 - DNA, 762 bp, Artificial Sequence
  Description of Artificial Sequence: Synthetic coding sequence
atgatgatggggtgcggggaaagcgagctgaagtcggccgacggcgaggaggctgcggctgttcccggtcccccaccagaacctcaggtgcctcagttgagagcccctgtgcctgagccgggattagacttgtctttatcgcctaggccggactctcctcaacccaggcatggatcacccggaaggagaaagggaagagccgagaggaggggtgcagctcggcagcggcgacaggtgcggtttaggctaaccccaccctccccagttcggagcgaacctcagccggctgtacctcaggaactggaaatgcccgttctgaagagctccctggccttaggcctggagctgagggccgcagcagggtctcacttcgatgctgcgaaagcggtcgaagagcagttacggaaaagtttccaaatcaggtgcgggttagaggagtccgtcagcgagggcctcaatgttcccaggagcaaacggttatttagagacctcgtgagcctccaagtgccggaagagcaggtactcaacgccgctctgagagaaaaactggctctgctgcccccacaggcccgtgcaccacaccctaaagagcccccaggccctggccctgatatgacgatcctgtgtgatcctgagaccttattctacgagtctccccatctcacgctggatggcctgccccctctgcgcctgcagctgcgcccacgaccctcagaggacaccttccttatgcaccgaactcttaggcggtgggaggcatag

SEQ ID NO: 59103 - DNA, 1269 bp, Artificial Sequence
  Description of Artificial Sequence: Synthetic coding sequence
atgtaccgggtgccagagttctatgcaagaaggaaacgcctgggtggccaaactccctacctgatggaccaactcggactgcgtctgggaatgtggtactggaaggatgagacgcgcacccttgaatttcgaaggttcgctgccgaggacagtgtgcaatggctgttgaagcaccacccccacttcactcccgctgcagaagtgaaggagaagggaaagaaaggcaaagcggtgcacttcgccgagactgatggccctgcctccgaccggttgacagataaacggctggcagccaaggacgataaatcggcgaaagctgtcgagaagagggggcagcagggaacaatcaccttagacgacgtaaagttcgtcaccctgctgctcttgcaggacaccgagatgcagcgcatatgttcgtttacaaccttcatgcgaaacaagaatttggacaacttcctgatggccctgttatactacctctctcattaccttgagaaaaacagtcttgagaaaaaacccaagtcatacatggtcgggctcgtggaaaagaaagaaatggagctggtgctctctgagttagaggccgcacagcggtacctggcccagaagtactgcatcttggtgctgggtctagccgtacctgataaacatcatatgtgttgtgggaaagagaaaatttccgatacccaaaaagactggaagttctttgagtccttctacacattttgcacctatgtggcttggattgtgttccggaggcagcacctgaccgagatcgaggaggaagtcggccgactgttccggacaaacatgttcaatattccaaggcgacggagagaggatgaggagtctggtggtgaaaagaaaaggatgacattcgtacagtttagacgcatgatggcgaagagaccagctattaagaaagcgatcaacatgaggtctccagttatgtctaccttacttcccagcctcagggagaaggctcagaacgtgttcgagaaaaagtaccaccaggtagatgtgcgatttccggctgagatgcagaagcacgtgggcactctcgacagcgtgcccatgcctgtcgttggcatcctgggtgagccgagatgtttgttcaaccctcacacgctccaccctctcgacccggaggaaaacacaaaaagcttcgggagatacccatctctcatggagaacaacaatatgaggatccaggacactttggatttggtaatgaagactctgtcctcacacacaagctgtccaaagtag

SEQ ID NO: 59104 - DNA, 624 bp, Artificial Sequence
  Description of Artificial Sequence: Synthetic coding sequence
atggctgccctggtggagccgctgggattggagagagacgtgtcccgagccgtggaactcctcgagaggctccagcgctcgggagagttgcctccccagaagctgcaagccctccagagggtcctccagagccgcttttgcagcgctatccgcgaagtctatgaacaattatacgataccttagatataaccggctccgcagagattcgggctcatgcaaccgcaaaagccacagtggccgcattcacagcctcagaggggcacgcacatcctcgggttgtggaattgcccaagacggacgaagggctcggattcaatattatgggagggaaggaacagaactcaccgatttacattagtcgagtcattcccggtggagtcgctgaccggcacggaggactcaagaggggagaccagctgctgtctgtgaacggtgttagtgtggagggggagcagcatgaaaaagcggtagaactgctgaaggcagcacaggggtccgtcaagcttgtcgttcgatatacccccagggtcttggaggagatggaggctcgtttcgagaagatgcgcagcgcaagacgccgacagcagcaccagtcatactccagcctggagagcaggggctag

SEQ ID NO: 59105 - DNA, 2064 bp, Artificial Sequence
  Description of Artificial Sequence: Synthetic coding sequence
atggagatcgcccctcaggaggctccacctgtcccaggcgcagacggcgatatagaagaggcacctgcagaggcgggttcgccttctccagctagtccccctgccgatggaagacttaaggccgctgcgaaacgcgtgacttttcccagtgacgaggacatcgtctccggagctgtggagccgaaggatccttggcgtcacgctcaaaacgtgacagtggatgaggttattggtgcttacaagcaggcttgccagaagctcaattgtcggcaaattcccaaattgctgcgccagctccaagaatttactgaccttgggcaccgattggactgtctcgacttaaaaggtgagaaattggattataagacctgcgaagccctcgaggaggtatttaaaaggctgcagttcaaggtggtggatctggagcagaccaatctcgatgaagacggagcatccgctctcttcgacatgattgaatactacgagtctgcaacccatctgaatatctcttttaacaaacacataggtactaggggatggcaggccgcagcccatatgatgcgaaaaacctcttgcctccagtacctggatgccaggaacaccccgctccttgatcatagtgctccatttgtcgccagagccctcaggatcaggtccagtctggcagttctgcacctagaaaatgcatcgctcagcgggcgtccgttgatgctgttggcaacggcattaaagatgaacatgaatctgcgcgagttgtatttagcagataacaagctcaatgggctccaagacagcgcccaattgggcaacttacttaaatttaattgctctctgcagatcctcgatttgcgaaacaatcacgtgttggactccggtctggcgtatatctgtgaggggttaaaagagcagaggaagggtctggtgaccttggtgctgtggaacaaccagttgacacataccgggatggctttcctcggcatgactctcagtcttgagacattaaacctcggtcacaaccctatcgggaatgagggggtacggcacctcaaaaacggtctgatttctaacaggagtgtcttgcgactcggacttgcctctaccaagctgacttgtgagggagccgttgctgtggccgaattcatcgccgagtctccacgattgcttcgcttggatctcagggaaaacgaaatcaaaacaggtgggctaatggctctgagtttggccctcaaagtaaatcacagcctgctgaggctcgatctggacagagagcctaaaaaagaagccgtgaagtcatttatcgagacccagaaagcactgctcgcagagattcagaacggctgtaaacggaatctggtactggccagggagcgcgaagagaaagaacagccccctcagctttccgccagcatgccagaaacaactgccaccgagcctcagccggatgatgaacccgcagccggtgtccaaaatggggctccttctccagccccttcccccgattcagacagcgattccgatagcgacggcgaggaggaggaggaagaagagggtgaacgcgatgaaacaccctgccccgctctggtgccacccaccgactccctgggccctggcgacagatccccgcctggtagtccatctacgcctaccgaacagagaataagtgtgtcctctcctggcagggggcacaaagtgttcgtcgtaaccagagtggaaagtccgcctgagcgggctgagccgcctgcgagtcccacgcccccttctcccccacctccgccttcgcccccagcttccccatccctgccccctgctggggctatcgatactagggatacagggtcatctgaaccacaaccacctcccgagcccccaagatctggccctccactgcccaatggcctgaagccggagttcgcactcgccctgcccccagagcctccacccggtccagaggtaaagggcggttcttgcggactcgagcatgagttaagctgtagcaagaacgagaaggagctagaggagctccttctcgaagcctcgcaggaaagcggacaggagactctttag

SEQ ID NO: 59106 - DNA, 858 bp, Artificial Sequence
  Description of Artificial Sequence: Synthetic coding sequence
atgatggctgtagacattgaatacagatataactgcatggcaccatctctcagacaggaacgtttcgcctttaaaatctctcctaaaccttctaagcccctgaggccatgcatccagttgtccagcaaaaacgaagcttcagggatggtagcccctgctgttcaggagaagaaggtgaaaaagagagtgagcttcgcagacaatcagggcctggcgctgacaatggtgaaggtcttctccgagtttgacgatcctctggacatgccattcaacataacagaactgcttgacaacatcgtgagccttactactgcagagtccgaatcattcgtgctggacttttcccagccatcggcggattatctcgactttaggaacagattacaagcggaccatgtgtgtctggagaattgcgttctgaaggataaagccatcgccggaacggtgaaggtgcagaatctggcatttgagaagaccgtgaaaatccgcatgacatttgacacatggaagtcttacaccgactttccatgccagtatgttaaggatacttacgccggaagcgaccgggacaccttctccttcgacatctctctacctgagaagattcagagctacgaacgcatggaattcgcagtctactacgagtgcaacgggcaaacctactgggacagtaaccgcggaaaaaactaccgcatcattcgggcagagttgaagtccacccagggaatgactaaaccacacagcggtccagacctggggatctctttcgaccagttcggctctccacgatgttcctatggcctctttccggaatggccatcctacctcggatacgagaaactcggtccttattactag

SEQ ID NO: 59107 - DNA, 858 bp, Artificial Sequence
  Description of Artificial Sequence: Synthetic coding sequence
atgatggccgttgatatcgagtaccgctataactgtatggctccgtctctgaggcaggaacgcttcgccttcaagatcagccccaaacccagcaaaccgctgaggccttgcatccaactgtcgagcaaaaacgaagcaagtgggatggtggcacctgctgtgcaggaaaagaaggtgaaaaagagagtgtcatttgccgacaaccagggcctcgctttgacaatggttaaggttttctcagaattcgatgatccattggacatgccatttaacatcacagaactgctagacaacattgtgtcactcactactgcagagtcggagtcttttgtgctggattttagtcagccatcagccgattacttagacttcaggaacaggttgcaggcagatcacgtgtgcctagaaaactgcgttctgaaagacaaagccatcgcaggaacagtaaaagtccaaaaccttgcctttgagaagaccgttaagatccgcatgacatttgatacgtggaaatcctacacagactttccctgccagtatgtgaaagacacctatgccggaagtgatagagacaccttctcatttgacattagtctcccagaaaagattcagagctacgagcgcatggaattcgcagtttattacgaatgtaatggtcagacatattgggattcaaaccgaggcaagaattaccgcatcattcgtgccgaactgaaatcaacgcagggaatgactaagccacacagcggtcccgaccttgggatctctttcgaccagtttggaagtccacggtgttcatatggactgttccccgaatggccaagttacctgggctacgagaagttaggcccttactactag

SEQ ID NO: 59108 - DNA, 687 bp, Artificial Sequence
  Description of Artificial Sequence: Synthetic coding sequence
atggtgcgactgacacttgacctgattgcgcgaaatagtaacctgaagccacgcaaggaagagactattagccagtgtttaaagaagatcacgcatattaatttttcggataaaaacatcgacgccattgaagatcttagtctttgcaagaatctgagcgtcctctacctctacgataattgcattagtcagatcacaaacctcaactatgcaactaatctcactcatctgtacttacaaaacaattgtattagttgtatagaaaacttaaggtccctgaaaaagcttgagaagctctacctgggaggaaattacatcgctgtgatcgagggattagaggggctgggtgagctcagagagctgcacgtggaaaatcagcgtttaccacttggtgagaaacttctgttcgacccgaggactctccattcactagcaaagtccctctgtatactcaacatctctaataataatatcgacgatatcacagacctggaactgctagagaatttgaaccaactgattgccgtggacaaccaattgcttcacgtgaaggatctggagttcctgttaaacaaactcatgaagctgtggaagatagatcttaacggtaatcctgtgtgtttgaagcctaagtaccgggatcgacttattcttgtttctaagtctctggggacgtacctctattag

SEQ ID NO: 59109 - DNA, 1068 bp, Artificial Sequence
  Description of Artificial Sequence: Synthetic coding sequence
atggtcagactcacactggacttgatcgccaggaacagcaatctgaagcccagaaaggaggagactatctctcagtgtttgaaaaagattacccacatcaattttagcgacaaaaacatcgacgctatcgaggacctgtctttatgcaagaacttgtcggtactctatctatacgataattgtatctctcaaattactaaccttaactacgccactaatcttacacatctgtacttgcaaaacaattgcatctcatgcatagaaaatctgcgtagtctgaagaagttggagaaactctatctggggggaaattacatcgcagttatcgagggattggaggggcttggcgagctcagggagctgcacgtcgaaaaccagagactccctctgggcgagaaactcctattcgatccgaggacgttacactcgctggccaagagcctctgcattctaaatatttccaacaacaatattgacgatatcacagatctagagctcctggagaaccttaaccaactgatcgctgtggataatcagctgctacacgtcaaagatcttgaatttctgctgaacaaactcatgaaattgtggaagatcgacttgaacggcaatccagtctgtctgaaaccaaagtatcgggataggctaatcctggtatctaaatccctcgaattcctcgacgggaaagagatcaagaatattgagaggcagtttctcatgaattggaaagcctccaaggacgcgaagaaaatttcaaagaagcgctccagtaagaatgaggatgcctcaaactccctcatctcaaattttaaaacaatgcatcacattgtacctgtttactatccacaagtgggcaagcccaagttggcctttttttccgagattcaacggtatcccgttaacgcaaacgctagtccagagtcaagctgccctttttggcctaatatagaaagaaaaaatctgagcttaaaacagtcggagagtttgcttactaagaatgatgtgcacgagcctcatctatttcataatccagaagaaaaggagaatttattcgtcgaaaacgagtag

SEQ ID NO: 59110 - DNA, 930 bp, Artificial Sequence
  Description of Artificial Sequence: Synthetic coding sequence
atggttagactgaccttggatctcatagcgaggaattcaaatctgaaaccaaggaaagaggaaacaatttcccagtgcctaaaaaaaattacgcacatcaatttctccgataagaacattgatgcaatcgaagaccttagcctctgcaagaatctcagtgtgttgtatctctatgataattgcatttcccaaattaccaatctgaattacgcaaccaatctgacccacttgtaccttcagaacaattgtatcagttgtatcgagaacctcagaagtctcaagaaactcgagaaattgtacttaggtgggaactatatcgctgtcattgaagggctggaggggttgggtgagctgcgggagttgcacgtggagaatcagaggttgcccctcggagaaaaactgctgtttgatcctaggaccttgcatagcctggctaaaagcctttgtatactcaacatctctaacaacaatatcgacgacattacggatcttgagttactggaaaaccttaaccaattaattgcagttgacaatcagctgctgcacgtcaaagatctggagtttctgctgaacaaactcatgaaactctggaaaatcgacttaaatggaaaccccgtgtgtctgaagccaaaataccgtgacagacttatccttgtgagtaagtcgctcgaatttctagacggaaaggagatcaaaaacattgaacggcagttcctgatgaattggaaagcatctaaagacgccaaaaagatctcgaagaaacgatcatcaaagaatgaggatgcctctaacagtcttatctcgaacttcaaaactatgcatcacatagtgcctgtttattaccctcaggtcggaaaaccaaagctggcattcttctcagaaatacaaaggtatcctgtaaacgctaatgcatcccctgaatcttcctag

SEQ ID NO: 59111 - DNA, 1245 bp, Artificial Sequence
  Description of Artificial Sequence: Synthetic coding sequence
atggatattgaggagcagaaagccgacatctacgagatggggaaaattgcgaaggtgtgcgggtgccctctttactggaaagctccaatgttcagagcagccggaggcgagaagaccgggttcgtgactgctcagagcttcattgcaatgtggagaaaactcctgaacaatcaccacgatgacgcctcaaagttcatctgtctgttggctaaaccgaactgcagttccctcgaacaagaggacttcattcctctattgcaagatgtggtagacacccacccaggacttacctttctgaaagacgctccggagttccactccagatacatcactacagttattcagcgcattttttacaccgtcaatcgcagctggtcaggcaagatcacaagtacagagatccgcaagagcaactttctgcaaacactagcacttcttgaggaagaagaggatattaatcagatcactgattacttctcttacgagcacttttatgtgatctactgcaagttttgggaactggatacagaccacgatctgtacattagccaggctgatttaagcagatacaatgaccaggcttcttcatccaggattatcgagaggattttctctggcgcagtgaccaggggaaaaactatccaaaaagagggacggatgagctacgcggacttcgtttggtttttgatctccgaagaggataagcgtaatcctacctctattgagtactggtttcggtgtatggacgtggacggcgacggcgtgctgtccatgtatgaactggagtatttctacgaggagcaatgcgagaggatggaggcgatgggaattgaacccctgcctttccacgacctcctttgccaaatgctggacctggtcaagcctgctgtcgacggaaagatcactctgagggacctaaagaggtgtcgtatggctcacattttctacgacactttcttcaatctggaaaaatacctggaccatgaacagcgggatcccttcgccgttcagaaagacgtggaaaatgacggccctgagccgagtgactgggataggtttgcagcagaagagtatgagacactggttgcagaggagagcgcccaggcacagttccaagaaggctttgaagattacgagaccgatgagccagcgtcacccagtgagttcgggaacaagtcgaacaagattctcagcgcctctctgccagaaaagtgtggcaagctccaatccgtagatgaggaatag

SEQ ID NO: 59112 - DNA, 3453 bp, Artificial Sequence
  Description of Artificial Sequence: Synthetic coding sequence
atggccgcaacatatcggctggtggtgtctacagtgaatcattatagttcagtcgtcattgatcggagattcgagcaggccattcactactgcactgggacctgtcacacatttactcatggaattgactgtattgtggtccaccactctgtgtgcgctgacctacttcatatccccgtgtctcagttcaaagacgccgacctgaacagtatgtttcttccccatgaaaacgggctgtccagcgcggaaggagactatccccagcaggctttcacaggaatcccacgggtgaagcggggatcgactttccagaacacttacaatttgaaggatatcgctggagaggctatttctttcgcctctggcaagattaaggagttctcattcgagaagttaaagaactcaaaccatgccgcttacagaaaggggagaaaagtgaagtccgactcctttaaccgtagaagcgttgacctcgacctgctttgcggccattataataacgacggtaatgcaccatctttcggtctcttgcggtcaagtagtgtggaagagaagcctctttcccatcgaaattccctcgatactaatttaacttccatgtttctgcagaacttttctgaggaggacttggtcactcagatactagaaaagcacaagatcgataacttcagctcgggcacagacattaagatgtgtttggatatccttcttaaatgtagcgaagaccttaagaagtgcaccgatatcatcaagcagtgtattaaaaaaaagtcagggagttcaatctctgaaggatcgggcaacgacaccatttcgagctctgagaccgtgtatatgaatgtgatgacgaggctggcttcttatctgaagaaactgcctttcgagttcatgcagtcaggtaataacgaagctttagatctaaccgagctcatctctaatatgcctagtcttcagctgaccccgtttagccctgtgttcggtaccgagcagcctcccaaatatgaggacgtcgtccagctgtcagcctcggactccggaagattccagacaatcgaattgcagaacgacaaaccaaattccaggaagatggatacagttcagtcaatccctaataacagcactaattcactgtacaatttggaggtgaatgaccccagaacgctgaaggcagttcaagttcaatcccaatcccttactatgaatcctctggagaatgtgtcaagtgatgacctcatggagactctctatatagaggaagagtccgacggcaagaaggcactcgacaagggtcagaagacagagaacggaccaagtcatgagctgttgaaagtaaacgagcacagagctgaattccctgagcatgccacccacctcaagaagtgccccacccctatgcagaacgagattggaaagatctttgagaagtcattcgtcaatctcccaaaagaggactgcaagagcaaggtgagtaagtttgaggagggggaccagagggactttacaaactcttcaagccaagaagagattgataagctgctcatggacctggaaagcttttcacagaagatggagacaagcttgagggagccactcgctaaagggaagaacagcaattttctaaattcccactcccagctcactggacagacgctagtggacctcgaacccaagtctaaggttagctctccaatcgagaaggtgtcgccaagctgtctcacccgcattattgaaaccaatggtcataaaatcgaggaggaggatagagccttgctgcttcgtatactagagagcatcgaggacttcgcccaggaactggtcgaatgcaaatcatcccggggaagcctgagtcaggaaaaggagatgatgcaaatcttacaagagactctgacaacaagtagccaggcgaacctaagcgtgtgcagaagcccagtaggggacaaggcgaaggataccacttcagctgtcctaatccagcaaactcccgaggtgattaaaatccaaaacaagcccgaaaaaaagccaggaactcctctcccaccccctgctaccagccctagttctccccgtccccttagtcccgtgccccatgtgaacaacgtggtaaatgctccactgagtatcaacattcccagattctactttcccgagggcctgcccgatacctgcagtaaccacgaacagactctgtccaggattgagacggcctttatggacatcgaggagcagaaggctgacatctacgagatggggaaaatcgccaaggtgtgcggttgtcccctctattggaaggcacctatgttcagagcagcaggcggagagaagacaggcttcgtcacagctcaatctttcattgccatgtggagaaaattactgaataatcaccacgacgatgcttctaaatttatctgtttactggcaaaacccaactgctcctccctagagcaggaggacttcattcccttactacaggatgtggtagatacccatccagggctgacatttctcaaagatgcacccgaattccatagtaggtacattactacggtgatacagcggattttctacaccgtgaataggtcttggtccggaaagatcacatccacagagatccgaaaatccaattttctgcagacgctggccctgctagaagaagaggaggatattaaccagattacggactacttcagttatgaacatttctacgtaatatattgcaagttctgggaactcgacacagatcatgatttatacatttctcaggctgatcttagtcgatataatgaccaagcgtcatcgagtaggatcattgaacggatcttctccggcgcagtcacccgcggaaaaacgatccaaaaagaggggaggatgtcctacgcagattttgtctggttcctaatctctgaagaagacaagcgcaatccgactagcatcgagtattggttcagatgcatggatgtagacggtgatggcgttctctcgatgtatgagctggaatacttttacgaagagcaatgcgagaggatggaggccatggggatcgagcctctcccatttcacgacctactgtgtcagatgctagatctggtaaaacctgccgtggatggcaaaattactctaagagaccttaagcgatgtcggatggcccacatattctacgacacctttttcaatttagagaagtacctcgaccatgagcagcgtgacccctttgctgttcagaaagatgtcgagaatgacgggccagaaccctctgattgggatagattcgccgctgaggaatatgaaacgctcgttgctgaggagtcagctcaggcccagtttcaagaagggtttgaggactacgagactgatgaacctgctagcccttctgaatttggaaacaagtcgaataagatattgtctgccagtttacccgagaagtgtgggaagctccagtcagtcgatgaggaatag

SEQ ID NO: 59113 - DNA, 1590 bp, Artificial Sequence
  Description of Artificial Sequence: Synthetic coding sequence
atgatgatcaaggaaacaagcctgcgcagagatcccgacctgcggggagagctggctttcttggccagggggtgcgattttgtgttgccctcaagatttaaaaaacgtttaaagagtttccaacagacccagattcagaacaagccagaaaaaaaaccaggcacacccttgccaccacctgccactagcccgtcttctcccagacccctatctcccgtccctcatgtgaacaatgtggtgaatgcaccacttagtattaacatccctagattttacttcccagaaggcctccccgacacttgttcaaaccatgagcagacgctgtctaggattgagaccgccttcatggatatagaggaacaaaaagccgacatctacgaaatgggaaagatcgccaaggtgtgcggctgtcccctgtactggaaagcacctatgttcagggcagctggaggggaaaaaaccggttttgtgacagcacagtcttttatagctatgtggcgcaaattgttgaataatcaccatgatgatgctagcaaatttatctgcctgctcgccaagcctaattgcagctccctggaacaggaggacttcattcctctcctgcaggacgtagtcgacacacatcccggattaacttttctgaaagacgctcccgaatttcatagccggtatattactaccgtgatccagcggatcttctacaccgtgaacagatcatggagtgggaagattacgtccactgagattcgcaagtccaattttctacagacactggcactgctcgaggaagaggaagatatcaaccagataaccgactatttctcctacgagcacttttacgtgatttactgtaagttttgggagttggacactgatcacgatctgtatatctcccaagccgatctctcaagatataacgatcaggccagcagtagcaggattatcgaacgaatctttagtggagcggtcacacggggaaaaaccattcaaaaagagggtaggatgtcctacgcagacttcgtatggtttctgataagcgaagaggacaaaaggaatcccacgtcaattgaatattggtttaggtgtatggatgttgatggggacggcgtgctctcaatgtatgagcttgaatatttctacgaagaacaatgtgagcggatggaggcaatgggaatcgagcctcttccctttcacgatctcctctgccaaatgttggatctcgtcaaacctgccgtggatggcaagatcactctgagggacctgaagcgatgccggatggcacacatcttttacgacaccttttttaacctggagaaatatttagaccatgaacaaagggacccttttgccgtgcagaaggatgttgagaacgatggacccgagccaagcgactgggatcggttcgccgctgaggaatatgagacactggtagcggaagagagcgcgcaggctcaattccaggagggcttcgaagattatgagactgacgagccagctagccctagcgaattcgggaataaatccaataagattctgagcgcctcattgcccgaaaagtgcggaaagcttcagagcgtggatgaagaatag

SEQ ID NO: 59114 - DNA, 486 bp, Artificial Sequence
  Description of Artificial Sequence: Synthetic coding sequence
atggatattgaagagcagaaagcggacatttacgagatgggtaagattgctaaagtgtgcgggtgtccactttactggaaagctcccatgttccgcgcagctggaggtgagaaaactgggttcgtgaccgcacagtccttcatcgctatgtggcgtaaactgctcaataatcaccacgatgatgccagtaaatttatttgcttgttggccaagcctaactgttcttccctcgagcaggaggacttcattcccctgctgcaggatgttgtggacactcatccaggactgacctttttgaaggatgcaccggagttccattctagatatattacaacggtcattcagagaatattctataccgtaaatcggagctggagcgggaaaattacatcgactgaaattcgaaagagcaattttctgcagagtaatgaagatctggctaaactcgctgttcacgacggatacacgaacatttttttgttctag

SEQ ID NO: 59115 - DNA, 1893 bp, Artificial Sequence
  Description of Artificial Sequence: Synthetic coding sequence
atgtcgactaacaatgctttaagggtgttttggaaatcaagagagtggaacatgaaaaccagcaccttcgattctgatgaggacatcctgctgctccctaaaaggaaaagattcagaaagaagaaatcaagaccagttaggcacactaaacggcatgaagaggagcaggtgtacgagcagggaacaacgctcccttgtagcatctgcaagcacgaaatcgacctgaccgggatctttttacacaaaaagcagcacgtcgctctggccacattaggattccagtggatgggacgtaaaaaaccccagccctccgttattgcagtgcaaagacaattcatgataagcaagctgctttccagtttcatgtttacagaaaaaacactgcaatccataaacaatgcctttgaactgctgtggaagaagcaaattcccgcatattataagattttcgataatatcgatcgctcagtcatttactcccagaagatctgtcacttattaatcaaaggggtcggtatttgtgaggacaggaatagcacctggaaggctgatatgaatgacaagtttaccgtagtgagcaatttcgggaacaagccaaacgtctgctttttcggcctgttcgatggtcaccacggagcatccgccgctgaactcaccagtatggagttacccgtgctcctgctgcaccagttgtccaaattcgacccatcgtaccaaatgactaccgacgaacagcagataatcaacagtttttacactgtattcagggaagagtacgccgctattgaggacctgttttctgctattaacaagacagaggccgtaagatgcgagtacgaggacacacataaggccttcgctaaggccttctggagaatggatcgactactaggacttgggcgaaaagaggtttcccgcgtgcagtggagcggctgcagcgcagtcacatgtattctggaagggaagccaaagagcccatatgcacacaagaactggaagcggaagaatactcacgatggcctggccgaatcatcccctagccaagagatgcctaagatcatcagcggtattctgcatgtggccaatactggcaacgtgcaggccgtcttgtgtagaaacggcaaaggattttgcttaacgaaagaacacacgaccaggaataccaacgagcggagaaggattctgcaaaatggagccgtgatctccagcaatgaaccctacggcctcgtggaaggccaagttaagactactagggggttgggcttccacgggaacctcaagctaaaaaagagcataattcccgcaccacagaccatatctgtgccgatcgacgacttatgtcagtttctaatagtagcgacaaacggtctgtgggaagtgctggataaggaggaagttacagcacttgctatgactaccttccacatgtacaaagaaacctattgtcccattatcccgaacaagagtccctccaaaggtcctctcctattctcaacaagtgaacccaatttaacgaagtcccagtccaatattcacgtgttgttccaatacaagtccgtgtctgaggtaagagtgtctactacgaattctaaggagaacctatcagatagtaactactctaaatattgtatttataatccggagaatgtggaaacgtttccggctgaaacgacacatagaaagccttgttccgagaaagttacagacaggcccactagtgtaaacgacgtcgccaccaacgagaaggaatccgacactaagtcattctacgagggcgctgcagagtatgtgagtcacgagttggtgaacgcggcacttctggccggtagccgggataatattaccgtaatggtaattttcctgaatgggagcgaataccagttgctgacatag

SEQ ID NO: 59116 - DNA, 1248 bp, Artificial Sequence
  Description of Artificial Sequence: Synthetic coding sequence
atggctgagatccctctgtatttcgtcgatctacaagacgacctggatgactatggtttcgaggattacgggaccgattgcgataatatgcgcgtgacagcttttctggacatccccggacaggacaatcttccacccttgactcggctggagaaatatgcattctccgaaaacaccttcaaccggcagatcatcgctcgtggactcttggacattttcagagactttggaaacaacgaagaggactttctcacagtgatggaaatcgttgtgaggctgtctgaagatgcagagcccacagtcagaactgagctgatggaacagatccccccaattgctatttttctgcaagagaacagatctaatttccctgttgtcctctcagagtatctgattccaatcgttgttcgctacctgaccgaccctaataatcagattatttgcaaaatggcttcgatgctgtctaagagtacagtggaacgcctgcttctccctcgattctgcgaactgtgtggcgaccgcaaactgtttcaagtgagaaaagtctgcgcagccaattttggagacatctgccatgccgtgggccaggaggccacggagaaattcctcatccctaaatttttcgagctgtgttccgatgcggtgtggggcatgagaaaggcctgcgcggaatgcttcacagccgtgagccacagctccagcccaggcgtgcggcgaacccagctttttccgctgtttattcgcctcgtctccgacccctgtaggtgggtacatcaagcagcgttccagtctcttggaccattcacgtctactttcgcaaaccctagccgcgctggtttatatctccgcgaggacggcgctctgtctatctggcctctcactcaggacctggattcaggcttcgcctcagggtctcctgctccaagctctggagggaatacgtctcctgcctctctaaccagatccgctaagcccgtgaggtccgagccagaactcccagtagaaggtacctctgctaagacttccgactgccctcactctagttccagttctgatggacctgccgagtccccggtagagtcttgtgtgtcagcgggtgcagagtggactagggtctcccctgaaacttctgcctgtagcaagctgtctgacatgaacgacttacccatcagttcctacccgggatccgactcttgggcctgtccagggaatacagaggacgtcttctcacacttcctgtactggtag

SEQ ID NO: 59117 - DNA, 1365 bp, Artificial Sequence
  Description of Artificial Sequence: Synthetic coding sequence
atgagttccggcgctccacagaaatcctcccctatggcctctggagcagaagaaacccctggatttctcgacacacttctccaggattttcccgcactgctcaaccctgaggatccgctgccttggaaggctcccggaacggttctttcccaggaggaggtcgaaggtgaacttgccgaattagccatgggattcctgggatcgcgaaaagcgcctccaccactggctgctgcactggcccacgaagccgtctcccagctcttgcagacagacctgtcggagttccgaaagttgcccagagaagaagaagaagaagaagaggacgacgacgaagaagaaaaggcgcctgtgaccttactcgacgcacagtctctggcccagtccttctttaaccgcctctgggaagtggccggacagtggcagaagcaagtccccctggccgcaagagcctctcagaggcagtggttggtgagtatacacgcaattcgcaatacccgacgtaagatggaggataggcatgtgtcactccctagttttaatcagcttttcggcctcagcgacccagttaatcgcgcttactttgccgtctttgatgggcacggaggcgtcgatgccgctagatatgccgcagtccacgttcacacaaacgccgcaagacagccagaattgccaacagatcctgaaggcgctctgagggaggccttccggagaacagaccagatgttcctaaggaaggctaagcgcgaaaggctacagtctggcactaccggagtgtgcgccttgatcgctggcgcaacgctacacgtggcatggctgggggactcacaggtgatcctggtgcaacaggggcaagtggtcaaactgatggagccccatagacctgaaaggcaggatgagaaggccagaattgaggctctcggagggttcgtctcccacatggattgttggcgggtgaacgggactctggcagtctctcgtgcgatcggagacgtgtttcaaaaaccatacgtgtccggcgaggctgacgcagctagccgggctttgaccgggtcggaagattatctgctcctggcgtgtgacggattttttgatgtcgtgccccaccaggaagttgtaggcctcgtacagagtcatcttaccaggcaacaggggtctggactgcgggtagctgaggagctcgtggcagccgcacgtgagagaggttctcatgataatataaccgttatggttgtcttcctacgggacccgcaggaattactcgagggcggaaaccagggcgaaggcgacccacaagccgaggggaggagacaggaccttcccagttccctgcctgaaccagaaacccaagctcctccccgatcatag

SEQ ID NO: 59118 - DNA, 1086 bp, Artificial Sequence
  Description of Artificial Sequence: Synthetic coding sequence
atgtcctcaggagctccacagaaatcatcacctatggcgagtggagccgaagagaccccaggctttctggacacactgttacaggacttcccagcccttctgaaccccgaagaccccctgccgtggaaggcacccggaaccgtcctgtcccaggaagaggtcgaaggcgaactcgcggaattagccatgggattcctgggctcacgcaaagccccacctcctctggcagctgcactagcccatgaggctgtctctcagctgctccagaccgatctgtctgagttcagaaagctccccagagaagaggaagaggaagaggaagatgatgatgaggaagagaaggcccctgtcactctgctggacgcacagtcgctggctcagtctttctttaatcgcctttgggaggtagccggacagtggcagaagcaggttcctttagcagcaagggctagccaacgccagtggctggtgtcaatccacgccattcggaatactcggaggaagatggaagatcggcacgtcagcttgccatccttcaatcagctttttgggctctcagaccccgttaaccgtgcctactttgccgtttttgacggtcacgggggagtcgatgctgctcgatacgcagcagtacacgtgcacacgaatgctgcgcgtcaacctgagctgcctaccgaccctgagggagcattgcgagaggcatttcggcgaacagaccagatgtttctcagaaaggcaaagagagagaggctgcagtccggcacaactggagtgtgcgccctgatagcaggcgcaactttgcatgtggcctggcttggcgactcacaggtgatcctggtgcagcagggacaggtggtcaaactgatggaaccccatcggcctgaacgtcaagatgagaaggcacggatcgaggccttgggtggctttgttagccatatggattgttggcgagttaatgggactctggcagtttcccgcgcaatcggagagtcacaaagaggccgacctaaatgggagaaagtcagccgaaaacccagacctagagtttggcccgcagcacatcagggctttcgcgaggccgtgtag

SEQ ID NO: 59119 - DNA, 861 bp, Artificial Sequence
  Description of Artificial Sequence: Synthetic coding sequence
atggaagacaggcacgtatccttaccttcattcaatcagttgtttggcctaagcgatcccgtgaatcgggcatacttcgccgtattcgacggacatggcggagtcgacgccgcaaggtacgccgctgtccatgtccacactaacgcggctcgccagcctgaactgccgacagacccggagggcgctttgagagaggcattccgccgtacggaccagatgtttttgaggaaggctaaaagggaaaggctgcagagcgggaccaccggcgtgtgcgcattgattgccggtgctacgctgcacgtggcttggctgggcgattcacaggtaatcctggtccagcaaggccaagtggtaaagctgatggaacctcaccggccagaacgacaggacgagaaagccaggatcgaagctttgggaggttttgtctcacacatggactgttggcgcgtgaacgggacactcgccgtctcaagagctattggggatgtgttccagaagccttatgtgagtggcgaagccgatgctgcttcaagagccctcaccggttcggaagactatctgcttttagcctgcgatggattctttgatgtggtaccacaccaggaggtcgtcggccttgttcagtcccatctgacccgacagcaaggaagtggcttgagggtagcagaggaattggtggcagcagcccgagagagaggcagccatgacaacatcaccgttatggtggtctttttacgggatccccaggaactgctcgaagggggaaatcagggagagggcgaccctcaggccgaaggcaggagacaggatctccctagtagcttaccagaacccgagactcaggccccaccaagatcttag

SEQ ID NO: 59120 - DNA, 861 bp, Artificial Sequence
  Description of Artificial Sequence: Synthetic coding sequence
atggaggacaggcacgtgtcactgccgtccttcaatcagctgtttggcctgagtgaccctgtgaacagggcctactttgcagtgttcgacggccacggcggagttgacgccgctaggtatgcggctgtgcacgtgcacactaacgctgctcggcagcctgagcttcccactgatccagagggcgcactgcgggaggcctttcggcgtaccgatcagatgttccttcggaaggcaaagagagaacgactgcagagcggaacgacgggagtatgtgcccttattgccggagcaacactccacgttgcctggctcggcgatagccaggtgattttagttcagcagggtcaggtggtgaagttaatggagcctcacaggcccgaacgccaggacgagaaagcccgaattgaggcactagggggttttgtctcacatatggactgctggcgcgtgaatgggacattagccgtttcccgggctattggagatgtgtttcagaaaccttacgtctcgggagaggctgacgccgcttctcgcgcactgaccggaagcgaggactatctgcttctggcatgcgacggcttttttgacgtcgttccgcatcaggaggtcgtgggtctcgtccagagccacctgacccggcagcaagggtccggactgcgtgtggccgaagaactggtcgccgctgctagggaacggggaagccatgacaatattacagtgatggtggtttttctgagagatccccaggaactcttagaaggaggcaatcaaggtgagggagatccacaagccgagggtcgtcggcaggatctgccttcctccctccctgagccagagacgcaggccccaccccgatcatag

SEQ ID NO: 59121 - DNA, 1053 bp, Artificial Sequence
  Description of Artificial Sequence: Synthetic coding sequence
atgggtctgtgcccttctacgcgagaaacagcaccgcctgcggtactggacgctcagtccctggctcagtcttttttcaacagactgtgggaagtggccggtcagtggcagaagcaggtgccactggccgcacgcgctagtcagcgtcagtggctggtgtccatacatgccatccggaacacaagacgtaagatggaggatcggcacgtctctcttccatccttcaatcagctcttcggactaagtgatcccgtcaaccgtgcctattttgcggtgttcgacgggcatggtggggttgacgccgctcgttatgccgctgtgcacgtgcacactaacgccgctaggcaacccgagcttcctacggaccccgagggggctctccgggaagcattccgacgcacggaccagatgttcctgcgtaaggctaagcgagagaggttgcaatctggcaccactggcgtgtgcgcattaattgccggagccaccctgcacgttgcatggctaggcgactctcaagtgattctggttcagcagggccaggtcgtgaagctcatggagcctcaccggcctgagaggcaagatgagaaagcacggatcgaagccctgggaggcttcgtctctcacatggactgttggagggtcaacggcacattggcagtctcaagagccattggtgacgtgtttcaaaaaccctacgtgtcaggagaggctgacgcagcctccagagctctgactggttccgaggattacctcctgctcgcctgcgatggattttttgatgtggtcccacatcaggaggtggtggggctggttcagtcacacctgacccgccagcaggggagcggactccgtgtggcagaggaactggtagcagctgcgcgtgagcgcggatcccatgacaacatcacagtcatggtggtctttctgcgagaccctcaagagctgttggaaggagggaaccagggtgagggggatcctcaggccgaaggacgccgtcaggatcttccatcctcactgcccgaaccagagacccaagcacccccacgcagttag

SEQ ID NO: 59122 - DNA, 3321 bp, Artificial Sequence
  Description of Artificial Sequence: Synthetic coding sequence
atgtttaatagtatgaccccccctcctatcagttcctatggtgaaccatgctgtcttagacctctgcctagccagggcgctccatctgttggaacagagggactgagtggccctccattttgccatcaagccaatctgatgagcggcccacactcatatggtcccgctcgggagactaattcttgcactgagggtcccctcttcagcagcccgaggagcgctgttaagttaaccaagaagcgagctctctccatctcacctctatcagacgcaagtctggatctgcagacggtcatccgaacatcaccttcgtcactggtagcctttataaattcaagatgtactagccctgggggttcatacggccatctttccatcggcacaatgtctccttccctcggttttccagcccaaatgaatcaccaaaaaggcccatcaccgagcttcggagttcaaccttgtgggcctcacgacagcgccagaggcggtatgattcctcacccacagtcacggggacccttccccacctgtcagcttaagagtgagctggacatgctagttgggaagtgccgagaagaaccgctcgagggagacatgtcatcacccaactcaactggcatacaagaccctcttctggggatgctagatggcagggaggatttagagcgggaggagaaacgcgagcctgagtcagtgtatgaaacagattgtaggtgggacggatgttctcaggagttcgactcccaggaacagctggtccatcatataaactcggagcatattcatggcgaacgcaaggagtttgtctgccactgggggggatgcagccgggaactcaggcctttcaaagcccagtatatgctagtggtccacatgcgtagacacacaggcgagaagcctcacaaatgtacgtttgagggatgcaggaaatcctactcacggctggaaaacttgaaaacacatcttcggtctcataccggtgagaaaccttatatgtgtgagcacgaaggctgctccaaagccttctctaatgcgtccgacagagccaagcatcagaataggacccatagcaatgaaaaaccgtacgtctgcaaactcccaggctgcactaagagatatacagatccctcttccctgcggaagcatgtcaagacagtgcatggtccagacgcacatgtgaccaaacgacaccgcggagacggaccgcttccacgagctccttctatatcaaccgtggaacctaaaagggagcgagagggtggaccaatccgagaggaaagcaggctgaccgtgccggaaggggcaatgaaaccgcagcccagccccggagctcagtcgtcttgctcatcggaccacagtcctgccggttccgcagctaatactgattccggcgtggagatgacaggtaacgccggtggtagcaccgaggatctttcctccctagatgagggcccttgcattgcaggtaccgggctctcaactttaagaagactggagaacctgcgcctggaccagttgcaccagctccggcctatcggaaccaggggtttaaaactgccctccctgagccataccggcactacggtaagtaggcgcgtgggaccacccgtctccttggagagacgttccagctcctcttcctccatcagttccgcatatacagtcagtcgtcgttcttccttggctagcccttttccacccggatcaccaccagagaatggggctagcagccttcccggtctcatgcccgcacaacattacttgctgagagctcggtatgcttctgcccgaggcggaggcacttctcctacagcagcctcatcattggatcgtataggaggtctgccaatgcccccatggcggtcaagagccgagtatcctgggtataaccccaacgccggagtgactagaagggcctctgatcctgcgcaagctgcggacagacctgcccctgccagggtacagcggttcaagtctctgggatgtgttcatacaccccctaccgtggcgggtggaggtcagaatttcgatccctacttgcccacgagtgtatatagcccacagcctcccagcattacagagaatgctgcaatggatgcaagaggcctccaggaggaaccggaagtcgggacgagcatggttggcagcgggttaaatccctatatggacttccccccaacggataccctcggttacgggggacctgaaggcgcagccgcagagccttatggggcaagaggccctggtagcctcccgctggggcctggccctccgactaactacggcccaaacccatgcccccagcaagcctcctatccagacccaacgcaggaaacatggggagagtttccatcccacagtggactctaccccggtcccaaggctcttggaggaacctattcccagtgtccacgcctggagcactatggacaggtgcaggttaaaccagaacaaggatgccccgtcggctccgactcaaccggcctagcaccttgcctgaatgctcaccccagtgagggcccaccccacccacagcctctgtttagccactacccgcagccctcacctccccagtatctgcaatccggcccatatacccagccgccaccggattatctaccatccgaaccacggccttgtctggattttgattcaccgacccacagcacaggccagctcaaggcccagcttgtgtgcaattatgtccagtctcagcaggaattactatgggagggcggaggacgggaggacgcaccagcccaagagcctagttaccaatccccaaagtttcttggaggctctcaggtgtctccaagccgcgctaaagctccagtgaacacctatggtcctgggtttggtcctaacctgcctaaccataaatcaggctcttacccgaccccatccccatgccacgaaaatttcgtcgttggcgcaaaccgtgcctcacacagggccgctgcccctccaagactgcttcccccactccctacatgttatggacctctcaaagtgggcggaaccaatccgagctgtggacatccagaggtcggcaggctagggggaggtccggcactataccccccacccgaggggcaggtctgtaaccctctcgatagtttggatctcgacaatacccagctcgatttcgtggccattctagatgagcctcagggtctctctccccctcccagccacgatcagcgtgggtcaagtggacacaccccgcctccttccggcccacccaacatggccgtgggaaatatgagtgtgctgctacgtagcctgccaggcgagaccgagttcctcaattcttccgcatag

SEQ ID NO: 59123 - DNA, 1023 bp, Artificial Sequence
  Description of Artificial Sequence: Synthetic coding sequence
atggaggacgctcattgcacttggctttctctgcccggattgcccccaggctgggctcttttcgcagtgctcgacggtcacggcggagctcgcgcagcccgatttggggcaaggcatctgcctggacatgtccttcaagaactcggtccagaacccagtgaaccagagggggtgagagaggccttgcggagagcgtttctctcagccgatgagagattgcgcagcttatggccaagagtggagaccggcggttgcaccgccgtggtgctgctggtgtctccacgctttctgtatctcgcccactgcggcgatagtcgcgcagtcctctcccgggctggtgccgtggcttttagcactgaggaccataggcctcttcgccctcgggagcgcgagcgaattcacgccgctggaggaacaatcaggaggaggagagtcgaagggagtctggcagtaagccgtgctttgggcgactttacttacaaggaggcgcctggccgacccccagagctgcagctcgtgagtgcggaaccggaggtggctgccttggcccgtcaggctgaagatgagttcatgttattagcaagcgatggagtgtgggatacagtgtctggagcggctctagccggactggtcgccagccgactgcggctgggtctggcccctgagctgttatgtgctcagcttcttgacacgtgcttgtgcaaggtgctcggtgcgtggcggggaacttttggggcttggtgtagccggggtagggagccgagaggatttggcgaggaagggtttgatcgcgaggcaagggtaaaactcgcgaaggagggcatcgggttgaagaggcgcgcttggcccgaagtgggcagggccaaaatccagggacggtccctgcgcgacgcgctgcgccatggccgagtgtccggccgtgatcttcgtgaaagggcatggagttttggtaaaggtcgattttgggtggtgggcgctggtcctgaggtcttaatctctgcaggcagatggaagagccggtag

SEQ ID NO: 59124 - DNA, 1293 bp, Artificial Sequence
  Description of Artificial Sequence: Synthetic coding sequence
atggctgtgcttgctaggcagctccagagattactttggaccgcctgcaagaagaaagaaagggagaaagaaggcagggaggaagaggaggaggaggaggctggacgacgtgcacctgaggggccacgctccctattgaccgcacctcggcgagctcagcggccacacgggggtgctgaagcatcgggcggacttagattcggcgcaagcgctgcacagggttggagggcccgtatggaggacgcacattgcacctggctttcccttcccggtctgccccctgggtgggccctcttcgctgttttggatggtcatgggggtgccagggctgctcgctttggcgctcggcacctgcccggtcacgtgctacaagagctcggacctgaacctagtgagcctgaaggtgtgagggaagctctgcggagggccttcctgtccgccgatgagagactgcgatctctgtggccacgggtggagacaggaggctgcactgctgttgtgctgctcgtttccccacggttcctgtatttggcccactgtggcgactcgagagctgtcctgagccgagcgggagctgtcgcattctctacggaggaccatagaccattacgcccacgcgagagggaacggatccatgctgctgggggaaccattcgccgacgcagagtggaaggaagtctcgctgtgtctcgggctttgggggatttcacgtacaaggaggccccaggaagaccaccagaacttcagttggtgtctgcagaaccggaagttgccgcactagcacggcaggccgaggatgaattcatgctgctggcgagcgacggtgtatgggacactgtgagcggcgctgccttggctggactggtggcctctcgactgcggctgggccttgcgcctgagctgctgtgcgcgcagctgctcgatacatgtctgtgtaagggctcccttgacaacatgacatgtatcctggtctgcttcccgggagcaccgcgtccttccgaggaggctattaggagggagctcgcccttgacgccgcactgggttgtcgcatagccgaactgtgcgcatctgctcagaagcctccaagcttgaacaccgtttttagaacgctggcttctgaggacatacctgatttgccaccaggcggaggactggactgcaaggctactgtaattgctgaggtttactcccagatctgtcaggtctctgaagagtgtggcgaaaagggccaggacggtgcagggaaatctaatcccacgcatttgggctccgccctcgacatggaggcgtag

SEQ ID NO: 59125 - DNA, 1209 bp, Artificial Sequence
  Description of Artificial Sequence: Synthetic coding sequence
atggctgagacttctgaggaggtggcagtgttggtccagcgggtggtaaaggatattacgaatgccttccgcagaaatccgcacattgatgagatcggactgattccgtgtcccgaagcacggtataaccggtcaccaattgtcttagtggaaaataagcttggtgtcgaatcttggtgtgtcaagtttctgctgccttacgtccacaataagttattgctgtatcgtacccgcaagcagtggttgaaccgggacgaactgatcgacgtgacttgcacattacttctgcttaatcccgattttacaacagcatggaatgtgcgcaaagagctcattcttagtggcactctaaaccccataaaggatcttcaccttgggaagttggctctgactaagttccccaagtctcctgaaacttggatccacagacggtgggtccttcagcagctgattcaagagacttctctgcctagctttgtgaccaaggggaatctgggtactatcccaacggagcgggctcagagacttatacaggaagaaatggaagtttgcggcgaagccgctgggcgttacccttctaactacaacgcctggtcacacagaatttgggtgttacaacatctagctaagctggatgtcaagatcttgctcgatgaactcagttctaccaagcactgggctagcatgcacgtgtctgaccattccggattccattatcggcaattcctcctgaaatcattaatttcccagaccgtgattgatagcagcgtgatggaacagaacccactccgctccgaacccgcactcgtgcctcctaaggacgaggaagcagcagttagcaccgaagagcctagaatcaatctgcctcacctcttagaggaagaagttgagtttagtacagacctgattgatagctatccagggcacgagaccctgtggtgccatcgtaggcacatattctacttgcagcatcatctgaatgcaggaagccagctgtcccaggctatggaagtggatggcttgaacgatagctctaagcagggctactctcaggaaactaagagactgaagagaaccccggtgcccgacagcttgggacttgagatggagcatcgctttatcgatcaggtactctcgacatgccggaacgtggaacaagctcgttttgccagcgcgtatcgcaagtggctcgtcactctatcccagtag

SEQ ID NO: 59126 - DNA, 1158 bp, Artificial Sequence
  Description of Artificial Sequence: Synthetic coding sequence
atgggatgtggtgcctcacggaaggtggtccccggacccccagccctggcttgggcgaaacacgaaggacaaaatcaggctggtgttgggggagcaggaccagggcctgaggctgcagcccaagcggcacagaggattcaggttgctcgttttcgggcaaagtttgatccacgggtcttggctaggtatgacataaaggcgctaattggaaccggcagcttcagtcgggtagtgagagtagagcagaagacaactaaaaagcccttcgcgatcaaagtcatggagacgcgtgagagagaggggagggaggcttgcgtgtcagaactcagcgtcctgagacgggtgtcacatagatatattgtgcagctgatggagatcttcgaaacagaagaccaagtgtacatggttatggagcttgccacaggaggggagttgttcgacagacttattgctcaggggtctttcacagagagagacgctgttcgcatcttgcagatggtagcggatggtatcaggtacctgcatgcactgcaaattactcataggaatctgaaacctgagaatttgctctactatcacccaggcgaagagtcgaaaatactgattactgattttggcttggcatatagtgggaaaaagtcaggggattggactatgaaaaccctctgcggtacccccgagtacatcgccccagaggtcctcttacggaaaccttacacatccgccgttgatatgtgggcgctcggcgtgatcacctatgccctcctcagcgggttcctgcccttcgatgacgagtctcagacccggttatatcggaaaattctcaaaggtaaatacaattacactggggagccatggccctccatctcccacctggccaaagactttattgacaaacttcttattctggaggccggtcacaggatgagcgctggccaggccctggaccacccctgggtaatcactatggccgctggaagctctatgaagaatctccagagggccatatctcgtaacctgatgcagagagcatccccccactctcagtccccagggagcgcccagagttctaagtcccactactctcacaaatcacggcatatgtggtctaagcggaacttgcgcatagtggagagtcctctgtccgctctcctgtag

SEQ ID NO: 59127 - DNA, 2265 bp, Artificial Sequence
  Description of Artificial Sequence: Synthetic coding sequence
atggccgctggagtcttacctcagaatgagcagccctactccacactagtgaacaattcggagtgcgtcgccaacatgaaagggaatctggagcgccctacccccaagtacaccaaggtaggtgagcgactcagacacgtcatccctggccacatggcgtgttccatggcttgtgggggacgcgcttgcaaatacgagaaccctgccaggtggagcgagcaggaacaggccattaaaggggtgtacagtagttgggtgacagacaacatccttgccatggccagaccctcatccgaacttctagagaagtaccatataattgatcaatttttgtctcatggaatcaaaacaattatcaacctgcagcgtccgggagagcatgcctcttgtgggaatcccctggagcaggagagcggcttcacatacctcccagaggcctttatggaagctggcatatatttctacaacttcggctggaaggactacggggtggcgagcttgaccacaatccttgatatggttaaggtgatgacgttcgctttgcaggaaggaaaggtcgcgattcactgccacgcaggattggggcgtacaggagtgctcatcgcctgttacctggtgttcgcaacccggatgaccgctgaccaggcaattatctttgtgcgggctaagcggcctaacagcatacaaacccgcggacagctcctgtgcgttcgagagttcactcaattcctgactccattgcgtaatatattctcttgctgtgacccaaaagcccacgcagtaactctgccacagtaccttatccgtcagcggcacttgctacacgggtacgaggccagactgttgaagcatgtcccaaagatcatccacttggtgtgtaagctcctgctcgacctggcagaaaacagacccgtgatgatgaaagacgtcagcgaggggccaggcttgtcggcggagatagagaagaccatgtccgagatggtgacgatgcagctcgataaggaactccttcgccacgacagtgacgtgagcaaccctcctaacccaaccgccgtagcggctgactttgataacaggggcatgattttcagtaatgagcagcagttcgaccctctgtggaaaagaagaaatgtggagtgcctccagccactcacccatctaaagcgccgactcagctactcagattcagatctgaagcgcgcagagaacttgctggagcagggcgagacaccgcagaccgtccctgcccagatcctggtggggcataagccacgtcagcagaagctcattagtcattgttacattcctcagagtccagaacctgacctgcacaaggaggccttggtgagaagcacgctgagcttttggtcccaaagtaagtttggaggactggaaggacttaaagataacggttctcccatcttccacgggaggatcatccctaaggaggcacagcaatcaggcgcattcagcgccgacgtctcaggttcacactcccccggagagccagtaagtcctagttttgctaacgtacataaggacccaaatcctgcccaccagcaggtctctcattgtcagtgcaagacccatggggtcggttctcccggatcagtccggcagaactcaaggacacccagatctcccctggattgcggatcctcacctaaggcacagtttctcgtggaacatgagacacaggactctaaggacctatccgaggctgcatctcattccgcgttgcagagtgagctgtctgctgaagcgagacggattcttgccgcaaaggcgcttgccaacctgaacgaaagcgtggagaaggaagagttgaagcgtaaagttgaaatgtggcagaaggagctgaattcccgggacggagcctgggaacggatctgtggggagcgcgacccattcatactttgcagcttaatgtggagttgggtcgaacagctgaaagagccagtcatcactaaagaggatgttgatatgttagttgatcgaagggctgatgcggctgaagccctgttcttacttgaaaaaggccaacatcagactatcttatgcgtgttgcattgtattgtcaacctccagacaatccctgtagacgtcgaggaggcatttctcgcacacgcgatcaaagccttcactaaggtgaatttcgacagtgaaaatggacccaccgtctataatacactcaagaaaatttttaagcataccctcgaagaaaaacggaaaatgactaaagatggcccaaaacccggtctctag

SEQ ID NO: 59128 - DNA, 2421 bp, Artificial Sequence
  Description of Artificial Sequence: Synthetic coding sequence
atgcaagtgcaggacgccacacgacggccatccgcagtccgctttctcagtagcttcctgcaaggacgcaggcactctaccagtgatcctgtgctgcggcttcagcaagctagaagggggagcgggctgggcagcggcagcgcaaccaagctgttgtcctcctcatccctccaggtaatggtggcagtttcttctgtgagccatgcagaaggcaatccaacttttcccgaacggaaacgcaatctcgagcgacctacacccaagtacaccaaagtgggtgagagactcagacacgtcatacccggacatatggcatgtagtatggcatgtggcggaagggcgtgtaagtacgagaatcccgctcggtggagcgagcaagagcaagctatcaaaggcgtttattcaagttgggtgacagataatatccttgcgatggccagaccgtcctctgagctgctcgaaaagtaccacataatagaccaatttcttagtcatggcattaaaacaatcattaacctgcaacgtccaggagaacacgctagctgtggcaacccactcgagcaggaatccgggtttacttacctgcctgaagcgtttatggaggccggaatctatttttacaacttcggctggaaagattacggcgtagccagcttgacaacaatcctcgacatggtgaaggtgatgacattcgctctccaggagggtaaggttgctatccactgccatgccggactgggcaggaccggggtgctgattgcatgttatttagtgtttgcgacacgcatgaccgcagaccaggcaatcatattcgtgcgtgcaaagcgcccaaattctatccagactaggggacagcttttatgcgtccgggaattcacacagttcctcacccctctgagaaacatattctcctgctgcgaccctaaggcccatgcagtgactctgccccagtatctgatccgacaacgtcatctcctacatggctatgaagccagactgctgaaacacgtccccaagattatacatctggtatgcaagctacttctggatcttgccgaaaacagacccgtcatgatgaaggatgttagtgaaggtcccggtctgtccgctgagatcgagaaaactatgtcagaaatggtgacaatgcaactcgataaggagctgctgaggcacgacagcgatgtttccaacccccctaacccaacagccgtggctgctgactttgacaatcgcggaatgattttctccaacgagcagcagttcgatcccctgtggaagcggcgaaacgtcgagtgcctgcagcctctgactcacctgaagcggaggctttcgtatagtgattccgaccttaaaagagcggagaacctgctcgaacaaggcgaaactccacagaccgtgcccgctcagatacttgtgggacacaagccaagacagcagaaattgataagccattgttacataccccagagccctgagccagatctgcataaggaagccctcgtcaggagtactttgagtttctggtcccagagtaaattcggtggattggaagggctgaaagataacggaagtcccatttttcatggacgaattattcccaaggaagctcaacaaagtggggcattttcagccgacgtctccgggagccattctcccggagagcccgtaagcccatcttttgccaatgtacataaagatccgaacccggctcaccaacaggtgtctcactgccagtgtaagacccacggcgttggcagtcccggaagcgtgcggcagaactccaggacgccccgatctcctctagactgtggtagcagcccaaaggcgcagttcctggttgagcacgaaacgcaggactctaaagatttatccgaggccgctagccattcagccctccagagtgaactcagtgcagaggctcggagaattctggcagctaaggccctggccaatctcaacgagagcgtggagaaggaagaattaaagaggaaagtagagatgtggcaaaaggaattgaatagcagagacggggcttgggaaaggatctgtggtgaaagggatccatttatcttgtgttctctgatgtggtcatgggtcgagcagctgaaagaacccgttatcacaaaagaggacgtggacatgctggtggacagacgcgcagacgcggctgaagctctctttctcctggaaaaaggacagcaccagaccattctatgtgtgctccattgcattgtcaacctgcaaaccatcccggtggatgtggaggaggcctttttggcacacgcaatcaaagcctttacaaaagtgaactttgacagcgagaatggtcctactgtgtataacaccctgaagaaaatcttcaagcacactcttgaagaaaaacgaaagatgaccaaagatggtccgaagcccggactgtag

SEQ ID NO: 59129 - DNA, 438 bp, Artificial Sequence
  Description of Artificial Sequence: Synthetic coding sequence
atgtggactgccaggggtcctttcagaagggataggtggtcctccgaagatgaagaggccgctggtccctcccaggccctgagtcccctcttatcagacactcggaaaattgtgagtgagggcgaactggaccagttggcacagatccgccctctaatctttaatttccatgagcagacagccatcaaagactgccttaaaattctagaggagaaaaccgcagcttatgacattatgcaggagtttatggcactggaactgaagaatttgcctggagaattcaactcagggaatcagcctagtaaccgcgagaagaatcgctacagggatatacttccgttccagcaccatggctacagcggacccaacgagcgaactacgttttggcacgggagcaatgagggcgcagtcagcctgttgctgcgctactgtgcctag

SEQ ID NO: 59130 - DNA, 681 bp, Artificial Sequence
  Description of Artificial Sequence: Synthetic coding sequence
atgagctcgccgagggatttcagagccgaacccgttaatgattatgagggcaacgattcagaggcggaggacctaaacttcagagaaactcttcctagctcctcccaggagaatacccctcgtagcaaggtgttcgaaaataaggtgaatagcgagaaagtgaagttgtcactgagaaactttccacacaacgattacgaggacgtgtttgaggaacccagtgagtctggtagcgatccgagcatgtggacagccaggggccctttccgcagagacagatggtcctcagaggacgaagaggcagccggtcccagccaagccttgtcccccctgttatccgatacacggaaaattgtgtccgagggcgaactagaccagcttgcccagataaggccgttgattttcaatttccacgagcagacagcaataaaggactgcttgaaaatcctggaagaaaaaactgctgcgtacgacattatgcaggaattcatggccctcgagcttaaaaatctacccggagagttcaatagcgggaatcaaccctcaaaccgtgagaagaaccgatacagggacattcttccattccagcaccacgggtattcaggaccgaatgaacgtacaactttctggcatggcagtaatgaaggtgctgtgagcctgctcttgagatactgcgcttag

SEQ ID NO: 59131 - DNA, 1020 bp, Artificial Sequence
  Description of Artificial Sequence: Synthetic coding sequence
atgtggactgcaaggggaccattccggagagaccgttggagcagtgaggacgaagaagcggcaggcccatcccaggcactttctcctctcttatccgacaccaggaagattgtctccgagggtgagctggatcagctagcccaaatccgaccgctgatcttcaactttcatgagcagacagctatcaaagactgccttaaaattctggaggaaaaaaccgccgcatatgacatcatgcaggagttcatggcactcgagctgaaaaatttacctggggagttcaacagcgggaatcagccaagcaacagggaaaagaatcgttatcgggatatccttccatacgacagtactagggtgccgctgggtaagtccaaagattatatcaatgccagctatatccggatagtgaattgcggagaagaatacttctatatcgcgacacaggggcctttgctctccaccattgacgacttctggcagatggtgctggagaataattcaaatgtgatagccatgataaccagggagatcgaaggcggtatcatcaaatgctatcactactggccgatctccctgaaaaagccactcgaactgaagcattttagagtatttctggaaaactaccagatcttacaatatttcatcatcaggatgttccaggtggtggagaagtctacagggacctcccattccgttaagcagcttcagttcactaaatggccagaccacggcacccccgctagcgccgactccttcatcaaatatatcagatacgcccgtaagtctcacctgactggacctatggtggtccattgctctgccggaattgggcgtacgggtgtgtttttatgcgtcgatgtggtgttttgtgccatcgtgaagaactgcagtttcaacattatggacatcgtcgcccagatgagagagcagcgcagcggcatggtccagactaaggagcagtaccacttctgttacgatatagtgctggaggtgctgaggaagctgctgaccctcgattag

SEQ ID NO: 59132 - DNA, 1137 bp, Artificial Sequence
  Description of Artificial Sequence: Synthetic coding sequence
tcattttcaccaaggctttgcagtgtgaatgactacgagggcaatgactccgaagctgaagacctgaactttagagaggctctgcctagctcgtctcaggaaaatacaccacggtctaaggtcttcgagaataaagttaattcagagaaagtgaagctgtccctcaggaacttcccacataacgactacgaggacgtgttcgaggaaccgagcgagagcggctctgacccttccatgtggaccgccaggggaccatttggtagagatagatggtcctctgaagatgaggaagccgctgggccttcccaggctttgagccctctgctctcagatacaaggaaaatcgttagtgaaggggagctggatcagttagcccaaatcagacctctaatttttaattttcacgagcaaaccgccatcaaggattgtctgaagatcctggaagagaaaactgcagcctacgatatcatgcaagaatttatggccctcgaacttaagaacttacccggtgagttcaattcaggcaatcagcccagcaaccgcgagaagaaccgttaccgtgatattttaccctacgattccacacgagtcccactcggcaagtcaaaagactacattaacgcatcctacattcgcatcgtcaactgtggcgaggaatatttttacatcgccacccagggaccattgctgtctacaatcgatgacttttggcagatggttttggaaaacaactcaaacgtgatcgccatgattacccgtgaaatcgaagggggaattataaagtgttatcactattggcccatctctctgaagaagccccttgagctaaagcatttccgtgtgtttctggagaactatcagattctccagtattttatcattaggatgtttcaggttgtggagaagtcaactggtactagtcattcagtcaagcagctgcagttcacgaaatggcctgaccatgggacaccggcttctgccgatagtttcataaaatacattagatacgccaggaagtctcacctgaccggccctatggtggtccactgcagcgccggaattggccgaacaggagtattcctgtgtgtggatgttgtgttctgtgctatcgtgaaaaattgctccgtgagcgtgtag

SEQ ID NO: 59133 - DNA, 279 bp, Artificial Sequence
  Description of Artificial Sequence: Synthetic coding sequence
tagggccctaattggcgcggatgttggggttgcagcggcaccgtgggggctgccccacaggctcaagtgtttgagaacaaggttaactcagaaaaggtcaaattgagtcttcggaatttcccccacaacgactatgaggacgtttttgaagagccgtcagaatctgggagcgatccatcaatgtggactgctcgtggaccattcggaagagaccgatggtcctctgaggatgaagaggctgcgggaccttcacaagcactctcccccctgttatcctag

SEQ ID NO: 59134 - DNA, 342 bp, Artificial Sequence
  Description of Artificial Sequence: Synthetic coding sequence
atgtcttcgcccagagacttccgcgctgagtctgtgaacgactacgaaggcaacgacagcgaagctgaagacctgaacttccgggaagctcttccaagttcctcacaagaaaacacccctcgctccaaagttttcgagaacaaggtcaatagcgaaaaggtgaagttgagcctccgaaatttcccgcataatgactatgaggatgtatttgaggagccatccgaatctgggtcagaccctagcatgtggaccgccaggggtccatttggcagagatcgctggtccagtgaggacgaggaagccgcaggaccatcccaagccctgagccccctgctgagttag

SEQ ID NO: 59135 - DNA, 924 bp, Artificial Sequence
  Description of Artificial Sequence: Synthetic coding sequence
atggagaaccaggtccttacaccacacgtgtattgggcgcaacgccatcgggaactgtatttgcgggttgagctctctgacgtgcagaacccagccatctcaatcaccgagaatgtgctgcactttaaggctcaggggcacggcgcaaagggcgataacgtgtatgagttccacctcgagttcctggatctggttaagccagaggaggaggagagattgaataagctgaggcttgaatctgaaggttcccctgaaacattaacgaaccttaggaaaggatacctctttatgtacaacctggtacagtttctaggtttttcctggatctttgtgaacttgaccgtgcgtttttgcatcctgggcaaggagtctttctacgacaccttccacactgtggcggatatgatgtacttttgtcagatgctcgccgtggtagaaactattaatgcagccatcggagtgacaacgtctcccgttctccccagcctgatacagctgctgggtagaaactttatcctcttcataatcttcggaacgatggaagaaatgcaaaacaaagcggtggtgttcttcgtgttctacttatggtcggcaatagagatcttccggtatagtttttacatgctgacttgtatcgacatggattggaaggtcctcacatggctgcgctacaccttgtggattcccttatacccactggggtgcttagccgaggccgtcagcgttatacagtcaatccctatttttaatgagaccgggaggttcagtttcacacttccctaccccgtaaaaataaaagtgaggttctcgttcttcctgcaaatttacctgatcatgatcttcctcggcctgtacatcaactttaggcacctgtataagcagcgcagaagacgctacggtcaaaagaagaaaaagatccattag

SEQ ID NO: 59136 - DNA, 1932 bp, Artificial Sequence
  Description of Artificial Sequence: Synthetic coding sequence
atgaggacgctgcgtaggctcaagtttatgtcttctccttcactctcagatcttggaaaacgggaacctgcggctgctgccgatgagcgcggaacgcagcagcgcagggcctgcgcaaacgccacctggaatagcattcataatggggtgatcgccgtgttccagcgaaaaggcctaccggaccaggaactattcagtttaaatgagggcgtacgccagctcttaaagaccgagctcgggtccttcttcacagagtacctgcagaatcaactgctcacgaagggaatggtaattctcagagataaaattcggttctacgagggccagaagctactggactccctggctgagacctgggacttcttcttcagcgacgtccttccaatgctgcaagctatcttctaccccgtgcagggcaaggagccgtcggtccgccagctcgccctcttacattttaggaacgcaataacgttgtctgtcaaattggaagacgcattggccagagctcatgcaagagtaccgcctgccatcgtccagatgctgttggtgctgcagggtgtacatgagtcccggggagtgacagaagactatttgcggctggagacactggtgcagaaagtggtgagcccttacttaggaacatacggcctgcatagttcagagggacccttcacacacagttgcattctggagctgcagcgggacaaggcagccgctgctgcagtccttggcgctgtcagaaagcggccttccgtcgtgccaatggccggacaggaccccgcactctcgacttctcatcctttctacgacgtggcaaggcatggcatcctccaggtggccggagacgacagattcggccgtcgtgtggtcacattttcgtgctgcagaatgccacctagccacgaactagaccatcagaggctgctggaatacaagaaaaatttgaaggctttatatgtggtccatcctacatctttcattaaagtactgtggaatatccttaagcccctcatcagccataaatttggaaaaaaggtgatttacttcaactacctctctgagctgcatgagcaccttaagtatgatcaattggttatcccccctgaggtcctgcgttatgatgagaaactgcagtcattgcacgagggtcgcactccgccaccgaccaaaacaccaccccctaggcctccattgccaacacagcagttcggtgtctctctccagtatctgaaagataaaaatcagggagagcttattcccccagtcctaagatttacagtcacttatttaagagaaaagggacttaggacagaaggactgtttcgtagaagcgcaagtgtgcagactgtgcgtgaaattcagagactttataaccagggcaagccagtgaatttcgacgactacggcgacatccatatccccgctgtcatattgaagacctttctcagggagttaccccagccgctccttacattccaggcgtatgaacagatcctggggatcacctgcgtggaatccagtctgcgggtgactggttgccgtcagatactgagaagcctcccggagcacaactatgtggttctcaggtatctgatgggattcctgcatgctgtttccagagaatccatcttcaacaaaatgaacagcagcaacctagcctgtgtgttcggtctgaacctgatctggccttctcagggggtctcctccctcagcgctcttgtgcccctgaacatgtttaccgagctgttgatagaatactatgaaaaaattttcagcactccggaggcccctggagagcacgggcttgccccttgggagcagggatccagagcagcgcctctgcaagaggctgtgccacgaacgcaagcaacaggtctcaccaagccaacacttcccccaagcccactcatggccgctagacggagactgtag

SEQ ID NO: 59137 - DNA, 1695 bp, Artificial Sequence
  Description of Artificial Sequence: Synthetic coding sequence
atgaggacactcaggaggctgaaattcatgagctccccatccctgtcagacctcggaaaacgcgagcctgccgctgccgcagatgagcgaggaactcagcaaagacgggcttgcgcgaatgccacatggaactcaatccataatggcgtgatcgcggtttttcagcgcaaggggctgcctgatcaagagctgttctcgcttaacgagggtgtaagacagttgctaaagactgaactcgggtccttctttaccgagtatcttcagaatcagctgctcaccaagggcatggtcattctccgggacaagattagattttacgaggaactgcagcgcgataaggctgctgctgctgccgtactcggcgctgtgcgcaaaaggccatccgtggtacctatggccggtcaggaccccgctctgagtacatcccaccctttttacgatgtcgctagacatggcattctgcaggtggcaggggacgaccgatttggtaggcgtgtggtcaccttttcctgttgccgcatgcccccaagccacgaactcgatcatcagcggctgctggagtatctgaagtataccttagaccagtatgtagagaacgattacacaatagtgtatttccactacggcctgaactcccggaataagccctcacttggttggctgcagtcagcctataaagagttcgatcggaaatacaagaaaaatctgaaggccctatacgtcgtgcaccctacaagtttcatcaaagtgctgtggaatatcctgaagcccttgatttcccataaattcgggaaaaaggtaatttattttaactacctgtcggagctgcacgaacatctaaaatacgatcagctcgtgataccgcctgaggtattgaggtatgacgagaagttgcagagcttacacgagggtcggaccccaccacccaccaaaactccccctccacgcccaccattaccaactcaacagttcggcgtatcacttcagtatctgaaggataagaaccagggcgagctgatccccccagttttgaggttcactgtaacttatcttcgggagaagggtctcaggacagaaggcttattcagaaggtcagcatcagtccagacagtccgtgaaatccagcggttatataaccaaggaaagccagtaaatttcgacgactacggcgacatccatatacctgcagtgatcttgaaaacattcctgagagaacttccacagccacttctgactttccaagcctacgagcaaattctgggcattacttgtgtggagagttctctgcgtgtaactggatgtcgacagattttgaggtctttgccggagcataattacgtcgtattgaggtaccttatgggattcctgcacgccgtctcccgtgagtccatttttaataaaatgaatagttcaaacctcgcatgtgtatttggactgaacctcatctggccaagtcagggcgtgagtagtctgagcgctcttgtaccgttgaacatgtttacggagctcctgatagaatactacgaaaaaattttctccaccccagaagcccctggtgagcatggactggccccttgggagcaaggttcccgcgcagcccctctgcaggaggcagtgcccagaacccaggccaccggtctaacaaagcccactcttcccccatcccccctgatggcggcacggaggcgcctttag

SEQ ID NO: 59138 - DNA, 1515 bp, Artificial Sequence
  Description of Artificial Sequence: Synthetic coding sequence
tgattgggctccttctttaccgagtatctccaaaaccagctgctgaccaagggaatggtgattctgcgcgataagatccgtttttacgaggagttgcagagggataaggccgcagcggcagccgtcctgggtgcagtaagaaagcgcccatccgttgtcccaatggctggtcaagatcctgctctgtccacctcccaccccttctacgatgtggcccgacatgggattctgcaggttgcaggcgacgacagatttggaaggagagtcgtaaccttctcctgttgtagaatgcctccatcccacgaactggaccaccaacgccttctggaatacctcaagtacactctcgaccagtacgtggagaacgactatacgatcgtgtactttcactatggattgaatagtaggaataaacccagcctgggttggttgcagagtgcatataaggagtttgacaggaagtataagaaaaatctcaaggctctgtatgtggtgcacccaactagctttatcaaggtcctgtggaatatcctaaaacccctgatctctcataagttcggaaagaaagtcatatacttcaattacttgtcagagctccatgagcacttgaagtacgaccaactcgtgatcccaccagaggtgttgagatatgatgaaaaactacagtctctgcacgaaggcaggacgccgccacctaccaagaccccaccgcctagacctccactacctacccagcaattcggagtgtcgctgcagtatctcaaagataaaaaccagggagagctcatccctcctgttctccggtttactgttacataccttcgagagaagggcctccggacagagggactgtttagacgctccgcctcagttcaaactgtaagagagatccagcggctgtacaatcaaggaaaacctgtcaacttcgatgactatggcgacatccatatcccagctgtgatcctcaagacttttttacgagagctaccacagcctctgcttaccttccaggcttacgagcagatcctggggataacttctctgccccttgccccactggaactctcacgggagcctcatgcactcccaggggtagaaagctctctgcgggtgactggatgccgccagatacttagatccctcccagaacacaattatgttgttctgcggtacctcatggggtttctgcatgctgtgtcccgggagagtatctttaataaaatgaactccagtaatcttgcctgcgtctttggcctgaacctaatctggccgagccagggggtttcatccctgagtgcactggtccccttaaatatgtttacagagttgctgatagagtactatgagaagatctttagtacgccagaggcccctggtgaacatggacttgcaccctgggaacagggctctcgggctgctccactacaggaagctgtgcctcgtactcaggcaacaggactcaccaagcctacactcccgccatcccccctcatggcagccagacgtaggttgtag

SEQ ID NO: 59139 - DNA, 1590 bp, Artificial Sequence
  Description of Artificial Sequence: Synthetic coding sequence
atgtttcctttgactgaggaaaacaaacatgttgctcagctccttctcaatactggtacttgccctcgatgtatcttcagattctgtggagtcgatttccacgccccatacaaactgccttacaaagagcttctcaacgagcttcaaaagttcctcgagactgaaaaagatgagctgattctcgaggtgatgaaccctccccctaagaagatcagattacaagagttagaagacagtatagacaacttatctcagaacggggagggacgcattagtgtatcccatgtggggtcaactgcatcaaagaatagcaacctcaatgtgtgcaatgtctgcttgggtatcttgcaggaattctgtgaaaaagatttcattaaaaaggtctgtcagaaggtagaggcttctggtttcgagttcacatccctggtgttctcagtcagcttcccccctcaactcagtgtcagagagcacgctgcctggctcctggtgaaacaagagatggggaaacagtccctgtctttaggccgagatgacatcgtccagttaaaggaggcctacaagtggatcacgcatcctctcttcagcgaagagttgggtgtgcctatcgacggaaagagcctgttcgaggtgagtgtagtattcgctcatccagagacagtggaagactgccactttctagcagccatttgcccagactgtttcaaaccggctaagaacaagcagagcgtcttcacccgtatggccgtgatgaaagcactcaacaagatcaaggaggaggacttccttaaacaattcccgtgtcctcctaatagcccaaaggccgtgtgtgccgttctcgagatcgagtgcgcacacggggctgtgtttgtggcagggagatacaacaaatacagcaggaacctgccgcagaccccgtggattatcgacggcgagcgcaagcttgaatcttcggtcgaagagctgataagtgaccacctgcttgccgtcttcaaggccgagtccttcaatttctcaagctccggaagggaagacgttgatgtgcggacacttgggaatgggagaccattcgccattgaactcgtcaacccgcatagggtgcactttacatcccaagaaatcaaagagcttcagcaaaagattaacaactcatcaaacaagattcaagtgagggacctgcagcttgtcactcgcgaagctatcggacatatgaaagagggggaagaagagaagacgaagacatactcagcccttatctggaccaacaaggccattcagaagaaagacattgagttcctgaatgacattaaagaccttaagatcgatcaaaagaccccgttgcgggtgctgcataggcgccctctggccgtgcgagcccgagtcatccactttatggaaacccaatacgttgatgagcaccacttccggctgcacctgaagacacaggccggtacatacataaaggagttcgtgcacggcgactttggacgcacaaagccaaatataggtagcctcatgaatgttacagccgacattcttgagctggatgtggagagtgtggatgtggactggccccctgcactagatgactag

SEQ ID NO: 59140 - DNA, 1590 bp, Artificial Sequence
  Description of Artificial Sequence: Synthetic coding sequence
atgttcccgctgaccgaagaaaacaagcatgttgcgcagctgctgctgaacacgggaacctgccccagatgtattttccggttctgtggcgtggattttcatgccccttacaagttgccttacaaagaactgctgaacgagctgcaaaaattcctagagactgagaaggatgaactcatcctggaggtgatgaacccccctcctaagaaaattaggctccaggaactggaagactcaatcgataatctgagtcagaacggcgaaggaaggatcagcgtctcgcacgtggggtcaacagccagcaaaaactcaaatctgaatgtttgcaatgtgtgtctgggcatccttcaggaattctgcgagaaggacttcataaaaaaagtgtgccagaaggtggaagcgtcaggctttgagttcacaagcctagtgttctccgtgtcgttccctccacaactgtctgttagagaacacgccgcatggctgctcgtaaagcaggagatgggaaaacaatccctgtctctcgggagggatgatatcgtgcagctgaaagaagcatataaatggataacccatccgctcttctctgaggaattgggggtgcccatcgacggtaagtctctttttgaagtctctgtggtgttcgcccaccctgagacagtcgaagattgccacttcttggcagcaatctgccctgactgcttcaaaccagcgaagaataagcaatctgttttcacgcgcatggcagtgatgaaggctcttaataagatcaaagaggaagatttcctgaaacaatttccctgtcctccaaactctcccaaagcagtctgtgcagtgctagaaatcgagtgtgcacatggggcagttttcgttgccggtcggtacaataaatactctcggaaccttccccagacaccttggattatcgacggggagcgaaaactagagagctctgtcgaggagctgatttcagatcacttactagcagtcttcaaagcagagagcttcaacttcagttcaagtggtcgggaggacgtcgatgtgcgcacgctgggcaacggccgtccctttgccatcgaattagtcaacccccaccgcgtccactttacctcccaagaaatcaaggagcttcagcagaaaattaacaactcgagtaacaagattcaggtgcgcgacctgcagctggttacacgtgaggccatcggacacatgaaggagggcgaagaggagaaaacgaagacatactctgcgctgatttggacgaataaagcaattcaaaagaaagatatcgagtttctgaacgatatcaaggacttaaaaatcgaccaaaagaccccgttgagagtactacacagaaggccactcgccgttagggctcgcgtcatccactttatggagactcagtatgtcgacgagcatcatttccgactgcacctgaagacacaggccggaacatacattaaggagtttgtacatggcgatttcgggagaaccaagccgaacatcggctccctgatgaacgttactgcagacatccttgagctagatgtggaatctgtggacgtcgactggccaccagccttagacgactag

SEQ ID NO: 59141 - DNA, 363 bp, Artificial Sequence
  Description of Artificial Sequence: Synthetic coding sequence
atgttcccattaactgaagagaataaacatgtcgctcaattactactgaacactgggacctgcccgcgatgtattttccgcttctgcggcgtggacttccacgccccatacaaattaccctataaagagctcctcaacgaattgcagaaatttcttgaaacagaaaaagacgagttgatccttgaggtcatgaacccccctccgaaaaagattcggctgcaggagttggaagattcaatagataatttgtctcagaatggtgaagggcgaatttccgtcagtcacgtcggctctactgccagcaagaattcgaatctgaatgtatgcaacgtgtgcctagggatccttcaggaattttgttag

SEQ ID NO: 59142 - DNA, 1986 bp, Artificial Sequence
  Description of Artificial Sequence: Synthetic coding sequence
atggagatgactgaaatgactggtgtttcgcttaagcgaggcgcactcgtggttgaggacaacgacagcggggtgcccgtggaggagaccaagaagcagaagctgtcagagtgtagccttacgaaaggacaggatggactgcagaatgacttcctgtctatctctgaggacgtgcctcggcctccagatactgtcagcactggtaaggggggaaaaaattcagaggcgcagctggaggatgaagaagaagaggaggaagatggattatccgaggagtgcgaagaggaggaatccgagtcgttcgctgatatgatgaagcacgggctcacagaggctgatgtggggatcaccaagttcgtttcgtcacatcagggcttctccggtatcctgaaagagcgctactcagatttcgtggtccacgaaatcggcaaagacgggaggatctctcacttgaatgacttgtccatccctgtcgacgaggaggatccttctgaggacatcttcaccgttttaactgccgaagaaaagcagcgcctcgaggagttgcagttattcaagaacaaggagaccagtgtcgcaatcgaagtcatcgaggatactaaagaaaagcgcaccattattcaccaagcaataaaatcactgtttcccggtttggaaaccaagacggaggatagggagggcaaaaaatatattgtcgcttatcacgctgccggaaagaaggccttggccaatcccaggaagcatagctggccaaagtcacgcggttcctactgtcactttgtcctgtacaaggagaacaaagataccatggatgcgatcaatgtgctatctaaatacctgcgggtgaagcccaacatttttagctacatggggaccaaagacaagagggctataaccgtgcaggagatcgcggtcctgaagatcacagcccagcgcctggcacacctcaataagtgccttatgaacttcaagctggggaacttttcctaccaaaaaaacccacttaaactgggtgagctccagggcaaccacttcactgttgttctgaggaacattactggcaccgacgatcaggtgcaacaggccatgaactccctgaaggagatcggatttattaactattacggaatgcagagatttggaaccactgcagtgcccacctatcaggtgggtagagcaatccttcaaaactcatggactgaggtcatggacctcattctgaagcccaggtcaggggctgaaaagggatacctggtgaagtgtcgtgaagagtgggccaaaaccaaggaccctacagcggcactgcggaagcttcctgttaagaggtgcgtagagggccagctcttaagaggtctttcgaaatacggcatgaagaacattgttagtgcgttcgggatcatcccacgcaataacaggctgatgtacatacattcatatcagtcttatgtctggaacaatatggtgtccaagagaatcgaggactacggtttgaaaccggttccaggggacctggtgctcaagggagctactgccacctatatagaggaggatgacgtgaataattactccatccacgacgtcgtaatgccactgcccggtttcgatgtcatctaccctaaacataaaatacaggaggcttatagggagatgcttaccgccgataatttggacatcgataacatgcgtcacaaaattagagattactctttgtctggggcttaccgcaagatcatcattagaccccagaatgtgtcttgggaggtggtcgcatatgatgatccaaaaatccctctgtttaatacagacgttgataatttggagggtaaaacgccacccgtattcgctagcgagggcaagtatcgcgctctgaaaatggacttctcattgcctccttcgacgtacgcaactatggcaattagggaggtgctgaaaatggacacatccattaagaaccagacccaactgaatactacgtggctgaggtag

SEQ ID NO: 59143 - DNA, 1986 bp, Artificial Sequence
  Description of Artificial Sequence: Synthetic coding sequence
atggaaatgaccgagatgaccggtgtttcactcaaaagaggcgcattggtggttgaagacaacgattcaggagtgccagtggaggagaccaaaaagcagaaattatccgaatgctctctcactaagggacaggatggactgcagaacgatttcctgtccatctctgaagatgtgcctcgccctccagacacagtgtccactggtaaaggaggcaaaaactctgaggcccagttagaggacgaagaggaggaggaggaagatggtctctccgaagagtgcgaagaggaggagagtgaatcgtttgccgacatgatgaaacatggactgacggaggctgacgtcgggattacgaaatttgtgtcaagtcatcagggattctcaggtatcctaaaagagaggtacagtgacttcgtcgtgcatgaaattggaaaagatggtaggatttcacacctcaatgacttatccattcctgtcgacgaagaggatccctctgaagatatcttcaccgttctcaccgcagaggagaagcagcggctggaggaacttcagctgtttaagaataaagagacttctgtcgcgattgaggtaatcgaagacacaaaagagaagcgcaccatcatccaccaagccataaagtccttgtttccgggactagagacaaaaacagaagatcgcgagggtaagaagtacatcgtggcctaccacgccgcaggcaagaaggcattagccaatcccagaaagcattcctggccaaagagccggggaagctattgtcatttcgtgctgtacaaagagaacaaagatacaatggacgcaattaatgtactctcgaagtacctgagggtaaaacccaatatcttctcatacatgggcacaaaagacaaaagggcaattactgtgcaggagatcgccgtgctgaagattactgcccagcgcctagcacaccttaataaatgccttatgaattttaagctcggtaatttctcctatcagaagaaccccctaaagcttggggaactacagggaaaccacttcaccgttgtgttaaggaatatcacagggaccgacgatcaagtgcaacaagctatgaatagcctgaaggaaatcggattcattaactattacggtatgcaaagatttggaacaaccgccgttcctacctatcaggtgggcagggccattttacagaattcatggactgaagtaatggatctgatcctgaagcctaggagtggggctgaaaagggatacctggttaagtgccgcgaggagtgggccaagacgaaagaccctacagcagccttacgaaagctgccagtcaagcggtgcgtcgaagggcagctgctgaggggactctcaaaatacggcatgaagaatattgtcagtgcttttggcatcatcccacgtaacaacagactgatgtatatacactcctaccaaagctatgtctggaataacatggtatctaagcgcatcgaagactacggactgaagcccgtcccaggcgacctcgtcttaaagggtgccactgccacatacattgaggaggacgacgtgaataattatagtattcacgacgttgtgatgcccttacccggatttgatgtgatatacccaaaacataaaatccaggaagcttatcgcgagatgctcactgcagacaatttagatatagacaatatgcggcacaagattagggactactcattgagcggtgcttatagaaagatcattattcgtccccagaacgtatcatgggaggtcgtagcctatgacgacccaaaaatacctctcttcaatacagatgtagataaccttgaggggaagacgccccctgtgtttgcgagcgaggggaaatatcgcgcactcaagatggacttctccctccccccttcaacttacgcgactatggcgattagggaagttctgaaaatggatacttctatcaaaaaccagacccagctgaacacgacttggcttcgttag

SEQ ID NO: 59144 - DNA, 1986 bp, Artificial Sequence
  Description of Artificial Sequence: Synthetic coding sequence
atggagatgacagagatgaccggcgtgtcactaaagagaggagcactggtcgtggaagataacgattccggtgtcccagttgaggaaactaaaaaacaaaaactaagcgagtgctctctgactaagggccaagacggcctgcagaacgattttctgagcatatccgaagacgtacccaggccaccagacactgtgagtactggaaaagggggtaagaacagtgaggcccagcttgaggatgaagaagaggaggaggaagacggcttgagcgaagagtgcgaggaagaagagagcgagtcttttgccgacatgatgaaacacggattgacagaagcagatgtcggcattacgaaatttgtgagcagccaccaagggttctccggaatactcaaggagcggtactctgacttcgtagtccacgaaatcgggaaggacggacgcatctctcatttgaacgacctaagcatccctgtggacgaagaggatcctagcgaagacatatttaccgtgctgaccgcagaggaaaagcaaagactcgaagaactccagctttttaaaaacaaggagacttctgtggccatcgaggttatcgaagatacaaaagagaagcggactatcatccatcaagccatcaagagcttgtttcctggtttggagaccaaaactgaagatcgggaaggaaaaaagtatatcgtcgcctaccacgcggctggtaagaaagctctggcaaatccacgaaaacactcatggcccaagtcgcggggaagctattgtcattttgtgttatacaaggaaaataaagacactatggatgccatcaatgtactgagcaagtacctccgagtgaagccaaacatattttcttacatggggactaaagataagagggctatcaccgtgcaggagattgccgtgctgaaaatcactgcccagcgcttggcccacctgaataaatgcctaatgaatttcaagcttggaaattttagttaccaaaaaaatcctctgaaactgggtgaactgcaggggaatcactttacagtagttctgaggaatatcaccggtactgacgatcaggtccagcaggccatgaattccctcaaggaaattggtttcatcaactattacggcatgcagcggttcggcaccacagccgtccctacctaccaagtgggcagagctattttgcagaatagctggactgaggtgatggatctgatcttaaagccgaggtcaggggcagaaaagggttatttggtcaaatgtcgtgaggagtgggcaaaaacgaaagatcctaccgccgcactgaggaaacttccagttaagaggtgtgttgaagggcagctgcttagaggtctgagcaagtacggtatgaagaacatcgtttcagcgtttggcattattccccgtaataatagactcatgtatatccactcctatcaatcttatgtatggaacaacatggttagtaagcgaatcgaagattacgggttgaagccagtccctggagatttggttcttaaaggtgcgacggcaacctatatcgaggaggacgatgttaacaactacagcatccatgacgtggtgatgcctttacccggtttcgacgtgatttatcctaagcataaaatccaggaagcctaccgagagatgctcacggctgataacttggatattgacaacatgcgacataagatcagggactacagcctttcgggtgcctacaggaaaatcatcattcggccacagaatgtctcatgggaagtagtggcctatgatgatccaaaaattccactgtttaatactgacgtcgacaatttggagggcaagacacctccggtattcgcttctgaaggtaagtacagagctttgaagatggacttctccctgccaccttccacttacgctactatggcaatcagggaggttctgaagatggacacttcaatcaaaaatcagacccagcttaatacaacttggcttagatag

SEQ ID NO: 59145 - DNA, 2106 bp, Artificial Sequence
  Description of Artificial Sequence: Synthetic coding sequence
atggaggaggacaccgattatcgcataagattctctagcttatgctttttcaatgaccacgtcgggtttcacggaactataaaatcttccccatcagactttatcgtaatcgaaattgatgagcagggacagctggtaaataaaaccattgacgaaccaatctttaagatttcggagatccagcttgaaccgaataattttcctaaaaagcccaagctggacctccagaacctgtcgctggaagatggacgaaaccaggaggtgcatacactgattaagtatactgacggtgaccagaatcaccagtctggctcagagaaggaggacaccatcgtggatgggactagcaaatgcgaggaaaaagcagacgtgctgtcaagcttcctcgatgagaagacccacgaactgcttaacaacttcgcctgtgatgtaagagagaagtggttgagcaaaacagagctgatcggcctgccacccgagttttccatcgggagaattctggacaagaaccaacgggcttccctgcattccgctatccgtcagaagtttcccttcctggtgactgtggggaaaaactctgagattgtggtgaagcctaacctggaatacaaagagctgtgtcacctcgtatccgaggaggaggcattcgacttctttaagtacctggatgcaaagaaggaaaacagcaagttcaccttcaagccagacacgaataaggaccaccgtaaggccgtgcaccacttcgtcaacaaaaaattcggtaatcttgtagaaactaaatctttcagtaagatgaattgcagcgcagggaacccaaacgtagtagttaccgtgagatttagggaaaaagcgcacaagagagggaagagacctctgagtgagtgccaggagggcaaagtgatatacacggcttttactttacgaaaggagaatttggaaatgttcgaggcaatcgggtttctggcaattaagctgggagttattccatcagattttagttacgccggactgaaagacaagaaagccattacctatcaggcaatggtagtgcgcaaggtcacgccagagcgcctcaaaaacatagagaaagaaatagaaaagaaacgtatgaacgtgtttaatattcggtccgtcgatgattcgctaaggttaggccaactcaaggggaaccatttcgatatcgttattaggaacctgaagaagcagattaatgatagtgccaatctaagagagcgcattatggaagccatcgagaatgtcaagaaaaagggcttcgtgaactattatggaccccagagatttggaaagggaagaaaggtacacaccgaccagatcggactagcgttgttaaagaatgaaatgatgaaagcaatcaagctgttcttaacgcctgaggacttggatgacccagttaaccgggcaaagaagtactttctgcagactgaagacgccaaaggcaccttaagcctgatgcctgagttcaaggtgagggaacgcgctctcctggaagctctgcatcgtttcggcatgaccgaggagggttgtatccaggcttggttttcattacctcactctatgcgcatcttttacgtgcacgcctatacttctaagatatggaatgaggcagtctcttaccgtctggagacgtacggagcacgggtggttcagggcgatctagtttgcctggatgaagacatcgacgacgaaaattttccaaactccaaaatccatctggtgaccgaagaagagggaagcgctaacatgtatgcaatacatcaagtagtccttccagttcttggctacaacatacagtaccctaagaataaagttggccagtggtaccacgacatcctgagcagagatggcttgcagacctgtcgctttaaagttcctaccctgaaactgaacattcctggctgttacaggcagattctcaaacatccctgtaatctctcataccaactaatggaggaccatgatatcgacgttaagaccaaagggagccatattgacgagactgccctgtcactgctcatctcatttgatttggatgcatcctgttatgccacagtatgcctcaaggagattatgaagcacgatgtgtag

SEQ ID NO: 59146 - DNA, 2106 bp, Artificial Sequence
  Description of Artificial Sequence: Synthetic coding sequence
atggaagaggacactgactacagaatacggttctcttctctctgttttttcaacgaccacgttggttttcacgggaccatcaagagctcgccctccgactttatcgtaatcgaaatcgatgagcagggacagttggtaaataagaccattgacgagccaattttcaagattagtgagatacagctggagccaaataatttcccaaaaaaacccaagcttgacttgcagaaccttagcttagaagacggcaggaaccaggaagtccatacgctgataaagtacacggatggggaccaaaaccaccagtctggcagcgaaaaagaggatacaattgtcgacgggactagcaaatgtgaagaaaaagcagacgtcctgtcttcattcctcgacgaaaagacccacgagctcctgaataactttgcatgcgatgtgagggaaaagtggttatcaaagactgagctgatcgggttacctcccgagttttctatagggaggatcctcgataaaaaccagagggcctctctgcactcagccatccggcagaagttccccttcctcgttactgtgggtaaaaactccgagatcgttgtaaaacccaacctcgagtataaagaactgtgccatttagtctcagaagaagaggcctttgacttctttaagtatctggacgcaaagaaggagaacagtaaatttacattcaaacccgacaccaacaaggatcatcgcaaagctgtacaccatttcgtaaacaaaaaatttggcaacttggtggagaccaaatcattttccaaaatgaattgctcagcaggcaatcccaacgtcgtggtaacggtgaggtttagggaaaaggcccacaagcgtgggaaaaggccactgagcgaatgtcaggagggtaaggttatatacacagcgtttactctgcgcaaggaaaatctggaaatgtttgaggccatcggcttcctggcgattaagcttggtgttattccttcagacttttcgtacgctggcttgaaagataaaaaagccattacatatcaagctatggtcgtgagaaaagtgaccccggaaagattaaaaaacatagagaaagagattgagaagaaacggatgaacgtattcaatatccgctccgttgacgatagcctccgcttaggccagttaaagggaaaccactttgatatagttattaggaatctcaagaaacagattaatgactctgcgaatctgagagaacgtatcatggaggctatagaaaacgtcaagaaaaagggatttgtaaattactacggaccgcaacggttcgggaaagggagaaaggtgcatacagatcaaatcgggctcgcactgctgaagaatgaaatgatgaaagcaattaaactgttccttaccccagaggatctggatgacccggtgaatcgggcaaaaaagtattttttgcagacagaagacgctaaaggcactcttagtcttatgccggaatttaaggtgagggagcgagcccttctggaggctttacaccggtttggaatgacagaggaaggctgcattcaggcttggttctctcttccccattctatgaggattttctacgtgcacgcgtatacctccaagatttggaatgaagctgtctcttaccggctggagacctatggcgcacgggtagttcagggggacttggtctgcctcgacgaagacatagatgacgaaaactttccaaactcaaagatccacctcgtgaccgaggaggaaggctccgctaacatgtatgcaattcaccaggtggtactcccagtgctcggatacaacatccaatatcctaagaacaaggttgggcaatggtaccacgacatcctgtccagggacggtctgcagacatgcaggttcaaagtacctacactcaagctgaacatacccggatgctataggcagatcctcaagcacccatgtaacttgtcctatcagctgatggaggaccacgacatcgacgtcaagaccaaggggagtcatattgacgagactgcgctcagcctgttaattagcttcgatctcgacgcaagttgttatgcgaccgtgtgcttgaaggagatcatgaagcacgacgtctag

SEQ ID NO: 59147 - DNA, 381 bp, Artificial Sequence
  Description of Artificial Sequence: Synthetic coding sequence
atggaagaggacacagactaccgaattaggttttcctcgctgtgtttcttcaatgaccatgtggggtttcacggaaccatcaaaagtagcccgtctgactttattgtcatagaaattgacgaacaaggacagctggtgaataagacaatcgatgagcccatttttaaaatatccgagatccaactggagcctaacaatttccccaaaaaaccaaaacttgacctacaaaatttatctcttgaggacgggaggaaccaggaagtgcatactttaattaaatacactgacggagaccagaaccatcagagcggatctgaaaaagaagacactattgtggacggtacttccaagtgcgaggagaaagccgatgtgctgtcctag

SEQ ID NO: 59148 - DNA, 2106 bp, Artificial Sequence
  Description of Artificial Sequence: Synthetic coding sequence
atggaggaagacaccgattaccgaatacggtttagtagcctgtgctttttcaacgaccacgttggatttcatggtacaataaagtctagcccaagcgatttcatcgttattgaaatagacgaacagggtcagttggtgaataagaccatagatgagcctatcttcaaaataagcgaaatccagctggagccgaataacttccctaaaaaacccaaactcgatctgcagaacctttccctggaggacgggagaaaccaggaggtgcatacacttattaagtacaccgacggggatcagaaccaccaaagcggctcagagaaggaggacaccatagtggatggcacttctaagtgcgaagagaaagcagatgtcctatcctccttcttggatgaaaagacccatgagctgctgaataactttgcgtgtgatgtgagggagaagtggctcagcaaaaccgaactgatcgggcttccaccagagttctcaataggcaggattcttgataaaaatcagcgggcatcgctccactcagccatccgtcagaagttcccttttttggtcaccgtgggtaaaaactccgagatcgtcgtgaagcctaatttagaatataaagagctctgtcaccttgtcagcgaagaggaggctttcgatttttttaaatacctggatgccaagaaggagaattcaaagttcactttcaagccagataccaacaaagatcacagaaaagctgttcatcacttcgtcaataagaaattcggcaatctggttgaaacaaagagctttagcaagatgaactgctccgccggaaaccctaatgtggtggtgacggtgcgattcagagaaaaggcccacaaacgcggtaagcggcctttatctgagtgtcaagaaggcaaggtgatttacaccgcatttacgctaagaaaagagaacctggagatgttcgaagccattggatttctcgccatcaagctgggcgtgatccctagtgacttctcttatgcagggttaaaagacaagaaggccatcacttaccaggccatggtggtgcgcaaggtcacccccgaacggctcaaaaacatagaaaaagaaatcgagaagaaacgaatgaatgttttcaacattcgaagcgtggacgattccttgcgccttggccagctgaagggaaatcactttgatattgtgattaggaatctcaaaaagcagataaatgacagcgctaatctgcgagaacgcataatggaggccatcgagaatgttaaaaagaagggtttcgtaaactattatggtccccagaggtttggcaagggaagaaaagtgcacaccgaccagattggactggctctgctgaaaaatgagatgatgaaggccataaaactgttcctcactccagaagatctcgatgacccagtgaaccgggctaagaagtattttctgcagaccgaggacgcgaagggcactctgtccttgatgcctgagttcaaggtaagagagagagctttgctcgaggccttgcaccgatttggcatgaccgaagaggggtgcattcaggcatggttcagtttgccacactcgatgcgcattttttacgtccatgcgtatacttcaaagatttggaatgaagctgtctcttatcggttggaaacctacggcgctcgagttgtgcaaggggacctggtatgtttggatgaggatattgacgacgagaatttccccaacagtaagatccatctggtaacggaagaggaaggtagtgctaatatgtatgcaattcaccaagtcgtgctgccggtgctgggatacaatattcagtatcccaaaaacaaagtaggacaatggtatcatgatatcctgtcacgggatggcttgcagacctgccggtttaaagtgccgaccctgaagttgaatattcccggttgctacagacagattctgaaacacccctgtaatctgagctaccagttgatggaggatcatgacatcgacgttaagacaaagggctcccacatcgatgagactgctctgagtctgctgattagttttgatctggatgcatcctgttatgcaaccgtctgcctaaaagaaattatgaagcatgacgtttag

SEQ ID NO: 59149 - DNA, 1098 bp, Artificial Sequence
  Description of Artificial Sequence: Synthetic coding sequence
atggaagaagacacggattacaggattcggttctcgtccctgtgctttttcaacgaccatgtgggattccatggtaccattaagagctctcccagcgacttcattgttattgagatcgacgaacagggtcagcttgtgaataagaccattgacgaaccgatcttcaagatcagtgagatccaactcgaaccgaacaactttcccaagaagccgaaattggacctgcaaaacctgagcctggaagatgggcgaaatcaggaggttcatacgcttattaaatatacggatggggaccagaaccaccagagtggatcagaaaaggaagacactatcgtggacggcacatctaagtgtgaagagaaggccgatgtgttgtcctcttttcttgacgagaaaacacacgaactgctgaacaactttgcgtgcgatgtgcgggaaaagtggctcagcaagaccgagctcatcgggctcccacctgagtttagtatcggcagaatactggacaagaatcagagagcctcactgcactccgctatacgccagaagttcccattcctcgtcactgttggcaagaatagtgaaatcgtagtgaaacccaacctcgagtacaaggaattgtgccacctcgtgtctgaagaggaggccttcgactttttcaagtatctagacgcgaaaaaagaaaatagtaagtttacttttaagccggacaccaataaagaccataggaaggcggtgcaccacttcgtaaacaaaaaattcggcaacctcgtcgagaccaagtccttttctaaaatgaattgttctgcaggaaatcccaacgtggtcgtcaccgtgagatttcgggagaaagcccacaagcgaggaaagcggcctctcagtgagtgtcaggagggtaaggtgatttataccgccttcactttacggaaggagaacctggaaatgttcgaggccataggattcctcgccataaaattgggcgtgataccttctgattttagctacgccggtcttaaagataaaaaggccattacgtaccaggctatggtggtgagaaaggttactcccgaaagactgaagaatattgagaaggagatctag

SEQ ID NO: 59150 - DNA, 912 bp, Artificial Sequence
  Description of Artificial Sequence: Synthetic coding sequence
atgtcaagcgcccctgcctccggatccgtcagagccaggtatttggtatatttccagtacgtcggaaccgattttaatggcgtggcagccgttaggggcacacagcgggctgtcggcgtccagaattatcttgaggaagcggcagagcggcttaacagcgtcgagcccgtacggttcaccatatcctcccggactgatgccggagtgcatgcactgagcaacgccgcacacctcgacgtgcagagaagaagcggtaggcctccattcccaccggaggttcttgccgaagcgttgaatacacacctaaggcatcccgctattagagtcctgcgagccttcagggttccatccgactttcatgccaggcacgcggcaaccagcagaacgtatctttatcggctggcaaccggttgtcacaggagagacgagctgcccgtttttgaaagaaatctgtgttggactctgccggcagattgcctggacatggtcgcgatgcaagaagccgcacagcatctcctcggaacgcatgatttcagtgctttccaaagcgccggttcgccagtaccttcgcccgtgagaactctacggcgagtgtccgtctcccccggacaagcttctccactcgtgacaccagaggagtctcgaaagctacgattttggaacctcgagttcgagagccagtctttcctgtacaggcaggttcgcaggatgactgccgtgttggtggctgtgggcctaggcgcacttgccccagcgcaggtgaaaactatcctggaaagccaggaccctttaggtaagcaccagactagggttgctcctgctcatggcctgtttctcaagagcgttctgtatggaaatttgggtgcagcgtcatgtactctgcagggaccccagttcggtagtcacggctag

SEQ ID NO: 59151 - DNA, 216 bp, Artificial Sequence
  Description of Artificial Sequence: Synthetic coding sequence
atgggtgcaacagggttagggttcttactgtcgtggcggcaggacaacttgaacggaactgactgccagggctgcaatatcctgtattttagcgaaaccaccggctccatgtgttccgaactcagtctgaaccggggtctggaggctcggagaaaaaaggatctcaaggactccttcttgtggcgagatggtgtgtctccctgcctcccatgctag

SEQ ID NO: 59152 - DNA, 444 bp, Artificial Sequence
  Description of Artificial Sequence: Synthetic coding sequence
atgggagcaacaggattggggttcctgctctcatggaggcaggataatttgaacggcactgactgccagggctgcaatatcctgtatttctccgaaacgaccggctccatgtgcagtgaactcagtctaaacagagggctggaggcgagaagaaagaaagacctgaaagactcgtttctctggaggtatggaaaagtggggtgtatcagccttccactgagagaaatgacagcttggattaaccctccccagatttcagagatatttcagggttaccaccagcgggtccacggtgctgatgcgctgtccctgcagactaactccttaaggtcccgcctttcctcccagtgtctcggccagtccttcttgctgcggacgctggaaagaggtcgtggattccgggctctaggcgacatctgtggccacgtccatgaagaggactag

SEQ ID NO: 59153 - DNA, 444 bp, Artificial Sequence
  Description of Artificial Sequence: Synthetic coding sequence
atgggcgcaaccggcctaggcttcctgttatcctggcggcaggataatctgaacggcacagattgccagggatgcaatattttatacttctctgaaactacagggtctatgtgctccgaattgtctctaaaccgcggactcgaagccaggcggaaaaaggaccttaaggattcgttcctttggagatacgggaaagtgggctgcatcagcctgcccctgcgggagatgactgcatggattaatcccccacagataagcgagattttccaagggtaccatcagcgcgttcacggagcagacgctctttcactgcagaccaactcactgcggtcgcggctaagcagccagtgcctaggtcagagcttcttgctccgaaccctggagcgaggtagggggtttagagctttaggtgatatatgtggtcacgtgcatgaggaggattag

SEQ ID NO: 59154 - DNA, 216 bp, Artificial Sequence
  Description of Artificial Sequence: Synthetic coding sequence
atgggcgcaacagggctgggttttctcctttcctggagacaggataatttaaatggaacagactgccaaggatgtaatatcctgtattttagcgaaactacggggagcatgtgctcagagttatctttgaaccgcggactcgaggctagacgcaagaaagacttaaaggatagcttcctgtggcgcgacggagtgagtccttgcctcccatgctag

SEQ ID NO: 59155 - DNA, 2202 bp, Artificial Sequence
  Description of Artificial Sequence: Synthetic coding sequence
atggggaaactaattacccgaatgtggaaattacttcggaggcggagcgccccaaaggagctactgtcccgcacatctcttgagacccaaaagcttgacctaatgactgaggtgtcagagttgaagttgaagctcgttgggatggagaaggagcagagagagcaggaggaaaagcagaggaaagcggaggaactcctccaggaattgcgtcacctcaagattaaggtggaggaattagagaacgagaggaatcagtatgagtggaagctgaaagctactaaggccgaagttgcccaacttcaggaacaggtcgctttgaaggacgctgaaatcgagagactgcattctcagctcagccgcactgccgctctccactctgagagccatacagaacgagaccaggagattcagcgcctgaagatgggtatggagactctgctgctcgccaacgaggataaggatcggcgaattgaagaattgacgggactgcttaaccagtatagaaaagtcaaagagatcgtgatggtcacacagggaccctcagagcgaaccctgtcaatcaacgaggaagagccagaaggagggtttagtaaatggaacgctactaacaaagaccccgaggagttattcaagcaggaaatgcccccacggtgcagttcacctacagtagggccacctccactaccacagaaatcactcgagacccgtgcccagaaaaagttatcatgtagcctggaggatctgaggtcagaaagcgttgataaatgcatggatgggaatcaacctttcccagtgcttgagccgaaagactcccctttcctcgctgagcataagtacccaaccttacccggaaaactaagcggagctacgcccaacggggaggccgctaagtcacccccaactatttgtcagcccgatgcaaccgggagcagtttgctccgcctacgagatactgaaagtggttgggacgatactgctgttgttaacgatctatcatctacatcaagcggcaccgaaagtgggcctcagtcccctctcacacccgacggaaagcgcaatcctaagggaataaaaaaattctgggggaagattcgccgaacgcagagcgggaatttttacacggatactctgggaatggctgagtttcgccgtggcggattgagagcaactgccggacctcgcctcagtcgcacacgggactctaaagggcagaaatcagacgctaatgcaccctttgctcaatggtccaccgagagggtgtgcgcctggttagaggatttcgggctggctcagtatgtcatcttcgcccgtcaatgggtttccagcggccatacactcctcactgccaccccacaggacatggagaaggagctcggcataaaacatcccctgcaccggaagaagctggtcctagcggtcaaggccatcaataccaagcaggaggaaaaaagtgcactgttagaccacatatgggtcacccggtggcttgatgacatcggattgcctcagtataaggatcaatttcacgaaagcagggttgacagacggatgctgcaatatctcactgtgaacgatctattgtttctcaaagtgacttcgcagttacatcacctgagcatcaaatgtgcaatacacgtattgcatgtaaacaagttcaatccccactgcctgcaccgccgacctgctgatgaatccaatctaagcccttctgaggtcgtgcagtggtccaatcatagagtaatggaatggcttcgttccgtagatctcgccgagtatgcccctaatttaagaggctcaggagtacacggcggactcattattctcgagcctcgattcactggagacaccctcgccatgttgttgaatattcctcctcaaaaaacacttcttagaaggcacttgaccacaaagtttaatgctctaatcggtccggaggcggaacaggaaaaacgagaaaagatggcttctcccgcatatacgcctctgacaaccacagcaaaggtgcggcctcggaagctgggttttagtcactttggaaatatcagaaaaaaaaaattcgacgaatcaacagactacatctgcccaatggagcccagcgacggagtcagcgacagccaccgggtatattctggttaccgcggactctctccgctggatgctcccgaactggatgggttagaccaggtggggcaaatcagctag

SEQ ID NO: 59156 - DNA, 2157 bp, Artificial Sequence
  Description of Artificial Sequence: Synthetic coding sequence
atgctgcaacaggagttactaagcaggacttccctcgagacccaaaagctggatttgatgacagaagtgagtgaacttaaattaaagctggtggggatggagaaagagcagagagaacaggaggaaaagcaacgtaaagctgaagagctgctgcaggaactgcgccatctcaagatcaaggttgaagagttagaaaatgaacgcaaccaatatgagtggaaattgaaggccaccaaagcggaagtagctcaactacaggagcaggttgcccttaaagatgccgaaattgaacggttacactcacagctcagccgaacagcggcattgcactccgaatcccatactgagcgcgaccaggagatccaacggctgaaaatgggcatggaaactctgctacttgccaacgaagacaaggataggcgcatcgaagagttaaccggcctgctaaatcagtataggaaggtcaaggagatcgtcatggttacccagggaccctcagagagaacgctgagtataaacgaggaagaacctgagggcggattttcgaagtggaacgccactaataaagatccggaggagctttttaagcaagagatgccccctcgatgtagttcacccacagtgggaccacctccactgccccagaagtctttggagactcgagcccagaaaaaactgagctgctccttagaagaccttaggtccgaaagtgtggacaagtgcatggatggaaatcagcctttccccgtgctagaacctaaagactcgccgttccttgccgaacataagtatccgaccctccccggtaagctaagcggcgcaactcccaacggagaagccgcaaagagccctccaaccatttgccaaccagacgcaacaggtagcagcctgctgcgtctcagagataccgagagcggctgggacgatacagccgtggttaacgatctgagtagcacaagttctggaactgaatctggccctcagtctcccctcacaccagacgggaagcgaaaccctaagggtattaaaaaattctggggcaagatacgacggactcagtccggaaatttctatacagacacgctcggcatggccgaatttagaaggggaggcctgagagctacggctgggcctcgcttatcccggacgagagactcgaagggccagaaaagtgacgcgaatgccccattcgcccagtggagtactgagcgagtttgcgcctggctggaagacttcggtcttgctcagtacgtgatattcgctcgacagtgggtaagtagcggtcacacactgctcactgccacaccccaggacatggaaaaagaactgggaatcaaacacccattgcatcgtaaaaagttagtccttgccgtgaaagccataaacaccaagcaggaagaaaagtcagccctgcttgatcacatctgggtcacacggtggcttgatgatatcggcttgccccagtataaagaccaatttcacgaaagcagagtcgaccgtaggatgttgcagtatctgaccgtgaacgatctgctgtttctaaaagtcacttcccagttgcaccacctttcaatcaaatgtgccattcatgttctgcacgtgaacaagtttaatccccattgtctacacagaaggcccgcagacgaaagtaatctgtcccccagcgaggtggtacagtggtctaaccaccgcgtcatggagtggctacgctctgttgatctcgcagagtatgccccaaacctgcgaggaagcggcgtgcacgggggtctgatcattctagagccgcgtttcaccggagatacactggctatgctgcttaacattcccccacagaaaactttattacgcaggcacctaaccacaaagttcaatgccttgattggccctgaggccgagcaagagaaacgggagaaaatggctagccctgcttacacacctttaaccactacagcaaaggtcagaccgagaaagttggggtttagccactttggaaacatccgcaagaagaagtttgatgaaagcaccgattatatatgtcccatggagccctcggatggggtgtctgattctcatcgtgtgtactccggctatcggggattgtcacccctcgatgcccctgagctcgacggcctggaccaggtcggccagatctcatag

SEQ ID NO: 59157 - DNA, 2631 bp, Artificial Sequence
  Description of Artificial Sequence: Synthetic coding sequence
atggcctccgacgcctcgcatgccctggaggcggcacttgagcagatggatggcattatcgctggaactaaaaccggtgcggacctgtctgatggtacttgtgaacccggactcgcttcacctgcaagctatatgaaccctttccctgtgctgcacctgattgaggacctgcgtttggcgctcgaaatgctggaactgccacaggagcgcgcagcccttctgagccagattcctggaccaacagccgcttacataaaagagtggttcgaggaaagtctctctcaggtcaaccaccactccgccgcatctaatgagacttaccaggagcgactggcacgcttagagggtgataaggagtccctcatccttcaagtatccgtcctgactgaccaggttgaggcccagggcgagaaaatcagagacctcgaggtctgtctggagggccaccaggtgaagctgaatgctgcggaggagatgctgcagcaagagctgctaagtcggactagccttgagacacagaaactagacctgatgacggaagtcagtgaactgaaactgaagctcgtgggcatggagaaggagcagagagagcaagaagaaaaacagcgcaaagccgaggaactgcttcaggagctgagacacctcaagatcaaagtggaggagctcgaaaacgaaagaaatcaatacgagtggaaactgaaggcaaccaaagcagaagtagcacagctgcaggagcaggtggcccttaaagacgcagagattgaacggctgcattcacagctctctcgaactgccgctttgcattccgaaagccacaccgaaagggatcaggagatccagagactcaagatgggaatggagaccttgcttctggccaatgaagataaagacagacggattgaggaactcactggactgctgaatcagtaccgaaaagtcaaggagatagttatggtcacccagggaccctctgaacggacactttccattaatgaggaagaacccgagggaggattctcgaagtggaatgcaactaataaggacccggaagagctgtttaaacaggaaatgcctccccgttgctcatctccaaccgtaggtccacccccactacctcagaagagtttggagacacgggctcagaaaaagttgtcatgcagccttgaggaccttaggagcgaatcggtagacaaatgcatggacggtaatcagccatttcctgtgctggagcctaaggatagccccttccttgccgagcataaataccctaccctgcctggcaagcttagcggcgcaactcccaatggcgaagcggcaaaatctcccccaaccatttgccaacccgatgctaccgggagttcattactgaggctgcgagatacagaatctgggtgggatgacaccgccgtggtgaatgacctgtcttctacttcatcaggcaccgagtctggaccccagtcacctttgacgcctgacgggaagcggaacccaaaggggatcaaaaaattttggggcaaaatccgacgaacccagtctggaaatttctatactgacactctcggcatggctgaattccggagaggaggactgagggcaactgccggacctcgactgtctaggacaagagacagtaagggacaaaaaagcgatgcgaatgccccatttgcgcagtggagtacagagcgggtgtgcgcatggcttgaggacttcggactggcccagtatgttatcttcgctcgccaatgggtgagctcaggacataccctcctgacggcgacgccccaggacatggagaaggaactcgggatcaaacacccactgcataggaagaaactggtccttgcggttaaggcaatcaacaccaagcaagaggagaagtcagctctcctggaccatatctgggtgactagatggctggacgacattggcctcccccagtacaaggaccagttccatgagtctcgggtggacaggagaatgctccaatacctcacagtgaatgacctgttgtttctgaaggtcacatcccagctccatcatctgtcgatcaaatgtgccattcatgtcctgcacgtgaacaaatttaacccacactgtctgcacagaaggcctgcggacgagtcaaatctttcaccaagcgaagttgtacaatggtccaaccaccgagtgatggaatggttaaggtcagtcgacctggcagaatacgccccaaatctccggggtagcggcgttcacgggggtttaatcattctcgagccaagatttaccggtgacaccctggccatgttgttgaacatcccaccccagaaaacacttctgcggaggcacttgacaactaaattcaacgcgctgataggtcctgaggccgaacaggaaaagcgggaaaagatggccagtcctgcctatacccctctgaccaccacagcaaaggtgcggcctagaaaactggggtttagtcattttggcaacatacgtaagaagaaattcgacgaatctaccgattacatatgcccaatggaaccgagcgatggggtctctgactctcacagagtgtatagcggctatagagggctgagcccactggacgctcctgagcttgatgggctggatcaggtgggacagatttcctag

SEQ ID NO: 59158 - DNA, 213 bp, Artificial Sequence
  Description of Artificial Sequence: Synthetic coding sequence
atggccagcgatgcgagccatgccttggaagcagcattggaacaaatggacgggatcattgccggaactaaaacaggagcagacctctcagacggtacatgcgagccaggtctggcatcacctgcatcctacatgaatcccttccctgtgctgcacctgatcgaggatctgcgactggctctggagatgctggagctgccccaggagcgctag

SEQ ID NO: 59159 - DNA, 270 bp, Artificial Sequence
  Description of Artificial Sequence: Synthetic coding sequence
atggcttcagacgcaagccatgcgcttgaagctgcactggaacagatggacggaattatcgccggtacgaagacaggcgctgacctgagcgatggcacatgcgaacctgggctggcctcccccgcttcatacatgaatccgtttcccgtcttgcacctaattgaggatctcagattagccttagagatgctcgagttgccgcaggaacgggcagccctgttaagccagatacctggaccaactgccgcttatatcaaagagtggttctag

SEQ ID NO: 59160 - DNA, 513 bp, Artificial Sequence
  Description of Artificial Sequence: Synthetic coding sequence
atggccagcgacgccagtcatgcactggaggctgcgttggagcagatggacggcatcatcgccggaacgaaaaccggagctgacttatctgatggcacttgtgaacctggcctggcgtccccggctagttatatgaacccgttccccgtgttgcatctcatagaagaccttcggctcgccctcgagatgcttgaactcccccaggaaagagctgccctgcttagtcagattcctggtccaacggcagcctatatcaaagaatggtttgaggagtccctttcccaggtcaatcatcactccgccgcatccaatgaaacttatcaggagcggctggcgaggttggagggagataaagagagcctgattctccaggtctccgtgctgaccgaccaggtggaggctcagggtgaaaagattcgtgaccttgaagtgtgtttggagggacaccaggttaaacttaatgctgccgaagagatgctgcagcaagaacttctgtctagaacatccctgtag

SEQ ID NO: 59161 - DNA, 270 bp, Artificial Sequence
  Description of Artificial Sequence: Synthetic coding sequence
atggcgtccgatgcgtcccatgcgctggaggccgcattagagcagatggacggaattatcgcaggcaccaagaccggcgcagacctgtccgatggaacatgcgagccagggttggctagccctgcttcttatatgaatcccttccctgtcctacatcttattgaggacctgcgcctggccctggagatgctcgagctcccccaagagcgggcagccttactttcccaaataccaggaccaacggctgcgtatatcaaagagtggttttag

SEQ ID NO: 59162 - DNA, 654 bp, Artificial Sequence
  Description of Artificial Sequence: Synthetic coding sequence
atgctccagtacctgacagtcaatgacctgctctttctgaaggttacctcccaactacaccacctgtcgatcaagtgtgccattcatgtgttacatgtgaataaatttaatcctcattgtctgcacagaagacccgctgacgagtctaacctgagcccatccgaggtggtgcaatggtcaaaccatcgggtgatggaatggcttcgttccgtggacctggccgaatatgctcccaatttacgcggatccggagtccatggcggactgatcatccttgagcctcgcttcaccggagacaccctcgccatgctgttaaatataccaccccagaaaacacttctgaggcggcacctcactacaaagttcaatgcacttattggccctgaggctgagcaggagaagcgtgagaaaatggcatcccccgcttacactcccctgaccacaactgcgaaggtgcgcccaagaaaactgggcttctcgcatttcgggaacatcagaaagaagaagttcgatgagtccacagactatatttgcccaatggagccatccgacggggtttcagactcccatagggtctactcggggtacaggggcttatcaccactcgacgctcctgagctggatggcctagatcaagttggccagatctcttag

SEQ ID NO: 59163 - DNA, 1203 bp, Artificial Sequence
  Description of Artificial Sequence: Synthetic coding sequence
atgctacagcaagagctgctctcacgcacctccctagagacccagaagcttgacctgatgacagaggtgtccgagttaaagctcaaactagtaggtatggagaaagagcagagagagcaggaagaaaaacagaggaaggccgaggaactcttacaagagctgaggcacctgaaaataaaggtagaagaactcgagaatgagcgcaatcaatacgagtggaaactgaaggcaaccaaagcagaagtagcgcagctgcaggagcaggtggcgctgaaagacgccgaaattgagcgcctgcattctcagttgtctcgtaccgctgccttgcattccgaatcgcatacagagcgcgatcaggagatccagcgcctcaagatgggtatggagactcttctcttagctaacgaggataaggaccgacgcatcgaggaactcaccggcctgctcaatcagtacaggaaggttaaagagatagtgatggttacccaaggcccttcggagcggacactatccataaacgaggaagagccagaaggaggcttctcaaaatggaacgccacaaataaggatccagaagagcttttcaaacaagagatgccaccacgctgttcttcacctaccgtgggtcctccacctttgcctcagaagtccttggagacgagggctcagaagaagctctcctgcagcctagaggacctgagaagtgagagtgtggacaagtgtatggacggtaatcagcccttcccagtcctggaaccaaaggactccccatttctggccgagcataaatatcctactcttcctggtaaactttctggggcaacacctaacggggaggccgctaagtccccgccaacgatctgccagccagacgcaactgggagctcccttctgcggctgagagacaccgagagcggttgggatgatacagccgttgttaacgacctctcttccacatcatctggtacagagtcaggcccacaatctcccttaactcccgatggcaaaagaaatccaaagggaattaagaagttttgggggaagatccggagaactcagagcggcaacttctacactgacaccctgggaatggcggaatttcgcagaggagggctgcgcgctaccgctggtcctcggcttagtcgcactcgcgacagcaagggccagggactgcaatggctccctgggcctcaacccccttag

SEQ ID NO: 59164 - DNA, 2277 bp, Artificial Sequence
  Description of Artificial Sequence: Synthetic coding sequence
atggatggcgatatcgatgtctacaaacactttagctggctgaagagaagccaggtcaaccaccactccgccgcaagcaacgagacttatcaggagcgactcgctaggctcgagggagataaggagagtttgattttgcaggtctccgtgttaaccgaccaggtcgaggcccaaggggaaaagataagagacctcgaggtgtgtctcgagggtcaccaggtgaagctaaacgctgctgaggaaatgctgcagcaagaactcctctcccggacgtctctggaaacgcagaagctcgatctgatgaccgaagtaagcgaactgaaactgaaactcgtgggcatggagaaagagcagcgcgaacaagaggagaaacaaagaaaggctgaggagctgctccaggagctgcgacatctcaaaatcaaagttgaggaactggaaaatgagagaaaccagtacgagtggaaactcaaggccacgaaggccgaggtggctcagcttcaggagcaggtagcactgaaggacgcagagattgagcgtttacatagccaactgtctagaacagccgctcttcacagtgagagccacacagagcgggaccaggagatacagagattgaagatgggcatggagactctgttattggcaaacgaagataaggaccgacgcattgaggagttaacaggtctacttaaccagtaccgcaaagtgaaggaaatagttatggtgacgcaaggccctagcgagcgcacactgtctattaacgaggaggagcctgaaggcggattctcaaagtggaacgctaccaacaaggaccctgaggaactcttcaagcaggagatgcctccaaggtgcagctctccgacggtagggcctcccccactcccacaaaagagcttagagacgagggcccaaaagaaattgagctgctctcttgaagatctgcgctccgaatctgtcgataagtgtatggatgggaatcagccattcccggtcctagagcccaaggattctccattcctggcagaacacaagtaccccacactgcccggtaaactctcaggagcaacacctaatggggaggctgcaaagtctccccctaccatttgtcagccagacgcaactggatcaagtctgttgcgcctcagagacacagagtccggttgggatgatactgcagtcgttaacgatctgtcctctactagcagcggtacagaatccggaccacagtcccccttaactcctgacggcaagaggaatcctaaaggaattaagaaattttggggcaaaatccgccgtacacaatccgggaatttctacactgacactcttggaatggctgagtttcggaggggcggtctcagagccaccgccggacccagactgtcacgaactcgagatagtaagggacagaagtcagacgctaacgccccttttgcacagtggagcacagagcgtgtgtgcgcctggctcgaggacttcggcttagcccagtacgtgatctttgccaggcaatgggttagctcaggtcatacgttgttaacagctacgccacaggatatggagaaagagctgggaatcaagcacccactccaccgcaaaaagctcgtgttggccgtgaaggcgatcaatacgaagcaagaagaaaaatccgctctcctggaccacatttgggtcactagatggctggatgacatcgggctccctcaatacaaggatcagttccacgagagtagggtggatagacgcatgttgcagtacctcaccgttaacgatctcctgtttttaaaagtcacatcccagctccatcatctcagtatcaagtgtgccatccacgtacttcatgtcaacaagtttaatccccactgcctgcacaggcgcccagccgatgagtccaacctttcgccctctgaggtggttcagtggagtaatcatagagtcatggagtggcttcgtagtgtagatctggccgaatatgccccaaatctgcgcggaagtggagtgcatggaggtcttatcattctagagccaagattcactggtgacacacttgccatgcttttgaacatacccccacaaaagaccctgctgaggaggcacctaacgaccaaatttaacgccttaattggtccagaggcagagcaggaaaaacgtgaaaagatggctagtcctgcatacacaccactaacgactaggtgggaccgcctggctgacgcgcttgtgacatgtccactgtgcacattaagggcacactcaaataccgtttgcgttaccatctag

SEQ ID NO: 59165 - DNA, 411 bp, Artificial Sequence
  Description of Artificial Sequence: Synthetic coding sequence
atgatggaccaagaagaaaagactgaagaaggttccggaccgtgcgccgaggccggtagcccggaccaggagggtttctttaacctcctctctcacgtccagggtgacaggatggagggacagcggtgttcgctccaagcgggtccagggcagacaactaaatcgcaatcagacccgacccctgagatggattcccttatggacatgctggcttcgacgcagggcagaagaatggatgatcagagggtcaccgtctccagcctgccgggattccaacctgtgggttctaaggacggggcacagaaacgagccggaacgcttagcccacagccacttctaaccccacaggatccgactgcactgggcttccgcaggaactcctctccacagccacccacgcaggccccttag

SEQ ID NO: 59166 - DNA, 207 bp, Artificial Sequence
  Description of Artificial Sequence: Synthetic coding sequence
atgtccgaactcaataccaaaacctccccagcaactaaccaagccgctggccaggaagaaaagggtaaagcaggaaatgtgaaaaaggcagaggaggaggaagaaatcgatattgaccttacggcgccagagactgaaaaagcagcactagccatccaggggaagtttagacggtttcagaaaaggaaaaaggacccatcgagctag

SEQ ID NO: 59167 - DNA, 1437 bp, Artificial Sequence
  Description of Artificial Sequence: Synthetic coding sequence
atgtggctggccgcagccgctccatccctcgcaagacggctcctcttccttggcccaccccctccccctttgctgctgctcgttttcagcagatcctcacgacggcgattacatagtctggggctggcagctatgcccgaaaagcgcccattcgaacgccttcccgcagatgttagtccaataaactgtagtctgtgtctgaagcctgatctcttagactttacatttgagggcaagcttgaggcagctgcccaggttagacaggctactaaccaaattgtaatgaactgcgcggacatcgacataattacagcctcctacgcaccagagggcgacgaagagatacacgcgacagggttcaattatcagaacgaagatgagaaagtgaccttgagctttcccagcaccctgcagactggcaccgggaccctgaaaatcgatttcgttggcgagcttaatgacaaaatgaaaggcttttatagaagcaagtacaccaccccaagcggcgaagtgaggtacgccgcagttacccagtttgaagccacagacgctaggagagcctttccctgttgggacgaacctgccatcaaagcaaccttcgacatctcgctagttgtgcccaaggatcgcgtggcactcagtaacatgaacgtcatcgaccgaaagccttatccagatgacgagaacctggtcgaggtgaaattcgccagaacacctgttaccagcacgtacctcgtggcctttgtcgtaggcgaatacgactttgtggaaaccagaagcaaggacggtgtgtgcgtctgcgtgtatacacctgtgggaaaagccgaacaggggaagttcgccattgaggtggccgcaaagaccttgcccttctacaaagattacttcaacgtcccctaccctcttcccaagatcgatctgatcgcgatcgccgacttcgctgcgggtgccatggaaaattgggaccttgttacatatagagagacggctttattgatagacccaaagaactcctgctcctcatcccgccagtgggtcgcattagtggtggggcatgagctggcccaccagtggtttggcaacttggttacaatggagtggtggacacatctttggttgaacgaagggttcgccagctggattgaatacctgtgtgtcgatcattgcttcccagaatatgacatctggacgcagttcgtttctgctgattacacccgcgctcaggaactggacgccctggataatagtcatcccattgaagtaagtgtggggcatcctagcgaggtcgacgagatttttgacgctataagttacagtaagggggcaagcgtgatcaggatgctgcacgactatattggggataaggacttcaaaaaaggaatgaacatgtacttaacaaagttccaacaaaaaaacgccgctgccggaaatctgtag

SEQ ID NO: 59168 - DNA, 975 bp, Artificial Sequence
  Description of Artificial Sequence: Synthetic coding sequence
atgaagggtttctatcggtctaagtacaccacaccttcaggggaagtacgatacgccgctgtgacccagttcgaagcaaccgacgcccgtcgcgctttcccctgctgggacgaacccgcaatcaaagcgacgttcgacatttcactcgtcgtgcctaaggatcgggtagctctgtccaacatgaacgttattgatagaaagccgtaccccgacgacgaaaacctggtcgaggtgaaatttgcccgaactcccgtcacgtctacttatctggtggccttcgtggtgggggagtacgacttcgtggagactcgtagtaaggacggagtgtgtgtgtgcgtgtataccccagtaggaaaggcagaacaagggaagtttgcaatcgaggtcgcggctaaaactctgcccttttataaggactatttcaacgtgccctaccctttacccaagatcgatctcatcgccattgccgacttcgccgcaggagcaatggaaaattgggatctcgtaacgtatagagaaacagccttactgatagaccccaaaaactcctgttcttcaagcaggcaatgggtggcactggtggtcgggcacgagctggcacatcaatggttcggaaacctggtcactatggaatggtggacgcatctgtggctaaatgaaggattcgcatcctggattgaatacctgtgtgttgatcactgcttccccgagtatgatatctggactcagtttgtcagcgccgattacacacgtgcgcaagaacttgatgctctggacaacagtcacccaatagaggtgagtgtcgggcacccaagtgaagttgacgagatttttgacgctattagttatagtaaaggggctagcgtcatcaggatgttgcacgactacataggtgataaggattttaaaaaagggatgaacatgtacctgaccaaattccagcagaagaatgctgctgcaggatggacgtggtag

SEQ ID NO: 59169 - DNA, 729 bp, Artificial Sequence
  Description of Artificial Sequence: Synthetic coding sequence
ttggtgaaaaccgccaagctgggaacctcatggaattacctattcgatttccatccacatcgtgttctggtagttggggcttttgccaatttctgtaccgagcccactggctgctcttgcttgttccccaagcttccccctcacctgctcatgctaccatgttggttccaccttttattctttcaggattatatcatgtccggagcttcagcgttacctcctggcttagtgtcattcgtcaaggcacccctcccacagtggtggccaggcggttgtcccggagtgggaggtcctctgcaggcactggaggcaaaaccgggacagctgtccctgcccatccgaaatcagaagagactcgtgaagtcggctcttgagctgggggaaaatgagctgttccaacagtttccaaatccgcaatcctcctgggtccagcgtacgcaagaagctctccgcccactgttgagcgtcgcacttcaacttttcctggggcgacgcggtctgcctctgccctttcgggctcccattaggactgtcgtggggagcgcgatacccgtgcagcagtcacctcctccaagtccagcccaggtagacactctgcaggcacggtatgtcgggagactgacgcaattgttcgaggagcatcaggccaggtacggcgtgccagccgaccggcacctggtccttactgaggccagacccaccgcgtggccccgattatctgcgggatag

SEQ ID NO: 59170 - DNA, 1419 bp, Artificial Sequence
  Description of Artificial Sequence: Synthetic coding sequence
atggcagggggtgaggccggagtgaccttaggtcaaccccatttgtcacggcaagacctaacaactttggacgtgacgaaattaaccccgttaagccacgaggtgatctctcgccaggcaacaattaatattgggacaatcggacacgttgcgcacggaaaatctaccgtggtcaaagctattagtggggtgcacaccgtgaggttcaaaaacgagctcgaaaggaatatcaccatcaagctggggtatgcaaatgcaaagatttaccagctggatgatccatcctgccctagacccgagtgctaccgctcatgtggatctagtatgcctgacgagttcccaaccgatatccctggaactaaaggtaacttcagactcgtgcggcatgtaagttttgtagactgccccggacatgacatcctgatggccacaatgctgaacggcgcagccgtgatggacgcagccctgctgcttatcgccggtaacgaatcttgcccccagccccagacatctgaacatttagcagccatcgaaattatgaaactgaaacacatattaatcctgcagaacaagatagatcttgtcaaagagcgccaggccaaagagcagtatgagcaaatattggccttcgtgcagggaaccgtggccgaaggggctccaatcatcccaatctcagcgcaactgaaatataacatcgaggttgtatgcgagtatatcgtgaaaaagatccctgttcctcctagggatttcacaagcgaacctcggctgatagtgatcagatcttttgatgtcaacaagccagggtgcgaagtcgacgacctcaagggaggagtggcaggcggatccatactgaaaggggtgctgaaggtgggtcaagagaccgaagtgagaccaggcatagtgagcaaggattctgaagggaagctcatgtgtaagagcatctttagcaaaatagtcagtctcttcgcagaacacaatgatctgcaatacgccgctccaggtggcctcatcggagtgggtactaagattgatccaactctgtgtcgcgcagaccgcatggttgggcagattctgggcgcagttggcgctctcccagagatattcaccgaactggagatctcttacttcctgttacgcagactgctgggcgtccggactgagggagataagaaggcggcaaaggtccagaagctgtccaaaaatgaggtactcatggtgaatataggtagtctatccaccggagggagagtctccgctgtgaaggccgacctgggcaagatagtccttactaatcctgtatgtaccgaagtcggggagaagattgctctaagccgtcgggtggagaaacactggcggctgatcggttggggccagattcggaggggagttacaatcaagcctactgtcgatgacgattag

SEQ ID NO: 59171 - DNA, 543 bp, Artificial Sequence
  Description of Artificial Sequence: Synthetic coding sequence
atggaggaggcgggactctgcggactgagagagaaggcagacatgctttgcaattcagaaagccatgacatattgcagcaccaggacagtaactgctcggctactagcaataaacatctcttagaggatgaagagggaagggactttatcacaaagaatcgctcttgggtcagccccgtgcattgcacacaggagtcccggcgagaactgccagagcaggaggtcgcccctccaagtgggcagcaggccctgcagcagcaggagcagcggaaatccctgaggaaacggtcgttcatcatcgacgcgagcccaaaacattttcgcctgcaacgccgttcctggcaactgagtgtgagaaacatgttgatcctggagatacatttattttacagaagagtgtgctttgagctgtacgatctcaagcagaacagcttctttggagactacggaaatattctcaatcgagaaactctcctggattttgtgaagcaaattatggaaaaaatacaaaacttcctgaaaaaccacgggaagtttctgtag

SEQ ID NO: 59172 - DNA, 396 bp, Artificial Sequence
  Description of Artificial Sequence: Synthetic coding sequence
atggaagaggccggattgtgcggactgagagagaaggccgatatgttgtgcaattcagaaagccatgatatcctccagcaccaagatagcaactgcagtgctacatccaataaacacctgctcgaggatgaggaaggacgggactttatcaccaagaacagatcctgggtttcccccgtgcactgtacacaagaatcaaggagggaattacctgaacaagaagtggccccacccagtggtcagcaggctctacaatgcaatcgaaacaaagagaaggtgttgggtaaagaggtgctcctcttgatgcaggcgctgaacaccctgagtacaccggaggagaagttagcagccctttgcaagaagtacgccgatctcggcaacagtcctctgctgtag

SEQ ID NO: 59173 - DNA, 423 bp, Artificial Sequence
  Description of Artificial Sequence: Synthetic coding sequence
atggaagaagcgggtctctgtggtcttcgtgagaaggctgatatgctgtgcaattccgagtctcatgacattctccagcaccaggacagtaattgttctgccacaagtaataagcacttattggaggatgaggaaggccgagactttatcacaaagaacaggagctgggtgagccctgtccactgcacccaagagagccgcagggaacttccggaacaagaggtggcccctccatccgggcagcaggctttacagtgcaaccgaaacaaggaaaaagtactcggaaataatttatgctctgttgtggggtgttgccatattctcgtctttctcttttatatcttttgtagcatgtctgactacgagctaggattgtttggcggtaagtgctgcctggtgaatttatttctccatttagtgtag

SEQ ID NO: 59174 - DNA, 513 bp, Artificial Sequence
  Description of Artificial Sequence: Synthetic coding sequence
tgaaccagttggcggcgtggggaagtcacaccccgtcggggatccggtgggggtgctaaaactattggtgccaaacagggcagaacacagttatccagcggcttcgttaactccactatggaggaggcagggctgtgtggcctccgggagaaggccgacatgttatgcaactctgagagccacgatatcttgcagcaccaggattccaactgtagcgccacttcgaacaaacatctactggaagatgaagagggcagagacttcatcaccaagaaccgaagctgggtctcacccgtgcattgtacacaggagtctagacgagaactgcccgagcaggaagtggcgcctcctagtggccagcaggccctgcagtgcaatcgaaacaaggaaaaggtgctcggaaaagaagtgctcctattgatgcaggcattaaatacgctctccactcccgaggagaaactggccgcactgtgcaagaaatacgccgacctggggaactccccattactgtag

SEQ ID NO: 59175 - DNA, 396 bp, Artificial Sequence
  Description of Artificial Sequence: Synthetic coding sequence
atggaagaggcaggtctgtgtggtctgcgcgaaaaagccgatatgctttgtaactctgaatcccatgatatactgcagcaccaggactccaactgttctgctacatccaataagcacctgctggaggatgaggagggacgggattttattacaaaaaacagatcctgggtctcccccgtgcactgtacccaggaatcacggagggagctccctgagcaagaggtcgcacctcctagcggacagcaagctctacagtgcaacagaaacaaggagaaggtcttagaacggcagggcttgagcctgtcccctcgcttggaaaggggtggaacctttatgggtcacgggagcctcaagctgcccgaactggtcatactgtccctgcagacgctcgagtag

SEQ ID NO: 59176 - DNA, 546 bp, Artificial Sequence
  Description of Artificial Sequence: Synthetic coding sequence
atgaagcaggaagaggcacagctcaaggaacagttattcctttatatggataagtttgaggaattccagacgaccatggctaagacaaatgagctgttcacggcctttaagcaggaaacagaaaagctaaccaaaaaaattaaaaagctcgagaaagagatggtgatttggtataccaaatgggaaaataacaataccaccttattgcagatggcagaggagaaaaccattagagacaagaattacaaagtctttcagatcaagctggagcgcttagagaagctgtacaaagcactccagatcgagcgcaacgagctcagcgagaaactgggcatcctgaagggtcaggtgtctgtcaaggtcgcggacgtagacctggctgttccggtcacgcacagctgtgctgatctggattcatcaaatatgctcaataccagttcgaaacgcgctcccggagtgcacttagaggctgatccaaagggaatgaatgaggtgaaatgctactccaaggcactgtctacgggtagccccttaggcatcgactag

SEQ ID NO: 59177 - DNA, 546 bp, Artificial Sequence
  Description of Artificial Sequence: Synthetic coding sequence
atgaaacaggaagaagcacagctcaaggaacagctattcctgtatatggacaaatttgaggagttccagaccactatggcgaagacaaacgagctgtttaccgcttttaaacaagaaaccgagaagctgacgaagaagattaaaaagctggagaaagagatggtgatctggtatacgaaatgggagaataataacaccaccctcctgcagatggccgaggaaaaaactataagagataagaattataaggtttttcaaataaagttagagaggctggaaaagttgtataaagctttgcagatcgagaggaatgaactgagcgagaagctcggaattctgaaaggacaagtaagtgtaaaggtggccgacgtggacctcgccgtgccggtcacccattcttgcgcagatttggattccagcaatatgctcaacacatctagtaagcgggctcctggagtccacctggaagcggacccgaaggggatgaacgaagttaaatgctactcaaaggcactttctactggatcgcccctgggtatcgattag

SEQ ID NO: 59178 - DNA, 792 bp, Artificial Sequence
  Description of Artificial Sequence: Synthetic coding sequence
atggaccgggcaaagcagcagcaagccttgctgctcctgccagtctgtttggccctaacattctctctgactgccgtggtatcatctcactggtgcgagggtacacgcagagtggtaaagccactttgtcaggaccagcctggcggtcagcactgtattcatttcaaacgagacaattctagtaacggaaggatggataacaattcgcaggcagtgctgtatatctgggaacttggggacgacaagtttatacaacggggtttccacgtgggactgtggcagtcatgcgaagaatcactcaatggcgaagatgaaaagtgcaggtctttccggtcggttgtgcctgccgaggaacagggcgtgctttggctctccatcggaggggaggtgttagatattgtccttattctgactagcgcaatcttgctgggcagtcgcgtctcttgccggagtcccggattccattggctgcgggtggatgccctcgttgccatttttatggtcttggcaggactactgggaatggtggcccacatgatgtatacaactatttttcagatcactgtcaacctcggccctgaagactggaagcctcagacttgggactacggttggtcatactgtctggcgtgggggtcatttgccctgtgcttagcagtatcggtgtcggctatgagccgtttcactgccgcacgcctcgaattcactgagaaacagcaggcgcagaatggttcccgccactcccaacatagctttcttgaacccgaagcctctgaaagcatatggaagtag

SEQ ID NO: 59179 - DNA, 888 bp, Artificial Sequence
  Description of Artificial Sequence: Synthetic coding sequence
atggctgaagaaactcagcataataagcttgctgctgccaaaaagaaattgaaagaatattggcaaaagaaccggcctcgcgtgcctgccggagtcaatagaaacaggaagaccaacgggtccattcccgagaccgcaacctctggaggctgccagcccccaggcgattccgccacagggttccatcgggagggccctacatccagcgccactctgaaggacctggagtcaccatgccaagagcgcgctgtagttctcgacagcacttccgtcaagatatctcgcctcaagaatacaattaagtcattgatctgtacgctcaaaaaagaaaaacagcaggacatgcggagagtggaagaactggagcgctctctgtcgaagctcaaaaaccagatggcggaacctcttcccccagagccccctgcagttccttccgaggtcgagctgcagcacttgcgcaaggagctggaaagggtggccggtgagttacagtctcaagtgaagaacaatcaacatatctccctgctcaataggcgacaagaagagcggattagggaacaggaggaaaggctgcgtaagcaagaagagcgacttcaggagcagcacgagaagcttagacagcttgcaaaaccccaaagcgtgttcgaggagctgaataacgaaaacaaatcaacattacagcttgaacagcaagtcaaggaactgcaggagaagttgggagaagtgaaagagacagagacctccaccccatccaagaaggggtgggaagctggatcaagcttactgggcggagaggtgcccggacagcggcagctaccagcgtggggactagtgacaaccgccccaagaagggcggtgctccggcttttcctggcgtcatgcctgtag

SEQ ID NO: 59180 - DNA, 888 bp, Artificial Sequence
  Description of Artificial Sequence: Synthetic coding sequence
atggcggaagaaactcagcacaataagttagcggcagctaagaaaaagctgaaagaatattggcagaagaacagacctagggtgcctgccggagtcaaccgcaataggaagacgaacggaagtattcctgaaacggctacaagtggcggatgccagccacctggtgactcagccaccgggttccatcgggaaggacctacaagctcggctacactgaaagacctagagtccccatgtcaggagagagccgtcgtgctggatagcacaagtgtgaaaatttctaggttgaagaacactatcaagagtctgatttgcacactgaaaaaggagaagcagcaggacatgaggcgggtcgaggaactggaaaggagcctgtcgaagctgaagaatcagatggccgagcctttacctccagagcctcccgctgtgccaagtgaggtggagcttcaacatctcaggaaggagctggagcgggtcgcgggtgagctgcaatcgcaggtaaagaataaccaacacatatcactgctgaacaggaggcaagaagaacggatccgcgaacaggaagagcgcctgcgaaaacaggaagagaggcttcaagagcaacatgagaaactcagacagctcgcaaaaccccagagtgtgttcgaagaactcaacaatgaaaacaaatccacactccaactcgagcagcaggtcaaggaacttcaagaaaaactgggggaggtgaaggagacagagacttctacccctagcaagaagggatgggaggccggaagttccctccttgggggtgaggtgcctgggcaaaggcaactgccagcctggggactggtgaccaccgctccaaggcgtgcagtgctccgcctgtttctggcctcctgtctctag

SEQ ID NO: 59181 - DNA, 720 bp, Artificial Sequence
  Description of Artificial Sequence: Synthetic coding sequence
tcagccacaggcttccacagggaagggccaacatcttctgcaacgctcaaggatctcgagagcccatgccaggaaagagcagtggtgcttgacagtaccagtgtgaagattagccgcctgaaaaacacaataaaatccctgatctgtacgctcaaaaaagagaagcagcaggatatgagaagggtggaagagctggagcgctctctgtccaagttgaagaaccagatggctgaacctttgccgccagaacccccagctgtcccctctgaggtggagttgcaacatctgcggaaggagctagaacgagtggctggtgagctgcagtcacaggtgaagaacaaccagcatatctctcttctgaatcggcgacaggaagagcggatccgggaacaagaggaacgcctgaggaagcaggaagagaggctgcaggaacagcatgagaaactgaggcaactcgccaagccccagtcggtattcgaagagctcaacaacgagaacaaatcaaccctccagctagaacagcaagtgaaagagctgcaggagaagttaggggaagtcaaggagactgagacatccacccccagcaagaagggctgggaggccggatcatcgctgctgggcggagaggtcccgggacagcgacagctgcctgcgtggggcctggtgaccacagcacctaggcgagccgtactcaggctcttccttgcctcatgtctgtag

SEQ ID NO: 59182 - DNA, 1899 bp, Artificial Sequence
  Description of Artificial Sequence: Synthetic coding sequence
atggctgaggaaacacagcataacaaattagcggctgcgaaaaagaagctcaaagaatattggcagaagaatcgcccacgcgtgcctgccggagtgaacaggaatcggaagactaacggctcaatccctgaaaccgccaccagcggcggatgtcaacctcctggagattcagcgactggtttccaccgcgagggcccaacgtcaagtgctacactgaaggacctggagagtccttgccaggaacgagctgttgtccttgacagcacctctgtgaagattagccgccttaagaataccatcaaaagcttgaagcagcagaaaaagcaggtggaacatcagttggaggaggagaagaaagcaaacaacgaacggcagaaagctgagcgggagttggaggtacaaatccaaacgctaataatccaaaaagaagagctcaacactgatctttaccacatggagcggagcttgcgatattttgaagaggaaagcaaagacctagctgtccgcctgcagcattccctgcagtgtaaaggcgagctggagtccgcgctcagcgccgtgattgcgactgaaaaaaaaaaagccaaccagctctccagctgtagcaaggcccacacggagtgggagctggaacagtctttgcaggatcaggccttactgaaagctcagctgacccagctcaaggagagtttccagcaactgcagttggaaagagacgaatgtgcagaacacatagaaggggagcgagcgcgttggcatcagcggatgagcaaaatgtcacaggagatctgcacactgaaaaaagagaagcagcaggacatgcggcgtgtggaggaactagaacgctccttgtccaaattaaagaaccagatggccgagcctttaccccctgaaccaccagccgtgcctagtgaagtcgagctgcagcatctgaggaaggaactcgagcgagtcgcaggagagctccagtctcaagtgaaaaacaaccagcacatctctctgctgaaccgaagacaagaggaacgaattcgggagcaggaggagcgcctgaggaagcaggaggaacggctgcaggagcagcatgagaagttgagacagctggcaaagccacagagtgtgtttgaagagctgaataacgagaataaatctaccctgcagctggagcagcaagtgaaagagcttcaagagaagctgggagaggaacatctggaggcagcaagccagcaaaatcagcagctgactgcacagctcagccttatggctctccccggagaaggtcacggcggagaacatcttgactccgaaggcgaggaggcacctcaacctatgcccagtgtacccgaagacctggaaagtcgagaagccatgagcagctttatggatcatctgaaagaaaaagcagacttaagcgagctggtcaaaaaacaggagctgcgcttcattcaatactggcaagagagatgccatcagaagattcatcacctcctcagtgagcccggtgggagagccaaggacgctgccctgggtggcggacatcaccaggcaggagcccaggggggagacgagggcgaagcggctggtgccgctgctgatggtattgcggcttattctaattacaataacgggcatcggaaatttctagcagccgcacataattccgctgatgagccaggtcccggtgcacctgctccccaggaactcggagccgcagataagcatggcgatctgcgagaggtaaccctcacctcctctgcccagggcgaagcgagagaggatcctcttctggacaaacctactgcccagccgatagtccaagatcaccaggagcacccgggactgggatcaaattgctgtgtgccactgttttgttgggcctggctccctaggaggcgcagatag

SEQ ID NO: 59183 - DNA, 1899 bp, Artificial Sequence
  Description of Artificial Sequence: Synthetic coding sequence
atggcagaagaaacccaacataataaactggcggctgcaaagaagaagctaaaggaatattggcagaagaacaggccccgtgtgccggcaggggtgaacagaaacaggaaaaccaatgggtccatacccgaaacagctaccagcggtgggtgtcagccgcctggcgactctgcgactggatttcaccgggagggacctacctcaagtgccacactcaaggacctcgaaagcccttgccaggagcgggcagtggttctcgactcaacgagtgtaaaaatttccagactaaagaacaccatcaagagtctgaagcagcagaagaagcaagtggagcatcagttggaggaggagaaaaaggccaacaatgaacgccagaaagctgaacgagaacttgaggtacagatacagactctgattatccaaaaagaggaactcaacacggatctgtatcacatggagagatccctaagatacttcgaagaggaatccaaggacctggcagtgcgtctccagcattcgctgcagtgtaagggtgagttagagtcggcgctgtccgccgtcatagcaaccgagaaaaagaaggcaaaccagttatctagttgttcaaaggcccacacagagtgggaactcgagcagtcactccaggaccaggccctcctgaaggcacaattaactcaattgaaagagtcattccagcaactgcaactggagcgcgacgagtgtgctgagcacatcgaaggcgaacgagccaggtggcatcaacgaatgtcgaagatgagtcaggagatttgcacactcaagaaggaaaagcagcaggatatgcggagggtcgaggagcttgagagatccctgagcaagttaaagaaccagatggccgaaccactgccaccagagcctccagctgtgccttctgaagttgagctacagcacttgcgaaaagagctcgaaagagtggcaggcgaattgcaaagccaggtaaaaaataaccagcacatatctctgttgaacaggcgacaggaagaacgaatacgtgagcaggaggaacggctcaggaagcaggaagaacggttgcaggagcaacacgagaagctcagacagctagcgaagccccagtcggtttttgaagagttaaataatgagaacaagtctactctgcaactggagcagcaggtgaaagagcttcaagagaaactcggcgaagagcatctggaggcggcatctcagcagaaccagcaactgactgcgcagctgagcctgatggcccttcctggagagggtcacggaggcgagcatttggactccgaaggggaggaagctcctagacctatgccctcagtgccggaagaccctgaaagccgggaggccatgtctagctttatggatcatctgaaggagaaggccgaccttagtgagttagtcaagaagcaagagctcaggtttatccagtactggcaggagagatgtcatcaaaagatccatcacttactgagcgaacccggaggacgcgctaaggatgcagccctcgggggtggccaccaccaagcaggggcacaaggcggtgatgaaggcgaggcagccggagccgctgccgatggaatcgcggcttacagcaactacaataatggccatagaaaatttctagccgctgctcacaattctgctgacgagcctggacctggagcacccgcacctcaagagctaggtgctgctgacaagcacggggacttacgggaagtgacgttgaccagtagcgcccaaggtgaagcgcgagaggacccactgctggacaagcctacggcacaacccattgtacaggatcatcaggagcacccagggctcggcagcaactgctgcgtcccactcttttgttgggcatggctccccaggagacgacggtag

SEQ ID NO: 59184 - DNA, 690 bp, Artificial Sequence
  Description of Artificial Sequence: Synthetic coding sequence
atggatatggggacttcagccctgagcaagaagccttggtggacactgccccagaactttcatgctcctatggtgtttcatatggaagaggaccaagaggaactgattttcggtcatggcgacacttatctgcgatgtatcgaagtgcactcacacacactcatccagcttgagagctggttcacagctacaggacagacgcgtgtgacggtggtgggcccacaccgagcccgacagtggctgctccacatgttctgctgcgtggggagccaggattcctatcatcatgctaggggaggatctactgcttggccctgggaaagggtcctgagtgctcgctcaaggggcggaccctgccctaagacttttattctgcagtggtgcagtacttggaagcgaacaaggcggtctagcagcagtgacctgatgacgcgcacattcgccgctttgtcttgcactgccacgcccttgttctcttggtgtttcacagccaccggacagactcgtgtgactgttgttggcccacctatggctaaacagtggttgctgctgatgtttcactgcgtcgggagccaggatagcaagtgtcacgctcgaggccttaagatgctggagcgagtgagaagccagcctctcaccaacgatgatctcgttaccagtgtgagtcttcccccttacacgggggactag

SEQ ID NO: 59185 - DNA, 492 bp, Artificial Sequence
  Description of Artificial Sequence: Synthetic coding sequence
atgagttcctgtcctgtccatgactgcccttcgtgggatcccgagcgccttgagcccgtcgaaacaggctcccgcggtgcacttagactaagggggggtgcacctggctcagctgccggatttcgagcttctatctggggcccagctggatacccaagtcctgtggggctgggccatccagcgagcctcccgagaccagcatatagcccccgttgccccgagccagacgctcgtcacggttggggttcaggcagtaacgccggttatcggggaccagatcgcgcaggaacaccttgccctgctcaggaccgcgagggacggtcaagcagtcctgtgcctcctcccagacttaaggctatgacatcacaggccaggaagcaaaacggcggtgccctcattgacacagtggactggacccgcgaagcaccagatagtgacccggtcatgagcatgcagaagactcaaaaaccccagactactgtgggccagtag

SEQ ID NO: 59186 - DNA, 591 bp, Artificial Sequence
  Description of Artificial Sequence: Synthetic coding sequence
atggatcatgaggctgcgcaactggaaaagcagcacgtgcacaatgtgtacgagagcaccgctccttacttcagcgacctccagtcaaaggcctggccacgcgtgcgtcaatttctccaagagcaaaagcccggttccctgatagcagacatcggctgcggcactgggaaatacctgaaagtcaacagccaggtgcacactgtcggctgtgactattgcggacctctagtcgaaattgccagaaaccggggatgtgaagccatgggactggaacacccttggatctggtacccaagagcatcgtggaatcagccacccacggacatcgagggccctcagtacttttatccaccgtgccatccaatacctgatcttcaaaaacagacgattatctgccatttcaaaggtcctacacttaatgaacaacaaaagtcctctccaactcaccacaggctccacgcttgttttcagcactgtagagaagaggaatctagaccgtggcttatggctctgagttcttgggaccaggttgccatggaaggccacgtcagcgcatccctgacaagttgcatcgtgagacttctgctgtag

SEQ ID NO: 59187 - DNA, 1365 bp, Artificial Sequence
  Description of Artificial Sequence: Synthetic coding sequence
atggatcatgaagctgcacagctggagaagcagcacgtgcacaacgtgtatgagtcgacagcaccctacttttcggatctccagagcaaggcctggccacgagtgaggcagtttctgcaggaacagaaacctggctcccttatcgcggatatcggctgcggaacaggtaagtacctcaaggtgaactcccaggtgcatacagtcggatgcgattactgcggacccctcgtggaaatcgccagaaatcggggttgcgaggccatggtgtgcgataatctgaatctgccattccgggacgaggggttcgacgcgatcatatcaattggcgtgatccatcacttcagcactaaacagcgtcgcatcagagcgatcaaggagatggccagggtattggtaccgggagggcagttgatgatctacgtctgggcaatggagcagaaaaatcggcacttcgaaaagcaggatgtgctagtcccttggaaccgggctctgtgtagtcagctgttcagcgagagttcccagtcaggtagaaaacgccagtgtggctatcccgaaagaggccatccttaccatccaccatgctccgaatgctcctgttctgtatgcttcaaagagcagtgcggttcaaagcgaagccactctgtggggtacgagcctgcaatggctcggacgtgcttcgccaatatatccaaagaaggagaagaagagtacggtttctacagcaccctgggcaagagtttccgatcctggttctttagtcgctcactggacgagtccaccctcaggaaacaaattgaaagagtccgacctctgaagaatacagaggtgtgggcttccagtactgtcactgtccagccatctaggcactcttctctggactttgatcatcaagagccattcagcaccaaaggtcagagcctggacgaggaggtatttgtggagtcatctagcgggaagcacctggagtggctccgggctcctggcactctcaaacacttgaacggggaccatcagggggaaatgcgccgaaacggcggtggcaatttccttgattctacaaataccggagtgaattgtgtcgacgccggaaacattgaagatgataacccctctgcatctaaaatcttgcgcagaatttccgccgtggacagcacggactttaacccagatgatacaatgagtgtcgaggacccccaaacggatgtgctggacagtactgcatttatgcggtactaccacgtgtttcgcgaaggtgagctgtgtagcctgctcaaagaaaacgtgtctgagctgagaatactgtcatcagggaacgaccacggcaattggtgcatcattgctgagaaaaagcggggatgtgactag

SEQ ID NO: 59188 - DNA, 1104 bp, Artificial Sequence
  Description of Artificial Sequence: Synthetic coding sequence
atggtgtgtgacaatttaaacctgccgttcagagatgaagggtttgatgctatcatcagtatcggagttattcatcacttcagcacaaagcaaaggcgcatacgagctattaaggaaatggctcgggtccttgtcccgggaggccaactgatgatatatgtttgggctatggagcaaaaaaaccgtcactttgaaaagcaagacgtgcttgtaccgtggaatcgggctctttgttcacaactgttctcagaatcttcccagtcggggaggaaacggcagtgtggctaccctgagagagggcacccttaccacccaccatgctcagagtgtagctgctccgtgtgcttcaaggaacagtgcgggagtaaaaggagtcactcagtcggctatgaacccgcaatggctagaacttgctttgcaaatatttctaaagaaggggaggaagaatacggcttctactcgactttgggtaaatcctttcggtcctggttcttctctcgttcactggatgagtctactctgaggaaacaaattgagagagttcggcctctgaaaaacacagaggtgtgggcaagctccactgtgacggttcagccctcaagacacagttccttggacttcgatcaccaggaacccttctctaccaaaggacagtccctggacgaggaggtgtttgtggagagctcatcgggtaagcacttggagtggctccgggcacctggcacattgaaacaccttaatggagatcatcagggcgagatgcgtagaaatggcggaggtaatttcctcgactcgacaaatactggagttaactgcgtggacgccggtaacattgaagatgacaacccatctgcttccaaaattctgaggaggattagcgcggtcgactctacggacttcaacccagacgacaccatgtccgtggaagatccccaaaccgacgtgctggattccacagcattcatgcgatactaccacgtcttcagggaaggtgagctgtgtagccttctcaaggaaaatgtgagtgaactgagaattctgtcgtccggtaacgaccacggtaactggtgcatcatagccgagaaaaagagggggtgcgactag

SEQ ID NO: 59189 - DNA, 2547 bp, Artificial Sequence
  Description of Artificial Sequence: Synthetic coding sequence
atggtaaaattgagtattgtactgactccgcagttcctgagtcatgaccaaggccaactcaccaaggagcttcagcagcatgttaagtccgttacctgtccgtgtgagtatctgcgcaaagtaatcaacacactggccgatcaccatcaccggggaaccgactttggcggatcgccttggctgcacgtaattatcgctttccctaccagttacaaggtggtcattactttatggatcgtctacctgtgggtatcccttctgaaaaccatattttggtcaaggaacggccacgacgggtccactgatgtacagcaaagagcgtggcggtcaaaccggagacgacaggaaggtcttagatccatctgtatgcacactaagaagagagtctctagtttccgcggaaacaagatcgtcctgaaggacgtgataacattacggaggcacgttgaaaccaaagtgagggcaaagatacggaagcggaaagtcacgaccaaaattaaccatcatgacaagatcaacggcaagaggaagactgccaggaagcaaaaaatgttccaaagagcccaggaactgagacggagagcagaggactatcacaaatgcaagattcccccttctgccagaaaggctttatgcaactgggtgcgcatggctgctgccgaacacagacattccagcggtctgccatattggccatatctgaccgcagagaccttaaagaacagaatgggacaccagccaccccctcctacgcaacagcattctatcacagacaactccctgtcacttaagactcctccagaatgtcttcttacacctcttccgccttctgctgatgacaacctcaagacaccccctgaatgtgtgttgactcctctaccaccttctgctgatgataacctgaagacgccacctgagtgcctgctgaccccacttcccccttcagccctgccttctgctccccctagtgccgatgataacctcaaaacccgcgctgaatgtctgcttcatccccttccacccagtgcagatgacaatctcaagactccttccgagaggcagctgacaccactgcctccctccgccccaccatcggcagatgataatatcaaaacacccgcattccaccctcagagaatgattatttcaaggcatctaccctccgtctccagccttccgttccaccctcaactgcacccccagcagatgatcattagcagacatctgcctagcgtgtgcggcggtagatttcatcctcagaggatgatcatcagcaggcatttgccatcggtgtctagccttccctttcaccctcaactccacccccagcagatgattatctcgcggcatttaccctcagtgtgtggcggaagattccatcctcagcggatgattatctctaggcacctcccgtcagtctcctccctccctttccaccctcagctgcacccacagcagatgattatatcccgacatctgccatcggtctgcggaggcagatttcacccacagcgcatgattatcagcagacacctaccttccgtctcttctctaccctttcatccccagctccacccacaacagatgatcatcagccggcacctgcccagcgtgtgcggtggacgattccatcctcagcgcatgatcatctcccgccatctgcctagcgttagttctttacctttccatcctcagcttcaccctcagcaaatgattatcagtcgacacctgccatctgtgtgcggcggacgattccacccacagcggatgatcatcagccggcatctcccaagcgtttcttccctgccatttcacacccagctgcacccccagcagatgattatttcccgtcatctccccagcgtgtgtggcgagcggttgagaggaccattgcctccatctgcagatgataacctgaaaacaccctcagaacggcagctcacgccccttcctcccagcgccccaccctcagccgatgacaatattaagacccctgccgaacgcctgcgcggtcccctgccgcctagcgcagacgataatctcaaaactccttcagagcgacaactgacgccattgcccccttctgctcccccatcggccgacgacaatatcaagacccccgcagagcgccttcggggtccactaccgccttctgccgacgacaacctaaagacacccccattagcaacccaggaggcagaggctgagaagcctcgtaaacccaagcggcagagggctgccgaaatggaaccaccaccggagcccaaacgccgaagagtgggagatgtggaaccgagtcgcaaaccaaagcgaaggcgggctgcagatgttgagccctcgagcccagagccaaagagacggcgtgtgggcgacgtggagcccagtcgcaagccaaaacgccgaagggcggctgacgtggagcccagttcacctgaaccaaagagacggagggttggagatgtggagcctagcaggaagcctaaacgccgtcgcgcagctgacgtcgaacccagcctgccagagcccaaaagacggaggttgagttag

SEQ ID NO: 59190 - DNA, 3417 bp, Artificial Sequence
  Description of Artificial Sequence: Synthetic coding sequence
atggtgaaactttctatcgtcttgacaccccagtttttgtctcacgatcaaggtcagcttactaaggagctccagcaacacgtgaagagtgtaacgtgtccttgcgagtatctgaggaaggtgattaacacgctcgcagatcaccaccacaggggcacagatttcggcggttcaccgtggctgcacgtcataatcgcctttcccacttcatacaaggtggtcatcaccctgtggatcgtatacctgtgggtatctctactcaagactattttctggtcccgtaacggccacgatgggagcaccgacgtgcagcaacgcgcttggcgatcgaatcgcagacgtcaggaaggactgaggtctatttgcatgcacaccaagaagcgtgtgagttccttccggggaaataaaattgtattaaaagatgtgataactcttcgccgacacgtggaaacaaaagtgcgcgctaagatccgtaagaggaaagtaactaccaaaatcaatcaccatgataagattaacggaaagcggaaaacggcacgtaagcagaaaatgttccagagggcccaggagttacgtagacgagcagaagactaccataagtgcaaaatccctccttctgctagaaaggctctatgtaattgggtcaggatggcagcagctgagcacagacacagctcgggccttccgtactggccttacctcactgcagagacccttaaaaaccggatgggacatcaaccccctcccccaacacaacagcactccatcaccgataatagcttgtctctcaaaaccccgcctgagtgtttgctgactcccctcccgccatccgctgacgataacctgaaaacccctcccgaatgcgtccttacccctttacccccttctgccgatgacaacctgaaaaccccgccagagtgcgtgttgacaccactcccaccctctgccgacgataatctgaagaccccacctgagtgcttgttgacacctttgcccccaagcgctgatgacaagttaaagacgcctcccgaatgtctgttgacccccctaccccctagcgccttgccatcagccccaccctctgccgacgacaatcttaaaacacgagcagagtgtctgctacatcccctacccccttccgcagacgacaatctgaaaacgcccagtgaacggcaacttacaccactcccccctagcgccccacccagcgcagatgataacataaaaacacccgcagagcggttaagagggcctctgccacctagcgcggatgataatctcaaaactccaagcgaaagacagctgacgcctcttcctcccagcgcacccccatctgccgacgacaatataaagactcctgctgaaaggcttagggggccacttcctccatctgctgacgataaccttaagaccccttctgaaagacagcttacccccctgcctccctcagccccaccgtcagccgatgacaacatcaagactcccgctgaacggctgagaggccctttgcctcccagcgctgatgacaacctcaagaccccctctgaaagacaattgactcccctgccaccgagcgcccctccctctgcagatgataacatcaagacaccggcagaaaggctgcgcggacctctgcccccatccgccgacgacaacctgaaaacgccctctgagcggcaactcacacctctgccaccttcagctccaccatcggcagacgataacatcaagacccccgctgaaaggctgcgtgggcctctgcctcccagcgctgacgataatctcaagacaccctcagaaagacaattaacacccctgcctccctcggcacctccctcagcagatgacaatatcaagacccctgctttccatcctcagaggatgatcattagccgacacttgccttccgtctctagcctaccgttccatccccagcttcaccctcagcagatgataatctctcgataccttcttagtgtgtgtggatttaggttccatcatcagcctatgattatctcacgccatcttccatctgtttctagcctacccttccacccacagttgcaccctcagcagatgattatcagtagacacttgccaagtgtatgtggaggacgtttccacccgcaacgcatgattatatcgagacacctgccttctgtgtcttctctgcctttccaccctcagcttcaccctcagcaaatgatcattagtcgccacttgccaagcgtgtgtggaggacgttttcacccacagcgcatgataatctccagacatctacccagtgtgagcagcctgccatttcaccctcagttacatccccagcagatgattatcagcagacacttgcctagcgtgtgcggagggagatttcatccacagagaatgatcatctctaggcacctcccaagcgtatcatccctgccgtttcacccgcaattgcacccccagcagatgataatatcccgccacctgccctctgtatgtggagggagatttcatccacagcggatgataatatcacgacacttgccaagcgttagctctttgccttttcatccacagctgcacccacaacaaatgattatctcacgtcacctgccatcggtgtgcggggagaggttaagagggccactgcccccaagtgccgatgataacctaaaaacaccgtccgaacgccagcttaccccgctgcctccttcagccccaccgagtgccgatgataatattaaaaccccagctgagagactcagaggacccctacctccaagcgccgatgacaatctgaaaacgccctccgagaggcagctcacacctctccctccctcagcaccaccatctgcagacgacaacattaagacacctgctgagagactgcgcggacccttacctccgtccgcagacgataatctgaagaccccctcagaaaggcagttaacacccctcccaccaagtgccccaccaagcgccgacgataatatcaagacgcccgctgaaagattgcgtggccctctgcccccttccgccgacgataatcttaaaaccccgcctctggccactcaagaggctgaagctgagaagcccagaaagccgaagaggcagagggccgctgaaatggaacctccccctgaacccaagaggcgccgtgtcggcgatgtcgagccaagcaggaagcccaagagaagaagggccgcagacgtggaaccctctagcccagaacctaaaaggcgcagggttggcgatgtagaaccttcccgaaagccgaaacgcaggagggcagcagatgtcgaaccatcttccccagaaccaaagcgccgacgcgtgggtgacgtagagccaagccggaagcctaagagacggagagccgcagatgttgagcctagcctgcccgaaccaaagcggagacgcttatcatag

SEQ ID NO: 59191 - DNA, 2979 bp, Artificial Sequence
  Description of Artificial Sequence: Synthetic coding sequence
atgttccagcgcgctcaggaactccgacgtagagcagaagactaccacaagtgcaagatcccgccatccgctcgcaaggccttgtgcaattgggtgagaatggctgcagcagagcatcgccactccagcggtctgccctactggccttacttaaccgctgagacattaaagaatcggatggggcaccagcccccacccccaacgcagcagcattcaattaccgataattccctttctctgaaaacgccccctgagtgcttattgacacccctacctcctagtgcagatgacaatttaaagaccccccctgaatgcgtgctgacccccttgcccccatcagcagacgataatctgaaaacacctccggaatgcgtcctaaccccgcttcctccgtcagccgacgacaatctaaaaacccctcctgaatgcctattgacccctctacctccatccgccgacgacaaactcaagacgcctccggaatgtctgctgactccattaccaccgtcggccctcccttcagcccctccctcggccgatgataacctgaaaacacgcgcagagtgcttactgcaccctctccccccatctgccgacgataacctcaagaccccttccgagagacaactgaccccgctgcccccttctgcccctccatccgcagacgacaacattaagacccctgccgagcgtctgagagggcctcttccaccatcagccgatgacaatctaaagacgccttctgagcgtcagctgacacccctgcctccaagcgccccacctagcgctgacgacaatatcaagactcctgcagaacgtcttagaggacctctgcctccatcagccgacgacaacctgaagacaccaagcgaacgtcagctgactcctttgcccccaagcgcgcctccttccgccgatgacaacattaaaacgcctgcggaacgtctccgtggaccgttgccccctagcgccgatgacaatctcaagacgcctagcgaacgtcagcttacgccactgcctcccagtgctcccccttcggctgatgataacatcaagactcccgctgaaaggctccgagggccacttcctccttctgctgacgataatctgaaaactccttcagaaaggcagctcacacccctgccccctagcgctcccccttctgccgatgataatattaagactccagcagaacggcttcggggacccctccctccgtcagcagacgacaacctgaaaacaccaagcgaacgtcaacttaccccgctgccaccctcagcccctccctcagcagatgataatataaaaatacccgctgaaaggctgcgtatccctttacccccatcagccgacgataacctcaagacaccatccgaacggcagctcactcccctgcctccatcagctcccccttccgctgacgataacatcaagaccccggctttccatccacaacgaatgataatttctaggcacttgccaagtgtaagctcactgcccttccaccctcagttacatccacaacagatgattatatcccgccacctaccctccgtgtgtggcggtcggttccatccacagaggatgattatcagcagacacctgcctagtgtgagctctctgccgtttcacccacagcttcacccgcagcagatgattatctctagacacttaccatccgtgtgcgggggtcgctttcaccctcagcgcatgataatttcaaggcatttaccaagcgtgagctctctccccttccacacccagctccacccgcagcagatgatcatctctcggcacctgcctagcgtttgtggcggaagattccatccccagagaatgatcatctcaaggcaccttccatccgtctcgagcctgccctttcatccccaacttcacccccagcaaatgatcattagtcgtcaccttccatccgtatgtggagggaggttccatccccagcgcatgataataagtcggcatctgcccagcgtgtctagtttgccattccaccctcagctccacccgcagcaaatgatcatatctagacacctcccatctgtctgcggccctctccccccttctgcggatgataacctgaagactccctcagaacggcagcttacgccattgcccccttccgcgccaccctctgccgacgataatattaagacccctgctgagaggctcaggggacctctgccgcctagtgccgatgacaacctcaaaactcccagtgaaaggcagctcactcccttaccaccgagcgcccctccctctgcggatgataacattaaaacacccgcagagcgtctcaggggacccctgccaccttctgccgatgacaatctgaagacgccctccgaacgccaactgaccccactcccgccatcagcgcctccttccgccgatgacaatataaagactccagctgagcgcttgcgagggcctctccccccttctgctgatgataacttgaaaaccccaagcgagcggcagctgaccccgctccccccttcagcacccccatcagctgacgataatataaaaacccccgctgaaagactgaggggccctcttccacctagtgctgacgataatctgaaaaccccgcctctggcaacacaggaagctgaagcggagaagccgaggaagcccaagaggcagagagcagctgagatggaaccaccccctgaaccgaagcggaggcgcgttggggatgtcgagccctctagaaagccaaagcggaggcgggcagccgacgtggaaccttcctcacctgagcctaagagacggagagtcggagacgtggaaccaagccggaagccgaaaaggcggagagctgcagacgtggaaccctcctccccagagcctaagcggagacgagtcggcgacgtcgaaccctctcggaagcccaagaggaggcgagccgctgatgttgaaccctctttgccagaaccgaagagacgtcgtttgtcttag

SEQ ID NO: 59192 - DNA, 1263 bp, Artificial Sequence
  Description of Artificial Sequence: Synthetic coding sequence
atggcagctgcagaacacagacactcatcaggactcccctactggccttatttaaccgcagagacactgaagaatcgaatgggtcaccagccaccgccaccaacccaacaacattccatcacagacaatagcttaagcctcaagacgcctcccgaatgtcttctaacgcctctgcctccctcagctgacgacaatctcaagacccctcccgagtgtgtcctgacccccttgcctccctcagcagacgacaatctgaagacaccacccgaatgcgtgctgacaccgctgcctccaagcgcagatgataacctgaaaacacccccagagtgcctgttgacacctcttccacctagcgccgatgataaactgaaaacaccccctgaatgtttgctcactcccctacctccctccgccttaccctccgccccaccgagcgccgacgataatctgaagacacgggctgaatgtctgctgcatccgttgcccccttccgcagacgataacctgaagacacctagtgagaggcagctaaccccccttcctccttctgcccctccaagcgccgacgacaacataaaaacccccgctgaacgtctacgtgggccactgccccctagtgcggacgataacttgaagacccccagcgagagacagctgacccctcttcctcctagtgcaccaccctctgctgatgataatataaagacacccgctgaaagattgcgcggaccattgccaccctcggccgacgacaatttaaaaacaccaagtgagaggcagcttacgcccctgccacctagcgctccaccttccgccgatgacaacataaagacccctgcggaacgcttgcgaggcccactgcctccatccgccgatgacaatctgaaaactcctccacttgccacccaggaagctgaggccgagaaaccgaggaaaccaaaacgtcagagagccgctgagatggagcccccacctgagccaaagaggcgcagggtgggggacgtagagccatccaggaaaccaaagcgacggagggccgctgacgtcgagccatcatcaccggagccgaaaagaagacgggtgggcgacgtggagcctagcagaaaaccaaagcgcagacgcgctgccgacgtagagccgagttcgccagagccgaaacgtcgtcgtgtgggggatgtggagccctctcgaaaacctaagcgaaggcgagccgctgacgtcgaaccttcgttgcccgaaccaaagagaagaagactttcctag

SEQ ID NO: 59193 - DNA, 1986 bp, Artificial Sequence
  Description of Artificial Sequence: Synthetic coding sequence
atgtttcagagagcgcaagaacttcggagaagagctgaagattaccacaaatgcaagattcctccaagcgccagaaaagctctgtgtaactgggtgcgcatggcagccgctgaacaccgccatagcagtggattaccctactggccatacctgactgccgaaacactgaagaaccgtatgggccatcagccccctcctccgactcagcagcatagtataactgacaactcgttgtctctgaagacaccaccagagtgcgtgctcactcccctccctccctccgccgatgacaatctgaagacccctcccgagtgcgtcctgaccccccttcctccttccgctgatgacaatctgaaaactccacctgagtgtttgctgacacctctccctccaagtgccgacgacaacctaaagacccctccagaatgcttgctgacacccctgccccctagcgctgacgataacctgaagacgccacccgaatgtctgctgaccccactgcctccctccgctcccccttccgctccaccgtccgcagacgataatctgaagacccgggctgagtgcctcctgcaccccttgcctccgtctgccgacgataacctcaagacaccttctgagcgccagcttaccccattgcctccaagcgcccctccttctgccgatgacaacatcaagacccccgcttttcacccacagcggatgatcatcagtcgtcatttaccttccgtgtctagtttgcctttccatcctcaacttcactctcagcaaatgatcatttccagataccttctaagtgtctgtggctttaggtttcaccatcaacctatgatcatttcccgccacctccccagtgtatccagtctacccttccatccccagttgcacccacagcagatgattatttcccgccacttgccctcggtttgcgggggaaggttccacccccaaaggatgatcatatcaaggcatctcccatccgtatcttccctgcccttccatccacagttgcaccctcagcaaatgattatatcgaggcatctccctagcgtctgtggtggacggtttcatccccagcggatgatcatctctcggcatctgccctctgtcagcagtctaccatttcacccacagctgcaccctcagcagatgatcatctcaagacacctgccttcagtgtgcgggggtaggttccatccacagagaatgatcatctcaagacacctgccttccgtaagctcactcccgtttcacccgcagctgcaccctcagcagatgatcatcagcaggcaccttccatccgtttgtggagggagattccatccccaacgtatgatcatctctcgacatctccccagcgtttcttccctgcctttccacccacagctgcacccccagcaaatgataattagcaggcatctaccaagtgtgtgtggggagcgtctgcgaggccctctgcccccatctgccgatgataatctgaagacaccttccgaaagacagctcaccccattgccacctagcgcccctccaagtgcagatgataacattaagacacctgctgaaaggttacgcggacctttaccgcctagtgctgacgataacctgaagaccccccctcttgctacacaggaagctgaagcagagaagccacgcaagcccaagaggcagcgcgcagcagaaatggagccccctcccgagcccaaaaggagacgcgttggggacgtcgagcccagccgcaaaccaaagagacggcgtgcagcagatgtggaaccctcctcacccaagcccaagcgccgacgggtaggcgatgtcgagccaagccgaaagcccaagaggaggcgggctgctgatgtagagccctcatctcccgagcctaagcgcagacgcgtcggggacgtcgaaccgtctagaaagccgaagcgcaggcgcgcagccgatgtggaaccctcaagtccagagcctaaacgacgccgtcttagctag

SEQ ID NO: 59194 - DNA, 1263 bp, Artificial Sequence
  Description of Artificial Sequence: Synthetic coding sequence
atggccgctgctgagcatcggcactcaagtggcctgccgtattggccttaccttactgcagaaactttgaagaaccggatgggacatcagccacctccacctacccagcagcattctatcacggacaactctctgagcctgaagaccccccctgaatgcgtcctgacaccccttccgccttcagcagatgataacctcaagacccctccagaatgtgttctgacaccattgcccccttctgcagacgataatctcaagacaccccctgagtgtcttctgacccccctgcccccttcagcagatgataatttgaaaacccccccagaatgcctcctgacaccgctcccgccatctgccgacgataatcttaagacccctccggaatgtttgcttacgccgctgccaccttcagcgccacccagtgcaccacctagcgctgacgataaccttaaaaccagagcggagtgcctattacaccctctcccacccagcgcagacgacaacctgaaaaccccttccgagcgacagcttacccctcttccccctagtgctccaccatctgccgatgataacattaagacccctgctgaacggttgaggggtcccttgcccccttccgctgacgataacctgaaaacaccatcagaacggcagctcactccacttccgccatctgccccaccatcagcagatgacaacatcaaaactccggcagagaggctcaggggcccactgccaccctccgcggacgataatctgaagacccctagcgagcgccagttaacacctctacccccaagcgctcccccttcggccgacgataacataaaaacccccgcagagcgcctgaggggccctctgccaccgtctgcggatgataatttgaagactccgcctctcgccactcaagaggccgaggccgagaaacccaggaaacctaagcgccagcgtgccgctgagatggaacctcctcccgagcccaaacgcagaagggtgggagacgtcgagccttctcggaagcccaaacggcgaagggccgcagatgtagagccgagcagccctaagcctaagcggcgacgtgttggcgatgtggaaccttccagaaaacctaagcgccgtagggccgctgatgtggaaccatccagccccgaacctaagcggcgaagagtgggagacgtggagcctagtcgaaaaccgaaaaggagaagagcagcagatgttgagcctagttcaccagagcccaagaggaggcgcctatcttag

SEQ ID NO: 59195 - DNA, 2505 bp, Artificial Sequence
  Description of Artificial Sequence: Synthetic coding sequence
atgaaggtgatcgtgattcataggaagatgttccagcgcgctcaggagctaaggaggcgggcagaggattaccacaagtgtaagattccgccaagcgctagaaaggccctatgcaactgggtgaggatggccgctgccgagcataggcactcatcggggctgccatattggccctacctgactgctgagaccctgaagaataggatggggcaccagccaccgcctccaacccagcagcatagtatcaccgataactccctcagcctcaagactcctcccgagtgtgtcttgactcctcttcctccctccgccgacgataatctcaaaactccaccagagtgcgtgttgacacccctgccgccatcagccgacgacaacctcaagacacctccggaatgtctgctcactccccttccgccaagtgcagatgataacttgaagacccctcctgagtgtctgctgacgccattgcctccctccgctgacgataacttgaaaactcctcccgaatgcctgctgacacctctacctccatcagcaccacccagtgctccaccaagcgcagatgacaacttgaagacccgtgctgaatgcctgctgcatccacttccccctagcgccgatgacaacctgaagacgccttcagagagacagttaacccctctgcccccttccgctccaccctccgccgatgataacatcaagacccctgctgagaggctgcggggtcccctgcccccatctgccgatgacaatctcaaaaccccttctgaaagacaattaacacctctgccaccatctgcgccacccagcgctgacgacaatatcaagacacctgcggaacgcctcagggggcctctgcccccaagcgccgacgacaacttgaagacacctagcgaaaggcaactgacccccctacccccatcggcacctccatcggccgacgacaatatcaagacacctgctgaaaggcttagaggcccattaccaccctcagcggacgacaaccttaagacacctagcgagcgccagctgacacctctccctccttcggccgatgataacattaagactccagccttccacccacagcggatgatcattagccgacacttgcccagtgtgtcatctcttccctttcatccgcagctgcactcccagcagatgattataagtcgttatctgctgagcgtttgcggattccggtttcatcaccagcctatgatcatcagcaggcaccttccttctgtgtcttctctgccttttcacccccaacttcacccacagcaaatgatcatctcacgtcaccttcctagcgtgtgtgggggaagattccatcctcagaggatgataatatcccgtcatctgccaagcgtgagttcattgcctttccatccacagcttcatccacaacagatgattatttccaggcatttaccctccgtgtgtggcggacgctttcacccacagcggatgatcatttcccggcacctacctagcgtgagttctctgccgttccatccccagctccacccacaacagatgatcatatccagacatcttcctagcgtgtgtggcggtcgttttcacccacagaggatgattatcagtagacacctcccctccgtgtctagtctgccttttcacccacagttgcacccgcagcagatgatcataagtagacatttacccagcgtgtgcggggagaggctgcggggtcctttgcctccttcagccgatgacaatctcaagacaccatccgagaggcagctgaccccactgcctccctcggctcccccttccgctgacgacaacatcaagactcccgctgaaaggctacgaggccctctacctccgtcagctgacgataacttgaagacgccaagtgagagacagctcacacccctcccgccttcagctcctccatctgcggacgataatattaaaactcccgctgaacgcttgagaggccctctcccaccctcagcagatgacaacctcaaaacgcccagtgagcgccagctcacacctcttcccccttcagcgccaccgtcggccgacgataacataaagactcccgcagaaagactgcgcggacccctaccaccgtctgctgatgataacttaaaaactcccccattggccacacaggaagctgaggcggagaaaccaagaaagcccaagcggcagagagccgctgagatggagccacccccagagcccaaaaggcggagggtgggagacgtcgagcctagccggaagccaaagagaagacgggcagccgacgttgagccttccagccctaaacctaaacgaagacgtgttggcgacgtggagccatcacggaaaccaaagcggcgtagggctgccgatgtcgagcccagcagtcccgaacccaaaaggcggagagtcggagacgtggagcctagtcgcaaacctaaacgcagaagagccgctgatgtggagcccagtagcccagagccgaaacgtcggcgtttgtcttag

SEQ ID NO: 59196 - DNA, 591 bp, Artificial Sequence
  Description of Artificial Sequence: Synthetic coding sequence
atgatcagatgtggtcttgcatgcgagagatgtcgctggattctgacgctcctgctcctgagtgccatagcttttgacattatcgcactcgccggaaggggctggttgcagagctctgacagagtgcagacttccagcctgtggtggaggtgcttcctacctcagggacgtcgaaggcgccagcgggtgttgcggggaaggttgccccagcctcacggagtaagagtcgggagcagtagtgctgcgatgctgttttggggagtgtcaattcttgtcatttgctttatactgagctttttcgtcctatgcgtgccacagattctagttttcttgcgtgtgatcggcggactcttggcactggccgctgtgtttcaaattattagcttggtaatctaccccgtcaagtacacccagccttctaccttcatgcctagccctgctgtaaccagtatctacaactgggcctgtgggttcggctgggccgctatgatcatcctcattgggtgcgcttttttttgctgttgcttgccatcatgtgaggacgatctcctgggcaacaccaagcctcggtacttctacacaagtgcctag

SEQ ID NO: 59197 - DNA, 1389 bp, Artificial Sequence
  Description of Artificial Sequence: Synthetic coding sequence
atggatagcctgtggggacctggcgctggatcacatccctttggcgtgcataatacccggctatcccctgacctgtgccctggcaaaattgttctaagggcccttaaagaatcaggggctggcatgcccgaacaggataaggacccaagagtacaggagaaccccggagatcagcggagggtccctgaagtcaccggcgatgccccttctgcattcagacccttacgagataaccgtggcctatcacccttcgtaccaggtcctgggcctctgcagactgaccttcacgcgcagaggagcgagataaggtataaccaaacctcgcagacaagctggaccagctcatgcacgaaccgcaatgccatctcctctagctactcttcaactgggggattgcccggtctgaagaggaggagagggcctgctagctcccactgccagctgacgctgagcagctccaagacagtgagtgaagatcgcccacaagctgtgagctccggccacacgcagtgcgagaaggcagcggatattgctccgggacagacactcgcgctgcggaacgacagctcgacctctgaggcctccagaccttccacccataagttcccactgctgccacggagacgtggagaaccactgatgctgcctcctccgctggagcttgggtatagagtgaccgtcgaagacctggacagggagaaagaggctgctttccagcggatcaactctgcactgcaggtggaagataaggctatttctgactgccgaccaagccgtccttctcacacactgagttctctcgccacagggacctctggcctacctgccatctccaaagcccctagcatggacgtacagcaggagacgcacaagtcacaagactgtctgggtctgcttgcacctctagccagtgccgcaggggtgccgagcaccgcccctatgtccggcaaaaagcacaagccccctggccctctgttcagctccagcgatccgctgcctgctaccagcagtcacagccaggattctgctcaggtaacttcactgattccagcaccattccctgctgcgtccatggacgtcggtatgcgacgaacacggtgtggtacgtctgcccctgccgctgctgctgccgcaccaccaccatccacattgaatcccaccttaggctcactactggagtggatggaggcattacacattagcgggcctcagccgcaactgcagcaagtaccacggggacaaaatcagcggtcacagactagtcgaacctcatcctgccccaagcggaacgcaatttcttccccttacagatccacaggcggactgccagagcgtaagaggcgcagaggaccagcatcgagccactgccaattaaacctatctagttag

SEQ ID NO: 59198 - DNA, 381 bp, Artificial Sequence
  Description of Artificial Sequence: Synthetic coding sequence
atggggagaatctttcagttgctgagagaccggaggatctcatccagaggtccgggtctgcacactcctaaggctgaacctcggagaagaaagggactcactactggtttgatgactcaggcagaaagacagaagcaagcacaccagcgccaggccgcaatgcgggaaaccgccctgtggtgtaccggccatattaggcctagaacccacacccacacaggcactcacacccagactgaccgcgaacgagagaggaacacccagcggctacgagaccgggagcggcgtgaaaacggcagacacactcacatacatacccagacgcacactcagagcttaatagctaaagccctaaaggacactcaccctggtaacccatag

SEQ ID NO: 59199 - DNA, 1395 bp, Artificial Sequence
  Description of Artificial Sequence: Synthetic coding sequence
atgatggcttgtcgtgatcctaaacccggagctaagcgtttagtgcgcgcacagaccctccagaaacaaaggagggctcctgtaggccctcgggctcctcctcctgacgaagaagaccctcggctcaagtgcaaaaattgcggggcatttggacatatggcccgatcaactcgctgccccatgaaatgctggaaagccgcactagtcccgccaacacttggcaagaaggagggcaaggagaatctgaagccatggaaaccccaggtagaagcaaatcctggtcctttaaacaaagacaaaggtgaaaaagaagagaggcccagacaacaggacccacagcgcaaggcattactgcacatcttcagtgggaaacccccagaaaagccactgcctaaccgcaagggctcaactgagagctcggtttacctccgcgtggcttcgggaccaatgcccgtccacaccacatccaagcggcctcgggtggacccggtcttagccgatagaagcgcaacggaaatgagcgatcgcggttctgccctcgcgtcgctgagtcctctccggaaggcatccttgtcctcttccagttcactgggcccaaaggaaaggcagactggggctgccgctgatattccgcagcctgccgtgcggcatcagggaccggagcccctcctcgtcgtgaaacctactcatagttcacccgagggcggatgtagagaggtgccccaggctgcttccaaaacgcatgggcttctccaagccatctctccacaggcgcaggacaagcggccagccgtaactagccagccttgccctcccgcagctacccatagccttggtttagggtcaaatttgtcttttggtcccggtgccaaacgtcccgctcaggcccctatccaggcctgcttaaatttcccgaagaagccccgtctggggcctttccagatccccgaatcggccatccagggcggtgagctgggagctccagaatacctccagcctccccctgctaccacagagttggggccaagcacctccccacagatggggcgacggactccagctcaggtcagcagcgtggacaggcaacctccccatagtaggccctgtctgcccacagcacaggcttgtacaatgagccaccacccagcaacatctcacgatggggctcagcctttacgtgtcctgttcaggcggctggagaacggccgatggagctcttcattgctggccgctccaagcttccatagccccgaaaagccaggggcatttttggcccagtccccccatgtatcagagaaaagcgaggtcccacgtgtccgtgtgcccccaaacgtcttgtatgaggatctgcaggtgtccagctctagcgaagactccgattcagacctcgaatag

SEQ ID NO: 59200 - DNA, 1383 bp, Artificial Sequence
  Description of Artificial Sequence: Synthetic coding sequence
cagatggccagacacagtgtgcaccaccaggcacagcgaccccctagagcaaagaacccccaggagcagcagagaagacccatggggcagacgacactccccgctgagcaggaggaaagcagggtgaagtgcaagaactgcggggctttcggccattccgcaaggtctaagacatgccccatcaaacgatggagcggtgccttgcctctgcaggccctcgggtctcacaaggaaaaggaaaacctgaaaccggctaaagcacaactgccctttaccacgccagggccatttaccacaaatgacagggaaaaggagagatccccgtcaccccaacagcaacagtcagaagccccaacgcaaaccttccctcggacaccacaggaaaaaatgcaggaggcctggaaggaaccagctgaggattgtttgttcttacgacatcccacgatgcctctgcccgtacatacaaccaagaaacggagcgtcctcggaccagtttccactgggcctccacccgtgaataaaccggagatgcgtctgctgtgccctagtggacataatgacagcccacagctctccacatgcgggcctaccaaaggtcacggccgagatgtcaccgcctcactccttccagttttgaagtccagccaccagacccctacattgagtgcgaggctccccgctaacaggcccgacatgagcagtcacggagccttacagcctgcgatgcaggcgttggcactgggtcccggactgaagagccaggctgagatcaagcaccccgacgccgacgctaaacccaggccgcaacaggtccgcaagcaatgcgggcaggactcccgcacacaggccccagacaaagaaccggctccagtgcctacccaaaccttccagaatcctgcaaagaaagcccgtttctcttcctttcagacacccgctctcagaacacagcttcctgatgtgggggctgtgcaaaccttacaaccccctcgcacggccacaggactgggctctaaagaagctccaaaggcaacagcagagaccgcggcaacgaagacggccacactgcaaccaagagttaacctccagccagcgccatcgtcaccatttctgggacccgctcaagggtgtccggttctccaaccaggaccaccgattcacgtcccaggacgcccagggtcggtcacgtttatgcgcggtgataagggacagaagtccccgaggttccgtatgccgccaacgtctcggcctcctgagaactccgcgagcgcccagagccctaggtttagtcggcagcccgagggccagggccctcaggtgtcaaccagcgtattatatgaggacctactcgtgactagcagtagtgaggattccgattctgattag

SEQ ID NO: 59201 - DNA, 894 bp, Artificial Sequence
  Description of Artificial Sequence: Synthetic coding sequence
tttgtgttaggggctgtttcaccagctgtggtcgtactgtacacaatggtgttacaggaaaatgggtacggtgtggaggaggacatccccacgcttttgatggcggcttcgtcaatggatgacctgctggctatcacagggttcaatacctgtctatctatagtcttttactcaggtggcatgatcaacaacgctatcgcgtcactacgcaacgtttgtatctccctgctggcaggtattgttctgggcttctttgttaggtacttcccttcagaagaccagaagaagattaccctgaagaggggattcttagtcctgatcacgtttgtgtccgccgttctcggtagtcaaccaattgggctgcacggcagcgggggtttgtgtacactggttctgcatttcatcgagtggaccaagtggagccaggaaaaaatgaaagtccagaaaatcattactaatgtctgggatatttttcagcccttgttgttcggattggtgggcgctgaggtgtcagtgtccctcctggaaagcaacattgtgggtattagtgtcagcacactgagtcttgcactttgcgtccggatcctcaatatctacctgttgatgtgcttcgctgggttttcctttaaggaaaaaatattcatcgcactggcatggatgcccaaggctaccgtgcaagctgtgttggggccacttgccctggaaacagccagggtgtcaactccacacctggaaacatatgccaaggacgtgatgactgttgcattcctagcaatcatgatcactgcacctaacggcgctctgcttatgggcattctgggcccaaagatgctaactcggcattacgatccgagtaagataaagttgcaactctccaccctggagcaccactag

SEQ ID NO: 59202 - DNA, 2325 bp, Artificial Sequence
  Description of Artificial Sequence: Synthetic coding sequence
atggagcctgaaagggagggcactgaacgacaccccagaaaagtgcgcgaaagcaggcaggccccaaacaagctggtaggcgctgcggaggcgatgaaggccggatgggacctggaggagagccaaccagaggccaaaaaggcccgactatcaaccattctgttcaccgataactgcgaagtgactcatgaccagttgtgcgaactgttgaagtacgccgtgttagggaagtcaaacgtgcccaagccgagttggtgtcagctgtttcaccagaaccacctgaataacgtagtagtcttcgtgctacaggggatgtctcagctgcatttctaccgtttctacctggagttcggatgccttcggaaggcattcaggcataaatttaggcttcctcccccatcgtccgactttctcgcagacgttgtgggactgcaaacggagcagagagcaggagacctccccaagacaatggaaggacctctgccctccaacgctaaagcagcaattaatttgcaggatgaccccattatacagaaatatggatcaaaaaaggtcggtctgacgcggtgcttgctgacgaaggaggaaatgaggacgttccattttccactgcagggattccccgattgtgagaattttctgcttactaaatgcaacggctctatcgccgataatagtcccttatttggactggactgcgagatgtgcttgacttcaaagggcagggaactgacccggatctcacttgtcgcagaaggcggatgttgtgtgatggacgagctcgtgaaaccagagaacaaaatactggactacctgacaagtttttccggcatcacaaaaaagatcctcaaccctgttaccacaaaacttaaagacgtgcagcgccagctcaaagccctcctgccaccagacgcagtcttggtcggtcacagtctggatttagacctcagggctctgaagatgatacacccctatgtcatcgataccagtcttctttacgtgagggagcaaggtagacgcttcaaactgaaatttcttgccaaagtcatcctggggaaagatatccaatgccccgataggctgggtcatgatgccacagaagacgctcgcactatcctggagcttgcccgatacttcctgaagcatggccctaagaagatcgcagagttgaatttggaggctctggcaaatcatcaggagatccaagctgctggtcaggaacctaaaaatacggccgaggtgctgcagcatccaaacacctccgtccttgagtgtcttgacagtgtgggacagaagctgttgtttctcacacgggagaccgacgcaggagaactgcctagttcccgaaactgtcaaacaataaagtgcttgagcaacaaggaggtgctggaacaggcgcgagtggaaattcctctgttccctttttccattgtgcaattctcattcaaggccttctctccggtgctgaccgaagaaatgaacaaacggatgaggattaagtggacggagattagcactgtttatgccggtccgttttctaagaactgtaacttgagagctctgaaacgactgttcaagagctttggacccgtccaatcaatgacgtttgtgctggagacccggcaacctcacctgtgtatccagtacgaagtgcttgaggcggctcagttggccatagagagcttagatggaatactggttgacggcatttgcataaaagtccagagaccagtcacagaactaacccttgactgcgacaccttagttaacgagctggaaggggactcagagaaccagggtagcatttacctgagtggcgtcagcgaaacctttaaggagcagctgttacaagaaccccgactgtttttaggcctggaggctgttatcctgcccaaagacttgaaaagtgggaaacagaagaaatactgttttctgaaattcaagtctttcgggtcagctcagcaggcactcaacatactgaccgggaaagattggaagctaaagggacgacatgctttgacacctagacacctgcacgcttggcttagggggttgcctccagagtctacccggctgcctggactgagggtggttccacctcctttcgagcaggaagcacttcagaccctgaaactggatcaccctaaaatagcggcatggagatggtcccgaaagataggaaagctgtataactccctgtgccctggcaccctgtgtctgatcctgttgcccggtacaaagagcacacacgggtccctgagcggtcttggtctgatgggtattaaagaggaggaagaaagcgccggtcccggactctgttcatag

SEQ ID NO: 59203 - DNA, 2232 bp, Artificial Sequence
  Description of Artificial Sequence: Synthetic coding sequence
atggagcccgagcgcgaaggcaccgagagacacccacggaaggtccgcgaaagtcgccaagccccaaataagctggtcggggcagccgaggccatgaaggctggatgggacctagaggagtcgcagcccgaagctaagaaggcacgccttagtacgatattgtttaccgataactgcgaggtgacgcatgatcagctatgcgagctcctgaagtacgcggttcttggaaaaagcaacgtgcctaagcccagttggtgccagctgtttcaccaaaatcatctgaacaacgtagtcgtgttcgtcctgcaaggtatgtcccagctgcatttttaccgattttatctggaatttggatgcttaaggaaggcgtttcgccacaaatttcgattacctcccccttcaagtgactttctggccgatgttgtgggactgcagaccgagcagagagccggagacctccctaaaaccatggaaggcccattgccatcaaacgccaaggccgctatcaatctccaggatgaccccatcattcagaagtacgggagtaaaaaggtgggccttacaaggtgtctgttaactaaggaggagatgcgtactttccattttccgttgcagggcttccctgattgtgagaacttccttttgactaaatgtaacggcagcatcgctgacaacagtccgctctttggcctggactgcgagatgtgtcttacaagtaaggggagagaactgacacggattagcctggtggccgaaggagggtgctgcgtgatggacgaattagttaaacccgagaataaaatactggactacctcacctcctttagcggtatcacaaagaagatactgaaccccgttaccaccaaacttaaggatgttcagagacagctaaaagctcttctcccgccagacgcagtgctagtgggccattcgctggatctcgacttgcgcgctctgaagatgattcatccctatgttatcgacacaagcctactgtacgtgagagagcagggacgcaggtttaaactcaaattcctggccaaagttattcttgggaaggatatccaatgtcctgaccgcctagggcatgacgcaactgaagacgcaaggaccattctcgagctggctaggtatttcctaaaacatggccctaaaaaaatagctgagcttaaccttgaagctctggccaaccaccaagagattcaagccgcaggtcaggagcctaagaatacggctgaggtgctgcagcatcccaacacctctgtcctagagtgcttagatagtgttggacaaaaacttctattcttgactagagagacggatgcaggtgagctgccttcctcgagaaactgtcagacgatcaaatgtctgtctaacaaggaagtgctcgaacaggcccgagtcgaaatcccattgttcccatttagcatcgtacagttctctttcaaggcgttctcacccgtgctgacagaggaaatgaacaaacggatgagaataaagtggaccgagatcagcaccgtttacgccggtcctttctccaaaaactgcaacctgcgggctctcaagcgtctatttaagagttttggaccagtgcagtccatgacctttgtgctcgaaacgcggcaggtgcagaggcctgtgaccgagctgaccctggattgtgatacactggtgaatgagctggagggtgacagcgaaaatcagggctctatctatctgagcggggtttctgaaacctttaaagagcagctgttgcaggaacccagactctttctcggactcgaggctgttatcctgcccaaggatctgaagagcggtaagcagaagaaatattgcttcctgaaattcaagtcattcggcagtgcccagcaggccctcaatatcctgacaggaaaggattggaaactcaaggggcgacacgcacttactcccaggcatctgcatgcctggctgcggggtcttcctccagaatccaccagactccccggattgagggtggtccctcccccattcgaacaggaggcactgcaaactctgaagttggatcacccaaaaatcgcagcctggaggtggtccagaaagatcggcaagctgtacaacagcctctgtcctggcactctgtgccttatcctccttcctgggaccaaaagtacacacggatccctatctggactgggcctcatgggtataaaagaggaggaggaatccgctgggcctggcttgtgtagttag

SEQ ID NO: 59204 - DNA, 2082 bp, Artificial Sequence
  Description of Artificial Sequence: Synthetic coding sequence
agcctgcctcagtccgaggcacaggggcaagccgtggatttgcgcacccccgtgtcatgtctcaggggtagacttccaccgggacatactgaggccagactggtgggcggagaacacccctgtgcgggacggctcgaagttacctggggcacagtatgtgacgctgctcttgacctggcaactgcacatgttgtatgtcgtgaattacagtgtggcgctgttgtgagtacacctgagggagcgcgatttggcaggggatctggacctgtttggaccgaagcatttaggtgcgccggaaacgaatccttattgtttcactgtcctcggggacggggaagtcagtgcgggcacggccacgacgccggtctcagatgctctgaatttcgaatggtgaacggttcgtcatcctgcgaaggcagggttgagtttcaggtgcagggatcttgggcacccctctgtgctacccattgggatatcgcagacgccacagttctctgccaccaattaaactgcggaaacgccgtagcagcccctggaggaggccatttcggtgatggcgacgcagctatctggcctgatgccttccactgcgagggtaccgagagctatttgtggaactgtcccgtgtccacactgggcgcacctgcatgtgctcccggaaacacggcatcagcagtttgcagcggattggcgcacgcattacgccttcgggagggccagagtcgatgtgacggacgcgtggaggtcagtctggatggtgtctggggacgcgtcctggacgatgcctgggatctccgcggagcgggagtggtctgtagacagctgggatgcaggggcgctcagcaagcttatgacgcgcctgctcccagccgaggatccgtgcaagtggcactctccagggtgcgctgcctaggaaccgaaacaagactgacgcagtgcaatgtgtccgctactcttcaggaaccagccggaacaagtagggacgccggagtcgtctgttccggggaagtcggtaccgcatccccgatggccagaaggcatgggataccaggcgcactgaccctgtctcttcaccgcgagcctcagggggcagccggacgcggagccggtgcactgcacggaggggcatgggggaccgtttgcgacgacgcctgggatctacgagacgcccacgtggtctgtcgccagttgggttgtggacgggcattaagtcccggaggaaggacgctgagaagccggggacgggcacacctagccggaagggcgggacttccaggccctagagtatgtgcagtggctgtgcctgtaggaggactgggagcagcacgcctggaagctcagggcggtcgcaggcgactccttctgagggtgggcggatccgaggcagcccgttgggacctgctactttgttgggtggccggtagggtactccaatgggatttggggagacacgtacagcagtgcccagagggaccgctcctcgtacatcacctgcaggcagctggtgtgtggggcgttggactggccggagaacaagcactgccactgtgcggtcacagagatcggctgggcggacagcaccgcgtgccccaagccgctcaactgcattcagtggccatgccttttccccctatggcccctgctctcctgcggccaagccgggctgggttggattacctatgccggatagttaggggtcaggctacaggctgctggggtgctccacaattgctcctgcttgctcgactgcctcggggtggtaggactgcaagagccagagggcgaggccctctgctgagagccaggggagcactggcgcgagggctccttgggcaccgagtgagacgttggctgggacctggcggtcggggaggccgagtgccacccgcagggctttggtcgggacggcgacgcccaggtgggcgtaggctttggccctggctgcgcgctagagttgcgggtagagggggagtgcctgggcaacgtggtgtgcccgtagggttgccaaggtcaggaggggatgccgagactgcaagaacaagacggacccgcgcatgtgccgcagggaaaaccaatagctag

SEQ ID NO: 59205 - DNA, 1359 bp, Artificial Sequence
  Description of Artificial Sequence: Synthetic coding sequence
atgaactcaggaatcctgcaggtgttccagagagagctcatttgtcccatttgtatgaactattttatcgatcctgtcacaatcgactgcggccacagcttttgtagaccttgtttctatcttaattggaaagactcaccattccttgtgcagtgcagtgaatgcacaaagtcaacaggtcagattaatctgaaaaccaacattcatttcaagaagatggcttctctggctagaaaggtgtccttgtggctgttcctcagttccgaagagcaaatgtgtggtacccacagggagactaaaaagatgttttgcgaggtggaccggtcgttactgtgcctgctgtgtagcagcagtcaggaacatagagaccaccgccactgccctattgagagcgcagcggaggaacatcaggagaaattacttcaaaagatgcagagtctgtgggagaaggcctgcgagaatcataggaacctaaatgtcgagacaacccgcacacggtgctggaaagattatgtgaacctaagactggaggccatccgcgctgagtatcagaaaatgcctgctttccaccatgaggaggaaaaacataacctcgagatgttgaagaaaaagggaaaagatatttttcaccggttgcatctgagcaaggccaagatggcccatagacgcgaaattttgagggggatgtatgaggagttaaatgagatgtgccataaaccagatgtggaattgctccaggccttcggcgacattctgcatcgctccgaatctgtgcttctccacatgccccagccgctgaaccctgagctctccgccggtccaattacgggcttgagggaccgactgaaccagttccgtgtccacatcacacttcatcacgaggaggccaactccgatattttcttgtgtgagatcctgcggagtatgtgtatcggctgcgatcatcaggatgtgccatattttacagccaccccgagaagcttcctcgcctggggcgctcagacatttacgagcggcaagtattattgggaggtacatgtgggcgactcatggaactgggcttttggagtctgtaacatgtattggaaagagaaaaatcagaatgaaaagatcgatggtgaagacggcttgttccttctgggctgcgtcaagaatgacatccagcgcagcttgtttactacttctccactgctgctgcagtatattcccagaccaacttcccgagtcggtctgtttctcgattgtgaagccaaaacagtgtcctttgtggacgtaaaccaatcctcccttatttacacgatcccgaattgctctttttcaccacctcttagacctatcttctgctgtattcatttctag

SEQ ID NO: 59206 - DNA, 339 bp, Artificial Sequence
  Description of Artificial Sequence: Synthetic coding sequence
caggtggcttacgtcagggcgcgagaattgcacacactggaagtgactggacttgaaacagtggctcagtcaaaggcccacgttgctagtctggaagggcttattccggaagacaaagtagtgcttctcgccggtagcccactacaaaacgaagccactttgggccagtgcggagtggaggctctgaccaccctggaggtggtgggacgacggctgggcggaaataactgcctgagcttgcaagtcaatccagtccagccggctagatacctgtggactaccctccattcctcaaagcagggagagcctaactcatcggctaatcatcgatgctcatag

SEQ ID NO: 59207 - DNA, 1026 bp, Artificial Sequence
  Description of Artificial Sequence: Synthetic coding sequence
atgcgcctctgtctcattccaaggaatacaggtacaccccaacgcgttctgaggccggtggtgtggtctcctccgtcaagaaagaagccagttttatccccgcacaactccatcatgtttggccacctgtcccccgtgcgtatcccatgtttgaggggcaagttcaatctgcagcttccctcgttggatgatcaggtgatcccggctcgtctgccgaagaccgaagttagcgccgaagagcctaaggaagcgaccgaagtgaaagaccaggtggaaacacagggccaagaggacaacaagagagggccttgtagtaacggagaggctgctagcacaagtcgacccttagaaacgcagggtaacctgacatcatcatggtacaatcctcggcctctggagggtaatgtccacctgaagtcccttaccgagaagaaccagaccgacaaggcgcaggttcatgcagtgtcattctattccaagggacatggagtggcctcatcccatagtccagccggtggaatcctaccgttcggaaagccagaccccctacctactgtcctgccggctcccgtgcctggatgttctttgtggcccgagaaggccgcattgaaggtgctgggtgaggatcatcttcccagctcaccgggactcctgatggttggtgaggacatgcagcccaaggaccccgctgcgttaggtagttcccgttcatccccgccacgggcagccggacaccgatcccataagcgtaagctctctggccctcctctccagttgcaaccgactcctccgctgcagctccgatgcgatcgtgatgagcgcccacctcccgctaagctgccatgcttgagccccgaggcgctcttggtggggcaggcaagtcagcgggaaggtagactgcagcacggcaacatgaggaagaacatgcgtgtcttatcacggatttcaaaattccgtcgcctgcggcagctgctcagacgaagaaagaaaactaggcaagggcgacggggtggctcgtgtctgtag

SEQ ID NO: 59208 - DNA, 285 bp, Artificial Sequence
  Description of Artificial Sequence: Synthetic coding sequence
atgcgcaagctcagactgcgtgccagcaatcctggcccttcaggcgctcctggtacacggcagcatttctcaactagtcgcggaggccatcactgcgctagaagatggctccggcgagtgcggagatcacggtcccaaaccccttcctaccaaaacttggatccaaatccacctattgtacgcttccccctgcccctagagagaatctctgaagtgccccgacgggcttgcctccacggtagggatgcctcctccgtctggcctccgcctgagaggtcagattag

SEQ ID NO: 59209 - DNA, 2268 bp, Artificial Sequence
  Description of Artificial Sequence: Synthetic coding sequence
atggccgcagtggctgctgaggccgcagcaacagcagcctcccccggagaaggcggtgccggtgaggctgagccagagatggaaccaatcccagggagtgaggctggaaccgacccccttccagtgaccgccacagaagccagcgtgcccgatggtgagaccgatggccagcaaagcgcaccacaggctgacgagccccctctgcctcccccaccacccccaccaggggagcttgctcggtcacccgaggccgtgggacctgagttggaggctgaggaaaagcttagtgtaagagttgcagagtccgctgcagcggctccccagggtggacccgaactgcccccttcccctgccagcccaccagagcagcccccagctccagaggagagggaagagccccctctcccccagcccgtagctccagccctcgttcctcctgccggaggtgactcaactgtgtcgcagttgatccccggaagtgaagttcgcgtgaccctcgatcatataattgaagatgcactggtggtaagtttccggtttggcgaaaagttattttcaggtgtgctgatggacttatctaagcgcttcgggccacacggcattcccgtgactgtgttccccaaacgggaatataaggacaagccagaagctatgcctttgcaatccaatactttccaagagggcactgaggttaagtgcgaggcaaacggcgctgttcccgatgacccatcccctgtaccacaccccgagctctccctggccgaaagtctgtggacctcaaagcccccaccgctgtttcacgagggagctccttaccctcctcctctgtttattagagacacttacaaccagtctatcccccagccccctccacgcaagattaaacggcctaagaggaagatgtacagagaagagcctacatcaatcatgaatgccattaagctgcgcccacgtcaagtattatgcgacaaatgcaaaaattccgttgttgcagagaagaaagagatcaggaagggatcctctgccactgatagctctaagtacgaggataagaaacggcgaaacgaatcggtgaccactgtcaataaaaagttgaaaactgatcataaggtggatggcaaaaaccagaacgagtcacagaagaggaatgccgttgtgaaagtgtccaacatcgcgcattctcggggaagagtagtgaaggtttcagcacaggcgaacacatctaaggcacagctgtctaccaagaaggtgctccagagcaaaaatatggaccacgccaaggctcgagaggtcctgaaaattgcaaaggagaaggcccagaaaaaacagaacgagacttctaccagcaagaatgctcattctaaggtccatttcacccgcagatatcagaaccctagtagtggaagcctgccccctcgggtccgcctgaagcctcagcggtaccgcaatgaagaaaacgatagctcgctgaaaaccggactagagaaaatgagaagcggcaaaatggccccaaagcctcagtcccgatgtacgagtaccaggtcagctggcgaagctccttcagagaaccagagccccagtaagggaccagaagaggcaagcagtgaagtgcaggacactaatgaagtgcatgtccctggggatcaggatgaaccccaaacacttggaaaaaaggggtctaaaaataacattagtgtctacatgacactgaaccagaagaagtcagatagttcgtcagcttcggtctgctctattgattcaactgatgacttaaaatcgtccaatagcgagtgctctagctcagagtcatttgatttcccacctgggtctatgcacgcaccttctaccagctccacgtcaagctcctcaaaggaggagaagaagctgagtaactccttaaagatgaaggtattctctaaaaatgtgagcaagtgtgtgacacccgacggcagaacaatctgtgttggtgacatagtatgggccaagatttacggatttccttggtggccagcccgaattctgaccatcacagtgagccgcaaagacaatggcctgctcgtaaggcaggaggcgaggatttcgtggttcggttcacccaccacgtcctttttagccctttctcagctctcaccatttctggaaaactttcagtcccgctttaataaaaagagaaagggcctttacaggaaggccatcaccgaggccgctaaggccgcaaaacagcttactcccgaagttcgcgctctcttgacacaattcgagacatag

SEQ ID NO: 59210 - DNA, 1683 bp, Artificial Sequence
  Description of Artificial Sequence: Synthetic coding sequence
atggccgctgtggcagccgaagcagccgctaccgcagcttcccctggcgaaggcggtgcaggggaggccgaaccagaaatggagcctattcctggatccgaggcaggcaccgaccctctccccgtgacagccacggaggccagcgtccctgatggggagactgatggccagcagagcgccccacaggctgacgagcctcccctacctcctcctcccccaccgccaggggaattagctagaagccccgaggctgtcggccctgagctggaagccgaggagaaactcagcgttagagtagccgaatcagcagccgcagctcctcaggggggtcccgagctgccaccttcacccgcttctcctcccgaacagcccccagccccagaagagagggaggagcccccattacctcagcccgtggccccagccctcgtgcccccagcagggggtgatagcactgtcagtcaactgattccaggtagtgaagtgagagtaactttggatcacattatcgaagatgctctcgtcgtcagcttcaggttcggcgagaaattgtttagtggggttctgatggacctgagcaagcggtttggaccgcatggtattcctgtaaccgtttttcccaagcgcgagtataaggacaaacccgaagcaatgcctttgcaatccaacacttttcaggaggggactgaagtaaaatgcgaggcgaatggggcagtgccggacgacccgagtcccgttccacaccccgaactcagtctcgctgaatccctctggacttccaaaccaccgcctctgttccacgagggagccccataccccccaccactattcattcgagatacctataatcagagcattcctcagcctccaccccgtaaaataaagaggccgaagagaaaaatgtatagagaagagccaacctccattatgaacgctatcaaacttagacccaggcaagtgctctgcgacaagtgcaagaattccgtcgtggctgagaaaaaggagatccgcaagggaagctccgccactgactcctctaaatatgaagacaaaaagcggagaaacgaaagtgtgactacagttaacaaaaagctgaagaccgaccacaaggttgatgggaagaatcagaatgagtctcagaaacggaacgctgtcgttaaagtgtccaatatcgcccattcccggggtcgtgtcgtgaaggtatcggcccaggctaatactagtaaggctcagcttagcactaaaaaagtgttgcagtctaagaacatggaccacgcaaaagctcgggaggtcctcaagatagccaaagaaaaagcccaaaagaagcaaaatgagacatccaccagtaagaacgcacattcgaaagtccatttcacacgcaggtatcagaaccctagctctggaagcctccctcccagggtccgccttaaaccacagcgctaccgcaatgaggagaatgatagctcgttgaaaacaggactcgagaagatgcgaagcggaaaaatggcccctaaaccccaaagtagatgcacctccactcggagcgcgggtctaaataaatggcagctattgcaccaaacagtgacatctccagccgctcctctgcaatgtcttactgatcattgtggctttcggctgggcgctctgaagcttacagtgaagcgtgccgctcagcgccactag

SEQ ID NO: 59211 - DNA, 1563 bp, Artificial Sequence
  Description of Artificial Sequence: Synthetic coding sequence
atggcagcagttgccgctgaagctgcggctaccgccgcttcacctggcgaaggaggcgctggagaagccgagcctgagatggaaccgattccaggatccgaggcaggtacggaccccctgccagtcaccgcgacagaagcaagcgtgcccgatggcgagacggatggacaacagagtgcacctcaagccgacgagccccctctgccaccccctcctccccctcctggcgagctggccagatcacccgaggccgtgggcccagagcttgaagccgaggagaagctctcagtgcgtgtggctgagtccgcggctgctgctcctcaaggtgggccagagctaccaccctcaccagcatcccctccagaacagccgcctgctcccgaagaaagggaggaaccccctcttccgcagcccgttgccccagctctggtgcccccagccggaggggactcaactgtgtcccagttgatccccggaagcgaagtgagggtcaccttagatcatatcattgaggatgcgcttgtggtctccttccggttcggtgagaagctgttctccggtgtcttgatggatctctctaaaagattcgggccacacgggatacctgtgacggtgttcccgaagagggaatacaaagacaaacccgaggctatgcctcttcagtcaaatacatttcaagagggaactgaggtgaaatgcgaggcgaacggggcagtcccagatgatccaagtcccgtgccacatccagagctgagtctggctgagtccctgtggacctcaaaacctccaccactgtttcacgagggcgctccctatccaccaccattgtttatcagagacacctacaatcagagtatccctcagccacccccacgaaaaatcaaacgtcctaagcgtaagatgtaccgggaggaacctacttccataatgaatgccatcaagttaagacccaggcaggttctgtgtgacaagtgcaaaaactctgttgtggccgagaaaaaggagattagaaagggatcatctgcgaccgactcaagtaaatatgaggacaagaagaggcgcaacgagtctgtgaccactgtgaacaaaaaattgaagacagaccataaagtagatggcaaaaatcaaaacgagtctcaaaaacgtaatgccgtggtaaaagtgagtaacatcgctcactcccggggacgggtggtgaaggtatctgcacaagcgaacacatctaaagcccagctctccacaaaaaaagtgcttcaatctaagaacatggatcatgccaaggcaagagaggtgctgaaaatcgctaaggaaaaagctcagaaaaaacagaacgaaaccagcaccagcaagaacgcccacagtaaggtgcattttacaagaagataccaaaatccctcttccggctccctcccacctcgtgtgagactgaaaccccaacggtaccgaaacgaggaaaacgattcttcccttaaaaccgggctagaaaagatgaggtcaggcaagatggctcctaagccccagagtcgatgtaccagtacccgatccgcagctcagcgtcactag

SEQ ID NO: 59212 - DNA, 1773 bp, Artificial Sequence
  Description of Artificial Sequence: Synthetic coding sequence
atggaacctagggccggttgccgccttcctgtcagggtggagcaggttgtcaatggtgctctagtggtcactgtgtcttgtggtgaaaggtcttttgccggaatcctgctggactgcaccaaaaaatcagggctctttgggttgccaccactggcacccctccctcaggtggacgaatccccagtgaatgacagccacggcagggctcctgaagaaggagatgccgaggtaatgcaattgggctcatcgtctccccctcctgcccgtggcgtgcagcccccagagaccacacggccagagcctccccctccattggtgcccccactgccagccggtagcctccccccatatcccccatatttcgagggtgccccatttccccaccctctttggcttcgggatacatacaagctgtgggttccgcagcccccacccagaaccattaagagaactcgcaggagattgtctagaaaccgagatcccggtcgtctgatcctgtcaactattcgattgcggccacggcaggtgctttgcgaaaagtgcaagagcactctctctcccccagaggcttctcccggtcctcctgctgccccaagagccagacgtagactgggttcaggtccagatagggagctcagaaagcccgaggagccagagaacggagaacccacggcagccgcaacagccaggagatcaaaaagagagaggagagaggaagaccgggcaccagcggagcaagtgccacgcagccccgtgatcaaaatcagctactccacaccacagggaaaaggtgaagtcgtcaaaataccaagcagggtgcacggtagcctcgagcctttccgccctcagcaagcaccacaggatgacggttcacaggacccagaggtgctagaccgagagtcccgggaccggccttcctgcgcccctagcgcctccattccaaaattaaagcttactaggcccgttcccgctggagccgatctgcctcctccaaagattcgattgaagccacaccgccttggcgattctgagcatgaacctgtgtaccgcgctgagctcgtgggcgaactcaacggataccttcgggattcatcccctgccccttgcgcagatggccctgccggagggctggccgacctctcctctgggagtagcggcgaagatgatgattttaagtcatgcccacagggtccgcagggcagggaaggcctcgctttccttgtgagctgtccagagggcagagctgattgcgccagcgagagtgcatgctcatcagactccctcgatgaagcacgatccagcggatccgagggcaccccagccgacactggggacttgagcccaggacacggcgcttctgctccatctgtctcccgggaagccaggcagactgtgcctcctttgacagtacggcttcacacccagtctgtatctgaatgcataaccgaggacggacgtacagtcgccgtcggagacatagtctgggggaagattcatggtttcccatggtggccagctcgggttttagacattagtctggggcagaaagaagacggagagccaagctggcgggaagcgaaggtcagttggttcgggtcccccactacctcctttctgagcattagcaagctgtcaccattcagtgaatttttcaaacttcggtttaaccggaagaagaaggggatgtatagaaaggccattacagaggcagctaacgcggctcggcatgttgcaccagaaattagagaactgttaacacagttcgagacttag

SEQ ID NO: 59213 - DNA, 1500 bp, Artificial Sequence
  Description of Artificial Sequence: Synthetic coding sequence
atggagccacgcgctggctgccgcttacctgtgcgtgtagagcaggtggtaaacggggctttggtggtgaccgtgtcgtgcggggagcgatcatttgctggcatattgcttgactgcaccaagaaatccggactgtttggacttcctcctctggcaccattaccccaggtcgacgagtcccccgtgaacgactcccacggtcgggctcctgaggaaggggacgcggaagtgatgcagcttggtagctccagcccccctcccgcacggggtgtgcagccgccagaaacaacccgtcctgagcccccacccccacttgtccctcctttacccgcagggtccctgccaccctaccctccttattttgaaggtgcacctttcccacacccattatggttgagagacacttataagctttgggtgccgcagccgccaccaagaacgatcaaaagaactcgcagacgtttaagccggaatcgcgatcccggtcgactgattctgagtaccattagactgcgtcctagacaggtgctgtgtgagaaatgtaaaagcacgctctctccccctgaggcttccccaggcccaccagccgctccaagagccagacgcaggctgggcagcggtcctgatagagagctccgcaagccagaggaaccggaaaacggagagcccactgccgcagcaacagcgaggcggagtaaacgggaacgcagagaggaggacagagccccagccgaacaggtacctaggtctcctgtaatcaaaatttcatatagcacaccccaaggaaagggagaggtggtgaaaattccatctcgggttcatgggagtctggaaccattccggccacaacaggcaccccaggatgacggctcacaggatccagaggtgctggatagagaaagcagagacagaccttcctgtgctcctagcgccagtattccaaaacttaagcttactcgccctgtgcccgcaggtgctgatctcccgcctccaaagatacgactgaaaccacaccgtctgggcgatagcgaacatgaacctgtgtacagagctgaattagttggtgagttgaacggctacctgcgagattccagtccagccccttgtgctgatggccctgcaggcggacttgccgacctgagcagtggctcttccggagaggatgatgacttcaaatcgtgtcctcaggggccacagggtcgtgaagggttagccttcctagtcagctgtcccgaaggtcgtgctgactgtgccagtgaatctgcctgcagttctgacagtctcgatgaggctcggtccagcggatcagagggaaccccagccgataccggcgacctgagcccagggcatggcgctagcgctccatctgtgagtagggaagctagacagaccgtcccccctttaaccgtgagacttcatacgcagagtgtgagtgagtgtatcaccgaggacggacggaccgtggctgtaggagatattgtctggggtcacagaaggtag

SEQ ID NO: 59214 - DNA, 540 bp, Artificial Sequence
  Description of Artificial Sequence: Synthetic coding sequence
tgacagtcacgcaggatcgagccagtcatgggaaggctgttgctgtgtgcgtcacatggtgagatcgaaaagcatccgagtctgcacgccagctcctatggactggtggctatcaaggaggctcatgacatcgagacccgtctcaacgaggtcgagaagctcctgaagactataattagcatgccctgcaaatactcaaggagtgaggtggtcttgacattttttgaacggtcacccctggaccaagtgctcaagaacgacaatgtccacaaaatccagccctctttccaaagcccagtgaagattagtgaaatcatgaggtcaaacggcttctgcctagctaatacagaaacaatcgtaatcgaccattcaatcccgaatggcagagaccagcaactgggggttgatcctaccgagcacctgttcgagaatggatccgagtttcctagcgagcttgaggatggagatgatcccgctgcctacgtcacaaacttaagttactatcacttggtgcccttcgagaccgatatctgggattag

SEQ ID NO: 59215 - DNA, 696 bp, Artificial Sequence
  Description of Artificial Sequence: Synthetic coding sequence
atggcctcagcagtttttgagggaacctcgcttgtgaatatgtttgtacgaggttgctgggtcaatggaattaggaggttgattgtgagccgcagaggagatgaagaggagttcttcgaaataaggaccgaatggagcgatagatcggttctttatttacaccggtccctcgccgatctgggcaggttgtggcagcgactgagggatgcttttccggaggatagaagcgagctggcacagggtcctttgcgacagggcctggtagccatcaaggaagctcacgacatcgaaacaaggctgaatgaggttgagaaactgctcaaaacaatcattagcatgccctgcaagtacagccggagcgaggtcgttctgacattttttgagcggtccccgctcgatcaagtcctcaagaacgacaatgtgcataaaattcaaccctctttccagagtcccgtgaaaattagcgagatcatgaggagcaatggattctgcctagccaacaccgagaccatcgtgatagaccacagcatccccaacggcagggaccaacagctgggtgttgacccaaccgaacatttgttcgagaatggcagcgaattcccatctgagttagaggacggcgatgaccccgctgcttacgttacaaatctatcgtattatcacctcgtaccttttgagaccgacatctgggattag

SEQ ID NO: 59216 - DNA, 1503 bp, Artificial Sequence
  Description of Artificial Sequence: Synthetic coding sequence
atggaagccgctcgtcccccaccgaccgcgggtaagtttgtagtcgttggaggaggcattgctggtgtgacctgcgctgagcagctagcgacccacttccccagcgaggacatactgctcgtcaccgccagccctgtgatcaaagccgtaaccaacttcaagcaaattagtaagattctggaggaatttgacgtggaggagcagtcatctaccatgctaggaaaaagatttcctaatatcaaggtgatagagtctggggtcaagcagctcaagtctgaagagcattgtattgtgaccgaagatggcaatcagcacgtgtataagaagctgtgcctttgcgcaggggcaaaacctaagctgatttgcgaaggaaacccatacgtgcttgggatcagggacacagactccgcacaagagttccagaagcagttaacgaaagccaaaaggatcatgatcattggcaatgggggaatagcacttgagttggtgtatgagatcgagggctgtgaggtgatttgggccataaaagacaaagccatcggcaacacctttttcgatgctggcgcagccgagttcctcacttcaaagctcattgcagaaaagtcggaggcaaagattgctcataaaagaacccgctacacaaccgaagggaggaaaaaggaggcaagaagcaagtctaaggccgacaatgtcggaagcgcactcggacctgattggcatgagggcttaaacctcaaggggacaaaggaattctcccacaagatccatctggagaccatgtgtgaggtaaagaagatatacctacaagacgaattcagaatactaaagaaaaaatcgtttacctttccgagggatcacaaatctgttaccgcagacaccgagatgtggcctgtgtacgtggaactgaccaatgagaagatttatgggtgtgactttatcgtatcagccacaggagttacacccaacgtcgagcctttccttcacggcaactctttcgacctgggcgaggacggcggactcaaagtcgatgatcacatgcacacgtccctccccgacatctacgcggcaggtgatatttgtacaacatcctggcagctaagtcccgtctggcagcaaatgcgactgtggactcaggctaggcaaatggggtggtatgccgcaaagtgtatggccgctgcatccagcggggattcaatcgacatggatttttcatttgaactcttcgctcatgtcaccaaattctttaactacaaggtcgtgcttttaggaaagtacaatgctcaggggctcggctcagaccatgagctgatgttgagatgtaccaagggcagggaatacatcaaagtggtaatgcagaatggaaggatgatgggcgcagtgcttattggagaaacggaccttgaggaaacatttgagaatctgattctcaatcagatgaacctgagctcctatggagaggatctactcgatcccaacattgacatcgaggattactttgactag

SEQ ID NO: 59217 - DNA, 420 bp, Artificial Sequence
  Description of Artificial Sequence: Synthetic coding sequence
atggaagccgcaaggcctcctcctaccgcagggaaattcgttgtcgtgggaggcggtatagccggagtcacatgtgccgaacagctggcgacccatttcccctctgaggatatcctgctcgttaccgcctctcccgtgatcaaagccgtgaccaactttaaacagatctccaaaatcctcgaagagttcgacgtcgaagagcagtcctcaaccatgttaggaaaaaggttccccaacattaaagtgatcgagtccggggtgaaacagctgaaatccgaggaacactgcattgttactgaggatggcaatcagcacgtctacaagaaattgtgtctgtgcgccggagccaaacccaaactcatctgcgagggtaatccgtacgtgctgggcattcgggatacagactcagcccaggtgtag

SEQ ID NO: 59218 - DNA, 1746 bp, Artificial Sequence
  Description of Artificial Sequence: Synthetic coding sequence
atggccgcttcagggaggggcctgtgtaaggccgtcgctgccagtcctttccccgcttggagaagagacaataccgaagccagaggcggattgaagcccgaatatgacgccgtggtcatcggcgctgggcacaatggccttgtcgccgctgcttacctgcagcgcctgggggttaacactgccgtgttcgagcgacggcacgtgattgggggagccgcagttactgaagagattattcctggcttcaaattttcaagggcctcatacttactgagcctcctaagacctcagatctacaccgacctcgaattgaaaaagcatggtcttcgactgcaccttcggaatccttattcttttacacctatgctcgaagaaggggctggtagcaaagtgcccaggtgcttactgttgggtactgatatggccgagaaccaaaagcagatcgctcaattctcgcaaaaggacgctcaggtgtttcctaaatatgaggagttcatgcaccgcttagctctggctatcgacccactgctggatgcagcgcctgtcgacatggcagcatttcaacacggctccctcctccagagaatgcgtagcctctcaactctcaagcccctgttgaaggccggacgcatcctcggtgcccagcttccaaggtactacgaggtgcttacagcgccaatcactaaggtgctggatcagtggtttgagtccgaaccccttaaagctacattggcaacggacgcagtcataggcgcaatgacgagcccccatacccccggtagcgggtacgtgctgcttcatcatgtaatgggtggacttgaagggatgcagggcgcatgggggtacgtgcaagggggaatgggagcactgagtgatgcaattgcctcctctgctaccactcacggagcctctattttcacggagaaaactgtcgccaaagtgcaggttaactccgagggctgtgtacagggcgtggtcttggaagatggtacagaagtgaggtctaagatggtgctgtcaaacacttccccccaaattacttttttgaagctgaccccacaggagtggcttccagaggagttcctcgagcgcatctctcagctcgacacccgcagcccagtgactaagattaacgtggcagttgatcggctaccatcatttctcgccgctcctaatgcccctcggggacagccactcccccatcaccagtgtagcatccaccttaattgtgaagataccctactcttacatcaggcgtttgaagacgccatggacggtctgcctagtcatcggccagttatcgagctgtgcataccctcatctctggaccccactctcgcaccccctggctgtcacgttgtatctctgtttacacagtacatgccttacactcttgcgggaggaaaggcctgggatgagcaagagcgcgatgcatatgcagatcgggtctttgattgcatcgaagtgtacgcacccggttttaaggactcagttgtgggcagggacatcctgacacctcccgatctggagcggatatttggcttaccagggggtaatatttttcactgcgctatgtcccttgatcaactttacttcgctaggccagtccccctgcatagcggataccggtgtccactgcagggcctgtacctctgcgggtcaggtgctcaccccggaggcggtgtgatgggcgctgcagggcgaaacgccgcacatgtggccttccgggacctgaaaagtatgtag

SEQ ID NO: 59219 - DNA, 591 bp, Artificial Sequence
  Description of Artificial Sequence: Synthetic coding sequence
atgaaacctagaaccctcgtcgagctcagtaagctgggcctgggaaatgagacggttgtccagctgcgcacactcgaattgcccgtagactaccgagaggcaaaacgcagggtgacaggaatatgggaggatcaccagccacaactggtggtccacgtggggatggacaccgcagctaaggccatcatcttggaacagagtggcaaaaatcaagggtacagggacgctgacatcagaagcttctggcccgaggggggagtgtgtctcccagggtccccagacgtactggaatccggagtgtgcatgaaagcggtctgcaagcgggtagctgtggaaggagttgatgtgatcttctccagagatgctggcagatacgtgtgcgactatacatactacttaagtctccaccacggaaagggctgcgcagctctgatccatgtaccacccctgagtcgaggtctgccagcatccctgctcggtcgtgcccttagagtcattatacaggagatgctggaggaagtgggtaagccaaagcatagggcacagtttgaggagaacagcacaatggtgctgcccgcaaaaggaaactag

SEQ ID NO: 59220 - DNA, 429 bp, Artificial Sequence
  Description of Artificial Sequence: Synthetic coding sequence
atggatacagcggctaaggccatcatcctcgagcagtctggaaagaaccaaggctatagagacgcagacataagatccttctggcctgaagggggtgtctgtctgccaggatctccagacgtgttggagtccggcgtttgcatgaaggcggtgtgcaagagggtggctgtggagggcgttgacgtcatattctcccgtgacgccggaagatacgtctgcgactatacgtattacctctctctccaccatggaaaaggttgtgcggctttaatccacgttcccccactgtcaaggggtctaccagcctctctccttggtcgagcactgcgtgtgattattcaggaaatgctggaggaagtcgggaaacccaaacatcgggcacagtttgaggagaattccacgatggtactgcccgcaaaagggaattag

SEQ ID NO: 59221 - DNA, 429 bp, Artificial Sequence
  Description of Artificial Sequence: Synthetic coding sequence
atggatactgctgccaaggccatcatactggaacagagcggaaaaaatcaagggtaccgagatgccgacattaggagcttctggccagaaggcggagtatgtctgcctggcagtcccgacgtgctcgaatccggagtctgtatgaaggccgtgtgcaagcgtgtcgccgttgaaggggtggacgtgatattttctagagatgccggtcgctacgtctgtgattatacatactatcttagccttcatcacgggaaaggatgtgcggctctgatccacgttccaccgctgagccggggactgcccgcttcactcctgggacgggctctgcgggtaatcatacaggaaatgcttgaggaagtaggcaagcccaaacaccgggcacaattcgaagaaaactctactatggtgctgcccgcaaagggaaactag

SEQ ID NO: 59222 - DNA, 8397 bp, Artificial Sequence
  Description of Artificial Sequence: Synthetic coding sequence
atgacgagcatccactttgtcgtgcaccccctgccgggaactgaagaccaattgaacgatcgtctgcgggaagtcagcgagaaactcaacaagtataatctcaatagccatcctcctcttaatgtgctcgagcaagctacaattaagcagtgcgttgtggggccaaaccacgcagcctttcttcttgaagacgggcgagtgtgccgcatcggattttcagtccagcctgacaggcttgagctgggaaaacctgacaacaacgatggatccaaattaaactccaacagtggtgcagggaggaccagtcgcccaggtcgcacttctgacagcccatggtttctgagtgggtccgagacattaggtcggctcgccggaaataccctgggcagccgctggtcctctggggtcggagggtctggtggcggatcgagcggtagatccagcgcaggcgctcgtgacagcagaaggcagactcgagttattcggaccggccgtgatagaggttcggggctactgggttcccagcctcaacctgtgatcccagcttccgtgatcccagaagagctcattagccaggcccaagtggtgctgcagggcaagtcccggtccgtgattatccgagagctccagcggactaaccttgacgtaaacctggccgtcaacaacctgctgagcagggatgatgaggacggcgacgacggcgacgatacagcatccgagtcatacctcccaggagaggacttaatgagtctcctggatgcagacatccattctgcccacccttcagttatcattgacgctgatgctatgtttagcgaggatatttcctattttgggtatccttcctttaggcgcagcagcctttcccgtctagggtctagtagggtgctactcctccctcttgaacgagactctgagctgctgagggagagagaatcggtcttgaggctgagggaacggaggtggctggatggggcttcctttgacaacgagagggggtctactagcaaagaaggtgagcctaacctggacaaaaagaacacacccgtgcagtccccagtgtccctgggggaggacctgcagtggtggcccgataaggatgggacaaaattcatctgcattggggctctgtactctgagcttttggcagtgtcctctaaaggcgagttataccagtggaagtggtcggaatccgaaccttacaggaacgcccagaaccctagcttgcaccacccaagagcaacttttctgggactgaccaacgagaagatcgtcctcctgtctgcaaatagcattagggctacagtggctactgagaacaataaagtggccacctgggtcgatgaaacattgagcagtgtggcgtctaagttagagcatacagcgcaaacgtacagtgaactgcagggcgaacgcatcgtgtctctccattgttgtgccctgtacacgtgcgcccagctggagaactcactttattggtggggcgttgttccttttagccagcgtaaaaagatgttagaaaaggcccgagctaaaaataagaagcccaaatcctccgctgggatcagttcaatgcctaacattacagtcggaactcaagtgtgtttacggaataatccactgtaccacgctggtgcggttgccttcagcatttccgccggtatcccaaaagtcggcgtcctaatggagagcgtgtggaacatgaatgattcctgtagattccagctccggtcaccagaatccctgaagaacatggaaaaggccagtaaaaccaccgaagcaaagcctgagtctaaacaagagcctgttaagaccgaaatggggcctccgccttcacccgcatccacgtgcagcgacgcttccagtatcgcatcttccgctagtatgccatacaaacgtaggcggtcgacaccagccccaaaggaagaggaaaaggtcaacgaagagcaatggagtctccgcgaagtggtttttgtcgaggacgtgaaaaacgtgcctgttggtaaggtgctgaaggtggatggagcttatgtcgccgtgaagttcccaggaacaagttccaatacaaattgtcagaactcttcaggtcccgacgcagatccctcgagtcttctccaggattgtagactcctccggatagacgaactgcaagtcgtaaaaactggcggtacccctaaggtgcctgattgttttcagcggacccctaaaaagctgtgcatacctgagaagaccgagatcctggcggtgaatgtcgattctaagggcgtccacgccgtgcttaagacaggcaactgggtgcgctactgtatctttgatcttgcgaccgggaaagcggagcaggagaataatttccccacttctagcatcgctttcctcggccagaacgagcgcaatgtggcaatattcacagccggacaggaaagcccgattatcctgcgtgacggaaacggtacaatctatccgatggccaaggactgcatgggtggcattagggatcctgactggctcgatctgcccccaatctctagcttgggcatgggagtgcatagtttgattaatttgcccgcaaatagtaccataaaaaagaaggcagcagtgatcataatggccgtggagaaacagacactgatgcagcatattctaagatgcgactacgaagcatgccggcaatatctgatgaatctggaacaggcagtcgtgctcgagcaaaacctgcagatgctgcagacttttatttcccacaggtgcgatgggaaccgcaacatattgcacgcctgtgtgtcagtttgttttcctacctctaataaggagacaaaagaagaggaggaggcagaacgcagcgagcggaacacgtttgcagaaagactttccgccgtggaggcgatcgctaacgctatcagtgtcgtgtcatccaatggacccggaaatcgcgcagggagcagcagttctcggagccttagacttcgtgagatgatgagacgctcccttcgcgctgctgggctgggaaggcacgaggcaggggcatcctcatcagatcatcaagatcccgtcagccctccaattgcacccccttcctgggtccccgaccccccagccatggacccagatggggatattgactttatactggctccagctgtcggaagcttaacgacggctgccactggcacagggcaaggaccaagtacctcgaccattcctggcccaagtaccgagccatcagtcgtggagtctaaggatcgtaaggctaatgcacacttcatacttaaactcttatgtgatagcgtcgtgctgcaaccctacctacgggagttgctgagcgccaaggacgctcgtgggatgactccttttatgagcgccgtgagcggcagagcctatccagcggctatcacaatactagaaacagctcagaagattgctaaagctgaaatcagttcttcagaaaaggaagaggatgtctttatgggcatggtttgcccatcagggaccaatcctgatgactctcccctgtatgtgttgtgctgcaatgacacctgttcttttacctggacaggggcagaacatatcaaccaggacatttttgaatgtaggacatgtggcctgctggagagcctttgttgttgtacggaatgcgcccgagtgtgccacaaagggcacgattgcaaactgaaacggacttcaccaaccgcttattgcgattgctgggagaaatgtaagtgcaagaccctgattgctggtcagaagtctgccaggctggatttactgtatagattattaacagcgaccaatttggtgaccctgcctaactcccgcggtgaacacttgctgctgtttctggtccagactgtggccaggcaaacagtcgagcactgccagtatagacccccaaggatccgtgaggatcgaaacagaaagaccgccagccctgaagacagcgatatgcccgaccatgacctggagccaccaaggttcgcccaacttgccttggaaagagtgcttcaggactggaatgccctgaaaagcatgatcatgtttggatctcaggagaacaaagatccgctgagtgcctccagtaggataggtcacctcctaccagaagaacaggtttacctgaaccagcagtctggtaccatcagacttgactgcttcacccactgccttattgtcaagtgtaccgccgatatcctgctgttagatactctgcttggcaccttggtcaaagagttgcaaaacaaatatactcccggaagacgggaagaagccatagctgtcaccatgcggttcctccggagtgtggcccgtgtttttgtaattctttcggtggagatggcgtcaagcaagaaaaagaataacttcataccacagcctatcggtaagtgcaagagagtctttcaggcgctgctgccttatgccgtagaggagctatgcaacgtggcagagagcctcatcgtgcccgttcggatggggatcgcacgtccaaccgcccctttcactctagcgtcgactagcatcgacgcgatgcagggctccgaagagttgttttctgtcgagcctctcccccctagaccatctagcgaccagtcatcatcctcaagtcaaagccagtcaagctacataataagaaacccacagcaaagacggatatcgcagagccagcctgtgagaggaagagatgaagagcaggatgatattgtgtctgcagatgtggaggaagttgaggtggtggaaggcgtggctggagaagaggaccaccatgacgaacaagaagaacatggtgaggagaacgcggaggcggagggccagcacgacgagcacgacgaagatgggtccgacatggaactagatctgctggcagccgctgagactgaatccgactctgagtctaaccattcaaaccaagacaatgccagcgggagacgatctgtggtgaccgctgccacagcgggaagcgaggcgggtgcaagctccgtacccgcatttttctcagaggatgattctcagagcaatgactcctcagactctgactcaagcagcagtcaatcagatgacatagaacaggagaccttcatgttagacgagccattagagagaaccaccaacagctctcatgccaacggcgcagcccaggcacctagaagcatgcagtgggccgtgcgcaacactcagcatcaaagagccgcatcaaccgctcctagcagtactagcacacccgcagcatctagcgcgggtctgatttacattgacccatccaatctcagaagaagtgggaccattagcacatccgcagcagcggctgcagcagccttagaagcgagtaacgcaagcagctacctcacctcagctagctctttggcccgagcatacagcatcgtgatcaggcaaatttctgatttgatggggctgatacctaagtacaatcacctcgtttatagccaaatcccagccgctgtgaaacttacttatcaggacgcggtgaatctgcagaactacgtggaggagaagttgattcctacgtggaactggatggtttcgataatggacagcactgaagctcagctcaggtatggctccgcgctggctagtgccggagatcctggtcatcccaaccacccactgcacgccagccaaaatagcgccaggagggagcggatgaccgcacgtgaggaggcttccttgagaaccttggagggtaggcgccgtgctactctgctcagcgcgaggcagggcatgatgagtgcgaggggcgacttcttgaactacgccctctcactgatgcgctcacacaatgacgagcattccgacgtgttgcccgtgctggacgtttgctctctcaagcatgtcgcttatgtgttccaagcactaatttactggataaaggcaatgaatcagcagacgactcttgatacgcctcagctggaaaggaaacggacccgagaactgctggagctgggcatcgataatgaagactccgaacacgagaacgatgacgatactaatcaatccgcgactttgaacgacaaggatgatgactcactcccggctgaaactggtcagaatcaccccttctttcggagaagcgactctatgactttcctagggtgtatcccgcctaatcccttcgaggttcccctcgccgaagccattccactagccgatcaaccgcacttgctgcagcctaacgccagaaaggaagatctgtttggacggccatctcaaggcctttattcgtccagcgcctcgtcggggaaatgcttgatggaggttacagtggatcgcaactgtctggaggttctcccaacgaagatgtcttatgccgcaaatcttaaaaatgtaatgaacatgcagaatagacaaaagaaggaaggtgaggagcaacctgtgctgccagaggaaacagagtccagtaagcctggaccctcagcgcatgacctggctgcccaattgaaatcctcgctgctggcagaaattggcctcaccgagtctgaggggcctcctctcacgtcattcagaccccagtgtagctttatggggatggtcatcagccacgatatgctcctaggaaggtggcgtctcagcctcgagctcttcgggcgagttttcatggaagatgtcggcgctgaacccggatcaattctgacggagctgggcggattcgaggtgaaggaatccaaatttcggagggaaatggaaaaactccggaatcagcaatctagggatttgtccctggaggtggaccgggatcgggacctcttaatacagcaaacaatgcggcagctaaacaatcatttcgggcgacgctgtgcgactacccctatggctgtgcacagagtcaaagttacttttaaagacgagccaggcgagggttcaggggttgctcgctcattttatactgccattgcacaggctttcctcagcaatgagaagctgcccaatctcgaatgcatccagaatgcaaataaaggcacccacacctctcttatgcagcgcctccgaaatcgcggagagcgcgaccgagaacgggagcgggagcgcgagatgcggagatcttcagggctgcgagctggatctaggcgcgatagagaccgggattttcggagacaattaagtatcgacacgagaccgtttcgaccggcttcagagggaaacccctctgatgacccagaaccgcttcccgctcacagacaggctctgggcgagagactgtacccccgtgtgcaggcaatgcagccagctttcgcctctaagattacgggcatgctgcttgaattgtctccagcccagcttctcctcttgttagcatccgaagattccctccgggcacgagtggatgaggcaatggaattaatcattgcccacggccgtgaaaacggcgcagactccatacttgatctcgggttggttgactcatcagaaaaagtgcaagaaaaccgtaaacggcacggctccagccgcagcgtcgtggatatggacctagatgataccgacgatggggacgataacgcgcctcttttctaccagcccggaaaaagggggttctatacgccacggccaggtaaaaatacggaagctcggctgaactgcttcaggaatatagggaggatcttaggcctgtgcttgttgcaaaacgagctctgccctatcaccttgaacaggcacgtaattaaagtcctgttgggccgtaaggtaaactggcacgatttcgccttttttgatcctgttatgtatgagtccctgcgccagctgatcctcgcctcccagtcctccgacgcagacgctgtgtttagcgctatggacctcgcttttgctatcgacctgtgtaaggaggaagggggaggccaggtggagctgatcccaaatggggtcaatattcccgtcacaccccaaaacgtgtacgagtacgtaagaaagtacgctgaacatagaatgctcgtcgtggcagagcagcccctgcacgcaatgagaaaggggctgctggatgtgctgccgaaaaacagtttagaggacctcacagccgaagatttccgactcctagtcaacggctgtggtgaagttaacgtccaaatgctcatctccttcacatcttttaacgatgaatctggcgagaacgcggagaaactgcttcaatttaaacggtggttttggtctatagtagagaagatgtccatgaccgaacgccaggatctcgtgtatttctggacgtcctctccctcactgcccgcatccgaggaaggattccagccaatgcccagcatcacaataagacccccagatgaccagcatctccccaccgcgaatacgtgtatttcccgcctgtatgttcccctgtatagtagcaagcagattttaaaacagaagttgctgctcgcaatcaaaacaaagaactttggattcgtttac

SEQ ID NO: 59223 - DNA, 414 bp, Artificial Sequence
  Description of Artificial Sequence: Synthetic coding sequence
atggcacgaggtcggcatgtgggttcatccgaaactaaattgctgcaacacctgctcgaagcgtgtggtagatgcgaagaggtgccggaagcatacgttgacatccacacggggctttccggttccggcgtggcctttgtttgcgccttctctgaagccctggcagaaggcgcagtgaaaatgggcatgccatcctccctcgcccacaggattgcagcccagaccttgctgggaaccgccaaaatgctgctccacgaagggcagcacccggcacagttgcgcagtgacgtctgtacgcccggtggaaccacgatttacggacttcacgctctcgagcaggggggtcttagggctgctaccatgtccgcagttgaagcggcaacgtgtagggcaaaagaattatccagaaagtag

SEQ ID NO: 59224 - DNA, 762 bp, Artificial Sequence
  Description of Artificial Sequence: Synthetic coding sequence
atgacacagggcacagaagacttgaagggacctggccagagatgcgagaacgaacccttgcttgaccccgtagggccagagcctttgggtccagagtctcagagcggcaagggagatatggtcgagatggccacacggttcggatccaccctccagctggatttggagaaagggaaagagagcctgcttgaaaagcggttggtcgcagaggaggaggaggacgaggaggaggtcgaagaggacggaccttcgagctgctccgaggatgactattctgaactgctgcaagagatcactgacaacctcactaagaaagagattcagatagaaaaaatccacctagacactagctcgtttgtggaggaacttcctggcgagaaagacctggcgcacgtcgttgagatctatgatttcgaacccgctctgaagacggaagatctgctcgctaccttctccgagtttcaggagaaaggtttccgcatccagtgggtggatgatacccatgctttgggaatcttcccatgcctggcatccgccgcagaagcacttaccagggagttctcagttctgaaaattcggcctttgacgcagggcacaaagcagtccaaactgaaagcactgcagcggcctaaactgctccggctggtaaaggaaagaccccaaaccaacgcaacagtggctaggcggctggtggctagagctttaggattacagcacaagaaaaaggagagacctgctgtgcggggaccattaccaccttag

SEQ ID NO: 59225 - DNA, 1443 bp, Artificial Sequence
  Description of Artificial Sequence: Synthetic coding sequence
atgaatatgaaggccagccgcgtcactcttggggaggcgggagcccgagccaggtggcctctcggaacgcccagagcagctgccacacggagagaagctgcagctcttccaccggtcaccctcgctctgttgtgcctggacggcgtttttttaagttctgcagagaacgacttcgtgcaccggatacaagaggagctggaccggttcttgctacaaaagcagctaagtaaagtcctgctctttccacccctgtcgtcccgtctgcgatacttgatccaccgtaccgcagagaattttgatttattgtcatcattctccgtaggcgaaggatggaaacgaaggaccgtgatttgccatcaggacatccgcgtgccaagtagtgacggactcagtgggccatgtcgcgcacctgcaagctgccccagtcggtatcacggccctagaccaatatcaaaccagggtgctgcggctgtccctcggggagccagagccggaagatggtacagaggcaggaagcccgatcagcccctttacgttccacgggtgctgcgacggcaggaggagtgggggctgacaagcacatctgttcttaagagagaagcccctgctggcagggatcctgaagagccaggtgatgtgggggctggggatcccaatagtgaccagggtctgccagtcctcatgacgcaggggaccgaggatttgaagggacccggtcagagatgcgaaaatgaacctttactagacccggtgggccctgagccactggggccagagagtcaaagcgggaagggtgatatggtcgagatggccacaagattcggctctaccctgcagctagatttggagaaaggtaaggaatccctgctagagaaaagacttgtcgcagaagaagaggaggacgaggaggaggtggaagaggacggtccaagctcttgcagtgaggatgattactctgagctgctccaggagatcaccgacaatctgaccaagaaggaaattcagattgagaaaatccacctagacacatcctcctttgttgaggagctgccaggtgagaaagacctcgcacatgtcgtagaaatctatgactttgagccagccttaaaaactgaggatctgctcgctacctttagtgagttccaggaaaaaggcttccgaattcagtgggtagacgacacccacgccctggggattttcccgtgtcttgctagcgccgcagaggccctgaccagggagtttagtgtgctgaagattcgacccctgactcaagggactaagcaaagcaagctgaaagccctgcagcggcctaaacttctccgacttgttaaggagcgacctcaaaccaacgctaccgtggccaggcgactggttgcaagggctctgggactgcagcacaaaaagaaggagcggcctgctgtgagaggtcccctccccccttag

SEQ ID NO: 59226 - DNA, 762 bp, Artificial Sequence
  Description of Artificial Sequence: Synthetic coding sequence
atgacccaggggacagaagatctcaaagggcctggccagaggtgcgagaatgagcctctgctggacccagtgggcccagaacctctggggcctgagtcacaaagcggcaagggggacatggtcgagatggcaacaaggttcggcagcacgctgcagctggatttggagaaaggaaaagaaagcctgctcgaaaaaaggctggttgctgaagaggaggaggatgaagaggaggtggaggaagatgggccttcaagttgcagcgaggacgactatagcgaacttctgcaggaaataactgataaccttaccaagaaggaaatccagattgagaaaattcatctggacacatcatcctttgttgaagagctcccaggggaaaaggatctcgcacacgttgtcgagatttacgatttcgagcctgcactaaagaccgaggacctcctggccacgttttcagagttccaggagaaaggatttagaatccagtgggtggatgacacccatgcactgggcatttttccttgtttggccagcgctgcggaggctctgacacgcgagttctccgttctcaagatcagaccactcacacagggcaccaaacagagcaaactgaaggcactccaacgaccgaagctgctcagattagttaaggaacgcccacagaccaatgccaccgtggcaagaaggctggtcgcacgggcactgggcttgcagcataaaaagaaggaaaggcccgctgtacggggaccactgcccccttag

SEQ ID NO: 59227 - DNA, 111 bp, Artificial Sequence
  Description of Artificial Sequence: Synthetic coding sequence
atgacccagggcaccgaggatctgaaagggcctggacaaaggtgtgaaaacgaaccgcttttagacccagtcggaccagaaccgcttggacccgaatctcagagcggatag

SEQ ID NO: 59228 - DNA, 402 bp, Artificial Sequence
  Description of Artificial Sequence: Synthetic coding sequence
atgactcagggaactgaggacctgaaaggcccagggcaacggtgcgagaacgagccactgttggatcccgtggggcctgagccactgggcccagagagtcaaagcgggaagggggatatggtcgagatggccacacgattcggcagcacacttcaactggacctggagaaaggtaaggagagcctgttggaaaagcggctggttgcagaggaggaggaggacgaggaggaagtcgaagaggacggtccgtccagttgctctgaggatgactactctgaactgctccaagagatcactgataacctgactaaaaaagagattcagattgagaaaatccatttggatacttcaagttttgtggaggagctgcccggagagaaggatctggctcatgtggtttag

SEQ ID NO: 59229 - DNA, 291 bp, Artificial Sequence
  Description of Artificial Sequence: Synthetic coding sequence
atgacccaaggcaccgaagatctgaagggcccaggccaacggtgcgagaacgaaccactcttggatcccgttgggcctgagccactgggccctgagtcccagtccggcaagggggacatggtggaaatggcaacaaggttcgggtcaacactgcagctggatctcgaaaagggaaaagagagcctcctagaaaaaagattggtggctgaggaggaagaagacgaggaggaggtggaagaggacggcccaagttcatgctcggaagatgactatagcgaactgcttcagtag

SEQ ID NO: 59230 - DNA, 3300 bp, Artificial Sequence
  Description of Artificial Sequence: Synthetic coding sequence
atgaggatgtccgatacagtgacagttaaggacgagactgccacgatgaaggatctcgaggctgaggtcaaggacactacaagggtagaaaatctcatcaaaagcgaaaattacggcaaaatcttggtggaaaaaaatgaacactgcatcgaaaacaacatcgatctgcagcggccactgcaatctttcggtcagacaggcaagaggagtaaatcttcctctaaactgaaactcgttaggagtctcgctgtttgcgaagagagcccccctccccctgcccctgagatttcacaggagaatcaggaaaagatccagattcagttgactcagtccttcgaaaaggaggagaagccgtctaaggacgaagctgaaaaagaaaaggcatccgacaaactcccaaggaagatgttgtctagagacagcagccaggaatacacggacagcaccggcatcgacctgcatgaatttctggtcaacactctcaagaacaaccctagggataggatgatgttgctgaaattggagcaggagatccttgattttatcggtaataacgagagccccagaaagaagttcccacctatgactagctatcacagaatgttgttacatagagtggcggcttactttggcctggatcacaacgtggatcagagcggtaagagcgtgatagtaaataaaacttcaaatactaggatccctgaccagaaattcaatgaacatataaaggatgacaaaggggaggatttccagaagaggtacattctgaagcgcgacaactcatcttttgacaaggacgacaaccagatgcgcattcgcctgaaggacgataggcgaagtaagagcatcgaggaaagagaggaggagtaccagcgcgcacgggaccgtatcttcagccaggattcactgtgcagccaagagaattatataatcgacaagagactgcaagacgaagacgcctccagcacgcagcaaaggaggcaaattttccgggtcaacaaagacgcttccgggagatcaacgaacagtcatcagtcctcgacagagaatgagctcaaatattcagaaccccgtccctggtcctctaccgatagtgatagcagcttgaggaatttaaagccggcagttaccaaagcctcatccttctctggcatttccgtactgacccgcggtgacagtagtgggagctctaaatcaatagggagattgagcaagaccggatctgagagttctggctccgtcggctcatctacaggctctctgtcccacatccaacagcccctgccgggtaccgcactctcacagagtagtcacggggctcccgtagtgtaccccacagtctccactcactcctccctctccttcgacggagggctgaacgggcaagtcgccagccccagtacttcgttcttcctgttgcctcttgaggctgccggaatccctcctgggagcatccttataaaccctcaaactggtcagccatttattaacccggacgggtcaccagttgtgtataaccccccaatgacccagcagcccgttcgcagccaagtgcctgggcctccccaacctcctcttcccgcacccccacagcaacctgctgctaaccatattttcagccaggataatctggggtctcagttcagtcacatgtccttggcgcgacagcccagcgccgacggatctgatcctcacgccgcaatgttccagtcaaccgttgtcctacaaagtccacaacagagcgggtacattatgacagcagcacccccaccccaccccccaccccctccaccaccaccgccacccccaccaccgttgcctcctgggcagcccgtgcccacagccggatatccagcctccggccatcccgtatctcagccagtgttgcagcaacaaggttatattcaacagccgagccctcagatgccagcttgctactgcgctcccggtcactaccactcatcacaaccccaatacagacccgtaccgtctgtccattataattcccatttgaaccaacccctcccacaacctgcccagcagactggctaccaagttattcctaatcagcagcagaattaccaaggaatcgtgggcgtgcaacagcctcagtcccaatcccttgttagcggccagcctaattccatcggaaaccagatacagggtgtggtgatcccctacacatcagtccctacatatcaagtgagcttgcctcagggcagccaagggatcccgcatcagacttatcagcagccagttatgttccctaaccaatcaaatcagggtagtatgccaacaaccgggatgcctgtgtattacagcgtcattccacccggtcagcagaacaacttgtctagctcagtgggatacctccagcacccaggttccgaacaggtgcaatttccacgaacaacgagcccttgctccagccaacagctgcagggccatcaatgtactgctgggcctccccctccacctgggggtggtatggtcatgatgcagttaagcgtgcctaacaatcctcagagctgtgcccactctccgcctcagtggaagcaaaataaatactattgcgaccaccagcgcggacagaaatgtgtcgagttttctagtgtggacaacatcgtacagcattcacctcaactgagcagcccaatcatatcccccgcacagagccctgcccctgcccagctgagtacactcaaaacggtgcggccatctgggcctcctctgtcaattatgccccagttctctcgcccattcgtccctggccagggggactctaggtatccactgttaggacagccacttcagtacaaccctccagctgtgctgcacgggcatatcccaaaccagcagggccagcccggtagcagacacggcaaccgcggacgtcggcaggccaagaaagctgccagcacagatctcggggcaggagagactgtcgtggggaaggtgctggagattacagaactaccagatggcattacacggatggaggccgagaagttgtttggagagcttttcaaaatcggcgcaaagattagatggctccgtgacccacagtcccaaccacgcaggcaccccctgtgctgcggctccggggataacacggcaaatcctgaacgtagcaagcctagcgatcttgcctcaacctatacggtactggcgacattcccatccatttccgcagctcaaaatgcgcttaaaaaacagatcaactctgttaataagttcaaactgaggaccagcaagaaacattatgatttccacatccttgaaagggcttctagccaatag

SEQ ID NO: 59231 - DNA, 2913 bp, Artificial Sequence
  Description of Artificial Sequence: Synthetic coding sequence
atgcgcatgtcggataccgtgactgtcaaggatgaaaccgcaacgatgaaggatctcgaagctgaggtcaaagatacaacaagggtcgaaaacctcattaaatctgaaaattacggcaagattctcgttgagaaaaatgagcactgtatcgagaacaacatcgatctccaggagaaaattcagattcagctgactcagtctttcgagaaggaggagaagcctagcaaggacgaagcggagaaagagaaagcaagtgataaactaccaagaaagatgctgagtagagatagctcacaggagtacacagactcgacaggcatcgacttgcacgagttcctggtgaatactctcaaaaacaaccctagagaccgcatgatgctcttgaagctggagcaagaaatcttggattttatagggaataacgagagcccgcgaaaaaaattcccaccaatgacttcctaccatagaatgctgctgcaccgagtggcagcttattttgggctggatcacaacgtggaccaaagcggcaagagcgtgattgttaacaagacctctaatactagaattcccgatcagaaatttaatgaacacattaaagatgacaaaggggaagatttccagaaacgctatattctaaaaagggacaacagctcttttgacaaggacgataaccaaatgagaattcggttgaaggatgacagacgctccaaaagtatagaggagagagaggaagagtaccagagagccagggatcgaatcttctcacaggattccctgtgctctcaggagaactacatcatcgataagcggctgcaggatgaagacgcctcttcaacacagcagagacgccagatctttcgagtcaataaggatgccagcgggcgttctactaatagtcatcaatctagcaccgaaaacgaactgaaatactctgaaccgcgaccttggtcatcaactgatagtgacagttcattaaggaacctgaaacctgcagtgacaaaggctagctcattttccgggatttccgtattgactcggggagattcttctggatctagtaaaagtatcggaaggctgagtaagacagggcagccattcatcaaccccgatgggagtcctgtggtatataatccaccaatgacacaacagccagtgcggagtcaggtccccggaccaccgcaaccgccattacctgccccacctcagcagccagccgctaaccacatcttctcccaggacaacctgggttcccagttcagccacatgagtctagcccgacagccaagtgccgacggcagcgatcctcacgctgctatgttccagagcactgtggtcctgcagagccctcaacagtctgggtacattatgaccgcagccccaccaccacacccaccgcctcccccacctccgcctccgcctccccctccccttccaccaggccagccagttccaacagctggatacccagcttcagggcatcctgtgagccagccggtgctccaacagcagggctatattcagcagccaagtccccagatgccagcatgttactgcgcccctggccattatcactcctctcaacctcagtaccgaccagtcccttctgttcattacaattcacatctgaatcagccattaccacagcccgcacagcagacaggctaccaagttatcccaaaccagcaacagaattatcagggtattgtaggggtccagcagccgcagagtcagtccctcgtgtcgggacagcccaacagtatcgggaaccagatacagggggtggtaatcccatatacctccgtacctacctatcaggtgagcctgccgcagggctcacagggaattccgcatcagacataccagcaacccgtgatgtttcctaatcagtcgaatcagggatcgatgcctactaccggcatgccagtctactattccgtgatccctccaggtcagcaaaataacctgtctagcagcgtcgggtacctccagcatcccggatcagagcaagttcagtttccgcgtactacctccccatgttcatctcagcagttgcagggacaccagtgtaccgccggtcccccaccccctcccggtggtggcatggtgatgatgcagctgagcgttcccaataatcctcagtcatgtgctcactctcctccacagtggaaacagaataaatattactgcgatcatcagagaggtcaaaagtgcgtcgagttctcctcagtagacaatatcgtgcagcacagtccccagctcagcagcccaatcattagccccgcacaatcgccagcccctgcccagttgagcacactgaaaactgttcggccttcggggcctcctttgtcaattatgccccaatttagccgacccttcgtgcctgggcagggtgatagccgctaccctctgttgggccagcccctccagtacaacccccctgcggtgctccacggtcacatcccaaaccagcagggccagccgggatcacgccacggcaaccgcggtcgccgtcaggccaaaaaggccgcttcaaccgacctgggtgccggagagacagtcgtgggcaaagtcctggagattaccgagctgcctgatggtatcacacgcatggaagcggaaaagctctttggcgaactcttcaaaattggggctaagattagatggctgagggatccacagtctcaaccacgacggcatccactctgttgcggttccggcgacaacacggctaatccagagcgctccaaaccttcagacctcgcctcaacttatacggtcctggcgacatttccttctataagcgccgcacagaatgccctcaagaagcagattaacagcgtcaacaaattcaagttgaggaccagcaaaaagcactatgacttccacatcttggagcgggctagctcccagtag

SEQ ID NO: 59232 - DNA, 807 bp, Artificial Sequence
  Description of Artificial Sequence: Synthetic coding sequence
atggtggcactagaaaatcctgagtgtgggcctgaggctgcagagggtacacccggtgggagacggctcttacccctgcctagttgccttcccgctctggcgtccagccaggtcaaacggttatccgcatcacggagaaaacagcacttcattaaccaggccgttcgtaatagcgacctggtgcccaaggcaaaaggaagaaagtccctgcagcgtctggagaatacccagtacctgttgactttgttggagacggatgggggtctgccgggactcgaagacggggacctcgctcctcctgcgtcccccggtatcttcgccgaagcttgtaataacgcaacgtatgtggaagtttggaacgatttcatgaatcggtctggcgaggagcaagagcgcgttttgcgctacctggaagacgaaggtagatctaaggctcggagaagggggcctgggcgaggggaagacaggcgccgagaagaccccgcatacactcccagagagtgctttcagaggatatcaagaaggctccgggctgtgttaaagaggagccggatccctatggaaacactcgagacctgggaggaacgcctcctacgctttttctctgtctctcctcaggctgtatacacagctatgcttgacaatagttttgaacggttgttgctacacgccgtttgccagtacatggatcttatttccgccagtgctgacctggaagggaagcgccaaatgaaagtgtcaaacagacacttggactttctcccccctggactcttgctctcggcttatttggagcaacacagttag

SEQ ID NO: 59233 - DNA, 690 bp, Artificial Sequence
  Description of Artificial Sequence: Synthetic coding sequence
atggctgaggacaaaactaagccatcagaactagatcagggcaagtatgatgctgacgataatgtcaaaatcatttgtctaggagactcagccgtagggaaatctaagcttatggagagattcctaatggacgggttccagcctcaacagctgtccacgtacgctctgacactgtataaacacactgccacagtcgatggccgaactatcctcgtcgacttttgggacaccgctggccaggagcggtttcagtctatgcatgcctcttattaccataaagcgcacgcctgcatcatggtcttcgatgttcagagaaaggtgacctatcggaacttgagtacatggtataccgagttgcgggagtttaggccagaaatcccttgcatcgttgtggcaaataaaatcgacgctgacattaacgtcacgcaaaaatccttcaatttcgccaagaagttcagcttaccactgtatttcgtttcggccgcagacggcaccaacgttgtcaaattgtttaacgatgctatacggctagctgttagctacaagcagaactcacaggatttcatggacgagatcttccaagagctcgagaatttttccctggaacaggaggaagaggacgtccctgatcaagaacagtcatccagtatcgagacgcccagcgaagaagccgcatcaccccactcttag

SEQ ID NO: 59234 - DNA, 687 bp, Artificial Sequence
  Description of Artificial Sequence: Synthetic coding sequence
atggcagaggacaagaccaaaccttcagagctcgaccaagggaaatatgatgcagacgacaacgtgaaaattatttgcttaggagacagcgctgtggggaaatctaaactcatggagcgtttcctgatggatggatttcagccccagcaattgtctacatacgccctgaccttatacaaacacaccgccactgtggacggtcggacaatccttgtggacttctgggatacggcgggtcaggaacgctttcaatctatgcacgctagctactatcataaagcccacgcatgtatcatggtcttcgatgtgcagcgcaaggttacctacagaaacctgtcaacctggtacacagagctgcgagagttccgcccagagattccttgcatcgtggtggccaataagatagatgatataaacgttactcagaaatcatttaatttcgccaagaaattcagcctgcccctgtacttcgtatccgcagccgacgggactaacgttgtgaagctctttaacgacgctatacggttggccgtgtcctataaacaaaactcgcaggacttcatggatgagatcttccaggagctcgagaacttcagcctggaacaggaggaagaggatgtgcctgaccaggagcagtcctccagcatcgagacaccctccgaggaggccgcttccccacacagctag

SEQ ID NO: 59235 - DNA, 690 bp, Artificial Sequence
  Description of Artificial Sequence: Synthetic coding sequence
atggccgaggacaaaactaagccaagcgagctcgaccaaggcaagtacgatgctgatgataacgtgaagatcatctgcctcggagatagtgctgtgggtaagtcaaagctgatggaaaggtttctcatggatggtttccagccccaacagctcagcacctatgccctgactctgtacaagcatacagcaaccgtcgatggtcggacaattctcgtagacttctgggacaccgccggacaggaacgctttcaatctatgcatgctagctactatcacaaagctcacgcctgcattatggtgtttgatgtgcagcgcaaggttacatataggaacttatccacttggtacaccgagttgcgtgaattccggcctgaaatcccctgcatcgtggtcgctaacaaaatagacgccgacatcaacgtgactcagaagtctttcaattttgccaagaaattttccttaccgctgtacttcgtgagtgcagcagacggaactaatgttgtgaagctgttcaatgacgctattcggctcgcggtgagttacaaacagaacagtcaggacttcatggatgagatctttcaagaattggagaacttctccctggaacaggaagaggaggatgtaccagaccaggaacagagtagctccattgaaaccccgtcagaggaggccgcatctcctcacagctag

SEQ ID NO: 59236 - DNA, 558 bp, Artificial Sequence
  Description of Artificial Sequence: Synthetic coding sequence
atgcttaaggccaaaatcttattcgtcggaccttgtgaaagcggcaaaactgtcttagccaatttccttacagaaagttcagatatcaccgagtattccccaacccagggggtcagaatcttagaattcgaaaacccgcatgtgaccagcaacaataagggaactggttgcgagtttgaactttgggactgtgggggagacgctaaattcgaatcttgctggcctgccctgatgaaggacgctcacggagtggtgatcgtcttcaatgcagacattccatcccacaggaaagaaatggaaatgtggtatagctgttttgtgcagcagccatcattacaggacacccagtgcatgctcatcgcacaccacaagcccggatcaggtgacgacaagggttctttgtcgctcagtccaccactgaacaaactgaagctcgtgcacagcaacctagaggacgaccctgaagagattagaatggaattcattaaatacctgaagtctatcattaactccatgtcagaaagcagagatagggaggagatgagcatcatgacatag

SEQ ID NO: 59237 - DNA, 558 bp, Artificial Sequence
  Description of Artificial Sequence: Synthetic coding sequence
atgctaaaggccaaaattctctttgtggggccatgcgagtctggcaaaacagtgcttgcaaatttcctgaccgagtcctccgatatcaccgaatacagcccgacccagggcgtaagaatccttgaattcgagaatcctcacgtcaccagcaacaacaagggcactggttgtgagtttgaactttgggattgtggaggtgatgccaagttcgaatcttgttggccagctctcatgaaagatgcacacggcgtagtaattgtgttcaacgccgacatcccatcacacagaaaagagatggaaatgtggtactcttgtttcgtgcagcagccctccctgcaagatacccagtgcatgctgattgcccatcataagcccggatccggtgacgataaaggctccctgtcacttagcccccctttaaacaagctcaaactcgtgcacagcaatttggaagacgaccctgaggaaattcggatggaattcattaaataccttaagtctataatcaattctatgagcgagtcccgcgaccgcgaggagatgagcattatgacatag

SEQ ID NO: 59238 - DNA, 468 bp, Artificial Sequence
  Description of Artificial Sequence: Synthetic coding sequence
atgctgaaagccaagatcttgtttgtagggccttgtgaatccggcaaaactgttctggcgaacttcttgacagaaagctctgatataacagagtattccccaacccagggtgtgagattcgagtcatgttggcccgctctgatgaaagacgcgcacggcgttgtcatcgtgttcaacgctgacatcccctcccataggaaggagatggagatgtggtacagttgtttcgtccagcagccgagcctacaggacacacaatgcatgttgatcgctcaccacaagccgggatccggagacgataagggtagtctgagccttagccccccactaaataagttgaaactcgtgcactccaacctagaggacgaccctgaggaaattcgtatggaattcattaaatacctgaagtcgataattaactccatgagtgaatcccgggacagagaagagatgtccatcatgacctag

SEQ ID NO: 59239 - DNA, 327 bp, Artificial Sequence
  Description of Artificial Sequence: Synthetic coding sequence
atgaaagatgctcacggagtcgtcattgtgtttaatgccgacataccctctcacagaaaggagatggagatgtggtatagttgtttcgtccagcagccctcgctgcaggacacacagtgcatgttgattgcccatcataaacccggatcgggggatgacaaaggctctctgtctctttccccaccactaaataagctgaaactagtccactccaacctggaagatgatcccgaggaaatacgaatggagttcataaagtacctaaaatccattatcaactcaatgtctgagtcgagagatagagaggagatgtccatcatgacctag

SEQ ID NO: 59240 - DNA, 327 bp, Artificial Sequence
  Description of Artificial Sequence: Synthetic coding sequence
atgaaagatgctcacggggtcgtgatcgtctttaacgctgacattccaagtcaccgcaaagaaatggaaatgtggtacagttgcttcgtgcaacaaccctcattgcaggacacacagtgcatgctgattgcccatcacaagccagggtccggcgatgacaagggctccctatccctgtctcctcctctaaataaacttaaactcgtgcattcgaacctcgaggatgatcccgaagaaatccgaatggagttcatcaagtacctgaagtcaataattaatagtatgagtgaaagcagagaccgcgaggagatgtctattatgacctag

SEQ ID NO: 59241 - DNA, 1071 bp, Artificial Sequence
  Description of Artificial Sequence: Synthetic coding sequence
atggattcttctgaggaacacgccggatgccctgcgaggggtacctgcccagtgttcctggccatgtctgcgggaaccgtcagatacgctccctcgggactgtgccccgtcctggaaggcaacctcagagaggagccatggggcactgatagcccgcctcagcccgaccagggcctcccacctccactcgcagctgttcccgtgccgtggaagagtactgatccttgtcaggggcaccgggagtcaccaggcgcactggtggagacttccgctggagaagaggcccagggacaggaaggacccgctgcagcccaactggacgtgctgcgactccggtcttctagtatggaaatcagggagaagggcagtgagtttctgaaagaggagctacatcgggcacaaaaagagctgaagctcaaggacgaggaatgtgaaaggctgtcaaaggtacgtgagcagttggagcaggagctcgaggagttgaccgctagtcttttcgaagaggcccacaagatggtgcgggaggctaacatgaaacaggctgcctcggagaagcaacttaaggaagcgagaggtaaggtcgatacaatcctatttgcagaattccaggcgtggcgggagtcccctaccttagataaaacatgtccatttcttgaacgggtgtacagggaagacgttggaccatgcctcgatttcactatgcaagaactgagcgtactggtgagagccgctgtggaggataacaccctcacaattgagcctgtcgcttcacagacgttgcctaccgtaaaagttgcagaagtggactgttcgtccaccaatacatgcgcgctgtccggactgaccaggacgtgtaggcacaggattcgactgggcgacagtaagagccattactatatctccccttcttccagggcaaggattactgctgtctgcaatttctttacgtacatccgttacatccagcagggactggtccggcaagacgctgaacccatgttttgggagatcatgaggctgagaaaggagatgtctctggccaaactcggctttttcccacaggaagcctag

SEQ ID NO: 59242 - DNA, 1149 bp, Artificial Sequence
  Description of Artificial Sequence: Synthetic coding sequence
atgtggagcgggcctccacagcccgatcagggcctcccccctcccctggccgctgtgccagtaccctggaagagcactgatccatgtcaaggccatcgtgaatcacctggagctttggtcgagacctctgcaggcgaagaggctcagggccaggagggcccagccgctgcgcaactggatgtcctccgactgcgcagctctagtatggagatccgcgaaaagggatccgaatttctcaaagaggaattacacagagcccagaaggaactgaaactgaaggatgaggagtgtgagcgactatctaaggttcgtgagcagcttgagcaggaactggaagagctcacagcaagcttgttcgaggaggcccataagatggtgcgcgaggctaacatgaagcaagccgcatctgaaaaacagctaaaagaagcaaggggaaaaattgatatgctgcaggcggaagtcactgccctgaagactctggtaatcacctccactcctgccagcccaaatagggagctgcacccgcagctcttatcacctacgaaggccggacccaggaagggtcactccagacacaagtcaacgagctcaaccttgtgtccagcagtgtgtcctgcggcaggccacaccctgacacctgacagagagggcaaggaggtggatacaatactcttcgctgagttccaggcttggagagagtcacccactctggataagacctgcccatttctcgaacgcgtctatcgcgaggacgtgggtccatgcctggactttacaatgcaggagcttagtgttctcgtgagagccgctgtcgaggacaacacgttgactatcgagcctgtggcttcccaaacgctgcccactgttaaggtggctgaggtggactgcagtagtaccaatacatgtgccctctccgggttaactagaacatgtagacaccgcatcagactcggtgacagcaagtctcattactacatctctccaagtagtcgtgcgcgaatcacggcggtgtgcaatttcttcacatacatccgctatattcagcaggggctggttagacaagatgcagagccgatgttttgggagattatgcggcttcgcaaagagatgtctctggccaagctgggtttcttccctcaggaggcctag

SEQ ID NO: 59243 - DNA, 318 bp, Artificial Sequence
  Description of Artificial Sequence: Synthetic coding sequence
atggccacgcaagggccagacaaggttatcttcctgctggtgggccacaagtcagatcttcagtcaactaggtgtgtgagcgcccaggaggctgaagagctggcggcttcactcggaatggccttcgtggaaaccagtgtgaagaacaattgtaacgtggaccttgcctttgatacattagccgatgccattcagcaggcacttcaacagggggacataaagttagaagaaggttgggggggtgttcgcctcatccataaaactcagatcccccgttcccccagcaggaagcagcactcgggcccttgccaatgttag

SEQ ID NO: 59244 - DNA, 1398 bp, Artificial Sequence
  Description of Artificial Sequence: Synthetic coding sequence
atggccatgacgggatccacaccatgctccagcatgagtaatcataccaaagaaagagtgacaatgactaaagtcacgttagagaacttctatagcaacctgatcgcacagcatgaggagcgggagatgagacagaagaaactggagaaagtgatggaggaggagggcctgaaagacgaggagaaaaggcttaggaggtcagctcatgctcggaaggagactgagtttctgcggctgaagcgaacccgattgggactcgaagatttcgaatcattgaaagttatcgggaggggggctttcggggaagttcgcctggtacagaaaaaagacacaggccacgtgtatgcaatgaagattctcaggaaggctgacatgctggagaaagagcaagttggccacattagagcagagagagacattcttgtagaggccgattctctgtgggtggtgaagatgttctatagttttcaggacaagcttaacctgtatctgattatggaatttctgcctgggggagacatgatgacattactgatgaaaaaagatactttaaccgaagaggagactcagttctacatcgcagagacagtgctcgctattgactctattcatcagcttggcttcattcacagggatataaaacccgataatttgcttttagattccaaaggtcacgtgaagctgtctgatttcggcctgtgcaccggattgaagaaggcccacagaactgagttctatcgaaatctgaaccatagtctcccaagtgatttcacatttcagaatatgaatagtaaaaggaaagcagagacgtggaagcggaaccggagacaactcgcattctctacagtggggacacctgattatatcgcccctgaagtgtttatgcaaacaggatacaataagctgtgtgactggtggtctttgggtgtaattatgtacgaaatgctgataggctatccgccattttgttcagaaacaccccaagagacatataaaaaagtcatgaattggaaagagactctgacattcccacccgaggtgcctataagcgaaaaggctaaagacctgatcctgcgcttctgttgcgagtgggaacaccggatcggcgcaccaggagtggaggagataaaatcaaatagcttcttcgagggcgtggactgggagcatattcgcgaacgccctgccgctatctccatcgaaatcaaatccatcgatgatacctcgaattttgatgagtttcccgaatccgacatcctcaagccaactgtggctacctcaaatcatcctgagaccgactacaagaacaaagactgggtattcatcaactatacatataagcgcttcgagggcttgacagccaggggggctatcccaagctacatgaaggcagctaaatag

SEQ ID NO: 59245 - DNA, 651 bp, Artificial Sequence
  Description of Artificial Sequence: Synthetic coding sequence
atggcaggaagagggggtgccgcacgcccaaatggcccagcggcaggcaataagatatgtcaattcaaactggtgttgctcggcgagagtgcagttggtaagtctagcctggtccttcggtttgtgaaagggcaatttcacgagtaccaagagtctaccatcggcgcagccttcctgactcaaaccgtatgcctcgacgataccactgttaagttcgaaatctgggatacagccggtcaggagcggtatcacagccttgctcctatgtactataggggggcacaagccgctattgtcgtttatgatataaccaacactgacacattcgcccgtgccaagaattgggtcaaagagctccaacggcaggcttctccgaacatcgtgatagctttagctggcaataaagcagatctggcttccaagagggccgtggagtttcaggaagcccaggcttacgctgacgacaacagcctgctgtttatggaaacttcagccaaaactgcgatgaacgtcaacgaaatctttatggcaatagccaagaagctccccaagaacgaaccacagaatgccactggcgcacccggtaggaatcgtggtgtagacctgcaagagaacaatcccgcttccaggtctcagtgttgctccaactag

SEQ ID NO: 59246 - DNA, 861 bp, Artificial Sequence
  Description of Artificial Sequence: Synthetic coding sequence
atggcggacactatatttgggagcggaaacgaccaatgggtgtgcccaaacgatcgacagctggccctgagggcaaagttgcagacaggctggtcggttcacacctaccaaactgagaagcagcgcaggaaacagcatttgtcacctgccgaggtggaggctatcctgcaggtcatacaacgtgctgagaggctagacgtccttgaacaacaaaggattgggcgtctggtggagcgcctcgagacaatgcggcgtaatgtgatggggaacgggctcagccagtgtctcttgtgtggagaggtcctgggctttctggggtcctcctcagtcttttgtaaggattgcagaaaagtctggaagcgatcaggcgcatggttctacaagggactaccaaaatacatcctgccactgaagacacccggacgcgcagacgacccgcacttccggccactgccgacagaaccggcagagcgtgaaccgagatcgtctgagacctcgaggatttatacttgggcaagaggcagagttgtgagttccgatagcgactccgatagcgacctgtcctcgagcagcctggaggaccgactaccgtcaacgggggttagagacaggaaaggggacaaaccctggaaagagtctggagggtccgttgaagctcctcgcatgggcttcacacatccccctgggcacctttccggctgccagagcagcctcgcgtctggagaaactggcactgggtccgcagatcctccagggggaccacgcccaggtctgactaggagggcacccgttaaggacacacccggaagggccccagctgccgacgccgcaccagcgggtccatccagctgcctgggctag

SEQ ID NO: 59247 - DNA, 2013 bp, Artificial Sequence
  Description of Artificial Sequence: Synthetic coding sequence
atgaaccaggtgaccgactgggttgatccctcctttgacgactttttagaatgctccggcgtaagcacgataactgccacctcattgggagttaataactccagccaccgcagaaagaacggaccctccactttggagagtagtaggttccctgctcggaagagaggtaacctgtcaagcttagagcagatatatggcctggagaattcgaaggaatacctgtctgagaacgaaccatgggtcgacaaatacaagccggaaacccagcatgaactggccgtccacaaaaagaagattgaggaggttgaaacctggctaaaagcccaggtgctcgagcgccagcccaaacagggaggaagtattctcctgatcaccgggcctcctggctgtggcaagaccacgacgttaaagattctgtccaaagagcacgggatacaggttcaggagtggattaacccggtgctccccgacttccagaaggatgacttcaaaggcatgttcaataccgaatcaagctttcatatgtttccctaccagtctcagattgccgtgttcaaggagtttcttctgcgggctactaaatacaacaaattgcagatgctgggcgatgatttgagaacggacaaaaaaattatccttgtagaagacttaccaaaccaattttatcgagattcacacacacttcacgaggtgctcaggaagtatgtacggatcgggagatgccctctgatcttcatcatcagcgatagcctctccggcgataacaatcagagactcctcttccccaaagaaatacaagaggagtgttccatctccaacatctcttttaatccagtggcccctacaattatgatgaagtttctcaatagaattgtgacgatagaagcaaacaaaaatggaggaaagataactgtacccgataagacatctctcgagttactgtgtcagggatgttcaggtgacatccgctctgctattaattcgctgcagttttctagttctaaaggtgagaacaatctgcgtcccagaaagaagggaatgtcactaaaatcagatgctgttctgtctaaatctaaaagaaggaaaaaacccgatcgagtatttgaaaaccaagaggtgcaagccatcggtggcaaggatgtttctctgtttctcttccgtgctttggggaagatcctctattgcaagcgggcaagtctcactgaattagactctccccgtcttccttcacaccttagcgagtatgaaagagacaccctcctggtcgagcccgaggaagtggtggagatgagccatatgcctggagacctttttaatctgtacttgcaccagaactatattgatttcttcatggaaatcgacgacatcgtgcgagcttccgaattcctgagctttgccgacattttgtcgggcgactggaatacaagatctcttttaagggaatatagtacatcgatagccacccgaggagtcatgcactctaataaggcgcgtggatatgcccattgccagggaggaggcagcagttttcggccactgcataaaccacagtggttcctcattaacaagaaatatcgcgaaaactgccttgcagcaaaagccctctttccagacttctgcttgcctgccctgtgtaggcagacccagttattgccgtacctggcgttgctgactatcccgatgcgtaaccaggcccagataagttttatccaggacattggcaggctgccgctcaaaagacacttcgggcgtctaaagatggaagccctcacagaccgggagcacggaatgattgacccggattccggtgacgaagctcagcttaacgggggacacagtgcagaagaatcactgggtgagcccactcaggcaaccgtgcccgagacatggtcactgccactgagccagaacagcgccagtgagctccctgcaagtcaaccccagcccttctccgcccagggtgacatggaggagaatatcattatcgaagactacgaaagcgatggaacctag

SEQ ID NO: 59248 - DNA, 2013 bp, Artificial Sequence
  Description of Artificial Sequence: Synthetic coding sequence
atgaaccaggtgactgactgggtggatccatctttcgatgattttttagaatgctcaggcgtgtccaccatcacagctacttcgctgggagtcaataacagcagccaccgacgcaagaacggacctagcacactggaatcttctaggttcccagcgcgaaagcgcggtaatctgtcatccctggagcaaatctacggactggaaaactctaaagaatatttgtctgaaaatgaaccctgggtggacaagtacaaacccgagactcaacatgagcttgctgtgcacaagaagaagatcgaggaagtagagacctggctgaaagcacaagtgttagagaggcaaccaaaacagggaggatctatactacttataactgggcctccaggatgtgggaagactactactctaaaaatcttgtctaaggaacatggcatccaagtacaagaatggatcaacccagtgctacccgactttcaaaaggatgacttcaagggaatgttcaacaccgagtccagtttccacatgtttccttatcaatcacagatagcagtattcaaggagttcctgctccgagccaccaaatacaacaagttgcagatgctcggcgacgatcttcgcacagataaaaagatcattctcgtggaggacctccctaaccaattttaccgggatagccatactttacacgaggtccttcgaaaatatgtgcggattggtaggtgcccactgatcttcattatctcagactcactgtctggggacaacaaccagagactcctgttcccgaaggagatacaagaagaatgtagcatctcaaatattagcttcaacccagttgcccctaccattatgatgaagtttctaaaccgcattgtgaccattgaagctaacaaaaatggcggaaagatcaccgtccccgacaagacctcacttgagttgctctgtcagggttgtagcggcgacatcagaagcgccatcaacagtctgcagttttctagtagcaagggcgagaacaacctcagacctaggaagaaggggatgtcactcaaatctgatgctgtgctgtccaaatcaaagcgacgcaagaagccagatagagtcttcgaaaatcaggaggtacaagccatcggcggaaaggacgtgagcctgtttctcttcagagccctgggtaagattctgtactgtaagcgtgccagtcttaccgagcttgattcacctagattgccttcacacctatctgagtacgagcgcgacacgcttctggttgagccagaagaagttgtggaaatgtctcacatgcccggtgatttgtttaacctctatctgcatcaaaactatatcgatttttttatggagattgatgacatcgtgcgtgcttctgaatttctgagctttgctgatatactctccggagactggaatacgaggagccttctaagggagtacagcacctcaatcgcgaccaggggcgtcatgcacagcaacaaggcgaggggctacgctcattgccaagggggtggaagctcttttcggcctttgcacaagccgcagtggtttctcataaacaagaaatatagagaaaactgcctggccgctaaagccctcttccctgacttttgcttgcctgccctgtgcaggcagactcagctcttaccctacctggccttgcttacaatccccatgcgaaaccaggcacaaattagttttatacaggatatcggcagactgccacttaaaagacattttggcagattgaagatggaagctttgactgaccgcgaacatggcatgattgatccagactccggcgacgaagcacaactgaacggaggacacagtgctgaagagagtttgggcgagccaactcaggcgaccgtgccagagacctggtctctacccctgtcccagaactctgcttctgaattaccggcaagccagccccagcccttttctgcccaaggagacatggaggaaaacattatcatcgaagattacgagtccgatgggacttag

SEQ ID NO: 59249 - DNA, 2013 bp, Artificial Sequence
  Description of Artificial Sequence: Synthetic coding sequence
atgaaccaggtgacagattgggtcgatccctcctttgacgactttttggagtgcagtggtgtaagtacaatcacagcaacatccctcggtgtgaataactcgtcacatcgcagaaagaatgggccttccaccctcgagagctctcgcttccccgctagaaagcgaggtaacctgagcagcctggaacaaatttacggactggaaaacagtaaagaatacctctctgagaatgagccctgggtggacaaatataagcctgagacgcaacacgagttagcagttcataaaaaaaaaattgaggaggttgaaacatggctcaaggctcaggttctggagagacagccaaagcaggggggttctatccttctcataactggtccgccaggttgtgggaagactacgacactgaagattctgtcgaaggagcatggaattcaggtgcaggagtggatcaatcccgtgttaccagattttcagaaagatgacttcaaagggatgtttaacactgagtcctcatttcatatgttcccctaccagtctcagatcgctgtcttcaaggagttcttactgagagcaacgaaatacaataagctgcagatgcttggggacgatcttaggacagacaagaagattatcttagtggaggacctgccgaatcagttctacagagatagtcacacactacacgaagttctcaggaaatacgtccggatcggaaggtgccctctcatatttataatctcagatagtctgagcggtgacaacaaccagaggctacttttccccaaggaaatccaagaggagtgcagcattagcaacatcagttttaaccccgtcgccccaactattatgatgaaattcctgaaccgaatcgtgaccatcgaagcaaacaagaatggcggaaagatcaccgtcccagataaaactagtttggaattgctgtgtcagggatgcagtggggacattcgcagcgcaatcaactccctccagttctcatcttccaaaggagagaacaatctccgtccgagaaagaagggaatgtccctgaagagtgatgccgtgctttccaagtctaaaaggaggaaaaaacccgatcgggtcttcgaaaaccaagaagtgcaggccataggaggaaaagatgtttcactttttctctttcgagctttaggaaagatcctttattgtaagagagcatccctaaccgagctggacagtccaagactgcctagccatctgagcgagtatgagagagacaccctgctggtggaaccagaggaagtcgtcgagatgtctcacatgcctggtgacctgtttaatttgtaccttcatcaaaactacatcgatttcttcatggagatcgatgacattgtgcgggctagcgaatttctgtcatttgccgatattctctctggcgattggaatacacgatcactgctgcgggagtacagtacttccattgcgactcgcggtgtcatgcattctaataaagcacgcggttacgctcactgccaggggggtggatcatcattcaggcccctccacaagcctcagtggttcctaattaacaaaaagtaccgcgaaaattgcctggccgcaaaagctttattccccgacttttgccttcctgctctgtgccggcagacccaactgctgccttacctggccctgttgaccatccccatgagaaatcaggcccagatctctttcattcaggatatcggacggctgccacttaaacgacacttcggcagattgaagatggaggccttgaccgaccgggagcatggaatgattgaccccgacagtggtgatgaggcacaactcaatggcggacactcagccgaggaaagtctcggcgaaccgacccaggcgactgtcccagaaacatggagtctaccactctcacaaaactcggcttcagagctgcccgcaagccaaccacagccctttagtgcacagggagatatggaggaaaatatcattattgaagactatgaatctgatggcacatag

SEQ ID NO: 59250 - DNA, 3480 bp, Artificial Sequence
  Description of Artificial Sequence: Synthetic coding sequence
atgagcctcccccaacctacacccaggatggcagagctgcgcaagccgacctcctcactgactccacctgaagaccccgattcacagccgccttcatcgaagcgattatgcttagaagaacctggtggggtgttcaaagcaggctggcggctgccgctcgttccaaggctcagcgaggcagaaaaagtctgggaactgtccccaagaccttttaagggactcctcgtctcaacaaacgcaatctttgacaactcaaccgattcctgcgtggagaaaagcgtgtcgggcaaacagatctgtaatctgaagtgctcaaatttgaagttccaaatgtcctcttgtcttcaatcaccaccttcacaaagcccagacagtgaccttagagcatcaggcagatctgaggcgggactccatgaccgcgaggccttctctgtccataggtctaactctagcaaggctggcgtgtcacaactgctgccgtctacgagcatacacgatatacacggtatacggaatgagaatagaaagcaacagttcgtgcagggccgtgataacgtccataaggagaacccttttctcgacgtaaccttttacaaagagacaaagtcccccttccacgagattaaaaatagatgcaaggcgaacagtgtggtcccatcaaacaaaagggagaacaacatttcttcttctgtgttaaaaatatctaagagtcaaaaccaacctagcctcgagattgcgaagccaagctattttcgggattccgggacaatttctgtcccacagtttcctatggacctcaactctaagatgagcagtgtgtatctcaaagagatagcaaagaagaagaatgacaaaaaggaggcatacgttcgcgattttaccaacatctactggagccagaaccgacctgatgtcaagaaacagaaactccagaacgacaagaaaactgtcgaggccgaaaatattttcagcaagtgttacgagaacgactaccccagtttgagcagccagaacacctgcaagcggaaagacctgattagtagtaattactgcaattgctcatccatacagtgtaacgtcagggactccagaaaaaactttgccatcctggaaaacgcgaattgggaggaagcagaatgcttggatagttacgtcctcacacgattggagaagagtcaaaactgggactgcaacgtgcggcatatcttaagacgaaatcggggaaattgttggataatcaacaactgtaaaactaaatgcgaaaacatgaagaaaactgaggagaagtggaactggctcctgttactggagattgacctgctgtcaaaagaggattaccactgtgcaaaggtgatcaacgcatacgaagaacagtctaagcttctggttagggagatcctgggaagccagactgcactgattaccacggtgtggctcaacggtaagggcgaaaatgacaatactttacaacttcggtacaacacaacacagaaagtgttccatgtcaataatccattcgagtcatttatcattgagatcttctatttccataagagtattagcgggaacaaaaaggataattctatccttacgtgttgtaacattctgaagtgcaagaaacaaatcgggatcatcggaattcagaacttgatcacccgaaacatgaacacaaacattaagaacgggattctcagcatatatctgcaggattccgtgtctgagcccctggacattctgctgaaaaccaatatagcatttctgttgaacaactttgattccttgaccaggatagagaatgacttcgaattggaagaagagtgtatcttcaagtgtatgctctacctgaagtaccctaagaatatagtcgaaaatcacaccgcttatctggtcaaaatcttaacatccagtcgcctacttgaagataacatgaagcctatgctgaaaaagcggaaactcttccgaacagaacaggtgtttgagaagtctaaaaagaaactgattaactctttttctatgaccacccagaacactggctttcctattttcgaaacatacgaaaagattcctcttctcatggactttgatgacatggacgagatctccctgatacgagaaatcacttgccagaacatgagctgcccacagcaggtagtaaacgtggagaactgggcacactacaactcctctaccgtaaaggcacacggcaattcgtgccctcagtttattcagaataatcggggatatatcaatgagaatttctacgaagtgaacatgcatagtcaggatctcaacatggaacggaagcaggggcacaataagatcagcaactttgactgtgagcatatcttcgaggatctatgcaacgtgagacagcaagcaataccagcctctcataatataatccacaacgaagaaactcataccacctcaataacacaggtacttaacttctggaacttgctcagcgaaatcgaagagaagaaatatgaccttatcctgaaggaggaggtgaaggtgactgcagagagcttaaccaattcatgccaagtgcataaggacactaaaattgagaaagaggagaaggactcgttctttcccatggatgacatgttcagtgttcagtccgtcagcttaattagtaaagaggtaaatgtggaggaaaataaatatgtcaaccaaaactacgttaccaatacaaatgagtatgagtctatcttgcctgagcgagagatagccaactccaaagacttccaccggaaaaatgactccgcactttatatcaatcatcagttcgagacagggctgagtgaaggcaacgatgagtgttttcaggacctggctgcgaaatacttgtctacagaagctttaactatcgtcaaagacttcgaaatgaaacgaaagttcgatctggtcttagaggagttaaggatgtttcacgagattagcagggagaacgagttgctgagcaccgttgagacaaacaatggtcaggaaaattactttggggagaacgacgcggaaaaagtgaaaatggaaatcgagaaagacctcaagatggtggtagtgaataagatccgggcatcatcctcctttcacgacacgatcgcgggtccaaacatgggaaagagccaccaatctttattcaagtggaagaccgtgcctaacaatggagaacaggaagtgcccaacgagtcatgttacccgtcccgaagcgaagaggagctcctatatagtaccagtgagaaggattgtgaaactccgcttcccaagcgaccagcttttcttcccgacgaatgtaaagaggagttcaactatctgctgcgcggtggctcacactttccacatgggatctctcgagtgaggcctcttaagacatgctcaagaccgatacgaattggactttcccgaaaggccaggattaaacagttacacccgtacctgaagcagatgtgctacggaaatctcaaggaaaatttttag

SEQ ID NO: 59251 - DNA, 1683 bp, Artificial Sequence
  Description of Artificial Sequence: Synthetic coding sequence
atgacggtcaaacccgcaaaagccgctagtcttgcacggaatctggctaaacgcagaaggacctatctcggaggcgcagctggacgcagccaggagcccgaagttccttgtgccgcagtgctgcccggtaagccaggggatcggaactgccctgagttcccaccccctgatcggactctcggctgctgggccactgatgccgcaccagcagctgggctgtgcggcgctgggtctgagccttccatcgcccctaccagttgtgccggtaacctcccttcccgccctccacctctcttatccccccttctggcctccagaaacccttgtccttggcactaccttcatctgtcgggctctcacaatacactggctcccacatgttttaaagccaaactccacagaaagagggggtcccagccgcctgatatggccagtgcactcaccgatcgtacatcccgggctccctctacctacacctatacatccaggcccagagccctaccttgccagagatcacggtaccgagattcactgacacaacccgatgaagagcctatgcattacgggaatatcatgtatgacaggcgcgtgatccgcggaaacacatatgctcttcagactgggcctctattgggaagacccgacagtttagaactgcagcgccagcgagaagcgaggaaacgtgccctcgccaggaagcaagcccaggaacaactgaggccccaaacccccgaacctgtcgaaggaagaaagcatgttgacgtacagacagagctctacctggaggaaattgctgacaggatcattgaggtggatatggaatgccagaccgacgcgttcctggatcgtccacccacgcccctgttcattccggcaaagactgggaaggacgtggccactcagattcttgaaggggaactgttcgacttcgacctcgaggtgaagcccgtgctggaagttttggtcggcaaaacgatcgagcagtcacttctagaggtaatggaagaggaagaacttgctaaccttcgggctagtcagcgcgaatatgaagaactcaggaacagtgaaagagctgaggttcagcggctcgaggaacaggaacgcaggcacagagaagagaaagagcgcaggaagaagcagcagtgggaaattatgcacaagcacaacgagacttcacagaagatagcagcaagggccttcgcgcagcgctacctagccgatctgttgccttccgtgtttgggagcctgagggattctggctatttctacgaccccattgagagagatatcgaaatcggttttctaccatggctcatgaacgaagtggagaaaaccatggagtactctatggttggacgtacggttctcgatatgctgattagagaagttgtagaaaaaaggctgtgtatgtacgaacacggagaggacacacatcagtccccagagccagaagacgagccaggcggacccggtgctatgaccgagagtttggaagcttctgaattcctcgagcaatctatgagccaaacacgggagctgcttctggatggcggatacctgcagagaactacatatgacagaagatcctcccaagaaaggaaattcatggaggaacgcgaactcctcggtcaggatgaagagacagctatgagaaagagtctgggagaagaggaactgtcctag

SEQ ID NO: 59252 - DNA, 1395 bp, Artificial Sequence
  Description of Artificial Sequence: Synthetic coding sequence
atgaccgttaaaccagctaaagccgctagtctggccaggaacctcgctaaacggcgtcgcacctacctgggtggggctgccggacggtcccaagagcctgaggttccgtgcgctgctgttctgcccggaaagcctggagataggaattgtccagagttccctccaccagaccgcacattagggtgttgggctaccgacgcagcgcctgctgcaggcctttgcggtgccggaagtgagcctagcatcgcaccaacctcctgtgcgggaaacctcccctcaaggcccccacctctcctctcacccctcttggccagcagaaatccgtgcccttggcattatttgcatctcagcggatctcataatacgctggcgccaacttgctttaaagccaagttacacaggaagcggggtagccagccacccgacatggcctccgccttgaccgatagaactagtcgggcaccttccacctatacatatacgtctagaccaagagcactgccttgtcagagaagcagatatagagatagcctgacccagccagatgaggaacccatgcattacggcaatatcatgtacgaccgcagagtgattcgcggaaatacttacgccctgcaaaccggtcctcttttgttcgattttgacctagaggtaaagcccgtgttggaagtgctcgttggtaaaaccatagagcaaagcctactcgaggtcatggaagaggaagagctcgctaacctgagagccagtcaacgggaatatgaggagctacgcaatagcgagcgagccgaagtgcagcgtctggaagaacaagaacggcgacacagagaggaaaaggaaagaagaaagaaacagcagtgggagattatgcacaagcacaatgagaccagccagaagatcgccgcaagagcattcgcccagcgctatttagccgacctgctgcccagtgtgtttggttcgttacgggattcgggttacttctacgaccccatcgagagggatatcgagattggcttcctgccttggctaatgaacgaggtggaaaagaccatggaatacagcatggtggggagaactgtactggacatgctgattcgagaagtcgtggaaaagcggctgtgcatgtatgaacacggagaagacactcaccaatcgccggagcccgaagatgaacctggtggccctggcgcaatgacagagtccctggaggcttcagaattcttggagcaatccatgtctcagactagagaactcctgcttgatggaggatacctacagcggaccacctacgataggagatcttcacaggaacggaagttcatggaggaaagggagctactcggtcaggatgaggaaactgccatgcgcaaaagcctgggtgaggaggagctttcttag

SEQ ID NO: 59253 - DNA, 1257 bp, Artificial Sequence
  Description of Artificial Sequence: Synthetic coding sequence
atggcttcagccctgacggacagaacgagcagggcccctagcacatatacgtacacatcacgccctcgcgctctgccctgtcagcgttcacggtatcgagattctttgacccagcccgatgaggagccaatgcactacggcaatattatgtacgatcggagagtgatcagaggcaacacttatgccctgcagacgggacctctgctgggccgacccgactccctggagctacagagacagcgggaagccagaaaacgcgctctagcccgtaagcaggcccaggagcagctgcggccacaaacaccagaacctgtggaggggcgtaagcatgtggatgtacagacagaactctatctcgaagaaatagccgataggatcattgaagtggatatggagtgtcagactgacgcatttctcgatcggcctcccacacctttgttcatccctgccaaaactgggaaggacgtagctacacaaattctggagggcgagctgtttgactttgatcttgaggtgaaacctgtactggaagtgttagtgggtaagacgattgagcagtccctgctcgaagtgatggaagaggaggaacttgctaacctgagggcctcccagcgggaatatgaggaactacgcaactccgagagggctgaggtccaacgcctggaggaacaagaaagacggcacagagaggaaaaagaaagacgtaagaaacagcagtgggagattatgcataaacataatgaaacatctcaaaagattgctgcgagagcctttgcccagagatatcttgctgacttgctcccctccgtcttcgggagtctgcgggattcagggtacttctacgaccccatcgagcgcgatatagaaatcggcttcctgccttggttgatgaacgaggtcgagaagaccatggaatactccatggttggacgaactgtcttggacatgctgatacgcgaggtggtcgagaaaagactttgcatgtacgagcacggcgaagatactcatcagtcacccgaaccagaggacgagcccggtggacccggtgctatgaccgaatctctggaggcatccgaatttttggaacaaagcatgtcacaaaccagagagctactgttggacggtggctacttgcagcggacgacttatgatcggaggagttctcaggaacgaaagttcatggaagagagggaactgctgggtcaagacgaggagactgcaatgagaaaaagcctaggagaagaggaattgtcgtag

SEQ ID NO: 59254 - DNA, 969 bp, Artificial Sequence
  Description of Artificial Sequence: Synthetic coding sequence
atggcatccgccctgacagaccgaaccagtagggctcctagcacttacacatacacatctcgcccacgggcattaccctgtcagaggtctcggtacagggattcgctgacgcagcccgacgaagaaccgatgcactatggaaacatcatgtacgatcggagggtgatcagaggcaatacatacgctctccaaaccgggcctctcctatttgacttcgacctcgaggtaaagcctgtactggaggtactggtgggaaagaccatcgagcagtcattacttgaggtgatggaggaggaagagctggccaatctgcgagcgagccagagggagtatgaagaattgcgcaattcagagcgcgctgaggtccaacgcctggaagagcaggagcggaggcatagggaagaaaaagagcggaggaaaaagcagcagtgggaaatcatgcataagcataatgaaacgagccagaagattgctgcgagggcgtttgcacagagatacctcgccgatttgttgccatcggtctttggcagccttcgcgactcaggatacttttacgaccccatcgagcgggatattgaaataggcttcctgccctggttgatgaacgaggtcgagaaaacaatggaatactccatggtcggcagaacggtactggacatgcttatacgggaagtcgtggaaaaacgtttatgcatgtacgagcatggtgaggatacacaccaatcacccgaacctgaggacgagcccggtggacctggtgccatgacagagtcactcgaagcctccgagtttctcgaacaaagcatgtcccagactagggaactgttactggatgggggttacctccaacgaacgacctacgaccgcagatcctcacaggagaggaaatttatggaggagcgagaactcctgggccaggatgaggagaccgctatgaggaagtctcttggggaagaggaactatcttag

SEQ ID NO: 59255 - DNA, 2613 bp, Artificial Sequence
  Description of Artificial Sequence: Synthetic coding sequence
atggtaaaggagaaaaagaaggccgacaaaaaaggcgaaaaaagcgcacgctctccctcctctctgagtgataacctggatttctccaagcaggatggaaacaccactcgccaggaaatgtcccccgctggcgtgccactgctgggaatgcagttgaacgaagtgaaaccgaagaaggacagacagaacgttcaacaaaatgaagatgccacacaatatgaggaaagcatactgacgaagctgattgttgagtcgtatgaaggagaaaaggttagagggctatacgagggagaaggttttgcagcgtttcagggagggtgcacttaccgcggaatgttctctgaaggcctgatgcatgggcaaggaacatatatatgggcagatggactaaagtatgagggagactttgtgaagaacgttcctatgaatcatggcgtatacacctggccagacggctctatgtacgaaggagaggtcgttaatggcatgaggaatggattcggaatgttcaaatgctccacccagccggtttcctatattggacactggtgcaacggcaaacggcacggaaaaggttctatatattataatcaggagggaacttgctggtatgagggcgactgggtgcagaacattaaaaagggctggggcatccggtgctacaaatctggaaatatctatgaaggacagtgggaggataatatgaggcatggggagggccgaatgcgatggctcaccaccaacgaagaatacacaggcaggtgggaaagagggatccaaaacgggttcgggacacatacatggttcctcaagcggatcaggagctcccagtatcctctgaggaatgaatacatcggtgagtttgtcaatgggtacaggcacggcagagggaagttctactacgcaagtggcgcaatgtacgatggagaatgggtcagcaacaaaaagcatgggatgggcaggctgacctttaagaatggcagggtgtatgaaggcgctttttcaaacgatcacattgcaggtttcccagacctggaggtggagttcatctcttgtctggacctcagctcaggagtggcccctaggctgagtagaagcgccgaactgattaggaagctggatggctctgagtctcactctgtgctggggtcctccatcgagttagatctaaatctcctgctggacatgtatccagaaaccgtccaacccgaggaaaaaaagcaggtcgaatacgccgttttgagaaatatcactgagcttaggaggatctattctttctactcatctctggggtgtggccattcactcgacaatactttccttatgacgaaactgcacttctggaggttcctaaaagattgcaagtttcaccatcataagctcaccctggctgacatggaccgaatactatcggctaacaatgacatacccgttgaagaaattcattcgcccttcactacaatcctgctgaggactttccttaactacctgcttcaccttgcctaccatatttatcatgaagaattccagaagaggtctccttccctctttctatgctttacaaagctcatgactgagaacatccggcctaatgcattccagattaagggcaacctgtttcgagaacagcagcggaccttgtacagcatgtcctacatgaataaatgctgggagatttacctagcctactgcaggccttccgcagctccaccacacgagcctaccatgaaaatgcgacattttctgtggatgttgaaggacttcaagatgataaataaagaactaactgctgccacatttatggaggtcatagccgaagacaataggtttatctatgacggaatcgactcaaactttgagcctgaactggtcttcctggagttttttgaggccttgctatctttcgcttttatatgtgtcacagaccaaatgacaaagagttataccaatgtccctgctgacgatgtcagcggcaataagcatgagactatctacacaatcctcaatcaggacgcacagaacaaatccccttctgccgtgatgtcacatgagtcagatgctgctcattctgactctgccaggtcgagctcatccaagcttgagctgtccccagatgtcaataaaatcagaaagtccgagcctaaaattaaaaagtccgtgtcccacgagagggtcagcaaaatgaattttaagctgacgggcaagggcatcacattttttagttccgaatcaaagaagtatgagcgacccaaggacgacagagaggaggagttcaacacttgggtgaataatatgtacgtgttcttcgtcaacacactgttccacgcctataagcgcgaggaagcgattaaggagaaaataagagcagaccggctccgctccaccgcccaagcccagcagcgaaagatggaggacgacgagctcgaggccagacttaatatctttattttacgcgaggaggaagctaagcgccatgattacgaagtggatatcacggtattaaaagaaccagccgatgtgtcttcaagccatctgattctggatccccctaaggaggatgttaccgtctccccttcctcaaagacaattacttctaaaaagaaaaagaagtag

SEQ ID NO: 59256 - DNA, 1857 bp, Artificial Sequence
  Description of Artificial Sequence: Synthetic coding sequence
atgaatcacggtgtatacacatggcccgacgggtctatgtatgagggagaagtggtgaacggcatgcgaaatggattcggtatgtttaaatgtagcacccagcccgtttcttacatcggtcattggtgtaacggtaaacgacacggcaagggctctatctactataaccaggaaggtacctgttggtatgagggcgactgggtccagaacattaaaaaaggctggggcatcagatgttacaagtctgggaacatctacgaggggcaatgggaggataatatgcgtcatggcgaaggcaggatgagatggctcacgaccaacgaggagtacactggcaggtgggagagaggaattcaaaatggttttggtactcatacttggttcctgaaacgcattaggagttcccagtaccccttgagaaacgaatatattggcgagtttgttaatggttaccggcacggacgtgggaagttctattacgcaagcggagcaatgtatgacggcgagtgggtgtctaacaagaaacacggtatgggaaggctcaccttcaaaaacgggcgagtctatgagggcgcattcagcaatgatcacattgctggatttccagacttggaggttgagtttatttcatgtcttgacctctcttcaggggtcgcccctcgcctatcccgtagtgctgaattaatccggaagctggatggctccgaatctcattccgttcttggcagctccattgagctagacctgaatctactcttggacatgtaccctgaaaccgtgcagccagaggagaagaagcaggtagagtacgcggttttgcgaaacataaccgagttgcgaaggatttacagcttctatagtagcctcggatgcggacattcactggacaacacttttttgatgaccaaactgcatttctggcgctttctgaaggactgcaaatttcatcaccacaagttaacactggcggatatggacagaatcctgtcagcaaataacgacattccggttgaggagattcactcaccctttacgacaattctgctaaggacgttcctgaactaccttctgcacttggcttaccacatttatcacgaagagttccagaaacggagtccctctcttttcctctgtttcacgaaactcatgacagagaacattcggcctaacgcttttcagatcaaaggtaacttgttccgtgagcagcaaagaacgctgtactctatgagttatatgaataaatgttgggagatttacctggcttactgtcgacctagcgcggctcctccgcacgaaccgacaatgaagatgagacacttcctgtggatgctgaaagacttcaaaatgattaataaagagctgacagccgctacctttatggaagttattgctgaagataacagatttatctatgacggaatagattctaacttcgagccggaactcgtcttcctggaattcttcgaagccctcctgagctttgctttcatctgcgtgactgaccagatgactaaaagctatactaacgtgcccgctgatgacgtgtcagggaacaaacatgagacgatttacaccattctcaatcaagacgcccaaaataaaagcccttcggctgtgatgtctcacgagtctgacgccgctcacagcgactctgcaagaagctccagctctaaattagaattgagcccagacgtgaataaaattcgcaagagtgagcctaaaatcaagaaatcagtgagtcatgagcgcgttagcaaaatgaactttaagctgaccggtaaaggcatcactttcttctcctccgagagcaaaaagtatgagagacctaaggatgatagagaagaggatgggcgttag

SEQ ID NO: 59257 - DNA, 2613 bp, Artificial Sequence
  Description of Artificial Sequence: Synthetic coding sequence
atggtcaaggaaaagaagaaagccgacaaaaagggagagaagagtgccaggtcgcccagcagcctgtcagacaatttggacttttccaaacaagacggcaacaccacccgacaggaaatgtcaccggctggagtacccctattaggcatgcagctgaacgaagttaagccgaaaaaggatcgccaaaatgtgcagcagaacgaggatgcgactcaatacgaggagagcattctgacaaagcttatcgtcgaaagctacgagggagaaaaggtcagaggcctgtacgaaggagaaggctttgctgctttccaaggaggttgcacctaccgcggtatgttctccgagggactgatgcatggccaaggtacatatatctgggcagatggactgaagtatgagggggattttgtaaagaacgtgcctatgaatcatggtgtgtacacctggcccgacggaagcatgtacgaaggcgaagtggtgaatggcatgagaaatgggttcggcatgtttaagtgtagtactcagcctgtttcctacataggtcactggtgtaatggaaaacgccacggtaagggtagcatctattataaccaggagggaacatgctggtacgaaggagactgggtccagaatatcaagaagggatggggtatcaggtgctacaaaagcggcaacatctatgaaggtcagtgggaagacaatatgcgtcacggcgaagggagaatgcggtggcttaccacaaacgaggaatacactgggcgttgggagaggggaattcagaacggtttcggaactcatacatggtttctgaagagaatccggtcctctcagtatcctttacgtaacgaatatatcggcgagtttgtgaatggttacaggcatggaagaggaaagttttattatgcctcaggtgctatgtatgacggggagtgggtgtctaacaaaaagcacggtatgggccgactgacttttaagaacggcagagtttacgagggcgcattttccaacgatcacattgccggattcccggatttggaggttgagttcattagctgtttggacctgtccagcggggttgcacccaggctgtcgcggtccgcagagttaattcggaaactggacggctccgagtcacattctgtgcttggatcatcgatcgagctcgacctcaatttgcttctcgatatgtaccccgagactgtgcagccagaggagaagaaacaggttgagtacgctgtcctccggaacatcaccgaacttcggcgaatctactccttttacagcagcctgggatgtgggcacagtctggataacaccttcctcatgaccaagttgcacttttggagattcctcaaagattgcaagtttcatcatcataaattgacattggctgacatggacaggattctgtcagccaataatgacataccagtggaggagatacactcacccttcacgaccatactgctcaggacatttctgaactatcttttgcacctcgcatatcacatctatcacgaggagtttcagaagcgcagtcccagcctctttttgtgcttcaccaaattgatgaccgaaaatattagaccaaacgctttccaaattaaggggaaccttttcagagaacagcaacgcacactatatagcatgtcttatatgaataagtgttgggagatatatctcgcctactgccgtccttccgccgctcctccacacgagccaaccatgaaaatgcgccactttctctggatgcttaaggatttcaagatgatcaataaggagcttaccgcggcaacatttatggaggttatagccgaagataacaggtttatttatgatggcatcgattctaacttcgagccagaactggttttcctggagttcttcgaagcactgctgagcttcgccttcatctgcgtaactgaccagatgacgaaaagctacactaatgtccctgccgatgatgtgtctgggaacaagcacgagactatctacaccatcttgaatcaggatgcacagaataaaagtccaagcgccgttatgtcacacgaatctgatgcagcccacagcgactctgcccgttctagttccagcaagctcgagctgtccccagacgtaaataagatccgcaagtcagagccaaagattaagaagagcgtgagccatgaacgcgtgtctaagatgaactttaagctgactggcaagggcatcacgttctttagcagcgaaagcaaaaagtacgaacggcctaaggacgaccgggaagaagaatttaatacatgggtaaataatatgtacgtgtttttcgtgaatacccttttccatgcatacaagcgggaggaggcaattaaagagaagattcgcgcagaccgactccgcagcactgcccaggcccagcagagaaagatggaggacgatgagttggaggccaggctcaacatctttattctacgcgaagaggaagccaaacggcacgattatgaagtggatatcactgtgctgaaggagccagccgatgtctctagttctcatctgattctggacccacccaaagaggatgtgaccgtttccccctcgtcaaagaccattacgtccaagaagaaaaaaaagtag

SEQ ID NO: 59258 - DNA, 2613 bp, Artificial Sequence
  Description of Artificial Sequence: Synthetic coding sequence
atggtgaaagagaagaagaaggcagacaaaaagggagagaaaagcgctaggtctccatcttctctgtccgataatctcgactttagcaaacaagacggaaacaccactaggcaggaaatgtctccggctggagtgcccctgttgggcatgcagctcaacgaagtgaagcccaaaaaggatcggcagaatgtgcagcagaatgaggatgctacacaatacgaggagagcatactgacgaagcttattgtggaatcttacgagggcgaaaaggtacgtggtttatacgaaggggagggctttgctgccttccagggcggatgcacatatcggggaatgttttctgaaggcctgatgcacggccagggtacatacatttgggctgacggcctgaaatatgagggagacttcgtgaagaacgtgcctatgaatcatggggtttatacttggcccgatggcagtatgtacgagggagaggtggtgaatggtatgcggaatgggttcggcatgttcaagtgtagtacccagccagtaagctacatcggtcactggtgcaatggcaagcggcatggtaagggctctatatactataaccaggaggggacatgctggtacgaaggtgactgggttcaaaacattaaaaagggatggggcatcagatgctacaagagtggcaacatttatgaggggcagtgggaggataatatgcgtcacggcgaagggaggatgcgttggctcactactaacgaggagtacacaggcagatgggaaaggggtatccagaatggcttcggtacgcacacctggtttctgaagcggatccgctcgagccagtacccactccgcaacgaatacattggcgagtttgttaatgggtaccgccacggcagaggcaagttctactacgcttctggagcgatgtacgacggagaatgggtctctaataaaaagcatggcatgggacggttgacatttaagaacggtagagtttatgagggcgcatttagtaacgatcatattgcgggatttcccgaccttgaagtggagtttatttcttgcctggatctgagctccggcgtagccccacggctgagtagatcggcagagttgatcaggaagctcgacggcagcgagagtcactcggtgctcgggtcctccattgagctggatctgaatctgttgcttgacatgtatcctgaaaccgtgcagccagaagagaaaaaacaggtggagtacgcagtgttaagaaacattactgaactccgcaggatatacagcttctactcctctttaggatgtggccacagtctggataatacgttcttgatgaccaaactccacttctggcgatttttgaaggattgcaagtttcaccaccataaactgacgcttgccgatatggacaggattctttcagccaacaatgatattcctgttgaggaaatccactcaccatttacaacgattctcctgagaacttttctcaattacctactgcatcttgcatatcacatctaccatgaggagtttcagaagagatcccctagcctgttcctgtgtttcacaaagttgatgaccgagaatatacggccaaacgcctttcaaataaaagggaacctttttagagaacaacagaggacgctgtattccatgtcatatatgaacaagtgctgggaaatctacctggcctattgtagaccaagtgctgcccctcctcacgaacctactatgaagatgaggcacttcctatggatgttaaaagattttaaaatgatcaacaaggagttgacagctgccacattcatggaggtgattgccgaggacaatagattcatctatgacgggatcgatagtaactttgagccagagctagtctttctagagttcttcgaggctctcttgagctttgctttcatctgcgtgacagaccagatgacaaagtcatataccaatgtgcctgccgacgacgtgtctggtaataagcatgaaacaatatataccatcctcaatcaagatgcacaaaataaatcgccatccgccgttatgagccacgaatctgacgctgcccactccgactctgccagatccagctcctcaaaacttgaactgtcacccgacgtaaataagataagaaagagcgaaccaaaaattaaaaagtctgtctcccatgagcgggtgtccaagatgaactttaagctgacaggcaaaggcattacctttttttcgtcagaaagtaagaagtacgagcgaccaaaagatgatcgggaggaagagtttaacacctgggttaacaatatgtatgtgttcttcgtcaacacactgttccacgcttacaagcgggaggaggcaataaaggagaaaattagagccgatcggctgcgcagtacagcccaggcccagcagcgcaaaatggaagacgatgagctcgaagcaaggctgaacatcttcattctgcgggaagaggaagctaaacgccacgattacgaggtcgacatcaccgtactgaaagagccggcagacgtaagctcctcacatctgatattggaccctccaaaggaggatgtgactgtcagcccttcttcaaagacaatcaccagtaagaaaaagaagaaatag

SEQ ID NO: 59259 - DNA, 2613 bp, Artificial Sequence
  Description of Artificial Sequence: Synthetic coding sequence
atggtgaaagagaagaaaaaagctgacaagaagggggaaaagtccgccagatcccctagctccctctcagataatttggactttagcaaacaggacgggaacacgacgagacaggagatgagccctgcaggcgttccactgctcggcatgcaattgaacgaagtgaagcccaagaaggatcgtcaaaatgttcagcagaacgaagacgccacccagtatgaggaaagtattctaactaagctgattgtcgagagctacgagggggaaaaggtgaggggcttgtacgaaggtgaaggattcgcagctttccaagggggatgcacatacaggggaatgttcagcgagggactgatgcatggccagggcacgtatatctgggcagatggcctgaaatatgagggagattttgtgaagaatgtaccaatgaaccacggcgtctacacttggccagacggctccatgtatgagggcgaagtggtgaatggtatgcgaaacggattcggcatgtttaagtgctctacccagcctgtgtcctacattggccactggtgcaacggcaagcggcatggcaaagggagtatctattataaccaggagggaacttgttggtatgagggcgactgggtgcaaaatatcaagaaaggttggggaatcaggtgctacaagagcggtaatatctatgaagggcaatgggaggataatatgcgtcatggggagggcagaatgagatggctcacaacaaatgaggagtatactggacgctgggagcggggaatccaaaatgggtttggaacccatacctggttcctgaagaggatccggagcagccagtatcctctgcgaaacgaatacattggggagtttgtcaacggctaccgccacgggcgaggaaagttttattatgccagcggcgcaatgtacgatggtgagtgggtcagtaataaaaagcacgggatggggaggcttaccttcaaaaacgggagggtatacgagggagcattcagtaacgaccatattgcaggcttccctgatctggaagttgagtttatctcttgtcttgatctttctagtggagtcgcccctcgactgtcccggtccgccgagctgataagaaaattggatgggtctgagagccacagtgtgctgggatcctcgatagagctagatctgaatttactgctggacatgtatccggagacagtgcagcccgaggaaaaaaaacaggttgaatacgcagtcttaagaaacatcactgaattaagaagaatatatagcttttacagctctctggggtgtggacattctttagacaatacctttctcatgacgaagcttcacttctggaggtttctgaaagactgtaaatttcatcaccataaattgaccctcgcagacatggaccgcatcctttccgccaacaacgatattcctgtggaggagatccactcaccattcactaccatactgctccgtacttttctgaattatctgctgcacctggcgtaccatatttaccacgaagagtttcagaaaagatcaccaagtctcttcttgtgcttcacaaagctgatgacagagaacatccgacccaacgctttccagatcaagggaaatctcttccgtgaacagcaacgcacactctattcaatgagctacatgaataaatgttgggaaatttacctcgcttactgtcgaccctctgccgcaccccctcacgagcccactatgaaaatgcggcattttctatggatgttaaaagacttcaaaatgataaataaggaactcaccgctgcaactttcatggaggtcattgccgaggacaatcgtttcatctatgacgggatagattccaattttgaacctgaactcgttttcttggagttctttgaagccctcttgtcattcgcctttatttgcgttacagatcagatgactaagagctacacaaatgtgccagccgacgacgtgagtgggaacaaacatgagacaatttatacgattctgaaccaagacgcccagaacaaaagcccttcagctgtcatgtcacacgagtccgatgccgcacacagtgattccgccagatccagctcttccaagctggagctcagccccgacgtgaataagattagaaagagcgagccgaagatcaaaaagtctgtttcacatgaaagagtctccaagatgaattttaaactcaccggaaaagggatcacttttttctcttccgagtctaagaaatacgagagaccgaaagatgaccgagaggaagagtttaacacctgggtcaataacatgtacgtgttcttcgtgaatactctcttccacgcctataaaagagaggaggccattaaggaaaagatccgtgccgatagactgcgatctaccgcccaggcccagcaacggaaaatggaggacgatgagctcgaagccagattgaatatctttatcctgagagaagaagaggccaagcggcacgactacgaagtggacatcacagtgcttaaagaacccgctgatgtttcgtctagccacctgatattggatccaccgaaggaagatgtgactgtttctccctctagcaaaacaattacttctaaaaagaaaaaaaagtag

SEQ ID NO: 59260 - DNA, 15 bp, Artificial Sequence
  Description of Artificial Sequence: Synthetic coding sequence
atggtgaaggaatag

SEQ ID NO: 59261 - DNA, 843 bp, Artificial Sequence
  Description of Artificial Sequence: Synthetic coding sequence
atgagacacggcgagggcagaatgcgctggctgacaacaaatgaggaatataccgggagatgggaaagaggaatacagaacggctttgggacccatacatggttcttaaaacgcataagatcatcgcagtaccccctgaggaatgaatacatcggagagttcgtaaatggttatagacatggcagagggaagttctactacgcctcgggggcaatgtatgatggtgaatgggtcagtaacaaaaaacacggaatggggagactgactttcaagaatggacgcgtgtacgagggggctttctctaacgaccacattgcgggatttcctgatttggaagtggaatttatttcttgccttgatttatcttcgggggtcgcccctcgactatctcgctctgccgagctaatccgcaagctagatggaagtgaatcccacagcgtgctgggcagttctattgagctggatctgaacttgctcctggatatgtacccagagacagtgcagccagaggaaaagaaacaggtggaatatgcagtgctgaggaatattaccgaactgaggcgaatctacagcttctacagtagcctgggatgcggccacagcctggacaacacattcttaatgaccaagttacacttttggcggtttctcaaggactgcaagtttcatcaccacaagcttactctcgctgacatggaccgcatcctgtccgccaacaatgatatcccagttgaggaaatacactctcccttcaccaccatcctccttcgcacattcctgaattacttgctgcacctggcataccacatttatcatgaggaatttcaacagttcattccctag

SEQ ID NO: 59262 - DNA, 42 bp, Artificial Sequence
  Description of Artificial Sequence: Synthetic coding sequence
atggtaaaagaaaaaaaaaaagcagacaaaaagggcgagtag

SEQ ID NO: 59263 - DNA, 2613 bp, Artificial Sequence
  Description of Artificial Sequence: Synthetic coding sequence
atggttaaggaaaagaagaaggctgataagaaaggcgagaagagtgctcgcagcccaagttcactgtctgacaatctggatttttcgaagcaggacggtaatacaacacgccaagaaatgagccccgcaggagtgcctctcctcggcatgcagcttaacgaagtgaagccgaaaaaggaccggcagaatgtgcaacaaaatgaggatgctagccagtatgaggagtctattttgacgaaactgatagtggagagttacgaaggcgagaaggtgcgcggactgtacgagggagaaggcttcgcagcttttcagggcggatgcacctaccgcggaatgttcagcgaggggctcatgcacggccaggggacatatatctgggccgatggcttgaaatacgaaggcgacttcgttaaaaacgtgcctatgaaccacggtgtgtacacgtggcccgacggctctatgtatgaaggcgaagttgtgaatgggatgagaaatgggttcgggatgttcaaatgctccacccagcccgtgtcctacatcggccattggtgtaacggcaaacgccacggcaaagggtctatctactataaccaggaggggacctgttggtatgagggcgactgggtgcagaatatcaagaaaggatggggaattcgctgttacaagagcggtaacatatacgagggacagtgggaggacaacatgaggcacggcgaagggaggatgcgttggcttaccacaaacgaagagtacactggccgttgggaacggggaatccaaaatgggttcgggacgcacacctggtttctgaagcggatcaggtcttctcagtacccccttcggaacgagtacattggggagttcgtgaacggctaccgtcacggcagaggcaagttttactatgccagcggtgctatgtatgacggcgagtgggtgtccaacaaaaaacacggcatggggaggctcacattcaagaacggaagagtctacgaaggcgctttcagcaacgaccatatagccggatttcccgacctggaagtcgagtttataagttgtctggacctgtcatcgggcgttgcaccccgactgtcccgtagtgcagagctgattcggaaattggatgggtccgaatctcacagcgtcctggggtcaagtatcgagttggacttgaacctcctgctggacatgtatcccgagactgtccagccagaggagaagaagcaggttgaatatgccgtactgagaaacataacggagctaagacggatttattcgttttatagcagcctggggtgcggtcattctctcgacaacacattcctgatgactaaactacatttctggcggtttctgaaggactgcaagttccaccatcataagctcactttagccgatatggaccggatactgtcagcgaataacgatatccccgtggaggagatccactccccatttacaaccattctcttacgaaccttccttaactacctcttgcatctcgcttaccatatttaccacgaggagtttcaaaaaaggtcaccctccctgttcttatgtttcaccaagttgatgacagagaatatcaggcctaatgcatgtcaaattaagggcaacttatttagagagcagcagcgaaccctgtatagcatgtcctatatgaataagtgctgggagatttatcttgcttactgcagaccttctgccgcacctccacacgagcctactatgaagatgcgccattttttgtggatgctcaaagactttaagatgatcaataaagagctgacagccgctacctttatggaagtgattgccgaggacaatcggttcatttacgacggcattgactccaacttcgaacctgagttggtcttcttggagttctttgaagctctgcttagtttcgcgtttatttgcgtcaccgaccagatgacaaaatcttacacaaatgtacccgcagatgacgttagcggcaacaaacacgagacaatctacaccatcctgaatcaggatgcgcaaaacaagtcaccatccgctgttatgtcacatgaatccgacgccgctcatagcgactctgccaggtctagctctagcaagttggagttgagcccagacgtgaacaagattcggaaaagtgaacctaagatcaaaaaaagtgtgagccatgaacgcgtatcaaagatgaacttcaagcttaccgggaagggaatcactttctttagtagcgagagtaagaagtatgaaagacctaaggacgaccgggaagaggaatttaacacctgggtgaataatacatacgtgttcttcgtaaacaccttgttccatgcttataaacgtgaagaggccattaaagagaagataagggcagatcgcctcaggagcaccgctcaggcacagcagagaaaaatggaggatgacgagcttgaagcgcgtctcaatatctttatcttacgcgaggaagaggctaagcggcatgactatgaagtggacattacagtcctaaaggaacccgcagatgtatcgtcttctcacctcattctcgaccctcccaaggaggatgtgaccgtaagcccatcctctaagaccatcaccagcaaaaagaagaaaaagtag

SEQ ID NO: 59264 - DNA, 843 bp, Artificial Sequence
  Description of Artificial Sequence: Synthetic coding sequence
atgagacacggcgagggtagaatgcgttggttgactacaaatgaagagtacacaggccgatgggagcggggaatccagaatggattcggaacccatacctggttcctgaagaggattagatcttcacagtatcctctgcgcaatgagtatataggtgagtttgtgaacggataccggcatggcagggggaagttctattacgcgagtggtgcaatgtacgacggcgagtgggtcagcaataagaaacacggaatgggcaggttgactttcaaaaacggtagagtttacgagggagccttcagcaacgatcacattgccggatttcccgatctggaggtcgagtttatcagttgcctggacttgagctccggggtcgcccctaggctctcaagatcagccgagctcataagaaagttagacgggagcgaatcccacagcgtgctggggtcttccattgagcttgatttaaatctgcttctggatatgtatcccgagacagtccaacccgaagaaaaaaaacaagttgaatacgcggttctgcgtaatattaccgagcttcggaggatctattccttctatagcagtcttggctgtggccattctctggataacactttcttaatgacaaaactgcacttttggagattcctcaaggattgtaaatttcaccatcataaactcaccctggccgacatggaccgaatcctctcagcaaacaacgacatacctgttgaagagatccattccccgttcactaccatactcctgagaaccttcctgaattacctgctgcacctcgcataccatatttaccacgaagagttccaacagtttatcccctag

SEQ ID NO: 59265 - DNA, 2613 bp, Artificial Sequence
  Description of Artificial Sequence: Synthetic coding sequence
atggttaaggaaaagaagaaagccgataagaagggcgagaagtcagcacggtctcctagttccctgagcgacaatttagacttctccaagcaagacggcaacaccaccagacaagaaatgtccccagcaggagtgcctctgctgggaatgcaactgaacgaggttaaacccaagaaggatcgacagaatgtacagcagaatgaagacgcgtcccagtatgaagaaagcatactaacgaaactcatcgtagaatcatacgaaggagagaaagtgagaggactctacgagggcgagggattcgcggctttccagggtggctgtacgtatcgcggaatgtttagtgagggcctgatgcatggacagggcacttacatatgggccgatggactgaaatatgaaggcgacttcgtgaagaatgtaccgatgaaccacggggtgtatacttggccagatggatccatgtatgagggagaggtggtgaatggcatgcgcaatggctttggtatgtttaaatgttccactcagcctgtgtcctacattggccactggtgcaacggcaagagacacggtaagggctcaatctattataaccaagaagggacttgctggtatgaaggcgactgggtgcagaacatcaaaaaaggctggggtattaggtgctacaagagcggcaatatctatgaggggcagtgggaagataatatgagacatggagaagggagaatgaggtggctcaccacaaatgaggaatacaccggtcggtgggaaagaggcattcagaacgggtttggaacccatacatggttcctgaagagaattaggagttcacagtacccactgaggaatgagtacatcggcgagttcgtgaacggctatcgccatggtcgtggcaagttctattacgctagtggagcgatgtatgatggcgagtgggtttccaataaaaagcacggaatgggtcgcttgacattcaagaatggacgtgtgtacgagggtgcttttagtaacgatcatattgctggttttccagatctggaagtggagtttatctcctgcttggatttgtccagcggagtcgctccaagactgtctcgcagtgctgaattaatcaggaaattggatggatcagagagccacagcgtgctaggctcctctatagaactggacctgaacctgcttctcgatatgtatccagagacagtgcagcccgaggagaaaaaacaagtggagtatgctgtgttgcggaatatcactgagcttcgtcggatctattccttttactctagcctggggtgtggtcattccctcgataacaccttccttatgactaagcttcacttctggaggttccttaaagactgcaaattccaccaccacaagttgacactggcggacatggaccgtattctgagtgctaataatgacatacccgtggaagagattcacagcccattcactacgattttgcttcgcacttttttgaattatttgctccacctggcctatcatatttaccatgaagagttccaaaagcggtcaccttcactgttcttatgtttcaccaaactgatgaccgaaaatatacgccctaatgcgtgccaaatcaagggcaatttattccgggaacaacagaggaccctatactccatgtcatatatgaataagtgctgggagatctatctcgcatactgcagacctagcgcggctccccctcacgagcctactatgaaaatgaggcactttctttggatgctgaaggatttcaaaatgatcaacaaggaactgaccgcagcgacatttatggaagttatcgccgaggataatcggtttatctacgacggcatagattcaaatttcgagcccgagttggtcttcctcgaattttttgaagcgctcctgtcattcgcattcatctgcgtcactgatcagatgacgaaatcttacaccaatgtacctgccgacgatgtgtcagggaataagcatgaaacaatctacaccattctgaaccaggacgcccagaataagagcccaagcgctgtaatgtcccatgaaagcgacgctgcccactctgacagcgccagaagttcttcaagtaaactggaactttcgcccgatgtgaataaaattcggaagagcgaaccaaagatcaagaagtccgtgtcacacgagcgcgtgtccaagatgaattttaaattgacaggtaaaggaatcacctttttctcaagcgaatcaaagaagtacgagagacccaaggatgatagagaggaagaatttaacacatgggtgaacaacacctatgtgttttttgttaacactctgtttcacgcctacaagcgagaagaagccataaaagagaaaatcagggctgatcgtctgcggtcaacagcccaagcccagcaacgcaaaatggaggatgatgagctggaggccagactcaatattttcatcctacgggaggaagaggctaagcggcatgattacgaggtggatatcacagtgcttaaggagcctgccgacgtgtccagttcacatctgatcctggacccccctaaagaggacgtgacagttagtccctcatccaagaccatcacttccaaaaaaaagaaaaaatag

SEQ ID NO: 59266 - DNA, 2613 bp, Artificial Sequence
  Description of Artificial Sequence: Synthetic coding sequence
atggtaaaagaaaagaaaaaagcggacaaaaaaggggagaaatccgccagatctccctcctctctgagcgataacctggatttcagtaagcaggacggaaatacaacacggcaggaaatgtctcccgcaggcgtgcccttgttaggcatgcaactgaatgaagtgaaacctaagaaagaccgtcagaatgtgcagcaaaacgaggacgcatcacagtatgaagaatccatcttaacaaaacttattgttgaatcatatgagggagaaaaagtgcggggactatatgaaggggagggatttgcggcatttcagggtggctgtacctacaggggtatgttctcagagggactgatgcacggccagggcacgtatatctgggcggatggcctgaaatatgaaggcgatttcgtcaagaatgtccccatgaaccatggagtgtatacctggcccgacgggtctatgtacgaaggtgaagtggtaaacggaatgagaaacgggttcggaatgtttaagtgttccacccagcctgtgtcctatatcggacactggtgtaacggaaagcgccatggaaagggaagtatctactataaccaagagggtacatgttggtatgagggggactgggtgcaaaacatcaaaaagggctggggaattcgttgttacaagtctggaaatatatatgaaggccagtgggaggacaatatgcgtcacggggaaggcaggatgcgctggcttacaaccaacgaggagtataccggcaggtgggaacgcggaattcagaatggattcggcactcatacctggtttttgaaacgcatccggtcgtcccagtatcctcttcggaatgaatatatcggcgaatttgtcaacggctacaggcacggtagggggaaattctattatgcctcaggggcaatgtatgacggcgagtgggtcagcaataagaaacatggaatgggcagactgacattcaaaaacggcagagtatacgagggcgcattctcaaacgaccacattgcaggcttcccggatctcgaggtagagttcatttcgtgcttggacctatctagcggcgttgcccctaggctatcccgctcagccgagctcataaggaaacttgacgggagcgaaagccactctgttttaggttcttcaattgagctggacctgaacctcctgttggacatgtatcccgagactgtgcagccagaggagaaaaaacaggttgagtacgcagtgctccggaatatcaccgaacttcgtaggatctattcattctactcttccctgggctgtggccacagcctggataacacattcctaatgaccaaactgcatttttggcgatttctcaaagattgtaaattccaccaccacaagctcacactggccgacatggatcgtattctttctgccaacaacgacattcctgtggaggagattcactcaccattcacaacaattttgttaagaacgttcttaaactacttgctgcacctggcataccacatctaccatgaggaatttcagaagcgcagcccttcgctcttcctctgtttcacaaagctgatgacagaaaacattcggcctaatgcctgtcagatcaaaggaaacttgtttcgggagcagcagcgaacactgtattccatgtcttacatgaataaatgctgggaaatctacctcgcctactgcagacccagcgctgcgccacctcatgagcccactatgaagatgagacacttcctgtggatgctgaaggacttcaagatgatcaacaaagagttaactgcagcaacttttatggaagtgattgcagaggacaaccgctttatatatgacggtatcgatagcaatttcgagccagaattagtattcctggagttttttgaagccttgctgagtttcgcttttatctgtgttactgatcaaatgaccaagagctacacaaacgtcccagccgacgatgtgagcggaaacaagcatgaaacaatctacaccattttaaaccaagacgcccaaaataagagtccttcagctgtgatgtctcacgaatccgatgctgcccactccgacagtgcacggtccagcagctccaagttggagctgagtccagatgtcaacaaaatccggaagtcagaacctaaaatcaagaaatctgtctcgcatgaacgagtgtcaaaaatgaacttcaaactgactggtaagggaatcacattctttagttctgagtcaaaaaaatacgagagacccaaggatgaccgagaagaagagtttaatacatgggtaaacaatacgtacgtcttcttcgtgaatacattatttcacgcgtacaaaagggaggaagcaatcaaggagaagattcgagcagatcggttacgctctaccgcccaagcccaacagcggaagatggaggatgacgaactggaagctagactgaacattttcattctcagggaagaggaggctaagcgccacgattacgaggtcgatatcaccgtccttaaggaaccagccgatgtgagctcttcccacctgatattggacccgcctaaagaggacgtaacagtgtctcccagcagcaaaacgattacctctaagaaaaaaaagaagtag

SEQ ID NO: 59267 - DNA, 180 bp, Artificial Sequence
  Description of Artificial Sequence: Synthetic coding sequence
atggtgaaggaaaaaaaaaaggccgataagaaaggcgaaaagtctgccaggtccccatcatctttgtcagacaatctggacttttctaagcaggatggcaatactactaggcaggagatgtcacccgcaggagtcccattgctgggcatgcaactgaatgaagtgaaacccaaaaaatag

SEQ ID NO: 59268 - DNA, 2613 bp, Artificial Sequence
  Description of Artificial Sequence: Synthetic coding sequence
atggtgaaagaaaagaagaaagccgataagaaaggggagaagtccgcacgctcccccagtagtctgagcgataacttggacttcagcaagcaggacgggaacacaacccggcaggaaatgtcccccgctggcgtgccactccttgggatgcagctgaacgaagtcaagccaaagaaggatagacaaaatgtgcagcaaaacgaggatgcgtcccagtacgaagaatcaatccttactaagcttatcgtcgagagctacgagggcgagaaagtgaggggcctctacgagggcgaagggtttgccgcttttcaggggggatgcacttatcgaggcatgttcagtgagggcctcatgcacgggcagggcacatatatctgggccgatggactcaaatatgagggcgactttgtgaaaaatgttcccatgaatcacggcgtctatacttggcctgacggatctatgtatgagggggaagtggtgaatgggatgaggaacggttttggcatgttcaagtgttccacacagccagtgagctatatcggtcattggtgcaacgggaaaaggcacggcaaaggcagcatctactataatcaggaaggcacctgttggtacgagggggattgggtgcaaaacatcaagaaggggtggggaatcaggtgctacaagagcggaaacatttacgagggtcagtgggaagataacatgcgtcacggcgagggcagaatgagatggctgacgacaaacgaggaatacaccggccgttgggagcggggtattcaaaacggattcggaactcacacatggttcctgaagaggatacggagcagtcaataccctctgcgcaatgaatacatcggggagtttgtaaacggctatcgtcatgggaggggaaagttctactacgcctccggcgctatgtacgatggcgagtgggtgtcaaacaaaaagcatgggatgggcaggctgactttcaagaatggacgggtgtacgaaggggctttcagcaatgaccatatagccggatttccagacctggaggtggagttcatttcttgcctagacctatccagcggcgtcgctcctcgtttgtcccgctctgccgaactgatccgaaagctcgatgggagcgagtctcatagcgtcttaggctcctccatcgagctggacctaaatcttctgcttgacatgtacccagaaaccgtacagccagaggagaaaaaacaggtcgaatacgccgttctccgcaacattacagagctccgccgtatttatagtttttattcttctctgggctgcgggcacagcttggacaacacattcttgatgactaagctccatttctggcggttcctgaaggattgtaaatttcatcaccataagctgaccctcgcagatatggaccgcatcctatctgcaaacaatgacatccctgtcgaggagattcacagtccttttacgacgatcctgctgaggacatttctgaattacctgcttcatctcgcttatcacatttaccacgaagagtttcagaaaagatcaccatctctgtttttgtgctttacaaagttgatgactgagaacatccgccctaacgcctgccagatcaagggaaatctgtttcgggagcagcaacgaacactttacagcatgagctatatgaataagtgttgggagatatacctggcatactgtcgtccatcggcagcgccaccgcacgaacctactatgaagatgcgtcattttctgtggatgctgaaggacttcaagatgatcaacaaggagctcaccgctgcaactttcatggaggtcatagcagaagataacaggttcatctacgacggtatcgattctaacttcgaacccgagctggtgttcctcgaatttttcgaggccctgctgtctttcgcgtttatctgcgtcacggatcagatgactaagagctacacaaacgttccggcagatgacgtgtctggcaataagcacgagaccatctacaccattctaaaccaggacgcccagaacaaaagtccaagcgccgtcatgtcacacgagagcgatgccgcacactctgactcagctaggtcttcatcttctaagctagagctgtctcctgacgtgaacaaaattagaaagagcgaaccaaagatcaagaagagtgtctcacatgagagggtttctaaaatgaacttcaagctcacaggcaaaggcatcaccttcttttcttcggagtccaagaaatacgagaggcctaaagatgatcgggaagaggagtttaatacctgggtgaataatacctatgttttcttcgtgaacactctgtttcatgcctataaacgggaagaggccatcaaggaaaagatccgggctgacagattgcgcagcaccgctcaggcccagcagcgaaagatggaggacgacgagctagaggcgaggctgaatatctttatacttagagaggaagaggccaagagacacgattatgaagtggacataaccgtgctcaaagagccagcggatgtttcctccagtcacctgatcctggaccctccaaaggaggacgttacagtatcccctagttccaagaccattacctcgaagaaaaagaagaagtag

SEQ ID NO: 59269 - DNA, 30 bp, Artificial Sequence
  Description of Artificial Sequence: Synthetic coding sequence
atggtgaaagagaaaaaaaaagccgattag

SEQ ID NO: 59270 - DNA, 1857 bp, Artificial Sequence
  Description of Artificial Sequence: Synthetic coding sequence
atgaaccatggcgtctatacctggcctgatggcagcatgtatgaaggagaagtggttaatgggatgcgtaacggctttggaatgttcaagtgcagtacccagccggtgtcctatattgggcattggtgcaacggaaagcgacacgggaaaggttccatttactacaatcaggaaggcacgtgttggtatgagggagactgggtacagaacatcaagaaaggctggggaattcggtgctataagtccggtaacatctatgagggccagtgggaagataacatgaggcatggggaagggaggatgcgctggctgaccacaaacgaggagtacactgggaggtgggagcggggaattcagaatggcttcggaacacatacttggtttctcaagcggataaggtcgtctcagtaccccctcagaaatgagtacattggcgaattcgtcaacggctaccgacacgggcgaggtaagttttattatgctagtggagctatgtatgatggggagtgggtctccaataagaaacacgggatgggaaggctcacctttaagaacgggagagtgtatgagggtgccttctccaatgaccacatcgcaggattccccgacctagaggttgaattcatcagctgtttagacctgtctagcggggtagcccctcgactctctcgttcagccgaactcatcagaaagctggatggctcagaatcccattctgttctgggcagctccatcgagctggacctgaatctcctgctagacatgtacccagagacagtgcagcccgaggaaaaaaaacaggtggaatatgccgttctgagaaacatcaccgagctcaggaggatctattccttctatagctctcttgggtgcgggcacagccttgacaacactttcctgatgacgaagcttcacttttggcggttcttgaaagattgcaagttccaccaccacaagctaacactcgcggacatggaccgtatccttagcgccaacaacgatattccagtcgaggagattcatagcccctttacaacaatactgctcagaaccttcctgaattatctgctgcacttggcttatcacatatatcacgaagagtttcagaagaggtcgccgtctctgtttctgtgcttcactaagctgatgacagagaacattaggcccaatgcttgtcagatcaaaggaaacctgtttagggagcaacagagaactttgtattctatgtcctatatgaataagtgttgggagatctatttagcgtactgccgcccttccgctgcccctccacacgagccaaccatgaagatgcggcacttcctttggatgctcaaagactttaaaatgatcaataaagaattaaccgccgctacctttatggaggtcatcgccgaagataacaggtttatatatgacgggattgacagcaattttgaacccgagctcgttttccttgagttcttcgaagctcttcttagtttcgctttcatctgcgttaccgatcaaatgacgaagtcgtacacaaacgtgcccgctgatgacgtgtctgggaataagcatgaaacaatttacaccatactcaatcaagacgcccagaacaagtcgccctctgcagtcatgtctcacgagagtgatgcagcacacagcgattcagctcgatccagctcctccaagcttgaactctcaccagacgtaaataagatacgcaaatctgaacccaagattaagaaatcagttagtcacgagcgggtcagtaaaatgaatttcaagctgacaggcaaagggattaccttcttcagctctgaatctaagaagtacgaaaggccgaaggacgacagagaagaagacggacgatag

SEQ ID NO: 59271 - DNA, 327 bp, Artificial Sequence
  Description of Artificial Sequence: Synthetic coding sequence
atgaaagccttatgtcttttgcttctgcctgtgttgggccttcttgtttccagcaagactttgtgctcaatggaggaggcaataaacgaaagaattcaggaggtagctggcagtctcatctttagagcgatcagcagcatcggattagaatgccagtctgtgacctctcgtggcgacctcgcaacgtgccctcggggatttgccgtgactggctgcacatgcggtagtgcttgtgggtcctgggatgtacgagctgaaacaacgtgccactgccagtgcgcaggtatggactggacaggcgcacggtgctgccgggttcagccatag

SEQ ID NO: 59272 - DNA, 4485 bp, Artificial Sequence
  Description of Artificial Sequence: Synthetic coding sequence
atgtacagcgaatggcgctctctccacttggtgatccagaacgaccaaggtcacacctcggtgttgcattcctatcccgagagtgtggggcgtgaagtggcgaacgccgtggtccgcccactgggccaggtgctgggtaccccaagtgtggctggctccgaaaacctcctcaagactgataaagaagtaaaatggactatggaggtcatttgctatggtttaacccttcctctggacggtgagacagtgaaatattgtgttgatgtctataccgactggattatggccctggtgctccccaaggattcaattcccctgccagtgatcaaagagcctaatcagtatgtgcagacgatcctgaagcaccttcagaacttattcgtcccaaggcaggaacaggggtcctcacagattcgcctctgcctgcaggttctcagagccatccaaaaactggctcgagagtccagtctgatggcccgagaaacatgggaggtgcttctgctctttctgctgcagattaatgacatcttgttagccccacctaccgtgcaggggggtatcgctgaaaatctggccgagaagttgattggggttctattcgaggtttggctcttggcttgcactaggtgtttccccacaccaccgtattggaagaccgctaaagagatggttgcaaactggcggcatcacccagcagttgtggaacaatggtccaaagtcatttgtgccctgacaagcagactgttgagattcacatacggcccatcatttccagccttcaaagtgcccgatgaggacgcctccctcatccccccagagatggacaatgaatgtgtggcccagacctggttccggtttcttcacatgctgtccaatccggtggatctgtcaaatccagcgatcatcagttcaactcccaagttccaggagcaatttttgaacgtgagtggcatgccgcaggaactgaatcaatatccctgcctcaagcacctcccccagatctttttccgggctatgcggggtatttcctgcctggtcgacgcatttcttgggattagtcgccctagaagtgatagtgcaccgcctacccctgtaaacaggctatctatgccccagtccgccgcagtcagcactactccccctcataaccgtcgtcaccgcgctgttacagtgaataaagcgacgatgaagaccagcaccgtctccactgcccacgctagcaaggtgcagcaccaaacttcctcaacatctccgctgtccagcccaaaccaaacctcatccgagccgagaccacttcctgcacctaggcggcctaaagtaaattccatattgaatctattcggtagctggctgttcgacgcagcatttgtccactgcaaactccacaatggcatcaatcgggactcttctatgacggccatcaccacacaggccagcatggaattcagacggaagggaagtcagatgtcaacagacacgatggtgtccaatcccatgtttgatgcgtctgagtttcctgacaactatgaagctggtcgcgctgaagcgtgtgggacattgtgcagaatcttctgctccaagaaaaccggcgaagaaattctccctgcctatttgtcaaggttttacatgctgctaattcagggtctccagataaacgattacgtttgtcatcccgttttggcctctgtcattctgaactcccctcccctcttctgttgtgacctgaagggtattgatgtggtcgtgccatacttcatctcagcgctggagaccatcctgccagatagggagttatcaaaatttaaaagttatgtgaacccaaccgagctcaggcgttcttccataaacattctgctaagtctgctccctttgcctcaccactttggaactgtgaaatctgaggtggtgctggaggggaaattttccaacgacgatagtagctcctacgacaagccaatcacctttctaagccttaaactgagacttgtcaatattctgatcggtgctctgcaaaccgagacggaccctaataacacccagatgatcctgggagcaatgctcaacatcgtacaggatagtgctctgctagaggccatcgggtgtcagatggagatgggaggaggagagaacaacctgaaatctcactccagaacgaattccgggattagtagtgccagtggcggttccacagagccaaccaccccggattcagagagacccgctcaggccttgctgcgggattatgcactgaacacggatagcgctgccggtctcctgattagaagtatacaccttgtgactcagaggttaaacagtcagtggcgtcaagatatgagcatttccctggcagctctggagctcctgtctgggcttgccaaagtcaaggtcatggtcgattcaggggaccggaagcgcgctatctcatctgtctgtacctacatcgtgtatcaatgcagtcgccctgccccactgcattcccgcgacttacatagcatgatagtcgccgcttttcagtgtctgtgtgtttggctcaccgaacacccggacatgttggatgagaaggactgcctcaaggaagtcctcgagatagttgaattgggcatctccgggtccaagtcgaaaaataatgagcaagaggtgaagtataagggagacaaagagcccaaccctgcctcaatgagagtaaaagacgcagcagaagccaccctgacctgcattatgcagctcctcggagcctttcctagtccttctggccctgcctcgccgtgttccctggttaacgaaaccactctcatcaagtattcaaggctgccaactataaacaagcatagtttcaggtattttgtcctggacaactcagtcattctcgcaatgctggagcaacctctgggaaacgaacagaatgacttctttccaagcgtgacggtgctggtcagggggatgtcaggcaggttagcctgggcccaacaactgtgcctgcttccgcgaggagcaaaagctaaccagaagctgtttgttccagaaccgagacccgtaccaaaaaatgacgtcgggtttaaatattccgtgaagcatcgcccttttccagaggaagtcgataaaattccattcgtgaaggcagatctgagcatcccagacctgcatgagatcgtgaccgaagagttggaggaaagacatgagaagttgcgcagcgggatggctcagcaaatagcctatgagattcatctggagcaacagtccgaagaggaacttcagaaaagaagtttcccagatccagtgacggactgtaaaccccctccgccagcgcaagagtttcagactgccaggctatttttaagccatttcggctttctctctttagaggccctgaaggagcccgcaaactctagactccccccacatttgatcgcattagattcaaccatacctggtttttttgacgatatcgggtatctggaccttcttccttgtcgcccattcgacacagtctttatcttctatatgaaacctggccagaaaacaaaccaagaaatccttaaaaatgtggaaagttctcgaacagttcagcctcatttcctggagttcttgttgagcttaggctggagcgtggatgtcgggcgacatccaggctggactggacacgtgtcaaccagttggagcataaattgttgtgacgacggcgaaggatcccagcaggaggttatttcttctgaggacatcggggcatctatattcaacgggcagaaaaaggttctatattatgccgacgccctgacagagatagcctttgtcgtccccagccccgtcgaaagcttaacggactctttggaatctaacatcagcgatcaggattccgattccaatatggacctgatgcccggaattcttaaacagccgtccctaaccctcgagctttttcccaaccataccgataacctgaactcaagccagcggctgtcaccaagtagcaggatgaggaagctcccccagggtcgccctgtacccccattgggccctgagaccagagtgagtgtagtgtgggtcgagaggtacgacgatatcgaaaacttcccactgtccgaactcatgaccgagatcagcacgggtgtggaaacaactgctaatagtagcacctcgctaaggtcaaccactctcgagaaagaggttcccgttattttcattcatccactgaacacaggactgttccggattaagattcaaggtgcaaccgggaagtttaatatggtcatccctctggtggatggcatgatagtgtctcgcagagccctaggcttccttgtacgccagacagtcataaacatctgcagacggaagagactcgagtccgactcatactcaccaccccacgtgcgtagaaaacaaaaaatcactgacatagtaaacaaatatcgtaataagcagctagagcccgagttctatacgtcactttttcaagaggtgggtcttaaaaattgctcttcttag

SEQ ID NO: 59273 - DNA, 2892 bp, Artificial Sequence
  Description of Artificial Sequence: Synthetic coding sequence
atgtatagcgagtggcggagcctgcacttggtgattcagaatgaccaaggccacaccagtgttctgcactcgtacccagaatcagtcggacgggaggtcgctaatgcggtggttcgtccactcggccaggtgctgggcacaccttcagttgcaggatcagaaaatttactgaaaaccgacaaagaggttaaatggacaatggaagtcatctgctatggcctgacactaccactggacggcgaaaccgtgaaatattgcgtggatgtatatacagactggattatggccctggtgctgccgaaagatagcattccattacccgtcataaaggaacccaatcaatacgtccagacaatcctgaagcacctgcaaaacctcttcgtgcctcgtcaggagcagggatctagtcagatccgcctatgtctccaggtgttacgagccatccagaaactggctcgcgaatctagcttgatggccagggaaacctgggaggtgttgttattgtttttgctccagatcaacgacattttactcgctcctcctaccgtgcaggggggaattgctgaaaacctagccgagaagctgatcggtgtgcttttcgaggtctggctgttggcatgcactcgttgctttcctactccgccttattggaaaaccgccaaagaaatggtggctaactggcggcaccatcctgccgttgtcgagcagtggagcaaagtcatatgcgcactgacctcaagacttttaagatttacctatggcccttccttccctgcctttaaggtgccagacgaagatgcctcactgattccacccgaaatggataacgaatgtgtggcccaaacctggtttcgatttcttcatatgctgtccaacccagtcgacctctccaaccccgcaatcatttcatccacgccaaaattccaggagcaatttctgaacgtgtccggaatgcctcaggaactgaaccaatatccttgcttgaagcacctgccccaaatttttttcagagccatgcgagggataagttgtctcgtggacgcatttctgggaatttcacgaccgaggagcgatagtgcccctcctactcccgtcaatcgtctgtcgatgcctcagagcgccgctgtgagcaccacccctccccataatagaagacatagggctgtgaccgttaataaggcaacaatgaagaccagtacagtaagtaccgcccacgcttcgaaggtgcagcaccaaacgtcttccaccagccccctgagctctcctaaccagacctcttcggagccacggccactccccgctcctcggcgtcctaaagtgaatagtatactgaacctcttcggtagctggctgtttgatgcggcatttgtccattgcaagcttcataatggaatcaaccgggatagctccatgacagccataacgacccaggcttctatggaatttcgacgcaaaggcagtcaaatgtctactgacaccatggtgagtaacccaatgtttgacgcttccgagtttcccgataactacgaggcaggcagggctgaggcctgtgggaccctgtgccgaatcttctgctccaagaagactggagaggaaatccttcctgcttatctctcacgcttctacatgctgctaatccaaggattgcagattaatgactatgtctgtcacccagtcctggccagtgtgatcctcaactcccctcccctgttttgctgcgatctaaaaggcatagacgtcgtggtcccctacttcattagtgccctagagaccattcttcccgaccgggagctctcaaaatttaagagctacgtcaaccctacagaactgcgccgatcgagcatcaatattttgctgtccctcctacccctcccgcatcactttgggaccgtgaaaagtgaggtggtgctggagggaaaattctccaatgatgattcctcctcatacgacaagcccattacttttctatctcttaaactgagacttgtgaacattttaatcggggcacttcagacggagacagacccaaataatacacagatgatcttaggcgctatgctgaacattgtgcaggacagcgccctgctggaagccatcggctgccagatggagatgggaggcggtgaaaataaccttaaatcacactcacggaccaactcaggcatttcttcagcatcaggagggagcaccgaacccacaactccagattccgaacgacctgcccaggccctgctgagggattacgcactcaataccgactcagcggctgggcttttaatacgatcaattcatctggtgactcagcgtctgaattcacaatggcgccaggatatgtcaatttcacttgctgctttagaattactgagtgggctcgcaaaagtcaaagttatggtagactctggtgataggaagagggctatttcttctgtctgtacctatatcgtctaccagtgctcacggcctgccccactccatagcagagatctgcactcaatgatcgtcgctgcttttcagtgtctatgtgtgtggctcacagaacacccagacatgcttgacgaaaaggattgtctgaaggaggtactcgaaatcgttgagctgggaatttctggttccaaatctaaaaacaacgaacaggaggttaagtataaaggcgacaaggagcccaatcctgcatccatgcgcgttaaggacgccgctgaggctacgctgacgtgtataatgcagctcctgggcgcttttccgagtcctagcgggcctgcctctccctgctccctcgtgaacgagacgaccctcattaaatattcgcgtctgccaaccatcaataagcaactcgagccagaattttatacttcgcttttccaagaagtaggtctcaagaactgcagcagctag

SEQ ID NO: 59274 - DNA, 3822 bp, Artificial Sequence
  Description of Artificial Sequence: Synthetic coding sequence
atggtggccaactggcgccaccatccagccgttgtggaacagtggtcaaaagtgatctgtgcactcacatcacgcctgctccgcttcacgtatggtcccagtttccctgcgttcaaagtccccgacgaggacgcctccttgatcccgccagagatggacaacgagtgtgttgcccagacttggttcaggtttctccacatgctaagcaatcctgtagatctgtccaaccccgctatcatttcatccacccctaagtttcaagagcaatttctgaacgtttcgggtatgccacaggagcttaaccagtacccttgcctgaaacacttaccacaaattttctttcgagcaatgcggggaatttcctgcctcgtggatgccttcctggggatatcaagaccgcgttccgattcggcccctcctacgcctgttaataggctgtccatgccccagtctgccgctgtgtctaccacacccccacacaaccgcaggcatcgagcagtcacagttaacaaggctactatgaagacatctaccgtgagtactgcccacgcctcaaaagttcagcaccagaccagctccacatctcctctaagctcccccaaccaaacaagctcggaacccaggcctcttccagcaccccgaaggcctaaagtaaacagcatcctgaatctgttcggttcatggctcttcgatgctgcctttgtgcactgtaagttacacaatggaatcaatagggattcctctatgaccgccattacaacgcaggccagcatggagttcagacggaaaggatcccaaatgagtaccgatacaatggtgtccaaccctatgtttgatgctagcgagtttcctgataactacgaggcaggcagagcggaagcatgtggcaccttatgtcgcatcttctgctcaaaaaaaaccggggaagagatcctgcccgcttacctatcaagattctatatgctcctgattcaggggctccagattaacgactatgtgtgccaccctgtactagcctccgttatcctgaacagcccccctctgttctgttgcgacctgaagggaattgatgtcgtggtaccctatttcatttcagctctggagactatactccccgatcgtgaactgagcaagtttaagagctacgtaaatccaacagagctccggaggtcttccattaatattctgctgagcctgttgcctctgcctcaccactttgggacggttaaaagcgaagtggtgttggagggaaagttctccaacgacgactcatcatcatatgacaagccaatcacattcctgtccctgaaattaaggctggtgaatatcctgatcggtgccctgcagactgaaaccgatccaaacaacacgcagatgattctaggtgcgatgcttaatatcgtgcaggactcagccctgcttgaggcaatcggctgccagatggaaatggggggaggagaaaataatctcaagagtcacagtcggactaatagtgggatcagtagcgccagcggaggatccacagaacccaccacacccgactcggaacgccctgcccaggctctgttgcgggattatgcactgaataccgatagtgctgccggattgctcattcgatcaattcatcttgtaacccagcggctgaacagccagtggagacaggatatgagcatttcattggctgcgctcgaactgctgtccgggcttgctaaagtgaaagtcatggtggatagtggagaccggaaaagggccatcagtagtgtttgtacatatatagtttatcagtgtagtcggccagcaccattgcactctcgggacctccatagcatgatagtcgcagctttccagtgtctgtgtgtatggctaacagaacaccccgatatgctggacgagaaggactgcctgaaggaagtcctcgaaatcgtggagctgggtatatcagggagcaagagcaagaacaacgaacaggaagtcaagtacaagggggacaaggagccgaatcccgcatccatgcgagtgaaagacgctgccgaagcaacgctgacctgcatcatgcagctccttggggcttttccgagtccttccgggcctgcatcaccttgtagtcttgtgaacgaaacgacgctcattaaatatagtcgtctgcccaccatcaataaacatagttttagatactttgtgctggacaatagcgtgatcctcgcaatgctggaacagcccctcggcaacgagcaaaatgattttttccccagcgtcacggtactggtgcgtggcatgtcaggaaggctggcctgggcccagcagttatgcctgctcccgagaggtgccaaggcgaatcagaagctgtttgtcccagagccaagaccagtccccaagaatgatgtggggttcaagtacagtgtaaagcaccgcccattccccgaggaggtcgacaaaatccctttcgtgaaagccgatctttcaatccccgatctccatgaaattgtgactgaggaactggaggagcgccacgagaaacttcgcagtggcatggcacagcagatcgcatatgaaattcatctagaacaacagtctgaggaagagctccagaagcggagcttccctgaccccgtcaccgattgtaagccgccacctccagctcaggaattccaaaccgcacggctgtttctctcgcacttcgggtttctgtcactggaggctctgaaggagcccgctaatagtcgcctacccccacacctgatcgcgctggatagcactatcccaggtttcttcgatgatattggttacctggatcttctcccctgtcgcccattcgatactgtttttatattttacatgaagcccggtcagaagaccaatcaggaaatcctgaagaacgtggagtcttcccggacagttcagccacatttcctggagttcctcctcagcctggggtggtctgtggacgtcgggcgtcatcctgggtggacaggtcatgtaagcacatcctggtccattaattgttgcgatgacggtgagggctctcagcaagaagaagtgatctcgagcgaagacatcggggcttccatctttaacggccagaagaaagtgctgtactatgcggacgccctgacagagatcgcttttgtggtccccagtcctgtcgaatctctgacggattctcttgagtccaacatctctgaccaagactccgacagtaatatggatttaatgccagggattctgaaacaaccaagtttgacacttgagctgtttcccaatcatactgataacctgaacagttctcaacggctgtcaccatcatctagaatgcgaaaactgccgcagggtcgacccgtacctcctctggggcctgagacacgggtgtcagtggtttgggttgagcgctacgatgatattgagaatttcccactcagtgaactgatgacggaaatttcaaccggcgtcgagaccactgctaactcatcgacctccctccgctcaactacgctcgagaaagaggtccctgttatttttatccaccctctgaacacaggtctcttccggataaaaatccagggagctacaggcaagttcaatatggttataccactggtggacggcatgatcgtttctaggcgggcactcggcttccttgtgagacagacagtgattaatatttgtcggcgtaaacgcttggaatctgacagctacagccctccccatgtccgcaggaagcagaaaatcacagatatagtgaataaatatcgtaacaagcagctggaaccagaattttacacaagcctattccaggaggttggactcaaaaactgcagcagttag

SEQ ID NO: 59275 - DNA, 4485 bp, Artificial Sequence
  Description of Artificial Sequence: Synthetic coding sequence
atgtatagcgaatggcgcagccttcatctggtcatacagaacgaccagggacatactagcgtcctgcacagctatcctgaatcagtggggcgagaagtcgccaatgccgtggtgagaccattgggccaggtgctgggcacaccaagcgttgctgggagcgagaacctgctgaagacagataaagaagtgaagtggacaatggaggtgatatgctacggtctgacacttcctttagatggggagacagttaagtactgtgtggatgtgtacaccgactggattatggcccttgttctgccgaaggactctatccccctccccgtgattaaggaacccaaccaatatgtgcaaaccatcttgaaacacctgcagaacctcttcgtgcccaggcaggaacaaggatcatcacagattaggctgtgtctgcaggtgctcagggcgatacagaagcttgcacgtgagtcatctctgatggcaagagagacttgggaggtgctgctgctgttcctgctccagatcaatgatattctccttgccccacccacagtgcagggcggtatagcggagaacttagcggagaagcttattggtgtgttatttgaggtttggttgttggcttgcactcgctgtttccctactcctccgtactggaagaccgccaaagagatggtcgccaactggcggcaccatcccgctgtggttgagcagtggagtaaagttatttgtgccctgacatcccgcctactacggtttacctatggcccaagttttcctgcttttaaagtgcccgatgaagatgcctcactgattccaccggaaatggataacgaatgtgttgctcagacctggtttcgcttcctgcacatgttgtcgaaccccgtcgacctttcaaatccagcaattattagctcaactccaaagtttcaggagcagtttctcaacgttagtggcatgccccaggaactcaatcagtacccttgtctcaaacacctacctcaaatatttttcagggcaatgcgcggaatctcctgccttgtcgatgccttcctcggaatatcccggcctcggtcagactcagcacccccaacccctgtgaacaggctttctatgcctcagtccgctgccgtttccaccacccctccacacaaccggcgacaccgggcagtgaccgttaataaggcaaccatgaagacctctactgtgtcaacagcccatgctagtaaagttcagcaccagacatccagcactagtccattgagttctccgaatcagacttccagtgagccccgacctcttcctgccccacgacggcctaaggtgaattctattttaaatttattcggcagttggttatttgacgccgctttcgtccattgcaagctgcacaatggcattaatagagattcatctatgacggctattacaacccaggcaagcatggagtttagacgcaagggatcacagatgtccactgataccatggtttctaaccctatgtttgacgcctcggagttccccgataattatgaggctggaagggctgaggcatgtggcacactctgtcgcatcttctgttccaaaaaaaccggagaagagatcttgcctgcatacctgagtaggttttatatgctcctcattcaaggactccagatcaacgattacgtatgccatcccgttctcgcaagtgttattcttaactcgccaccactgttctgttgcgatctgaaggggatagacgtggtagtgccttatttcatatccgctctggagacaatcttgccagatcgcgagctcagcaagtttaagtcttatgtaaacccaaccgagctgcgcaggtctagtattaatattctcctctctctccttccgttaccgcatcatttcggaaccgtgaagagtgaggtcgtgcttgagggaaaattcagcaacgacgattcaagctcatatgacaaacccatcaccttcctcagcctgaaacttaggctggtgaacattctcataggggctttgcagacggaaacagatcccaacaatacccagatgatactcggggcaatgttgaatatcgttcaggactcagcactccttgaagcaatcggctgtcagatggagatgggcggtggagaaaataatctaaagagccattcgcgtacaaattcgggcatttctagtgctagcggcggtagcaccgaaccaacaacaccagattctgaacggccagcccaggccctcctgagggactacgcactgaacactgacagcgccgctggcctgctaatccggagtattcatctggtcacacagagacttaactcccagtggaggcaggatatgtcaatctccctcgctgccctggaactgttgtctggcctggccaaagttaaagtgatggtagacagtggggatagaaagcgagcaataagttcagtgtgcacctatattgtttaccagtgctctagacctgcacccctccactctcgggacctgcacagcatgatcgtggctgcatttcagtgcctttgcgtgtggcttacagagcaccccgatatgttagacgagaaagactgcctaaaagaggtgctggagatcgtggaactcgggataagcggttccaaatcaaagaacaacgagcaggaggtaaagtataagggggacaaggaacccaatccagctagcatgcgcgtcaaggacgcagcagaggcaactctgacttgcataatgcagcttctgggcgcttttccatcaccctcaggacccgcatcaccatgcagcttggtgaacgagaccaccttgattaaatactcccgcctgcctactattaataaacattctttcagatacttcgtgctggataacagcgttattctagccatgttagaacagcccctcggcaacgaacagaatgatttcttccccagcgtgaccgtgcttgtccgcggaatgagtgggaggctggcctgggctcagcagctctgcctgctcccacgtggcgcaaaggcgaaccagaagctgttcgtcccagaacccagacctgtgcccaagaatgatgtgggctttaaatacagcgtcaaacataggcccttccctgaggaggttgataaaataccattcgtgaaggcagaccttagcataccagatctgcatgagatcgtgacagaggaactcgaggagagacacgaaaaactgcgctctgggatggcccagcaaatcgcctacgagatccatttggagcaacaatctgaggaagaattgcagaagcggtcctttcctgaccctgtcacagattgcaaacccccaccacccgcacaggagttccagactgctaggctgttcctgtctcatttcgggtttctttcacttgaagctctaaaggagccggcaaacagcagactgcctccgcacctgattgccctggatagcaccatccccggtttttttgatgacatcggctacctcgacctcctcccctgccggcctttcgatacagtctttatcttttacatgaagccaggccagaagactaatcaggagatccttaagaacgtggagtcatcgagaacagtccagccgcacttcctcgagttcctgttatccttaggctggagcgttgatgtgggtcgccacccgggatggacaggccacgttagcacctcttggtcaattaactgctgcgacgatggagagggatcgcagcaagaggtgataagctctgaggacattggagcctcgatttttaatgggcaaaaaaaggtgctgtattacgctgatgcattaaccgagatcgcctttgtagtaccttcccctgtggagagcctgacagacagcttagaaagtaatatctcagaccaagatagtgatagcaatatggatttgatgcccggaattctgaagcaaccaagtcttactttagagctgttcccaaaccacacagataacctcaattcttcacaacgcctatctcccagctcccgaatgaggaagctgccccagggtcggcctgtgcctcctttgggcccagaaacccgggtgtctgttgtctgggtcgaaagatacgacgacattgaaaactttccattgtcggagttgatgactgaaatctcaacgggtgtcgaaaccactgccaactcatctacctctctgagaagtactacgctcgagaaagaggttcccgtcatctttattcatcctctgaatacaggattgtttagaattaaaatccagggagcgaccggaaagtttaacatggtgatccctctagtcgacggaatgatcgtgagccggagggcgttgggctttctggtcaggcaaacagtgatcaacatctgcaggcgcaagcggttggagagcgacagctatagtccacctcatgtgaggcggaagcagaagataactgatatcgtgaacaagtaccgcaataagcagttggagcctgagttttacacatctctctttcaggaagtgggcctcaagaactgttcttcatag

SEQ ID NO: 59276 - DNA, 4476 bp, Artificial Sequence
  Description of Artificial Sequence: Synthetic coding sequence
atgtacagcgagtggcggtccctgcatctggtgatccagaatgatcaaggtcatactagcgtgctccactcatacccggaatccgtgggccgagaggtagccaatgcggtggtcaggcccctgggacaggtcctgggtactccaagcgtcgctgggtcagaaaacctccttaaaacagataaggaggttaaatggactatggaggtaatctgctatgggctcaccctgccgctggacggggaaacagtaaagtattgtgttgacgtgtatacagattggattatggccctcgtactgcccaaggacagcatccccctccccgttattaaggagccaaatcagtacgtgcagaccattctgaagcacctgcagaaccttttcgtgcctcggcaggagcagggctcttcccaaatcagattgtgtctccaggtcctgcgggctatacaaaaactggccagagaaagctccctcatggcacgcgagacctgggaagttcttttgctgtttctcttgcaaataaatgatatcctcctcgcaccgccaaccgtccagggtggcatagctgaaaatctcgccgagaaactgattggagtgcttttcgaggtctggcttctcgcatgcaccaggtgttttcctacacccccatactggaagactgccaaggaaatggtggcaaactggcgacaccacccagcagtggtggagcagtggagcaaagtgatatgtgccctcacgtcccgtctgttacggtttacttatggaccatccttccccgcattcaaggtgcctgatgaggacgcctcacttatcccacccgagatggataatgaatgcgtggcccaaacctggttcagattcttgcatatgctgagcaaccctgtcgatctctctaatccggctattatctcatctacgcccaaatttcaggaacagtttcttaatgtcagtggaatgccccaagagctgaaccagtatccctgtcttaaacatctgcctcagattttcttccgggctatgaggggcatctcatgtcttgtcgacgccttcctcggaatctctagacctagaagcgactcagcccctccgacacccgtgaaccgcctgagcatgcctcaatctgcagccgtaagcacgaccccgcctcataaccgacgccatcgggcagtcaccgttaacaaagcaaccatgaaaacttctacagtgagtaccgcccacgccagcaaagttcagcaccagacatcgagcacgagcccactctcctctcctaaccagacttccagtgaaccccgacctcttccggctcccagaaggcccaaagtgaactctatcctcaacctcttcgggagttggctgttcgatgctgctttcgtccattgcaagcttcacaatggaataaatcgtgattcaagtatgaccgcaattacgacacaggcctcaatggagtttagacggaagggtagccagatgagtactgacacaatggtctctaatcccatgttcgacgctagcgagttccctgacaactacgaagctgggagggccgaagcctgtggcacactatgtcggatcttctgctcgaagaagacgggggaagaaatcctgcctgcttatttgagtcgcttttatatgttactgatacaaggactgcagatcaacgactatgtttgtcatccggtactcgcatcagttatcttgaattcccctcccttgttttgttgtgacctcaaaggtatcgacgtggtggtcccctattttatctccgctctggagaccattctgccagaccgagagttatcaaagttcaaaagctatgtgaatccaactgagctcaggagaagctccattaacattctgctgagtcttctgccccttccacatcacttcggtacagtgaagtctgaagtcgtactcgagggcaaattctcaaacgatgatagtagttcctacgataaacctatcacttttctgagcctgaagctcaggctggtgaacattctgattggggcactgcagacggagaccgatccaaacaatactcagatgatccttggagctatgttgaatatagtgcaggactccgctctgctggaggccattggatgtcagatggaaatgggaggaggcgagaacaatttaaaatcccattcgcggactaactctggcatcagcagcgcgagtggcggtagcaccgaacctactacacccgactctgaacggccagctcaggcattgctccgtgactacgactctgccgctggactactgatccggtcaatacacctcgtgacccagcgattgaacagtcagtggagacaggatatgagcattagtttggctgcactggagctgttgagcggcttggctaaagttaaagtcatggtggattcaggggacagaaagcgggcaatctccagtgtgtgtacttacatcgtttatcagtgttccagaccagctccactgcactcaagagacctccattctatgatcgttgctgcgttccagtgcctctgtgtgtggcttactgaacacccggatatgctcgatgagaaggactgtctgaaagaagtgctggagatcgtcgagcttggaattagcggttccaaatcgaaaaacaatgagcaagaggtgaagtacaaaggggataaggagcctaaccccgcttccatgcgagtgaaagacgcagccgaagccacactgacatgcatcatgcagctcctgggagcatttccctcaccaagtgggcctgcctccccatgttccctcgtcaatgaaacaaccttgatcaaatactcaagactcccaacaatcaacaaacactctttcagatactttgtgttggataattcggtcattctggcaatgctcgagcagccgttgggaaatgaacagaacgatttcttcccatctgtaaccgttctggttagaggaatgtccggcaggctggcttgggcacagcaactgtgtttgctgccgcgaggcgctaaggctaaccaaaagttatttgtaccagagcctcgccctgtaccaaaaaatgatgtcgggttcaagtactcagttaaacacagacctttccctgaagaggtcgacaaaatccccttcgtaaaagccgatctgtctatccccgatttgcatgagatcgttaccgaggagctggaggaacgtcacgagaagttgcggtctgggatggcccagcagatagcctatgagatccatctagaacagcaatccgaagaagagctgcagaagaggtcattccccgaccccgtgacagactgtaaaccaccaccccctgctcaggagttccagacggcccgtctcttcctgtcacattttggattcctttcactcgaggccttaaaagagccggctaatagcaggctcccccctcatctgatcgcccttgactccaccattcctggattcttcgacgacatcgggtacctcgatctgctgccctgtcggccatttgacacagtttttatattctacatgaagccgggacaaaaaaccaatcaggaaattttgaagaacgttgagtctagtaggaccgtgcagccccacttccttgagttcctgttaagcctcggatggtccgtcgatgtggggaggcatcctgggtggacagggcatgtgtctaccagttggtctatcaactgctgtgacgatggcgaagggtcacagcaagaggaggtgatctcctccgaagatatcggtgcttcaatttttaacggtcaaaagaaggtgctgtattacgccgacgcactgactgaaatagcttttgtcgtaccttcgcctgtggaaagcctgacagatagccttgagtctaatatttccgatcaagacagtgatagcaatatggatctcatgcctgggattttaaaacagccatctcttactctcgagctgttcccaaatcacacggataatctgaactcatctcagagactatctccctcctccaggatgagaaagctgcctcagggcaggccagtgccaccgctcggaccagaaactagagtctctgtggtttgggtcgaacggtacgacgatatcgagaattttccattgtctgaacttatgaccgaaatctctacaggagtggagactactgcaaattcctcaaccagccttcgctcgactaccctggagaaggaggtccccgtgatttttatacatccactgaacacgggcctgttccgcattaagattcagggagctaccgggaagttcaatatggtgataccactggtcgacgggatgattgtgagccgcagggcattggggttcttggttcgacaaacagtgatcaacatatgtagacggaaaagacttgagtccgactcctacagtccccctcacgtgcgccgtaaacagaagatcactgatatcgttaacaagtataggaataaacaactggagccagagttttacacatcccttttccaagaggtcgggctgaaaaactgcagttcatag

SEQ ID NO: 59277 - DNA, 3972 bp, Artificial Sequence
  Description of Artificial Sequence: Synthetic coding sequence
atcaacgacatcttacttgctccacctactgtacagggcggtatcgcagaaaatcttgccgaaaagctgattggagtgctgtttgaggtgtggctgttggcctgcactagatgttttccaacgccaccctattggaagacggctaaggagatggttgcaaattggcgtcaccacccagccgtggtggaacagtggagtaaagtgatctgcgccctaacttcacgtttgctgagattcacttacggtccatcatttcctgccttcaaggtccctgatgaggacgcctccctgataccacctgaaatggacaatgaatgcgtggcccaaacctggttcaggttcttgcacatgctttctaaccctgtggacctgtccaatcctgccatcatctcctctacccctaaatttcaggagcagttcttgaacgtatccggcatgccccaggaactgaatcagtatccctgtctgaaacacctaccccagatattctttcgggcaatgcgcggaatctcctgtcttgtggacgctttcctggggattagccgaccacgcagcgactctgcccctccaaccccagtgaatcgcttaagcatgccccagagcgcggctgtgagtaccactccccctcataatcgtagacatcgggcagtaaccgtcaacaaggcaactatgaagacgagtaccgtttcaactgcacatgcctccaaggtgcagcaccaaacctcatctaccagccctctgtcttctcccaatcagacctcctccgaacccagaccactacctgcccctcgcaggccgaaggtgaatagtattctgaacttattcggatcctggctcttcgacgccgcttttgtacactgcaagctccacaatggcataaatagagactcatcaatgacagccatcactacccaggcatccatggagttccggagaaagggtagccagatgagcacggatacaatggtgtccaatcctatgttcgatgcttccgagtttccagacaactacgaagccggacgcgctgaggcctgtgggacattgtgtagaatcttttgttcaaaaaagacaggcgaggagattctgccagcctacctatcgcgcttctatatgctattgatacaaggactccaaattaacgattatgtatgccacccagttctcgcctctgtgatcctaaactctccaccactgttttgctgtgatctcaaggggatcgatgtggttgtgccctattttatcagcgccttagagaccatcctgccagatcgggagctcagcaagttcaaaagttacgtcaatccaacggaattgcgccgatcctctatcaacatactgctctcactactaccgctacctcatcacttcggcaccgtgaaaagcgaggtggtgcttgagggaaaatttagcaacgacgactccagctcatacgataaaccgattacatttctgtccctgaagttgcggctagttaacattcttatcggcgctctgcagaccgaaacggaccccaacaacacacagatgattctgggagccatgctgaatattgtgcaggactccgccttgctggaggctattggctgtcagatggagatgggcggtggcgaaaacaacctcaagtcccattcccgtactaattctggaatctcctccgcttccggaggcagcactgagcctacaactccagatagtgaaaggccagcccaagcacttctcagggattacgccctcaatacggattccgccgctggactgttaatccggtctatccaccttgttacacagaggctcaacagtcaatggaggcaggacatgagtattagcttagctgcgctggagctcctaagcggattagctaaggtaaaagttatggttgattcaggggataggaagcgcgctattagctcagtgtgcacatacatagtctatcagtgctccagaccagcacctctgcattctcgggacctgcactccatgattgtagccgcattccagtgcttatgcgtctggttgaccgagcaccccgacatgctagatgagaaagattgcctcaaagaggtgttggagatagtggagttgggtatcagtggctctaaaagtaaaaataatgaacaggaggtgaagtacaaaggggataaggagcctaaccccgcttccatgagggtgaaagatgccgcagaagcaacattgacatgtataatgcagctgctgggcgcattccccagtcctagcggtcctgccagcccctgtagcctagtcaacgaaacgacactcattaagtactcccggttacccaccatcaacaagcacagttttcgctactttgtgctggacaactcagtaatactggcgatgctggagcaaccgctggggaatgagcaaaacgacttcttcccttcagtgaccgtgctagtgagagggatgtccggccgactcgcctgggctcagcagctctgcctgctcccacgtggcgctaaggcaaaccagaagctgttcgtaccagaacccaggccagttccgaagaatgatgtagggtttaagtattccgtcaaacataggccctttcctgaggaagtggacaaaatcccttttgtgaaagccgacttgagcattccagacctgcacgagattgtgacagaagagttagaggaacggcatgagaaactacgcagcggcatggctcagcagatcgcttacgagattcatctggaacaacagtccgaagaagagctccaaaagagaagttttcccgacccagtaactgactgtaaaccgcctcctccagcccaggaattccagactgctagattgttcctaagccacttcggattcctgtccctggaagccctcaaagagcccgctaactcgcggttaccccctcatctcattgccctggattctactattcctgggttttttgatgatatcggctatctggatttgctcccttgcagacccttcgataccgtgttcatcttttacatgaagccgggacagaagacaaatcaagagattctgaagaatgttgagtccagtagaactgtccagccccacttcctggagttcctgctctcactggggtggtcagttgatgtggggcgacacccaggctggactggccacgtgtctacatcatggtccatcaattgttgcgacgatggtgaaggctctcaacaggaagaggttatcagctccgaagatatcggggcttccatttttaatggtcagaaaaaggtcttatattacgccgatgcgctgaccgaaatcgcattcgtggtcccatcccccgtggagtcgctcactgacagcctcgaaagtaacatcagcgatcaggactcagactcgaacatggatttgatgcccggtattctgaagcagccgtccctgactctagaactttttccaaatcacacagataatctgaattcctcacagagattgtcaccctcgtcaagaatgaggaaactgccgcagggcagacctgtccccccacttggacccgaaacacgggtatctgttgtttgggttgaaaggtacgacgatatcgagaattttccactatccgagctcatgacagaaatctccaccggcgtagagactactgctaactccagcacaagcctcaggtctactacgttagagaaagaggtcccagttatttttatacatcccttgaacacaggcttattcagaatcaagatccagggggctactgggaaattcaacatggtgatccccctggtggatggtatgattgtgtctcgccgagcactcggctttcttgtccgccagaccgtcatcaacatctgccggcgaaagcgactggagtccgacagttattcaccacctcacgtccggcgaaagcagaagataaccgacatagttaataagtaccggaacaaacagctcgagccggaattttatacctctctcttccaggaggtaggtctgaaaaactgctctagctag

SEQ ID NO: 59278 - DNA, 1434 bp, Artificial Sequence
  Description of Artificial Sequence: Synthetic coding sequence
atgtactcagagtggcggagcctgcacctcgtcatccagaatgaccaaggacatacctcggtactacactcttatcccgagtccgtggggagagaggtcgccaatgctgttgttcggcctcttgggcaggttctgggaaccccttccgtggccggatcagagaacctgctaaaaacagataaggaggtaaagtggaccatggaggtgatttgctacggcctgaccctccctttagacggggaaacggtcaaatactgtgtggatgtctacaccgactggattatggcgctcgtgctcccaaaggatagtatcccgttgcccgttattaaggagccaaatcagtatgtccagactatactcaagcacttacagaatttgtttgtgccccgtcaggaacaagggtcgagccagatcagactctgtctgcaagtactcagagctattcagaaactggctagagagtctagtctcatggcacgggaaacatgggaagtgctcctcttgttcctgctgcagataaatgatattctgctggcgcctcccacagtacaaggtggcatcgccgagaatctggccgagaaacttattggagtgctctttgaagtgtggctgctggcatgcacaagatgcttccctactcccccttactggaagactgcaaaagaaatggtcgccaactggcggcatcaccctgccgtcgtggaacagtggtctaaagtgatctgtgcgctcacatcccggttactgcgttttacctatgggccatcattccctgcctttaaagtgccagatgaggatgcctctctaataccgccagagatggataacgagtgtgtggcgcaaacttggttccgtttcctgcacatgttgtcaaatcctgtcgaccttagtaaccccgcaataatctcttctacacctaagtttcaggaacagttcctgaatgtaagcggcatgccacaagaacttaaccagtatccctgcctgaagcatcttccccagatttttttcagggcaatgcgtgggatttcttgtttagttgatgcgttccttgggattagcagacccagatctgactctgccccaccaactcccgtcaatcggctgtccatgccgcagtctgccgcagtgagcacaaccccgccacataatagacgtcatcgagctgtcaccgtcaacaaggcaacaatgaaaacatccactgtgagtacagcgcacgctagtaaggtccagcaccaaacttcctctacatcacccctgtccagtcctaaccagaccagcagcgaaccaaggccgctgcctgctccacgaaggccaaaagtgaactccatactcaacttattcggatcctggctcttcgatgccgcttttgtgcactgtaaactccacaacggtataaatagagatagtagcatgacggacttcacctgtttttag

SEQ ID NO: 59279 - DNA, 2334 bp, Artificial Sequence
  Description of Artificial Sequence: Synthetic coding sequence
atgctgccacggcctctgcgattgttgctagatacctctcctcctggaggagtcgtgttgtctagctttcggagccgtgaccctgaggagggcggaggaccaggcggtttagtggttgggggtggccaggaagaggaagaggaggaggaggaggaggctcccgtgtcagtttgggatgaagaagaagacggtgctgtctttaccgtcacttcccgccaatacagacccttagaccccttagttccaatgccgccacccagatcctctagaaggcttcgcgctgggaccctggaggcgctggtgcggcatctcctggatactcgcacctcagggacagacgtcagcttcatgtctgcctttctagctactcacagagcattcaccagtaccccagcactgcttggtcttatggccgacagactggaggctttggaaagccatcccacagatgagctcgagcgtactactgaggtagcaatctcagtgctgtcaacctggctggctagccatccagaagacttcggtagcgaagcaaagggccagcttgacagacttgagtcttttctcctccagacaggctacgccgcaggaaagggcgtaggcggaggatccgctgatctcattcgaaacctaagatctagagtggacccacaggcgccagacctgcccaaaccactggctctgccaggcgatcctcccgctgaccccaccgacgtactagtgttcctggcggaccacctcgctgaacaattgacactgttggacgccgaactgttcttgaatctcataccttctcagtgtttaggtgggttgtgggggcacagagacagacccggacattctcatctttgccccagtgtcagggctactgtaacccagttcaataaggtggctggagctgttgtatcgtcggtgctgggagccacatcaaccggcgaaggccctggagaggtgacgatccgacctctccgacccccacagagagccaggctgctggagaagtggattcgagtggccgaagaatgtaggctgttgcgcaatttctccagcgtctacgctgtcgtcagcgccttgcagtccagccccatccatcgattgcgggctgcatggggcgaggctacgcgagacagcttaagggtctttagttccctatgccagattttctccgaggaggacaattactcccagtctagagagttactagtgcaggaagtcaagctgcaatcacctttagaaccacactccaagaaggctcctcgaagtggttcccgaggaggaggagtagtcccctacctgggtaccttcctgaaagaccttgttatgttagatgccgcttccaaggacgaactggaaaatgggtacatcaacttcgataagagaagaaaggagttcgcggtgctgtccgagctgaggcgcctgcagaacgaatgtcgcggatacaatcttcagcctgaccatgatatacagagatggctgcagggcctgaggcccctcaccgaggcgcagagccatagagtctcttgtgaggttgaaccaccgggatcttccgacccgcctgcccctagggtcctgagacctaccttggtgatttctcagtggacagaggtgctcggctctgtgggcgtacccactcccctcgtatcttgtgaccgcccatctaccggcggtgatgaggccccaactacccctgcacccttgttgacccggctggcgcagcacatgaagtggccctctgtttcatcgcttgatagcgcgctcgaatcctcgccatccctgcattcccctgccgacccttcccacctgtcaccgccagccagttctcccaggcctagtagaggacataggcgttctgcttcctgcggatcccccctttctgggggtgccgaggaggcaagcggaggtaccggctatggcggagagggctccggtcccggagcctcagattgccgaatcatcagggtccaaatggagcttggcgaagacggatcagtgtataagagtattctggtgacaagccaggataaagctccttcggtaatcagccgcgtgttaaagaagaataaccgcgattccgccgtcgcatccgaatatgagctggttcagctcctcccgggtgaaagagagcttactatcccggcatctgcaaacgtgttctatgccatggatggggcatctcacgatttccttctccgccagcgccgaagatcaagcaccgcaacgcctggggtgacaagtgggccatcagcttccggcacaccaccaagcgaagggggaggaggcagcttcccgagaataaaagcgactggcaggaagattgctcgggcactgttctag

SEQ ID NO: 59280 - DNA, 441 bp, Artificial Sequence
  Description of Artificial Sequence: Synthetic coding sequence
atgctgcctaggccactgcgcctactgctggacacctcacccccaggaggtgtggtcttgtcttcctttaggtcaagggacccagaggaagggggaggacccggtggcctggttgttgggggtggccaagaggaagaagaggaagaggaggaagaggcccctgtatcagtttgggatgaagaggaggatggtgcagtattcacggtgacctcgcggcagtaccgccctctcgaccccctggtccctatgccaccgcctaggtcctcaagaagactgagagctggcactctggaggccctggtgcgacacttacttgataccaggacttctgggacagacgtgtcctttatgagcgctttcttggcaacccatagggcgttcacaagcacccccgcacttctggggctgatggcggatcgacttgaagccctcgagagttag

SEQ ID NO: 59281 - DNA, 2334 bp, Artificial Sequence
  Description of Artificial Sequence: Synthetic coding sequence
atgttgccacggccactacggctacttctggatacttcgcctcctggtggggtcgtcctgtcctcgtttcgcagccgggacccagaggaggggggaggcccaggcggtctcgtggtgggaggtggccaggaagaggaggaggaggaggaggaagaagcccctgtaagcgtgtgggatgaggaggaggacggggctgtgtttaccgtcacctcccggcaatacagacccctggatcccctggtcccaatgccgccaccccgaagctctaggcggctgcgcgcaggtaccctcgaagcactcgtcagacatctgttggacacccgcacttccgggactgatgtgagttttatgagcgcctttctcgccacccatagagccttcacaagcacccccgctctgctaggccttatggctgatcggctggaggccctggaatcccaccccactgacgagctcgagaggactaccgaggtcgctatcagcgtgctctcgacctggctggctagccacccggaagactttggctccgaagccaaaggccaactggacaggctggagtcctttctgctccagacaggctacgctgctggaaagggcgtgggtgggggaagcgctgacttaataagaaatttgagaagccgagttgatcctcaggctcccgatctgcccaaaccattagccctacccggagacccgccagctgacccaactgacgtcctggtgtttcttgctgaccacctggccgaacaacttaccctgctagatgccgagctcttcctgaacttaatccccagccagtgcctggggggactgtggggccacagagatcgcccaggccacagccatctgtgtccgagcgtgagggctacagttacccaatttaacaaagttgcaggtgccgtcgtatcgagcgttcttggcgctacttcaacaggcgaaggcccaggagaggtcactattcgccctctgcgccctccacaaagggctcgcctgctggaaaaatggatccgggtggccgaggagtgccggctgctccggaacttttcatcggtttatgctgtggtctccgctctgcagagctcccccattcatagacttcgggctgcgtggggggaggccacaagggatagcctcagggttttctcaagtttatgtcaaattttctcggaggaagacaactattctcagtcacgcgagctgctcgtgcaggaggtgaagctgcagtcccccctggaacctcacagcaagaaagctcccagatctggatccagaggcggaggggtagttccctacctcggaactttcctgaaagacttggtgatgctagatgccgcatccaaagatgagctagaaaatggatacatcaacttcgataagcgcaggaaagaattcgcagtactcagcgagctcaggcggctgcagaacgaatgccgcggatacaaccttcagccagaccatgacattcagaggtggctgcaaggcctgcgaccgctcaccgaggcccagtcccatcgcgtgtcctgcgaggttgaacctccaggttcctctgacccacctgccccacgggttctgcggccaacactggttatttcccagtggaccgaggtgctgggaagtgtgggcgtgcctacgccactcgtgtcctgtgatcggcctagcaccgggggagacgaagcaccgaccacgccggctccgttgctgactagacttgctcagcacatgaagtggccgtctgtctcttccttggattccgcccttgaatcttccccatcactgcattcccccgcagatccatcccatctttctcctcctgcatccagtcccaggccctcgaggggtcataggcgatctgcctcgtgtggcagtcctctctctggcggtgccgaagaagcctctggcggtaccggatatggaggcgaaggaagtggccctggtgccagcgattgtcgaattattcgcgttcagatggaactgggggaggacgggtcagtttataagtccatcctggttacctcccaggacaaggcaccctcagtgattagtagggtattaaagaagaataatcgcgatagcgccgtagcctcagaatatgagttggtgcagttactgcctggagaacgggaattgaccatccccgcttctgcgaacgttttttacgcaatggacggagcctctcatgatttcctgcttagacagaggaggcgaagctcaactgcaaccccgggagtcacaagcggaccatctgcatcaggaacccccccaagcgaaggaggtggcggttctttcccaaggatcaaggccacgggtaggaagatagccagagccttgttttag

SEQ ID NO: 59282 - DNA, 2334 bp, Artificial Sequence
  Description of Artificial Sequence: Synthetic coding sequence
atgctaccgaggccactccggttattgctggataccagccctcctggcggtgtggtgctctcttcctttaggtctagagatccggaagaaggtggcggacccggaggtctagtcgtgggcggagggcaggaagaggaggaggaggaagaagaagaggccccagtctcggtatgggacgaggaggaggatggcgctgtgttcaccgtaaccagtcggcaataccggccattggaccctctcgtgccaatgcctccacctaggtcaagtaggaggctgcgagcaggaacattggaggccctggtgaggcatcttttggacaccagaacctcaggcacagacgtttcatttatgtccgcctttcttgctacgcatcgcgcttttacgtctactcctgctttgctcgggctgatggccgatcgcctcgaagcattggagtcacacccaacagacgagctggagagaaccaccgaagtggcgatttccgttctctccacatggcttgcttcacatcccgaggatttcggatctgaggcgaagggccaactcgatagactcgaatcttttctgctgcagaccggctatgctgcaggcaagggcgtggggggtggttcagctgatctcattaggaacctccggtcccgggtggacccccaggctcctgatttgccaaagccattagccttacccggagaccccccagccgatccaacagacgtgctggtcttcctcgccgaccacctggcagaacagttgaccctgctcgacgccgagctgttcctgaatttgattccatctcagtgtctggggggattgtggggtcaccgagaccgcccaggccactctcatctttgcccttccgtgagagccactgtgacccaattcaataaggtggcgggtgcagtcgtatcttcggtcctaggagctacaagtaccggggagggccctggcgaggtgactatcaggcccctgcgccctccacagcgggctcggcttctggagaagtggatccgggtggcagaagagtgcaggctgttgagaaacttttcctcagtctatgccgttgtgtccgccctccagagtagccccattcatagattgagggccgcttggggcgaggcgacacgagattccctccgggtcttctcctccctatgccaaatcttcagcgaggaagataactattcacagtctcgcgaattgcttgtgcaagaggtgaagttacagagtcccctggagcctcactcaaaaaaagctccacgctcaggctcaagaggtgggggagtcgtaccgtatcttggcaccttcctgaaggacctggttatgctggatgccgctagcaaggatgaactggagaatggatacatcaatttcgataaaagaagaaaagaattcgctgtgttgtctgagttgcgcagattgcagaacgaatgtaggggctataacctgcaaccagaccatgacatccagcgatggctacaggggctgagaccactcaccgaagctcagtctcacagagtgagctgcgaggtggagccccctggcagtagcgatccgcctgcccctagagtgctgcggcctacgctggtaatcagtcagtggaccgaggtgctagggtctgtcggggtgcccacccccctcgtgtcctgcgaccgccctagcacagggggtgacgaggctccaaccacacccgcacctctcttgacccgcctggcacagcatatgaagtggccgagcgtgtcttcccttgactcagctctggagagtagtcctagcctgcatagtcctgcagacccctctcacctatctccgcctgcgagtagcccgcgtcccagtaggggccaccgcagatctgccagttgcggctctccgctttccggtggggcagaagaagcctctgggggaactgggtatggcggagaagggagtgggccaggagctagtgattgccggatcatccgtgtgcagatggaactgggtgaggacggatccgtctataagtcaattctagtcacgtcccaggacaaagccccatcagtgatctcaagggttttaaagaagaataatagagattccgcggtagcctccgagtacgagctggttcagctgttacccggagagagagaactgaccatccctgcatccgccaacgtgttttacgctatggatggtgcatcacacgacttcttactaagacaaaggcgccgttcttctactgccacgcctggtgttacctcaggaccgagcgcctcaggcacccccccatctgaagggggtggtggatctttccctaggatcaaggccaccgggaggaaaattgccagggccctgttttag

SEQ ID NO: 59283 - DNA, 1977 bp, Artificial Sequence
  Description of Artificial Sequence: Synthetic coding sequence
atggcagatcgattggaagccctcgagagtcatcccactgacgaattggagcgcacaaccgaagtcgctatcagcgttctctccacgtggctggcatctcacccagaagattttggctccgaagctaagggccagctcgataggttagaatctttcctgctacaaaccggctacgctgcgggaaaaggagtgggaggtggttcggccgatctgattcgaaaccttcgctcccgggtggatccacaggctcctgatctgccgaaacccctcgcattgcccggagatccgccagccgatccaacagacgtgttggtgttcctagctgatcacttagccgagcagttgactctcttggatgctgaattatttctgaatctcattccatcccagtgtctcggcggactgtggggtcacagagaccgacccggtcattcccatctgtgcccttcagttcgcgctacggtcactcagttcaataaagtggccggagccgttgtatcttcagtccttggagccacatctactggagagggcccaggagaggtgacgatacggccactgcgccctccccaaagagccaggctactggagaaatggatccgggttgccgaggaatgccggctactgaggaactttagctctgtctacgccgtggtgtcggcattgcagagtagcccgattcacaggctgcgggcagcatggggggaggctacccgggatagtctgcgggtattttctagcctgtgtcagattttcagcgaggaagacaactactctcagtctagagagctccttgtccaggaggtgaagctgcaatctcccttagagccccattccaaaaaggccccaaggagcggatcccgaggaggaggtgtggtcccctacctcgggacattcctgaaggacctggtgatgttggatgcagcaagcaaggatgagctcgagaacgggtatatcaattttgataaacgacgaaaagagttcgccgtcttgtccgagcttagacgcctgcagaacgagtgccgcggttacaatctgcagcctgaccacgacatacaacgttggttgcagggactcagacccctgaccgaagctcagtcccaccgagtgtcatgtgaggtggaaccccctgggtcctcggatcctccagcccctcgggtcttgcggccaaccctcgtcatttcgcagtggacagaggtgctgggttccgtcggggtgcctacacctttagtttcatgcgacaggccatctacaggcggtgatgaagcccctacaacccccgctcctctccttactcgcttagcccaacacatgaagtggccatccgtgagcagtttggattcggcgttagagagttcaccctccctgcactcccccgctgacccttcacatctaagtcctcctgctagctcacctcggccttcgcgcggacaccgcagatccgcaagctgtggaagcccactgtccgggggagcagaagaggccagcggtgggaccgggtatgggggagagggctccggtcccggtgcgtctgactgtagaatcatacgggtgcagatggaattgggagaagacgggagcgtgtacaaatccatcttggtcacttcccaagataaggccccatctgtgattagccgggtgctgaaaaaaaacaatagggacagtgcagtggcatctgaatacgagctggtccaactgttgccaggagagcgggaactcacgatcccagctagtgccaatgtgttctacgccatggatggggcaagtcatgatttcctgctcaggggggagggtcccttattgctgcacttggcgtcaccagtcgccagactcccacaggagttgctccgggtccgggaagaaggagcgcctttccctggatcacgaccccaaggcggacgattgcatggtcattgcagtgaagaggaggcacccctggcctataggagtcacggagtgcacacccggtgcggctag

SEQ ID NO: 59284 - DNA, 441 bp, Artificial Sequence
  Description of Artificial Sequence: Synthetic coding sequence
atgttgcctaggcccttgcggctgctcctcgacaccagccctcctgggggagtggtgttgagttcgttccgctcacgtgatcctgaggaagggggaggacccggtgggctggtggtgggcggtgggcaggaggaggaggaagaagaagaggaagaagccccagtgtcggtgtgggatgaagaagaagatggcgcagtgtttaccgtgacttcaaggcagtaccgtcccttagaccctctagtgcctatgccaccccctcggagcagcaggaggctgcgggctgggacccttgaagccctcgttcgacatcttctcgacactcgtacctcaggaaccgatgtgagcttcatgtcagcctttcttgcaacccaccgggcattcaccagcacgcccgctctgctcggactgatggccgacaggctggaggccctggagagctag

SEQ ID NO: 59285 - DNA, 441 bp, Artificial Sequence
  Description of Artificial Sequence: Synthetic coding sequence
atgcttcctcggcctctgaggctcctccttgatacctccccaccgggtggggtcgtactctcctcattccggtcccgggatcccgaagaagggggaggtcctgggggtctggtcgtgggcggaggccaagaggaagaggaagaggaagaagaagaagcccctgtctccgtctgggatgaggaggaagatggggcagtctttaccgtaacctccaggcagtatcgccctttagatcctctggttccaatgcctcctccccgttccagtcggcgtttaagagctgggactttggaggcactggttcggcatctgctagatacacgcacctctggtactgacgtctcctttatgagtgcctttcttgccactcacagagccttcacatcgaccccagcccttttaggcctcatggcagatagactagaggcgctggaatcgtag

SEQ ID NO: 59286 - DNA, 1383 bp, Artificial Sequence
  Description of Artificial Sequence: Synthetic coding sequence
atgcctcccccacggtcctctaggcgcttgcgggctggcacactcgaagccctcgtgagacacctgttagacacacgcaccagcggcaccgacgtgtcattcatgagcgcctttctagcaacccatagagcatttacctcaacacccgcacttctcgggctgatggcagacaggctcgaggcgctagagtcacacccaactgatgaattggaaagaaccacggaggtggctatctcagttctttcgacatggctcgcaagtcaccccgaagacttcggctcagaggccaaggggcagctcgaccgtctggaatcgtttctgctccagacggggtatgcggctgggaagggcgtgggaggcggaagtgccgacctgataagaaacctgcgctcacgcgtcgacccccaggcacctgacctgcccaaacctctcgcgttacccggagacccccctgctgatcccacggatgttcttgtatttttagcagatcacctggccgagcagctgacattgcttgacgcagagctttttttaaatctgatcccaagccagtgcctgggtggtctttgggggcatcgggatcgcccaggccactcgcacctgtgtccaagtgtaagagcaacagttacccaatttaacaaagttgcgggtgcggtggtatctagcgttctgggagccactagcaccggtgaaggtcctggagaagttaccatccgtcctctgcgcccacctcagagagctcgcctcctggagaagtggatcagggtggcagaggaatgtaggctgctgcggaatttcagctccgtgtacgccgtagttagcgcgttgcaatcaagccccatccatcgcttgagggccgcttggggggaagccacacgcgattccctgcgcgtgttttccagtctgtgccagatcttctccgaggaggataattactcccagagccgcgagttgctcgttcaggaggtgaagttacagtcccctctggagccacactctaagaaagcaccacgctccgggagcagaggtggcggtgtagtcccctaccttggaactttccttaaagacttggtgatgctggacgcagcctcgaaggacgaactggaaaatggctatattaacttcgataaaagaagaaaggtgtctggagtctccggtctggatgcgggtttaccttacccatgcagtagaaaaggtcggggtaagtcacaaggttctctctcttttggatcatgctctctgcgcgctccttctcaggagttcgcagttctgtcagaactgagacgactgcagaatgaatgtagaggctataacctgcagcccgaccatgacatacaaaggtggctccagggcctaagacccctgaccgaagcccagcgctag

SEQ ID NO: 59287 - DNA, 441 bp, Artificial Sequence
  Description of Artificial Sequence: Synthetic coding sequence
atgctgccacgtcccctgaggctgctcctcgatactagtccacccggtggagtggtactctcctcttttcgaagccgggacccagaggagggaggcggacccggaggcctcgtcgtgggcggaggccaggaggaggaggaggaggaggaggaggaggctcctgtctcagtttgggatgaagaagaagacggagcggtattcacagtgacatcacgccagtatcgcccactcgatccactggtgccgatgccccctccaagatcttcacgcaggctcagggcagggacgctcgaggccctcgtgcgccacctcttggatacccggacctctggtacagacgtctctttcatgagcgccttcctagccacccatagagcttttacttccacccccgctcttctgggcctcatggcagaccggttggaagccttagagagctag

SEQ ID NO: 59288 - DNA, 2334 bp, Artificial Sequence
  Description of Artificial Sequence: Synthetic coding sequence
atgcttccgaggcccctacggttgctcctcgatacctcgccacctggcggagtggttctgagctccttccgatcacgagacccagaggaggggggtggcccaggcggacttgtggttggtggaggacaagaggaagaagaggaggaagaggaagaggcaccagtcagtgtgtgggacgaagaagaagacggcgctgtgttcactgttacatcaagacaatatagacctctagatccactcgtaccaatgcctccaccgcgatcctcacgcaggctgcgggcaggtacgttggaggctctggtgagacacttgctggatacgcgaacctccggtaccgacgtatcattcatgtctgcttttttagctacacaccgtgcctttacctccactccagccctcctcggcctgatggctgaccggttggaggcccttgagtcacacccgacagatgaactggaacggacaaccgaggtcgcaatttcggtattgtctacctggttagcgagccacccggaagattttggctccgaagccaaggggcaacttgaccggctggaaagcttcctgcttcagacagggtatgcagctgggaagggcgtcggaggtgggtccgctgatctgattaggaacttaaggagcagagttgacccccaggcacctgacctccccaaacccctggcactgcccggagatcctccagccgatcctaccgacgtcctcgtctttctggccgatcacctagccgagcaactgacactgctggacgctgagttgttccttaacctgataccctcgcagtgtctcggcggactctggggccatagagacaggccaggccattcccacctgtgcccatcagtcagggcgactgtaactcagttcaacaaagtggctggcgcagtggtgtcatctgtgctgggtgccaccagcaccggagaggggcctggcgaggttactatcagacccctgaggcccccacagagggctaggttattagaaaagtggattcgggtcgcagaggaatgtcgcctgctgcgcaacttcagctcagtgtatgccgttgtttcagctttgcaatcctcgcctattcataggctgcgggctgcctggggtgaagccacccgtgactccctacgggtcttcagctccctgtgtcagatcttttcagaggaagataactattctcagtctcgagagctgctggtgcaggaggtgaaacttcaaagccccttagaacctcatagcaagaaggcgccaaggagtggttctaggggcggaggcgtggttccctacttagggaccttccttaaagatctggtcatgcttgatgcagccagtaaagatgaactcgaaaatggctacatcaattttgacaagagacgaaaggaattcgccgtgctgagcgaactgcggaggctgcagaatgagtgccggggatataaccttcagcccgatcacgacatccagagatggctgcagggactgaggccactcactgaggcacagtcgcaccgtgtgtcatgcgaggtagagcctcctggctcaagcgaccctccggcacccagagttctccgccctactctggttatcagccagtggaccgaggtgcttgggagcgtgggggtgcccacgcccctcgtgtcctgcgataggccttccacaggaggagatgaagctccgaccacgcctgctccactgctgacccggctcgcccaacacatgaaatggccaagcgtttccagtctggattctgccctggaatcctctccatcattacactcccctgcagacccaagccacctgagcccccctgcctcatctcccagaccatcccgaggacaccgaagatccgcgtcctgtggctcccctttgagtggtggcgcagaagaggcatctggcggtacaggatacggcggtgaaggttccggacccggagccagcgactgtagaatcatcagagtgcaaatggaactgggagaagacgggtctgtttacaagtctattctggtgaccagtcaggataaagctccatccgtgatctctagagtgctgaagaagaacaatcgagactcggcagtcgcatctgagtatgagttggtccaattgctccccggtgagagggaactgacaattcctgcaagtgccaacgtcttttacgcgatggatggcgctagccatgattttctgttgcgccagcggagacgctcaagtacagccacgcccggagttacatctggtccaagcgcatccggcacgccaccttcggaaggaggaggtggatcctttccgcgaataaaagcgaccggacgcaagattgcccgtgccctcttttag

SEQ ID NO: 59289 - DNA, 441 bp, Artificial Sequence
  Description of Artificial Sequence: Synthetic coding sequence
atgttaccacgaccccttagactgttacttgacacaagccccccaggcggagtggtgctttctagctttcgctcgagagatcccgaggaggggggaggccctggcggtcttgtcgtgggcggaggacaggaggaagaggaagaagaagaagaggaggccccagttagcgtatgggatgaagaggaggatggggcagtctttaccgtgacctctcgccagtatcgaccccttgatcccctggtccctatgccccctccccgtagtagccgcaggttaagggccggtacgctcgaggctctcgtgcgccacctgctcgatacaagaaccagtggtacagacgtcagttttatgtctgcgttcctggccacccatcgggcatttactagtacaccggcactccttggcttgatggccgatcgcctcgaagcgcttgaatcctag

SEQ ID NO: 59290 - DNA, 2334 bp, Artificial Sequence
  Description of Artificial Sequence: Synthetic coding sequence
atgctgcccaggcctcttaggcttttactggacacatcccctccaggaggggtcgtgctgagttccttccgctcacgagacccagaggaaggaggcggtcccggaggtctcgtggtcggcggaggacaggaggaagaggaggaggaggaggaggaagcccctgtgtctgtgtgggatgaggaggaggacggcgctgttttcactgtcacaagcagacaataccggcctctggatccactggttcccatgcctcctccccgatccagtagaagactgagggctggaactcttgaggcacttgtgcgccatctactcgatactcgaaccagtggtaccgatgtgtctttcatgtcagcttttcttgcaacacaccgggcatttacctccacacccgcactgctcgggctgatggccgacagattggaggcactggagtcacaccccaccgatgagcttgagaggactacggaagtagctataagtgtattgtccacgtggttagctagtcatcccgaggactttggctctgaagccaaaggccaactggatagattggaaagcttcctcctgcagactggttacgctgctgggaaaggcgtgggcggtgggagcgctgatctgattagaaatttaagaagccgggttgatcctcaggctccggatttacctaaaccacttgccctacctggcgacccacctgccgatcccaccgacgttctggtgttcctggctgaccacctggcagagcagttaaccctactcgacgctgagctgttcctgaatctgatcccctcccagtgtttaggaggcctgtggggccacagggacaggccaggtcacagccatctgtgtccgtctgtgagagcaacagtgacacagttcaataaggtagccggtgcagtcgtctcctctgtactgggtgccacctccaccggtgaggggccaggcgaagtcaccattcgccctctcagacctccacaaagagcgaggctcctggaaaagtggattcgggtcgccgaggaatgtcgactgctccgaaatttttcttccgtgtacgcggttgtgagcgccctgcagtcctcccctattcatagactgcgagctgcttggggggaggccacccgggactcattgcgggtgtttagtagtctctgccagatcttttccgaagaagataattattctcagtcaagagagttgctggtgcaggaggtaaaactccagtcaccacttgagccgcattcaaagaaggcccctcgctccggatctcggggaggtggggtggttccctacctcggcacgtttcttaaggacttggtgatgctggatgccgcttctaaggatgaattggagaacggctacattaatttcgacaagcgccgaaaggaattcgcagttctgtctgaattgcgcagactgcagaacgagtgcagaggctacaaccttcagcctgatcacgacatacaaagatggctccaaggacttcgacctctgactgaagcacagagccaccgtgtgtcttgcgaggtggagccacccggtagttcggatccgccagcccctagagtgctgaggcctacccttgtaatttcccagtggaccgaggtcctgggatctgtaggagttcccactcccctggtaagctgtgatagaccgagcaccggtggcgatgaagccccaaccacgccagcccctttgctcacgcgccttgcccagcacatgaagtggccaagcgttagctccctggactccgccctggagtcttctcctagtttgcatagcccggcagacccaagtcacttgtctcctcccgcttcatcccctcggccttctcgcggtcaccgccgatccgcctcctgcggcagtcctttgtctggaggggctgaagaggcgtccggaggtactgggtacggcggagaaggcagcggccctggagccagcgactgtaggatcatccgagtccagatggaacttggggaggatggatccgtgtataagtcgatcctggttacaagccaggacaaagcaccttctgtcataagcagggttttgaaaaagaacaatagggactccgcagtggcctccgagtacgagctggtgcagctgctgccaggggagagagaactcacaattcctgcatcagcgaacgtgttctacgccatggacggtgcaagccatgacttcttgctgcgccaacggagaagaagtagtacagcaaccccgggtgtaacttcgggaccatccgcctctggcactcctcctagcgagggtggcggtggatcctttccccgtataaaagcaacaggccgaaagatcgccagggcactgttctag

SEQ ID NO: 59291 - DNA, 1383 bp, Artificial Sequence
  Description of Artificial Sequence: Synthetic coding sequence
atgccgccaccacgctcttcccgaagattacgagccggaaccctggaggctcttgttcggcacctcttggacacacggaccagtgggacagacgtgagttttatgtctgctttcctggccacgcatcgggcttttaccagcacacctgccctgctcgggttgatggccgaccgactggaggcccttgaatcgcaccccacagatgagctcgaacgaaccactgaagtcgctattagcgttctgtctacatggctggcctcacaccccgaggacttcggcagtgaagccaaagggcagctggatagactagagtcattcctgctgcagacaggttatgccgctggaaagggtgtgggaggagggtcggccgatcttattagaaatctgagatcacgggtcgatccacaagctcccgatctgcccaagcctctggctctgcccggagaccctcctgctgatcctactgacgtgcttgtattcctcgctgaccacctggcagaacaactcacactgctggatgccgagctattccttaatctaattccttctcagtgcctgggcggactgtggggccatagggatcgacctggccacagccatctgtgcccctccgtaagagctaccgtgacccagttcaacaaagtggctggcgctgtagtcagctctgtactgggagctacaagtacaggagagggacctggcgaggtaaccatccggcctctgcgacctccccaacgggctcgccttttggagaaatggatcagagttgccgaggagtgccggctgcttcgcaacttcagtagcgtctatgctgtcgttagcgcactgcagtcctctcctattcaccgcttgagggcggcttggggggaggccaccagagatagtctccgggtcttctccagcctttgtcaaatcttctctgaggaggataattattctcagtcccgcgagctgctggtccaggaggtgaagcttcagtcaccgctggagccccactctaagaaggcacccaggtcaggctcaagagggggtggcgtcgtaccatacctagggacatttctcaaagacttagtgatgcttgatgccgctagcaaagatgaactggaaaacggctacataaatttcgacaagcgacggaaagtgtccggcgtaagcgggcttgacgccggtctcccctatccgtgttcccgaaagggacgagggaagtcacaaggttccctgtccttcgggtcatgctctctcagagccccatctcaagaatttgccgtattaagtgaacttcgaagactgcaaaacgagtgtcggggttacaatttgcagcccgatcacgacatacaaagatggctccaaggcctgcggcctctgaccgaggctcaacgatag

SEQ ID NO: 59292 - DNA, 1977 bp, Artificial Sequence
  Description of Artificial Sequence: Synthetic coding sequence
atggccgaccgtctggaagcattagagagccaccccactgatgaattggagcggaccaccgaagtagccatcagtgtgctttcaacttggcttgcctcccaccccgaagatttcggatccgaagctaagggacagctagaccgcttggaatcctttctcctccagactggatacgccgctgggaagggagtgggcggaggatccgcggacctaattagaaatctaagaagtcgggtggacccgcaggccccagatctcccaaagcctttggcgctgcctggtgaccctccggctgaccccaccgacgtgcttgtgttccttgccgatcaccttgcagaacaactcactctgctcgacgcagagctgttcttgaaccttatcccgagtcagtgcctcgggggtttgtggggccatagggacagacccggtcactcccacttatgccccagcgtccgggctacagtaacacagttcaacaaggtggctggcgcagttgtatcgtccgtattaggagcaaccagcacaggcgaggggcctggggaagtgaccatcagacccctgcgtcctccccagagagctcgcttactggaaaagtggatcagggttgccgaggagtgcagactgctgagaaatttttctagcgtgtacgctgtggtatctgcccttcaaagcagccccatacatcgattgagagctgcatggggggaagcaaccagggacagcctcagagtgttctcttctctctgccaaatattctcggaagaagataactactcccagtccagggagctcctggtccaggaagtgaagctccagagcccactggagccacactcgaaaaaagcaccaaggtcgggctccaggggagggggtgtcgtaccctacctaggcacatttttgaaagacttggtcatgctggacgccgcatccaaggatgagctggaaaacggctacataaactttgataaaaggcggaaggaattcgcagtgctgtcagaattgcgcagacttcagaacgagtgccgcggatacaatctacaacccgaccatgatatacagcgctggttgcagggtcttcgccctttaactgaagctcaatcccatcgagtgtcttgcgaagtcgaaccgccaggctcaagtgatcctccagcacctagggtgcttaggcccaccctcgtcatcagtcaatggacagaggtactcggttcagtcggcgttcccaccccccttgtaagctgcgatcggccatccacaggcggagacgaggcgcctaccactcctgctcctctgctcacccggttggcacagcacatgaaatggccttccgtgtcttcactggactctgccctggagtcatcaccctctctccactctcccgctgacccctcgcatctaagcccacctgcctccagccctcgtcccagtcggggacaccgacggtctgcgagctgcggttcgcctctgtcaggtggagccgaagaagctagcgggggaactggctatggtggggagggctcaggaccgggtgcttccgactgtcgaatcatcagggttcagatggagctcggcgaagacggctccgtctataaatccatcctggtcactagccaggataaagcgccaagcgtaatctcccgcgtgctcaagaagaataaccgagacagcgctgtcgcatcagaatatgagctcgttcaattgctccccggtgagcgtgagctcactattcctgcctcagcaaacgtgttctacgctatggacggggcatcccacgacttcttgcttagaggcgagggcccactgttgctccaccttgctagccctgttgctaggttgccacaggaactactgagagtgagagaagagggtgctccgttccccggtagtcgaccccaaggcggtcggctgcacggtcactgttctgaagaggaggctccgctagcttatagatcccatggcgtgcatacaagatgcggttag

SEQ ID NO: 59293 - DNA, 1977 bp, Artificial Sequence
  Description of Artificial Sequence: Synthetic coding sequence
atggccgataggctggaagctcttgaaagccatcctacggacgaattagaacggaccaccgaggttgccatctcagtgcttagcacttggcttgccagtcacccagaggactttgggagcgaagccaagggacagctcgacagactggaatccttcctgctgcagaccggctacgctgcaggaaagggagtcggaggtgggtccgctgacctgatacggaacctgagaagcagggttgatccccaagcccctgacttacccaagcctctcgcactgccaggtgaccccccagcagatccaacagatgttctcgtctttctggctgatcacctggccgagcaactgactcttttggacgcagaactctttctgaacctgattccctcccagtgcctgggaggactttggggccaccgggacagaccgggacattcccacttgtgcccgagtgttcgagcaacagtgacccaattcaataaggtggccggagccgtggtctccagtgtgctgggggctacctcgaccggggaggggcctggcgaggtgacaatcagacctttgcggccaccacaacgggctcgcctgctggagaagtggattagggtagcagaggagtgcaggctcctgaggaattttagctccgtttatgccgtggtctctgcactccagtcttcccctatacaccgcctacgagcagcttggggggaggccacacgcgactcgctgcgtgtgttttctagtctttgtcagattttctctgaggaggacaattattcccagagtagagaattgcttgtccaagaagtaaaactccaaagcccactggaaccccactccaaaaaagctcctcggtcaggctctaggggagggggagtcgtgccctatctgggaaccttcctgaaagacttggtcatgctagacgctgcaagtaaggacgagctggaaaacggctacatcaatttcgacaagcggagaaaggagtttgccgtgttgtctgaactgcggcgtctgcagaacgagtgcagaggatataacctgcagcccgatcacgatattcagcgttggctccaaggtcttcgcccattgactgaggctcaatcccaccgtgtgtcatgcgaagtggaacccccaggctcttctgaccccccagccccacgggttcttagacccaccctcgtgatatcacaatggactgaggtgctaggaagtgtgggggtgcccaccccattggtttcctgtgacaggcctagtaccggcggtgatgaggctcctacgacgcccgcacctttgttgaccagactggcacagcacatgaagtggccttcagtgtcatctttagactccgccctggaatccagcccatcattgcatagcccagctgatcccagtcacctctctccgcctgcctcctctccaagacctagcaggggacaccgaaggtcagcctcttgtggatctcctctgtctgggggtgcagaggaggcaagcggtggaaccggctacgggggtgaggggtccggtccaggagcatcggattgccgcataatccgagttcagatggaactgggagaggacggtagtgtatacaagtccatcttggtaacctcccaggacaaggctccttctgttatctcccgggttctcaagaagaataaccgcgattcagcagtggcgtccgaatatgaactggtgcaactgctgcccggagaaagggaactgaccataccagccagcgccaatgttttttacgctatggacggcgctagccacgattttctgctgcgcggagagggtccgctgctgttgcacctggcctcgccagtagcacgtttgccacaggagctcctgcgcgtcagagaagaaggcgctcccttccctgggtcaaggccacaaggaggacgcctgcacggccattgtagtgaagaggaagcacccctggcctatagatcccatggtgtgcacactagatgtggctag

SEQ ID NO: 59294 - DNA, 1977 bp, Artificial Sequence
  Description of Artificial Sequence: Synthetic coding sequence
atggcggatcgtttagaggctctggagagtcacccaacagatgagctcgagagaaccaccgaggtggccatctcagtattgagtacatggctggccagccatccagaagactttggctcggaggcaaagggccagctggacagactggaaagttttctgttgcagaccgggtatgcggctggcaagggcgtgggcggaggaagcgccgacctgattaggaacttgaggtctagagtcgatccccaggcacccgacctgccaaaacctctggcccttccaggggatccccctgcagatcccacagatgtactagtgttcctggccgatcacttagccgagcaactcactctgctggacgctgagctgttcctgaacctgatcccctcacagtgtctgggcggattgtggggccatcgggaccggccaggccactcccacctgtgccccagtgtgagggctacagtgacacaatttaacaaggttgccggagcagtcgtctctagtgtccttggtgctacttcgaccggcgagggccctggcgaagtcaccattaggcccctccggccaccgcagagagccagactcctagagaaatggattagagttgctgaagagtgccgcttgctgcggaatttcagctcagtgtacgccgttgtatccgcccttcagagtagtcccatacaccgccttcgcgctgcctggggtgaggcaacacgagacagcttgagggttttctccagcctgtgccagattttttctgaggaagataattactctcagagccgcgagctcttggtgcaggaggttaaacttcagtcaccactggagccccactcaaagaaagctcctcgttccggatctaggggagggggagtagtcccctatctggggacctttctaaaggacctggtgatgctcgacgcggcatcaaaggacgagttggagaatggctacataaacttcgataagaggaggaaagaattcgcagtgctgtctgaactaagacggctccagaatgagtgcagggggtataacctgcaacccgatcatgatatacagagatggctccagggccttcgacccctgacggaggcacaaagtcacagggtgtcctgcgaggtggagcctcctggatcgtctgacccgcctgctcctcgagttctgcgacctactctagttatctcacaatggacggaggttctcggatctgtgggcgtacctactcctctagtcagctgtgatcgaccctccacaggtggcgacgaagctcctacaactcctgcccctttacttaccagactggcccagcacatgaaatggcccagtgtttcctccctggactcagccctcgagtcctcgccttctctgcacagtccagccgatcctagccatctatcacctcctgcctcgagtcctcggccaagtaggggccaccggagaagcgcatcttgcggcagccctctgagcgggggtgccgaggaggcttcaggcggaaccggttacggaggcgagggatctggcccaggagcctccgattgtaggataatcagggtccagatggaactgggtgaagacgggtcagtatacaagagcatcctggtgacttcccaggataaagccccatccgttatctctcgcgttctgaaaaagaacaatcgagacagcgccgtggcttccgagtatgagctcgtacagttgctacctggggagcgcgagctgacaattcccgcatccgctaacgtgttctatgccatggatggggcttcccacgacttcctactgaggggagaaggcccacttttgttgcacctggctagccccgtggccagactaccccaggagctgctgagggtaagggaagagggtgctccctttcctggtagccggcctcaagggggacgcttgcacggccactgctcagaggaggaggctccactggcataccgttcacacggcgtccacaccaggtgcggatag

SEQ ID NO: 59295 - DNA, 1977 bp, Artificial Sequence
  Description of Artificial Sequence: Synthetic coding sequence
atggctgaccgcctcgaagctctggaatcccaccctactgacgagttggaaagaaccaccgaggtggccataagcgtactgtcaacatggctcgcctcgcaccctgaggacttcggtagcgaagctaaaggacaacttgatcggctcgaatctttcctcttacagacgggttacgcagcgggaaagggtgtggggggaggcagcgcagacttgattagaaacttgaggtccagagtcgacccgcaagcacccgaccttccaaagcccctggcacttcctggggatccccctgctgacccgactgacgtgctggtattcctggcagaccatctcgccgagcagctgaccctcctggacgccgagctgttcctcaacttaatacctagtcagtgtctgggtgggttatggggtcaccgggaccggccaggacactctcacctgtgtccgtcagttagagctacagttacgcagttcaacaaggtggccggagcagtggtctcatcagtattaggggctacctcaacaggtgagggcccaggtgaggtgaccatcaggccgctgcggcctccccaaagggctcgcctgctggaaaaatggattagagtagccgaggagtgcaggcttctgcggaacttcagcagcgtgtatgcagtggtctccgcacttcaatccagccctatccatcggctgagagcagcctggggagaagcgacacgcgattccttacgggtgttctcttccctctgtcagattttttcagaggaagacaattacagtcagtctagagaattacttgtccaggaagtaaaactccaatctccactggagcctcacagtaaaaaggctcccagatcaggttctagaggcggtggagtagtcccttacctcggtacctttctgaaagatctcgttatgctggatgccgcatctaaggacgagttggagaacggatacattaactttgacaagcggcgtaaggagtttgcagtgctttcagaattgcgccgactccaaaacgaatgtcgaggctataacctgcagcccgaccacgacatccagcgttggttgcagggactgcgcccacttaccgaggcacaaagtcacagagtgtcatgcgaggtagaaccacccggtagctccgaccccccagcccctcgagtgctgagaccaactctggtgatctctcagtggactgaagttttagggtctgtgggcgtcccaacgcctcttgtcagctgcgacagaccgagcacgggaggggacgaggccccaacaaccccagctccccttctgacacgcctggctcaacacatgaagtggcctagtgtgagctctttagattcggccctcgagagcagtccatcattacactctccggcagatcccagccacctgtctccacccgcatcatccccgaggcccagcagaggccacaggcgcagtgcatcctgtggatcccctctcagcggcggtgcggaagaggccagtgggggaacgggctacggaggtgagggatcaggtccaggagccagcgattgccgtataattagagtgcagatggagcttggtgaagacgggagcgtgtacaaatctattctggtgacaagccaagacaaggccccaagcgtaatctccagggtgcttaagaagaataatcgggattctgctgtggcatctgagtacgagctggtacagctgctgccgggagaacgtgaactgactattcctgcctcagccaatgttttctatgcgatggacggcgcatctcacgactttctgctcaggggggagggccctctgttacttcatctggcttcgcccgtggcaagactccctcaagaactgctgcgagtgagggaggagggcgcaccattccctgggtcacgccctcagggcggaaggctacacggccattgttctgaggaagaggcacccctggcgtaccggtcccatggtgtccatacccgctgcgggtag

SEQ ID NO: 59296 - DNA, 1383 bp, Artificial Sequence
  Description of Artificial Sequence: Synthetic coding sequence
atgccacccccaagaagcagccggaggttaagagctggcaccctcgaggcactggtgaggcatctcttggacacgcgaaccagcggaaccgatgtgagctttatgagcgcattcttggctacacaccgcgcttttacgtctacgcctgcgctgctgggactcatggccgacaggctcgaggcacttgagtcccatccaaccgacgaattggagcgcacaactgaggttgcaattagcgtcttgtcaacttggttggcatcgcatcccgaagatttcgggtccgaggcaaagggacaactggataggctcgagagctttttgttgcagacaggttacgccgcaggaaaaggtgtggggggaggcagtgccgacctcatccggaatctgcggtcacgggtcgaccctcaggcaccagatctgccgaagccgctggcactgccaggagatcctcctgcagatcccacagatgtgctggtgtttctggcagatcatttggctgagcagctgacacttctggacgctgagcttttcctcaatcttattcccagccaatgtttgggtggactctggggtcacagagatcggccaggtcactcccatctctgcccctcagtgagggctaccgtgacgcaatttaacaaagtcgctggagcagtggtgagctccgtgctgggagcgacctccacaggcgaaggcccaggtgaggtaactattagacctcttcgaccaccacagcgggctcggctgctggagaagtggatccgagttgcagaagagtgtaggctgctgaggaacttctcttctgtgtatgctgtagtctcggccctacagtcatcgcccatccacagattgcgagccgcttggggagaggccactcgagactccctcagggtgtttagtagtttgtgccagattttcagtgaggaggataattactcccaatcaagagaactcctcgtgcaggaagtgaaactccagtcacccctggagccccactcaaaaaaggctccaagaagtggaagccgaggaggaggcgtggtgccctacctcggaacctttttgaaggatttagtcatgctcgatgccgcaagcaaggacgagctcgagaacgggtatatcaacttcgacaaaaggcggaaagtgagcggagtctccggactggacgcgggtctgccctacccatgctcccggaagggtcgcggtaaatcccagggaagcctgagcttcggctcatgctcccttagagctccctctcaggagttcgccgtgctctcggaacttagacgcctccaaaacgaatgcagaggatacaatttgcagccagaccacgatattcagcggtggcttcaaggcttgaggccactgacagaggcccagagatag

SEQ ID NO: 59297 - DNA, 1383 bp, Artificial Sequence
  Description of Artificial Sequence: Synthetic coding sequence
atgcccccaccacgcagttctagacgcctgcgagctggaaccctggaggccctggtgcgacatctgttggacacacggacaagcggtacagatgtgtcctttatgagcgccttcctggcaacgcaccgagcattcacctccactcctgcactgctggggcttatggcagatcgactagaggctttggagtctcaccctaccgatgagttggagcgcacaactgaggtggcaatctcagtgttatcaacatggttagctagccatccagaggactttggctcagaggccaaggggcagctcgatcggctcgagagctttctgctccagactgggtacgctgctggcaaaggggtcggcggaggatcggccgatctgatccggaacttgcgatccagagtggaccctcaggcacccgatctgccaaaaccattagctttacctggcgaccctcccgcagaccctactgacgtcctggtctttcttgcagatcacttagccgaacaactgacattgttggatgctgagctctttctgaatctaattcccagccaatgcttggggggtttatggggacatcgagaccgccctggccactctcacctgtgtccatcagtgcgagccaccgtcactcagtttaacaaggtggcgggagccgtggtgtcttccgtgctcggcgcaacgtccaccggagaggggcctggcgaggtgaccattaggccactgagacccccacagagggcccgtctgctcgagaagtggatcagggtggccgaagagtgtcgattgcttcggaatttttccagcgtctacgccgtggtgtcagccctccagagcagccctatccatcggcttcgggctgcatggggtgaggccacccgtgactctcttcgcgtgttctcctcactctgccagatctttagtgaggaggataactactcgcagtccagagaactgctggtgcaggaggtaaaattacaatcacctttggaacctcactcaaagaaagccccaaggagtggatcacgagggggaggggttgttccatacctcggcacctttctgaaggacctcgtgatgttagatgcagcgtctaaagatgagctggaaaatggttatataaactttgataagcggaggaaggtctctggcgtctcaggattagatgcgggactcccctatccctgcagccggaagggaaggggaaaatcccagggttccctcagcttcggctcatgcagtttgagagccccatctcaggaattcgcagttctgtctgagctgaggaggctccagaacgaatgcagagggtacaacctgcagcctgaccatgacatccagcgttggctccagggtttgagacccctgaccgaggcacagcgctag

SEQ ID NO: 59298 - DNA, 1383 bp, Artificial Sequence
  Description of Artificial Sequence: Synthetic coding sequence
atgcccccaccaaggtcaagccgacggctgcgcgctgggaccttggaggcactagttcgtcatctacttgacacaaggacctctggtaccgatgtctctttcatgagcgctttcctggcgacccatcgggcattcacaagtactccggctttgctcggtctgatggcggaccgactcgaggctctcgagtcacaccccaccgatgagttggaacggaccacagaagtcgccataagtgttctgagtacatggcttgcttcccacccagaggattttggatctgaggccaaggggcaactggacaggctggagagcttccttctgcagactggatacgctgccggtaaaggcgtcggagggggaagtgcagatctcattcggaatttgcgaagccgagttgatccccaagctcccgacctgcctaagccactcgcacttcccggtgatcctcctgcagatcccaccgatgtattagttttcttagcagaccacctggccgaacagctgacattactcgatgctgagctcttcctgaacctgattccctcccagtgtttaggcggactgtgggggcatcgtgataggccaggccactctcacctgtgtcccagcgtaagggccacggtcacacaatttaacaaggtggccggtgccgtggtcagctccgttctcggcgctaccagcacaggggaggggccaggagaagtgaccatcaggccactccgaccacctcaaagggccaggctgctggagaaatggatacgtgtggccgaggagtgcagactcctcaggaacttctcatctgtgtacgctgtggtcagcgccctgcaatccagcccgattcataggctgcgggctgcatggggagaagccactcgggactccctgcgagtcttctcatccttatgtcagatcttctctgaggaggataactatagccagtctagggagttgctggtacaggaggtcaagctccagtcacccctggagcctcacagcaagaaggcacctcgctcggggtcgcgaggtggcggagtcgtgccttatctaggaacattcttgaaggacctagtgatgctggacgctgcgtctaaggacgaactcgagaacggatacatcaatttcgataagcggagaaaggtaagcggagttagtgggctggacgcaggacttccatatccttgcagcagaaagggcaggggcaaatctcaaggaagtctgagcttcggcagttgttctctcagggctccttcccaggagtttgccgtgctgagcgagctgcggagattacaaaatgaatgtcggggttacaaccttcagcctgaccacgatatccaacggtggctgcagggtcttcgtccccttaccgaggcccagagatag

SEQ ID NO: 59299 - DNA, 1494 bp, Artificial Sequence
  Description of Artificial Sequence: Synthetic coding sequence
gcccgagccggtagaggagcggctagcggtcctcctagggtcgcacaaacctctgatcccgactcttccgaagcatgcgcagaggaggaggaggggctcatgccacaggggccacagctactggacttttcagtagacgaagtagctgaacagttgacactgatagatctagagctcttttcaaaggttcgcctgtatgaatgcttgggctcagtgtggtcccagagagaccgtccaggggcagccggtgcttcccccacggtgcgggcaactgttgcccaattcaatacagtgaccgggtgtgtcttaggctccgtacttggtgcacctgggctggccgcaccgcagagggctcagcgtctggagaagtggattcgcattgcacagagatgtagagagttacggaattttagcagtttgagggctatcctctcggctctgcagtctaacccaatatataggctaaaacgaagctggggtgccgtgtctcgggagcccttgagtacattcaggaagctgagccaaatctttagcgacgaaaataatcatctttcatccagagagattctattccaagaagaggccacagaggggagccaggaggaggataatacccccggaagtctaccctctaagcccccacctgggccagtaccttatctaggaacatttttgacagatctcgtgatgctcgacaccgccttacctgatatgttggagggggacctcataaattttgaaaagcgacgcaaagagtgggagatcctggcgcgtatccaacagctgcaacgaaggtgtcagagctacaccctctcacctcacccccctatactggctgcactgcacgcacagaatcagctgacagaggagcagtcgtaccgactgtcaagagtcattgagcctccagctgcctcttgcccttctagtcctcgtatcagacggaggatctcccttaccaagcgattatctgcaaagctcgcaagggaaaagagcagcagcccttcgggctctccaggtgacccctcatcgccaacttcttctgtttcccctgggagtcctccatccagtcctcgctctagagacgcaccagccggatccccaccagcctctccaggaccacagggcccatctaccaaactccccctctccctggacctgccatcccctcgtccattcgcgcttcccctaggctccccacggatccctctccctgctcaacagagtagcgaagccagagtgataagggtttctatagataatgaccatgggaacctctacaggagcattctactcacatcacaggataaggctcccagcgtcgttaggcgcgctctgcagaagcacaacgtgcctcagccttgggcttgcgattaccaactgtttcaagtcctgcctggtgatagaggttgggaggagatgctgatttcggctatcaagagcgtcggtacgttctttggcatgttcgctatgtgtcaggccaggttttacagatag

SEQ ID NO: 59300 - DNA, 2133 bp, Artificial Sequence
  Description of Artificial Sequence: Synthetic coding sequence
atggaacggacagctggaaaggagcttgccttggccccactgcaggactggggtgaggagaccgaggacggagctgtctactccgttagtctccgaagacaacgctcacagagacgctctccagcagagggcccaggaggttctcaagccccaagcccaatcgctaataccttcttacactataggacttccaaagtacgggtccttagggcagcacgactagagagattagttggtgaactggttttcggagacagagaacaagacccaagctttatgcccgcattcctcgcgacctaccgtacctttgtaccaacagcatgtttgctggggtttctactcccacctatgccccctccccctcctcctggagtggaaatcaaaaaaaccgccgtgcaggaccttagttttaataaaaatctgagagcagtggtgtcagtactcggctcatggctgcaggaccaccctcaggacttccgtgacccccctgcacactccgatctcggaagcgtaagaaccttcctagggtgggcagccccaggaagcgctgaggcccagaaagctgagaagctgctggaagactttctcgaggaagctgaacgggaacaggaggaggagccccctcaagtctggacaggccctcctcgcgttgcgcagacctctgatcctgactcgtccgaggcttgcgccgaggaggaagaaggcctgatgccccagggtccccagctcctggatttttccgtcgatgaggtcgccgaacagctgacccttatcgatctggagctgttctccaaggtgagactgtatgaatgccttggatcagtgtggtcacagcgggataggcctggcgcagctggtgcttcccctactgtaagagccacagtggcccagtttaataccgtgacaggatgcgtgttggggagcgtgctcggggctcctggcctggcagctcctcagcgcgcacaacggttagagaagtggattagaattgcccagaggtgtagggagttaaggaattttagctctcttagggctattctgtccgctctccagtccaacccaatttaccgtctgaaaaggtcatggggagcggtgtcaagagaacctctgtcaaccttcagaaaactcagccagatattctcggacgaaaacaaccatctgtcatccagagagatcttgtttcaggaagaggctacagagggatctcaggaagaagacaatacaccaggaagtctgccatcgaagccccctcccggtcctgtgccctatctgggcaccttcctgactgatctcgttatgctggatacagcactccctgatatgcttgaaggcgaccttataaacttcgagaagcgaagaaaagagtgggagattctcgcacgcatccagcaactgcaacgcaggtgtcagagttacaccctatctccgcacccgcctattctggctgcgctacatgcccagaaccaactcacagaagaacagtcttatcgcctgtcaagggtcatagagcctcctgctgctagttgtccatcatcaccaagaattcggcgtcggatcagcctcaccaagagactgagcgctaaactggcccgtgaaaaaagcagttctccaagcggtagtccaggcgatccgtcttcccctacttcgagcgtgagtcccggttcaccaccctccagtcctagaagtcgggacgctccggcaggaagtccgccagcttctccaggaccacaggggccatctacaaagctgcctttatctctcgacctgccctccccacggccatttgccctgcccttgggcagccccaggatccccctgcctgctcaacaaagtagcgaggccagagtgattagagtcagcattgacaatgaccatggtaacttataccggtccattctgctgaccagccaggacaaagcaccctccgttgtgagaagagcactccagaagcataacgtgccacagccatgggcttgcgattaccagctatttcaggtgctgcctggcgaccgggtgctgctgatcccggataacgccaacgtgttctacgctatgtccccagttgctcccagggattttatgttacggaggaaggaaggtacacgaaatacattatcagtttctcccagctag

SEQ ID NO: 59301 - DNA, 2151 bp, Artificial Sequence
  Description of Artificial Sequence: Synthetic coding sequence
atggagcggacagctggaaaggagctcgccttggcccctctgcaggattggggcgaggagacagaggacggagctgtgtattctgtctcgctcaggaggcagagaagccaaaggcggtctccagccgagggaccaggcggttctcaggcaccctcaccaatcgcaaataccttcctacattacagaacgagcaaagtcagagtcttgagagctgctcgtcttgaacgtctggtgggcgaacttgtattcggggaccgggagcaggatccaagcttcatgccagcatttctggctacttacaggacctttgtgcccactgcatgcctcctgggatttctgctgccccctatgcctcccccaccaccaccaggcgtggaaatcaaaaagactgctgttcaggatttgtcatttaacaaaaatctccgcgcagtagtaagcgtactcggaagctggctgcaggatcatccccaggacttcagagatccaccagcgcactcagacctcggtagtgttagaacctttctcggatgggccgctccaggaagcgctgaggcgcagaaagccgaaaaactgttggaggactttctggaggaggctgaaagggaacaggaggaggagcctccgcaggtctggactggcccacctagggtcgcccagacctccgatcccgacagttctgaggcgtgtgcagaggaggaagaaggtctcatgccacaaggacctcagctgctcgatttctccgttgacgaagtggccgaacagctcactttaatcgacctggaactgttttccaaagtaagactttacgagtgtctaggctctgtatggagccagagagacagaccgggtgcagcaggggcatctccaacagtacgtgctaccgttgcgcagttcaatacagtgaccggctgcgtgctggggtcagtactgggggctccgggactggcagcccctcagagagcgcagcgtctcgagaagtggattcgtattgctcaacgctgtcgagaactccgaaatttctcgagcctgcgcgctattttaagcgcgttgcagtccaatccgatatatcgtttgaagcggtcctggggagccgtgtcacgggagccgttgtcaacattccggaaactttctcagatattttccgacgagaacaatcatctgtcatctagggagattctgtttcaagaggaagccactgaaggctcgcaagaagaagacaatacccccggatctttgccatcaaagcctccaccaggccctgttccatacctgggcacctttctgaccgaccttgtcatgctagatacagcgctgccagatatgctggagggagatctgataaactttgaaaaaaggcgcaaagaatgggaaattctggcaaggattcagcaactgcaacggagatgtcaaagttacacattatcaccccatccgccaatccttgctgcactccacgcccaaaaccagctgaccgaggaacagagttacagactgagtcgcgttattgagccccctgctgcaagctgccccagtagccccagaatacggagaaggattagccttactaagcgcttaagcgcaaaactcgccagagagaagagctcaagtcctagcggatctccaggcgacccatctagtcccacttcctctctctgtatcagcccaagcgtatcaccgggaagccccccttcatcccctcggtccagagacgctccagcagggagcccgcctgcgtcccctggaccgcagggcccatctacgaaactgcccctgtccctcgatttgccaagccctcggccattcgcgttgccactggggtctccgagaatcccgctgcctgcccagcagagcagcgaggccagagtgataagggtgtcaatcgacaatgaccatggtaacctctatagaagcattttgctgacctctcaagacaaagcgcctagcgtagtgagaagagcacttcaaaagcacaatgttcctcagccatgggcctgtgactatcagctcttccaggtccttcccggagaccgggtattactaattccggacaacgccaacgtattttacgcgatgtcaccagtcgctccccgtgacttcatgcttagacgcaaagagggaacaaggaataccctttctgtgagccccagttag

SEQ ID NO: 59302 - DNA, 813 bp, Artificial Sequence
  Description of Artificial Sequence: Synthetic coding sequence
atggagagaactgctggcaaagagctggctttagcacctctacaggactggggggaagagactgaggacggggcagtatactctgtgagcctgcgccgtcagagaagtcagagaagaagtcctgcagagggaccaggtggaagtcaggcccctagtccaatcgccaacacattcctgcactatagaacttccaaggtgcgcgtgctgagggcggcacgattggaaagactggtcggcgaacttgtgttcggcgatagagaacaggacccttccttcatgcctgcgtttttggccacataccgtacctttgtccccactgcctgcttgctgggctttctcctgcctcctatgccaccaccccctccccctggggtggagattaagaaaacagccgtgcaggatctcagttttaataaaaacttgaggctgtttagagggctcagagggggacggggaagggcccacgccagtcggagtcctgcccctgggctgcaacgaggaaggggaggcagagccgcagatccccaccgtctgggggcactgctccaaggcgaggctctgagggtgctgggactgagagtggtggctgaggggcctgcgggaggatgccgtcgactgccacattgtgccagacacaggggcccagtgcagcaccgggatcggctgtgcgccggttttcgcgcaaggtccaccggcctagggagaccagccgagggcgctgcagccggtgaggtggatccacatcgaccagctctgcccagaactgcagaactcttgctccttgcaaggcaccccgtgagaccagcaatctag

SEQ ID NO: 59303 - DNA, 258 bp, Artificial Sequence
  Description of Artificial Sequence: Synthetic coding sequence
atgacagggaagactcagacatctaatgtgaccaataaaaatgatcccaagtccatcaattcccgcgtgttcatcggaaatctgaatacagctatcgtgaagaaggttgacatcgaagccatcttctctaagtatgggaagatcgttgggtgttccgttcacaagggttacgcctttgtccagtacatgtccgagcgccacgcccgtgctgcggttgccggagaaaatgctagggtcattgctggccagcccctgtag

SEQ ID NO: 59304 - DNA, 876 bp, Artificial Sequence
  Description of Artificial Sequence: Synthetic coding sequence
atgaccggaaagacacaaactagtaacgtaacaaataaaaatgatccaaaaagcatcaactccagggtctttattggtaatctgaacacagccattgttaagaaagtggatatcgaggctatattttccaaatatggaaaaatagttgggtgctccgtacataagggttatgcgttcgtgcaatacatgtcagaacgtcatgcacgtgccgcagttgccggagagaacgcacgcgtgattgcgggtcagccactggacataaacatggcaggcgaacctaagccatacaggccaaaacctggtaataagaggcctctctccgccctgtatcgcttggagagcaaggagcccttcctctctgtggggggttatgtattcgattacgattactatagagacgatttctataaccgcctctttgattaccacggcagggtgccaccccctcctagagccgtcattcccttaaaaagaccgagagttgctgtaaccactacacggagaggtaaaggggtgttctcgatgaaagggggttcccggtccacagcatctggcagcaccggctcaaaactcaagtctgacgagctgcagactattaagaaagagcttacacagatcaagacaaagatcgacagtctgctgggcaggctcgagaaaattgagaaacagcagaaagcagaagcggaggcccagaagaaacaacttgaagagtcacttgtgctaatccaagaggagtgtgtgagcgaaattgccgaccactccacagaagaaccagccgaagggggaccagatgctgatggcgaggagatgactgacggtatcgaggaggactttgacgaagacggcggacacgagttgttccttcaaataaaatag

SEQ ID NO: 59305 - DNA, 876 bp, Artificial Sequence
  Description of Artificial Sequence: Synthetic coding sequence
atgacaggcaaaactcagacttcgaacgtgactaacaagaatgatcctaaatctatcaatagccgagttttcatcggaaatctgaacacagccattgttaagaaggtcgacatcgaggctatattctccaaatacggcaaaatcgtcggatgtagtgtgcacaaaggctatgcttttgtccaatacatgtccgagcgacacgccagggccgctgtggccggtgagaatgcgagagttattgcgggacagcctttggatatcaatatggcaggtgaacccaagccctaccgcccaaagccagggaacaaacgaccactctcggcactttaccggctcgagtccaaagagccgttcctgtcagtggggggatatgtgtttgactacgactactaccgggacgatttctacaatcgcctatttgactatcatggccgagtgcctcctcctccccgagctgttattccacttaagaggccgagagtggccgtcaccactacgagacgcggaaagggagtcttcagcatgaaaggagggtccaggagtacggcctcaggctccactgggagtaagctgaaatcagatgagctccagacgattaagaaagagctgacccaaattaaaacgaagatcgactccctgctgggtagattggaaaagattgagaaacagcagaaggctgaagctgaagcccagaagaaacaactcgaggagagcctagtgctgatacaggaagaatgcgtctctgagatcgccgatcactctacagaggaacctgctgaagggggtccagacgctgatggggaggaaatgaccgacggcattgaagaggacttcgacgaagacggcggacatgaacttttccttcagataaagtag

SEQ ID NO: 59306 - DNA, 876 bp, Artificial Sequence
  Description of Artificial Sequence: Synthetic coding sequence
atgacaggtaagacacagacatcaaatgtaaccaataaaaacgacccaaagtccatcaactcaagagtgtttatcggcaatctaaacaccgccatcgtgaagaaggtggatatcgaggctattttctcaaaatacgggaagatcgtggggtgttccgtgcataaagggtacgcttttgtgcaatatatgtcagaacggcacgctagggccgcagtggccggagagaacgcgcgtgtaatcgctggccagcctctcgacatcaatatggccggagaacctaagccctaccgacccaagcccggaaacaagcgacccctctcagccctgtataggctggaatcgaaggaaccatttctgagtgttgggggttatgtctttgattacgactactacagggacgacttctacaatcgactttttgattatcatggcagagtcccccctccccctagagccgttatcccgctcaagaggcccagagtagcagtaacaaccaccagacggggaaaaggggtgtttagtatgaagggcggaagccgatcaactgctagtggcagtacaggcagtaagctgaagtccgacgagctgcagaccattaagaaagagctgacccagatcaagaccaagatcgactctctgcttggaagactggaaaagatagaaaagcagcagaaggccgaggctgaggctcagaagaaacaactggaggagagtctggtgctgatccaggaagagtgtgtctccgagatagccgaccacagtactgaggagcccgcagaggggggacccgacgctgatggggaggagatgactgatggcatcgaggaagatttcgacgaggacggcggtcacgagttgtttctgcagatcaagtag

SEQ ID NO: 59307 - DNA, 258 bp, Artificial Sequence
  Description of Artificial Sequence: Synthetic coding sequence
atgacagggaagacacagactagtaatgtcaccaataagaacgatcctaagtcaatcaattctagagtgttcattggcaaccttaatacagctatcgtcaagaaggtcgatatcgaagctattttcagcaaatacggtaaaatcgttggatgcagcgttcataagggttatgccttcgttcagtatatgtctgaacgtcacgctcgcgctgccgtggcaggcgaaaacgctcgtgtaattgccggacagccactgtag

SEQ ID NO: 59308 - DNA, 657 bp, Artificial Sequence
  Description of Artificial Sequence: Synthetic coding sequence
atgaccatgtataagtctaagcgcagacatcaaagatatatcaacatggctggggagccgaagccctacaggcccaagcctggcaacaagcgcccactttctgccctgtaccgcctggagtccaaggagccctttttgagtgtgggcggttacgtgtttgactacgattactatcgagatgacttctataatcgcctgtttgactatcacggacgggtgccacccccacccagggccgtgatacctctgaagagacctcgcgttgccgtgacaacaacaagacggggaaaaggcgtcttcagcatgaagggcggaagtcgaagcacggcctcaggaagcaccggtagtaaactgaagagcgacgagctgcagaccataaagaaggagttgactcaaatcaaaacaaaaatagactcactcctaggcagactcgaaaaaattgagaaacagcagaaagccgaggccgaggcccagaaaaaacagttggaggagagcctggtcctcatccaggaggaatgcgtctccgaaatcgccgaccacagcaccgaagagccggcagagggagggccagacgccgacggcgaggagatgaccgatggaatagaggaggacttcgacgaggatggcggacacgagctcttcctacagatcaaatag

SEQ ID NO: 59309 - DNA, 1986 bp, Artificial Sequence
  Description of Artificial Sequence: Synthetic coding sequence
atgaagcctctagagaagttcttgaagaagcagaccagtcagctggctggcagaaccgtagcgggtggacctgggggaggcctggggagctgcggcggacccggtggcggaggaggacccggtggaggaggaggaccagctggaggacaaagatctctccagagaagacagtccgtgtcccgccttctgcttcctgcttttttacgggagccaccggctgaacctggactggagcccccacccgaggaggggggagaacccgcaggtgtggcagaggagcccggatctgggggtccttgctggctacagttggaagaagtccctggaccaggaccgctggggggaggtggaccgctccggagcccctccagctactcttctgatgagctgagccccggtgagcctctgacgagccctccatgggccccacttggagcccctgagcgcccagaacaccttctgaaccgcgtgcttgagcggttggcgggaggagccactcgggacagtgccgctagcgatatcctcctcgacgacatagtcctgactcacagcttgtttcttccaacagaaaaattccttcaagaactccaccaatactttgtacgggcaggaggaatggaaggcccagaaggtctggggagaaaacaggcgtgtctggcgatgctcttacacttcctcgacacctatcaggggctgttgcaggaggaggaaggagcaggtcatattattaaagatctgtatctgctgatcatgaaggacgaatctctctatcagggactacgagaggacaccctgcgcctgcaccaactagtggaaactgtggagctcaaaatcccagaggagaaccagccacctagtaagcaagtcaagcccttatttagacacttccgcagaatagattcttgtctccaaacccgcgttgctttccgagggtccgatgaaattttctgcagggtatacatgcccgaccactcatatgtgactatcaggtccaggcttagcgctagcgttcaagacatcctcggaagcgtaactgaaaagttgcagtactcagaggagcctgccggacgagaggactctttgattttggtggccgtcagttcgagtggagaaaaagtgctgttgcagccaactgaggactgtgtcttcaccgctctcggaataaacagccacctgttcgcttgcacccgtgactcctacgaagctctggtccctctaccagaagagattcaggtgtcaccaggcgatactgagattcatagggttgaaccagaggacgtagctaaccatttaactgccttccactgggagctgttcaggtgtgtgcatgaattggaatttgtcgactatgtcttccacggagagcggggtagacgcgagaccgccaatctggagttactgctgcaaagatgctctgaagtgacacactgggtggccacagaagtcctgctgtgtgaggctccgggaaaaagagctcaactgttaaaaaaattcattaaaatcgcagctctatgcaaacaaaaccaggacctcctgagtttctacgctgtggtgatgggactggacaatgccgctgtctcccgcttacgactgacttgggagaagctgccgggtaaattcaaaaacttgtttcggaagttcgagaacttaacggatccttgcagaaaccacaaaagctatcgcgaggttatatctaaaatgaagcctccagttattccctttgttcccctgatactgaaggacctcacctttcttcacgaagggtctaaaaccctggtcgacggactcgtgaatattgagaagcttcatagcgttgcagaaaaggtgaggacgattcgcaagtatagaagcaggccgctgtgcctggatatggaagccagtccaaaccacttacagacaaaagcctatgtgcgccagtttcaggtaattgataaccaaaacttgctcttcgagttgagctataaactggaggccaacagccagtag

SEQ ID NO: 59310 - DNA, 1371 bp, Artificial Sequence
  Description of Artificial Sequence: Synthetic coding sequence
atggagggaccagaaggactcggccgaaaacaggcgtgcctggccatgctcttacattttctggacacctatcaaggactgttgcaggaggaggaaggagctggccatatcattaaggatttgtatctgctgatcatgaaggatgagagcctttatcagggcctgagagaagatacattgaggctgcatcagctggtggaaacggtcgagttgaaaataccagaagaaaaccaaccgcctagtaaacaggtcaaacctctgtttaggcatttcaggcgaatcgatagctgtttgcagacacgggtggctttcaggggcagcgacgagatcttttgcagagtgtacatgcccgaccacagctatgtaacaataagatcgcgactgtctgcctcagtgcaggacattctgggctccgtgactgagaagttacagtacagtgaggaacccgctggacgagaagactcactgatcctggtagctgtgtcaagcagtggtgaaaaggtgctgcttcaacccaccgaggattgcgtgtttaccgccttagggattaacagccatttgttcgcttgcacccgggatagttacgaggccctggtacccctgcccgaagaaatccaggtttcccccggtgacaccgaaatccatcgggttgaacctgaagacgttgcaaaccacttgaccgctttccattgggagcttttccgctgtgtccatgagcttgagttcgtagattacgtctttcacggggagcgagggaggcgggagacggctaatctcgaactgttgctgcaacgctgctccgaggttacccactgggtggcgaccgaggtgctgttatgcgaagcccctggaaaaagggcacagcttctgaagaagtttattaagattgccgcactctgtaagcagaatcaggatctcctttctttttacgccgtggtgatgggcctggataacgctgctgtctctaggctgagactgacttgggaaaagctgcccggaaaatttaagaatcttttcaggaagtttgagaatctgacagacccctgccggaaccacaaaagctacagagaggtgattagcaagatgaaaccacccgttataccttttgtacccctcattctcaaggatttgacctttttgcatgagggaagtaaaaccctggtggatggactggttaacatcgaaaaactacactcagtggccgagaaggtcagaaccatcagaaagtataggtctcgccctctttgtctcgatatggaggcaagtccgaatcatctgcagaccaaggcttacgtgcgacagtttcaggtgattgataaccagaatttgttattcgaattgtcctataagctcgaagcaaatagccaatag

SEQ ID NO: 59311 - DNA, 1371 bp, Artificial Sequence
  Description of Artificial Sequence: Synthetic coding sequence
atggagggacctgaaggtctcgggagaaagcaggcttgcctggccatgcttctgcattttctcgacacatatcagggacttctgcaggaggaggaaggcgctggccatatcattaaagacctgtacctcttgataatgaaagatgagtcactgtatcaaggcctgagggaagatacactaagactgcatcagctggtcgaaaccgtggaactgaagattcccgaggaaaaccaaccaccctctaaacaagtgaagcctctgttcaggcacttccggcgaatagactcttgtctacagactcgggtggcctttagggggtccgacgagattttttgcagggtctacatgccggatcattcctacgtgaccattcgatctcggctctccgccagcgtgcaggacattctcgggtctgttaccgagaagttacagtactcggaagagcccgcagggcgtgaggattctcttatcctcgtcgcagttagctcctccggagaaaaggtcctcctccagccaaccgaagattgcgtatttacagccctgggcattaacagtcacctgttcgcatgcaccagggatagttatgaggcactggtgcctctgcccgaggaaatccaggtgtcccctggggatactgagatccaccgagtagaaccggaagacgtggccaatcacttaacagcctttcactgggagctgttcagatgcgttcatgagctcgagttcgtggactacgtgtttcatggagaacggggacgcagggaaaccgcaaatctcgagctgctcctgcaacgatgctctgaggtaacacactgggttgccaccgaggtcctactctgcgaggcacctggcaagagggctcagctgctaaaaaaattcattaaaatagccgcactttgcaaacagaaccaagatcttctttccttctatgccgtggtcatgggactggataacgcagctgtgtcccgactccgtctgacatgggagaaacttccagggaagtttaagaatctgtttagaaaattcgagaacctgactgacccttgccgtaatcataagtcatatagagaggtaatctctaagatgaagccacctgtaattccctttgtccctctcatcctcaaagacctgactttcttgcatgaaggcagtaagacccttgtcgacggactggtcaatatcgaaaagttacactctgtggcagagaaggttcggaccatcagaaagtaccgtagccggccactgtgccttgatatggaggctagccccaatcacctacagaccaaggcctatgtgcgccagttccaggttatcgacaaccaaaacctcctgttcgaactatcctataagttagaagcgaacagccaatag

SEQ ID NO: 59312 - DNA, 63 bp, Artificial Sequence
  Description of Artificial Sequence: Synthetic coding sequence
atggaaggacccgagggcctcggaaggaagcaggcatgtctggccatgctgctgcatttttag

SEQ ID NO: 59313 - DNA, 306 bp, Artificial Sequence
  Description of Artificial Sequence: Synthetic coding sequence
atggagggcccagaggggctcggaagaaagcaggcatgtctagctatgcttctgcatttcctggatacttatcaaggtttgcttcaagaggaggagggcgcaggacacattattaaggatctttacctgttgatcatgaaagatgagagcctttatcagggcctgcgggaggacactctgcgccttcaccagctggtcgaaaccgtggagctaaagatccctgaagagaatcagcctcctagcaagcaggtaaagccgttgttcagacatttccgtcggattgacagctgtctgcaaacacgctag

SEQ ID NO: 59314 - DNA, 450 bp, Artificial Sequence
  Description of Artificial Sequence: Synthetic coding sequence
atggaggggccagaaggattggggagaaaacaggcctgtctggccatgctgctgcatttcctcgacacataccagggactgctgcaagaagaggaaggggctgggcacatcatcaaagatctctatttattaattatgaaggatgagtctctgtaccagggtctgagggaagatacgctcagactccaccagctcgtggagactgtcgaattaaaaattcccgaagagaaccagccaccttccaaacaagtgaagcccctgtttaggcattttcggagaatcgactcctgtctacagactcgagtggccttccgcggaagcgacgaaatcttctgcagggtctacatgcccgatcactcctacgtgaccatccggtctaggctgtccgcctcggttcaggacatattgggaagcgttaccgaaaagctccagtactctgaggaaccatag

SEQ ID NO: 59315 - DNA, 1359 bp, Artificial Sequence
  Description of Artificial Sequence: Synthetic coding sequence
atgcctgacttgccgcatcttctcgccttcctgagtgccagccgagatgtgctgcctcgaaccctgctgctgccaccccctaccttgggaccacgcgatgagcacaccgaccctgtgcaaataggaagggtgcagcaggacactcctgggaaggtcctgagcattgtgaaccagctgtaccttgagactcacagggggtggggcagagagcagactccccaggagacggaaccagaggcagcccagcgtcacgaccctgccccacgcaatcccgcacctcacggtgtgagctgggtgaagggtcctctgtctcctgaggtggatcaccccggaccagccttagcgtctctgctagaggaggaggaagaggacttagaagggaaggaggaggggagggaggatgacccagaggaggagggacccgaagacgtgctgacgattcatgtgcagagcttggtgagggcaagatctagctatgtggccagacaatacaggtccttgagagtaaggattgcatccgatagcggaggccctcacggatccggggatcccgctactgagctactgcaggatgtgagacacctgctgacagacctgcaggatcatctggcaaaggactcttacataagggctgtgtttgggtcgagagggcctggactgcctaagaaagatgaagatcccggacctgctctggaaacagccgtctgccaggctgtgcttgccccactgaagcctgcgctttggactaggctgcggaccctccgcgctccagagctgcggagacttcgcaggagacagacagcgctgcgcgctggcgctggccctccaggggctcagggcccaggaccagagggccagtcccccgctccagccctgcgcagtagaatacatgagcgcctcgcccacttacatgctgcatgcgctcccaggcgtaaagtggcgctcctcttggaggtttgccgcgacgtgtacgccggactggctcgtggcgaaaatcaggacccactgggagctgacgccttcttgcccgcattgacagaagagctaatatggtccccggacattggagacactcaactggatgtggaattcctgatggagctgctagatccagatgaactgcgaggcgaggcagggtattacctcacaacctggtttggcgcattgcatcacatagctcactaccagcctgagactgaccgtgcccctcgaggattgtcttcggaggccagagcctctctgcatcagtggcatcgccgaagaacccttcaccgcaaggatcaccccagggcccaggccaaccttccctttaaagagccctgggcggaggaaacagttacgggaaccagcgataactag

SEQ ID NO: 59316 - DNA, 1359 bp, Artificial Sequence
  Description of Artificial Sequence: Synthetic coding sequence
atgcccgatctgccccaccttctcgctttcctcagtgcaagtcgagatgtgctgccacgaacccttctattgcccccacctaccctgggcccaagggatgaacatactgaccccgtgcaaattggacgggtccagcaggatacccctggcaaggtcctctcaattgtgaatcagctgtacctggagacccatcgaggttggggacgcgaacaaacaccccaggagacggaacctgaggctgctcagcgccatgacccagcccctagaaaccccgctccacacggcgtgtcatgggtcaagggacctcttagccctgaggtggaccacccaggcccagctctggcctccttgctagaggaggaagaggaggacctggagggaaaagaagaaggaagggaggatgatcccgaagaggaaggaccagaagacgtactcacaatccacgtgcagtcactggtccgtgccagaagcagctatgttgctcggcagtatcgcagtcttcgtgtgaggattgcgagcgatagcggtgggcctcacggatctggagatccagccacagaacttttacaggatgtgcgccatttgctaaccgacttgcaggatcatctggcaaaggatagctatatccgcgcagtcttcggatcgcgcggtcccggattgccaaagaaggatgaggaccccggacccgcattagagactgctgtatgccaggctgttctggccccactaaaacccgcactgtggacacgtctgcgaaccctgcgcgctcccgaattaagacgtctacgcagacggcagacagccctgcgcgctggcgctggcccacctggtgcccagggcccaggccctgagggacagtcacctgcgcctgctttgcgatctcgcatccacgagcggctggcccaccttcacgccgcatgcgctccccgaagaaaagtagctctactgctggaggtgtgccgagatgtttatgccggtctcgctcgcggtgagaaccaggacccactgggggctgacgcttttctgcctgcccttacggaggaactgatctggtctccggatataggcgatactcagctggacgtcgagtttctcatggaactcctcgatccagacgaattgaggggcgaagctgggtactatctcaccacttggttcggcgcactgcaccatatagcccactaccagcccgagacggaccgcgcacccagaggactgtcctccgaagcaagagccagcctgcaccagtggcaccggagacgcaccttgcataggaaagaccaccctagagctcaggccaaccttccattcaaagagccctgggcagaagaaaccgttactggaactagtgacaattag

SEQ ID NO: 59317 - DNA, 1260 bp, Artificial Sequence
  Description of Artificial Sequence: Synthetic coding sequence
atggagctcaaggtgtgggtggacggcgtccagagaatcgtttgtggtgtgaccgaggtcaccacgtgccaagaagtggtaattgctttggcgcaggccattggccgaaccggcaggtacacgttgattgagaaatggcgcgacaccgagaggcaccttgcgccacatgagaaccctataatctccctcaacaagtggggccagtacgcgtctgacgtgcagttgatcctcagacggacaggacccagcctcagcgaaaggccaacctccgacagcgtggccagaatcccagagcgcactctgtatcgccagtctctacctccgctggcgaaattgcgccctcagattgacaaatccattaaaagacgagaaccaaaaagaaagagtctgacgttcacaggaggtgccaaaggcctaatggacattttcggcaagggcaaagagaccgaatttaagcagaaagtcctcaacaattgtaagactacagccgatgagctgaagaagctgattcgtctccagacagaaaaactgcagagtattgagaagcagctggaaagcaatgagattgagattaggttctgggaacagaagtacaacagtaacctcgaggaagagatcgtgaggctcgagcagaaaataaagcgaaacgatgtggaaatcgaagaagaagagttctgggaaaatgagctgcagatcgagcaggagaacgaaaagcaacttaaagatcagctgcaagagattaggcagaaaatcactgagtgcgagaataaacttaaagactacctggcccagattcgcacgatggagagcggacttgaagcagagaaactgcaaagggaagtgcaggaggcccaggtaaatgaagaagaggtcaaaggaaagattgggaaagtaaaaggagaaatcgatatacaaggtcaacagtctctccgactagaaaatggcatcaaggctgttgaaagaagtcttggacaggcaaccaagcgcttgcaggacaaggagcaagaacttgagcagctgacaaaggaactgcgtcaggtgaacctgcagcaattcatccagcagactggaactaaggtgacagtgttaccagctgagcccattgaaatcgaggcttcacacgccgacatcgaacgcgaagctccttttcaatccggttctctcaagaggcccggttccagtcggcaacttcccagtaacttacggattctgcagaaccccatctccagcgggtttaaccccgaaggaatctatgtctag

SEQ ID NO: 59318 - DNA, 1179 bp, Artificial Sequence
  Description of Artificial Sequence: Synthetic coding sequence
atggagttgaaggtttgggtggatggggtacagaggatagtgtgcggtgtgaccgaagtaactacatgtcaggaggtggtcattgccctggcccaggcaattggcagaactgggcgatacacgctaatcgaaaagtggcgcgataccgaacggcacttggcccctcatgagaatcccatcattagcctgaacaaatggggccagtacgcgtccgatgtgcaacttattctccggcgaaccgggcctagcttgtcggaacggccaacatcagactcagtcgcccgtattcccgaacgcaccctgtacaggcagagcctgccacccctggcaaaacttcgcccacagatagacaaatctattaaacggagagagcccaagcgcaaaagtctcaccttcacaggcggagctaaaggtcttatggatatcttcggaaagggaaaggagactgaattcaagcagaaggttttgaacaattgtaagacaactgcagatgagctcaaaaagcttatacgtcttcagacggaaaaacttcagagcattgaaaaacaactggagagtaatgaaatcgaaatcagattttgggaacagaaatacaatagtaacctggaggaagaaatcgtacgtctggagcagaaaataaaaagaaacgatgttgagattgaagaagaagagttttgggaaaacgagctccagattgaacaagaaaatgagaagcagttgaaagatcagttgcaggaaatacgtcagaaaataaccgagtgtgagaataagctcaaagattacctggctcaaatcaggaccatggaaagcggactcgaagccgaaaaactgcagcgcgaagtgcaagaggctcaggttaacgaggaggaagtgaaaggcaaaatcggcaaagtgaaaggtgaaatagacattcaaggacagcagtctttaaggttagaaaacggtatcaaggccgtggaaaggagcctaggccaggcgacaaaacggttgcaagataaggagcaggaacttgagcagttaactaaggagctgcggcaggtgaacttacagcagtttatacaacaaaccggcacgaaagtgacagtactgcccgcagagcctatagagatcgaggcttctcatgccgacatcgaaaggggtatcattattttatccgacaaacaggaatgcaaggactag

SEQ ID NO: 59319 - DNA, 1260 bp, Artificial Sequence
  Description of Artificial Sequence: Synthetic coding sequence
atggaattaaaggtctgggtggatggagtacaacggattgtttgtggcgtgacagaggtgaccacctgccaggaagttgtgatcgcactagcccaggctattggcagaacaggtcgctataccctcatcgagaaatggcgggatactgagcggcacctggcgccacatgagaaccctattatttctttgaacaaatggggccaatacgcgtctgatgtccagctcatcctgcgacggacagggccttctttgagcgagaggccaacttccgactccgtggccagaattcctgagagaactctttacaggcaatctctcccaccgcttgccaaactgcggccacagatagataagagcatcaaacgccgtgagcctaagcgaaagagcctgactttcaccggcggagcaaaaggcttgatggacatcttcggcaagggcaaagaaacggagtttaagcaaaaggtgttaaacaactgcaagacaactgccgatgagctgaagaaactcattagactgcagaccgagaaactgcagtctatcgaaaagcagttagagtccaacgaaatcgaaatcaggttttgggagcagaagtataactcaaacctcgaggaagaaatcgtccgtctggagcaaaaaatcaaaaggaatgatgtggaaatcgaggaggaggagttttgggaaaatgagctgcagattgaacaggagaacgaaaagcagctgaaagatcaactccaggaaattagacagaagattaccgaatgcgaaaataaacttaaagattaccttgcacagatccgtacaatggaatctggactcgaagcagagaaactccagagggaagtccaagaggcacaagtgaacgaagaggaagttaagggcaagatcggcaaagtaaaaggggaaatagatattcagggccaacagagcctgcgtttggaaaacggcatcaaagctgtggagcggtctctcgggcaggccaccaaaagactgcaggacaaggagcaggagttggagcagcttaccaaggagttacggcaggtcaatctccagcaatttatacaacagacgggcactaaggttacagtactgcccgcagaaccgatagagattgaagcctcccatgcggacattgaaagggaggcgccttttcagagcggaagccttaagagacccggaagcagtcggcaactaccctcgaatctgaggatattacagaacccaataagctccggattcaatccagaagggatatacgtgtag

SEQ ID NO: 59320 - DNA, 276 bp, Artificial Sequence
  Description of Artificial Sequence: Synthetic coding sequence
atggagctcaaagtgtgggtggacggggtgcagcgaatcgtctgcggcgtaactgaggtgaccacttgtcaggaggtggtgattgcccttgcacaggcgattgggagaactggtaggtatacattgatagagaagtggcgggacactgagaggcatctagctccccacgaaaaccccattatcagtctcaataaatggggacaatacgcatcagatgtgcagttaatactacggaggactggccctagcctatctgagcgcccaacgagcgactag

SEQ ID NO: 59321 - DNA, 90 bp, Artificial Sequence
  Description of Artificial Sequence: Synthetic coding sequence
atggagctgaaggtctgggttgacggagtccagaggattgtgtgcggtgtcacagaagttaccacctgtcaagaggtagtcatcgcttag

SEQ ID NO: 59322 - DNA, 627 bp, Artificial Sequence
  Description of Artificial Sequence: Synthetic coding sequence
atggagttgaaggtctgggtggacggcgttcagcgcatcgtgtgtggggttacggaggtaactacctgccaggaagtggtaatcgcattggcacaggctattggacggactggccgatacaccttaatcgagaagtggcgggataccgaaaggcacctcgcaccgcacgagaacccaattatctcactgaacaagtggggccaatatgccagtgatgttcagctcatcctgcgtaggaccgggccatctctcagcgaacgaccaaccagtgacagtgtggcaagaatcccagaacgcaccttgtatcggcagagcctgcccccacttgctaaactaagaccacagatcgataaatctattaagcggcgtgagcctaagcgcaagtctttaacattcacaggcggagctaagggtttgatggacatcttcgggaagggaaaggaaactgaatttaaacagaaggtactcaataactgtaaaactacagctgatgagttaaagaagttgatacggttgcagaccgagaaattgcaaagcatcgaaaaacaactcgaatccaacgagattgagatcaggttttgggagcagaagtataattcaaatctggaggaggagattgtgcgttag

SEQ ID NO: 59323 - DNA, 1260 bp, Artificial Sequence
  Description of Artificial Sequence: Synthetic coding sequence
atggagctgaaagtctgggttgacggggtgcagcggatagtctgtggggtaacagaggttacaacatgccaggaagtagttatagctctggctcaggctataggtcgaaccggcaggtatacattgatcgagaaatggcgggataccgagagacacctggctccccacgagaacccaatcattagcttgaacaagtggggccaatacgcaagcgatgtgcagctgatcctgcggaggacggggccaagcctttctgagcggccaacgtctgacagcgtggccaggatcccagagagaactttatataggcagagtctacccccattggccaagctgcggccacagatcgacaagtccattaaacgacgagagcccaagcgaaaatcactgactttcacaggcggagccaagggccttatggacatcttcggaaaaggcaaggagacggagtttaaacagaaggtacttaataattgcaaaaccactgccgacgagctaaaaaagctgatacggctgcaaacagaaaagctccagtcaatcgagaagcagctcgagagcaacgagattgagatccgattttgggaacagaaatacaactctaatctggaggaagaaattgtaaggcttgagcaaaagataaagcggaatgacgtggaaatcgaggaggaagagttttgggaaaacgagctgcagattgaacaggagaatgagaagcagttaaaggaccagctacaggagatccgacagaaaattactgagtgcgagaataaactgaaagattacctagcccaaatccgaactatggagtcaggtttagaagccgagaaacttcagcgggaggtgcaggaagcccaggtgaatgaagaggaagtgaaggggaaaatcgggaaggtgaagggcgagattgacattcagggtcaacagagtctgaggttggaaaacggaatcaaggccgttgagaggagtctcgggcaggccacaaagcgtctacaagacaaagagcaggaactcgaacaactcactaaagagctgagacaggtgaatctccaacagttcattcagcaaaccggaacgaaggtcaccgtactgcccgcagaaccaatagagattgaggcctctcacgctgacattgaacgcgaagcacctttccaaagcggctcactgaagcgccctggaagtagtaggcagctgcccagcaatctccgtattttacagaacccaatttcaagcggatttaaccccgagggtatctacgtgtag

SEQ ID NO: 59324 - DNA, 330 bp, Artificial Sequence
  Description of Artificial Sequence: Synthetic coding sequence
atggaacttaaagtgtgggtggatggcgtgcagagaatcgtgtgtggcgtgacagaggtcacaacttgccaggaggttgtcatcgcattagctcaggcaattggaagaactggcagatacacattgatagagaaatggagggacaccgaaaggcacttagcccctcacgagaaccctatcattagcctcaataaatggggacagtatgcgagtgatgtccagctgatactgcgtcgaacaggcccaagcttgtctgagcgccctacatcggactccgttgctagaatacctgaacggaccctctatagacaaagcctgcctctctcatag

SEQ ID NO: 59325 - DNA, 660 bp, Artificial Sequence
  Description of Artificial Sequence: Synthetic coding sequence
atggagctgaaggtatgggtcgatggcgtgcaaaggatcgtgtgcggcgtaactgaggttaccacctgtcaggaagtggtcatcgccctggcacaggccatcggacgcactggaagatatacgctgatcgaaaagtggagagacacggagaggcacctcgcaccgcatgaaaaccccatcattagcctgaataaatggggccagtatgcatctgacgtccagctaattctccggcgaaccggaccatctctgagtgaacgccctaccagcgattccgtggctagaatccctgaacgaacgctgtatcgccaatcactgccccctctggccaagctgaggccacagatcgacaaatccatcaaaagaagagagcccaagcgaaagagcctgacctttaccggaggcgctaaaggcctgatggacatatttgggaagggaaaagagacggagttcaaacagaaagtgctgaataactgcaaaaccacagccgacgagcttaagaagttaatcaggctccagactgagaaactgcagtcgatcgagaagcaacttgagtccaatgaaattgagataagattctgggaacagaagtataactcaaacctggaggaagagatcgtgcgacttgagcaaaaaatcaagagaaatgacgtagaatag

SEQ ID NO: 59326 - DNA, 369 bp, Artificial Sequence
  Description of Artificial Sequence: Synthetic coding sequence
atggaactgaaagtttgggtggatggcgtgcagcgcatcgtctgcggcgttaccgaagttacgacctgccaggaggtggtcattgccctggcccaagccattgggagaacaggaaggtatacccttatcgagaagtggcgagataccgaaaggcacctggcccctcacgaaaaccctattattagcctgaacaaatggggtcaatatgcttcagatgtgcagctgatactgcggaggacgggaccctctctgagcgagcgcccaacctcagatagcgtagccagaattccagagaggactctgtataggcaatctctgcccccactagccaaactaaggccccagattgataagtcaatcaaacgttag

SEQ ID NO: 59327 - DNA, 1260 bp, Artificial Sequence
  Description of Artificial Sequence: Synthetic coding sequence
atggaactgaaagtttgggtggatggtgtccaacgcattgtctgtggtgttacggaagtgaccacctgccaggaggttgtgattgcattggcccaggccatcggacgaaccggccgttacactctgattgagaagtggagggataccgagcggcatttggcaccccatgagaatccaatcatttcattaaacaaatgggggcagtacgccagcgacgtgcaacttatactgaggaggactggcccaagtctctcagaacgcccaacatctgactctgtagccaggattcccgaaagaacgctttatagacaatcacttccgccactggcaaagcttagaccacagattgataagagcattaagcgcagggaaccaaaaaggaagagtctgacctttacaggaggagcaaagggcctcatggacatatttggcaagggcaaggagaccgaattcaagcagaaagtgctgaacaactgcaagactaccgctgacgaactgaagaagttaatcaggcttcaaaccgagaagctgcagagtatcgaaaagcagctggaaagcaacgagattgagattcggttttgggaacagaagtataacagtaatttagaggaagagattgttagattggagcagaaaatcaaaaggaacgacgtcgaaatcgaggaggaagaattttgggagaacgagctacagattgagcaggagaatgaaaagcagctgaaggaccagctccaggagatccggcaaaaaattaccgaatgcgagaataagttaaaagattatcttgcccagatccgcacgatggaatccgggttagaggccgagaagttacaaagagaggttcaggaggcccaagtcaatgaggaggaggtgaaggggaagatcggaaaagtcaagggagaaattgatatccagggtcaacagtcactgcgactggaaaatggcattaaagctgtcgagcgttctctgggccaggccaccaagaggttgcaggacaaggaacaagagctggagcagctcaccaaggagttgaggcaggtgaatctgcaacagtttatccagcagactggaaccaaagtgacagttctcccggctgaacctatagagatcgaggcaagtcacgcagacatcgaaagggaagcaccgttccaatctggctctctaaaacggcctggctcttctagacagctcccatccaatttgagaattttgcagaatccgatctcgtctggattcaatcccgaagggatttatgtatag

SEQ ID NO: 59328 - DNA, 480 bp, Artificial Sequence
  Description of Artificial Sequence: Synthetic coding sequence
atggaattgaaagtctgggtggatggagttcagaggatcgtctgcggtgttactgaggtcaccacgtgccaagaagtcgtgattgccttggcccaggctataggccgaacaggcagatatactctcatcgaaaaatggcgcgacacagagcgtcatctggccccacatgaaaacccaattatctccctcaacaagtggggccagtatgcttcggatgtccagctgatcctccgcagaaccggtccatccctttctgaaagacctacgtcagactcggtagcccgtatccctgaaagaaccctgtaccggcagagcttaccaccactggccaagctgcgcccacagattgataagtctataaaacggagagagccaaagcggaagtctctgacttttactggaggggcaaagggcctgatggacatatttggtaaggggaaagagaccgagttcaagcagaaggtgttgaataactgctag

SEQ ID NO: 59329 - DNA, 2412 bp, Artificial Sequence
  Description of Artificial Sequence: Synthetic coding sequence
atggccaagcgatcttctctgtacattcgtattgtcgaagggaaaaacctcccagcaaaggacataactggctcatcagatccatactgcattgtgaaggttgacaacgagccaatcattcggacggcgaccgtgtggaagacgctgtgccccttctggggtgaggagtatcaagtgcatcttccccctacctttcatgccgtcgccttttatgtgatggatgaagatgctctaagtagggatgacgtcatcggtaaagtttgcctgacccgggatacaatagcctcccaccctaaaggcttctccggctgggcccacctgacagaggtggatccggacgaagaggtgcagggcgagatccacttgcggttggaggtttggccgggtgcacgcgcttgtcgtctcaggtgctctgtgcttgaggctcgcgacctggctcctaaagaccgaaacggcaccagtgatcctttcgtgcgcgtccggtataaagggaggacaagggaaacttctatagtgaagaagtcgtgttatccccgttggaatgagaccttcgagtttgaactccaagagggagcaatggaagcgttatgtgtggaggcctgggattgggacctggtaagtcgcaacgactttcttgggaaagtggttattgacgtgcagagactgagggtcgtgcagcaggaagaggggtggtttcggttacaacccgaccaatcgaagtcccggaggcacgatgaggggaatctggggtccctgcagctggaagtgcgccttcgcgatgaaacagtcctcccctccagttattatcagcccctagtgcatttactttgccatgaggtcaaattaggaatgcagggtcctgggcagctgataccactgatcgaggaaactacctccacggagtgccgccaggacgttgccacaaacttgctgaagctgtttctcggtcagggactggccaaagattttctcgacctgctgttccaactcgagctgtcccggacctccgaaaccaacactttgtttcgctcgaactcattggcctctaaatctgttgaatccttcctgaaggtggctggcatgcagtatctgcacggagtactgggcccaattattaacaaagtgtttgaagagaaaaaatatgtggaattggacccaagcaaagtcgaggttaaggacgtgggctgctccggactgcatcgtcctcaaaccgaggcagaggtgctggaacaatctgcccagacattgcgagcccacctaggcgctcttctgtctgcactgtcaaggtctgtgcgagcatgccccgctgtggtgcgggcaacgtttcgacagttgtttcggagagtgagagagcggttcccaggagctcagcacgaaaacgtgccctttatcgctgttacttccttcctgtgccttagattcttttcgccggcaatcatgagccctaaactgttccacttacgcgaacgacacgccgacgctcgaacctctcgaaccctgctgttactcgctaaggctgtacaaaatgtaggcaacatggacacacccgctagccgagccaaggaagcttggatggagcctctgcagcctactgtgcaccagggagtcgctcagcttaaggactttattaccaagcttgtggacatcgaagagaaggatgaactcgacctacagagaaccttgtcactgcaagcccctcccgtaaaagagggcccactcttcattcacaggaccaagggaaaaggcccactgatgtccagctcattcaaaaagttatatttctccctgactactgaggcactctcgtttgcgaagacaccctctagtaaaaaaagcgccctgattaaactggccaacattagagcggcagaaaaagtagaagaaaagtcattcggtggctcccatgttatgcaggtcatctataccgacgatgccggaagaccccaaaccgcatacttgcagtgcaagtgcgtgaacgaactgaaccaatggctgtcggcgttgcgaaaagtgagcatcaacaacacagggctgttgggctcataccacccaggtgtgtttcgcggagataagtggtcttgttgccatcaaaaggaaaaaactggccagggctgcgacaaaacccgatccagggttaccctgcaggaatggaatgatccgctggaccatgatcttgaggcacagctgatctacaggcatctcctaggggttgaggctatgctttgggaacgccatagagagttatctggtggcgctgaagcaggcactgttcctacatccccaggaaaggttcctgaggatagcctagccaggctgcttagggtccttcaggatctgagggaggcccactcttctagcccagcgggaagtccaccgagcgagccgaactgtctgctcgagttgcagacctag

SEQ ID NO: 59330 - DNA, 2274 bp, Artificial Sequence
  Description of Artificial Sequence: Synthetic coding sequence
atggcaaagcgctcctcactgtatattcgaatcgtggagggcaagaacctccctgccaaagacatcacgggatccagtgatccatattgcatcgtcaaggtggacaatgaacctattattaggacggctaccgtttggaagaccctgtgtcccttttggggcgaagaatatcaggtgcacttgccacctaccttccatgccgtagccttctacgtgatggacgaagacgctttatctcgggatgatgtgatcggaaaggtgtgcctcacccgcgataccatcgccagtcatccgaaggggtttagcggctgggcgcacttaacggaagtggatccggacgaggaggttcagggggaaatccaccttagacttgaagtgtggcccggagccagggcttgcaggctcaggtgtagcgtgctcgaggctagggacctcgcaccaaaggaccggaatggcaccagtgaccccttcgtgcgggttcggtataaggggcgtacgagggagacttctattgtcaagaaatcatgctaccctcgttggaacgaaactttcgaatttgaactccaggagggagctatggaggcgttatgcgtggaagcctgggattgggacttagtgagcagaaacgactttttggggaaagtggtcatcgatgtgcagcgtctgcgcgtggtgcaacaggaagagggttggtttcggctgcaaccagatcaaagtaaaagccgccgacacgatgaagggaacttgggttccctacagctcgaggtgcggcttagggacgagacggtactgccaagctcttattaccagcccctcgtccatcttctgtgccacgaagtgaagctgggcatgcaaggccctggccagctgatcccattgatcgaggaaactacatccacagaatgccggcaggacgtagccaccaatcttctgaaactgttcctcggccagggattggctaaagacttcctcgaccttctgttccagcttgagctaagcagaacttcagagactaatacactcttccgatcaaactctctggcgtcaaagagtgtagaatcttttttgaaagtggccggaatgcagtatctgcatggagttctaggacccattatcaacaaggtcttcgaagagaaaaagtatgtcgaactcgatccctctaaggtggaggtgaaggatgtcgggtgttctgggttacaccgccctcagactgaggccgaggtgctggaacagagcgcccagactcttcgggctcatctcggtgccttactttcagccctgtcccggtctgtccgggcttgtcctgctgtcgtgagggccacttttagacagttgttccgcagagtgcgtgaacgtttccctggcgctcagcatgagaacgttcccttcatcgcagtgaccagcttcctgtgcttaaggttcttttccccagcaatcatgagtcccaagttattccatctgagagagcggcatgctgacgctcggacatctagaaccttgttgctactagcgaaggccgtccagaatgtgggaaacatggacaccccagcctctcgcgctaaggaggcttggatggaacctcttcagccgacagtccatcagggggtggcccagttgaaggattttattaccaagctggtggacattgaagagaaggacgagctggacctccagaggaccctgtctctgcaggcgccacccgttaaggagggtcctctgttcattcatcgtactaagggaaaaggacctctgatgagttctagttttaaaaagctctatttctctctgacaacagaagccctcagttttgccaagacccccagtagtaagtgtgttaatgagctgaatcagtggctctctgcactcaggaaagtctcgatcaacaatactgggctgctgggttcgtatcatcccggagtttttcggggtgacaaatggtcttgctgccatcagaaggagaagaccggccaaggatgtgataagactcgcagtagggtcaccttgcaggagtggaacgatccattagaccatgacctggaggcacagctaatctacaggcatctccttggcgtggaagctatgttgtgggaacgacaccgggagctctccggaggcgctgaggcgggtaccgtccctacttctcctggcaaagtgccggaggattctttagctcgtctgctgagagtgctgcaagaccttagggaggcgcacagttccagcccggctggaagcccgccttctgaacctaactgcctgctggaactgcagacctag

SEQ ID NO: 59331 - DNA, 3774 bp, Artificial Sequence
  Description of Artificial Sequence: Synthetic coding sequence
atgcagaagggcatcagactaaacgacggtcatgttgcctccctgggacttctggccaggaaggatggcacacgtaaaggctacctcagcaagaggagcagcgataacaccaagtggcaaacaaagtggtttgcactcctccaaaatttgctgttttacttcgagtccgactcctctagtcggccttctggactgtaccttctggagggctgtgtgtgcgaccgcgctccatctccgaagccggcactttccgccaaggagccactcgagaagcagcactatttcacagtgaattttagccacgaaaatcagaaagctctcgaacttaggaccgaggacgccaaagattgcgacgaatgggttgcggctatcgcacatgcttcctaccgtaccctggcaactgagcacgaggcgctgatgcagaagtatcttcacctcctgcagattgtggagactgaaaagacagtggctaagcagctcagacaacagatagaagatggggagatcgagattgagcgactgaaagcggagatcacatcattactgaaagacaacgagaggattcagtccacacagaccgttgctccaaatgatgaggattcagacattaaaaagatcaagaaggttcagtcctttctgcgcggatggctgtgcagaagaaagtggaagaccatcatacaggattacattaggtccccacacgctgactcgatgcgaaagcggaatcaggtagttttctcaatgttggaggccgaagccgagtacgtgcaacaactccacattttagtgaacaactttctgagacccttgcggatggccgctagttcaaaaaagcctcccattacccacgacgatgttagttcaatcttcctgaactccgaaaccatcatgtttctacaccagatcttttatcagggactaaaagccagaatttctagttggcccacccttgtgctcgccgatctgtttgatatccttctccctatgctgaatatctatcaggagtttgttcgcaaccatcagtactctctacagattttagcccattgcaagcagaaccgggacttcgacaagctgctgaagcattatgaagcgaagccagattgcgaggaaagaacactcgaaactttcctgacttatccaatgttccagattcctcgctacatcctgacccttcacgagctactggcgcacacacctcacgagcacgttgagcggaattcgctcgactatgccaagtccaaactcgaggaactgtcacgaatcatgcatgacgaggtgtcagagacagaaaatatacggaagaatctggccatcgaaaggatgattattgagggctgtgaaatccttcttgatacatctcaaacatttgtaaggcaagggtcgctgatccaagtacccatgagcgagaagggcaaaattacgcggggtcgcttaggcagtctgagtttgaaaaaagagggcgagcgccaatgcttcctgttttctaaacacctgattatttgcactagggggtccggcggaaaactgcacctgactaagaatggcgtgatcagcttgatcgattgtaccttgttggaagagcccgagtcgaccgaggaagaggcgaaaggctctgggcaggacatcgatcatctggacttcaagatcggggttgagcctaaggacagccccccttttacggtgatacttgtcgcaagctccagacaggagaaggctgcttggacctcagacatttcacaatgcgtggataacatccgttgtaacggcctgatgatgaatgccttcgaggaaaattcgaaggtgactgtcccccaaatgatcaagtcagacgcctccctgtattgtgatgacgtggacataaggttttctaagactatgaacagttgcaaagtccttcagatcagatacgcttccgtagagagactactagaaagactgactgatttgaggtttctctctattgacttcctgaatacgttcttgcattcatatcgggtcttcaccaccgcaatcgtggtgctagataaactcataactatttataagaaacccattagcgccatacctgctcggtccctggaattgctgttcgctagtgggcagaacaataaattgttgtacggagaaccacccaaaagtccccgagccacacgcaaattcagctctcctcctcccctgagtataaccaagacctcatccccctccagacggagaaagctctctttgaacatccctataatcactggaggaaaagctctggatttagctgcgctcagctgtaattccaatggctacacctccatgtactctgccatgtcaccattttcaaaggcaaccctcgatacctcaaaattgtatgtgtcctcttcattcactaacaagatccccgatgagggggacacaacacctgaaaagccagaggatcccagtgctctgagcaaacagtctagcgaagttagtatgagggaggaaagtgatatcgaccagaatcaatccgatgacggagatacagagacatcacccacgaaatcacctacgactcccaaatctgttaagaacaaaaactcctctgagttcccactcttttcttacaacaacggggtggtgatgaccagttgccgggagctggacaataataggagtgcattgtcagctgccagcgcctttgctattgctaccgccggagctaacgaagggacccccaacaaagagaagtacagacgcatgtccctggccagcgccggatttccccctgaccagcgcaacggcgacaaagaattcgtcatcaggcgggctgcaacaaacagggtcctgaatgtgttgcggcattgggtctcgaagcacagccaggacttcgagaccaatgacgagctgaagtgcaaggtgatcggcttcctagaggaggtgatgcatgatcctgaactgttaacgcaggagcgtaaagctgcagctaatatcatcaggacattgactcaagaagatcctggagataatcaaattactttagaggagataacacagatggccgagggcgtgaaagcggaaccttttgagaatcactcggcacttgaaatagccgagcaattgacactcctcgatcatctcgtctttaaaaagatcccatatgaggagttttttggacaaggatggatgaaactagagaaaaatgaacgcaccccttacatcatgaaaaccactaaacacttcaatgatattagcaacctgattgcatcggagatcattaggaacgaggatataaacgcacgtgtgtccgccatcgaaaaatgggtcgccgtcgccgatatttgccgttgtctgcacaactataacgcagttttggagatcacttcatcaatgaatcggagcgccattttccgacttaagaagacctggctaaaggtatcaaagcagacaaaggccctgatcgacaagctgcagaaactggtttcctctgagggaagatttaagaatctgcgagaggctctgaagaattgcgatcccccatgcgtgccttatctcggtatgtatctgactgatttggccttcatcgaagaaggcactcccaattacacagaggatggattggtcaactttagtaagatgagaatgatatctcacataatcagagagatacggcagttccagcagacggcctataagatcgagcatcaggctaaagttacccaataccttctcgaccagtcatttgtgatggatgaagagagtctatacgagtcatccttgcggatcgagccaaagttgccgacatag

SEQ ID NO: 59332 - DNA, 1470 bp, Artificial Sequence
  Description of Artificial Sequence: Synthetic coding sequence
atgtacagcgctatgtcccccttctccaaagctaccctggacacgtccaaactctacgtcagctctagcttcaccaacaaaatccctgacgaaggcgatacaacacccgagaaaccggaggatccatcggcgttgtcaaaacagagttctgaggtttccatgagagaggaaagcgatatcgaccaaaaccaatctgacgacggcgacactgagacctcccccaccaagtctcctactacccctaaatccgtgaagaataaaaatagttcagagttccccctgttttcatacaacaacggggtggtgatgacctcgtgtcgggagttagataataaccgtagcgccctgtcggcagcctctgcattcgccattgccactgccggtgcgaatgaggggaccccgaataaagagaagtatagacggatgtctctggcctccgctgggtttccacctgaccagcgcaatggggataaggagttcgtaatcagaagggccgcaacaaatagagtcctgaatgtccttcggcattgggtgagtaagcatagccaagactttgagaccaatgatgaactgaaatgcaaggttattggatttctggaggaggtgatgcatgaccccgagcttctgacccaagagcgcaaagccgcagctaatattatccggactctcactcaagaggatcctggagacaatcagatcaccctcgaggagattactcagatggcagagggggtgaaggctgagcctttcgagaatcacagtgccctggagatcgcagagcaactgaccttgcttgaccacctggtattcaaaaagatcccttatgaggaattcttcggccagggctggatgaaactcgaaaagaatgagaggacaccgtacataatgaaaactaccaaacactttaatgacataagcaacttaatcgcatccgaaataattaggaatgaggacataaacgcccgtgtgagcgctatcgaaaagtgggttgccgttgcagacatctgccgctgtctgcacaattacaatgcagtcctggagatcacgtcgtcgatgaataggagtgctatatttcgcctgaagaaaacgtggctcaaggtgtcaaaacagaccaaagctctaattgataagcttcagaagttagtttcctcagagggacgtttcaagaacttgagagaagctcttaagaactgtgatcccccatgtgtcccctacctggggatgtacctcacggacctcgcattcatcgaagagggcactcccaactatacagaggatggcctggttaacttcagcaagatgcggatgatctctcacattatcagagaaatccgccagttccaacagactgcatacaagatcgagcatcaggctaaagtgacacagtacctgctggaccaatcttttgtaatggacgaagagtctctgtatgaaagtagcttgcggattgaaccgaagcttcccacgtag

SEQ ID NO: 59333 - DNA, 3822 bp, Artificial Sequence
  Description of Artificial Sequence: Synthetic coding sequence
atgcagaaagggatcaggttgaacgatggccacgttgccagccttggtcttctggcgcgtaaggacggcacgcgtaagggctacctgtccaagaggtcctccgacaacaccaaatggcaaacaaaatggtttgccctgttgcagaatctactgttctactttgaaagcgacagttcctcacgtccgtccggtttgtatctccttgaaggatgcgtgtgcgaccgggctcccagccccaagcccgcactctctgccaaagaaccgctggagaagcaacactatttcactgtcaactttagtcatgaaaatcaaaaggccctcgaactgcggacagaggacgctaaggattgtgatgagtgggtagccgcaatcgcccacgcaagttataggacattagccacggaacacgaggccctcatgcagaaatatctccacctactgcagatcgtagagaccgagaaaaccgtcgccaaacagcttaggcagcaaatagaggacggagagattgaaatcgagcgcctgaaagctgagataacatcactgctgaaggataatgaaaggatccagtccacgcagacagttgcaccaaacgacgaagacagcgacattaaaaagattaaaaaagtgcagtccttccttcgtggctggctctgccgcagaaaatggaagacaatcattcaggactatatacggagtccccacgctgatagtatgcgcaaacgcaaccaagttgtgttttccatgctggaagcagaggcagaatatgtgcagcaactgcatatactggtgaataactttctgcgccctctgcgcatggctgcgtctagtaaaaagcctcccatcacccatgatgacgtgagtagtattttccttaactccgagaccattatgtttctgcatcagatcttttatcaagggctcaaggcccgaatttctagttggcctactttggtcctggctgatttgtttgacatcctgcttcctatgttgaatatttaccaggaattcgttcgaaatcatcaatactccctgcaaattctagcccactgcaaacagaacagggatttcgataagctgctgaaacattatgaagcgaagcctgattgtgaagagagaacattggagactttcctaacttatcccatgttccagatccccaggtatattctgacgctgcatgagttattagcccatactccacatgagcatgtggagcgcaatagtctggactacgcaaagagcaagctggaggagctgagccggattatgcacgatgaagtgtcagagaccgagaacatcagaaagaatcttgctattgagcgcatgatcattgaaggctgtgagatactgcttgatacctcacagacattcgttcggcaaggatcactcatacaggtgcccatgagtgagaagggaaagattactcggggaagattaggcagtctgtcgctaaaaaaggaaggggagcgccagtgcttcctcttttccaagcacctgataatttgcacccgtgggagcggcggaaaacttcatctcactaagaacggagtgatttccctgattgactgtacgctgcttgaagagccagagtctactgaagaggaggctaaaggctctggccaggacatcgaccatttggattttaaaattggagtggagcccaaggatagccctcccttcactgtcatcctcgtagcaagctctcgtcaggaaaaggccgcatggacatccgatatctcccagtgcgtggacaatatccgctgcaacgggctcatgatgaatgcgtttgaggagaactccaaagtcaccgtcccccagatgatcaaaaggacccgagaaggcaccagggaggccgaaatgtctagaagtgacgcctccctctactgtgatgatgtcgacatccgattctcgaagacaatgaactcctgcaaggtactccaaatcaggtacgccagcgtagagaggctccttgagaggctgactgacctcaggtttttgtccatcgattttctgaacaccttcctccattcatatcgggtgttcacgacagccatcgttgtcctcgataaactaattacaatttataagaagccaattagcgctatccctgcaagatggctgcggagcttagagttgctgtttgctagcggacagaataataaactgctgtacggcgaaccccctaagagccccagggccacacgaaagttctcttcaccaccaccgctctcaattacaaagacctcttctccctcaaggcggaggaaactcagcctcaacattcctatcattactgggggaaaagccctcgacctggcagcactgtcctgtaactcaaacggctacaccagtatgtatagcgccatgagtccattttcaaaggctacactggacacatccaaactctacgtaagtagctcctttacaaacaagattccagacgaaggcgatactaccccagagaagcctgaagacccttctgcattaagcaaacagtcttctgaagtctctatgagagaagaatcagacattgaccagaatcagtccgatgacggggacaccgagacatcccccacgaaaagccctaccactccaaaaagtgtcaagaacaaaaattccagcgagttccctctcttttcatataataacggagtagtcatgaccagttgcagagagctggataataataggagtgctctgagtgcagcttctgctttcgctattgcgactgctggcgcaaacgagggcactcctaacaaggagaaatatcggcgtatgagtcttgccagcgcagggttccctccagatcagaggaatggagataaagagttcgtgatccggcgagcggcaaccaaccgtgtcctgaatgtactgcggcactgggtttcaaagcatagccaggatttcgaaactaacgatgagctgaaatgtaaggtgatcggttttctcgaagaagtcatgcatgatcctgaacttctgacccaggagcgcaaagcggcagccaacatcatccgcacattgacccaggaagatcccggtgacaaccagattacactcgaggagatcactcagatggccgaaggggtcaaggccgaaccttttgaaaaccactcggccctggagatcgcagaacagctaaccctcctcgatcatctcgtctttaaaaagattccctatgaagagttctttggacagggctggatgaaattagagaagaatgagagaactccatacatcatgaagacaactaagcactttaatgatatttccaatctgatcgcttccgaaattatccgtaatgaagatatcaacgcacgagtgtctgcgattgaaaaatgggtggccgtggctgacatctgtcggtgtctccacaattataacgcggttctggaaatcacatccagcatgaaccggtcggctatcttcaggctgaagaaaacttggctgaaggtcagcaagcaaacaaaggccctcatcgacaaactgcagaaactggtgagcagcgaagggcgattcaagaatctgcgggaagcattgaagaactgtgatcccccatgcgtgccctatctcgggatgtatctcaccgaccttgctttcattgaagagggcacccctaattataccgaagatggcctggtgaactttagcaaaatgcggatgatttctcacatcataagagagattaggcagttccagcagaccgcatataagattgagcaccaggccaaggtaacccagtacctcctggaccaatcctttgtcatggatgaggagagtctgtacgagtctagccttcggatagagcccaaactgcccacctag

SEQ ID NO: 59334 - DNA, 3783 bp, Artificial Sequence
  Description of Artificial Sequence: Synthetic coding sequence
atgcaaaaagggatccgcctgaatgatggccatgtggcaagcctaggactgctcgcacggaaggacggcactagaaaggggtaccttagcaagcgcagctccgataatactaaatggcagactaagtggtttgcgcttctccagaacctgcttttctacttcgagagtgattcctctagcagaccttcaggcctttatttgttggagggatgcgtatgtgaccgggcacctagccctaagccagccctgtccgcaaaggaaccattggagaaacagcactactttaccgtgaacttcagtcacgaaaaccagaaagccctggaattacgaacagaggacgccaaggactgcgacgaatgggtggcagccattgcccatgcaagttacaggactttggccactgagcacgaagcgttgatgcagaaatatcttcacttgctgcagatcgtcgaaaccgagaaaaccgtagcaaagcagctgcgccagcagatcgaggacggtgaaattgagatagagaggttaaaggccgagattacttcgctccttaaagataacgaaaggattcagtcaacacagacagtcgcaccgaatgacgaagattctgacatcaaaaagataaaaaaggtgcagtctttcctcagggggtggctgtgcagacgtaaatggaagacaatcatacaggactacatcaggtctccacatgccgactccatgaggaagagaaaccaggtggtgtttagcatgcttgaagccgaggccgaatatgttcagcaactgcacatcctcgttaataattttctccgacccttgcggatggctgcctccagcaaaaagcctcctattacccacgacgatgtctcctccatttttttgaacagcgaaactatcatgttcttgcaccagattttttaccagggcctcaaagctaggataagcagctggccgacactcgtgttagctgatctgttcgacattctgctccctatgcttaatatttaccaagaattcgtaaggaaccatcagtactctttacagatcttggcgcactgtaagcagaaccgtgatttcgacaagttactcaagcactatgaggctaaaccggattgcgaagaacgaacgctggaaacgttcctgacttaccccatgtttcagattcccaggtacatcctgaccctgcatgagcttctcgcccatactccacatgaacacgtcgagcgcaactccttggactatgctaagtccaagttggaagaactcagcagaataatgcatgatgaggtcagcgaaaccgaaaatattcggaagaatctggccattgaacgcatgataattgaagggtgtgagattcttcttgacactagtcagacgttcgtgagacaggggagcctgatacaggtgcctatgagcgagaagggcaagattacccgcggacggcttggatctctcagtcttaagaaagagggggaacgccagtgttttctgttttcaaaacatctgattatctgcactcgaggatccggtggcaagctgcacctcacaaagaacggcgtgatttccttaattgattgtactttactcgaggaaccagagtcgacagaagaagaggccaagggatccggccaggacatcgaccatctggatttcaaaatcggggttgagccaaaagactcaccacccttcacggttatactagttgcgtcttctcggcaggaaaaggcagcctggacctcggacattagtcaatgcgtggataacattcggtgtaatggcttgatgatgaacgcctttgaagagaactccaaagtaacagttccccagatgatcaagtccgacgcatctctgtactgtgacgatgtggatatccgcttctctaaaacaatgaatagctgtaaggtgctccagattaggtacgcctcagttgagaggctgcttgagaggctgactgacttgagatttctgtcaatcgacttcttgaacacatttctgcactcttaccgggtatttacgaccgcaatcgtggtgcttgataaactcattacaatatacaaaaaacccataagtgccatcccggcaaggtggctgcggtcactggagctattgttcgcttcgggccaaaataataagcttctctacggagaaccccctaaatccccacgtgcaacacggaagttcagctcccccccaccattgagcatcacaaaaacttcctcaccttccaggagacggaagcttagcctgaacatccccattatcactggcggaaaggcgctcgacttagcagcgctgtcctgtaatagcaacggatatacctctatgtattccgccatgtcacccttcagtaaggcaactctggacacctctaagctgtatgtgtcttcatcttttacgaataagatcccagatgagggggatacgacacctgagaagcccgaggacccgagtgccctctctaaacagagtagcgaagtaagcatgcgcgaggagtcagatatcgatcaaaaccagtcagacgacggcgacacagaaaccagccctactaaaagcccaacaacacccaaaagcgtgaaaaataagaactcctccgaatttccactcttctcttacaacaatggagtcgtgatgacaagttgcagggagctggacaacaatcgcagtgcactctccgctgcatcagccttcgctattgccactgcaggcgctaacgagggtacccccaacaaggaaaagtaccgtaggatgtctttggcttctgcaggctttccacccgaccagaggaacggcgacaaagagtttgtgattcgacgagcagccacaaatcgcgttctgaacgtgctacggcactgggtgtcaaagcactcccaggatttcgagaccaacgacgagctgaagtgtaaggtgattggttttttggaagaggttatgcatgaccccgaacttcttacacaggaacgaaaagccgcagctaacatcatacggaccctgacccaggaagatccaggggataatcagattactctggaagagatcacacagatggccgagggcgtgaaggctgaacccttcgaaaatcacagtgcactcgagatcgctgagcagctcacacttctagaccaccttgtgtttaagaagatcccttacgaggaattctttggacaaggctggatgaaacttgagaaaaatgagcgtaccccatatatcatgaaaactactaaacattttaatgacatctctaatcttatcgcaagcgagatcatccgcaatgaggacattaacgcccgtgtgagtgccatcgagaaatgggtcgctgttgctgatatctgccgatgtttgcataattacaacgccgtccttgaaattactagttcgatgaaccggtctgctatattccgcctcaagaagacatggttaaaggtgagcaagcagacaaaggcgttgatcgacaaattacaaaaactggtgtctagcgaggggaggtttaagaacttgcgagaggctttgaagaactgcgatcctccatgtgttccatatttgggaatgtatcttaccgacctggctttcatcgaagaaggaacccctaattacacagaggatggtctggtcaacttctcaaaaatgcggatgatcagtcatattattcgtgaaatcagacagttccagcagacggcatataagatcgaacatcaggccaaggtcacacaatatctgctggaccaaagttttgtgatggatgaggagagtttatatgagagcagtctcagaattgagcccaagttacccacatag

SEQ ID NO: 59335 - DNA, 1470 bp, Artificial Sequence
  Description of Artificial Sequence: Synthetic coding sequence
atgtttctggagcctcaggaaacaatgccccagacttccgtagtgttctccagtatactagggccatcctgttctggacaggtgcaaccgggaatgggagagagaggtggtggagcaggaggcggtagtggcgatctcatctttcaagacgggcatctgatctccggaagcttggaggcattgatggagcatctggtgcccacagtggactactaccccgaccggacatatatttttacctttctgctcagctctcgagtgtttatgcctccacatgatctcttagcgcgagtcggacagatttgtgtcgagcagaaacaacagctcgaagccggacccgagaaagccaaactgaagtcctttagtgccaaaatcgtgcaacttctgaaggaatggaccgaagcctttccttatgactttcaggatgagaaggccatggcagagctgaaggcaattacccatcgcgtgacacagtgcgacgaggagaatggcaccgtcaaaaaggctattgcccagatgacacagtcccttctgctttctctcgcagccaggtcccagctgcaggagctccgcgaaaaacttagaccccctgccgtcgataagggcccaattcttaagacaaagcccccagctgcccaaaaagatatcttaggggtttgctgtgatccactcgtgctggcccaacaactgacccacatcgaactggatagagtgtcctcaatttacccagaagacttaatgcaaatcgtctctcacatggactcgctggacaaccatcgctgtcgcggagatttaaccaaaacctattctctggaggcttatgataattggttcaattgtcttagtatgctcgttgcaactgaggtttgtcgcgttgtgaaaaagaagcacagaacgcggatgctcgagtttttcatcgatgtggctcgcgaatgcttcaatattggcaactttaacagtatgatggcaatcatttcagggatgaatctgtcccccgtggcaagattgaaaaaaacctggagtaaggttaaaacagcaaagttcgatgtcctcgaacatcacatggaccctagcagcaatttctgtaattacaggaccgcactgcaaggcgcaacgcaacggtcccagatggccaatagtagtcgtgagaaaatcgttattcccgtgttcaatctgttcgtgaaagacatttacttcttgcacaaaatccacaccaatcatttgcccaatgggcacatcaacttcaagaaattctgggaaattagtaggcagattcacgagtttatgacctggacacaggtggaatgcccgttcgaaaaagacaaaaagatacagtcatatcttctaaccgctcctatctacagcgaagaggccctctttgtggccagttttgagtctgagggtccagaaaatcacatggagaaggactcttggaaaaccctccgcaccactctactcaatagggcctag

SEQ ID NO: 59336 - DNA, 1446 bp, Artificial Sequence
  Description of Artificial Sequence: Synthetic coding sequence
atgccccagacaagcgtggttttctccagcatcctaggaccaagttgttcagggcaagtccagcctggaatgggcgagcgcggagggggtgctggaggcggtagtggcgatttgatcttccaggatgggcatctaatctcaggtagcctggaagcattaatggagcatctcgtgccaaccgtggactactatccagatcgaacatatatcttcaccttcttgctgagctcccgagtgttcatgcccccacacgacttactcgccagagttgggcagatttgcgtcgagcagaagcagcaactggaggccggacccgaaaaggctaaactcaagtcttttagcgccaaaatagtgcagctgctgaaggagtggaccgaggcattcccctacgacttccaggacgagaaggcaatggctgagttgaaggctataacacatagggttacgcagtgtgatgaggaaaatggtaccgtcaagaaagctatcgctcagatgacgcagtcactacttttgagcctcgccgctcgttctcagctccaggagctgcgcgaaaaactgcggccacctgcagtcgacaagggtcccatcttgaagaccaaaccacctgccgctcagaaagacatcttgggggtgtgctgcgatccactggtgctggcccagcagctgacacatatcgaattagatagggtcagcagtatatatcctgaggacctaatgcaaatcgtttctcacatggactccctggataaccaccggtgtcgtggcgacctcacgaagacatacagcctggaagcctacgataattggtttaattgcctgtcaatgcttgtggccaccgaagtttgccgagtagttaagaaaaagcataggacgcgcatgctggagttttttatcgatgtagctagggagtgtttcaacataggaaatttcaattcaatgatggcaataatatccgggatgaatctcagtcctgtggccagattaaaaaagacttggtcaaaagtaaaaactgcgaagtttgatgtcctggaacaccacatggacccaagctcaaatttctgtaattatagaacagccttacaaggcgcaactcagcgcagccagatggcaaacagtagtcgcgagaaaattgtgatccccgtgtttaacttgttcgtaaaggatatttactttctgcacaaaattcatactaaccacctcccgaatggccacatcaattttaagaagttttgggaaatttctaggcagattcatgagtttatgacttggacgcaggtagaatgccccttcgagaaggataaaaaaatacagtcctaccttctgactgccccaatttacagcgaggaggctctcttcgtcgccagttttgagtccgagggaccagagaaccacatggagaaagattcttggaagaccctcaggacaacgttgctgaaccgcgcatag

SEQ ID NO: 59337 - DNA, 1446 bp, Artificial Sequence
  Description of Artificial Sequence: Synthetic coding sequence
atgccacaaacatcagttgtattcagttctatccttggcccttcttgttctggacaggtccagccaggcatgggtgaacgcggaggcggagccggaggaggctctggagatctcatctttcaggatggacatctgatctccgggtcgctcgaggctctgatggaacacttggtgccaaccgttgactactacccagacagaacttatatctttacatttctcctgagttccagggtatttatgccaccgcatgatctgctcgcgagggtgggccaaatctgcgtcgagcagaaacagcaattggaagctggtcccgagaaagctaagctgaagtctttcagtgccaagatcgtgcagctgctgaaagagtggacagaggcctttccttacgacttccaggatgagaaagcaatggctgagctcaaggccatcactcaccgagtgacccagtgtgacgaggagaacggcacagtcaagaaggctatcgcccaaatgactcaatcactacttctgtcccttgcggctcgctcacagctgcaagaattgagggaaaaactgagacctcctgctgtggacaaaggccctatcttgaagactaaacctccagccgctcaaaaagacatattgggcgtgtgctgtgatcccttagtcctagcccagcaacttacacacatcgagcttgatcgggtgtccagtatttaccctgaggacctgatgcaaatagtgtcacacatggacagtctggataaccaccgctgtcggggagacttgaccaaaacatatagcctggaagcatatgataactggttcaattgtctctcaatgcttgtagccacagaagtgtgtcgagtggtgaagaagaaacaccgcacccgcatgctggaattttttatcgacgtggctagggaatgttttaacattggcaacttcaatagcatgatggcaattatatcaggaatgaacctgtctcccgtagctaggctcaaaaagacctggtcaaaggtaaagacagcaaaattcgacgttttagaacatcacatggatcccagttccaatttttgtaattacaggaccgctctccagggggctacacaaagaagccagatggcaaacagttcaagggagaagattgtcatccctgtctttaacctgttcgttaaggatatttactttctccacaagatccataccaatcacctgccaaatggacacatcaactttaagaaattctgggagatttcgagacaaattcacgaattcatgacttggacacaggtggaatgtcccttcgagaaggataagaagatacagtcatacctgctgaccgctcccatctactcagaagaagctctgtttgtcgctagttttgaatctgagggacctgagaaccatatggagaaggactcttggaagacgctcagaactaccctcctcaatcgtgcctag

SEQ ID NO: 59338 - DNA, 1422 bp, Artificial Sequence
  Description of Artificial Sequence: Synthetic coding sequence
atgccgcagacacccccattctcagccatgtttgattcgtccggatataacagaaatttataccagtctgctgaagacagttgcggcggtctgtattaccacgacaacaacctgttgtcaggatcgctggaggccctgattcaacacctggtgcctaacgtggattactaccccgacaggacatacatattcacgtttctgctgtcaagccggctcttcatgcatccatatgaactgatggccaaggtgtgccacctgtgcgtggagcaccagcgtctctcagatccggacagcgataaaaaccagatgaggaagatagcccctaaaatcctccagctactgacagagtggacagagacgtttccctacgattttcgcgatgagcgcatgatgagaaatctcaaggacttggctcatcgcatcgcgagtggagaggaacagacatatagaaagaatgtccagcaaatgatgcaatgcctgatcagaaaactggcagcattgagccaatacgaggaagttcttgccaaaatctcgagtaccagcaccgaccgtttgactgtcttgaaaaccaagcctcaatcgattcagagagatatcatcacagtctgcaatgatccctatacattggcacagcagcttacgcacatagaacttgagagacttaactatattggcccagaagagttcgtccaggcctttgtacagaaagatcctcttgataatgataaaagttgttatagcgagcgcaagaagactcgaaacttagaagcatacgtagaatggtttaaccgtctcagttatctagtggctaccgagatttgtatgccagtcaaaaagaagcaccgcgcacggatgattgaatattttatcgatgtggcacgggagtgcttcaacattggaaatttcaacagcctaatggcgatcatctccgggatgaatatgtcgccggtgagccggctcaagaaaacttgggctaaagttaagaccgccaaattcgacattctggagcatcagatggatccaagctccaatttctataactaccgcacagccttgcggggagcagcccaacgcagcttgacagcacactccagtagagagaaaatcgtcatccctttcttttcattgctgatcaaagatatatatttcctgaacgaggggtgcgccaacagactgcccaatggccacgtgaattttgagaaattttgggaactggcgaaacaggtcagcgagtttatgacatggaaacaggtggaatgtcctttcgagagagatcggaaaatcttacaatacctgctaactgtccccgtgtttagtgaagacgccctgtatctggcctcatatgaatccgaggggccagaaaaccatatcgagaaggatagatggaagagcctccgcagcagcttacttggcagggtgtag

SEQ ID NO: 59339 - DNA, 1296 bp, Artificial Sequence
  Description of Artificial Sequence: Synthetic coding sequence
atgccacagacaccccctttctccgcaatgtttgactccagtggctataatcgcaatctctatcagtccgccgaggattcctgtgggggattatactaccacgacaataatctcctatccggaagtctggaagctctgattcagcacctcgtaccaaatgtggactactaccctgacaatcagatgagaaaaattgcgcctaaaatattgcagcttttaaccgagtggacagagaccttcccttacgatttcagggatgagcgtatgatgcgtaacttgaaagacctcgcacatcgtatcgcttctggggaagaaacatatcgcaaaaacgtgcagcaaatgatgcaatgcctcatcagaaaattggcagctctttcgcaatacgaggaggtgttggccaaaatcagctctacctctacagaccgactcacagttctcaagaccaaaccccagagtatccagcgtgacattatcacagtgtgcaacgatccgtacacactcgcacagcagctcacacatatagagctggaacgcctgaactatattgggccagaagaattcgtccaggcgtttgtgcagaaagaccccctagacaacgataagagctgctactctgaaaggaaaaaaactaggaatctggaggcctatgttgagtggttcaacagactgtcctacctggtggccacagagatctgtatgccagtgaagaagaaacatcgcgctcgcatgattgaatattttatcgatgtggctagagagtgttttaatattggcaatttcaacagccttatggctatcatctcaggcatgaatatgagccctgtgagccggttgaagaaaacttgggctaaggtcaagactgctaaatttgacattttggaacaccaaatggatccatcatccaacttctacaactatagaaccgcgctgcgtggtgccgctcagagatccctgaccgcacactcaagccgcgaaaagattgtcatcccattcttcagtctcctcattaaggacatttattttctgaacgagggctgcgcaaaccggcttcctaatgggcatgttaactttgaaaaattctgggagctggcaaagcaagtgtcagagttcatgacatggaagcaggtggagtgcccgtttgaacgagatcgcaagatactgcaatatctgttaaccgtgcccgtgttttccgaggacgcactgtacctggcatcctatgaatcagaaggcccagaaaatcacattgagaaagatagatggaagtcccttcggtcctcactcctgggacgggtgtag

SEQ ID NO: 59340 - DNA, 633 bp, Artificial Sequence
  Description of Artificial Sequence: Synthetic coding sequence
atgccccaaactccacctttcagcgctatgttcgacagtagtggttataaccgtaatctgtaccagtctgccgaggactcctgcggcggtctttattaccatgataacaatcttctgagcggctccctcgaagctcttattcaacatctggtgccaaacgttgactactatcccgatagaacatacatcttcacctttctgctctcgtcaagactgttcatgcacccatacgagctcatggccaaggtgtgtcacctgtgcgtggagcatcaaagactgagcgaccccgattccgataaaaaccaaatgagaaagatcgccccaaagatccttcaactgttgacagagtggacagagacttttccctacgacttccgagatgagaggatgatgcgcaacctcaaggacctggctcataggatagcttccggagaggaagtgggaaatcttaacctggcacgcctgcttgaattccccggacgcgcttgggttggcaacggcgctgaactgtgcatattaatctcgacagccagtagtttgttctgtctctgggcaagccccccacaccatatcttagtgtacctggtgtgtcaggtgcggatgatcataccaagtcattttaaaggaatatag

SEQ ID NO: 59341 - DNA, 633 bp, Artificial Sequence
  Description of Artificial Sequence: Synthetic coding sequence
atgccccagactccccctttctcggccatgttcgactcttcggggtataatagaaacctctatcagtctgccgaggatagctgtgggggactgtactatcacgacaacaatctgttgtccggtagcttggaagcactgatccagcacctggtgccaaacgtggactactacccagacagaacctacatattcactttcttgctctctagccgcctgttcatgcacccctatgaactcatggccaaggtgtgccacctctgtgttgaacaccaaaggctcagtgacccagattctgataagaaccaaatgcgcaagattgcaccgaaaatcctgcagctcttgaccgaatggacagagacgttcccgtatgatttcagggacgaacggatgatgagaaacttaaaagacctcgcccaccgaattgcaagcggcgaagaagtgggcaatttaaatttggccaggcttttggagttccccggaagagcgtgggttggtaacggagctgaactttgcattctgatttctaccgcatccagcctgttctgtctctgggcatccccgcctcaccacattctggtgtatttagtttgccaggttaggatgatcattccctcccattttaaggggatctag

SEQ ID NO: 59342 - DNA, 1419 bp, Artificial Sequence
  Description of Artificial Sequence: Synthetic coding sequence
atgccgcaaacacccccattttccgctatgttcgattcctccggatataaccgaaatctatatcagagtgctgaagactcatgtggcggactctactaccacgataataatctgctgtcaggatccctggaagccctgatccagcatctggtgcccaatgttgattactacccggataggacttatatattcaccttcttgctgagttccagattgttcatgcacccctacgagctgatggccaaagtgtgccatctttgcgtggagcaccagcgcttatccgatcctgacagtgataagaatcagatgagaaagatcgcacctaaaattctgcagttgctgacagagtggacagaaacttttccctacgatttcagggacgaaaggatgatgcgcaatctgaaagacctcgctcatcgcatcgcgtctggcgaggaaacctatagaaagaacgtccaacaaatgatgcagtgcctcatacgcaaactcgcagccctcagccaatacgaagaggtgctggcgaaaatttcttccacatcaactgatcgactgacggttctaaagaccaagccccagtcaatccagagagacatcataacggtgtgtaatgacccgtataccctcgcgcagcagttaactcacatcgagctggagagattgaattacattggtccagaagagtttgtgcaagcttttgtgcagaaagaccccttggataacgacaaatcatgctattctgagagaaagaaaacccgcaacttagaagcttatgttgagtggtttaatcggctctcgtaccttgttgcaactgagatttgtatgcccgtgaaaaagaaacacagagcaaggatgattgaatactttattgatgtggctcgcgagtgcttcaacattggcaatttcaacagccttatggccatcataagcggtatgaatatgtctcccgtgtcacggctcaagaagacctgggctaaagtgaagacggctaagtttgacatccttgagcaccagatggatccgtcatccaatttttacaactaccgtaccgccctgcggggagccgctcagcggtctctgaccgcccatagtagcagggaaaagatagttattccttttttctctctgctgattaaagacatttacttcctgaatgagggttgtgccaaccgcctgccgaatggtcacgtgaatttcgaaaagttttgggaactggctaaacaggtttcagaattcatgacatggaaacaggtcgaatgcccgttcgagcgcgaccgaaagatcctccagtacttgctgaccgtcccagtttttagcgaagatgctctttacctcgcatcctatgaatctgaaggaccagaaaatcatattgagaaggacagatggaaatctctgaggtccagtttactcggaagagtttag

SEQ ID NO: 59343 - DNA, 1401 bp, Artificial Sequence
  Description of Artificial Sequence: Synthetic coding sequence
atgccccagacactatccgcaagcgacatggtaacacccggatcactcagcccacctcccacagaacccaccgatggcgagcaagcaggtcagccattactggacggagccccatcatccgctagccttgaaactctcatccagcacctagttcctacagccgattactacccggagaaagcctacatttttaccttcctgctgtcctctaggctgtttatcgagcctcgggagctgctcgctcgggtgtgtcacctatgtatcgagcagcagcaactcgataagcccgtgttagataaagccagggttcgcaaattcggccctaaactattgcagctgttagcagagtggactgaaaccttcccgagggacttccaggaagaatccaccatcggacatttgaaagatgtggtgggtcggattgctccttgtgacgaggcatatagaaaaaggatgcaccagcttctgcaggccctccaccaaaaactcgctgccctccgtcaggggccagaaggattagttggagccgataagccgatatcatacaggacaaagccacccgcatctatccatagggagctgcttggggtctgttcagacccttatactcttgcccaacagcttacacatgtcgagctggagcggctgcgccacatcggccctgaagagtttgtacaggcttttgtcaacaaggatcctctagctagtacaaaaccctgcttctccgataagacatccaatctcgaagcctatgtgaaatggtttaaccggctctgctatcttgtggctacagaaatctgtatgccggcaaagaaaaaacagagggcccaggttattgagtttttcatagacgtagctcgagagtgttttaacataggcaacttcaattctctgatggcaatcatctccgggatgaatatgtcacccgtatcgcggttgaagaagacgtgggccaaagtcaggaccgctaagtttttcattttagaacatcagatggaccctacgggcaacttttgtaactacaggaccgccctcaggggcgcagctcataggagtctcaccgcccattccagcagagagaagattgtcattccttttttctcgctacttatcaaagacatttactttctcaatgaaggatgtgccaatcgtttgcctaatggacacgtcaacttcgagaagtttctggagctggctaagcaagtaggagagtttatcacttggaaacaggtggaatgcccattcgagcaggatgcgtctatcacacattacctctatactgctccaatctttagcgaggacggcctctacctcgcatcttacgagtcggagagtcccgagaaccagaccgagaaagagaggtggaaggcccttagatctagcattttgggcaaaacatag

SEQ ID NO: 59344 - DNA, 1401 bp, Artificial Sequence
  Description of Artificial Sequence: Synthetic coding sequence
atgccacagaccctgagcgcatcagacatggtcacccctggatcgctctctccgccacctaccgagccaaccgacggggagcaggcaggccaacctctgctcgatggggcaccgagctcagcatctctggagaccctgatacaacacctggtccctacagccgactactacccggagaaagcatatatatttacttttctgctgtcaagccggctcttcatagagccacgggaactgctggcacgggtgtgtcacctgtgcattgagcagcaacagctcgacaagcccgtccttgataaagcgcgtgtccgcaagttcggccctaagctgctccagcttcttgcagagtggaccgagaccttcccacgggacttccaggaggagtccactatcggtcatctcaaagacgtcgtgggaagaattgcgccatgtgacgaagcataccgtaagcggatgcatcagctgctgcaagccctgcatcagaaactagctgccctccgccaaggcccagagggcttagtgggcgctgacaagccaatctcctatagaaccaaaccaccagccagcatccaccgggaacttttaggcgtgtgttcggacccttacaccttagctcagcaacttacacatgtggaactggagcgtttgcgccacatcggcccagaagagtttgtgcaggctttcgtgaacaaggatccgctggcgagcacaaagccctgcttctccgacaagacatcaaacttagaggcatacgtcaaatggtttaaccgcctgtgttacctggtggctactgaaatctgcatgcctgcaaagaaaaagcagagggcccaggttattgagttcttcatagatgtggcccgtgagtgcttcaatatcgggaacttcaactctctcatggccatcatatcaggaatgaatatgagtcctgtcagcaggttaaaaaaaacttgggcaaaagtgagaacggccaaatttttcatcctggagcaccaaatggatcccaccggcaacttctgcaattaccgcactgctcttaggggcgcagcccatcggagtctgactgcccattctagccgcgagaagatcgtgattccttttttttccctccttatcaaggatatctatttcctcaacgagggttgcgcaaacagattgccaaatggacatgttaactttgagaagttcctggagctggcaaagcaggtgggtgagttcattacctggaaacaggtcgaatgtcccttcgaacaagatgcctctataacacactacttgtacaccgccccaatcttctccgaggatgggctctacttggcctcctacgagtcagaatctccagaaaaccagacagagaaggagagatggaaggccctcagatccagtattcttgggaaaacctag

SEQ ID NO: 59345 - DNA, 1170 bp, Artificial Sequence
  Description of Artificial Sequence: Synthetic coding sequence
atgcgcgtgctcgtgagaaggtgttggggcccaccacttgcacacggagcacgaaggggtcgaccttctcctcaatggcgcgctcttgctaggctgggctgggaagattgtcgggattcgcgtgttagagagaaacccccatggagagtcctatttttcgggacagatcagtttgccagggaggccctccgagccctgcatgcagcaagggaaaacaaagaagaggagctcatcgataagcttgaggtggtaacaatgccaagcccgtcacctaagggactcccagttaagcagtacgctgtccagtcccagctccccgtttacgaatggccagacgtaggatccggcgaatatgacgtgggagtggtcgcatctttcggtagactgctgaacgaagccttaatcctgaagttcccctacggaattcttaatgtgcatccttcctgtctgccccgatggcggggaccagcgccagtcatacatactgtgctgcacggggacactgtcacgggggtcacaatcatgcagataaggcccaaaagatttgatgtgggtcccattttgaagcaggagacagtccctgttcctcctaaatcgacagctaaagagctggaggccgttttgagtagactcggggctaacatgctgatcagcgtgcttaagaacctccccgagtccctgtctaacggtcggcaacagcctatggagggcgcaacttacgcacctaagattagcgcaggaacctcgtgtattaaatgggaggaacagaccagtgaacagattttccgactgtacagagcaatcggaaacatcattcccctgcagaccctgtggatggctaatacgatcaagctgctggatcttgtggaggtgaatagctccgttctagcagaccccaagttgacaggccaagctctgatccccggaagtgttatataccataaacaatctcaaatccttctggtgtactgtaaggatgggtggatcggcgtgcgaagcgtgatgctgaaaaaatccctcactgcgacagatttttacaatggctatctacatccctggtatcaaaagaactctcaggctcaaccctcacagtgccgattccagaccttgaggttacccacaaagaagaaacaaaagaagacagtagcaatgcagcagtgcatcgagtag

SEQ ID NO: 59346 - DNA, 744 bp, Artificial Sequence
  Description of Artificial Sequence: Synthetic coding sequence
atgtccagcgtgtttggcaagccacgggcagggagcggcccacagagcgccccacttgaggttaatctggccatcctaggtcggcgaggggctggaaagagcgaagatacctattccagtgaagagactgtggaccaccagcccgtgcacctgcgagtcatggacactgccgaccttgatacacccagaaactgtgagagatacctgaattgggctcacgccttccttgtggtttacagcgtagactcccgccagagcttcgactctagcagcagttacctggaactcctggcactgcacgccaaggaaacacaacggtccatccctgccttgctgctcggtaacaagctggacatggcccagtaccggcaggttactaaggctgaaggcgtcgcattggcaggcaggtttggctgcctttttttcgaggtgtcagcttgtctcgactttgagcacgtgcagcatgtattccacgaggctgtgagggaagcacggagggagctcgagaagagtcccctcaccagaccactcttcatcagcgaagaaagggctttgccccaccaggcccctcttacagccagacacgggctcgcctcttgtacgttcaacactctgtctaccattaaccttaaggagatgcctacagtggcccaggctaaactggtcaccgtgaaatcatcacgcgcacagtcaaaaaggaaagcgcctacacttactcttctcaagggcttcaaaatattttag

SEQ ID NO: 59347 - DNA, 768 bp, Artificial Sequence
  Description of Artificial Sequence: Synthetic coding sequence
atggttattatggggcctgagttagtgggcagttggagcgatttcaagaatgaagcggcagatccgagggccttaacggttaagttcctgacgaagcgctttatcagcgaatacgatcccaacttagaggacacttatagttctgaggagacagtggatcatcaaccagtgcacctgcgggtcatggatacagccgatcttgatacacctcggaactgtgaacgctacctaaactgggcgcatgcttttctggtggtgtactcagtggacagcagacaaagctttgactcatccagctcctatttagagctgctcgcactccacgcgaaagaaacacagcggtcgatccccgctctcctcctggggaacaagttggatatggcacagtaccgccaggttaccaaggctgaaggagtcgcgttggctggcagatttgggtgccttttctttgaggtgagcgcctgcctcgattttgaacatgtgcagcatgtctttcacgaggccgtaagagaggcccgtagggagctggagaagtctccactgacaagaccacttttcatctccgaggagcgtgccctaccccatcaagcacccctgaccgcaagacacggcctggctagctgtacctttaatacactcagtactattaatttgaaagaaatgccaactgtagcacaggcaaagctcgtcacagtaaagagtagccgcgctcagtcgaagcggaaagctccaacattgaccctgctaaaggggttcaaaattttctag

SEQ ID NO: 59348 - DNA, 1131 bp, Artificial Sequence
  Description of Artificial Sequence: Synthetic coding sequence
atggccgaagagagacccggagcctggtttggattcggcttttgcggattcggccaggagcttggctctggccgaggcagacaggtccatagcccttctcccctgcgcgcaggcgtggacatctgccgggtttccgctagctggagttacaccgcctttgtcactcgcggtgggaggttggaactgtctggctcagcctctggcgcagctggccgatgcaaagatgcctgggctagcgagggcctgcttgctgtgctgcgcgcaggccctggcccagaagcacttctacaggtttgggccgcagagtctgccttgcgcggagagcctctgtgggcgcagaatgtcgtgcctgaggccgaaggggaagacgatccagcaggcgaagcccaggctgggaggttgcctctgcttccatgtgctcgcgcatatgttagcccaagggctccattttaccgacctcttgccccagaactacgtgccaggcagctggagctcggggcagaacacgcgcttcttcttgacgctgcgggacaagtcttctcctgggggggaggcagacacggtcagctggggcacggcaccctagaagccgaattggaacccagactcctcgaggcccttcaggggctggtgatggcagaggtagctgccggtgggtggcattctgtgtgcgtttccgagaccggcgacatatatatctggggctggaatgagagcgggcagttggcactgcccacccgaaatttggccgaggacggcgaaacagtggcaagggaggcgacagagcttaatgaggatggaagccaggtgaagcggacaggaggggcagaagatggagcacccgcaccctttatcgcggtgcagcctttccccgctttacttgacctgcccatgggctctgatgctgtgaaggctagttgcggatcaagacataccgcagtcgttacaaggacaggagagctttacacatggggttgggggaagtacgggcaacttgggcacgaggataccacaagcctcgaccgacctagaagggttgagtacttcgttgataaacaattacaggttaaagccgttacttgcggaccgtggaacacatacgtctacgccgtggagaagggaaagtcctag

SEQ ID NO: 59349 - DNA, 1131 bp, Artificial Sequence
  Description of Artificial Sequence: Synthetic coding sequence
atggctgaggaacgacccggagcctggtttggattcggtttctgtggatttggacaggaacttggatcaggccgtggacgccaggtccactctcctagccctctgagggcaggcgtcgatatttgtagggtctcagcgtcctggagttataccgcatttgtgacccgaggagggaggctggagctcagcggttctgcttcgggcgctgctgggagatgtaaggacgcatgggcttccgagggattgctggcggtactccgggctgggcctggaccagaggctctgctccaggtctgggcagcagaatctgctctgagaggcgaacctctttgggcccagaacgttgtgcccgaagcagagggggaggatgacccagctggtgaggcgcaggccggtcggctacccctgttaccctgtgcacgcgcttacgtgtcaccccgagctccattttaccggcctctggcccctgagctgcgggctcggcagctggagcttggagctgagcacgctctcctgctggacgcggctggacaggtttttagctgggggggagggaggcatgggcagctcggccacggaactctggaagctgaactggaaccaagacttctcgaggccctgcaaggcctggttatggcagaggttgccgcaggaggatggcacagtgtgtgtgtttccgaaacaggagacatctacatctggggctggaacgagtctggacagctggccctgcccacacgcaacctcgccgaggatggcgagacagtggctcgggaagccaccgagctcaacgaagatgggagccaagtgaagcggacagggggtgctgaggatggggcacctgccccatttatcgccgtgcagccattcccagccttactagacctgcctatgggttccgatgctgtgaaagcgtcctgtggaagcagacataccgcagtagttacacggacaggggaattatacacatggggctggggcaagtatggtcagttgggacacgaggataccacatccctggaccgcccaaggagagttgagtactttgttgacaagcagttgcaggttaaggcagtcacctgtggtccgtggaatacctacgtgtatgctgtggaaaaaggaaaatcctag

SEQ ID NO: 59350 - DNA, 594 bp, Artificial Sequence
  Description of Artificial Sequence: Synthetic coding sequence
atggaagaaaggccagctgagacaaacgccaatgtagataattcggcctccccctctgttgcccaacttgcagggaggtttagggaacaggcagcggctgctaaggaaacaccagcgtccaaacccacaagaaggaaacccccttgctccttaccacttttcccgccaaaagtggacctaggacagaatggtgaggaagccaacctgacatttgatcctgccgctttgttacccggtgcctctcctaaatcacctggcctgaaggcaatggtgtcccctttccattcacccccaagtacgccgagcagtcccggagtgcgctcccgcccttcagaggccgaggaggtgcccgtctctttcgatcagcctccggaagggagccacttgccatgctataacaaagtgagaacccgtggatccattaagcggaggcctcccagccgtcgttttagacggtctcagagcgactgtggggagctcggtgactttagagctgtagagtcgagccagcaaaacggagcaaaagaggaggatggcgacgaggtgctgcccagcaaatccaaagctccaggaagcccactcagttcagagtag

SEQ ID NO: 59351 - DNA, 1251 bp, Artificial Sequence
  Description of Artificial Sequence: Synthetic coding sequence
atggaggaacgtcccgctgagactaacgcaaacgttgataatagcgcctcccctagcgtcgcccagttagcgggtaggttcagagaacaggctgccgctgctaaggaaacaccagcttccaagcccaccaggaggaagccaccatgcagcttgccgctctttccgccaaaggtggacttgggccagaacggagaggaaaagtcccccccaaatgcctctcatccccctaaattcaaagttaagtcaagccctctgatcgaaaaactgcaggccaatttgacctttgacccagccgctttgctgcccggagccagtccgaagtccccgggactcaaagcgatggtgagccccttccatagtcccccttcaaccccatcttctccaggggtcagatcgcggccatcggaggccgaggaagtgcccgtttcgttcgatcagccccctgagggtagtcacctcccatgttataataaagtgaggacacggggatccatcaaaaggcggccaccctctaggcgctttagacggtctcagtcagactgcggggagctaggggacttccgcgctgtcgaatcttctcagcaaaatggtgccaaggaggaggacggagatgaggtattgccctctaaaagtaaagctcccggtagccccctcagttccgaaggagcggctggagaaggtgttaggactctgggtcccgcagaaaaaccccctctgcgaagaagcccctctcggactgagaaacaagaagaggatcgggctaccgaggaggcaaaaaatggggagaaggctcgacggtcctcggaagaggttgacggacagcatcctgcccaggaagaagttccagaaagcccacagacgtccgggcctgaggctgagaatagatgtggttcccctagggaggaaaagccggcaggcgaagaggccgagatggagaaagccacagaggtgaagggcgaacgcgtacagaacgaagaggtgggtcctgagcacgacagccaggaaaccaaaaagctggaggaaggagccgctgtgaaagagacgcctcactccccccctggcggagtaaagggaggcgacgtcccgaaacaggagaaagggaaagagaagcagcaggaaggagccgtgttggaaccagggtgctcgccgcagacgggtcctgcccaattggaaacaagcagtgaggtgcagtccgagcctgccgtgccgaagcctgaagacgatacacccgtgcaggacaccaaaatgtag

SEQ ID NO: 59352 - DNA, 1161 bp, Artificial Sequence
  Description of Artificial Sequence: Synthetic coding sequence
atggaagagcgtccagccgagactaatgccaacgtggataattccgcctcaccctccgtggctcagctcgcaggacggttccgcgaacaggcagctgcagcaaaggagaaatccccacccaatgctagccaccctcctaagttcaaagtaaagtcgagcccactgatcgagaagctccaggcaaatcttacgttcgatcctgcagccctgttgcctggcgcaagcccaaagagccccggattaaaggcaatggtgtccccattccacagccctcctagcactccttcctcgcccggtgtgcgctccaggccatcagaggctgaggaggttccagtgtcttttgaccagcctccagagggcagccacttgccttgctacaataaggtaagaactaggggtagcattaagcgccgtcctcccagccgccgttttcgccgttctcagagtgactgtggggaactgggagattttagagccgtagaatcctcccagcagaatggcgctaaggaagaggacggagatgaggttctgccatcaaaaagtaaggcgccaggttcacccctctcttcagaaggagcggcaggagaaggcgttcgcaccctgggtccggctgagaagcccccattgcggaggtctcccagcagaactgaaaagcaagaggaagatagagctactgaggaggcaaagaatggagagaaggccagacgctctagcgaggaagtcgatggccagcaccctgcacaggaagaggttcccgagagcccgcagacctccggcccagaggcagagaatcgttgcggctctccgcgagaggagaagcctgcaggagaagaggcagagatggaaaaggccaccgaggtgaagggggaacgagttcaaaatgaggaggtcgggcctgaacatgattcgcaggagactaaaaagctagaggagggcgctgctgtaaaggagaccccccattctccaccaggtggggtaaaggggggtgacgtcccgaagcaggagaagggcaaagagaaacagcaggagggggctgtcctcgaacctgggtgttccccacagacaggaccagctcaacttgagacctcctccgaggtacagtcagagcctgccgtgccaaaacctgaagatgacacacccgtgcaagatactaagatgtag

SEQ ID NO: 59353 - DNA, 561 bp, Artificial Sequence
  Description of Artificial Sequence: Synthetic coding sequence
atggagcccaccagagattgtcctttgttcgggggtgctttctctgccattctgcccatgggggctatcgacgtcagtgacctcaggcccgttccagataaccaggaggtcttttgccatccggtgaccgatcagtcattgatcgtggagttgttggaactgcaagctcacgttagaggggaggccgctgctcggtaccatttcgaagacgttgggggagtgcagggagccagagccgtccacgtagaatcggtgcagccgctgtcactggagaacctggctctgcgaggtaggtgccaggaggcatgggtcttatcggggaagcagcaaatcgccaaggaaaaccaacaagtagccaaggacgtgacactgcatcaggccttgctacgactgccacagtaccagacagacttgttactgaccttcaatcagcccccacctgacaaccgcagttctctggggcctgaaaacctctcacccgcaccctggtccttgggagattttgagcagctcgtgacaagcctcaccctccatgatcccaacatttttgggccacagtag

SEQ ID NO: 59354 - DNA, 870 bp, Artificial Sequence
  Description of Artificial Sequence: Synthetic coding sequence
atgtcagcgttctccgaagcagccctggagaagaaactgagcgagttgtccaacagccagcaaagcgttcagaccctaagcctctggcttattcaccatcgcaagcactctagacccattgtgaccgtctgggaacgggagctccgcaaagccaaacctaacaggaagttgacattcttatatctagccaatgatgtcatccagaattccaagaggaagggacccgagttcactaaagatttcgcacccgtcatagtcgaggcttttaagcacgtgtcctctgaaacagacgagagctgcaaaaaacacctcgggcgagtgctctccatatgggaagaacgcagcgtgtacgagaacgacgtgctggagcaactcaaacaggcgctgtatggggacaaaaagcccaggaaaaggacctacgagcagattaaagttgacgaaaacgaaaactgtagtagccttggttcgcccagcgagcctccgcagactctggatctcgtgcgggcattacaggatctcgaaaatgcagcctctggcgatgccgcagtccatcagagaattgcatctctgcccgttgaggtgcaggaggtgtccctgctggacaaaattaccgacaaagagagtggcgaaagactatccaaaatggtggaagacgcctgcatgctgctggcagattataacggtaggctggcagccgaaattgacgaccggaagcagcttactagaatgttggccgattttctgcgatgccagaaggaggccctcgctgaaaaggagcataaactagagatacttgatatgggcgtaagcagtaatgacgtggtaactatctcgatcttttttctgcttaaaattaatattaagccctag

SEQ ID NO: 59355 - DNA, 831 bp, Artificial Sequence
  Description of Artificial Sequence: Synthetic coding sequence
atgcggaactccaattggaggttctgccaaacaggaatttacagtaagccaaataggaagctgactttcttgtacctcgcaaacgacgtgatccagaatagcaagcgcaaaggtccggagtttacaaaagactttgcccctgtgatcgttgaggcattcaaacacgtctcaagtgaaaccgatgagagctgcaagaaacacctaggcagagtcttatcaatctgggaggaacgcagcgtctacgagaatgatgttcttgagcagctcaagcaggcgctctacggtgacaagaagcctaggaaacgtacttatgaacaaatcaaagttgacgagaacgaaaattgtagctccctggggtccccctcagaaccccctcagaccctggacctagtcagggcattgcaggatctagagaatgcggcaagtggcgatgccgctgtccatcagcgaatcgcctccctccctgtagaggtacaggaagtgtcactacttgataaaattactgataaagaatctggggagaggctcagcaaaatggtggaggacgcctgtatgttgttggctgactataatgggaggcttgctgcagaaattgacgaccggaagcagctgacacgtatgctggcagacttcctccgctgtcagaaggaagcactggctgagaaggaacacaagttggaagagtacaaaaggaaactggcccgtgtatcactagttaggaaggagctcagaagccgcatacagtcactgccggacttatctaggctgccgaatgtgacagggtcccacatgcatctgccattcgctggcgatatctactccgaggactag

SEQ ID NO: 59356 - DNA, 939 bp, Artificial Sequence
  Description of Artificial Sequence: Synthetic coding sequence
atgtccgccttctcagaagccgctctcgagaaaaaactctccgagttgagcaattcccaacagtcagtacaaaccctaagcctgtggctcatccatcatagaaagcattcgcggcctatagtgaccgtgtgggagcgcgaactgcggaaagccaagcccaaccggaagctgactttcctatacttggccaatgacgtgattcaaaatagcaaaagaaagggcccagagtttacaaaggatttcgctccggtgattgtggaagctttcaaacatgtctcatccgagaccgacgaatcttgcaagaaacatctgggaagggtactgtcaatctgggaggaaaggtccgtttatgaaaatgacgtgcttgagcaattgaaacaggccctgtacggggacaaaaagcccagaaagcgcacctatgagcagatcaaagtggacgaaaacgagaattgttcatcgctggggagcccttcagaaccaccccagactcttgatctggtacgtgccctccaggacctggagaacgccgcttcaggagacgccgctgtgcaccagcgcatagcatccctgcctgtggaggtgcaggaggtgtcgttactggacaaaatcaccgataaagagtcaggggagagactgagtaaaatggtagaggatgcctgcatgctgctggcagattacaacggtcggctggcagcagaaatcgatgatcgaaaacaattaacaaggatgcttgccgacttcttaagatgtcaaaaggaggccttggccgagaaagaacataagcttgaggagtacaagagaaaactggctagagtcagcctggtcaggaaagaattaagaagcaggattcaaagtttgcctgatctttcgcggctgccgaacgtgacggggtcccacatgcacctgccatttgccggagatatatatagtgaggattag

SEQ ID NO: 59357 - DNA, 939 bp, Artificial Sequence
  Description of Artificial Sequence: Synthetic coding sequence
atgagcgcattctccgaagccgcactggagaagaagctgtccgagttgtcgaacagtcagcagtcagtgcagaccctgtccctctggctgattcaccatcgcaagcacagccgcccaatagtgactgtctgggagagggagctgagaaaggccaaacctaatcggaagctgaccttcctgtacctggcaaatgacgttatacagaactccaagagaaaaggcccagaattcacgaaagacttcgctccggtgatagtcgaggcgttcaaacacgtgagctccgagacagatgaaagttgtaaaaaacacctcgggagagtgctttctatttgggaggaaagaagcgtatacgaaaacgacgtcctggagcagttgaagcaggctctgtacggagataagaagcctcgcaagcgcacatatgagcagattaaggtagatgagaacgaaaactgctcttcattaggttcaccctccgaaccccctcagactctcgatctcgtgagggcactacaggacttggaaaacgcagccagtggtgatgcagccgtgcaccagcgtatcgcgtctctcccagttgaggtccaggaggtgagcctgttagacaaaattaccgacaaggagagtggcgaaagactctccaagatggtcgaagatgcgtgtatgctgttggccgattacaatggccgtctggccgctgaaatcgacgaccgcaaacagttgacccgaatgcttgccgatttcttgcggtgccaaaaggaagctctggctgagaaggagcacaaacttgaggagtacaagcggaaactagcccgagtatcacttgtgagaaaagagctgcgcagtcgtatacagtcgctgccggatctaagccgtctccccaatgtgaccgggtcccatatgcacctccccttcgctggggatatctattccgaggattag

SEQ ID NO: 59358 - DNA, 981 bp, Artificial Sequence
  Description of Artificial Sequence: Synthetic coding sequence
atgagctcctttagcgagtctgccctggagaaaaaactgagcgagttatcaaacagtcagcaaagtgtacagacgctgagtctctggttaatacaccacagaaagcacgctgggcctatcgtgagtgtgtggcaccgagagctaaggaaggcaaaatcaaacagaaaacttacatttctataccttgcaaatgacgtgatccagaacagcaagaggaaaggacccgaattcactcgggaatttgaaagcgtgcttgtggacgcattctcccacgtggcacgcgaggcagacgagggatgtaaaaaaccgctggagcgtttacttaacatttggcaggaaaggtccgtgtatggcggagagttcatccagcagttgaagctgtccatggaggactccaagagcccccctccaaaggcaaccgaagagaaaaagtccctgaagaggacattccagcaaattcaagaggaggaggacgacgattacccgggttcttacagccctcaggacccctctgctggcccacttctaaccgaggagctcatcaaggccctccaggacctggaaaacgcagctagcggagatgcgactgtgagacagaagatcgcctccttgcctcaggaagtgcaggacgtgtccttgctggaaaaaatcaccgataaagaggctgcagagcgactgtccaagacagtggatgaagcctgcttgttgctggccgaatataacggtagattagcggcagagcttgaggatcgtcggcagctggcaaggatgttggtggaatatactcaaaatcagaaagatgtgctttcggaaaaggagaagaaactggaagagtataagcagaaactggcaagagtaacacaagttcgcaaggaattaaaatcacatatccagagcctgccagatctatctctgcttcctaatgtgacaggtggtcttgccccacttcccagcgccggagatcttttctcaaccgactag

SEQ ID NO: 59359 - DNA, 459 bp, Artificial Sequence
  Description of Artificial Sequence: Synthetic coding sequence
atggctgcgggagggggaggcggttcatctaaggcatctagcagcagcgcctcatccgctggcgctcttgagagttccctcgaccggaaatttcagtcagtgactaataccatggagagtatacaaggcctaagttcctggtgtatcgagaataaaaagcaccacagtacaatcgtgtaccactggatgaaatggctgcgtcgtagcgcttatcctcatcgacttaacctgttctacctggcaaacgacgtgatccaaaactgcaaacgaaagaatgcgattatttttagggagtctttcgccgacgtgctccccgaagcggcagccctcgtgaaggacccctccgttagcaagagtgtagagagaatctttaaaatttgggaggacaggaatgtgtatccagaggaaatgattgtggctctgcgcgaagctctatcaaagtgcttgtttctctcatag

SEQ ID NO: 59360 - DNA, 4386 bp, Artificial Sequence
  Description of Artificial Sequence: Synthetic coding sequence
atggcagcgggaggaggcggaggatcttctaaggcatcttcaagcagcgcaagctcggcaggcgctctcgagagctcccttgatagaaaattccagtcagtgactaacacgatggaatctattcaaggcctgtccagttggtgcatcgaaaataaaaaacaccatagtactatcgtttaccattggatgaaatggctccggagaagtgcatacccccataggctgaacctgttttatctggccaacgatgtgatccagaattgtaaacggaagaacgcaataattttcagagaatcatttgctgacgtgttgccagaggcagccgctctggttaaggatcccagtgtgtctaaatctgtggagaggatcttcaaaatctgggaggaccgcaacgtgtaccccgaggaaatgatcgtcgctctcagagaagcgctctctaccacattcaagacgcaaaagcagctcaaggagaacctgaataagcagccaaataaacaatggaaaaaatctcagacatcgacgaaccccaaggccgcacttaagagcaagatcgtggcagaattccgctctcaggcgctgatcgaggaactcctgctttataaaagaagcgaagaccaaatcgagctcaaagagaagcagctgtctactatgcgggtggacgtgtgctctaccgagaccctgaagtgcctcaaagataaaaccggaggtaagaagttttcaaaagaattcgaggaggccagttccaagctggaggagttcgtgaatggcctcgacaagcaggtgaaaaacggccctagcctgactgaagccctagagaatgccggaatcttttatgaggcgcagtacaaagaggttaaagtggtcgcgaacgcctataagacgttcgccaaccgagttaacaacctcaaaaaaaagctcgaccaactgaagtccaccctgcccgatcccgaagagtcgcccgtacctagtccctccatggacgctccgtcaccgactggcagcgagagcccattccaggggatgggaggggaggagtcccagagtcctaccatggagtcagaaaagtctgctacccccgagcccgttaccgacaaccgcgacgtggaagatatggaactaagcgatgtggaggacgatgggagcaagatcatcgtagaggaccgcaaggaaaagcctgcagagaaatctgccgtcagtacctcggtgcctacaaagcccacagaaaatatatccaaagctagttcctgtacgcctgttccagtgaccatgaccgccaccccgccactgcctaagccagtgaacactagtcttagcccatcgccagccttagccctccccaacctggccaacgtagacctcgcgaaaatctccagcatcctgtcctcactcacgagtgtaatgaaaaacaccggggtaagcccggctagccggccttcaccaggcactccaacatccccctctaatctcactagcgggctcaaaacacccgctcccgcaacgaccacaagccacaatcccttggccaatatactgtctaaagtagaaattacaccagagtccatcctgtcagccctttccaaaacccagacccaaagtgcaccagccctccagggactctctagccttcttcagtccgtcaccggcaatcccgtgcccgcttcggaggccgcatcccagtctacaagtgcttcaccagccaacacaacagtgtctactattaaaggtaggaatctgccatcatctgcgcagccattcattcccaaatccttcaactacagcccaaacagcagtaccagtgaggttagtagcacttctgcaagtaaggcatctataggccagtcacctggactacctagcaccacattcaagttgccatctaacagcttgggctttactgctacccacaacactagccccgcagcccctcctactgaagtgactatctgccagtcttccgaggtatctaagcccaagctggagtctgaatcaacctcaccttccctggagatgaagattcacaactttctgaaagggaatcctggctttagtggcctgaaccttaacatcccaatcctttcatcactgggttcaagcgccccatccgagagccacccatcagacttccagaggggccctacttcaacatcaattgataatatagatggcacccctgtacgcgacgagaggtctggcacacctactcaggacgagatgatggacaaacccacttcgagcagcgtagataccatgtctctgctaagcaagatcataagccctggctccagtaccccttctagcacaagatccccacccccaggacgcgacgaatcgtatccacgtgaactttccaactctgtctccacctacaggcctttcggtctcgggagtgagtccccatacaaacagccgtctgacggtatggagcgaccgagctccctgatggattcatcccaggagaagttctatccggacaccagcttccaagaagacgaggattaccgggacttcgagtacagtggccctcctccttctgctatgatgaacctcgagaagaagcctgccaagtcaatcctgaaatcctctaaactctccgacacgacagagtatcagcccattctttcgagttacagtcaccgagcccaagagtttggggtcaagagtgcctttccaccaagcgtgagagccctgttggattcttctgaaaattgtgacagactgagttcatccccaggcctctttggagctttttctgtcaggggaaacgagcctggctcagaccgttcccccagtccaagcaagaacgattcttttttcaccccagactccaatcataactccttgtcacaatccacaacaggccatttatccctgcctcagaaacagtacccagacagtcctcacccagtgccccacaggtccctgttttctcctcaaaacaccctggccgcacccaccggacatccccctacctcaggggtggaaaaggttctcgcatccaccatcagcaccactagtaccatcgagttcaagaacatgctgaagaatgcaagtcggaaaccatctgacgataaacacttcggccaggctccctctaaggggacaccgagcgatggggtgtccttgagcaatctgactcagccctcactgaccgctacggatcaacagcagcaggaagagcactataggattgaaaccagagtgagcagtagttgcctcgacttgcctgacagtaccgaggagaaaggagcccctatcgagactctcggctaccattcagccagcaacagaagaatgtcgggagaacctattcagaccgtggagtccattagggttcctgggaagggaaatcgtgggcatggcagagaggcttcccgagtgggctggtttgatctctctactagcgggtcatcttttgataatggcccaagctctgccagtgagttagcctccttgggcggaggaggcagcgggggtcttacggggtttaagactgccccttataaagagcgagctccccagtttcaggagtccgtgggtagcttccgatccaatagtttcaacagcaccttcgagcaccacctgccaccgagccctctcgagcacggaacccccttccagcgagagccagtgggcccatctagcgcaccccctgtgccaccaaaggaccatgggggaatattttcccgcgatgcccctacccacttgcccagcgttgacttaagtaatccgttcaccaaagaagcagccctggcacatgccgctccaccgccacccccaggggaacattcaggaattcccttcccgacaccccctccacctcctccacccggtgaacacagcagctccggtggcagcggggtgccgtttagcaccccgcctccccctcccccaccggttgatcactccggcgtggtacctttccccgcaccccctctcgcggaacacggcgtcgccggtgcagtggcagtgtttcctaaagaccacagctcacttctgcagggcactctggcagagcactttggcgtactgccaggaccacgcgaccacgggggtcccactcagcgggacctgaacggtcccggactgagtagagtccgcgagtctctgaccctcccctctcactcactcgagcacctgggcccaccacacggtggcggaggaggtgggggaagcaacagctcatcgggacctcccttaggcccttcgcacagagacacgatcagccgatcagggatcattctgcgcagccctcgacccgactttcgcccaagagaacctttcctgagtagggatccatttcacagccttaaacgccctaggcctccgtttgctaggggtccaccctttttcgcccctaaaagaccattttttccacctcggtattag

SEQ ID NO: 59361 - DNA, 4308 bp, Artificial Sequence
  Description of Artificial Sequence: Synthetic coding sequence
atggctgcaggcggtggaggtgggtcatctaaggctagcagttcttctgcttcaagtgctggagctctagagagtagcctcgatcgaaaatttcaatctgtaacaaatactatggaaagcatccagggactgagtagttggtgcattgaaaacaaaaaacaccactcaacgatcgtgtatcactggatgaagtggctgcggcgttctgcatatccacaccggctgaacctcttttacttggccaatgatgtgattcagaattgtaagcgcaaaaacgcgattatctttagggaatcttttgctgacgttctcccggaagccgctgcacttgtgaaggacccctctgtcagcaaatcagtggagagaatttttaaaatctgggaagataggaacgtgtatcccgaggagatgatcgtggctctgcgcgaagcactgacttcaacaaatcctaaggccgcattaaagtcaaaaatagttgctgagttcagatcacaggccctgattgaggagctgctgctatataaacgtagtgaggaccagattgagcttaaggagaaacagctgagtaccatgagggtggacgtttgtagcacggagaccctaaaatgtttgaaagacaagacagggggaaagaagttctccaaagagttcgaggaagcctcttcaaagctggaagaatttgttaacggcctcgataagcaggtgaagaatgggccatcccttacggaagccctcgaaaacgccggaatcttctatgaggcccagtataaagaggttaaggtggtcgctaacgcatacaaaacgttcgcgaacagggtgaacaacctcaagaagaagctggaccagctgaagagtactctgcctgatccggaggagtcaccggtgccttcgccttcaatggacgctccatcaccaactggcagcgaatcaccgttccagggaatgggcggagaggaaagccagtcgccgaccatggaatccgagaaaagcgccacacccgaacccgttacagacaacagagatgtagaggatatggaactgtctgatgtggaagatgacggctcaaaaattattgtggaggaccgcaaagagaaacctgccgagaagtccgcggtgagcacttctgtgccaacgaaaccaactgaaaacatttctaaggcctctagctgcactcctgtgcctgtgaccatgacagccacccccccactgccgaagcctgttaatacatctctgagtccgtcaccggctctggccctccctaacctggcgaacgtggatcttgcaaagatatcaagcatattaagttcactaacgtctgtgatgaagaacaccggagtgtcacctgcctctcgtccttctccaggaacccctacaagccccagtaacctcacgtcaggtttaaagacacccgcaccggctacaacaacgtctcacaatccgctggccaacatcctctcaaaggtggagattacgcccgagagcattctgtccgctctgtccaagacccagactcagagcgctccagcactgcaaggcctatcatctcttctacagtctgtcactggcaaccctgtgccggcaagcgaggcagcctcgcagtctacgtccgcctcaccagcaaataccactgtcagtacaatcaagggcaggaatctgccatcatctgctcagccctttattcccaagtcctttaactattcgcctaattcttcaacttccgaagtgagttccacgagcgcctcaaaagctagcatcggccaatccccagggctgccatcaacgacgttcaagctaccctcgaacagcctggggtttaccgctacacataacacatctccggctgcccctcccactgaggtgactatctgccagagttcagaagtctctaagcccaaactggagtccgagagcacatccccctcgctagagatgaaaattcataactttcttaaggggaacccaggtttttccggcctgaaccttaatattccgatactcagtagcctgggatccagcgctccatctgaatcacacccttcagacttccagcgtggccctacctccacatcgatcgacaacattgacggcactccagtgagagacgagagatcgggaactcctactcaggacgagatgatggataagccgacgagttccagtgtcgacaccatgtccctgctgagtaagataatttctcccggtagtagtacaccgagctctacaaggtcaccgcctccaggtcgggacgaaagctatccgagagagctgagtaactctgtgagcacataccggcctttcggactgggttctgagtctccttacaagcagccgtctgatggaatggaacgcccatcgtcgctgatggattcctcccaggaaaaattctacccagacacctcattccaggaggacgaggattatagggattttgagtattctggtcccccacctagtgcaatgatgaatctagagaagaaacctgcaaagagcatcttgaagagtagtaaactgtctgatacaactgagtatcagccaattttgagctcttactctcaccgcgctcaggagtttggagttaaaagcgccttcccaccgtctgtgagggcgcttctggacagctctgagaattgtgacaggctaagcagtagtccagggttattcggcgcttttagcgtgagagggaatgagccaggaagcgacagatccccgagtccctccaaaaatgacagttttttcactccagattctaaccacaactctctctcacagagcaccacgggccacctgtccctgcctcagaaacagtatccggattcccctcatcccgttccccatcggtcgctgttctctccacagaataccttggccgctccaactggccaccctcctacatctggcgtcgaaaaggtcctcgcctcgactatctcaactacatctaccatcgagtttaagaatatgttaaaaaatgcatcccgtaagcctagcgacgacaaacacttcggacaggcgccatccaaaggcacgcctagcgacggggtctcactgagcaacctgacccaaccttcacttacagccaccgaccaacagcagcaggaggagcactaccgcatcgaaacaagagtgtccagtagctgcctcgaccttcccgactctacagaggaaaaaggagctcctattgagaccctcggctatcactctgcctccaaccggcgaatgagcggggaaccgatccaaactgtcgaaagcatcagggttcccggtaagggaaacaggggccacggcagggaagcaagccgcgtcggatggtttgacttgagcacctccggatccagcttcgataatggacctagctctgcttccgaactagcatcattgggtgggggtggctccggcggacttactggcttcaagactgccccttacaaggagagagcaccacaattccaggaaagcgttggttccttccgttctaactcattcaattctactttcgagcaccacctgccgccatcacctctggagcatggcaccccttttcagcgtgaacctgtcggcccatcaagcgctccaccggtgcctccaaaagaccatggcggaatctttagccgagacgcacccacacatctaccttcagtggatttgagcaacccatttaccaaagaggcagcacttgcccatgctgctccccctccgcctcccggtgagcatagtgggattccgtttcccacacctccaccccctccaccacccggagagcactcgtccagcggcggtagtggagtgccattttctacgcccccacctcctccgcctccagtggaccacagtggagttgtgccctttccagcacctcctcttgcagagcacggggtcgcgggtgccgtggcagtatttcccaaagatcactcatccctcctccagggaaccctcgctgaacactttggggttcttccgggaccgagagaccatggtggccctacacagcgcgatctcaatgggcctggactcagcagggtcagggagagcttaaccctgccttcacattcacttgaacatctgggaccccctcacggcggaggcggaggtggcggaagcaattctagcagcggccctccacttggaccctcccatcgagatacgatttcccgaagcgggattatcttaaggtcaccacggccagacttcaggccgagggagcctttcttatctcgcgatcctttccactctttgaagagacccagacctccgttcgcccgaggaccccctttcttcgctcccaagcggcctttttttcccccacgttattag

SEQ ID NO: 59362 - DNA, 2805 bp, Artificial Sequence
  Description of Artificial Sequence: Synthetic coding sequence
atggctgccggaggcggaggcggttctagtaaggcctcaagttcaagtgccagtagcgccggagcactggagtcgtcgttggatagaaaattccaatccgttactaacacgatggagagcattcaaggactgagctcgtggtgcattgaaaacaagaaacaccacagcacaatcgtctatcattggatgaaatggctgcggagatccgcgtacccgcacaggcttaacttgttttatcttgcaaacgacgtcatccaaaactgtaaacgaaaaaacgccataatattccgggagtcatttgctgatgtcttaccagaagccgcagccctcgtgaaggatccctccgtgtcaaaatccgtagagaggatatttaaaatatgggaagacaggaatgtgtatccagaagagatgatcgtcgcactacgggaagccctaacgtccactaatccaaaagcggcactcaagagcaagatagtggcagaattccgatcccaagccctgatagaagagctgctgttgtacaagcggtctgaggatcagatagagctgaaagagaagcagctctctactatgcgcgttgacgtatgcagtacagagacactcaaatgcttgaaggacaagacgggaggaaagaaattttccaaagagttcgaggaggcatcctccaagttagaagagttcgttaacggtttggacaagcaggttaaaaacgggccttccttaaccgaggccctggagaacgcaggcattttctatgaggcccaatacaaggaggtgaaggtggtcgccaatgcctataaaactttcgccaacagagtcaataacctgaaaaaaaaactggaccagctcaagagcactctccctgatcctgaggagtcacctgtgccaagtcccagtatggacgcccctagtccgactggatctgagtcaccattccaaggcatggggggtgaggagagccaatctcctactatggagagtgagaaatccgcgactccagaaccagttactgacaacagggacgtggaagatatggagttaagtgacgttgaggatgatggatccaagattatcgtggaagatcggaaagaaaagcccgcagaaaaatctgctgtatctacgtcagtacctaccaaacccaccgagaacatttccaaggcatcatcctgtacaccggtgcccgtgaccatgacggctactcctcccctgccaaaaccggtaaatacgagtctctccccatcacctgcattagcccttcctaacttggctaacgtggatctcgctaaaatcagtagtatcctgagttcactcacttcagtgatgaaaaacactggggtgtcgccagcatctaggccttctcccggtacgccgacctctccttctaacctgacatccggcctaaaaactccagctcctgccaccactacatctcacaacccacttgccaacatcctgtcaaaagttgagattactcccgaaagtatcctctccgcactctctaagacgcagacacagtcagctcctgctctgcaagggctgagcagccttttgcagtccgtaactggcaatcctgtgcctgcctcggaagccgcaagtcagagcacatcagctagccctgcaaataccactgtgtctacgatcaaagggcgaaatctgccgtcctccgctcaacccttcattccgaagagctttaactactctccaaacagttccacaagcgaggtcagcagcacgagtgcgtccaaggccagcatcggccagagcccgggtctcccttcaacgacctttaagctgccctctaactctctggggtttaccgcaacacataatacatcccctgctgctccacctaccgaggtgacgatttgtcaaagcagcgaggttagcaaaccgaaactcgaaagcgaatccaccagccccagcctggagatgaaaatccataatttccttaaaggaaaccccggtttcagtggactcaatcttaatatacctatattgagcagtttgggctcctcagcaccaagcgaatcgcaccctagcgacttccagagaggacctacttccacaagcatcgacaacatagatggcaccccagtgcgggatgagcggtcgggcacccccactcaagatgagatgatggacaaacccacttcttcgagcgtggacacaatgtcacttctctctaaaattattagcccgggatcgtctacccccagctccactcggtcaccaccacctggacgagatgagagctatccacgggagctttcaaattccgtttcaacatatcgcccttttggtttggggagtgagagtccctacaagcagccatccgacgggatggaaaggccaagctccttgatggacagcagccaagagaagttctatcccgacaccagcttccaggaggatgaagactatagggatttcgaatacagcggtccccctccttctgcaatgatgaatttggagaagaaacccgctaaatcgattttgaagagtagcaaactaagcgacacgactgaataccagccaatcctttccagttattcccaccgggctcaggagtttggagtaaaatcagccttcccaccgtcagttagggccctgctggatagtagcgagaactgcgacagactgagctcatcacccggtctctttggtgcgttctctgttaggggtaacgaaccagggagcgatcggtcacctagccctaagcatccctgtcgctcgcatggaagccccactcacgtgcggcgtggcgagagtccgggtctacaccattttcaccatgtggatgattag

SEQ ID NO: 59363 - DNA, 3231 bp, Artificial Sequence
  Description of Artificial Sequence: Synthetic coding sequence
atgtcttcggctgaaataattggtagcaccaatcttatcatcttgctggaggatgaagttttcgcagacttttttaacacctttttgagtttaccagtgtttggccagactcccttttatacagtggagaattcccaatggagcctgtggccagaaatcccatgcaacctgattgccaaatacaaggggttgttgacctggctcgaaaagtgcaggctcccctttttttgcaagacgaatctttgcttccactatatcttatgtcaagagttcataagtttcattaagtcgccggaggggggagaggaactggttgatttctggatcctcgctgaaaacatcctgagcatcgacgagatggacctggaggtgagagactattatctgtcactcctcctgatgctaagggcgacgcaccttcaggaaggctcgagagttgttacactgtgcaacatgaatatcaagtctctgctgaatctgagcatttggcaccccaatcagtcgactacacgcagagaaatattgtcccacatgcagaaagtggcacttttcaagctgcagtcgtactggcttccaaatttttacactcataccaagatgactatggctaaggaggaggcgtgtcacggcctgatgcaggagtacgaaactaggctctacagcgtctgttacacacacatcggtgggttacctctgaacatgtccataaagaagtgccatcattttcagaaaaggtactcctcccggaaggccaagcggaaaatgtggcagctcgtcgatccagactcatggtctttagaaatggacctaaaacccgacgccatcggtatgcctctccaggagacgtgtcctcaggagaaagtagtcatccagatgccttccctgaagatggcttcgagcaaggaaaccaggatctcctcactcgaaaaggacatgcattacgctaagatttctagtatggaaaacaaggctaaatcccacctgcatatggaagctcccttcgagaccaaagtaagcacacacctgcggactgtcattccaatcgtcaaccattcttcaaaaatgaccatccaaaaggctattaagcaatccttctcactgggttatatccacctggctctgtgcgcagacgcgtgcgcgggaaaccccttcagagatcacttgaagaaactgaaccttaaggtggagatacagctcctggacttgtggcaagatctgcaacacttcctgtcggtcctgttgaacaacaagaagaacggaaacgcgattttccgccatctgctcggcgaccgcatctgtgagctgtacctcaacgaacagatcggcccatgtcttccgctcaagtcccaaacaattcagggtctgaaagagctccttccttccggagacgttattccctggatcccaaaggcacagaaggaaatttgtaaaatgctcagtccttggtatgacgaattcctggacgaggaggactattggttcctgctgtttacaacccaaaataggtttatctcctccagacagcataagcgagaattcatcggaaaagaggaaaacatccttctctacaagagaattcaacagtcacttgagcttagccaagccctggctgatatgaaggagatggattacaggcaatggcgtaagatagcaactgaagatctgaagcaagggggaagcctgcaggtagaactcacatccccagtgttcctgaccgacatcactaaaatgagttttgaggagttatgctacaaaaaccctaaaatggcaatacagaagatttccgatgactacaaaatctactgtgagaaagcccctaagattgattttaaaatggagatcataaaagagacaaagacggtatcgagatccaatcgcaagatgagtctattgaagcggacccttgtgcgcaagccaagtatgagaccacggaatctgaccgaggtgctcctgaacacacaacatttggaattcttcagagagtttttgaaagagagaaaagccaagatcccccttcagtttctgaccgctgttcagaaaatttctatcgagaccaacgagaagatctgcaaatcactgattgagaacgtgatcaagaccttctttcagggacagctaagtcctgaggagatgcttcagtgcgatgcacccatcatcaaggaaatagcgtccatgagacatgttacaacctctactctgctgaccctgcagggacatgtcatgaagtctattgaggaaaaatggttcaaagattatcaggacctgtttccgccacaccatcaagaggtggaagtgcagtctgaagtccaaatctcatctcgcaaaccatcaaagatagtgtcaacttatttgcaagagagtcagaaaaaaggttggatgagaatgattagttttattcggtctttttgcaaatatcggagattcatgttaaatccaagcaagaggcaagaattcgaggattacctgcatcaggaaatgcagaactccaaggagaacttcacgaccgcccacaacacgtctggcagatcagcccctccatctaccaacgtccgttctgccgaccaggagaatggggagatcaccctcgtgaaacggagaatcttcggacatagaattattactgtgaattttgctatcaacgatctgtatttcttcagtgaaatggaaaaattcaatgacttggtgtcttccgcacacatgctgcaggtgaatcgggcttataacgaaaatgacgtgatccttatgaggtccaagatgaacattatccagaaactgttcttgaatagcgacatccccccaaaactgcgggtgaatgtgcccgaattccagaaggacgccatccttgcagccattaccgaggggtacctcgatcggtccgtgttccacggggcaatcatgtctgtatttccagtggtcatgtacttttggaaacgtttttgtttttggaaggccaccagatcctatcttcagtaccgtggcaaaaaattcaaggacaggaaatcgccacccaagagtactgataaataccccttctcaagcggcggagacaacgccatactccgttttactttgctgcgcggaatagagtggctgcagccacagagagaggctatctctagtgttcaaaacagctcgagcagcaaacttacccaacctcgactcgtggtgtcggccatgcagttgcacccagtccaggggcagaagctgtcctatattaagaaggaaaaatag

SEQ ID NO: 59364 - DNA, 309 bp, Artificial Sequence
  Description of Artificial Sequence: Synthetic coding sequence
atgctgtccgtgcggagggtgtccgaggatatctgctcacgaatctacgagagtgcccagagaattgattccatcactttcttgccttccagcgggtttcatttgaaatggaaaatacagacacggatagccaacgaaaagtatctgagaactcacaaagaagtggaatggctgatcagcggcttttttagggaaatcttcttgaaacggcctgacaacattcttgagttcgctgccgattactttaccgatccacgtctgcccaacaagattcatatgcagctgattaaggataaaaaggctgcctag

SEQ ID NO: 59365 - DNA, 1176 bp, Artificial Sequence
  Description of Artificial Sequence: Synthetic coding sequence
atggatcagtgtgttaccgtagagcgggagctagaaaaggtacttcacaaattttccgggtacggtcagctgtgtgaacgtggccttgaggagctcatcgactacaccggcggactgaagcacgaaatcttacagtcacacggtcaggacgccgagctgtcgggtactctcagcctcgtgttgactcagtgctgcaaacgcattaaagataccgtgcagaaactggcaagtgatcataaggatatccactcgtccgtgtcccgcgtgggcaaggcgatcgacaagaattttgacagcgatatcagttccgttggaattgacgggtgttggcaggcggacagccagaggctgcttaatgaggtgatggtagaacacttcttccggcaaggaatgctggacgtggctgaggagctctgtcaagaatccgggttgagcgtggatccttcgcaaaaggagccttttgtggagctgaatcggatccttgaagctctgaaggtgagggtgctgcgtcctgcccttgagtgggcagtgagcaatcgagaaatgcttattgcccagaacagcagtctggagtttaagctccatcgcctgtactttatctccctcctaatgggtggcactaccaatcaacgggaggctctgcaatatgccaagaactttcagccatttgcacttaaccaccagaaggatatccaagtccttatggggtcgttggtgtacctgagacagggcatcgagaactctccttatgtccacctattggacgccaaccaatgggcggacatctgtgacatctttactcgcgatgcgtgtgctctgctagggttatcagttgagtcaccattgtccgtctccttcagtgctggctgcgtcgccttacctgcccttatcaacatcaaggccgtaatagaacagcgtcagtgcaccggtgtgtggaaccagaaggatgaactgcccattgaggtggaccttggcaaaaagtgttggtaccactcaatcttcgcatgccccatccttcggcagcagacgacagataacaaccctcctatgaaactggtctgtgggcatataatctctagggacgcattaaataaaatgtttaatggctcaaagctcaagtgtccctactgccctatggaacagtcacccggtgatgctaaacagattttcttttag

SEQ ID NO: 59366 - DNA, 1182 bp, Artificial Sequence
  Description of Artificial Sequence: Synthetic coding sequence
atggaacagtgcgcctgcgtcgaacgtgaactcgacaaagtcctccaaaagtttcttacttacggacagcactgcgagaggagtctagaggagcttctgcactacgtggggcagttacgggctgagctggcaagcgcagcactgcagggcacccctttgtcagctaccctgtctctggttatgagccagtgctgcaggaagatcaaagacaccgtgcagaaactggcctccgatcataaagacatccattcctcggtatctcgagtgggaaaggccattgatcgaaattttgactccgaaatctgtggcgttgtatccgacgctgtgtgggacgcaagggagcagcagcagcaaattttgcagatggcgatcgttgagcacttgtaccagcagggtatgctgagcgtagcagaggaattgtgtcaggagtcaaccctgaacgttgacctggactttaagcagccattcctggagttgaataggatcctggaagccctgcatgaacaggacctgggccctgcactcgaatgggctgtgagccaccgccagcgactgctggaactgaactcaagcctagagttcaaacttcatcggctccattttattcggctgctggccggagggccagcaaagcagttggaggcgttatcttacgcaaggcacttccagcctttcgccaggttacaccaaagagaaattcaagtcatgatgggatctctggtgtatctgcggttgggactggagaagagcccatactgccacctgttggactcaagccactgggcggagatatgcgaaacatttacaagggatgcctgctccctgctgggcttgagcgtcgagagccccctgtccgtctcctttgcatctggatgcgtagcgctcccagtgcttatgaacatcaaggctgtgattgaacagaggcaatgcacaggcgtgtggaaccacaaggacgagcttcccatcgaaattgaactgggcatgaaatgctggtaccatagcgtctttgcctgtcctattctgaggcagcagacgtccgattctaaccctccaattaagctaatatgtggacacgtaattagccgcgatgcactaaataagctgatcaacggcggaaaattaaaatgtccttactgtccaatggagcagaacccagctgatgggaaacgaattattttctag

SEQ ID NO: 59367 - DNA, 345 bp, Artificial Sequence
  Description of Artificial Sequence: Synthetic coding sequence
atggagcagtgcgcctgcgtcgagagggaattggacaaagtgttacagaaattcctcacctatggacaacattgtgagagatctctggaagagctgctccactatgtaggtcagctgagggccgagctggctagtgctgccttgcagggtacccctctgtctgcgacactgtccctggtgatgtcccagtgctgcaggaaaatcaaagataccgtgcagaagctagctagcgaccacaaagacatccacagttccgtcagccgcgtgggcaaggccatagacaggaattttgactccgagatatgtggcgtggttagcgatgccgtctgggatgctagggagtag

SEQ ID NO: 59368 - DNA, 447 bp, Artificial Sequence
  Description of Artificial Sequence: Synthetic coding sequence
atggagcagtgcgcctgcgtcgaacgagaactggacaaagtgctccagaagttcctcacatatggacagcactgtgaaaggtccttagaagagttactgcactacgtgggccagctccgcgcagagctggctagcgcagcgctccagggaacacctctgagtgctacactgagtctggttatgagccaatgttgtcgcaagattaaggacaccgtccagaagcttgcctctgaccataaggacatacatagttcagtgagtcgggtggggaaagcgatcgatcgcaatttcgacagtgagatttgtggagtcgtgtctgacgccgtgtgggatgctcgggagcagcagcagcaaattctccagatggcaatcgttgagcacctgtatcagcaaggcatgcttagcgtggctgaagagctgtgccaagagagtacattaaatgtttag

SEQ ID NO: 59369 - DNA, 174 bp, Artificial Sequence
  Description of Artificial Sequence: Synthetic coding sequence
atggagcagtgcgcttgcgtggaacgtgagttggataaagtattgcagaagtttcttacttacgggcaacactgcgagcggtccctcgaagagctgctgcattatgtgggtcaactgcgggctgagctggcgagtgctgcgcttcagggcaccccactaagcgccactctatag

SEQ ID NO: 59370 - DNA, 1182 bp, Artificial Sequence
  Description of Artificial Sequence: Synthetic coding sequence
atggagcagtgtgcatgtgtggaacgggagctagacaaggttctgcaaaagttcctgacttatggacagcattgtgaaaggtcccttgaagaactgctccactacgtggggcagctcagggctgaacttgctagcgcagcactccagggcactccgctgtcagccacgcttagcttagtgatgagccagtgttgccgtaagattaaagacaccgtgcagaagcttgccagcgatcataaggacattcactcatctgtttctcgcgtcggtaaagctatcgacagaaacttcgattctgaaatctgcggcgtggtgagtgacgctgtgtgggatgccagggagcagcagcagcaaatactccagatggcgatagtcgagcacctgtatcaacagggtatgctgtctgtggctgaggaactgtgccaggaaagtaccctgaacgtggatctggacttcaagcaaccttttctggagctgaatagaatcctcgaggctctgcacgagcaggatctgggacccgcattagaatgggcagtcagccatcgccagcggctgctagaacttaacagtagtctcgaattcaagctgcacagattgcatttcataaggttactggccggtggcccagcaaagcagctggaggccttgtcttatgctcgccactttcagccatttgcaaggctgcatcagagggaaattcaggtaatgatgggtagcctggtctatttacgtcttggtctggagaaatctccttattgtcacctgcttgactcttcgcattgggcagagatttgcgaaacatttacaagggatgcatgctcactcctgggcctgtccgttgagtcccccctgtcagtgtcttttgccagtgggtgtgtggctctccccgtactgatgaacatcaaagccgtcattgaacagcgccagtgtaccggtgtgtggaatcacaaggacgagctgcctatcgagatcgaactaggaatgaagtgttggtaccactctgtgttcgcgtgccctatactacgccaacagacatctgattcaaatcccccaattaagctcatctgtggacatgtgatctctagggatgcgttgaacaagttgataaatggagggaaactgaagtgtccgtattgccccatggagcagaatcccgcagacggcaaaagaatcatcttttag

SEQ ID NO: 59371 - DNA, 1143 bp, Artificial Sequence
  Description of Artificial Sequence: Synthetic coding sequence
atggcagactgctcacttgatcttcctggctccagttccccgccatcgcacctctcccttctgaggtcctgggaccaccggcgtgtgcctccttgtcctgctcttcagggcaccccgctgtcagcgactctgtcactggttatgagccagtgttgcagaaaaataaaagatactgtccagaaactcgcgtccgatcacaaagacatacatagctccgtgtcacgggtcggaaaggcgatcgatagaaatttcgattccgagatttgtggtgttgtaagtgacgctgtttgggatgcacgggagcagcagcagcagatcctgcaaatggcgatcgtcgaacatttgtatcaacaggggatgctgtcggttgcagaggagctttgtcaagaaagcacacttaatgtggacctagacttcaagcagcctttcttggaactgaatcggatcctggaagcccttcatgagcaggacctaggccctgctttagaatgggctgtgtcacacagacagcgccttttggaattaaactcctcactcgagtttaaacttcaccgccttcatttcatccggctgctggcaggaggccctgcaaagcagctggaggccctttcctacgcacgacattttcagccgtttgccagactgcaccagcgagagatccaagtcatgatggggtcactggtgtatctgagactcggcttggagaagtctccttactgtcacctgcttgactcttctcattgggcggagatctgtgaaacgttcacgcgggacgcttgtagcctactcgggctttctgtggagtcgcctctttccgttagtttcgctagcggctgcgttgcacttccagtattaatgaatatcaaagccgtgatcgagcagcgccagtgtacaggtgtgtggaaccataaggacgaattgccgattgagattgaactgggcatgaagtgctggtaccactctgtgtttgcttgtcccatacttcggcagcaaacctccgactctaatcctcccatcaaacttatctgtggacatgtgatcagtcgtgatgcattaaataaacttattaatgggggaaagctcaagtgtccctattgtcctatggagcaaaatcccgctgacggaaagcgcatcatcttttag

SEQ ID NO: 59372 - DNA, 804 bp, Artificial Sequence
  Description of Artificial Sequence: Synthetic coding sequence
atggtgctcgggaactcccaccttttcatgaaccgatcaaacaagctggcggtcatcgcctcccatatacaggagagccggttcctgtacccaggtaagaatggacgcctgggtgatttttttggagatcctgggaacccacctgaattcaacccgtcagggtctaaggacggaaagtacgaattgctcacctcagccaacgaggtcatcgtcgaggaaattaaggatctgatgaccaaatctgacataaaggggcagcacaccgagactctgctggcaggctctctcgctaaggcactgtgctacatacatcgtatgaacaaagaggtaaaagacaatcaagaaatgaaatcacgaatcctggtaataaaagccgcagaggattctgcattacaatatatgaacttcatgaacgttatattcgccgctcagaagcagaacatactgatcgatgcctgcgtgttggattccgatagtggactgctccaacaggcctgtgacataaccggcggtctctaccttaaggtgccacagatgcctagcctcttacagtacctgctttgggtctttctgccggaccaggatcagagaagtcaattaatcctgcccccacctgtgcacgtcgattaccgcgcagcatgtttttgtcataggaacctgatcgagattggctacgtctgttccgtttgcctttctatcttttgtaacttttccccaatttgcactacctgcgagacagcattcaagatctccctgccacccgttctaaaagctaagaagaagaaactgaaagtcagcgcttag

SEQ ID NO: 59373 - DNA, 864 bp, Artificial Sequence
  Description of Artificial Sequence: Synthetic coding sequence
atggccgagcactttaaacagatcatcaggtgccccgtctgtctcaaagacctggaggaagccgtacaactgaaatgtggctatgcatgttgtcttcaatgtcttaattctctccagaaagagccagatggggagggcctgttatgtagattttgctcagtggtctcacaaaaggacgacattaagccaaagtataagctgcgcgcattggtttcaatcattaaggaactggagcccaaattaaagtcagtgcttacaatgaatccgaggatgcggaagttccaggttgacatgacctttgacgtggacaccgctaacaactatctgatcattagtgaagatctccggagtttccggtctggagatctctctcagaatcgtaaagagcaggctgagaggtttgacacggctctgtgcgtgctcggcaccccccgattcacaagtggaaggcactattgggaggtggacgttggtacctcccaggtgtgggatgtgggcgtatgtaaagaaagcgtgaacaggcaaggtaaaattgtgttgtcttcggagcacggattcttaactgtgggttgtcgcgaggggaaagtttttgccgcttcaacggtgccgatgacccctctctgggtgtctccccaactccacagggtgggtatctttttggacgtgggcatgcggtcgatcgccttctacaatgtatctgacggctgccacatatacacatttattgaaattccagtgtgcgaaccttggcgccctttttttgcgcataagaggggctcgcaggatgaccaatccatcttatccatatgttccgtgatcaatccttcagcagcatcagcccctgtctccagcgaggggaaatag

SEQ ID NO: 59374 - DNA, 792 bp, Artificial Sequence
  Description of Artificial Sequence: Synthetic coding sequence
atggctaagcgcctccaggccgagctgagttgccccgtctgcctggacttcttctcctgttccatctccctgtcctgcactcatgttttttgcttcgactgtattcagcggtacattttagaaaaccacgacttcagggcaatgtgcccattatgccgagatgtggtaaaggtccctgcattggaggagtggcaagtgagcgtgctgacactgatgacaaaacaacacaatagtcggctcgagcagtcactgcacgtgagagaggagttgcggcatttccgcgaggacgtgacactggatgccgcaacagcctccagtctgctggtcttttccaacgatctccggagcgctcagtgcaagaagattcatcacgacctaacgaaggaccctcgtttagcgtgtgtgctcggcaccccctgtttttcttccggacagcactattgggaagtcgaagtgggagaagttaaaagttggtccctgggcgtgtgcaaagagccggctgatcgcaaatccaacgacctgtttcctgaacatggtttctggatctccatgaaggcaggggctatccatgccaacacacacctcgaaaggattcctgcctccccacggttgaggcgggtaggcatttttcttgatgccgacctcgaggaaatccagttctttgatgttgataacaacgtactcatatacactcatgatgggtttttctccttggaattgttatgccctttcttctgtctggagctgcttggcgagggggagtctggcaacgtactaaccatatgtccttag

SEQ ID NO: 59375 - DNA, 597 bp, Artificial Sequence
  Description of Artificial Sequence: Synthetic coding sequence
atgccactgtttggatggatgaagtggcctaagaacgacagttataagcctactcattaccctggcagtgatatcgtgactaagacactactccgggaattgaagtggcacttaaaggaaagagaacgcttaatccaggagattgaaaatgagcagaaggtcaagaagaccggcgtcgattacaattggctacgtaattaccaaaacccgcatacaactatccccgttacggagcagagacagcttgaggtcctgtgcagccaggtccagccgtgccagaccggtaccatactgagcagatttcgtgaagttctagcagagaatgatgtgctgccctgggagattgtctatatttttaagcaggtgctgaaggatttcctctcaagcagcgatagaggtagtgaacaggaagatctggaggactccggcagtatggattgcagcgccccatctgtgatccagggagattctagcaaaagggctgataaggacgagattcccacaatttcatcatacgtcgataaaaacactaaagacagattcccagttttcagccacagaatctggaacctgccctattatcacccctcctcctag

SEQ ID NO: 59376 - DNA, 4167 bp, Artificial Sequence
  Description of Artificial Sequence: Synthetic coding sequence
atgtccattcctctgcattccctgcgtttcaataataccatgcgtgaagagaacgtcgagccacaaaacaagcaaatggccttttgccgacctatgacggagacccgggctgacgtgcagatcctccactctcatgtgcaactgccaatcgtgagtacgtctgcctccgaccccggtggaacgagcacgcaattgatgacaagtccagtgttcgatacaatgtccgcccctctaatgggcgttcctaactcaggcgctctgtcaccgcctctcatgcccgcaagtgattctggtgcgctctccccattgctcatgccagcatccgactccggcgctctctctcccctcttgatgccggctctcgactctggaaccctctcccctcttctgtccacctccgaatatggcgtcatgagtcccggaatgatgacaatcccagactttggcacaatgagtgccactctcatggtggccccagattcagcagagattagccccttggcaatgccagcaccctccagcggggtagtgtgtaccccaatcatgagcacttcctccagcgaggccatgtccaccccactgatgctagctcctgactccggtgaactgagcccaatcctgatgcaggatatgaatccaggggtgatgtcgactcagcccgtgcctgctccaagctctgaggctatgtctccactacagattacagacgaagatacagaggcgatgagcaaagtgctgatgacagccctggcgtccggcgaaatatctagtctgctaatgagcgggaccgactctgaggctatcagcagcttgatcatgtcggccgttgcctcagggggaacatcccctcagcctacatccacacagaattcaggaggaattccgactccacttatgagtgatttggactcgggaatcatgagctcactgctcatgtcaagtcctgggtctgaagtcatgtctacccccttgctctctgtccccgacgcaggcgagatgagtactctgccaaagccggctcccgatgcagaagctatgagcccggctctgatgacagctctgccatcaggagttatgccaacccagactatgcctgctccgggttccggtgctatgagcccttggtcaacccagaacgtggatagtgagatgatgtctaacccaccagttagagccacagccagcggggtgatgtcggccccaccggttcgtgctttggactctggggctatgtctacgcccctgatgggggctccggcatccgggaatatgtcaactctgcagaagacggtccctgcttctggagcgatgacaaccagcctaatgactgttccatcgtccggagtaatgagcacagagcagatgagtgctacagcttccagggtgatgtccgcccagctgacaatggcaaagacctctggtgcgatgcccacaggatcgatgaaagccgtggctaaacagtacaagagagccactgcaagcggcaagatgtcaacacccctgcggcgtgccccaacttcaggagcaatgtcaacacagcccgtgaccgctacagcctctgaaactatgagcatgccacagctgaccgtcccagcaagtgggagcatgagcatgctgcagatgagggctcctgtcagtgaggctatgtcaatgcctcagatgcggactatggctagtggtctgaccagtgcagctcaaatgaaggctatgaccagtggcgcaatgtccacccccttgatgaccgctcaaacctccgggtcgactagtaccctgttaatgcgggatactgcgagcggagtcatgagctgtccgcaaatgagatcattggcttccggtgccctttcgaagccactgatgacgccaaaggcttcgggcactatgttcaccgagaagatgaccacgaccgcctccgaagccatgccaacactgttgatgcgcgataccgtgtcaggggctctctcaatgccgcaaatgacggatacggccagtgggggacttagcgccagtctgatgcgagataccgcttcaggagctatgtccacctcacaaatgacagctacagtgagcggcggaatgagcatgcctcttatgagggctcaagaccctggtgttatgccagccagcctgatgcgagctaaagtgtccggcaaaatgctgtctcaacccatgagtactcaggatcccggtggcatgtccatgtcaccaatgaagtccatgacagcgggtggcatgcaaatgaactcgcctactagcgatgtgatgtccacacctacagtccgcgcttggacctctgagactatgtctacacccctgatgaggacctccgatcccggagagcgccctagccttctgaccagagcttcctctagtggggagatgagcctcccgctgatgcgagcgccagcctccggcgagatcgcaactcctctgaggagcccagcatacggggctatgtctgctccacaaatgacagccacggcctcaggaatgatgtcatctatgccccaagtaaaggcgccaatcagcggtgccatgtccatgccccttacacgctccactgctagcggcggtatgagtatgccactgatgcgagctccagacagccgggtaacatctacctcccaaatgatgccaacggcatctggcgacatgtgcaccctgcctgtcagagcccctgcctccggcggtgtttcaagtcccttagttcgggcacccgcttcgggcactatgagcacaccccttcggcgacccagtgcctgtgagacagtgtctacagaactgatgagggcgagcgctagcggacatatgagcaccgcgcagacaaccgccatggtcagcggcggaatgtctaaaccgctgatgagagcacctgcttcaggaacgatgcccatgcccctaatgtctgctatggcttcaggggaaatgagcatgcctctgatggaaaccatggctagcggtgcgacctccactttgcaaacgagtgtggccaatagtaggagcatgtctctttcgcagaccacatatacggtgtccggtaggatggccactgctccaatccgagcgagtgcttctggagctcggtccacctcctttatgagggcgagcgtgagcggttccatgccgatgccactccccagggcaaccgcgtcaggatgcggcatgggaatgagtatgccccagatgaccgccactgacagtcgaggaatgtccactccccttatgcgagcctctggaccaggcaccatgtctaccccccagaccgcctttggggttatgtctacccccgagattaaggccacagactccggtgaggcatccacttctcacatcaatatcactgctagcggaagcaagcccacctcccacatgacagctacaactcccgagacagctaaacctccccctaaggaagtgccgtcttttggtatgctgactccagcactgtgttatctgcttgaggaacaagaggctgccagaggaagctgctctgttgaggaggagatggaaatcgatgaagagaagcagatgaaaggctttctggacgacagtgaaagaatggcatttttagtgtcgctccatctcggagcagcggaacggtggtttatcctccagatggaagttggtgagccactgtcccacgaaaacaagtccttcctcaggcggtcccaggggatttatgatagtttgagtgaaatagacattctgagcgcggtgttatgccacccaaaacagggccagaaatctgtgcggcagtatgctacagatttcctgctgctcgctagacacctcagttggtcagacgccatattacgaacccgattcctggagggtctaagtgaggcggtaacaacgaaaatggggaggatcttcctaaaggttgctggaagcctgaaggaactaatagatagatccctgtacaccgaatgtcaactcgctgaggaaaaggactctcctggaaattctagtcaagtgctgccaacggcctgcaagagaaacaatgaagaagccatgggaaatgagctgagctctcagcagcaaacggaggagcaccagcatgtgagcaagagatgttactacttaaaggagcatggcgacccacaggaagggctgcatgaccacctcggacagtcaaccggccatcaccaaaaagcccacacgaataagtag

SEQ ID NO: 59377 - DNA, 267 bp, Artificial Sequence
  Description of Artificial Sequence: Synthetic coding sequence
atgtctattcccttgcattcccttcgattcaataataccatgcgagaggaaaatgtcgagccccagaataagcagatggccttttgccgacctatgaccgagactagagccgacgtccaaatcctccacagtcacgttcagttgccaattgtgagtaccagtgctagtgatcctggcggaacgtcgacccagttgatgacctcacccgtgtttgacactatgtcagcacccctcatgggggtacccaattctggcgcattgagttag

SEQ ID NO: 59378 - DNA, 4167 bp, Artificial Sequence
  Description of Artificial Sequence: Synthetic coding sequence
atgagcatccctctgcatagcctaaggtttaacaacaccatgagggaggagaacgtggagccgcaaaacaagcagatggccttttgccgccctatgactgaaacaagggcggacgtacagatcctacattcacatgtgcaactccccattgtgtctactagtgcgagcgacccaggcggaaccagcacccagctgatgaccagtcccgtctttgatacaatgtccgcaccactcatgggagttccaaactctggagctctgagcccgcctctaatgcccgcttcagatagcggagcattaagtcctctactaatgcctgcaagtgatagcggggctctgtcccctctgctgatgcccgctctggattctgggacgttatcgccactgctgagtacttccgaatatggcgtaatgtctccgggtatgatgacaatcccggatttcggtactatgtccgccacgctgatggtggcaccagatagcgccgagatctcaccacttgcgatgcccgctccgtctagcggtgtcgtctgcacccccattatgtctactagttcttctgaggctatgagtacccctctgatgctcgcccctgacagcggggaattgagccctatccttatgcaagacatgaacccaggggtcatgtcaacccagccagtgccagctccctcaagtgaggccatgagcccactgcaaatcaccgacgaagatactgaggctatgtctaaggtccttatgaccgcgttggcctcaggcgagatcagcagcctgctcatgagtggcacagatagcgaggccatctcatctctgattatgagtgcagtcgcaagcggcggaacttcaccccagcctacttctactcagaatagtggcggaattcctacccctctgatgtccgatctcgattctggcatcatgtccagcctactaatgtctagccccggaagtgaagtcatgtccacaccactcttgtccgtgccagacgccggtgagatgagcaccctgcctaaaccagcgcctgacgcagaggcaatgagccccgctctgatgacagcccttccctcaggggtcatgcctactcagactatgccagccccagggagcggggctatgtccccttggtctacccagaatgtggactctgaaatgatgtccaacccacctgtccgggcaactgcgagcggggtgatgtccgctcctccagttagggccctggactctggggcaatgtcgacccccctcatgggtgcacccgcatctggcaacatgagcacgcttcagaagactgtgccagcaagcggagctatgacaacgtccctgatgaccgttcctagctctggggtgatgtccaccgagcagatgtccgctaccgcatcacgagtcatgagcgctcagctgacaatggcgaaaacctctggtgccatgccaactgggtcaatgaaggccgtggccaaacagtataagagagcgaccgccagcggcaagatgtctacaccacttaggcgtgctccaacctcaggggctatgtccacccaaccggtgaccgccacagcgagcgaaactatgtctatgccgcaactcacagtgcccgctagtggctctatgtctatgctccaaatgagagcccctgtttcagaggcaatgagcatgcctcagatgcgcaccatggcctctggactgacatccgccgctcagatgaaagcaatgacctctggggctatgtcgaccccactcatgaccgcccagacttccggatccacatctacactgctgatgagagataccgcttccggcgtaatgtcgtgcccacagatgagatctctcgcttctggcgctctgtccaaacccctgatgactcctaaggcttccgggactatgttcaccgaaaagatgacaacaactgccagtgaagctatgccaacccttctgatgcgagataccgtgtccggcgctctgagcatgcctcagatgacagacactgcttctggcggattgtctgccagtttaatgcgggacaccgcatctggcgctatgtccacaagccagatgacagcaacggtctctggtgggatgtccatgccattgatgcgtgcacaggaccccggagtcatgcctgccagtctgatgagagcaaaagtgtccgggaaaatgctgtcacagcctatgtccacccaggaccctggtggcatgagcatgagtccaatgaaatctatgaccgccggagggatgcagatgaactcacctacctccgatgtcatgagcactccaaccgtgagggcctggacgtctgagacgatgtcaactcctctgatgcgaaccagcgaccctggcgaacgtccgtctctgctcaccagagcttcttctagtggagagatgtcactgccgcttatgagggcgcctgcctccggcgagattgctacacctctgaggtcaccagcctatggcgcaatgagcgccccacagatgaccgccaccgcaagtggaatgatgtcctcaatgccacaggtgaaagccccaatctccggtgctatgagtatgccactgactagatctacagcttccggcggtatgagcatgcctctcatgcgggcaccagattcaagggttaccagcacatcccagatgatgcctacagcctcaggggatatgtgcacactcccagtgcgggctcccgcatctggcggtgttagctccccgctggtcagggcccctgcctcaggaacgatgtctactcccctgcgaagaccatcagcatgcgagacggtatctacagaactgatgagggcctccgcctcaggccatatgtccactgcccaaacaacggcaatggtaagtggagggatgtccaaacccctgatgcgtgccccagccagcgggaccatgccaatgccattaatgagtgccatggccagcggagaaatgtcaatgcccttgatggagaccatggccagcggtgcgactagtacactgcagactagtgtggccaattcacggagtatgagtttatctcagacaacttacactgttagtggaagaatggccacagctcctatcagggcatctgcaagcggggcaagaagtacatccttcatgcgggcatccgtgtccggcagtatgcccatgcctctgccccgagctacagcaagcggatgcggtatgggcatgagtatgcctcagatgaccgcgactgacagtagaggaatgtccacccctcttatgcgtgcctcaggtcccggaacaatgagcaccccacaaactgcattcggcgtgatgtctacccccgagatcaaggctaccgacagcggcgaagccagcacctcccacatcaatatcaccgccagcgggagcaagcccacaagccacatgaccgcaacaacaccagaaactgcgaaaccccctcctaaagaagtgccaagctttggaatgctcaccccagctctgtgctatttgcttgaggaacaggaggcagctagggggagctgttctgtggaggaggaaatggaaatagacgaagagaaacaaatgaagggctttcttgatgattccgaaaggatggccttcttggtaagcctgcacctcggcgcagccgaacgatggtttatcttgcagatggaggtgggcgagcccctgagccacgagaacaaaagcttccttcgtcggagccagggcatctatgattccttgtctgagattgacatcctgagtgccgtactctgccaccccaaacagggtcagaaatcggttcgccagtacgccacagacttcctgcttctggcaaggcacctgagttggagcgatgcgatcctcagaacgcggtttctcgagggactgagcgaggctgtgaccacaaaaatgggcagaattttcctaaaagtggctggctccctgaaggagctgatcgatcggagtctgtataccgagtgtcagctggctgaggaaaaagattcgcccggaaattcaagccaggtgctacccaccgcctgcaaacgcaataacgaggaggcaatgggaaacgagctctccagccaacagcaaacagaggaacatcaacacgtgtctaaacgctgttactaccttaaggagcacggagatccgcaggaagggctgcatgaccacctcgggcagagtaccgggcatcaccagaaggcccacaccaacaagtag

SEQ ID NO: 59379 - DNA, 2850 bp, Artificial Sequence
  Description of Artificial Sequence: Synthetic coding sequence
atgtctatcccgttacactctttgcggttcaataatactatgcgtgaagagaatgttgaaccacagaacaagcagatggccttctgtcgacctatgacagaaacaagggccgacgtccaaattttacactcccacgtccagttacctatcgtgtcgaccagcgccagtgacccagggggtacctcgacacagctcatgacctctcccgtgttcgacactatgagtgcccctcttatgggcgtgccaaactccggcgcactgagccccccattgatgccagcctcagatagtggggcacttagtccacttctgatgcctgccagcgactcaggggcacttagcccgctgctaatgcccgctctggattcgggtaccctcagccctctgctgtcgaccagtgagtatggtgtgatgagcccaggtatgatgacaatccccgacttcggtactatgtctgcaaccctgatggtcgccccagactctgcggaaattagcccattggccatgcccgcaccttcctcaggagtggtgtgtacgcccattatgtctacctcttcgagcgaggcaatgtccactccactgatgctagcccctgactcaggagagctcagccccattcttatgcaagatatgaacccaggagtcatgtccacgcagccagtcccagcgccaagctccgaggctatgtcaccactgcagatcacagatgaagacaccgaagcgatgagtaaggtcctcatgacagcattggcatcaggcgaaatctcctcactgctgatgagcggcaccgactcagaggccatcagcagcctcatcatgtctgccgtcgcatccggcggtacgtccccccagccgacttccacacagaatagcggaggcatccctacaccactgatgagtgacctggacagcggtattatgtccagcctgctgatgagcagtcccggatccgaggtcatgtcaacaccccttttgagcgtacccgacgctggagagatgtcgacgctccccaaaccagcccctgatgcagaagccatgagccccgcactgatgaccgccttgccctccggcgttatgcctactcaaaccatgcccgctcctggatcaggagccatgtccccttggtctacccagaatgtagattctgagatgatgagtaaccccccagtgagagcaaccgcttccggcgtgatgagcgcacctcctgtgagagccttggattctggagcaatgagtacccctttgatgggggctcctgctagtggaaatatgtctaccctccagaagaccgttccagccagtggcgcaatgaccacctccctgatgacagtgccctcgtctggggtcatgtcaaccgagcagatgagtgcaacagcctctcgggtaatgtctgctcagctgaccatggccaaaacatcaggtgccatgccaaccggcagcatgaaggcggtggcaaaacaatataaacgcgctactgcttcaggaaagatgagtaccccacttaggagggctccaacgtctggggcaatgtcaacccaacctgtcacagctacggcctccgagacaatgtcaatgccgcagctcacggtccctgccagcgggagtatgagtatgttgcagatgcgcgctcctgtgagtgaggcgacctccacactccagacgtctgtggctaattccagatctatgtctctcagccagacaacatatacagtatcaggccgtatggctactgccccaattagagcctcagcatcaggggcacgctcaacatcatttatgagggcatctgtctccgggtctatgccaatgcctctgccacgggctaccgcctccggatgtggaatgggcatgagcatgccccagatgaccgccaccgattctcgaggaatgagcacaccccttatgcgcgctagcggtcctggaaccatgtccaccccgcagaccgcgtttggggttatgagtacacccgagatcaaagccaccgacagtggggaggccagcacttcccatattaatattactgcatcaggtagcaaacccaccagtcacatgacggctactacacctgaaacggcaaaaccacctcctaaagaggtccccagctttggcatgctcactccagcgttatgttaccttctggaggagcaggaggcagcccgtggaagttgttcggttgaagaggaaatggagatcgacgaggagaaacaaatgaaaggtttcctggacgacagtgagagaatggctttcctagtgagcctacacctcggcgcagccgagcgatggtttattttgcagatggaagtgggggaacctttatctcatgaaaacaaaagttttcttagaagatcccagggcatctatgacagtctgagcgagattgatatcctctctgccgtcctgtgccacccgaagcagggtcaaaaaagcgtgcgccagtacgccactgactttcttcttctggcacgccatctctcctggagtgatgcgatccttcgaactcggttcctggaaggactgagtgaagccgtgacaacgaagatgggcagaatcttcctgaaggttgctggtagtcttaaggaactcattgatagaagtctgtacactgaatgtcagcttgctgaggaaaaggattcccccggaaattccagtcaggtcttacccacagcctgcaaacgcaacaacgaagaggccatggggaatgagcttagctcacagcagcagacagaagaacatcaacatgtatctaagcgctgttattacctcaaggaacacggggatccacaagaggggctgcacgaccatctgggccagtccaccggccaccaccagaaagcccacactaacaaatag

SEQ ID NO: 59380 - DNA, 1710 bp, Artificial Sequence
  Description of Artificial Sequence: Synthetic coding sequence
atgtcagaggcatcagggaatctgaactctctgaggatggcaaacgtggctctccgagaggaactcaacgcactgcgcggagaaaacgctaatttagggctgcagctcgggagggctctagccgaggtgaatagcctacgcggaaacgtgagtagttacatcaggtggcccgttccaatagtcccagtcttggccgaagagaacctggagttcgccctaagcgaaattgaggttattccgggtggcgagctcccattcttatgcagacctccacccagggcagagccagattgtatcagcgacgaccttctgatcaacgtcattcaagaccgctccaccccagatggccctgctgaccctccattactgcccatcccacctcctccggctctccctccacccgcttctaaggaaccccctcctcagccaccactggcccctctggagcgccctgagatagaacctttctccggtgacccagtctatttggctgagtttctcatgcaactcgagacgttcatcgcggatcacgaagttcactttcctggaggagccgaacgagttgcgttcttgatcagcttcttcacgggagaagccaaggattgggccatctctgtgacacaggagggctccccactgcacgccaatttccctaggttcctggatgagatcaggaaggagttttgtggaccgattccacctcgcgttgctaaaaaggctatccgcaagcttaagcagggacattgcaccctcggtagctatgcagatgcttttcagttcctcgctcaatttctgagttgggacgactgcaggctgcagaatcagtttctgaaggggctgagtgagttttttaggaaggagctgctatggtctactgaaatggctgatctggatgaacttatcctcgagtgcgtagaaatagagaggaaggtgagagtgcccaagcctatccctttaccaggagttaggaacatcatctttccttttgctccctccccaaacgaagaagaaagcgaagatgaggagtactatagcgaggacgaagaccaggaggccagaaggcaccgactgcactctaaggatcaacgcaagcgcatgcgtgcctttcagcaagaaatgaaggagaaggaggaggaagagatgaaaaaagaggaagagatgaaaaagaaggaggagaaggaagaagaagaagaggaggaaatgaagcagaaggaagaagaagaggaaatcagaaacaagaatgaggaggaaggcgagtctaaggatgaagaagatgaagacgaggatggtggacagaaacctgagggggagccacaacaggatccagggacagaggagacatatggtgaggtagaggaagagccactggacgaggcccaggatgacgatctcgatgagctgatggaaatggagccaaccttcgtgcatgccagtagccaaacctctgggcctacttctgggtaccatgccgagaattttttgggagcgtcccctcctatcattcagcctagcaggaggcgaaaccagaatagggtgccactactggagggcctgccaggtacaaatagccccttttacagctcgcctcagttgatccggagaaccggaagattgggtcaacgccaggttagaaggaggccccctgtacttttcaggctgactccacgccagggcggacaccgggcagctaggggcagaattcgggtgtag

SEQ ID NO: 59381 - DNA, 1710 bp, Artificial Sequence
  Description of Artificial Sequence: Synthetic coding sequence
atgagcgaggcctcagggaacctgaattctcttcgaatggcaaacgtcgctctcagggaggagcttaacgcgctgaggggggagaatgcaaatctcggcctacagttaggccgagcactagcagaggtgaacagtcttcgaggaaatgtctcctcttatatccgctggccggtccctatcgtacctgtgctggctgaagagaatctggagtttgccttgagtgaaatcgaagtgatcccgggtggagagttacctttcttgtgtaggccacctccacgtgcggagcctgattgcatttccgacgacctgctcattaatgtgatacaggataggagtacccccgacggcccagccgacccaccactccttcctatcccaccgcctccagccttacccccaccagcctccaaagagccccctccccagcctcctctggcgccactggagcggcctgaaatcgagcctttctccggcgacccagtatacctggcggagtttcttatgcagctcgagacctttatcgccgaccacgaagtgcattttcccggaggtgccgaacgtgtggctttcctaatcagcttcttcacgggagaagcaaaggactgggcaatctctgtgacgcaagaaggtagtcccttgcacgctaattttccccgatttttggacgaaatcaggaaggagttctgtgggccaatacctccacgtgttgcaaaaaaagcaattcgcaaactcaaacagggccattgcaccctgggctcttacgcagacgcttttcagttccttgcccagtttctgagctgggatgattgtcggctccagaaccaatttttgaaggggctctccgaattttttagaaaagagttgctttggagcacagaaatggcggatttggatgaattgatcctcgaatgcgttgagattgaaaggaaagtgcgtgtccctaagccgattcctctgcccggagtcaggaacattattttcccctttgccccttcccctaacgaggaggagagtgaagacgaggagtattatagtgaggacgaagatcaggaggccagaaggcataggctccactcaaaggaccagcggaagaggatgcgggcttttcagcaggaaatgaaggagaaggaagaggaggagatgaagaaggaggaggagatgaaaaagaaagaagagaaagaggaggaagaggaagaagagatgaaacagaaggaggaagaggaggagattagaaataaaaatgaagaggagggcgaaagcaaggatgaggaggatgaggacgaagacggcggacagaagcctgagggggagccccaacaggacccgggtaccgaggagacctatggggaagtggaggaggaacccttggacgaggctcaggatgacgacctggatgaactcatggagatggagcccacttttgttcacgcaagcagccagactagcggtcctacatctggatatcacgccgagaactttctgggggctagtcctccaataatccagccttcacgcagacgcaatcagaatcgcgtgcccctcctggaaggcctcccgggaacgaacagtcctttctactcctctccacagctaattagaagaaccggccgtttgggtcagcggcaggttcgtcgccgtccgcctgtcctgtttcgtctgaccccaagacaaggtggtcacagagcggctcggggaaggatccgcgtatag

SEQ ID NO: 59382 - DNA, 2028 bp, Artificial Sequence
  Description of Artificial Sequence: Synthetic coding sequence
atgctgagggccacagcaccctgctggtttccccctggctacccagaagccaagaaggtcgctgaggaggcagctctagaggcctcaagacacctggggggagagcagtcccaagcaggagctcctgaagggtccaaaatgctgagagcaaccgccccttgttggtttcggccaggttatcctgaggctaagaaggtggccaaggaggctgctcctgaagcctccagacatttgggggctgagcaaagccccgcaggcgcaccagaggggtctaaaatgctgcgggctaccgcaccctgctggttccctcccggatatccagaggcgaagaaggttgccgaggaggcggctctggaagcccctgagttccctctcccatctcaccaaccagcccagtctttcggactctgggtacctcagatgcataagcaggccagcgcattcgtggatatccaggccgagccccagaaccgaggtcctgcagtgcctccagcctggcccaagatggtcacggagtcttgttactttccagcgcaacggggttcagcatgtaggctgccggcagcccctaggcttactgagagaccatctggggtacgcatctccgctcctcgaaagcggaaaaccatcgcccatagcagctccccatgtctggtgacaggctacactgacgccaagagaaccagagtagcatctagctcccagcgctctcgtggttccaaagtcggtcgccagcccggaaagacacggaaccgatcaggaatggcttgcaaaacaactgcgacgacatctagtaagagaatagtgcggagggcaagcctcccttccctgtccctgaagaagcctattatcctgcgcagcagtggttgtcaggtacccactgtgctgcgcaggggctacctgcagctctttacagaggaatgtcttaaattctgtgcatccaagcaggaggcggaagaaaaggctttgaatgaggagaaggtcgcatacgactgttctccgaacaaaaacaggtacctgaacgtagttcttaatactctgaaaagattaaagggcctaaccccgtcttctatgcccggactgagtagagctgccctctactccagactgcaagagtttctactgacgcaggatcagctgaaagaaaacggctaccccttcccacacccagagcgtcccggaggcgctgtacttttcaccggacagggcaaaggcccaggggactcttcttgtagagtgtgttgcagatgcggaactgaatatctcgtgagcagtagcgggcgatgcgttagagatcagctatgttattatcattgggggagggttagatctagtcaggtcgccggtggccgagtgagccagtatacatgctgcgctgctgccccaggctcggtggggtgccaggtggccaaacagcatgtgcgcgacggcagaaaggaatccctggatggctttgtggagaccttcaagaaggagctttctagggacgcttaccccggtatttatgccttggattgcgaaatgtgctacaccactcatggacttgagttgaccagggtgactgtcgtcgatgccgacatgcgtgtcgtgtacgacacattcgtgaagccggacaatgagatagtcgactataacaccagattttctggagtgacggaggccgacgtggcaaaaacttcaattacactaccccaggttcaggcaatcctgctctcattcttctccgctcaaacaatactgatcggccacagcttagaatccgatctgctggcactgaagttgattcatagtacagtggtcgacacggcagttctctttccacattacctcggcttcccttacaaaaggtcactacggaaccttgcagccgactatctggcccaaattattcaggattcacaggatggacacaactccagcgaagacgctaatgcctgcctccagttggtgatgtggaaggttcggcagcgcgcacagatccagcccaggcaccgcagcgcatcgcctgctgccctcgcatgcccatag

SEQ ID NO: 59383 - DNA, 2028 bp, Artificial Sequence
  Description of Artificial Sequence: Synthetic coding sequence
atgctgagggcaacagccccatgttggtttccgccaggctatccagaggccaagaaggttgccgaggaagccgcattggaggccagcaggcacctggggggagagcaatcccaggcaggggctccagaagggtcgaaaatgctgcgggcaacagccccatgttggttccggcctggatatccagaagctaagaaggtggccaaagaagcagcacccgaggccagtagacacctcggagccgaacagtctccagcaggagcaccagagggctccaagatgcttagagcaaccgccccttgctggtttccacctgggtaccctgaggctaaaaaagtggccgaggaggcagctctggaggcaccggaattccccctcccctctcatcagcccgcacagtcatttggtttgtgggtgcctcagatgcacaaacaggcaagtgctttcgtggacattcaggccgagcctcagaatagaggacctgcagtccctccggcatggcctaagatggttactgagtcctgctactttcccgcacaaaggggaagcgcatgtcggctccccgctgcccctcgtcttacagaaagaccgtccggcgtgagaatttctgctccgcgaaagagaaaaacaatagctcactcctcgtctccgtgcctggtgactggttataccgatgccaagagaactcgggtggcttcttcaagccagcggtctcggggaagtaaagtgggcagacagccaggaaagactcggaaccggtccgggatggcatgtaaaactaccgcaacaacttccagcaagagaatcgtgcgcagggctagtctccccagtcttagcctgaaaaagcccattatccttcgatcaagcggatgccaagttcccaccgttttgcggagaggctacctgcaactattcacagaggagtgcttaaaattctgcgcaagtaaacaggaggccgaggaaaaggcacttaatgaggagaaggtggcatacgactgctccccgaataaaaataggtatctcaatgtagtgctaaataccctgaagcggttgaagggccttaccccttcctccatgccaggattgtcgcgcgctgccctgtacagcagactacaggaattcctcttaacccaggatcagcttaaggagaatgggtacccctttccccatccagaaaggcctgggggagccgtgctcttcaccggtcagggcaaggggccaggtgatagcagctgtcgggtctgctgtaggtgcggtaccgaatatttggtgtcttccagtgggcgatgtgtaagagaccagttatgctactaccactgggggagggtgcgctcctcacaggttgcagggggacgcgtgagccaatatacatgctgcgccgctgctcccggaagcgtggggtgtcaggtagctaaacagcacgtgagggacggccgaaaggagtctttagatggtttcgtggagacattcaagaaggagctcagccgcgacgcttatcccggaatctacgcgctggactgcgaaatgtgctacacaacccacgggctcgaactgactcgggtaactgtggtcgatgccgacatgcgggtggtttacgatacattcgtgaagccagataacgagattgtggattataacacacgctttagtggggtcactgaagccgatgtcgccaagactagcattaccctgccacaggtgcaggcgattttactgtcattcttctccgctcagaccattcttattggacacagcctcgagtctgatctgttggctttaaaactgatccacagcacagtcgtggatacggctgtgctgtttcctcactacctgggatttccgtacaagcggtctctgcgcaatctggccgcagactaccttgcccagatcatccaggatagtcaggacggccacaatagcagcgaagacgcaaatgcatgcctgcaactggtgatgtggaaggtccgtcagcgagcccaaatccaaccgcgtcatagatctgccagtccggcagcactggcgtgtccttag

SEQ ID NO: 59384 - DNA, 3864 bp, Artificial Sequence
  Description of Artificial Sequence: Synthetic coding sequence
atggtagccaggtcaacagattctttggatggccctggagaagggagcgtacagccgctgccgactgccggtggaccaagcgtcaaaggtaagccaggcaagaggctttcagcccctcggggaccatttccacgcctggcggactgtgcacattttcattacgaaaatgttgatttcggccacatccaactgctgctgagtcctgacagggaagggccatctctgtccggggagaatgaactggtgttcggtgttcaggttacatgtcaggggaggagctggccagtcttgcggtcctatgacgacttcagatcactggatgctcatcttcatcggtgtatttttgacagaagattttcctgcctccccgaactgccccctcccccagaaggcgctagagctgcacagatgctcgtgcctttgttgcttcagtatctcgagaccttatcaggcctcgtggattcgaaccttaactgcggacctgtgctgacatggatggaactcgataaccacggcaggcgtctacttctcagtgaggaggcaagcctgaacatcccggctgtggcggcagcccatgtcataaaaaggtacaccgcccaggcgccagatgaactatcctttgaggtgggtgacattgtgtctgtcatagacatgcccccaacagaggacaggtcctggtggagggggaaacgcggattccaggtggggttcttcccctccgagtgcgtggagctcttcacggaacggcctggaccaggtttgaaagccgacgcggacggacccccttgcggcatcccagctccacagggaattagctcactgacaagcgcagtccccagaccaagaggaaagttggccggactgttgcggacttttatgcgatcgcgcccttccaggcaacgcctgaggcagcgagggatccttcggcagcgggtgttcgggtgtgatttgggtgaacacctgagcaactcaggacaggacgtgccacaggtgctacgatgttgtagcgagtttattgaagcacacggagtcgtagatggtatatatcgactatccggcgtttcatcaaacattcaacggctacggcacgagtttgactccgagcgaatcccagagttgtcaggcccagcctttttgcaggacatccacagcgtgtcgagcctgtgtaaactgtacttccgcgagctgccaaaccctctattgacatatcagctgtacggtaaatttagtgaagcaatgtccgttccaggcgaggaggagcggttggtgagggtgcacgacgttatccaacagctacctccaccacattaccgcacccttgagtacctcctcaggcatctggcccgtatggccaggcactctgcaaacactagtatgcacgccaggaacctggcgattgtgtgggcccctaatctgctgagatctatggaactggagtctgtgggcatgggaggcgctgccgcattcagagaggtgagagtgcaatcggtggtggtcgagtttttactgacccatgtcgatgtgcttttctccgacaccttcacttccgcgggactcgatcccgcagggcgatgcctgttacctagacccaaatctctcgccggttcatgcccaagcacacgcctgcttactctggaggaggcccaggcacgaactcaggggagattggggacaccgactgaacctaccacacctaaagcccctgcatcgcccgctgagaggcgaaaaggagagcgaggcgaaaaacagcggaagcccggtggctccagctggaagacattttttgcactgggacgcggtccatccgtccctagaaagaagccgttaccctggttgggaggcacgagagcccctccacaaccttctggcagcaggcccgatactgtgaccctcagaagcgccaaaagtgaggaatccctatccagccaggccagcggggcaggtttacaaaggcttcatcgcttgcggagaccccacagctcttcggacgccttccccgtgggaccagcccctgcaggctcttgcgagtcactatcatcatcctcgtcaagcgaaagttcttcgagtgagagtagttctagctcatccgagagctctgccgcagggctgggggcactatcaggatccccctctcacaggacgtcagcgtggctggacgatggcgacgagttagatttctctccacctagatgtctcgaaggcctgcgcggtctggatttcgacccactgacgttcaggtgctcttctccaaccccaggagatccagccccacctgcctcacccgcaccacccgcaccagcttccgccttccctccgagggtgactccacaagctatttcacctaggggcccaacgtcaccagctagtccggctgctctagacattagcgaaccgctggccgtcagcgtgcccccagccgtactggagcttctgggagccggaggcgcacctgcgagcgccactcccacgcccgctctatcgcccggacggtccctgaggccgcacctgataccacttctgttgcgtggagccgaagcccctttgaccgacgcttgtcaacaagagatgtgtagtaaactccgcggtgcgcagggaccactaggacctgatatggaatctcccctccccccaccccctctgtccctgctgaggccaggcggagcccctcctcctccacccaaaaacccagcaagactcatggcgctcgcgctggcggaacgcgcacagcaggtggcggaacagcaatcacagcaagaatgcgggggtacaccacccgcttcccagagtccattccatagatctctgagtctcgaagtgggaggagagccactgggcacttccggaagcgggcctcccccaaattccctagcacaccctggggcttgggtgcccggaccacccccttatttgcccaggcagcagagcgatggaagtttgctgcggagtcagagacctatgggaacgtccagacgcggacttaggggaccagcccaggtatcggcgcagcttcgggctggcggtgggggtcgcgacgccccagaagctgcagcccagtcaccctgctccgtgccttcccaggtccccacccccggattcttttcacctgccccaagggagtgcttacctcccttcctgggagtacccaagccaggattgtaccccttgggtcctcccagctttcagccctctagccccgctccagtgtggcgctcatctttgggcccacccgcaccccttgaccgcggagagaacctgtattatgagataggggcttctgagggcagtccatattctggccctaccaggagttggtctccttttagatctatgcctcctgaccgccttaatgcctcgtatgggatgctcgggcaaagccctccgctgcatcggagccctgatttcctgctgagttatcctcccgcaccaagctgtttcccccctgaccaccttgggtacagtgctccacagcacccggctagacgtccaacccctccagaacccttgtatgtgaatctggcattaggcccaagaggcccaagtcccgctagttccagctccagcagccctcccgcacatccgcgaagtcgaagcgatccaggcccaccagtgcccaggctgcctcagaagcagcgggctccttggggaccccgaactccacatcgtgtcccaggcccttggggccctcctgagcctctcctcctctatagggctgctcccccagcgtatggccgagggggagagctgcaccgaggaagcctgtaccggaatggcggacagaggggggaaggagccggtcctccacctccctatccaaccccttcatggtctctgcacagcgagggacagacccgctcgtactgctag

SEQ ID NO: 59385 - DNA, 2604 bp, Artificial Sequence
  Description of Artificial Sequence: Synthetic coding sequence
atgcggtccaggtctccccctcgccctaagtggcattcccgcgatggtagttcccagagcgactccggcgaagagcagtcccgtggccagtgggcaagaaggcggagacgggcaaggtcttggtccccttctagctccgcaagttcatccgcttctccaggcaggtcacagagcccacgcgcagccgcagcggctctcagccagcagcagagtctccaggagaggctgaggctcagagaggagcggaagcagcaggaagaactcatgaaagcattcgagacaccagaagagaagcgggcaagaagactcgcgaagaaagaagccaaggagcggaaaaagagagagaagatgggttggggggaggagtatatgggatacacaaacaccgacaacccctttggcgacaacaatctattgggaacttttatctggaacaaagccctggagaagaagggcattagtcacctggaggaaaaggaactcaaagagagaaacaaacgtattcaggaggacaacaggcttgagttacagaaggttaagcaactgcggctggagcgggagcgggaaaaggccatgcgcgaacaggaactggaaatgctgcagagagaaaaggaggctgaacacttcaagacatgggaagagcaggaggataatttccatcttcagcaggccaagctgcggagtaagatcaggataagagacggtcgtgctaagcccatcgaccttttggcaaagtacatttccgctgaggatgacgaccttgccgtcgaaatgcatgagccttacacttttcttaatggcctgacagtggccgacatggaggatctccttgaggacatacaggtgtacatggagctggaacaggggaagaacgcggacttctggagagatatgacaactattaccgaagacgagatcagtaaactgcgcaagctggaggccagcggtaagggacccggagagcgacgagagggtgtcaatgctagcgtcagtagcgacgtacagtccgtgtttaaggggaagacctacaaccagctgcaggtcatcttccagggtatagaagggaagattcgagccggagggcctaatctggacatgggctactgggagagtctcctgcaacagttaagagctcacatggctagagccaggcttagagagagacaccaggatgtgttgcgccagaaactgtacaagttgaaacaggaacagggagtggagagtgagcctctctttcctattctgaagcaggagcctcagagccccagtagaagtctggagcctgaagatgcagcccctactccacccggaccttcctctgaaggcggtccagctgaagctgaagtggatggtgccactcctacggagggagatggcgatggcgatggggagggagagggggaaggcgaagctgtgctgatggaggaggatcttatccagcagtctttagatgattacgacgcgggaagatactcaccacgcctgctcactgcgcatgagctgccactggacgcacacgtcttggagcctgatgaagatctgcagcggttgcagctcagcagacagcagttgcaggttaccggggacgcttccgagtctgcagaggacatctttttccgccgagccaaggagggcatgggccaggacgaggcgcagttctcagtggagatgcctctgaccggcaaagcttatctgtgggccgacaagtatcgtccacgcaagccgaggttctttaatagggtacatactggctttgagtggaataaatataatcagacccactacgactttgataacccaccacccaagatcgtgcaaggttacaagttcaacatcttctacccagaccttattgacaaacgcagcacccctgaatattttctggaagcctgcgccgacaataaggacttcgcgattctacgattccacgccggaccaccatatgaagatatcgccttcaagattgtcaaccgagagtgggagtattcccatcgtcacggttttagatgtcagttcgcgaatggaatttttcagctgtggttccactttaaacgataccgctaccgaagacccggtccgtgctggcggcctattcggcattgtcgtcgtgatccattatggactccaacactttgtagagattggccccctacacatcccgtgctcgcaggaggggtccatttccctgctgccggtatcccccctcccggtctactcaccgggccttggtctatgcggccagtgacaccaagcttcgcccacatcaggacggtggccccaagtcacagtccgttttcaggccaagaggggcgtggacctcacgggtgccactcgccaggaagatccggacccgcaggcagacttgtgctgcagcatcccacagggacctcccctacggaggcaaagcggaaggttccccctggaccacccgagggccatcctacctcgccggtgacatcaccgcgacctcccacagctccccctcgccacccagccagctctggaaatagctccgtatgctttagtaaaaaaacttgccggtgggaaaaaaagtcattcgtcctgatggaactcgcttattggcaagaccgcatgtttttctag

SEQ ID NO: 59386 - DNA, 3381 bp, Artificial Sequence
  Description of Artificial Sequence: Synthetic coding sequence
atggtggccagatctacagattcgctggatggacctggtgagggcagtgtgcaaccgctgcccaccgcagggggaccatccgtgaaggggaagccaggtaagcggctgagtgcacccaggggacctttccctcgattggctgactgcgctcacttccactacgaaaatgtcgactttggacacatacagcttttgctaagtccagatagggaaggaccctccctgagcggtgaaaacgagctggttttcggcgtgcaggtgacatgtcagggcagatcatggccggtgctcagatcgtacgacgacttccgctcactggacgcgcacctgcatagatgcattttcgaccgaaggttctcctgcttaccggagctgccacccccaccagagggggcacgggcagcgcagatgctcgtgccactcctgctgcagtatttggagacactgtctgggttagtggattcaaacttgaattgtggcccagtcctcacctggatggagctggataaccatggacgccgacttctgctcagtgaagaggcctccttgaacattccagccgtggctgccgctcacgtgatcaagcgatacaccgcacaagcccctgatgaactatcatttgaagtaggagatatcgtgtcggtgatcgatatgcccccaacagaggatcgatcatggtggaggggaaaacgcggttttcaggtggggttttttccgtctgagtgcgttgagctgttcaccgaacggccaggcccaggcttgaaggcagatgccgacggtcctccttgcggcatccccgctccccagggtatttcttccctgacctcagcagtgccaagacccagaggcaagctagccggtctgttgaggacatttatgcggagtcgtcctagccggcaacgattgaggcaacgtggcatcctgagacagagggtattcggttgtgatcttggcgaacatcttagtaacagtggccaggacgtcccccaggttctccggtgctgctccgagttcatcgaggcacatggggtggtggacgggatctaccgactttcaggcgtctcttctaacatccagcggctgcgccacgaattcgactccgagcggatacccgaactgtccggaccggcatttctccaggacatccatagcgtatccagcttatgtaagctctatttccgagagttgcctaaccctctgctgacgtaccagctttacggcaagttcagcgaggcaatgtccgtgcctggggaagaggaaaggttggtgcgggtgcatgatgtgatacagcaattgccaccaccgcactatcggacccttgagtatctgttacggcatttggctagaatggcacgccatagtgccaatacgtccatgcacgcaagaaatctggccattgtgtgggcccctaatctcttgagatccatggagctggagtccgtgggaatgggaggagccgcagcattccgggaggtacgggtacaatcagttgtggtggagtttttactgacccacgtggatgtcctcttcagcgatacatttacgtcagcaggccttgaccccgcagggcgttgcttattgcctagacccaagtccctagccggatcctgcccatcaactagacttctgaccctggaagaagcacaggcacgtactcagggacggctgggcacacctacagaaccaacgactccaaaggcccctgcctctccagctgaacgtcggaaaggcgaacggggtgaaaaacagcgcaagcccggaggtagcagttggaagacattcttcgccttggggaggggccctagtgtcccacgcaaaaagcctctgccatggttaggtggtactagggcccctccccaaccctccgggtccaggcccgacacagttacattaagatccgcgaagtccgaagagtcattaagctcgcaggcaagcggagccgagttactcggagcaggcggtgcacctgcctcagcgacccctactcctgcgctgtctccaggtcgaagccttcgacctcatttgatccccctgctactgcggggagctgaagcacccctgactgatgcctgtcagcaggagatgtgttctaagctgcggggagcacaaggcccactgggaccggacatggaatcacctctgcctccgcctcctctttcattgctgcgcccaggcggagccccaccacccccacctaaaaacccagccagactgatggctctggcattggcagagcgggcacagcaagttgcagaacaacagagtcagcaagagtgcggtggtactccacccgctagtcagagcccgtttcataggtcactatctctcgaagtagggggagagccccttggtacctctggatctggtccacctcctaattctttggcccatcccggagcttgggtgcctggtcctccaccttacctgccgagacagcaatccgatggttctctactgagatcccaaagacccatgggaacatcaagaagggggcttcgaggcccagcacaggtgagtgctcagctccgagctggcggagggggacgcgatgcgccagaagcagctgcccagagcccttgctccgtgccctcccaggtgcccacaccaggatttttcagtcccgctcctcgcgagtgccttcctccattcctgggggtccctaagccaggcctctacccgctgggtcctcccagcttccagccttcctctcccgcacctgtatggcggtcaagcttgggccctcccgcacctttggaccggggtgagaatctatattacgagataggggctagcgaaggctctccgtacagcgggccaactcgttcctggtcaccttttcggagtatgccgcctgaccggctgaatgcctcttatggtatgctgggccaatctccccctctgcaccgttctcctgacttcctgctgtcatacccaccagccccatcctgtttccctcccgatcatctcgggtactctgcaccccagcatcccgcacggcgtcccactccccctgaacccctctatgttaacctcgccctgggcccacgtggcccttcccctgcctcttcatcttcttccagcccacctgcgcatcccagatcccgcagcgaccccggtccaccagtcccacgcttaccccagaagcagcgggcaccgtggggccctcgcactccccacagagtgccagggccttggggacccccagagcccctcttactctaccgcgcagcacctcctgcctatgggcgtggcggtgagttacacaggggatctctataccgcaacggtgggcaaagaggggagggggcaggacctccgccaccttatcccacaccctcatggtccctgcatagtgaaggtcagacacggtcctattgctag

SEQ ID NO: 59387 - DNA, 3372 bp, Artificial Sequence
  Description of Artificial Sequence: Synthetic coding sequence
atgctcgtgccactgctattgcagtatttggagacactgtcaggcctcgttgacagtaatctgaactgtggccctgtgctaacctggatggagctggataatcacggtcggcgtctgttattatctgaggaagccagcctgaatattccggctgtggcagctgcacatgtcatcaagaggtataccgcgcaggctcctgacgaattgtctttcgaggtgggcgacatagtatccgtgatcgatatgcctcctactgaggatcgaagctggtggcgagggaaacgaggcttccaggtcggcttctttccatccgagtgtgtggagctgttcactgaaaggccgggtcctgggttgaaggccgatgctgacgggcctccctgcggcatacccgcacctcaaggcatctcctccctcactagcgcagtgcctagacctaggggaaagttagccggactgctgcggaccttcatgcgctctaggcctagcaggcaaaggttgaggcagcgagggatccttcggcagcgagtcttcggatgcgacttgggggaacatctgtctaatagcggccaggacgtacctcaggtcttgcgatgttgcagtgagttcatcgaggcccatggagtggtcgacgggatctatcgcctctccggggtttcaagtaacatccagaggttgcgacacgaatttgatagcgaacgcatcccagaactgtcaggcccagcttttctacaagatatccacagcgtgtccagtctatgtaaactgtacttcagagagctccccaaccccctcttaacttatcaactgtacggtaagttctctgaagccatgagcgtgccaggcgaggaagagcgcctggtgagggttcacgacgtgatacagcagctgcccccaccccactataggaccctggaatatctgctcagacatctcgccagaatggctagacactctgccaacacctcgatgcatgcacggaacctggcaatcgtgtgggcacccaatctgctccgcagcatggagctagagagtgtcggcatgggaggcgctgctgccttccgtgaggtgcgagtgcagagtgtagttgtggagttcttactgacccacgtcgacgttctgttttctgatacttttacctccgctggtctggatcccgcaggcagatgcttattacctagaccaaaatcccttgccggatcttgtccctcaactcgcctgcttaccctagaagaggcccaggccaggactcagggccgattgggaacacctactgagcctaccactcctaaggcgcctgcatcacccgctgagaggcgtaaaggtgagcgaggagagaagcaacgcaagcccggagggtcctcttggaaaacatttttcgccctcggtaggggcccaagtgttcctcgcaaaaagccactgccctggctggggggaacgcgagccccaccacagccgtctggttcgcgacccgacaccgtgactctacggtctgctaaatcagaggaatcactgtcctcacaggcctctggcgcaggcctgcagaggctgcaccgtcttagacgcccacattccagctccgatgcatttccagtcggtcccgcacccgctggtagctgcgaatctttaagctccagttcctcaagcgaaagcagtagcagtgaatcatccagctcaagttctgagtctagtgctgccggactgggcgctctttccggatccccaagccatcgtaccagcgcatggttggacgacggagacgagcttgactttagcccacccaggtgtcttgagggcttacggggactggacttcgacccccttaccttccgctgttcctcgcctaccccaggagacccggcacctccggctagtccagccccacctgcccctgcttccgccttccctcccagagtgacccctcaagccattagccccaggggccctacctcacctgcttcacccgcagctctggacataagtgagcctttagcagtgtctgtaccacctgctgtacttgagctgctcggtgctgggggagctcccgcatccgctaccccaacgccagctctcagtccaggcaggtccctgcgacctcacctaatcccactcctgctccggggtgccgaagccccactgacggatgcatgccagcaggagatgtgctctaagctgcgtggcgcacagggacccttagggccagacatggaatccccactccctcctcctccactgtccttattgagacccggtggggcacctccacccccacccaaaaaccccgctagactcatggcactcgccctcgccgaacgagcccaacaggtcgccgagcagcagtcccagcaagagtgcgggggtacaccccctgcctcccagtcgcccttccaccggtctctgtctctggaggtgggaggagagcccctgggaacatccggctcaggaccccctcctaactctctcgcacaccctggagcatgggtgcccggacctccaccctacttgcctaggcagcagtctgacgggagcctcctgcgttctcagcgaccaatggggactagccggcgagggctgcgaggtcctgcgcaggtccctacccccggatttttctcaccagctcccagggagtgcctgccccctttcttgggcgtccctaagccagggctgtacccactcggccctccatcatttcagccttccagcccagctcctgtgtggagatcgagcttaggaccccctgcacccctggataggggggagaacctatattacgagataggcgcaagcgaaggaagcccgtatagcgggcctacgaggtcatggtccccatttcggagtatgcctcctgatcggctcaatgcgtcctacggcatgctgggtcagtccccccctttgcatagatcccccgatttcctgctcagctaccccccagctccaagttgcttcccccctgatcacctcgggtacagcgctccccagcatcctgctcggcgtccaacaccccctgaacctctgtatgtgaatctggccttaggtccaaggggcccatcccctgcctcttcttcaagtagtagccccccagcgcacccaagaagcaggtccgatcccggtccccctgtgccccgacttccacaaaagcaacgggctccatggggaccaaggacgccgcacagagttccaggcccttggggcccacctgaacccttactcctatacagggccgctcctcccgcatatgggaggggtggagagctccatcgcggaagtttataccgcaacgggggtcagcgaggtgagggggctgggcctccacccccatatcccaccccatcgtggtccttgcactcagagggacaaacccgttcttactgctag

SEQ ID NO: 59388 - DNA, 2625 bp, Artificial Sequence
  Description of Artificial Sequence: Synthetic coding sequence
atggggttacccaccctggaatttagtgatagttatctggactcaccagatttccgcgaaagactgcaatgccatgaaattgaactggagcggacaaataaatttatcaaggaactcatcaaggatggcagtctcctcatcggcgcactgaggaacctctctatggccgtgcagaaatttagtcaatctctccaagacttccagtttgaatgtatcggagacgccgagacagacgatgagatatcaattgctcagtccttaaaggaattcgcacgattacttatagccgtggaggaagaacggcgacggctgattcagaatgctaacgatgtgcttatcgcccctcttgaaaagttccgtaaggagcagatcggagccgctaaggacggaaagaagaagtttgataaagaatcagagaagtattactcaattctcgagaagcatctgaatctgagtgcaaagaagaaggaatctcatctacaggaagctgacacccagatcgatcgagaacaccagaatttctatgaggccagcctggagtatgttttcaagattcaagaagtacaggaaaagaaaaaattcgaattcgtcgaaccattactgagcttcctgcaggggctatttactttctatcatgagggctatgaattggcccaggagtttgccccatataagcagcagctccagtttaacttgcagaatactaggaataatttcgagagcactcggcaggaagtcgaaagattgatgcagcgtatgaagtctgcgaaccaggattaccgccctccatcccagtggaccatggagggatacctttatgtgcaggagaaacgtccacttgggttcacatggatcaagcattattgcacttatgataaggggagtaagacgttcacaatgtcggtgagcgaaatgaaaagtagcggaaaaatgaacgggctggtgacatctagccccgaaatgttcaaactcaagtcctgtatcagaaggaagaccgattccattgataaacgattctgcttcgatattgaggtggtagagcgacacggaatcatcacactacaggcatttagcgaagcgaataggaagctatggctagaggcaatggacgggaaagaacccatctacactctgcccgcaatcattagtaagaaggaggaaatgtatttgaatgaggcaggttttaatttcgtgaggaagtgcattcaggccgtggaaactcgcggtatcaccattctggggctctaccgaatcggaggtgttaattccaaggttcaaaaactgatgaataccacatttagccccaaatccccgcctgatatcgacattgacattgagctgtgggacaacaaaacgatcacctcagggttgaaaaactacctgcggtgccttgcagaacccttgatgacttacaagctgcacaaggacttcattatcgccgttaagtccgatgaccagaattaccgcgttgaggctgtccacgcccttgtgcacaaactccccgagaaaaatcgagaaatgctcgatatactgattaagcatctcgtgaaagtctctcttcatagccagcaaaatctgatgacagtttctaatcttggtgtcatttttggacctacactaatgcgcgcacaggaggagacagttgccgcaatgatgaatatcaagtttcagaacatcgtcgtagagatattgatagagcactacgaaaaaattttccatacagccccagacccttccattccgctgcctcagcctcaaagccgctctggctctagacggactcgcgctatatgccttagcacaggaagtaggaaacccagaggtcggtatacgccatgccttgccgaacccgactcggacagttatagcagcagtccagattccacgcctatgggaagcattgaatctctgtcctcccactccagcgaacaaaattctactaccaaatccgcttcttgtcagcccagagagaaaagtggcggaatcccatggattgcaacgccatcaagctctaacggtcaaaaaagcttgggcctctggacgacttcccccgagagtagttcacgggaagatgccacaaaaactgatgctgagtccgactgtcagtcggtggcttcggtcacgagcccaggggacgtgtccccgcctattgacctggtgaagaaagagccatatggtctgagtgggctaaaaagagcctccgccagttcgctcaggagtatttcagccgcagaggggaacaagtcttattccggctctatccaatctttaacaagtgtcggatcaaaggaaacccctaaggctagcccaaacccagatctgccacctaaaatgtgtaggcgcctacgcctggacaccgcatcctcaaatggttatcagcgcccaggctcagtggtcgccgctaaagcccagctatttgaaaatgtcgggagtcccaaacctgtgtcatcagggcgtcaggctaaagccatgtactcctgtaaggctgaacacagccacgaactcagcttccctcagggtgctatattctccaatgtttatccatcagtggagcctggctggctgaaggccacctacgaggggaagacagggctagttccagagaactacgtagtgtttctctag

SEQ ID NO: 59389 - DNA, 1647 bp, Artificial Sequence
  Description of Artificial Sequence: Synthetic coding sequence
atgcagcccggtctgagccccggttccccgggagaccccagaccgccaacgcctgaaacagattatcccgagagcttaacctcctaccccgaggaagactactcccctgtgggcagtttcggcgagcccggacctacctctccactaaccaccccccctggatggtcatgtcatgtgtctcaggataagcagatgctctataccaatcattttacccaggagcagtgggtcagattggaggatccccatggcaagccgtacttctacaacccagaagactcgtcggtacggtgggagctaccacaggttcctgtcccagctcccagatcaatccataaaagcagtcaggatggtgatactccggcacaagccagtcccccagaggaaaaggtgccagcagagctggatgaggtgggatcatgggaggaagtgagtccagctacggctgcagtgcgtaccaaaactcttgacaaggccggagtactgcatcggacgaagaccgctgacaaggggaaacgtctgcgtaagaagcattggtccgcctcatggactgtgctagaggggggagtgttgacattctttaaagattctaagactagtgccgctggtgggctccggcagcccagcaagttcagcactccggagtatacagtggagctgcgtggtgctacactgtcttgggccccaaaggataagtctagtcggaaaaatgttctcgagttgaggtcccgagatggctccgagtatctgattcaacatgatagtgaagcaataatttctacttggcataaagctatagcgcaggggatccaggaactgtccgctgagctccctcccgaagagtctgaatcttcacgggtggatttcggcagcagtgaaaggctgggcagctggcaagagaaagaagaggatgcaagaccaaatgccgcagcgcctgctctgggccctgtgggccttgaatccgacttgagcaaggtgagacacaaactcaggaagtttttacagcgaagaccaacactgcaaagcctgcgtgagaaaggctatataaaggaccaggtgttcgggtgcgctctggcagcgttgtgtgagcgggagaggagccgcgtgccacgctttgtgcagcaatgcattcgggcagtcgaggccagagggcttgatatagatggactgtatcgaatcagcgggaatctggccacaatacagaagctgaggtacaaggtggatcacgatgagcggctcgatttggacgatggaagatgggaggatgtgcacgtgataactggcgcacttaagctgttttttcgcgaactccctgaacctcttttcccattcagtcacttcagacagtttatcgcagccatcaaacttcaggaccaggccaggcgttcaagatgcgtgcgggatttagtgaggtccctgcccgcaccaaaccatgataccctacggatgctgttccaacatctgtgtcgcgtgatcgagcacggcgagcagaatcgtatgagtgttcagagtgtcgccatcgtctttggcccaaccctgctcagacctgaagtggaggagaccagcatgcctatgacaatggtattccaaaatcaagtggtagagctgatactacagcaatgcgcagacatcttcccgccacattag

SEQ ID NO: 59390 - DNA, 1200 bp, Artificial Sequence
  Description of Artificial Sequence: Synthetic coding sequence
atggtcgacattatcgccaaggtgactaggagacagagcagggcccttcctgcgcaggtggatgacccgcctgaaccagtctatgctaatatcgagcgacaaccacgagccaccagccccggagccgcagctgctcctttgccttcccctgtctgggaaacacacactgacgcgggaacaggaagaccctactactataatcccgacaccggcgtgactacatgggagagcccttttgaggcggcagagggagctgcttcgccggcaaccagcccagctagcgtagattctcacgtgtccctggaaacagaatggggccagtattgggatgaagagtcccggagagtgttcttttacaacccattaactggggagacagcctgggaggacgaagccgagaacgaacctgaggaggagctggagatgcaacctgggttgagtcctggatctcctggggatccaaggccgcctactccggagaccgactacccagagagtctgacctcctaccccgaggaagactactcgcccgttggctcgtttggcgagcctggacctacgtcaccccttactacgcctcccggttggagctgccatgtcagccaggataagcagatgctgtatactaaccactttactcaggaacagtgggtgcggctggaagaccctcatggtaagccgtacttttacaacccagaagattcttctgtgaggtgggagctgccacaggtccccgttcccgcacccagaagtatacataagtcgtctcaagacggtgatacacccgcacaagcatctcctcctgaagagaaaaccaagacgctggataaggccggtgtgctgcatcggacaaagacagcggataagggcaagcgccttaggaagaagcactggtctgcatcttggacagtgctggaagggggagtcctaacattcttcaaagattctaaaacttccgccgctggcggtctacgccagccatctaagttttctaccccagagtacacagtggaactgcgaggagcaacactctcctgggctcccaaggacaaaagtagcaggaagaacgtcctcgaactccggagcagggatggatcggaatacctcatccagcacgactccgaggcaataatctccacatggcataaggctatcgctcagggaattcaggaacttgtgagccgtgcccagggcttgtag

SEQ ID NO: 59391 - DNA, 1647 bp, Artificial Sequence
  Description of Artificial Sequence: Synthetic coding sequence
atgcagccagggttgtcaccgggatcacctggcgatccgaggcctccaactccggagacagattatcctgaatctttaacatcctatcccgaagaagattacagccccgtcggctcattcggcgagcctggcccaacttctcccttgacgacgcccccaggatggtcgtgccacgtgagccaggacaaacagatgctgtacacaaaccatttcacccaggagcaatgggtcaggttagaggacccccacgggaaaccctatttttacaatccagaagactctagcgtgagatgggagctgccacaggtccccgttcctgctccacgcagcattcataagtccagtcaggatggagacaccccagctcaggcctctcctcctgaagagaaggtgcccgcagagctcgatgaggtcgggtcttgggaagaagtttctccggctactgccgctgtgcgcaccaaaactttggataaggctggtgtattgcacagaacaaaaactgccgacaaggggaagagacttagaaagaagcattggtccgcctcatggactgttctcgagggcggagtgctgacttttttcaaagactcaaagacgagtgccgctggtgggcttagacagccctccaagttttccacacccgaatacacagtcgagctccgtggagctactctttcctgggctccgaaagataagagtagcaggaagaacgtgttggagttgcgatcacgcgatgggtcagaatacctgatccagcatgactccgaggctattattagcacgtggcacaaagctattgctcagggcattcaggagctgagcgctgaactgcctccagaggagtctgagagctcccgtgttgatttcggatcatcagaacgactcggcagttggcaagagaaggaggaagatgcacgccctaatgcggcagcacctgcacttgggcctgtgggcctggagtcagacctcagtaaagtgagacacaagcttcgtaaatttctacagcggagaccaactctccagtcccttagagagaaagggtacattaaagatcaggtgttcggctgcgctttggcggctttgtgcgagagggagaggagcagagtaccgagattcgtgcagcagtgcatccgtgcagtggaagcacgaggcctggatattgatgggctatatcgaatatctgggaacctggccacgatacagaaactgaggtataaagttgatcacgatgagcgcctcgatctggatgatgggaggtgggaagacgtgcacgtgatcacaggagcattgaaactgtttttccgagagctgccggagccattatttccatttagtcactttcgccaattcatcgccgctattaagcttcaggatcaagcacgtcgatctcggtgcgtgagggacctggtcaggtcactgccggctcccaaccacgacacacttcgtatgctgttccagcatctctgtagggttatcgagcacggggaacaaaataggatgtccgttcaaagtgtagccatcgtatttgggccaaccctgctgcggccagaagtggaagaaacctcaatgccaatgacaatggtattccaaaatcaggttgtggagctgattttacagcagtgcgccgacatctttcccccacattag

SEQ ID NO: 59392 - DNA, 2589 bp, Artificial Sequence
  Description of Artificial Sequence: Synthetic coding sequence
atggcagcagacgtcgtgggagatgtttacgtgctagtggaacaccccttcgagtacacgggtaaggacgggagacgcgtggccattcgccctaacgaaagatatcggttgctgcggagatctaccgagcactggtggcatgtcaggagagaaccgggaggccgacctttctacctccctgctcagtatgtgagggagctccccgctctcggtaaccctgccgctgctgcaccaccaggcccacatccttcccccgctgccccagaacccctggcctatgattacagattcgtctctgctgccgcaactgccggtccggacggtgctccagaagagagcgggggacgaactagctccctgtgcggccctgcacagcgtggcgctgcaacccagcgaagttctctggccccaggtctgccagcttgcttatatctgcggcctgcagctcccgtacggcctgcacagagcctcaatgatttggcctgcgcagcggtatctccccctgccggacttctgggctcgtccggctctttcaaagcctgcagcgttgccggttcttgggtctgccctagaccactggccaggagtgattcagagaatgtatatgaagtcatccaggacctccatgtcccaccacgcgaggagtcagctgaacaggtggatgacccgccagaaccagtgtacgctaatatcgagaggcagcctagggctacaagccccggagctgcggctgctcctctgcccagccccgtgtgggagacgcatacagacgcaggcaccggtcgcccttattattacaacccggacaccggagttaccacttgggagagtccgtttgaagcggctgaaggcgcagcctctcctgcgacgtcgcccgcatcagtcgatagtcacgtgtccctggagaccgaatggggccagtactgggatgaagaaagcaggcgggtgtttttctataaccccctgacaggtgagaccgcctgggaagacgaagcggagaatgagccggaggaggaactggagatgcaacctgggctctctccgggttctcccggagaccctaggccacccacaccagagaccgattaccctgaatcattaacctcttaccccgaagaggactattctcctgtggggtctttcggcgaaccaggccctaccagcccactcaccaccccccctggttggtcttgccacgtgtcgcaagacaagcagatgctttataccaatcatttcacacaggagcaggtgccagttcccgctccacgcagtattcacaaaagttctcaggacggcgatacccctgcccaggcctctccccctgaagagaaagtaccagcagaactagatgaagtaggctcctgggaggaggtgtcgcctgccaccgccgcagtgaggacaaaaactctcgacaaggcaggggtgctgcatagaactaagaccgcagataaaggaaaacgtcttcgcaagaagcattggtccgcttcatggaccgtgctagaagggggagtcttgacattcttcaaagatagcaaaacgtccgccgcagggggactgcgccaaccttcaaagttctcgacccctgaatacaccgtggaattgagaggggctaccctgagctgggccccaaaagataagtcgtcccgcaagaacgtcctagagctgcgtagccgcgacggaagcgaatacttgatccagcatgactcggaggccatcatcagtacctggcataaggcgattgcccaggggatccaggaactgagtgcagagctgcccccagaggagtctgaatcgtctagggtcgactttggatcaagcgaacgcttgggatcttggcaggaaaaggaggaggacgccagaccaaatgctgcagcccctgccctggggccagtaggtctcgaatcggacttgtcaaaggtcaggcataaactgagaaagtttcttcagcgacgaccaaccctgcagtccctgcgagaaaaaggatacatcaaagatcaggtgttcgggtgcgccctggccgcactctgtgagcgggagcggagtcgggtcccaaggtttgtgcagcaatgcattcgcgcagtggaagcgagagggctcgatatcgacggtctttaccgtatctcgggcaacctggcgaccatccagaaactcagatacaaagtagatcacgatgaaaggctggatctggatgacggaagatgggaggacgtccacgtcattacaggtgccctgaaactgtttttccgcgagcttcccgagcccctgttccctttttctcactttcgccagtttattgcggctattaaactgcaggatcaggcccgtcgcagtcgatgtgtgcgtgacctagtcagatctttgccagcacccaatcatgacacactgcggatgcttttccagcacctgtgtagggtgatcgagcacggcgagcaaaacaggatgagcgtgcagagcgtggccattgtgtttggccctacactcctgaggcctgaggtcgaggagacctctatgccaatgactatggtatttcagaatcaggtcgtggagttgatcctgcaacaatgtgctgacattttccctccccactag

SEQ ID NO: 59393 - DNA, 792 bp, Artificial Sequence
  Description of Artificial Sequence: Synthetic coding sequence
atggccgctgacgtggtgggggacgtgtacgtgttggtggaacatccttttgagtacaccggcaaggacggcaggcgtgttgccataaggcccaatgagcggtacagattgctgcggcgatcgacagaacattggtggcacgtccgcagggagcccggagggaggcctttctacctgccagctcagtatgttcgggaactccctgccctagggaaccctgctgccgcagccccacccggtccccatcctagcccagccgcaccagaacccctggcctacgattatcggtttgtatcggccgcagcaacagccggacctgatggagctccagaggaaagcgggggaagaacgtcaagcctctgcggaccagctcaaagaggtgccgcaacccaacggtcctcactggcacctggtctcccggcatgcctgtacctgcggccagctgctccagtgcgtccagcacagtcgctgaacgacctcgcctgcgccgcagtgagccctcccgcagggctgctcggctccagcgggagcttcaaagcatgctcggtagccggatcttgggtgtgtccgagacccctggcaagatccgattcggaaaacgtgtatgaggtgatacaggatcttcacgtaccaccaagagaggaatccgccgaacaggtgccgccaagggctctcggcagagggggaggttggcgcgctagggatcgggcaagaaccgaacctggacggaaggaaactaggagcgcccagcgcagggctagacggcctcctctgagcgaggactttggctag

SEQ ID NO: 59394 - DNA, 2526 bp, Artificial Sequence
  Description of Artificial Sequence: Synthetic coding sequence
atgagcgcccaaagcctccccgcagccactccaccaactcagaagccccctagaattatccggccacgacccccaagtagatctagggctgcacagtctccaggtccaccccacaatgggtctagcccccaagagttgccacggaacagcaatgatgcccctacccctatgtgtacacctattttttgggaaccacccgctgcgtcccttaaaccgcctgctctgttgcctccctctgcttctagagcttctcttgattctcaaacttcgcccgactccccttcaagcacgcccacgccaagcccagtcagcagacgaagtgcctctccggaacctgccccaaggagccccgtcccccctccaaagcctagtggctcgccctgtacacctcttctccccatggccggtgtgctggcacagaacggaagcgcttcagcaccagggacggtgcgcagactcgccggtcgcttcgaagggggagccgagggcagagctcaggacgccgacgccccagagcccggacttcaggcaagggctgatgtgaacggggagcgcgaggctcctttaaccgggagtggaagtcaggagaacggcgctcccgatgccggactggcttgtcccccttgctgtccgtgtgtatgccacaccacaaggcccggattggagcttaggtgggtgcccgtcggaggctatgaggaggtgcctcgagttccgaggcgagctagcccattgcggacctcccggagtcggccacaccccccttccatcggacaccccgctgtggttctgacaagctacagaagtacagccgagcgcaagctccttcccctgctcaagccacccaagccgacgcgggtccgccaagacgccacaatctttggagatcccccacagcctgatttagacctgctgtctgaagacggtattcagacaggtgattcccccgacgaggccccacagaacacccctccagcgacggttgaagggagagaggaggaaggcctcgaagtcctgaaggaacagaactgggagctcccattgcaggacgagccactataccagacctatcgagccgctgttttatccgaagaactttggggcgtgggggaagacgggtctccaagccctgcgaatgcaggggacgctcccacattccctaggccacccggacccaggaatactttgtggcaggagctcccagccgtgcaggcatccggattactggatacactctcgccccaggagagacgaatgcaggaatccctgttcgaggtggtaactagcgaagctagctacctgcggagcctgcggctgctgaccgacactttcgtacttagtcaggcactgagggacacccttacccctagagatcaccataccctatttagcaacgtacagcgtgtgcagggagtgtcagaacgatttctggcaacactgctcagccgcgtacggtcctccccacacatctccgatctgtgcgacgtcgtacacgctcatgccgtcgggcctttttctgtatacgttgactatgtgcggaatcagcagtaccaagaggaaacctacagccgccttatggataccaacgtccggttctcagctgagctgcgccgactgcagtccttgcccaagtgcgaacggctcccgcttcctagcttccttctgctgccatttcagaggatcacacgactgaggatgctactgcagaacattctgcgacaaactgaagagggctccagtcgtcaggagaacgcccagaaggccctcggcgctgtttcaaaaatcatcgagcggtgtagcgccgaggttgggcgtatgaaacaaacagaggaacttatccgcctaacccaaagacttcgctttcacaaggtgaaagctttaccacttgtttcttggtcgcggcgattagagtttcagggagagctcacagagcttggctgtcggaggggtggagtgctgtttgctagccggcctcggttcacccctctctgcctcttgctgttttccgatctgctgctaattacacaacccaagtccggtcagagattgcaggtcctggactatgcgcaccggtcactcgtgcaggctcagcaggtgcccgatccatcaggaccccctacatttcgtctatcattactttccaaccaccaaggtaggccgacccacaggctgttacaggccagcagtctttccgacatgcaaagatggctgggagccttccccacaccagggcctttgccatgttcgccggacaccatttacgaggactgcgactgcagtcaggagctctgctcagagagtagtgctcccgcaaagacagaaggcaggtctctcgagagtagagcggctcctaaacaccttcacaagacaccggagggttggctgaagggcctgcctggcgcttttcctgctcaattggtgtgcgaggtgaccggtgaacacgagaggcgcaggcatctccgacaaaatcaacggctactggaagccgtgggatcatcaagtggcacgcccaatgccccaccgccttag

SEQ ID NO: 59395 - DNA, 2526 bp, Artificial Sequence
  Description of Artificial Sequence: Synthetic coding sequence
atgtccgctcaatctcttccagccgcaacacctccaacccagaagccccctcgaattattcggcctaggccgccatcccgctccagggccgcacagagccccggacctccacataacgggtcaagcccccaggaactgcctcgtaatagtaacgacgctcccactcctatgtgcactccaatattctgggaaccccctgctgcctcactgaaaccgccagctctgctgcccccttccgcctcgagagcgtctttggattcacagacatcccccgactcaccaagttctactccaacaccctcccccgtttcccgtaggagtgcttctcctgaaccagccccaagaagtcctgtcccgccacccaagcccagcggatccccttgcactcccttactccccatggcgggagtactggcccagaatgggagcgcctccgctccagggacagtgagaagactggccggtagattcgagggaggggcagaagggagggcccaggatgcagacgccccagagcctgggctgcaggccagggctgacgtgaatggcgagcgggaggcgccattgaccgggagtggaagccaggagaatggcgctccagacgctggcttagcttgccccccatgttgcccctgtgtttgccacacaacaaggcccggattggagcttcgttgggtgcccgtcggagggtacgaggaagtcccgagggttccccgaagggcctctcctcttaggacctcacggtcccgccctcatcctccgtctatcggccaccctgctgtcgttctcacttcatatagatccacagcggagcgcaagctcctgccccttctcaagccccctaaaccgacacgggtacgccaggatgctaccatctttggtgaccccccacagcccgatctagacctgctcagcgaggacggaattcagaccggggattcacctgatgaagcaccccagaacaccccacccgcaacagtggaaggaagggaggaggagggacttgaggtgctgaaagaacagaattgggagctaccactgcaggatgaacctttatatcagacctatagagcagccgttctctctgaagaactctggggcgtcggcgaggatgggtcccctagccccgcaaatgccggagacgcccctacctttcctaggccccctgggcctaggaacaccctgtggcaggagctgcccgctgtgcaggcctccggcctcctagatacactgagcccacaagagaggcgaatgcaggagtcgctgttcgaggtggtgacttctgaggcgtcatatttaaggtcgctgagattgctgacagatacttttgtcctcagtcaagccttacgggatacactaacccctagggaccaccacactcttttttcgaatgtacagcgcgtccaaggggtgagtgagcgcttcctggccactctactgtcaagggttaggtctagccctcacatctctgacctgtgcgacgtggtgcatgcccacgccgttgggccatttagcgtatatgttgattatgtgcgcaatcagcagtaccaggaagagacatattccaggctcatggacacaaatgttcgcttttcagcggagctccgcaggctgcagagcctgcctaaatgtgagaggctgccattaccctcctttttactccttcccttccagagaatcacgaggctccgcatgctcctgcaaaacattctgagacaaactgaggagggcagcagcagacaggagaacgcccagaaagcgttgggcgcagtctccaaaattattgaacgttgttccgccgaggtcggacggatgaaacagacggaagagctaattcgcctgacacagcggttgcggttccacaaggtgaaagccctccccctggtgtcttggagtcgcaggctggaattccagggagaactgacagagcttggctgccgcagggggggagtgttgtttgcctcacgtcctcgattcacgcccctgtgtttgttgctgttcagtgacttgctattgattacccagcctaaatctggccagcgcctgcaggtgctcgactatgcacatagaagcctcgtgcaggcacaacaggtgccagatccctcaggccctcccacttttaggctgagcctgctgtctaaccaccagggcaggcccacccatagacttttacaggctagttctttaagcgatatgcagcggtggttgggcgcatttcctacccccggacccctcccctgttcgcccgatacaatctacgaggattgcgactgtagccaggagctgtgctccgaaagcagtgccccagctaaaactgagggccgtagtctcgaatcccgcgcagcacctaagcacctgcacaaaacaccagaaggttggctcaaaggtttgcctggcgcttttcctgctcagttggtgtgcgaagtcacaggcgagcatgaaagaaggagacacctgcgacaaaaccagcggcttctcgaagccgtgggtagtagctccggaacacccaatgctccacctccctag

SEQ ID NO: 59396 - DNA, 1896 bp, Artificial Sequence
  Description of Artificial Sequence: Synthetic coding sequence
atggccccactgcataagaactaccctgagacacctatgatgcatcagcctcaatgcgcccctccatcctctgggtctccccagcttcacccaagttctccacttttattttgtcccccacaaaacggatctgcctccgccccaggcaccgtcaggcggcttgctggtcgttttgaaggcggagcagagggtcgcgcacaagacgccgatgcacccgaaccaggactccaggctagggccgatgtgaacggagaacgggaagccccactaaccggcagcggatcccaggagaacggcgctccaggggatagcccagatgaggcaccacagaatacacccccagctaccgttgaaggcagagaggaggagggtcttgaggttttaaaagagcagaattgggaactgccgctgcaggatgagccactctaccagacctatagagcagctgtgttatctgaggagttgtggggagttggagaggatggctcccctagtccagcaaacgccggagacgcccctacttttccccgacctcccggtccgaggaatacactctggcaggagctgccagccgtgcaggcctccggactcctggacacgctcagtcctcaagaacggaggatgcaggagtccctgtttgaggtagtgacttccgaggcatcttacttgcggtcacttcggctgttaacagacacctttgtgttaagccaagctcttagagatacattgactcctcgagatcaccacactttatttagtaatgtccagcgggtccagggagtcagcgaacggttcctggcgaccctactgtcccgcgtgaggtcctctcctcatattagtgatctatgtgacgtggtccatgctcatgccgtggggccattctctgtatacgtggactacgtccgcaatcagcagtaccaggaggagacctattcgaggctgatggatacaaacgtgagatttagtgctgagctgagaaggctgcagagtcttccgaagtgcgaacgcctccccctaccaagctttctcctcctaccattccaacggataactcgtctgaggatgttactccaaaacattttacgccaaaccgaggaggggagttccaggcaggaaaacgctcagaaagctctaggagccgtgtctaagattatagagcggtgtagtgccgaggtcgggcgtatgaaacagactgaggaactgatccggctgacccagcgacttagattccataaggtcaaggctctgccactggtcagctggtcaaggcgtttagagttccaaggggaactcaccgagctaggttgcaggcggggaggagtgttgttcgcctccaggcccagatttacaccgctttgcctactgttattcagcgatctgctgctcattacccagcccaagagcggacagcgtcttcaggtcctggactacgcccacagatccctggttcaggcccagcaggtaccagatccctccgggccacccacctttagactttcactgctgagcaatcatcagggccgtccgacacacagactgctgcaagctagctccctgagcgacatgcagcggtggctgggggctttcccaacacctgggcctctgccatgtagtccggataccatttacgaggattgcgactgctcccaggagctgtgctcagagtcatcagctccggctaagaccgaagggcgtagcctggaaagtagggcagcccctaagcacctccacaaaacgcctgaaggttggctgaagggccttcctggggcatttccagctcagctcgtgtgcgaggtgactggcgaacacgaacgtaggagacatctcaggcagaatcagcggcttcttgaggcagtcggaagctcctctgggactcccaacgctccacccccatag

SEQ ID NO: 59397 - DNA, 2616 bp, Artificial Sequence
  Description of Artificial Sequence: Synthetic coding sequence
atggacggagagagtgaagtggacttctcctctaacagtatcacccccttatggcgtcgccgtagcatcccacagccacaccaggttttaggcaggagcaaaccgagaccccaatcgtatcagtcgcccaacgggttattaataacagattttccagtggaggacggcggaacgcttctcgccgctcaaattccggctcaggtgcctacagcctccgactcgagaactgtccatcggtcaccgctgcttctcggggcacagcggagggccgttgccaacgggggaacagcttcaccagagtatagagccgcatccccaagactccggcgtcccaaatcccccaaattgcccaaggcagttcccggtgggagtcccaagtcccctgcaaacggggcagtgacactgcccgcaccccctcccccacccgtcctgcgcccaccacggactccaaacgctccagctccatgtactcccgaagaggatctcactggtctgacagcttcaccagtgccttcacctactgcaaatggccttgccgcaaacaacgactctccagggagcggatcgcagtcggggaggaaggcaaaggatccagaacggggactgttccccggacctcagaagtcaagttcagaacagaaactcccactccagcgcctcccctctcaagagaatgagttgctggagaatccttcagtagtgctttctacgaactcaccagcggctcttaaggtaggtaagcaacaaattattccaaagtctctcgcgtccgagatcaagatcagcaagtcaaataatcaaaatgtggaaccacataaacgactgctgaaggtgagaagcatggttgaaggcctcggtgggccactgggccacgccggagaggaatccgaggttgataacgatgttgactcccctggatctctgaggcgcggtcttcggtctaccagttaccgccgtgcagtcgtgagtggctttgattttgactctcctacatcatcaaaaaaaaaaaacagaatgtcacagccagtgctgaaagttgtgatggaggacaaggagaagtttagcagcctaggacggattaaaaagaagatgctgaaagggcagggcaccttcgatggagaagagaatgccgtcctgtatcagaactacaaggaaaaggctttggacattgactctgacgaagaatctgagccaaaggaacagaagtcggatgaaaaaattgtgatccatcacaagcccctcagatctacatggagtcaattgagcgcggtgaaacgtaagggactgtctcagacggttagccaggaagaacgcaagaggcaggaggccatttttgaagtgatttcctcagaacacagctatctcctttcactggagatacttatccgcatgttcaagaacagcaaagaattaagcgataccatgactaaaaccgagcggcaccacctgttcagtaacataaccgacgtctgcgaggcctccaaaaagtttttcattgaactggaagctagacatcaaaataatattttcatcgatgatatatctgatattgtggagaaacacacagcgtcgacctttgacccatatgtgaagtattgtaccaatgaggtgtaccaacaacgcacactgcagaagctgctggccaccaatccctcttttaaggaagtcctgagtaggatcgaatcccatgaggactgtcggaatctgcccatgattagtttccttattctcccgatgcaacgcgtgactcgactaccactgctcatggacacgatctgccagaaaactcccaaagatagccccaaatacgaagtgtgcaagcgagcattaaaggaagtaagcaaattggtccggctttgcaacgaaggcgcaaggaagatggagaggacagagatgatgtatacgattaattcccagctggagttcaagatcaagccgtttcctcttgtctcctccagtcgctggctcgttaagcgcggagaactgaccgcctacgtggaggacaccgtgctcttttcacgtcggacttcaaagcagcaggtatacttctttctgttcaacgacgttcttattatcaccaagaaaaaaagtgaagaatcatacaacgttaacgactatagcctgcgcgaccagctactagtggaaagttgtgacaacgaagagcttaattcttcacctggaaaaaacagctccaccatgctctacagcaggcagagctcggcctcccatttgttcaccctcacggtcctgagcaatcacgccaatgaaaaagtggagatgctactgggtgccgagacacagagcgagcgggctagatggatcaccgctctcggccactccagcggcaaacctcctgccgacaggacatcactgacacaggttgagatcgttaggtctttcaccgctaaacagcctgacgagctctctttacaggtggcagatgttgtgttgatttatcagcgggtctctgatggctggtacgagggggaacgcttgagggacggggagcggggatggttcccgatggagtgcgcaaaggagattacctgtcaagccactatcgacaaaaacgttgaacgcatggggagacttctgggccttgagaccaacgtgtag

SEQ ID NO: 59398 - DNA, 2616 bp, Artificial Sequence
  Description of Artificial Sequence: Synthetic coding sequence
atggacggggagtctgaggttgacttctcttctaacagcataacgccactctggagacgcaggtcgatccctcagcctcaccaggtactggggcgaagtaaacccagacctcagtcttaccagtccccgaatggcctcctcattaccgatttccccgtcgaggacggtgggaccttactggcagctcagatacccgcacaggtaccgactgcatcagactctcgcactgttcatcgcagcccactcctgctaggggctcaaaggcgagctgtggccaatggcggaacagcatctcctgagtatcgcgcagcctcccccaggctgaggcgaccgaagtcccctaaacttccaaaagcggtgcccggagggagtcctaagagtcctgcaaacggcgctgtgacactgccggcaccccctcctccacctgttctgcgccctcccagaactccaaatgccccagcaccttgtactccagaggaggacctcaccgggctcacagcctcaccggttccctcacctactgcaaacggcctggccgcaaataacgatagcccgggtagtggtagtcagagcggcaggaaagccaaagatcctgagcgagggttgttcccaggaccccagaagtcttcgagtgaacagaagcttcccctacagcggctcccctcacaggagaacgagctgctggagaacccatccgtcgtgttgagcacgaatagccctgccgctctgaaagtcggcaaacagcagatcattcccaaaagtctagcttcagagatcaagatatccaaaagcaataatcagaatgtggagccccacaagagattgctgaaagtgcgctcaatggtggaagggctcgggggacccctgggccacgcgggagaagagtcagaggtagacaatgatgtggatagtcccggatctctccggaggggtctcaggtccacatcttaccgccgagctgtcgtgtctggtttcgactttgactccccaactagctccaaaaaaaaaaatagaatgagccaaccggtgctgaaggtcgtgatggaagataaagaaaagttttcatccctcgggagaataaagaaaaagatgctgaaagggcaaggcacgtttgacggcgaggagaatgctgttctgtatcaaaactacaaggagaaggccctggacattgatagtgatgaggagtctgagcctaaggaacagaaaagcgatgagaaaattgtgatacaccacaagcccttacggtccacctggtcccagttgagcgcagtgaagcggaaggggttgagccagaccgtctctcaagaagagcgtaaaaggcaggaagccatatttgaagtgatcagctccgaacattcttacctcctttccttggaaatcctgattcgaatgttcaagaattccaaagagttgagtgacacaatgacaaaaactgagaggcatcatctcttctctaatattaccgatgtgtgtgaggctagcaaaaagttttttatcgaactggaggcgcgtcatcagaacaatattttcatcgatgatatttcagacatagtggaaaaacataccgcctctactttcgatccctatgttaaatattgtaccaatgaggtataccagcagcggacgcttcaaaagttgctggctacaaatccatcattcaaggaagtgttatcacgaatcgaatcccatgaggactgtagaaacctgccaatgattagcttccttattttgcccatgcagagggtgacacgcctccccctacttatggacaccatctgtcagaaaacccctaaagattctcctaagtacgaagtgtgtaagagggccctgaaggaggtcagcaaactggtgcgtctgtgtaacgagggggctaggaaaatggaacgcacagaaatgatgtatactattaactctcagctggagttcaagataaagcctttccccttggtgagtagctcacgatggctcgtgaagaggggagagctaacggcttacgtagaggatactgtacttttcagccgcagaacaagtaaacagcaggtctacttcttcctattcaacgacgtgttgattattacgaagaaaaaatccgaagaatcatataatgtgaatgattattcactgagagaccagctactggtggagtcttgtgacaatgaagagcttaattcatcccctggtaaaaacagctcaactatgctgtacagccgtcagagctccgcgtcccatttgttcactcttacagttctgtccaatcacgctaatgagaaggtggagatgctgttgggggcagagactcaaagcgagagggccagatggataactgccctgggccattcctccgggaaacccccagcggaccgaacctccttgacccaggtcgagattgtgcgatcctttaccgcaaaacagcccgatgaactttctctccaggttgccgacgtcgtgctgatatatcagagggtgtccgacggatggtacgagggcgaaaggttacgcgatggcgagagaggatggttcccgatggagtgtgccaaagagatcacatgtcaggccacgatagataaaaatgtggagcgaatgggacgcttacttggactggaaaccaacgtttag

SEQ ID NO: 59399 - DNA, 1341 bp, Artificial Sequence
  Description of Artificial Sequence: Synthetic coding sequence
atggacggcgagagtgaggtggacttttccagtaattccataactcctctctggcgacgtagaagcattccccaaccccatcaggttctgggcaggagtaagccccgacctcagagttaccagagccctaatggactgctgattacggatttccctgtcgaggacggaggaacgctgcttgctgcgcaaatcccagcacaagtgccaaccgcaagcgactcacgaaccgttcacagatctcctctgctcctgggcgcacagcgacgcgcagttgctaatggaggaaccgctagcccagagtatcgcgctgcgtctcctcgactgcgaagacctaagagcccgaagctaccaaaggccgtccccggaggctcgcctaagtccccagctaacggagcagttaccctccctgctcccccaccccctccagtactgaggccaccaagaacgccaaatgctcccgcaccttgcacccctgaggaagaccttactgggcttacggccagtcccgttccctcacctacagctaatggattggccgcaaataatgattcacccggttcagggtctcagagcggtaggaaggccaaggatcctgagagaggccttttcccaggtccacagaaaagctcttcggagcagaaactgcccttgcagcgcctcccaagccaggaaaacgagctgcttgagaacccatctgtagttcttagcacaaatagtccggcagccctcaaggtgggtaagcagcagattatcccaaaaagtctcgcatcagaaattaaaattagcaagagcaacaaccagaatgtagagccacacaaacgtctcctaaaggtcaggtccatggtggagggcctgggaggccctctcgggcacgcgggagaagaatccgaagtcgataacgatgtggacagccccggtagcctccgcaggggtcttcgctctacctcgtacaggagggcagtcgtgtctgggttcgacttcgacagtccaacgtcaagtaagaagaagaatcgcatgtctcagccagtgctgaaggtggtgatggaagataaagagaagttcagctcccttgggaggatcaagaagaagatgctcaagggccagggtactttcgatggggaagagaacgccgtgctgtatcagaattataaagagaaagccctcgacatcgatagcgacgaggagagtgagcccaaagagcagaaaagcgatgaaaaaatagtcatacaccacaaacccttacgtagcacatggagccaactgtctgcagtcaagaggaaagtcatcctgattgtgggatttatggagatgaaagacggcaggttgcgtggtggcaaatag

SEQ ID NO: 59400 - DNA, 2376 bp, Artificial Sequence
  Description of Artificial Sequence: Synthetic coding sequence
atggacggagagtccgaggtcgatttttcctccaatagtattacccctctgtggcggagaagaagcataccacagccacaccaagtccttggtaggagcaaaccgaggccccagagctaccagagcccaaatggactcctaatcaccgattttcccgtggaagacggcggtaccttgctggcagcccagatacctgcccaggttccaaccgcttcagacagtcgaacagtccacagatcaccattgttgctaggcgcacaacgtcgcgcagtcgctaatggcggaacggcctcgcccgaatatagggcggcttctcccagactgaggcggcctaagtcccctaaacttcctaaagcggttccaggaggttctcctaaaagccccgcaaatggcgctgtaacactgcccgctcccccaccccctcccgtccttcggccaccgagaactcctaatgcgccagccccttgcactcccgaggaggatctcaccggcctgactgcatcgcctgtcccctcccccactgctaacgggctggccgctaacaatgacagcccgggatcaggttcccagagcggtaggaaggcaaaggatcccgaaagaggcctgtttccaggtcctcagaagagctcatccgagcaaaagctgcctctccagcggcttccttctcaggagaatgaactgctagagaacccatccgtggtgctctcaacaaactcacctgctgccctaaaggtagggaaacaacagattatcccaaagtccctggcttctgagatcaaaattagtaagtcgaacaaccaaaacgtcgaaccacacaagcgtttgcttaaggtccgcagtatggtggaaggcctcggcggacctctgggccatgcaggagaagaatctgaagtcgataatgacgttgacagtcctggctcactcaggcggggactcagaagcacctcgtataggcgagccgttgtgagtggcttcgacttcgactccccaactagcagcaaaaaaaagaacagaatgtcccagccagtgctaaaggtcgtcatggaagacaaggagaaattttcttctctggggaggataaaaaagaaaatgctcaagggacagggtacctttgatggagaggaaaacgcggttctataccaaaactataaggagaaagccctagatatagactccgacgaagaatccgaacctaaggagcagaagagtgacgagaaaatagttatccaccacaagcccctgagaagtacatggagtcaactatctgccgtcaaacgcaaagggctgagccagaccgtgagtcaggaggaacgaaaacgtcaggaggcgattttcgaggtaatctcaagcgagcactcttacttactgagtctggagattctgattcggatgtttaagaatagcaaggagctaagcgataccatgaccaagactgagcgacaccatcttttttccaacataaccgacgtttgtgaagccagcaaaaagttcttcatcgagttagaagctcgtcaccagaacaacatcttcattgacgacattagcgatattgtcgagaagcacactgcttcgacatttgatccatacgtcaagtactgcactaatgaggtctaccaacagaggaccctccagaagcttttggcaacgaacccgtccttcaaagaggtgctatccaggatcgaaagccacgaagactgtcgcaacctgcccatgatttccttccttattctgcctatgcagagagtgactcggctgccactcctgatggacaccatctgccaaaagacccccaaggattcccccaagtacgaagtttgcaagcgggcactgaaggaagtatctaaactggtacggctgtgcaatgagggggctcgcaaaatggagcgcaccgaaatgatgtacaccatcaattcacagctggaatttaaaatcaaaccctttcctctggtgagcagcagtcggtggttggtgaagaggggagagctgacggcatacgtggaagatacagtcctgtttagcagaagaacctcgaagcaacaagtgtatttctttctgttcaatgacgtactcataatcaccaagaagaagagcgaggagtcttacaacgtgaacgactattctttgcgagaccagctattggtggagtcctgcgacaatgaagagctgaactcgtctcctggtaagaattcttccacgatgctgtactctcggcagagttctgctagccatctctttacacttaccgtgttgagtaaccacgccaacgagaaggttgaaatgctgctgggagcagaaactcagtcagaacgggctcggtggattacagccctcgggcactcatccggtaaacctcctgctgatcgtacatgtggctag

SEQ ID NO: 59401 - DNA, 2613 bp, Artificial Sequence
  Description of Artificial Sequence: Synthetic coding sequence
atggagaagacgaaaaccaagcagggggagaatgagcacatgcccgtaaataatcctagcacacagatctaccaactgcaggcactggcgagtgaactgaagacaggattcacagaggctatgcaagagctgagccggatacagcatggcgaatacgccttggaggaaaaagtcaagtcttgtagatgctctatggaggaaaaggttactgaaatgaaaaattcactaaattacttcaaggaggagctgagtaatgcgatgtccatgattcaggccattactagcaaacaggaggagatgcagcaaaagattgagcaactgcaacaggagaaacggcgagagagcagaaaggttaaggccaagaaaacgcagaaagaagaacactcctctcaggcagggccagcacaggcccaggggtcacccttcagaagcattaacattcctgaacccgtgttgccatccgaggacttcacgaatttgctgccctctcaggcctacgaaaaggctcaagagagcaggtcagtgcatgtcggggatagtaatgtgaagggtatgatgggccctggcgtgaatcccacaactcccgaagcagaagaaaatcttaaatcctgtctgagcgcagatatccagtctaaggggcaccttccaagcgggatgtggaggcagcctaaggatggcaaagaatggggtgaagagtacgtgaccaaagaccatcctgataagctgaaagaagccggacagggacgccattcttctctggagaatgttttgtgtgagaccagcctggccgcaaaacggcagaccgttgctctcgagctgttggagagcgaacgcaaatatgtgattaacatcagcctgatcctgaaaataaaggccacatttcagggttcagatggaaagagaaactccaaagaaaggagcctgtttcctggctctctccgctatctggtgcaacagcacttggaccttctccatgccctacaagagagagtccttaagtggcctcgccaaggtgttctgggtgacctgtttctgaagcttactaacgacgagaataactttctcgattactatgttgcatacttacgtgacctcccagagtgcatctcgctagtccatgtggtcgttctaaaagaaggggacgaggagatcaagagcgacatttatacactcttttttcacatcgtccagcgcatccccgaatacttgattcacctgcagaatgtgctgaagtttactgagcaggaacaccctgactattatctacttctggtttgcgtacagcggttgagagtctttatctctcattataccctgctgtttcagtgtaacgaggacctgctcatccagaaaaggaagaaattgaagaaaagttcgatggccaagctttacaaagggctcgctagccagtgtgccaatgccggacaggatgcttcaccaaccgctggacccgaggccgtaagagacaccggaatacacagcgaggaactgctccagccctacccctcagctccttccagtggcccagcgattacgcacctcatgccaccggttaaaaagagtcagcagcagcaatcattaatggagagcatgcagccagggaaaccctcagattgggagctggaaggccgtaagcatgagcgacctgagtcgctgctcgccccaacccagttctgtgcagctgaacaggacgtcaaggcactggcaggtcccctgcaggccattcccgagatggactttgagagcagcccagccgagccactgggtaacgtagaaagaagtctgagagcgcctgccgagcttctgcctgacgccaggggatttgttcccgctgcgtatgaggaattcgagtacggcggtgagatttttgctctgcccgctccctacgatgaggaaccattccaggctcccgctctttttgaaaattgtagccctgcgtcgtccgaaagctcactcgacatatgtttcctgcgcccagtctctttcgcaatggaggccgaaaggcctgagcacccactgcagccactacctaagtcagccacatctcccgcaggcagctcatcagcatataagttagaagctgcggcacaggctcacggcaaggccaaaccgctgtctaggtcactcaaggaatttccccgagcacctccggcagacggagtagcccctaggctttacagcacgcgatcctccagcgggggacgagctcctattaaggccgagcgggcagcacaggctcacggacccgctgccgcagcagttgcggctcgtggcgcaagtcgtacgtttttccctcagcaacggtcccagtctgaaaagcaaacatacctggaagttcgaagagagatgcaccttgaagacaccactagattctgcccaaaggaagagagagaaagcgagcagacatcattttccgatcaaaatcctcgacaagaccagaagggaggttttcggtcttcatttaggaagctcttcaaaaaaaagtcatcagggagcgagtatcgagaaaagactaatgaaaacccatctatggatccatccccaactaaacaagattttttcaggaaccggcttgccctcgccaacgatttagaccagggcactgcagtatag

SEQ ID NO: 59402 - DNA, 2535 bp, Artificial Sequence
  Description of Artificial Sequence: Synthetic coding sequence
atggagaagactaagacaaaacagggagaaaacgaacacatgcctgtgaacaatcccagtacccagatctaccagttgcaggcgttagcgtcggaactgaagactggattcactgaagcgatgcaggaattaagtaggattcagcacggtgagtatgcactggaagagaaggtgaagtcatgcaggtgctcgatggaggagaaggtcacagaaatgaagaactccttaaactattttaaagaggagctttccaatgccatgtccatgatccaggccattacctccaagcaggaagaaatgcagcaaaagattgaacagctccaacaagaaaaaagacgcgagtccaggaaagtgaaagcaaagaagactcagaaggaggaacattctagccaggctggccctgcccaagctcaaggcagtccttttcgctccatcaacattcctgaaccagttctgccctctgaggacttcactaacctcctgccctcacaagcctacgaaaaggcgcaggaatctcggagcgtgcatgttggggacagtaatgtgaagggcatgatggggcctggagtgaaccccaccactccagaggcagaagaaaacctgaagagctgtctgagcgccgatatacaaagtaagggtcatctacccagtggcatgtggcggcaacccaaagacgggaaggaatggggcgaagaatatgtaactaaggaccatcccgataaactgaaagaagcaggccagggacgccatagctccctggaaaatgtgttgtgcgagacttccctcgccgcaaaacggcaaacagttgccctggaactcctggaatccgaaaggaagtacgttatcaacattagtctgatcttaaagatcaaggccactttccagggcagcgacggaaaacgcaacagcaaggagcgaagtttgttccctgggagcctaagatatttggtacaacagcacctagacttactgcacgccctccaggagagggtgcttaagtggccaaggcagggggtgctgggtgatttgttcctgaagctgaccaacgacgagaacaactttctggactattacgtagcatatctgagggacctgccagagtgcatcagtctcgtgcacgtggttgtgcttaaggagggcgatgaggagataaagtcagatatatacacgctgtttttccacattgtccagaggatcccagagtacctcattcatctgcagaacgtgctcaaattcacggagcaggagcacccagattattatctactgctggtctgcgtgcagagactgagagtgttcatctcccactacaccctgctcttccagtgtaatgaagacctcttaatccaaaaaaggaagaagctgaagaagtcctcgatggctaagttatacaaaggcctggcaagtcagtgtgccaatgcgggtcaggacgcatccccaactgccggacccgaagcagttagggacacgggaatccactccgaagagttgctccagccttacccatcagcaccttctagtggcccagcgataacccacttgatgcccccagtcaaaaagtcacagcaacaacaaagcctcatggagtccatgcagcccggtaagcctagtgattgggagttggagggacggaaacacgagagacccgaaagtctcttagccccaactcaattttgcgcggctgagcaggatgtcaaggctctggcagggccactgcaggcaatcccagagatggactttgaaagcagccctgctgagcccctgggcaatgtcgagaggtcactgcgggcacctgccgagctcctgcccgacgctcgcggatttgtccccgctgcttacgaggaattcgaatatggtggcgagatcttcgccctgcccgcaccctacgatgaagagccctttcaggcaccagcgctgtttgaaaattgttcacctgctagttctgagagctccctggatatctgtttcctccggcctgtcagtttcgctatggaggctgagcgacccgagcacccgctccagccactccccaagtccgcaactagtccagcagggagttcttctgcctacaaactggaggccgctgcccaggcgcacgggaaggcaaagccactctcgagatccctgaaagaatttccccgagctccgcctgcagacggagtcgccccacgactgtactcaactcgcagtagtagtggcggacgcgctcctatcaaggccgagagggcggcacaggcccacggaccagctgcagcggctgtggctgcacgaggcgcatcacgtacattttttccacagcaaaggtcacaatctgagaaacagacatatttggaagtcaggcgagaaatgcatctcgaagataccacaaggttctgcccaaaagaagaacgcgaatcagaacagactagcttctcggaccaaaaccctcgccaagatcagaaaggagggtttcgcagttctttcaggaaactcttcaagaagaaaaacggtaatgcaacaggtgaagacttctgtggcccttgggggtggtggtag

SEQ ID NO: 59403 - DNA, 2613 bp, Artificial Sequence
  Description of Artificial Sequence: Synthetic coding sequence
atggaaaagacaaagacgaagcaaggagagaacgagcatatgccggttaacaacccctccacccaaatataccagcttcaggctctggctagtgagttaaagactggcttcacagaggccatgcaggagttatcccgcattcagcacggcgaatacgcactagaggagaaagtgaaaagctgccgctgcagcatggaggaaaaagttaccgaaatgaaaaactccctgaattactttaaagaggagctgtccaacgcaatgtccatgatccaggccatcacatccaaacaggaggagatgcagcagaagattgaacagctccagcaagagaaaagacgggagagtaggaaagtaaaggctaaaaagactcagaaagaggagcactcctctcaggctgggcctgcgcaggctcaggggtcccccttccggtctatcaatattcctgaacccgtactcccctctgaagactttacgaacctcctcccatcacaggcgtatgagaaggcccaggagtccaggtctgtacacgtgggagatagcaatgttaaggggatgatggggcctggcgtcaaccctactacccccgaggccgaggaaaatttaaagagctgcctgtcagctgatatacagtcgaaaggacacctaccatccggtatgtggcggcaacctaaggacggaaaggagtggggggaagagtacgtcaccaaggatcatcctgacaagctcaaggaagctgggcagggaagacactcctccctagagaatgtcctgtgtgagaccagccttgccgctaaacgccagactgtagctctcgaactgcttgaaagcgagcgaaagtatgtcattaatattagcctgattctcaaaatcaaggcaacttttcagggatcagatggaaagaggaattcaaaggagcgatcacttttccctggatcacttcgctatctggtccaacagcacctggatctgttacacgccctgcaggaaagagtacttaagtggccgcgtcagggcgtgttgggtgacttgttcctgaaactgacaaatgacgaaaacaacttccttgattactacgtcgcatatctccgcgatctccctgagtgcatctcgctggtccacgttgttgtgctgaaggaaggggacgaagagatcaagagcgatatctatacactttttttccatatagtgcagaggattcccgaatatctgattcacctgcagaacgtgcttaagttcaccgagcaggagcatcccgactattacttgctcctggtttgtgtgcagcggctaagggtgtttatcagccattacacacttctctttcagtgcaatgaggatcttctcattcagaagaggaagaagctgaagaagagtagcatggcaaagctttacaaaggcttagcatcacagtgtgctaacgcaggtcaggacgcatcccctacagccggtcctgaggctgtgagagacacaggaattcatagtgaggagctgcttcaaccataccccagtgccccatctagtggacctgctatcacacacttaatgcctccagtgaagaagagccagcagcagcagagcttaatggagtccatgcaacccggaaaacccagcgattgggagttggaaggccgaaaacacgagagaccagaatctctgctggcgccaacgcaattctgtgcagctgaacaagatgtaaaagcactggccggaccactgcaggcaatcccagagatggatttcgagtcctctccggctgaacctcttgggaacgtcgagcgatctctacgcgctcccgcagaacttcttcccgacgctagagggtttgtccccgcagcctacgaagaatttgagtatgggggtgaaatattcgctttaccagccccttacgatgaggagcccttccaggctcccgctttgttcgaaaactgcagccctgcgagctcggaaagctcccttgatatatgcttcctcagaccagtttcatttgccatggaggcggaacgcccagagcaccccctgcagccactcccaaagtcagccacttcgccagcgggtagttcgtcagcctacaagctggaggcagccgcacaggcccacggaaaggctaagcctctgtcccgttcactgaaggagttccctcgggcacccccagccgacggcgtggccccaaggctttacagtacacgatcctccagcggcggtagagctccaatcaaagcggaaagggctgctcaggctcacggcccagctgctgctgctgttgctgctagaggggcatccagaacctttttcccccagcagcgctcacagtcggagaaacagacgtatctggaagttcgcagagagatgcatctggaggatacaactaggttttgtcctaaggaggaaagagagagcgaacagacgagcttctctgatcaaaaccctaggcaggaccagaaggggggattcagatctagtttcaggaagttgttcaaaaagaaatcttccgggagtgaataccgcgaaaaaacgaacgagaacccttccatggatccatcccccaccaagcaggattttttcaggaatcgacttgctctggccaatgatctggatcagggtactgcggtgtag

SEQ ID NO: 59404 - DNA, 1455 bp, Artificial Sequence
  Description of Artificial Sequence: Synthetic coding sequence
atggaggccgaggaggctcagcacggggcaagccccccaattagcgccatcgaagagttcagcatcattcctgaggctcccatgaggtcttcacaggtgagcgctcttggtctggaggcccaagaagatgaagatcctagttacaagtggcgggaagagcataggctttccgccactcaacagtccgaactgcgtgatgtgtgtgattatgccatcgagactatgccaagctttccgaaagaaggctctgccgatgtagagcctaatcaggaatcactcgtagccgaagcatgcgacacccctgagcattgggaggccgtaccgcaatccctggctgggagacaggcccgtacgctagcccctccagagttgtgggcttgtccaattcaatctgaacatctggatatggcacctttttcctctgacctgggctctgaggaagaagaggtggagttttggcctggtttgacttcccttacgctcgggagcggtcaagcagaagaggaggaggagacatcgtctgacaacagtggccagacccggtattacagtccttgcgaggaacatccagcggaaactaaccaaaatgaaggcgcagagtccgggacaattaggcagggagaggaactgcccagcgaggagttgcaggagtcacagggtctgttgcatccgcaggaggtgcaggtgcttgaagagcagggccaacaggaagcgggttttaggggtgagggtacattgagagaagacgtatgtgcggacggactgcttggagaagaacagatgatagaacaagtgaatgacgagaaaggcgagcagaagcaaaagcaggagcaggtgcaggatgtgatgctggggcgacaaggtgagagaatgggtctcaccggggagccagagggcctgaacgacggcgagtgggaacaggaggatatggagcgtaaagctcaaggtcaaggcggtcctgagcagggcgaagagcgtaaacgggaactgcaagtgcccgaggaaaaccgagcagactcacaggatgaaaaatctcagacttttctgggtaaaagcgaagaagtcactgggaaacaagaggatcacggcattaaggagaaaggcgtgcctgtgtcgggccaggaagccaaggagccagaatcctgggacggaggcagactgggtgccgtcgggagggccaggtcccgagaggaagaaaacgagcatcacgggccaagtatgcccgcactgatcgcccctgaggatagcccccattgcgatcttttcccaggggcaagctacttggtaactcaaattcctggaacacagactgaatccagagccgaagagctgagcccggctgccctgtccccactgcttgaacccattaggtgctctcaccagcccatctcgttgcttggttccttcctgacagaggagtccccagacaaggagaaactcctttccgttctgtag

SEQ ID NO: 59405 - DNA, 1455 bp, Artificial Sequence
  Description of Artificial Sequence: Synthetic coding sequence
atggaggctgaagaggcccagcacggagcgtcgcctcccatctccgccatagaggaattctctatcatcccagaagctccgatgaggtctagtcaagtcagtgctttaggtctggaagcccaagaggatgaggaccctagttacaagtggcgggaagagcatagactgagtgccacacagcaaagcgaacttagggacgtgtgtgactatgcgatcgagacaatgccttcctttccgaaggaagggagcgccgacgttgagcctaatcaagagtcattggtcgccgaggcttgtgacaccccagagcattgggaggcagtgccgcagtccctggcaggcagacaagctagaaccctagctccacctgaactctgggcctgccccatccagtccgagcacttagatatggcacccttttctagcgacctgggttcagaggaggaggaagtcgagttttggcccggactcacgagtttgacactcggttcagggcaggcagaagaggaggaggaaacgagttctgataactccggtcagacccggtactattcaccatgtgaagaacatccagcagagaccaatcaaaacgagggcgcagaatcgggcacgattcgccaaggggaggaactgccatctgaggaattacaggagagccagggactactgcatccacaggaagtgcaggtgctggaggagcaaggtcagcaggaggcgggtttcaggggcgagggcactctgcgcgaagatgtgtgcgccgacggtctgttaggagaagagcagatgatcgagcaggtgaatgacgagaaaggggagcagaaacagaaacaagagcaagtccaagacgtcatgctcggcaggcaaggagaacgaatgggtcttaccggagagcctgagggattgaacgatggagagtgggaacaggaggacatggagcgaaaggctcagggtcaaggtgggcctgagcaaggggaggaacgcaagagagaacttcaggtccccgaagagaacagggccgactcgcaggacgagaaaagtcagacattcctggggaagagtgaagaagtaacaggaaagcaggaagatcatggaattaaggagaaaggcgtccctgtgtctggccaggaggcaaaggagcccgagagctgggatggaggcaggctcggcgctgtggggcgagctcggagcagagaggaggagaacgaacatcatgggccttcaatgcccgctcttattgcccctgaagactccccccactgcgatttgttcccaggcgcttcatacctcgtgacccagatccctgggactcagacagaatccagggcagaggagctgagcccggctgccttatcaccgctgctcgaacccatcaggtgttcacatcaacctatatctcttctgggtagctttttgacagaagaatcacctgacaaagaaaagctgttgagcgtcttgtag

SEQ ID NO: 59406 - DNA, 672 bp, Artificial Sequence
  Description of Artificial Sequence: Synthetic coding sequence
atgctgggtgttaccaccgtgcgctcccgaatgaggagggccctggtctttgggatggtggttccctcagtcttggtaccttggctgttactgggcgcttcttggctcattcctcagactagcttcttgtcgaacgtctgcggccttagcatcggcctggcctatggactgacttattgttactcaattgatctcagcgagcgggtggcattgaaactggaccagactttccctttctctttaatgcggcgaatttcagtgttcaaatatgtgtcgggctcttccgccgaaaggcgtgcagcacaatcacgcaagctgaaccctgtgcccggttcataccctacgcaaagctgtcatccgcatctgagcccctcccatccagtctcgcagacccagcatgcaagtgggcagaagcttgcctcctggccaagctgtactccgggacatatgccaactcttcccccttatcagcccgcaagtggactatgttacgtgcagaatcacttcggcccaaatcctacctctagcagcgtgtatccggcaagtgctggtaccagcttggggatacagcctccaacccctgtgaacagtcctggcacagtttatagcggagctctgggcactcccggagcggcagggtccaaggagtccagccgtgtacctatgccatag

SEQ ID NO: 59407 - DNA, 2013 bp, Artificial Sequence
  Description of Artificial Sequence: Synthetic coding sequence
atgattctggaggagcgcccagacggagcgggagcaggggaggagtcaccgcgactccaagggtgcgactcactcacacagattcagtgcgggcagctgcagagccgtcgggctcagattcaccagcaaatcgataaggaactgcagatgaggacaggcgcagagaatttgtatcgcgctacttccaacaacagggtgagagagactgtggctttagaactcagctatgtcaattccaatttacaactcctaaaagaggagttggaggaactttccggaggtgttgaccctgggagacacggttcagaggcagttactgttcctatgattcccctgggattgaaggagactaaagagctggattggtctaccccccttaaggaattaataagcgtccacttcggcgaggatggtgcctcttacgaggccgaaataagggagcttgaggccctacgccaggcaatgcggacacccagccgaaacgaaagcggcctggaacttcttaccgcttattacaatcagctctgctttcttgacgcacgatttctaactcctgcccgttctctgggcctgtttttccattggtatgacagcttaaccggggtacccgctcagcagcgagcgctcgcgtttgagaagggatctgttctgtttaatattggggcattacatacacagatcggcgctcgccaagacagaagctgtacagagggtgcacgcagggcaatggaggccttccagagagccgcaggggctttttcattactgcgtgagaacttcagccatgctcctagccccgatatgtcagcggcttctttgtgtgctctggagcaattgatgatggctcaagcccaggaatgcgtgttcgaaggtctttccccccctgcaagcatggcgccacaagattgcctagctcagctgaggctggctcaggaagcagcacaggtggctgccgagtaccgtttggttcaccgaactatggctcagccccctgtccacgactacgtgcccgtgtcttggacagcactcgtacacgttaaggccgagtactttcggtccctcgctcactatcacgtggctatggccctgtgcgatggcagtcctgctactgagggtgagttgcccacccacgaacaggtgtttctgcagccccctacgtcttcaaagcctcgtggcccagtcctcccccaggaactagaggagcgacggcaactcggcaaagcccacttaaagagggcaattctaggtcaggaagaggcgctgcggctccatgctctgtgtagggtactcagagaggtcgacttgctccgtgctgtgatttctcagactttgcagcgcagcctagccaaatatgccgaactggaccgggaagacgacttctgcgaagcagctgaagctcctgacatccagcctaaaacacatcagaaacctgaggccagaatgccccgtctttctcagggtaagggaccggatatttttcacaggctcgggcctctgtcggtatttagcgccaaaaacaggtggcgactggtcggtcctgttcacctgactagaggagaaggtgggtttggcctgacactccggggagattcaccggtattgatagccgctgtaatacctggctcacaggccgcagccgctgggcttaaggagggggactatatcgtgtcagtgaacggccagccctgtcgatggtggagacacgccgaggtcgtgactgagctgaaggcagccggagaggcgggagcctccttgcaggtggtgagcctcctgccgtcatccagactgccgtccctgggtgaccggagacccgtgttattaggcccacgcggactactgcggtcccaacgagagcatggctgtaagacacccgctagcacctgggcatccccacggccactactgaattggtctcgcaaggcacagcagggaaagactggagggtgcccccagccatgtgcccctgtgaaacccgcacctccttccagccttaaacaccccggatggccttag

SEQ ID NO: 59408 - DNA, 546 bp, Artificial Sequence
  Description of Artificial Sequence: Synthetic coding sequence
atgtacaatattaagcagtccactgacacgaaagaggcagccgcaattgaggcacgcagaaatcgtgaaaaggagcggcagaacaggttttttaacgtgcgaaatcgggtgatgggcgtcgacgtgcaggctctgaacaatcaggtcggcgataggaagaggcgcgaggctgccgagcggtctaaggaagccgcttacggaacatcacaggtacagtatgacgtggtggtacagatgctggaaaaagaagaagccgaccggactagacagttggctaaaaaggtgcaggagtttagggagcagaagcaacagttgaagaatggcagggagttctctctgtgggatcctgggcaggtctggaagggcctcccaacctacctcagctatagcaacacctacccaggacctgcctccctgcaatatttcagcggggaagatctggaccgcgatacccgattaagaatgcagcaaggccagtttaggtacaatctcgaacgccagcagcaggagcaacagcaagccaaggtggacgaaaattacacatag

SEQ ID NO: 59409 - DNA, 1140 bp, Artificial Sequence
  Description of Artificial Sequence: Synthetic coding sequence
atgtacaacatcaaacagtctactgatacaaaagaagccgcagcgatcgaggctcggaggaaccgcgagaaagagagacaaaatcggttcttcaacgtacgcaacagagtcatgggtgttgacgtccaggccctcaacaatcaagtcggggaccggaagagaagggaagcagccgaacggagcaaggaggcagcctatggcactagccaagttcagtatgacgtcgtcgtgcagatgctggagaaggaagaagctgaccgtacaaggcagctggcgaagaaagttcaggagtttcgagagcagaagcaacagctaaaaaacgggagagaattcagcctgtgggatccagggcaggtttggaagggattgccaacctacctctcctatagcaatacctatccaggccctgcctctttacagtatttttcaggcgaggatctcgatagggacactaggttacgaatgcagcaaggacagttccggtataatctggagcgacaacagcaagaacagcaacaagcgaaagttgatgaaaactatacggacgccctgagcaaccaacttagacttgccatggacgctcaagccacccacctcgccaggctggaggagagttgccgcgctgccatgatgtgtgccatggccaacgccaacaaggcccaggccgcagtgcaggcagggaggcagaggtgcgagcggcagagggagcaaaaggccaacctggctgagatccagcaccagagtacctctgacctgctcaccgaaaatccacaagtcgctcagcatccaatggccccttaccgggtgctgccctattgttggaaaggaatgactccagagcagcaagctgcaattaggaaagaacaagaggtgcagaggtcaaagaaacaggcacatcgacaagccgagaagaccctagacacagagtggaaatcacagactatgtcaagcgcgcaggctgtgttggagctggaggaacaggaacgcgagctgtgcgcagtgttccagcgcggattaggctccttcaaccagcagttagccaacgagcaaaaagctcaacaggattatcttaatagcgtgatctatacaaatcaaccaaccgcgcagtaccaccagcaattcaatacttcctccagatag

SEQ ID NO: 59410 - DNA, 717 bp, Artificial Sequence
  Description of Artificial Sequence: Synthetic coding sequence
atgtacaacatcaaacaaagcactgatacaaaagaggctgcagctatcgaagcccgacggaatcgagagaaggagcggcagaacagatttttcaacgtgaggaaccgcgtaatgggcgtcgatgtgcaagccctgaacaaccaggtaggagatcgcaaacgacgggaggccgcagagcggtctaaagaggccgcatacgatgctctgtccaatcaattgcggctggcgatggacgcccaggcaacacacctagctagattggaagagtcctgcagagcggctatgatgtgtgcgatggctaacgctaataaggcgcaggcagctgttcaggcaggacggcagaggtgcgaacggcagagagagcagaaggctaacctagccgagattcagcaccagtctacgagcgatctgctgactgagaatcctcaagtggcccagcacccgatggctccgtatcgagtgctgccctactgctggaaagggatgacccccgagcagcaagcagcaatccggaaggaacaggaggtgcagcgctcaaagaaacaggcccaccgacaggccgagaagacgctggacacagaatggaagtcacagactatgagctcagcgcaggctgtgctggaactggaggagcaagagagagagctctgtgcggtcttccagcgcggtctgggatcttttaaccagcaactggcgaacgaacagaaagctcagtag

SEQ ID NO: 59411 - DNA, 579 bp, Artificial Sequence
  Description of Artificial Sequence: Synthetic coding sequence
atgtataatatcaaacagagtacagatacgaaggaggctgcggcaattgaagccagacggaacagagagaaggagaggcaaaatcgattttttaatgtccgcaacagagttatgggagtggacgtgcaagcccttaataaccaagtcggggatcgaaagcggagggaggctgccgaacgtagtaaggaggctgcctacggcactagccaagtgcaatacgacgttgtagtgcagatgctagagaaggaggaagccgatcgcactaggcagttggcaaaaaaggttcaggagtttagagagcagaagcaacaactaaaaaatggccgagaattctccctctgggatccgggtcaggtgtggaagggactgccgacctatctaagctactcaaacacctaccccggacccgcaagcttgcagtacttctctggtgaggatctggatcgcgatactcgtctgaggatgcagcagggccagttccgctacaaccttgagagacagcagcaagagcagcaacaggccaaagttgatgaaaactatacaggcaagcaaccgggaccacccgattcagagacgtag

SEQ ID NO: 59412 - DNA, 930 bp, Artificial Sequence
  Description of Artificial Sequence: Synthetic coding sequence
atgcgccagaatgacaagattatgtgcatcctggagaaccgaaagaaacgggaccggaaaaacctgtgcagggccattaacgacttccagcagtcttttcagaagccggagacacgcagagagtttgaccttagcgaccccttagctttgaagaaagacctgcccgctagacagtccgacaacgacgttcgcaacactatcagcggaatgcaaaagtttatgggagaagatctcaacttccacgaaagaaagaagtttcaggaggagcagaacagggagtggtcactgcaacagcaaagggaatggaaaaacgctagggcagagcagaagtgtgccgaggctctgtacacggaaacgcggttgcagttcgacgaaacagctaaacacttgcagaagttggagtccaccactagaaaagcagtgtgcgcgtcagtcaaagattttaataagtcacaggccattgagtccgttgagcggaaaaaacaggagaaaaagcaggagcaggaggacaatcttgcagagataacaaatctccttagaggcgatctactttcagagaatccccaacaggcagcctcgagtttcggccctcacagagttgttcccgacaggtggaaaggcatgacacaggagcagctggaacagatccggttggtccagaagcagcagatccaggaaaagttgcgactgcaggaagagaagagacagagagatttggattgggataggagacggattcagggggctcgggctactctgctctttgagcgccagcaatggcgtaggcagagagatctccgccgagccctcgatagtagcaatctgtccttggctaaggagcagcatttgcagaagaaatacatgaatgaggtgtatacaaaccagccaacaggcgattattttactcagtttaatactggaagccgctag

SEQ ID NO: 59413 - DNA, 1134 bp, Artificial Sequence
  Description of Artificial Sequence: Synthetic coding sequence
atggccgtggctttgccccgagatctccggcaagacgccaatttggcaaaacgaagacacgccgaactgtgtcgccagaagcgggtgttcaacgcaaggaaccggatcattggcggtgatacagaagcctgggacgtccaggtgcatgaccagaaaatcaaggaggctacggagaaggctcgacacgagacgctcgctgccgaaatgcgccaaaacgataagatcatgtgcattctcgagaacagaaagaagcgtgatcggaaaaacctttgccgagccatcaacgacttccagcaaagcttccaaaagcccgaaaccagacgggaatttgatctcagcgaccccctggcactgaaaaaagatttacctgccagacaaagcgataacgacgttagaaataccatcagcgggatgcaaaaattcatgggggaagacttaaacttccatgaacgcaaaaagttccaagaagagcaaaaccgcgagtggagcttacaacaacagagggagtggaagaacgcgagggccgagcagaagtgtgctgaggccctttataccgaaacgaggttgcagtttgacgaaactgcaaagcacctgcagaaattggagtcaaccacacgcaaagcagtttgtgccagcgttaaggatttcaacaagtcgcaggccatcgagtccgttgagaggaaaaaacaggaaaagaagcaggagcaggaagataacctcgccgagattacaaacctgttgaggggcgacctactgtctgaaaacccacagcaagctgcaagctcctttggaccacacagggtggtcccagatagatggaaggggatgactcaagaacagctcgagcagattagactggtgcagaagcagcagatccaggagaagcttcgtctgcaggaggagaagagacagcgagacctagactgggaccggcgtcgaatacaaggcgctcgggctacgttgctgttcgagcgccagcagtggaggcgccagcgggacctcaggcgggcacttgacagtagcaacctgagcctggcgaaggaacagcatctgcagaagaagtacatgaatgaggtgtacactaaccagcccacaggagactactttacacagtttaacactgggtcacggtag

SEQ ID NO: 59414 - DNA, 432 bp, Artificial Sequence
  Description of Artificial Sequence: Synthetic coding sequence
atggaaaccttccccctgcttctcctgtctttgggcctagtgctcgccgaagcttcggaatctaccatgaagatcatcaaagaggagttcacagatgaagaaatgcaatatgacatggccaagtcaggccaggagaagcagactattgagattcttatgaatcccatactgctcgtcaagaatactagcctgtccatgagcaaggatgacatgtcctctacactgttgaccttccggtccctccactacaacgaccccaagggaaattcttcgggcaacgataaagagtgctgcaatgacatgacagtgtggagaaaggtttccgaagccaatgggtcctgtaaatggagtaacaatttcatccggagttcaactgaggtcatgagacgggtgcacagggccccaagctgcaaattcgtgcaaaacccatag

SEQ ID NO: 59415 - DNA, 555 bp, Artificial Sequence
  Description of Artificial Sequence: Synthetic coding sequence
atggtgcgttattcattggaccccgagaacccaaccaaaagttgtaagtctcggggatccaacttacgcgtgcacttcaaaaatacccgggagacagcgcaggcaatcaaagggatgcacatcaggaaggcaactaagtacctgaaggacgtgacccttcaaaagcagtgtgtcccattccggaggtataatggaggcgttggacggtgcgcccaggccaagcaatggggctggactcagggtcgttggcccaaaaagagcgctgagttcctcctccatatgcttaaaaacgccgaatccaacgccgaattgaaagggttggacgtcgatagcctcgtcattgaacacattcaggtgaacaaagcacccaaaatgagacgtaggacctatcgtgcacacgggagaatcaacccatacatgtcaagcccctgccacatcgagatgatccttaccgaaaaggaacagatagtcccaaaaccagaggaagaagtcgcacagaagaagaagatatctcaaaagaagctgaagaaacagaagttgatggcacgcgaatag

SEQ ID NO: 59416 - DNA, 441 bp, Artificial Sequence
  Description of Artificial Sequence: Synthetic coding sequence
atgcatatccgtaaggccacaaaatacttgaaagacgtcacactccagaaacagtgtgttccctttaggcgctacaatggaggggtcggtcggtgtgcacaagctaagcaatggggctggacacaaggcaggtggccaaaaaaatccgccgagttcttgcttcacatgctgaagaacgccgaatcaaatgctgagctcaaaggcttggacgtggactcgctcgtgattgagcacattcaggttaacaaggcaccaaaaatgcgcagaaggacttatagagcacatggaaggattaatccgtacatgtcttccccatgtcacattgaaatgattctcactgagaaagaacaaatcgtgcccaagcctgaggaggaggtcgctcagaagaagaagatctctcagaagaagctcaagaagcagaagctgatggcaagggaatag

SEQ ID NO: 59417 - DNA, 525 bp, Artificial Sequence
  Description of Artificial Sequence: Synthetic coding sequence
atggtgaggtacagtttagaccctgaaaaccccaccaagtcatgtaaatcccggggtagcaatctgagagtgcatttcaaaaatactagggaaaccgcacaagcgattaaaggtatgcacataagaaaagccactaagtatcttaaggatgtcactctgcagaaacagtgtgtcccgttccggcgttataatggaggtgtgggcaggtgtgcacaggccaagcagtggggatggactcaaggtaggtggccaaaaaaaagtgcagaatttctgctgcacatgttgaagaacgcagagtccaatgccgagctgaaaggcctggatgttgacagcctggttattgagcacattcaggtgaataaagctcccaagatgcgacgcaggacttaccgtgctcatggcaggattaacccttatatgtctagtccgtgtcacatcgaaatgattttaaccgaaaaggagcaaatcgtccctaagcccgaggaagaagtggctcagaaaaagaagattagtcagaaaaagtag

SEQ ID NO: 59418 - DNA, 585 bp, Artificial Sequence
  Description of Artificial Sequence: Synthetic coding sequence
atgccagttgctcgatcctgggtttgtagaaaaacttacgtgacaccgagacgccctttcgagaagtcaaggctggatcaggagctgaaactgataggcgagtacggcctccggaacaagcgcgaagtatggagagtcaaattcaccctggccaagattagaaaggccgcaagagagctgctgacactggacgagaaagatccgcgtcggctgtttgagggcaatgctcttctgaggcgcctcgtcagaattggcgtgctggacgaaggcaaaatgaaactagactatatccttgggctcaagattgaagacttcctggaacgaaggctgcaaacccaggttttcaaactgggcctcgccaaatccatacatcatgcaagggtactgatccgacagcgccacatcagggtgcggaagcaggttgtcaacattcccagcttcatcgtgagattggattctcagaaacatatcgacttctccttgcgttcaccatacggcggtggccgtcccggacgcgttaagcggaaaaatgccaaaaaaggccagggcggagcgggagccggtgacgatgaggaagaggactag

SEQ ID NO: 59419 - DNA, 888 bp, Artificial Sequence
  Description of Artificial Sequence: Synthetic coding sequence
atgagcggtgccctggacgtgctgcagatgaaagaagaggacgttctgaaattcctggcagcgggtacccacctgggtggcacgaacctggactttcagatggaacactatatttacaaacggaaatccgacgggatctacatcatcaatctcaaacggacctgggaaaagctgctcctagctgcaagagctatcgtggcaatagagaacccagccgacgtttcagtcatctcaagtaggaacacagggcagcgggctgtgttaaagtttgcggcagcaactggggctacgccaattgctggcaggtttacacctggcacattcacgaatcagatccaagctgcattttgggaaccccgactgctcgtggtgacagacccacgcgcagatcatcagcccctgaccgaagcatcctatgtgaatctgcctaccattgcactttgcaacacagattctccactgagatacgtggatattgctattccttgtaacaacaagggtgcccattcagttggcctcatgtggtggatgttggctcgagaggtgctaaggatgcgtggcaccatctcccgggagcacccttgggaggtgatgcccgatttgtacttctacagagacccggaagaaatcgaaaaggaagagcaggcggctgccgaaaaagctgtgacaaaggaggagtttcaaggagagtggaccgcaccaagtcctgaattcaccgctacacagcccgaagttgctgactggagcgagggcgtgcaagtgccttcagtgccaatccaacagttccctactgaggactggagcgcccagcctgcaaccgaggactggtccgccgcacccacggcacaggctacagagtgggtcggcgctactacagattggagttag

SEQ ID NO: 59420 - DNA, 843 bp, Artificial Sequence
  Description of Artificial Sequence: Synthetic coding sequence
atggtagcacggcgtcgaaaatgtgctgccagagaccccgaggataggatacccagtcctctgggctacgctgccatccccatcaagttttctgaaaaacagcaggcttctcattatttatacgtgcgcgcacatggagtgagacagggaactaagagcacttggcctcaaaaacgcacactctttgtgttgaatgttccgccttattgcacagaggaatcactgtctagattgctttcgacttgtggattagtgcagtcagtggagctgcaggagaagcctgatcttgcagagagcccaaaggaatcccgatccaagttttttcacccgaaacccgtccccggatttcaggtagcttatgtcgtgttccagaaaccgagtggcgtgagcgcagccctggcgcttaagggacctctgctcgtttccacagaaagtcatcccgtgaaatcgggtattcacaaatggataagcgattacgcagacagcgtgcccgatccggaggccctgcgcgtagaagtggacactttcatggaggcctacgatcagaagatcgccgaagaagaggcgaaggccaaggaggaagagggggttccggatgaggaaggctgggtgaaggtgacaaggaggggacgtcgtccggtgctgccacgaaccgaggccgcaagcctcagggtcttggaacgtgagcgacgcaaacgctccagaaaggaactccttaatttttacgcctggcaacatagagagtccaagatggaacaccttgcccagctgcggaagaaattcgaggaggacaagcagcggatcgaactactgagagcacaacgcaaatttaggccatattag

SEQ ID NO: 59421 - DNA, 735 bp, Artificial Sequence
  Description of Artificial Sequence: Synthetic coding sequence
atggccgcaccaagcgacggctttaagcccagagagcgatctggtggggagcaggctcaggactgggacgcattgccaccaaagcggccacgtttgggcgctggaaataagattggtggacgcaggctgatcgtcgtccttgagggggcaagcctggagactgtgaaagttggtaagacttatgaattgctgaactgcgataaacacaaatcgatactccttaaaaatggacgcgaccctggggaagcgagacccgacattacacatcaatcactgctgatgctgatggattctccactgaatagagctggcctgctccaggtgtacattcatactcagaagaatgtgctgatcgaggtgaatccacaaacccgcatacccagaacatttgatcgtttctgcggcttgatggtgcagctgctgcataagctttctgtgcgcgcagcagatggccctcagaaactcctgaaagtgattaagaaccctgtatcagatcatttccccgtcggatgtatgaaagtaggaacctccttcagcatacccgttgtgtcagatgtgagagagcttgtgccctccagcgatcccatcgttttcgtcgtgggtgcttttgcccatggaaaagtgtcagtggagtacaccgaaaaaatggtgtctatcagtaattaccctctgtccgcggctctgacttgtgctaagctgaccactgcctttgaggaggtttggggcgttatttag

SEQ ID NO: 59422 - DNA, 474 bp, Artificial Sequence
  Description of Artificial Sequence: Synthetic coding sequence
atgaatcttgatggaagcgcccaggacccagagaagcgcgagtatagcagcgtctgtgtgggtcgtgaggatgacatcaaaaagagtgagcgcatgaccgccgtggtgcacgatcgtgaagtcgtgattttctatcataagggcgagtaccatgctatggatatccgctgttatcactcaggaggacctctgcacctgggagacatcgaagacttcgatgggagaccctgtatcgtgtgcccctggcataagtataaaatcaccttggcaacaggagaaggattatatcagtccatcaatcctaaagaccccagcgctaaacctaagtggtgctcaaagggcattaagcaacgaattcatactgtgacagtggataatggaaacatttacgtaactctgagcaacgaaccgtttaaatgtgactccgacttctatgctacaggtgatttcaaggtgataaaaagttcctcctag

SEQ ID NO: 59423 - DNA, 633 bp, Artificial Sequence
  Description of Artificial Sequence: Synthetic coding sequence
atgctgaaatgcttcaggaactgtctcagaccttcctcgctatctactctcccgttgcagtacggcattctgtttcccaagttactggcttgtcttgtacacctgcatttcggccacttctccagcgctgtgatcagcgttacatctttttacctgagcatgaacctcgacgggtccgctcaggaccccgaaaaacgcgagtactcatctgtgtgcgtcggacgcgaggacgacattaagaagagcgagagaatgaccgcagttgtgcacgaccgcgaagtagttatcttttaccacaaaggcgagtatcacgcaatggacatacgctgctatcactccggcggtcccttgcatctcggcgacattgaggactttgacggcagaccatgcattgtctgtccctggcacaagtataaaataaccctggcgaccggcgaaggtctgtaccagtctatcaatcccaaggatccaagtgccaagcccaagtggtgcagcaagggaattaaacaaagaatacatactgtgaccgtggataatgggaacatctacgtcacactctctaacgaaccttttaaatgtgactcggatttttacgccactggagattttaaggtgatcaagtcaagcagctag

SEQ ID NO: 59424 - DNA, 633 bp, Artificial Sequence
  Description of Artificial Sequence: Synthetic coding sequence
atgctcaaatgttttcggaattgcctgagaccgtcgagtttgtccacactgccacttcaatatggaatcctgtttccaaagctgctggcttgtctcgtccatctgcacttcggacatttttccagcgctgttatttcggtaacttcattctatctgagcatgaacctcgacggctcagcccaggacccggagaaacgggaatacagctctgtgtgcgtcggacgggaggatgatatcaagaagagcgaacggatgactgcagttgtgcacgacagagaagtagttatcttttaccacaagggggagtaccatgcgatggacattaggtgctatcacagcggaggccctctccaccttggggatattgaagactttgacggcagaccctgcatcgtgtgtccctggcacaagtacaagatcactcttgcaactggagaggggctgtatcagtccatcaatcccaaagatccatctgctaagccaaagtggtgttctaaaggcattaagcagcgtatccacacggtgacggtggacaacgggaacatctacgtgaccttgagtaacgaacccttcaagtgcgattctgacttctacgctacaggcgattttaaagttatcaaatcatcttcatag

SEQ ID NO: 59425 - DNA, 357 bp, Artificial Sequence
  Description of Artificial Sequence: Synthetic coding sequence
atgaatctcgacgggtccgcccaagatcccgagaaacgagagtactcaagtgtctgtgtgggcagagaagacgatatcaagaaatctgagcggatgacagctgttgtacacgaccgcgaagttgtgatcttttaccataagggagagtaccacgctatggacataagatgttatcattcaggaggacctctgcatttgggcgacatcgaggatttcgacggacgcccatgcatcgtatgtccatggcacaagtataaaataaccctcgcaaccggcgagggcctgtatcagtccatcaacccaaaggacccttcagccaaaccaaaatggtgctccaagggcatcaagcagcgttag

SEQ ID NO: 59426 - DNA, 1032 bp, Artificial Sequence
  Description of Artificial Sequence: Synthetic coding sequence
atggctgagcagctatcacctggaaaggctgtggaccaggtttgtactttcctctttaagaagccaggccgaaagggcgctgcaggtcggaggaaacggcctgcctgcgaccctgagcctggcgagtctggctcatcttccgatgagggatgcactgtggtgcgcccagaaaaaaagcgcgtcacacacaatcccatgattcagaagacgcgggattcaggcaaacagaaggccgcttacggagatttgtcttccgaggaggaggaagaaaatgaaccggagagcttaggggtggtttacaagagcacgaggtcggctaagcctgtgggacctgaggatatgggtgctactgctgtctatgagctggacactgaaaaagagagggatgcccaagctattttcgagcgcagtcaaaaaattcaggaggagttgagaggcaaggaggacgacaaaatttatcggggaattaataattaccaaaaatatatgaaacccaaggacacgtcgatgggaaacgcctcgtccgggatggttcggaaggggccaatacgagcgcctgagcacctccgagcaactgttcgatgggactatcaacctgatatctgcaaagattacaaagagaccggattctgcggtttcggagattcttgcaaattcctgcacgacaggagtgactataagcacggctggcagattgagagagaattggatgaaggcaggtatggcgtctacgaagatgaaaattatgaagtcgggtcagacgacgaagaaatccccttcaagtgttttatttgccgacagtcttttcagaatcctgtcgtgaccaagtgcaggcactatttttgtgaaagctgtgccctacaacatttccgcaccacccctcgatgctatgtgtgtgatcagcaaaccaacggcgtcttcaacccggctaaggagcttattgccaagctggaaaaacatcgggcaactggcgagggaggcgctagtgatctgcctgaggatcccgatgaggacgcaatccccatcacttag

SEQ ID NO: 59427 - DNA, 969 bp, Artificial Sequence
  Description of Artificial Sequence: Synthetic coding sequence
atggccgctcccccatcccccggtaggacggcagatcaagccgatcaggtgtgtacctttctttttaaaaagccaggcagaaagggcgcagccggtctgcgcaaaagacctgcgtgcgatcccgagcatggcgaaagctctagctccggcgacgagggagacaccgttgcacaaccaccaagggtggctcccagaccgaggggcctgcattcttggcaaaaggcagcgcacggcgataggcgaggtgaagaagccgctccagagagtttggacgtggtttaccgcagtacacgcagtgcgaaaccagtgggtcctgaagacatgggtgctactgcggatttcgagcaggatactgaaaaggagcaccacaccccaactattctgaagtgtagccagcgggtgcaggaggccctccggggaagggagcatgaccatatctaccgcggtatacactcctatttaaggtacctcaaacccaaagacacttccatgggcaacagtagcagcggcatggcaaggaagggtcccatcagagccccaggacatctgcgagctaccgttcgttgggattatcagcctgatatctgtaaggactataaggaaaccggtttctgtggtttcggggacagctgcaaattcctacacgacaggtcggactacaagcttggatgggagattgaacgagagctagaggaaggtcgctattgtatttgtgaagatgagaaccatgaagtcggctccgaagaagaggaaattcctttccgttgtttcatctgccgacaagcgttccagaacccagttgtaaccaaatgtcgccattacttctgcgagtcctgtgcactcgaacactttcgcgctactccaagatgttatatctgtgaccaacccactggcggtattttcaatcctgctaaagaactcatggccaagcttcagaagctgcaggcagctgagggcaagaaacgttag

SEQ ID NO: 59428 - DNA, 516 bp, Artificial Sequence
  Description of Artificial Sequence: Synthetic coding sequence
atgtccagcaaacgcacaaaaaccaagaccaagaaaaggccacagcgggcaacaagcaatgttttcgctatgtttgaccagtctcaaatccaggaattcaaagaggctttcaacatgatagaccagaatcgcgacgggttcatcgataaggaggacttacacgacatgctggctagccttggcaaaaatcccacagacgaataccttgacgcaatgatgaacgaagctcccggtcccatcaacttcacgatgtttttaactatgtttggggaaaagctcaatggaacagatccggaagatgtcatcagaaatgcttttgcgtgcttcgatgaagaggccaccggaaccattcaagaagattatttgcgggaattgcttacaaccatgggtgaccgtttcaccgatgaagaggtagatgagttgtacagagaggctccaattgacaaaaagggcaatttcaactacattgaatttactcgcatccttaagcacggcgcaaaagataaggacgattag

SEQ ID NO: 59429 - DNA, 936 bp, Artificial Sequence
  Description of Artificial Sequence: Synthetic coding sequence
atggctgaggcgtcaccacaccccggaagatacttctgccactgttgctctgtagagatcgttccgagactgcctgactatatctgccccagatgcgaatctggctttattgaggagctccccgaggaaacacgatctaccgaaaacggcagtgcaccctcaaccgcgccaacagatcagagccggcctcccctcgagcacgtcgaccagcatcttttcactctgccccagggctatggccaattcgccttcggcatctttgacgactcttttgaaataccaacatttcccccaggagcacaggccgacgatggcagagatcccgaaagcaggagagaacgcgatcaccccagccggcaccgctacggagctcggcaacctagagcacgccttactacacgaagggcaacgggacgacatgagggcgtgcccactcttgaggggattattcagcagcttgtcaatggcattatcacacctgctacgattccctctctggggccttggggcgtgctccactctaaccccatggattatgcatggggggcaaatggcctggatgccatcattacccaacttctcaaccaatttgagaacaccggccctccccctgcagataaggagaaaattcaagcactgccaacagtgccggtcactgaagagcatgtgggatcgggacttgaatgtcccgtatgcaaggacgactatgccctaggggaaagggttcgccagcttccttgtaatcatctattccacgatgggtgtattgtcccatggctggagcaacacgattcctgtcccgtgtgtaggaagtccttgacaggccaaaatactgcgacaaaccccccaggactcacaggggtcagcttcagcagcagctcctcttccagctcttcttctagtccaagcaatgagaacgccacatcaaacagttag

SEQ ID NO: 59430 - DNA, 984 bp, Artificial Sequence
  Description of Artificial Sequence: Synthetic coding sequence
atggccgaggcttcgccacatccgggtcgttacttctgtcactgttgttcagttgagatcgtaccaagactccctgattatatatgcccaagatgtgaatcgggcttcatagaagagttacctgaggagacaagatccactgagaatgggtcggccccatcgactgcacctactgatcagtcccgtcctccccttgaacacgtggaccagcacttattcaccctaccacaggggtacgggcagtttgcgtttggcattttcgacgactcattcgaaatcccgacattccctccgggagcgcaggcagacgacggtcgcgaccccgaatccaggcgcgaaagagaccatccctcccgccatcgatacggggcacggcagcctcgggcacgactcacaactagaagagctacgggtagacacgaaggtgtgcccacactggaaggtatcattcagcagcttgtgaacggcatcatcacacccgctacaatcccctccctaggaccctggggcgtgctgcacagcaaccctatggactacgcgtggggcgcaaacggactggatgcaattattactcagctgctgaatcagttcgagaacacgggcccaccacccgcagacaaagagaagattcaggcattgccaaccgtgcctgtgacggaggagcacgtcgggagcggactagagtgccccgtgtgtaaggacgactatgcactgggcgaacgggtgcgtcagctgccctgcaatcacctgtttcatgacgggtgtatcgtaccctggctcgaacagcacgattcgtgccccgtgtgccgcaagagccttacagggcagaatactgccaccaacccaccgggtcttacgggcgtttccttctcgtcatctagtagctcctcttcttcctctagcccaagcaacgagaatgccacaacctggtctcctttggggagacctcagcccccacggccactcagcaatctcaccttatag

SEQ ID NO: 59431 - DNA, 456 bp, Artificial Sequence
  Description of Artificial Sequence: Synthetic coding sequence
atggccgaagacctcagcgcagccacaagctataccgaagatgacttctattgccccgtgtgccaggaggttttgaaaacacccgtgcgaacaacagcttgccagcatgtgaacagatccgagaccagtactagcgacaatacagaaacgtatcaggaaaatacaagtagcagcggtcatccaacgttcaaatgcccgctttgccaggagtctaactttacgcggcagaggttactggaccattgtaactccaaccacctcttccagatcgtccctgtcacttgccccatttgtgtgtctctcccctggggcgacccgagtcaaattactcgcaatttcgtcagccatttgaatcagcgacaccagtttgactacggtgaattcgtaaacctacagcttgacgaagagacacagtaccagacagccgttgaggaatcattccaggtgaacatttag

SEQ ID NO: 59432 - DNA, 738 bp, Artificial Sequence
  Description of Artificial Sequence: Synthetic coding sequence
atggctgaagatttgtctgccgctacttcttacaccgaggatgacttctattgccccgtgtgtcaggaggtgttgaagaccccagtgcgcacaacggcctgccaacatgtcttttgccgtaagtgtttcctgactgccatgcgggaatctggagctcactgccctctgtgccgcggtaatgtgacccgtagagagcgagcttgccccgagagagcgctggatctcgaaaatataatgagaaagttcagtggctcatgtcgctgctgcgccaaacaaattaagttctatcggatgcgtcatcactataagagctgtaaaaaataccaggacgagtatggggtcagctccattatccctaactttcagatcagtcaggattccgtgggtaattccaatcggtcggaaactagtacttctgataacactgaaacctatcaggagaatacctcctccagtggccaccccacattcaagtgtcccctgtgccaagaaagcaattttaccagacagcgtctgctggatcattgcaactctaaccacctttttcaaatcgtgccagtgacatgcccaatatgcgtgagcctgccatggggcgatccctcacaaattactagaaacttcgtgtcacatctcaaccagcgtcaccagttcgactatggggagtttgtgaatctccagcttgatgaagaaactcagtatcaaactgcagttgaagagagcttccaagtaaacatttag

SEQ ID NO: 59433 - DNA, 693 bp, Artificial Sequence
  Description of Artificial Sequence: Synthetic coding sequence
atgggccagcagatatctgatcaaacccagctcgtcattaacaagctgcctgaaaaggtggccaagcatgtgaccctcgtgcgggaatcgggctccctcacttacgaggaatttctgggacgcgtggccgaactgaacgacgttactgccaaagtcgcaagtggccaagagaagcatctgctctttgaggtgcaaccaggcagtgattcaagcgcattttggaaggtagtcgtgcgggtggtctgtacgaaaattaataaaagctctggtatcgtggaggctagtagaattatgaacctttaccagtttatacagctctataaagacattaccagccaagccgcaggggttctagcacagtcttctacctccgaagagcccgacgaaaactcctcttctgtgaccagctgtcaggcttctttgtggatgggccgtgtgaagcagttgactgatgaggaggaatgctgtatatgtatggatgggcgagccgacctgatcctgccctgcgcacattccttttgccagaaatgcattgacaagtggtctgatcggcataggaactgtcccatatgccgattgcaaatgactggcgctaatgagagctgggtggtatcggacgccccaacagaggacgacatggccaattacatccttaacatggctgatgaggcgggacagccccatagaccatag

SEQ ID NO: 59434 - DNA, 543 bp, Artificial Sequence
  Description of Artificial Sequence: Synthetic coding sequence
atgggacagcagatttccgaccagacacaactggtaataaacaaactgcccgaaaaggtggcgaaacacgttacgctggtgcgtgagtcaggctcattgacatacgaagaatttttaggcagggtggccgaactaaatgacgttaccgcgaaagtagcctccggtcaggagaaacatcttctgttcgaggtgcaacctggctccgactcttccgctttctggaaggtagtggtccgggtggtgtgtacaaaaattaataaatcgtctgggatcgtcgaggcttccagaatcatgaatctgtaccagttcatccagctttacaaggacattacttcgcaggccgcaggagtgctggcccagtctagcacatccgaggagcctgacgaaaattcttctagtgtcacgagttgccaggcctcactctggatgggacgggtcaagcagctgaccgacgaggaggagtgttgtatatgcatggatgggagggccgatcttatcctcccatgcgcccacagtttctgccagaagtgcatagataaatag

SEQ ID NO: 59435 - DNA, 2040 bp, Artificial Sequence
  Description of Artificial Sequence: Synthetic coding sequence
atgggagctctcacctctaggcaacatgctggcgtagaggaagttgacattccttccaattccgtataccggtaccctcctaagtccgggagttacttcgctagccattttatcatgggtggcgagaagttcgactctacgcacccagaggggtacctatttggggagaactcagatctcaacttccttggaaacaggccagtggtctttccttacgctgccccacccccacaggagccagttaaaaccttgcgttcacttgtcaatatcagaaaggacaccctgcggctggtcaagtgcgcagaggaggttaaatctccaggcgaagaagcatctaaagccaaggtacattacaacgtggagttcacattcgatacagatgccagagtggcaatcactatctactatcaggccactgaggaattccagaatggtatcgcgtcttacatacctaaggataatagcctacagagcgagacagttcaatacaaaaggggagtgtgtcagcaattttgcctgccaagccacaccgtcgacccatccgagtgggctgaggaggagctcggcttcgatctggacagggaggtgtacccgttagtggtacacgcagtggtggacgagggcgacgaatacttcggtcattgccacgtgttgctgggcacattcgaaaagcacacagacggcaccttttgcgtaaaacccctgaaacagaaacaggtcgtggatggtgtgagctacttgctccaggaaatttatggcatagaaaataagtataatacacaggatagcaaggttgccgaggatgaggtgtctgataatagtgccgagtgcgtggtatgcctttctgacgtgagggacacactgatcttgccttgtcgccatttgtgcctttgtaacacctgtgcagacacactgagataccaagcaaacaactgccccatctgtaggttgcccttccgggcattgcttcagatccgcgctatgaggaaaaaattggggccactgtcccccacgtcgttcaaccccataatctcatctcagaccagtgactccgaggaacacccctcttctgaaaatatccctcccggatacgaagtggtgtcgctgctggaagcactcaacggacccctgacgcctagtcccgcagtcccccctctgcacgtgttaggagacggacacctaagtggaatgctgccaagttacggcagcgatggccacctacccccagtgagaaccatcagcccacttgataggctgagtgactccagcagccaagggttgaagctcaagaaatcgctctccaaatcaacctcccagaattcctcggtgcttcacgaagaggaggacgagcactcctgttccgaatccgagacacagttatcacaacggccttctgttcagcacctgggcgaagagtgcggggtgacccccgaatctgagaacctgacactaagcagctctggcgctattgaccagtcatcctgtaccgggactccacttagctcgacaatatctagcccagagggccctgcaagctctagtctggcgcagagtgtgatgtctatggcgtccagtcagatttcaaccgatacggtgtcgtcgatgtctgggagttatatcgctccaggaacagaggaagagggcgaggctctctcatccccccagccagccagccgggctcccagtgaggagggcgagggtctgcctgctgagtccccggactcaaatttcgctggacttccagccggagaacaggacgccgaagggaacgacgtgatcgaggaggaggacggcagcccaacccaagagggccaacggacatgtgctttccttggaatggaatgcgataataataatgacttcgacattgcttcagttaaggccctcgataacaaactgtgctccgaggtgtgcctccccggtgcctggcaagccgatgataatgccgtgtctcgaaatgctcaacgcagacgactttcttccagctcgctcgaggacagcgagacacgaccctgtgtctggggacccctcgcggtatag

SEQ ID NO: 59436 - DNA, 1143 bp, Artificial Sequence
  Description of Artificial Sequence: Synthetic coding sequence
atggggggtgagaagttcgattcaactcaccccgaagggtatctgttcggggaaaattccgacctgaattttctgggaaatcggccagtcgttttcccctacgctgcccctccaccacaggagccggtcaaaacattacggtccctcgtcaatatacggaaggacactctgcgcctggttaagtgcgcggaagaggtgaagagccctggggaggaggcatctaaagctaaagtccactataacgtggagtttacctttgatacagacgccagggtggcgattacaatttattaccaagcgacagaggaattccagaacggtatagctagctatattcctaaagataactcgctccagtctgagacagtgcagtataaacggggagtgtgccagcaattttgcctgccaagccatacagtagatccaagcgagtgggcagaggaggagttgggtttcgatttggaccgggaagtgtacccgctggtcgtgcacgcagttgtggatgagggcgacgagtatttcggccactgccacgtgctgctgggtactttcgagaagcacactgacgggacattctgcgtgaagcccctaaagcagaaacaagtcgttgatggagtttcatatttacttcaggaaatatatggaatcgagaacaagtataatacgcaagatagcaaggttgcagaggatgaagtgagcgataactccgctgagtgtgtggtgtgcctctcggatgtgcgggacacactcattttaccttgtcgccacttgtgcctgtgtaatacatgtgccgacacactcagataccaggctaacaattgtccgatctgtcgtctgccttttcgcgctctcctccagatcagggcaatgagaaagaagctgggtcctctctctcccacctcgttcaaccctatcatatcttcgcaaacatctgatagcgaggagcacccttccagcgagaatatcccaccaggatatgaggtggtcagccttctcgaagctctaaatggtcccttgactcctcctagtttattgaaaatacaaaagatttcatgggcctggcttcaggcccctgtggtacctgctacctgggaagccgaagccggagaatggcccgaacctggcagacggagtctgcagtag

SEQ ID NO: 59437 - DNA, 1974 bp, Artificial Sequence
  Description of Artificial Sequence: Synthetic coding sequence
atgggcgcacttactagtcggcagcacgctggcgtcgaggaggttgatattccttccaatagcgtgtatagatacccgcctaaatcggggtcttacttcgccagtcacttcattatggggggtgagaaattcgactctacccatcccgagggctatctattcggtgagaatagcgacctgaattttctaggcaaccgcccagtcgtatttccctacgctgccccacctccacaggaacctgtcaagacattgaggtctctggtgaacatcagaaaggacaccttgcgcctggtgaagtgtgccgaagaagttaaatctcccggagaggaggcctctaaagccaaggtccactacaatgtggagtttacctttgataccgatgcccgagtggcgatcacaatatattaccaagccaccgaagagttccagaacggcatagcttcctacattccaaaagataatagtctacagtccgagacagtgcaatataaacgcggtgtgtgccagcaattctgtttgccatcgcacaccgttgacccatcggaatgggcggaggaagagctgggctttgacctagatcgtgaggtctaccctctggtggttcacgctgtagtggacgaaggggacgaatacttcggccattgtcatgtgctgctaggaacatttgaaaaacacacagacggtaccttttgtgtgaaacctcttaagcagaaacaggtcgtagatggcgtctcctatctcctccaggagatatatggaattgagaacaagtacaacacacaggatagcaaggtggctgaggacgaggtgtcagataacagtgctgaatgtgtcgtctgtctcagcgatgtgcgggacactctgatcctgccctgccggcacctatgtctctgcaatacttgcgcggacaccctgagatatcaggcaaataactgtcccatctgccggttaccctttcgtgctctcctgcaaatcagggcaatgcgtaagaaactaggacccctatctccaaccagctttaacccgatcatctcctctcagactagtgattccgaggaacaccccagctccgaaaacatacctccaggctacgaggtggtaagcctactggaagcgctgaacggtcccctgacccccagccctgctgtgcccccactccacgtccttggggatgggcacctatccggcatgctaccgagctacgggtctgacggacacttacccccagtccgcacgatcagccctctggaccgtctgtctgatagtagttcacagggtcttaagctgaagaagtcactgagtaagagcaccagccagaatagctcggtgctgcacgaggaggaagatgaacactcctgcagtgagagcgagacccagttaagccaaaggccatccgttcagcatctgggcgaggagtgcggcgtcactcctgaaagcgaaaatctcacactgtctagttctggggctattgaccagtcctcctgcaccggaactcctttatcctcaacgattagtagtccggagggaccagcatcctctagcctcgcccagtcggtgatgagtatggcttcatcccagatcagcaccgataccgtaagttccatgtctggatcctacatagcgccaggcactgaggaagagggcgaagcactgagtagcccacagccggcttccagagctcccagcgaggagggggagggcaacgacgtgatcgaggaggaggacgggagcccaacccaagaggggcagcggacttgcgccttccttggcatggagtgtgataataataacgattttgatattgcctccgtcaaggccttagataacaaactctgctcagaggtgtgtttgcctggggcatggcaggcggatgacaatgctgtctcacggaacgctcagagaaggcgactgtcatcatcatccctcgaagactcagagacaagaccgtgcgtgtgggggccactggctgtgtag

SEQ ID NO: 59438 - DNA, 1041 bp, Artificial Sequence
  Description of Artificial Sequence: Synthetic coding sequence
atggtgttagttcacgttggctacctggtgctccccgtttttggtagtgtgcggaacaggggagccccatttcagagatctcagcaccctcacgcaacatcatgtagacatttccacctcggtcccccacaaccacagcagttagcacccgacttccctctggcccatccagtccaatcccagccaggattaagcgcccacatggcccctgctcaccaacattccggagccctgcaccagtctctcaccccactcccaacactgcagtttcaggacgttacaggtccctcatttctcccacaggcgttacaccaacagtacctgctccagcaacagctcttggaagcgcagcacagacgcctggtaagccatccgagaagaagtcaggaacgggtcagcgtccacccacatcgtcttcatccttcgtttgattttggtcaactacaaaccccacagccacggtatctggccgagggcacagactgggatctgagcgtcgacgccggtcttagcccagctcaattccaggtgcggccaattcctcagcactatcagcactatctagctacacctcgaatgcaccactttccgcgaaactcaagctcgacccagatggtggtccatgagatccgcaactacccgtaccctcagctacacttcttagccctgcaagggctcaatccgagccggcatacatctgcagttcgggaatcttatgaggaacttcttcagctcgaagacaggctgggaaatgtgactcgcggtgcagttcaaaatactattgagaggttcactttcccacataagtataaaaaacgtagaccacaggatgggaaagggaagaaggatgagggagaggaaagcgatactgatgaaaaatgcacaatttgcctcagcatgctcgaggacggcgaggacgttcggaggttgccgtgtatgcatctgttccatcagctgtgcgtggatcaatggttggcaatgtctaagaaatgcccaatatgccgggtggacatcgaaacccagctgggggcagatagttag

SEQ ID NO: 59439 - DNA, 465 bp, Artificial Sequence
  Description of Artificial Sequence: Synthetic coding sequence
atgcatcactttcctagaaatagttctagcacacagatggtagtgcacgaaatccggaattacccatatccgcaactccatttcctggccctgcaaggcctgaaccccagcagacatacgtccgccgtgagggagagctacgaggagctgctgcaactcgaggatagacttggtaacgtaacgcggggagcagtccagaacacaattgagagatttacatttcctcataaatataagaagcgcaggccccaggatgggaagggaaagaaggatgagggggaggaatcggataccgatgaaaaatgcacaatctgtctcagtatgctggaggacggggaagatgttagacggttaccctgcatgcacctttttcatcagctatgcgtcgatcagtggctggccatgtccaagaagtgtcccatttgtcgcgtggacatcgaaacacagctgggggcagactcctag

SEQ ID NO: 59440 - DNA, 87 bp, Artificial Sequence
  Description of Artificial Sequence: Synthetic coding sequence
atggttctcgtacatgtgggttacctcgtgctgccagttttcggctctgtgaggaatagaggcatttccgtgtggatgctcgcctag

SEQ ID NO: 59441 - DNA, 714 bp, Artificial Sequence
  Description of Artificial Sequence: Synthetic coding sequence
atggccatgttccgaagtctggtagcatccgcccagcagagacagcctccagcagggcctgcaggaggcgattccggactggaggctcagtacacttgcccgatctgtcttgaagtctaccaccggccagtcgctatcggaagctgtggacacacattctgcggcgagtgtcttcagccatgcttacaggtaccgtctcctctgtgcccgctgtgtaggctgccatttgatccaaaaaaggttgacaaagcaactcatgtcgaaaagcagctctctagctacaaagccccttgcagggggtgtaacaagaaagtcaccctcgcaaagatgagggtccatataagttcatgtctgaaggtccaggagcagatggccaattgcccaaaattcgtccccgtggtaccaacctcccaaccaattccttctaatatccccaaccggtccacctttgcatgtccgtactgcggcgctcgcaatctggaccagcaggagctagtcaagcattgcgtggagtcccacaggagcgacccaaacagagtggtatgcccgatttgctctgccatgccatggggggatccatcatataagtccgcaaactttctccaacacctattacacagacataagttttcctatgacacgttcgttgactactcaattgacgaggaggccgcttttcaagcggcacttgccttatccctctctgagaattag

SEQ ID NO: 59442 - DNA, 471 bp, Artificial Sequence
  Description of Artificial Sequence: Synthetic coding sequence
atggccatgttcaggtccttagtggcctctgcgcagcagagacagccaccagctgggcctgctgggggtgatagcggactcgaggcgcaatacacatgcccgatttgtctcgaagtgcaggaacagatggctaactgtccaaaatttgtgcctgtggtgcccactagtcaaccgatacccagcaatattccaaaccgaagcacttttgcatgcccctactgtggggctaggaatctggatcagcaagaattggttaaacattgcgtggagtcacatcgatcggatccaaaccgggtggtgtgcccaatttgctcagctatgccatggggggaccctagctacaagtcagctaacttcctgcagcacctgcttcacagacataaattcagctacgatacattcgtagattattctattgatgaggaagccgcattccaagctgctctggccctgtctctctctgagaactag

SEQ ID NO: 59443 - DNA, 387 bp, Artificial Sequence
  Description of Artificial Sequence: Synthetic coding sequence
atgcgcgtgcatatcagctcgtgtcttaaagtacaggaacagatggccaactgtcccaaatttgttcccgtggtgccaacctctcagccgattccgagtaatatccccaataggtccactttcgcctgcccatattgtggggctcgcaatctggaccagcaggagcttgttaagcactgtgtcgagtcccaccgaagcgacccgaatcgtgtcgtatgtccgatatgtagtgctatgccatggggcgatccgtcttacaagagcgccaacttcctccagcatctgttgcacaggcataaattctcttacgatactttcgttgattattctatagacgaggaagctgccttccaggctgcgctggccctgagtctatctgagaattag

SEQ ID NO: 59444 - DNA, 471 bp, Artificial Sequence
  Description of Artificial Sequence: Synthetic coding sequence
atggccatgttcaggtctctggtggctagtgctcagcagcgccaacctccggcagggcctgccggtggcgattccggactggaggctcagtacacctgcccaatttgcctggaagtgcaagagcagatggcaaactgtccaaagttcgtgccagtggtacctacctctcaacctataccatctaacatacccaaccgaagcacctttgcttgtccgtactgcggagctcgcaaccttgaccagcaagaactggtcaagcactgtgtggaaagtcacaggtccgaccccaaccgggtagtctgccccatttgctccgcaatgccctggggggatccaagttataaaagcgcaaactttctgcaacacttgctacataggcataaattctcttatgatacctttgtcgattactccatagatgaggaggcggctttccaggcagctttggccctttctctcagcgagaactag

SEQ ID NO: 59445 - DNA, 2127 bp, Artificial Sequence
  Description of Artificial Sequence: Synthetic coding sequence
atggcagcagctgggccttccacaagagctagcagcgctgcggctgcagctgccctcagtcggaggggcagaagaggaagatgtgacgaaaccgctgcagcaaaaaccggggctccgggacctgcgtcagggccaagtctcctcgtactttcccccccactgcttcagccaccactgcctccacgaccagaagagagcggctgtgcagggtgtttagaacccccaggcgaagctgctgctctgccctgtggacatagcctctgcaggggctgcgcccagcgggctgcagatgctgccggaccaggttgcccaagatgcagagccagagggcctggttgggcgagacgcagggccagggatgatggtcaagctgactctgaggtgctgggcgagtgcgctagaaggtcccagccggagaggtgcaggcccaggagagacgggggagccgctgccgctggacccaggccagagcaagaaccacgagctgccccagcggagccagacttcattttccgagctcccattaaactcagcaaaccgggtgaactacgcgaggaatacgaaagcctgagaaaattaagagaggagaagcttcaggaagagaagccgagcgaggatcagattcataagctgctgcctgaggacactgaaacaggcaaaagaaagatggacgagcagaagaagcgagacgagcccttggtcctgaagaccaatctagagaggtgtccagcccgactgtcggactcagagaatgaagagcctagccggggacagatgacccagactcatcggagcgcttttgtgtctaaaaacaactcgtacagtcttgcatttctcgctgggaaattgaatagcaaggtggagcgatcacagtcctgctcagatacggcacaggagcgggctaaatctcgtgtgcgggctgtgccagggaacaaagccaaagtgaccaccatgactccagctagcaacccaataatcggcgtgctgcttagcacccaaaacaatcgatgtgtttctgctccggatcttactatcgagaaacggctgcctttctctagcctgagtagtttagcatccctacacaagcccgagcgaagcgtctcacctgagtctaacgacagtatctctgaggagctaaaccacttcaagcccatcgtatgttctccatgtactcctcctaaaaggcttcccgacggacgcgtcctctctccgctcatcattaagagcacacctaggaacctgaatcggtctctacagaaacaaacctcctacgaggcctcgcctagaattctcaaaaagtgggagcagatcttccaagagagacagatcaaaaagacattgtctaaggcgactctaacctcgctggctccagaaatgggtgaggagctgttggggtcggaggggatccactcaagcaaggagaaacccctcgtggcagttaatactcggttgtccggtgggcaagttctgagcgaatacaccggacccactagcgctgacctggaccatttcccctctgtgtctcaaactaaagccgagcaggattccgataataaatcttctaccgagatccctctggaaacatgttgtagctcggagctgaaaggcggaggttccgggactagtctcgaaagggaacagtttgagggcctggggtcgacccccgacgcaaagctggataagacttgcatttctcgcgcaatgaaaatcactactgtgaactctgtgcttccccaaaacagtgtgttgggtggggtgctgaagacaaagcaacaacttaaaacattaaaccactttgatttaacgaatggcgtgcttgtagaatccctatccgaagaacctctgccttctctgcgcaggggccgtaaacgccactgcaagacgaaacacctggaacagaacggtagcctgaagaagctccgacagactagcggggaggtgggtttagcaccaacagaccctgtgctgagggaaatggaacagaagctccaacaggaggaggaagatcggcagctggcactgcagctgcaaaggatgttcgacaatgaaagaagaactgtctcacgaagaaaagggtcagtggaccagtatctgctccggtcttccaacatggcaggagccaagtag

SEQ ID NO: 59446 - DNA, 240 bp, Artificial Sequence
  Description of Artificial Sequence: Synthetic coding sequence
tagctggagcagaacggatctctcaaaaagctgagacagacctcaggagaagtggggttagctccaaccgatccagtgctgcgcgaaatggaacagaaactgcaacaggaggaagaggatcgccaactagctctgcagctgcaaaggatgtttgataatgaacgtaggacggtgtcccggagaaagggatccgtagaccagtatctgctgcggagtagcaacatggctggagccaagtag

SEQ ID NO: 59447 - DNA, 579 bp, Artificial Sequence
  Description of Artificial Sequence: Synthetic coding sequence
atggcagaacagcaggggagagaactcgaggcagagtgccctgtctgctggaatcccttcaataatacctttcatactccgaagatgctggactgttgtcacagcttttgtgtggagtgtctggcacacttatcactcgtgactccagcaagaaggcggctgctgtgcccactgtgtagacagcccactgtgctggcttccggtcagcctgttaccgatcttccaaccgacactgctatgctggccctgttacggctcgagccacatcacgtaattttagaaggtcatcagctgtgtcttaaggaccagccgaagtcacgctactttctcaggcagccacaagtatacactcttgatttgggaccccaacccggagggcagaccggcccacccccagatacagcaagcgccaccgtgtccactccaattcttattccaagccaccactcgctgagagaatgctttaggaacccgcaattccgtatctttgcatacttgatggctgtgatcctttccgttaccctgctgttgatattttcaatcttttggactaaacaattcctgtggggggttggctag

SEQ ID NO: 59448 - DNA, 579 bp, Artificial Sequence
  Description of Artificial Sequence: Synthetic coding sequence
atggcagagcaacagggacgtgaattggaggcagagtgtcccgtgtgctggaatccctttaataacactttccacaccccaaagatgctcgactgctgtcacagtttttgtgtggagtgtctcgcccatctgtcgctggtgacccccgcacggcgaaggctgctctgccccctctgtcgtcagcctactgtcctggcttcaggacaacctgtgacggacctgccaacagacaccgcgatgctggcgctcttgcgtctggaaccacatcacgtaattctggaagggcaccagttgtgcctaaaggaccaacctaaaagtcgctatttcctccgccagccacaggtgtacaccctggaccttgggccacagccaggtggacagacaggaccccctcctgatacggcctccgcaaccgtgtctaccccaattctgattccctctcaccacagcctgcgagagtgctttcgtaatcctcagttcaggatttttgcttatctcatggcagtgattctttcagtaaccctgttactgatattcagcattttttggactaagcagtttttgtggggggtgggctag

SEQ ID NO: 59449 - DNA, 579 bp, Artificial Sequence
  Description of Artificial Sequence: Synthetic coding sequence
atggcggaacagcaaggaagagagctggaagctgaatgcccggtgtgttggaatccctttaataatacctttcacactcctaaaatgttggactgttgccactcgttttgtgtcgaatgcttagcccatctctccttggtgacacctgccaggagacgcctgctgtgcccgttgtgccgccagcctacggtacttgcctccgggcagcccgttacagatctgccaaccgatacagcgatgctggctctgttgaggctcgagccccatcacgtaatcctcgaaggacatcaactctgtctcaaggatcaacctaaatcacgctattttttgaggcagccccaggtatacaccctcgatctggggccacaacctggcggacaaacaggacctcctccagataccgccagtgccaccgtctccaccccgatattaatcccatctcaccattcactaagggagtgttttagaaatcctcagtttcggatattcgcataccttatggctgtgatacttagtgtgaccctcctcttgatattcagcatcttttggacaaaacagtttctctggggtgttggatag

SEQ ID NO: 59450 - DNA, 579 bp, Artificial Sequence
  Description of Artificial Sequence: Synthetic coding sequence
atggcggagcagcagggcagagaactagaggccgagtgcccggtgtgttggaatccctttaacaacacctttcacacaccaaagatgctggactgctgccattccttctgtgtcgaatgcttagctcacctgtccttggtaacaccggctcggagacggctgctgtgtcccttgtgccgacaacctaccgtgctggcttctggccaaccggtgaccgacctcccaactgacactgccatgttggcgctcctgcggttggagcctcatcacgttatccttgaagggcatcagctgtgcctgaaggaccaacccaagagccggtacttcctcagacagccccaggtgtacaccttggatttgggcccacagcccggtggtcagaccggtcccccacccgatacagcgtctgccaccgtgagcacccccatcttaattccttcacatcattctctcagggagtgtttccgtaacccccaatttcgaattttcgcctatttgatggcagtgattttgtccgtgaccctgctgctgatcttcagcatcttctggacaaagcagttcctgtggggcgtgggatag

SEQ ID NO: 59451 - DNA, 1905 bp, Artificial Sequence
  Description of Artificial Sequence: Synthetic coding sequence
atgagcggcgcaatatttggcccacttgagggtccgagttcgctggatgcaccctcaatccaccccctcgtctgccctctctgtcacgttcagtatgaaagaccatgtctgctcgattgcttccacgacttttgtgcgggatgtctcagggggagggccacggatggcaggctgacttgccctctgtgtcagcaccagacagtgctgaaggggccaagtggactgcctcctgttgatagactgctgcagttcctggtggattccagcggcgatggggtggaggcggttagatgcgctaattgtgatttagagtgttccgagcaggacgtggagacaacctacttttgcaatacgtgcggacaaccgctgtgcgcacggtgtagggatgagacgcatagggcgagaatgttcgccaggcacgacattgtggccttgggccaacgaagcagagatgtaccacagaaatgcactttgcatgcagaaccatatctgttgttttcaacagataaaaagttgctgctctgtatcagatgtttccgcgatatgcagaaagaaagccgggctcattgcgtcgatctcgaaagcgcctacgtacagggctgtgagagacttgaacaggccgtgctggccgtcaaggcgttgcaaaccgccacccgtgaagctattgctctccttcaggctatggtcgaggaggttagacactccgctgctgaagaggaggatgccattcatgccctgtttggcagcatgcaggataggctggcggagcggaaagcactactgctgcaggcagttcaatcacagtatgaggagaaggacaaagcctttaaggaacaactgagccacctagctaccctcctccccacactgcaggttcacttagtgatctgcagctcctttctgagtctggccaataaagccgagttccttgacctgggttatgagctgatggagcgtcttcagggtatcgtgactagacctcatcatctccggcctattcagagcagcaaaatcgcttcggaccatcgtgctgagttcgcacggtgtctggaaccgctgctcctcttaggccctaggcgggtagcagcagcagcatcaggagctaatactctggccggaggactcggccctaaagcgctgaccggtcctcactgccctagcccagtggggaaaatgtcaggctcccccgtgcagaagcccaccctacataggagtatatcaaccaaggttctgttggctgagggcgaaaacactcccttcgcagagcactgtcgacactatgaagacagttatcgccatctccaagctgagatgcagagcttgaaggaccaggtacaggagcttcacagggacctcacaaaacaccactctctgatcaaggcagaaattatgggggatgtcctgcacaaatcactgcagttggacgtgcagatcgcctccgaacacgcaagcttggagggcatgagggtagtcttccaggagatctgggaggaagcgtatcaacgcgtcgccaacgaacaggagatctatgaagcccaacttcacgacctactgcagttacggcaggagaatgcttatctgaccacaattaccaaacagattaccccctacgttagatcgattgctaaagtgaaggaaagacttgaacccaggttccaggctcctgtcgacgagcagtccgaaagcctccagaatacccatgacgattccaggaacaacgccgcatccgcaaggaataacccaggcagtgtaccagagaagagggagaaaacatctgagccaaaaggcaattcctgggcgccaaacggcctgtctgaagagccattgctgaaaaatatggaccaccaccgatcaaaacagaagaacgggggagatgtccccacttggcgcgagcatccaacgtag

SEQ ID NO: 59452 - DNA, 435 bp, Artificial Sequence
  Description of Artificial Sequence: Synthetic coding sequence
atggtggaggaagtcagacattctgcggcagaggaagaggatgctattcacgccctgtttggtagcatgcaggacaggctcgccgaaaggaaggccctgctactgcaggctgttcagtcccaatacgaggagaaggacaaggcctttaaggagcaactgtcacatcttgcaaccctgttgccaaccctgcaggtccacctggtgatctgtagtagctttctctcattagcgaataaagcggaatttttggacctgggatacgcagggagagggcttcggcctcagggtgctgacggtgctcctttacccctcccatcccggaaagatgtcggagtgacacgtccaaaggcccacgcagctcccgttcatcagcatcagggcgcagctggtggagggagggagcatgcattgagaagggccctgccaccgctatag

SEQ ID NO: 59453 - DNA, 786 bp, Artificial Sequence
  Description of Artificial Sequence: Synthetic coding sequence
atgccatccgatcctggaccagaggctgggagcgggtggcccggtctcctcatgtcctgcctcaagggacctcatgttatcctgaaaatggaagccatgaagatcgtccatccggagaagtttcccgaattgcctgcagcgccttgcttccccccagccccacggcctaccccaacactggctcctaagcgggcttggcccagcgacacagagatcatcgtaaatcaagcttgtggaggggacatgcctgcccttgagggcgctcctcacacccctccgctccccaggcggcctcggaagggcagtagtgagctgggcttccctagggtagccccagaagacgaggtaattgtgaaccagtacgtgattagacccggaccaagtgccagtgccgctagtagcgcagctgcaggcgaacctctcgagtgcccaacatgcggacacagctacaacgtcacacagcgcagacccagagtgctgtcttgtttacactcagtgtgcgagcaatgtcttcagatcctgtacgagtcctgtcccaaatacaaattcatttcatgtccaacctgcaggcgggagaccgtcctcttcacagactatggactggccgcactggcggtgaacacctccattctgtctagactgccaccagaagccctcacagccccttctgggggacagtggggagccgaacccgagggcagctgctaccaaaccttccggcaatactgtggagcagcctgcacatgccatgtccgaaatccactcagcgcctgttcaatcatgtag

SEQ ID NO: 59454 - DNA, 786 bp, Artificial Sequence
  Description of Artificial Sequence: Synthetic coding sequence
atgccctccgaccctggccctgaagctggctccgggtggcccggactgcttatgagctgtctaaaggggcctcacgttatcctgaagatggaggctatgaaaattgtgcatcccgaaaaatttcccgaacttcccgctgcgccatgcttcccgcctgccccaaggccaacgccaacactcgcacccaaacgggcttggcccagcgataccgaaattatcgtcaatcaggcctgtggtggtgatatgccagccctcgagggggctcctcatacccctcctcttcccagacgtccaaggaagggctcatcggaacttggatttcctagggtggccccagaggacgaggtaatagtgaatcagtacgtgatacgtccaggaccttctgcctcagctgcatcatctgcggctgcgggagaaccactggaatgcccaacatgcgggcactcttacaatgtcactcagaggcggcctagagttctctcatgtctccatagtgtatgcgagcagtgcctacagatcctgtatgaaagctgtccaaagtataaatttatatcttgcccaacctgcaggcgcgagaccgtcctgtttactgactacggccttgctgcactcgccgtcaacaccagcatactctcccgcctgcctcctgaggccctgaccgcaccgtctggtggtcagtggggcgcagaacccgagggtagctgttaccaaacttttagacagtattgtggtgccgcttgcacttgccatgtcagaaatcccctgtccgcatgctctataatgtag

SEQ ID NO: 59455 - DNA, 2112 bp, Artificial Sequence
  Description of Artificial Sequence: Synthetic coding sequence
atggctgcctctgaggtcgctggggtggtggcaaacgctccttcccctcccgaatctagtagcctgtgcgcaagcaagagtgacgagggcttacctgacgggctctctactaaggactcagcgcagaagcaaaagaatagtccgcttttatccgtgtcgtcacagaccataaccaaagagaataacagaaatgttcacctcgagcattccgaacagaaccctggatcttctgctggcgacacctcagctgcccatcaagtggtattaggcgagaacttaatcgctactgctctttgcctctcaggttccggttcccagagcgatttgaaagatgtagccagcactgctggcgaggaaggcgacacgtcattaagagagagcctgcatcccgtaaccagaagcctaaaagccggatgtcatactaagcaactggcgtcgcgcaactgctctgaggaaaagtcacctcagacctccatacttaaggaggggaatcgagacacgtcgttggacttcaggcccgtggtgagccccgcaaacggcgtcgaaggagtacgtgtcgaccaggacgacgaccaagactcgtcctccctgaagctttcccaaaatattgcggtccaaacagatttcaagacagctgatagcgaggtgaataccgatcaagacatagaaaaaaacctcgataaaatgatgaccgagaggaccctgctgaaggaacggtatcaggaggtcttggacaaacaacggcaagtggagaaccagctgcaagtccagctcaagcagctgcagcagcgccgagaggaggagatgaagaatcatcaggagatactgaaagccatacaggacgttacaatcaagagagaagagaccaagaaaaagatagaaaaagagaaaaaagaatttctgcagaaagagcaagatctgaaggccgagattgagaagctgtgtgagaagggaagacgggaggtgtgggagatggaactcgataggctgaaaaaccaagacggtgagataaatcgtaatataatggaagagaccgagcgggcatggaaagcggagatcctgtcactggaatctaggaaagaacttctagttctgaaactagaggaagccgaaaaagaggctgaactacacctgacgtatctcaaaagtactccacccacacttgagaccgtacggtctaaacaagagtgggagacgcgattgaatggggttaggattatgaaaaagaacgtccgtgatcagtttaacagccacatacagctggtcagaaacggtgctaagctgagctccctcccgcagattccgactccgacccttccccctcccccaagcgagactgacttcatgttacaggtgttccagccctcgccctccttggcaccaagaatgccttttagcatcgggcaggtgactatgcccatggtgatgccatccgctgaccctcgcagcttatctttccccatcttaaatcctgccctgtctcagccctcccagccaagttcccccctgcccggtagccacggccgaaatagtcctgggctgggctcactcgtttcacctcatggcccacacatgcctccagcggctagtattccacctccccctggactgggtggggtaaaggcctcggccgaaactcccaggccacagccagtagacaagctggaaaagattctggagaagctcctgactcggtttcctcagtgcaataaagcccaaatgaccaacattctgcagcagattaaaactgcacgaacgactatggccggattaaccatggaggaattgatccagctggtcgccgcaaggctggccgaacacgagcgggtggccgcttccacccagccgctcggcagaattcgggcactttttcccgcacccctggcccagatcagtacccctatgtttttacctagcgcccaggtaagttatcctggccgaagttctcatgcacccgcaacatgcaaactgtgcctcatgtgccagaaactggttcaaccctctgagctccaccctatggcctgtacccacgtcttgcacaaagagtgtatcaagttttgggctcagactaacaccaacgacacatgcccattctgtcctacactgaaatag

SEQ ID NO: 59456 - DNA, 2112 bp, Artificial Sequence
  Description of Artificial Sequence: Synthetic coding sequence
atggccgcatctgaagtggcaggcgttgttgctaacgcgccttctcccccagagtcctccagcctctgcgccagcaaatctgatgaagggctccccgacggactgtctactaaagactctgcacagaaacagaagaatagcccactcctctccgtaagtagccagaccataacgaaggagaacaatcgcaacgttcacctggagcattcagagcagaatcctgggtcctccgcaggggacacgtcagcggctcatcaggtcgtcctgggcgagaacctaattgctaccgctctgtgtctgtcaggctctggaagtcagagtgacctaaaggacgtggcatctacggcgggtgaggaaggagatacctctctgagggaatctctgcatcctgtcaccagatctcttaaggccggttgccatacaaaacaattagcttctcgcaactgtagcgaagagaagagtccccagacaagcattctgaaagaaggcaaccgagacacatctctcgacttcaggcctgtcgtgtcaccagccaatggtgtggagggtgtgcgcgtcgatcaggacgacgatcaggactccagttcattaaaattgtcacagaatatcgccgtccagactgattttaaaacagccgactccgaagtcaacaccgaccaggacatagaaaagaacttggacaagatgatgacagaacgaacactcttgaaggagaggtaccaggaagtccttgataagcagaggcaggtggaaaatcagctgcaggtacagctgaagcagctccagcaacgcagagaggaagagatgaagaaccatcaggaaatcttgaaagcaattcaggatgttactattaaaagagaggagacgaagaaaaaaatcgagaaggaaaaaaaggagttcctccagaaggaacaggacctcaaggccgagattgaaaagttgtgcgaaaagggaagacgcgaagtttgggaaatggagctggaccggctaaaaaatcaagacggtgaaattaaccggaacatcatggaagaaacagaaagagcgtggaaagctgagattctgagtctggaaagtaggaaggagcttttggtcctcaagctcgaggaagccgagaaagaggcagagctgcacctgacgtacctgaagtctacaccccctactctggaaacagttcgatccaaacaggaatgggagactaggctcaatggcgttcggataatgaaaaagaatgtacgcgatcagtttaactctcatatccagctggtccggaacggcgcaaagctgagctcactccctcaaattccgacacccactttgccaccccctccttccgaaacggactttatgctacaggtgttccagccctccccctcccttgcgccacggatgccctttagtattggacaggtcaccatgccaatggtgatgccatctgctgaccccaggagtttgagctttccgattctgaatccagctttgtcccagccctcgcagccttctagccctctgccgggtagtcatgggaggaactctcccggactcgggagtttggtgtcacctcacggtccgcacatgcccccagccgctagcatcccgccacctccaggtctgggcggtgtgaaggcctcagcagaaacaccacgcccacagccagtagataagctggagaagatcctagagaagctgcttacccgcttcccccagtgtaacaaagcccaaatgacaaatattttacagcaaattaagacagcgaggacaaccatggcaggcctgactatggaagaactgatccagctggtcgcggcaagactggccgagcatgaacgcgttgccgcatcaactcagcctctgggccgtattagagccctgtttccagcgcctctcgcccagatttcaactccaatgtttctgcccagcgcacaagtgtcttacccaggcaggtcctcgcatgcaccagctacatgtaagctgtgtcttatgtgccagaaattagtgcagccatctgagctgcatccaatggcttgtacacacgttctgcataaggagtgcatcaaattttgggctcaaacgaatacgaatgacacgtgccccttctgtccaactctcaaatag

SEQ ID NO: 59457 - DNA, 441 bp, Artificial Sequence
  Description of Artificial Sequence: Synthetic coding sequence
atggcagccagcgaagtggctggcgtggtggcgaatgccccaagcccccctgagtctagctctctgtgtgctagcaagtctgacgaagggcttcccgatgggctctccacaaaagattcagcgcagaaacaaaaaaattcacccctactgagcgtttctagccaaacaatcaccaaagagaataaccggaacgtgcacctcgaacattccgaacagaatcctggatcctccgctggggatacctccgcggctcatcaggtggtgttgggggagaacctgattgcaacagccctgtgtctctccggtagcggaagccagtcagacctgaaggatgtcgcttccactgccggagaggagggagacacctcactgcgggagagtctacaccctgtgactagatcactgaaagctggctgccatacgaaacagcttgcttcttag

SEQ ID NO: 59458 - DNA, 2181 bp, Artificial Sequence
  Description of Artificial Sequence: Synthetic coding sequence
atggcgcaaacagtgcaaaacgtgacattatccctgacgttgcctataacatgccacatctgtctgggtaaagtgaggcagcctgtcatttgtatcaataatcacgtgttttgctctatctgtatcgatttgtggcttaagaacaactcccagtgtcccgcatgtagggtgccgataacccctgagaacccctgcaaagagataatcggcggaacctccgaatcagagccaatgctttcccatacagttagaaagcatctgaggaagactcggctggagctgttgcacaaggagtatgaagatgagatagactgcttgcagaaggaggtggaagaactcaagtctaagaacctaagcttagaatcccagatcaaaacaattctcgatccacttactctggtccagggaaaccagaacgaagataagcatctggttaccgataatccctctaagatcaaccctgaaacagttgccgaatggaagaaaaaactcaggaccgcgaacgaaatctacgagaaggtcaaggatgacgttgataagcttaaagaagcaaacaaaaagttgaaacttgagaacgggggactggtacgggagaacttgcgcttgaaggctgaagtggacaaccgatcaccgcagaagtttgggaggtttgctgtggccgctcttcaatccaaagtagagcagtacgagcgtgagactaacagactcaaaaaagccctcgagcggagcgataaatacattgaggaactcgagtcacaggttgctcaactgaagaattcctccgaggagaaggaagccatgaacagcatttgtcagaccgcactttcagcggatggaaaagggagcaaggggtccgaggaggacgttgtgtctaaaaaccaaggggattccgcccgaaagcagcccggatcttcgacaagttctagtagccacctggcaaaacctagctccagcaggctgtgcgacacatccagcgccagacaggagtccactagtaaagcggatttaaattgtagtaaaaataaagatctgtaccaggaacaagtggaagtcatgctggacgtgactgacacaagtatggatacctatttggagagagagtggggtaataagcccagcgattgcgtgccctataaagatgaggaattatacgatcttccagcaccctgtacccctttgtctctcagttgcctgcaactctcgacacccgagaaccgagagagcagcgtggttcaggccggaggatcaaaaaagcattcaaatcacctaagaaagctggtgttcgacgacttctgcgactccagcaacgtgagtaataaagatagtagtgaagacgacatcagcagatcggaaaatgagaagaagagtgagtgcttcagcagtccgaagacagggttctgggattgttgttcaacttcgtatgctcagaatctggactttgagtcgtctgagggcaatacgatcgctaacagcgtaggagaaatttcatccaaactgtctgaaaagagcggcctgtgcctctcaaaacgactgaattccatccgcagcttcgagatgaatcgaactaggaccagcagcgaagcaagcatggatgcagcctatctcgataagatcagcgagctggactcaatgatgagcgaatctgacaacagtaaatcaccctgcaacaacgggtttaaaagccttgacttagatggcctgtctaagagttctcaggggtcagagtttctcgaggaacccgataaactggaagaaaagactgagctcaacctgtcaaaagggagcctcaccaatgatcagctggagaacggcagcgagtggaagcctacctccttcttcctgttgtcgccttcggatcaggagatgaacgaagactttagtttgcactcaagtagttgcccggtgacaaacgaaataaagccacccagctgtctgttccagacagagttctcacaaggcatcctgctgtcttcaagccaccgcctgttcgaggaccagaggtttgggtcctctttgttcaagatgagttcagagatgcattcactccacaatcatttacaaagcccatggagcacaagctttgttccagagaagcgtaacaagaatgtcaatcagagcacaaaacgcaagattcagtcctcactttccagtgcgtccccctcaaaagcaaccaagagctag

SEQ ID NO: 59459 - DNA, 663 bp, Artificial Sequence
  Description of Artificial Sequence: Synthetic coding sequence
atgtccgaaggcgagagcaaggatagtagcggatcagagtgtcccgtatgctatgagaagttccgagacctggaaggagcatctcggacactttcttgtggccacgttttttgccatgactgtctagttaaatatttactgtcaacacgggtggacggacaggtgcagcgtaccctcgtctgcccaatttgtaggtatgttacgtttctgagcaagaagtcctccaggtggccctcaatgttagataaatcttcccagacactggcagtgccagtgggcctcccttccgtgccccctctggacagcttgggccacactaaccccctagcggcttcatcgccagcctggagaccaccaccaggccaggcacgccctcccggatctcctggccaatccgcgcagctccccctggatctgctgcccagtctgcccagggagtcacaaatctttgttatttcccgacatggaatgcctctgggcgaacaagattcagtgcttccacgccgtagtctggcagaattgagtgaagcctctctcgcacccaggtccgccagagcgttctgctgcaggtcacgagccttgctactgataacattaattgctgtggtcgcggtggtcgctgccatcctaccatgggtgctattggtgaggaaacaggcgtag

SEQ ID NO: 59460 - DNA, 663 bp, Artificial Sequence
  Description of Artificial Sequence: Synthetic coding sequence
atgtccgaaggagagagcaaggattcttcaggttccgaatgtcccgtgtgctacgaaaagttccgagacctagaaggcgcttcccgcactcttagttgcggccacgttttctgtcacgattgtctggtgaaatacctgctgagcactagagttgacgggcaggttcaacgtactctagtttgccccatctgcaggtatgtcacttttttgagtaaaaagtctagtcggtggcccagtatgctcgataaaagttcccagacgctggctgtcccagtgggattaccgtccgtgcccccacttgacagcttggggcacacaaatcccctggcagcctcctctccagcgtggcgaccaccgcctggccaggcaaggccacccggatctccaggacagtcagcccagctacctctggacctcctgcccagtttgccacgggaatcacagatctttgttatctccaggcatggcatgcccctcggggaacaagatagcgtattgcctcggagatccctggcggaattaagcgaagcatccctggctcctaggagtgccagagcgttttgttgccgatcccgggctcttttgctcatcaccctaattgctgtggtcgccgtggtcgccgcaatccttccctgggttctcctggtgcggaagcaagcatag

SEQ ID NO: 59461 - DNA, 471 bp, Artificial Sequence
  Description of Artificial Sequence: Synthetic coding sequence
atgcaagacgctgccgctggaggccctccagggctcggtggtgggggaccgcctgaagaacgtaccgattgcatcatttgttgctccgcatatgacttgagtggtcacctgccacggaggctttactgcggacatacgttctgtcaagcctgcgtcaggcggcttgatactccagccccagagcaacggtggattccttgcccacagtgccgccagtccacgccgacccctaggggtggggtcgccatgctcgacctggatctggccgcttttctcgctgtgaaagcagagcgggaaccagctcgcttggagccgttgcccttaacttcactgaagggttctgctataacacgccagccggctggcttgtgtccggctttgggcccacaacctcatttccctcaacccagatactgttgctgggggtgcggaagcctctgctgccccccacttgggagccctgaggtatag

SEQ ID NO: 59462 - DNA, 954 bp, Artificial Sequence
  Description of Artificial Sequence: Synthetic coding sequence
atgggttacgacgtgaccagattccagggtgacgtggatgaggatcttatttgccccatctgcagtggggtacttgaagagcccgtgcaagccccacactgtgaacacgcattttgtaacgcttgtatcacacagtggttcagccagcagcagacctgtcccgtggacagaagcgtggttacagttgcgcacctgaggccggtgccaagaattatgcgaaacatgctcagcaaactccagatcgcctgtgacaatgcggtgttcggatgtagcgcggtggtgcgcctggacaacctaatgtcccacctatcggactgtgaacataatcctaagcgccctgttacttgtgaacaaggttgcggcctggagatgcccaaggacgaattgcccaaccacaactgcatcaagcatctacgttctgtggtgcagcaacagcaaacccgcatagcagagttggagaagacctcggctgagcataagcaccaactcgccgagcaaaagcgggacatccagttattgaaggcttacatgcgggcaattcgcagcgtcaaccccaaccttcagaatctggaagaaacaattgagtacaatgagattctggaatgggtgaatagcctccaaccggcaagagtgactcggtgggggggaatgatatctacccctgatgctgtcttgcaagctgtgatcaagcgttctctcgtggaaagtggatgccctgcctccatagtgaacgagttaattgagaatgcccacgagcggagttggccacaggggctcgcaacgctggagacaaggcagatgaaccgtaggtattacgagaattacgtcgctaagcgaattcccggaaagcaggccgtggtcgtaatggcctgtgagaaccagcatatgggagatgatatggtgcaggagccagggctggttatgatatttgcccatggggtcgaggagatctag

SEQ ID NO: 59463 - DNA, 741 bp, Artificial Sequence
  Description of Artificial Sequence: Synthetic coding sequence
atgcgcaatatgctcagtaagctccagattgcctgtgataatgcggtcttcggatgctcagccgtggtgaggctcgacaaccttatgagtcacctgtcggactgtgagcataacccgaaacggccagtaacctgtgaacaaggctgcggccttgagatgcccaaggatgaactgccaaaccacaattgcatcaaacacttgagatctgtcgtacaacagcaacagacaaggatcgccgagctggagaaaacaagcgcggaacataaacaccaactagccgaacagaaacgggacatacaactgttgaaagcttacatgcgtgccatccgaagcgttaatccaaacctacagaacctagaagagacgattgaatataacgagatcctagagtgggttaacagcttgcagcccgctcgagttacacggtgggggggtatgatttccactcctgacgcggtactccaagcggtaattaagcgcagtctcgtggagtcaggctgtcccgcaagcatagtcaacgaactgatcgaaaacgcccatgaaagaagctggccacagggactggccacactcgagactagacagatgaatcgccgttactacgaaaactacgtggcaaaacggattcccggtaaacaggcggtggttgtgatggcctgcgagaaccagcatatgggggacgacatggtgcaagaacccggactggttatgatttttgctcatggggtggaagaaatttag

SEQ ID NO: 59464 - DNA, 915 bp, Artificial Sequence
  Description of Artificial Sequence: Synthetic coding sequence
atgggttatgatgttacacggttccagggggatgtggatgaagacttgatctgtcctatttgttcaggagtgctcgaagaacctgtgcaggctccccactgtgagcatgccttctgtaatgcgtgcatcacccagtggttttctcagcagcaaacatgcccggtccccaggattatgaggaacatgctgtctaagctgcagattgcatgtgacaatgcagtgtttggttgtagtgcagttgtgaggctggataatctgatgagccatctctcagactgtgagcataatcccaaaaggcccgtgacctgcgagcagggctgcggtcttgaaatgcccaaggacgagctgcccaatcacaactgcataaagcacctgagaagtgtggtgcagcagcagcaaacccggatcgccgaacttgagaagacctcggctgagcataagcaccaactcgcggagcagaagagggatatacagttgctcaaggcttatatgagggctattagaagtgtcaacccaaatctccaaaacctagaggagaccatcgaatacaacgaaatactggagtgggttaacagtttgcagccagcaagagtaacgcgctggggcggaatgatcagcactcccgacgctgttctgcaggcggtaattaagcggagtttagtagaatctgggtgcccagcttctatagttaacgaactgatcgaaaacgctcatgaaagaagttggccccagggtctcgccaccttggagaccagacaaatgaacaggcgctactatgagaactacgtggcaaagcggattccaggaaaacaggctgtggtcgtgatggcttgtgagaaccaacatatgggcgacgatatggtccaggagcctggactagtgatgattttcgctcacggggtggaagagatctag

SEQ ID NO: 59465 - DNA, 573 bp, Artificial Sequence
  Description of Artificial Sequence: Synthetic coding sequence
atgggatatgatgttacccgatttcagggggacgtcgatgaggacctgatctgtcctatctgtagcggcgtcttagaagagcctgtgcaagcccctcactgtgagcacgccttctgcaatgcttgtatcacccaatggttcagccagcagcagacctgtccagttgatcggagcgtagtgactgtcgcacatcttaggccagtccctaggatcatgaggaatatgctgagcaagctgcaaatcgcgtgtgacaacgccgtctttggatgttcagcagtggtgcgcttggacaatcttatgtcccacctttctgactgcgagcacaatccaaaaaggcctgtgacttgtgagcaggggtgtgggttggagatgcccaaggatgagctgcctaatcataactgtatcaagcacctgaggtctgtggtccaacagcagcagactcgcatagcagagctggagaaaactagcgcggagcataagcaccagcttgccgagcagaaaagagacatacaactgctcaaggcatatatgcgggctatccggagtgtgaatcctaatttgcaaaatctttag

SEQ ID NO: 59466 - DNA, 441 bp, Artificial Sequence
  Description of Artificial Sequence: Synthetic coding sequence
atgagaaatatgctgagcaaactgcagatcgcctgtgacaacgccgtgtttggttgctccgccgtcgtcagactcgacaacctgatgtctcacctgagcgactgtgaacataatcctaaaagaccagtgacctgcgagcaagggtgcgggttagaaatgccgaaggatgagcttccaaaccataattgcattaagcatctccggtccgtcgtacagcagcagcagaccagaattgccgaactggagaagacatcagccgaacacaagcaccagctcgcagagcaaaagagagatattcagcttcttaaagcatatatgagagccatcagatccgtgaatccaaatctgcagaatctggaagagacgatagagtataacgagatcctcgagtgggtcaatagtctgcagcctgccagggtcacccgatggggcggtatgtag

SEQ ID NO: 59467 - DNA, 606 bp, Artificial Sequence
  Description of Artificial Sequence: Synthetic coding sequence
atgggatacgacgtgaccagatttcaaggcgatgtggacgaggaccttatttgcccaatttgctctggagttctggaggagcctgtacaggcccctcattgcgaacatgctttttgtaacgcttgcataacacagtggttctcacagcaacaaacttgtcctgtagatcgatccgtggtgacagtggcgcatctcaggcctgtgccccgtattatgagaaacatgcttagcaagttacagatcgcttgtgacaacgctgtttttggctgtagtgcggtcgttaggctcgacaacctgatgagccacctgtctgactgtgagcacaatcctaaaagacccgtaacatgcgaacaggggtgcgggctagagatgcctaaggacgaattgccgaatcacaactgcattaaacacctccgctcagtggtccagcagcagcagacacgcatcgccgagttagaaaagactagtgccgaacacaaacatcagcttgccgaacagaagagagacatccagctgctcaaagcctacatgcgggctattcgatctgtgaaccctaatcttcagaatctcgaggagactattgaatataatgagatactagagtag

SEQ ID NO: 59468 - DNA, 954 bp, Artificial Sequence
  Description of Artificial Sequence: Synthetic coding sequence
atgggatacgatgtaaccaggttccagggggatgttgacgaagatcttatttgtcccatttgttctggcgtgctagaggagcccgtgcaggcccctcactgcgagcatgcattctgtaacgcttgcattacccaatggttcagtcaacagcagacctgccctgtcgatcggagcgtagtgaccgtagctcacctcaggcccgtgcctaggataatgcggaacatgctctccaagctccaaatcgcctgcgataatgccgtgtttggctgcagcgctgttgtgcgtctggacaaccttatgtcccacctgagtgactgtgaacataatcctaaaagaccagtcacgtgcgagcaaggctgtggtttggaaatgcctaaggatgagctgcctaatcacaactgcattaagcacttgcgtagcgtagttcagcagcagcaaacgagaatcgctgagctggagaagacatccgctgagcacaagcaccagctggccgagcaaaagcgcgacatacagcttctgaaggcttatatgcgggcaataaggagcgtcaatcccaatctgcagaacttggaagagactattgagtataacgagattctggaatgggtcaacagcctgcagccagccagagtgaccaggtggggcggaatgatttccactccagatgccgtgctgcaggccgtgatcaaaagatccttagtggagagcggttgccctgcgagtattgtcaacgagttgattgagaacgctcatgagcggagctggccacaggggttggccacactagaaacccgccaaatgaacagacgctattacgagaattacgttgccaaaagaattccaggcaagcaggctgtcgtcgtgatggcctgcgagaatcagcacatgggcgacgatatggtgcaagaaccaggcttggtgatgatatttgcacatggagtcgaagaaatctag

SEQ ID NO: 59469 - DNA, 1299 bp, Artificial Sequence
  Description of Artificial Sequence: Synthetic coding sequence
atgcggccttgggctttagcagttactcggtggccgccaagtgcgcctgtaggacaacggaggttcagcgcaggccctggatccacaccgggtcagctctggggctcacctggcttggaaggccctttggcctctcctcctgcacgcgacgagcgactcccctcccagcaaccccctagcagaccacctcacctccccgtcgaggaacgtcgtgcttcggcccctgcaggcggaagccctaggatgctccaccccgcaacccagcagagtcccttcatggtggatcttcacgagcaggttcatcagggtcctgtgccactgagctacaccgtcactacagtgaccacccagggatttccgcttcccactgggcaacatatcccaggctgtagtgcccagcagttaccagcttgctccgtgatgttcagtgggcagcattacccattgtgctgcctgccccctccactgattcaagcctgtacaatgcagcaactgccggtgccataccaggcctatcctcatctgatctccagtgaccactacattttacatccaccaccacccgcacctcccccacagcctacacacatggcgccactgggacaattcgtgtcacttcagacccaacatcccagaatgccattgcagcggttagataatgatgtcgatcttagaggggaccaaccatccctaggttcttttacttattccaccagtgcccctggacccgcattgtccccatccgtcccacttcactatctcccacatgatccgctgcaccaggagctgtctttcggggttccttacagtcacatgatgcccagacgtttgtctacccagcggtacagattgcagcagcctttgccacctccacctccccctccacctcccccaccttactacccatctttcctcccttacttcctttctatgctcccgatgtcccctaccgctatgggcccaacaatatcgctggatttggatgtagatgatgtggaaatggagaattacgaggctctgctgaacttggccgagcgcttgggggatgccaagcctcggggactcacaaaggctgatatcgagcagctcccttcctaccggtttaatcccgactcccatcaaagtgaacaaactctttgcgtggtgtgcttctcagactttgaggcacgccagttgctgcgagtcctcccctgtaatcacgaattccatacaaagtgcgttgacaaatggctcaaggccaatagaacatgcccaatctgccgagctgacgccagtgaagtgccaagagaggccgagtag

SEQ ID NO: 59470 - DNA, 1056 bp, Artificial Sequence
  Description of Artificial Sequence: Synthetic coding sequence
atgctgcatccagctacacagcaatctccctttatggtggacctgcatgaacaagtccatcagggccctgtacctttatcatataccgtcaccactgtgacgacacaggggttccctcttccgactgggcaacacatcccagggtgtagcgcccagcagctgcccgcttgcagcgtgatgttctctggccaacactatccactctgctgtctgccaccgccattgatacaagcctgtactatgcagcagctgcccgttccgtaccaggcatatcctcatctgatctcctccgatcactatatactgcacccccctcctcccgctccgccacctcaaccgactcatatggctcctctgggccagttcgtgtccctgcaaactcaacatcctcgaatgccactgcagagactcgataacgacgtcgatctgagaggagaccagccctccctggggagctttacttactctacttctgctcctgggccagccttaagccccagcgtcccacttcattacctcccccacgaccccctccaccaggagctctcttttggcgtgccctactcgcacatgatgcccagaaggctgtcaactcaacgttacaggctgcagcagcccctccccccacctccaccaccccctcccccacccccttactatccgtcatttctcccctacttcctttcaatgctccctatgagtccaacggcgatgggtcctacaatttctctcgatctggacgtggacgatgtggagatggaaaattatgaggctctgctgaatttagcggaaagactgggggatgccaagcctagaggtctgaccaaagccgacatcgagcagctgccgagctataggtttaatccggattcacaccagtcagagcagaccttatgcgtcgtctgtttttctgacttcgaggcccgtcaactcctgagggtgcttccttgcaaccacgaatttcacactaaatgtgtcgacaaatggttgaaagccaaccgcacctgccctatatgccgggcagacgcgtcagaagtccccagggaggccgaatag

SEQ ID NO: 59471 - DNA, 1707 bp, Artificial Sequence
  Description of Artificial Sequence: Synthetic coding sequence
atggattatagacgactattaatgtcaagagtggtgcccggtcaatttgatgatgccgacagttccgactccgagaaccgggatttaaagactgtgaaagagaaggacgatatcctgttcgaggatctgcaggacaatgttaatgagaatggtgagggagaaattgaggacgaagaggaggaaggctatgacgatgatgacgatgattgggattgggatgaaggcgtcggcaagcttgcaaaaggctacgtgtggaatgggggatccaatccgcaggcaaacaggcagacctctgattcctcaagcgcgaaaatgtcaacacccgcagataaggtgctgagaaagttcgagaataagataaaccttgacaagctcaatgtcaccgattcagtcattaacaaggtgaccgaaaaatcaagacagaaggaggccgacatgtaccgcattaaggacaaagccgaccgggctacagttgaacaagtccttgatccacggacaagaatgatactattcaaaatgcttactcggggaattatcaccgagatcaacggctgtatctctacgggaaaagaagctaatgtatatcacgctagcacagctaacggcgaatcacgtgctatcaaaatttataagacgtctattctggtctttaaagatcgagataagtatgtgtctggggagtttagattccgccacgggtattgtaagggtaatcccaggaaaatggtgaagacatgggctgaaaaggaaatgaggaacctgattagactgaataccgctgaaataccttgccctgaacccatcatgctgaggagtcacgttcttgtcatgtcgtttatcggcaaggatgacatgccagcccctcttctgaaaaacgtacagctgagcgagagcaaggccagggagctgtacctgcaggtgattcagtacatgaggaggatgtatcaggacgcaagactcgtgcacgcggacctgagcgaatttaacatgttatatcacggaggaggggtgtacatcatagatgtgagtcagtctgtagagcacgaccaccctcatgccttagaatttctcaggaaggactgtgccaatgtaaatgacttctttatgcgtcatagcgtagctgtgatgacagtgagagagctgtttgaattcgtgaccgatcctagcatcacccatgaaaatatggatgcctacttatccaaagccatggagattgcatcgcagcgcactaaagaagagcgctcatcacaagaccacgtcgacgaggaggtgtttaaacgagcttacattccaaggacactgaatgaagtgaaaaactatgagagggacatggacattatcatgaagcttaaagaggaagacatggccatgaacgcccagcaggataacatcctctaccagacagttacaggcctcaagaaagacctgagtggtgtgcagaaagtcccagcactcctcgagaaccaggtcgaagaacgtacgtgttccgactctgaagatatcggttcttctgaatgctccgacactgattcagaggaacagggagaccatgctcgccctaagaagcacactaccgatccagacatcgacaagaaagagaggaaaaagatggtgaaagaagctcagagggagaaacggaagaataaaattcctaaacacgtgaaaaagcggaaggagaaaaccgccaaaacgaaaaaaggcaagtag

SEQ ID NO: 59472 - DNA, 1659 bp, Artificial Sequence
  Description of Artificial Sequence: Synthetic coding sequence
atgggaaaggtgaacgtggccaagttacgctacatgtcccgcgacgattttcgtgttctgaccgcagtcgaaatgggaatgaaaaaccacgaaattgtgccaggcagtctgatcgcctcgattgccagcctcaaacatggaggatgtaacaaggtgctgagagaactcgttaagcacaaattgatcgcttgggagaggaccaagacagtacagggctatcgactgaccaatgccggatacgactacctggcactcaagacgttgagcagtcgtcaagtggtagaaagcgtgggcaatcagatgggggtgggcaaggagagcgacatctacatcgtagccaacgaggaaggtcagcaattcgccttgaagctgcatagacttggacgaacatccttcaggaatctaaaaaacaagcgagattaccacaagcaccggcacaacgtttcatggctctacctttcccgcctcagcgctatgaaggaattcgcctacatgaaggccttatatgagcggaaatttcctgtgccgaagcctattgattataatcgtcatgccgtagtcatggagctgatcaatggttaccccctctgccagattcaccatgtggaggatcccgcaagtgtctacgacgaggccatggagctgattgtgaagctggccaatcatgggttgatccacggggacttcaacgagttcaaccttatccttgatgagagcgaccatatcaccatgattgacttcccacagatggtgtccacttcacacccgaacgcagaatggtactttgacagagacgttaaatgcataaaagacttcttcatgaagagatttagttatgagtccgagctgtttcccacattcaaggacatcagaagggaggatactttagacgtggaagtcagcgccagtgggtacaccaaggagatgcaggcggatgacgaattgttgcacccattgggccctgacgataagaacatagagaccaaagagggctctgaattcagtttttccgacggagaggtcgcagagaaggctgaagtgtacggctcagaaaacgagagtgagaggaattgcctcgaggagagcgagggttgctactgccgctcttcaggtgatcccgagcaaattaaggaggactcattgtcagaggagtcggcagacgcccgttcgttcgaaatgacagagtttaatcaggccctggaagagataaaaggccaggtcgtggaaaataattcagtgactgagttctcagaagagaaaaatagaaccgaaaattacaacagacaggatggccaaagggttcagggtggggtacctgccggttctgacgaatacgaggatgaatgtccccatctgatagccctgtcatccctgaatagggagttccgccctttccgtgacgaagagaacgtaggggcaatgaaccagtatcggactagaacattgtctattacttcatctggcagcgccgtttcctgctcaaccataccccctgagctggtgaagcagaaggtgaagcgccagctgaccaagcagcagaagtccgccgtgaggcggagattgcagaagggagaggccaacatttttactaagcagagaagagagaatatgcagaatatcaaaagctctttggaggccgctagcttctggggggagtag

SEQ ID NO: 59473 - DNA, 1425 bp, Artificial Sequence
  Description of Artificial Sequence: Synthetic coding sequence
atggggaaggtcaatgtggccaagctgaggtacatgtcccgagacgactttagggttctgactgccgtggaaatgggcatgaagaatcacgagatagtccctgggtccctgatcgcttccatcgcaagtctcaagcacggaggctgcaacaaagtgctgagagaactcgtgaaacacaaactcatcgcatgggagcgcacaaaaacagtccagggctatcgacttacaaatgcaggttacgactaccttgcactaaagaccctgagtagccgccaagtggtggagtcagtcgggaaccagatgggagttgggaaagagagcgacatttacatcgtcgcaaacgaagagggccaacagtttgccctgaagctgcatcggctggggcgtactagcttccgcaatcttaaaaacaaacgggattaccacaagcatcggcataatgtctcttggctgtatctcagtcgcctctccgcaatgaaggagtttgcgtatatgaaggcactgtacgagagaaagttccccgtacccaagcccatcgactataacaggcacgccgttgtgatggagttgatcaacggctatccactttgccaaatccaccatgttgaggaccctgctagcgtatacgatgaggccatggagctgatcgtcaagctcgctaaccatggcttgatacacggggatttcaatgagttcaacttaatactagacgagagtgatcacatcactatgatagacttccctcagatggtgtctacctcacaccccaatgctgagtggtattttgatcgagacgtgaaatgcatcaaggacttcttcatgaagcgcttctcttatgaaagtgaactcttcccaactttcaaggatattcggagggaggatactcttgacgtcgaagttagcgcgagcggctatacgaaggaaatgcaggcagatgacgaactgctgcacccactaggcccagacgacaaaaatatcgagacgaaagagggctcagaatttagctttagcgacggagaggtggcggagaaggccgaggtgtacggctctgagaatgagtccgaacgaaattgtctggaagaaagtgagggatgctattgcagatcttcgggggatcccgaacaaatcaaggaggattccctgtccgaagagagcgccgacgcgagaagcttcgaaatgacagagtttaaccaggcacttgaggaaataaagggtcaggtggtcgaaaataactctgtgaccgagtttagcgaggaaaagaaccggacggaaaactataacaggcaggatggacagcgagtgcaaggcggagtgcccgcagggagcgacgaatacgaggatgagtgtcctcacttgatcgctttatccagtctgaaccgtgagttcaggccgtttcggtacaggctgctgtctattgccttttag

SEQ ID NO: 59474 - DNA, 1560 bp, Artificial Sequence
  Description of Artificial Sequence: Synthetic coding sequence
atggaccttgttggagtggcgagcccggagcctggaactgccgcagcatgggggccatccaagtgtccatgggccattccacagaacaccatttcctgttcactggccgatgtgatgtctgaacaactcgctaaggagctgcagctcgaggaggaggcggctgtcttcccggaagtcgctgtcgccgagggcccttttatcacaggagagaatattgacacgtcaagtgacctcatgttagctcaaatgctacagatggagtatgaccgagagtatgatgctcagttgcgcagagaggagaagaagttcaacggggacagtaaagtaagcataagtttcgagaactaccgaaaagtgcatccatacgaggactccgactcttccgaggacgaggtcgactggcaagacaccagggacgatccgtataggcccgcaaagccagtgcctacacctaagaagggctttatcgggaaaggtaaagacattactaccaaacatgacgaggttgtctgtggtcgaaagaatacagccagaatggagaatttcgcccctgaattccaagtcggcgacggcattggaatggacctaaagttgtcgaatcatgtcttcaatgccctgaagcagcatgcatacagtgaggagcggaggtcggcgagactccacgagaaaaaggaacactctaccgctgagaaggcggtggaccccaaaactcggctgctgatgtacaaaatggttaattctggcatgctcgagacaattacagggtgcatcagtacagggaaagagagtgtggtctttcacgcctatggagggagcatggaggatgagaaagaggattctaaggtcattcctacagaatgtgctattaaggtctttaagaccactttaaatgaatttaagaacagagacaagtatatcaaggacgattttcgctttaaggaccgattttccaaattgaatccaagaaaaatcatccgcatgtgggcagaaaaagagatgcacaacctggctaggatgcaacgagcaggaattccttgtcccacagtggtgctgctgaagaagcacatattggtgatgtcctttatcgggcacgaccaggtgccagcacccaagctgaaggaagtgaaactgaatagcgaggaaatgaaagaagcttattatcagacgttgcacctgatgagacagctctaccatgaatgcactctggtgcatgccgacttaagcgagtacaatatgttatggcatgccggaaaggtttggctgattgacgtttcacagtctgtcgagccaacacatccacatggccttgaattcctgttccgcgactgccgtaacgtttcccagtttttccagaagggcggagtgaaggaagcactgagcgaacgcgaactgttcaatgctgtttctgggctgaatattactgctgacaacgaagcggattttcttgccgagattgaggctcttgaaaaaatgaacgaagaccatgtacagaagaatggacgcaaggccgcttcatttcttaaagatgatggtgacccacctttgctctatgacgagtag

SEQ ID NO: 59475 - DNA, 1248 bp, Artificial Sequence
  Description of Artificial Sequence: Synthetic coding sequence
atgaacgtaacgtctattgcactgcgggcagaaacatggctgctggccgcttggcatgtcaaggtacctcccatgtggctggaggcctgtataaactggatccaggaagagaataacaacgttaacctgagtcaggctcagatgaacaagcaggtcttcgaacaatggctgctgactgatctgcgcgatttagagcaccctctgctgcctgacggtatccttgaaatccccaagggagaactgaatgggttctatgcccttcagatcaacagtctcgttgacgtgtcacagcccgcatactcacagatacagaagctccggggaaagaataccactaatgatttagttacagcggaagcccaggttacacccaagccctgggaggcaaaacccagccgcatgctgatgctccaactcaccgacggtattgtgcagattcaaggtatggagtaccagccaatccctatattgcatagcgatttgccgcctggcacgaaaattctgatttacggcaacattagctttcgtctcggcgtgctgttactgaagcctgagaatgttaaagtattaggcggagaagtcgacgccctgctggaggaatatgctcaggaaaaagtcttggcacgtttaataggagaaccagacttggtagtctcagtgattcctaacaacagcaacgagaatattccgcgtgttaccgacgtgttggatccagcgctcggtccatctgacgaagagttgctcgcatcgctcgacgagaacgacgaactgacggccaataatgatacctcctctgagaggtgcttcaccaccggaagctctagtaacacaattcccactcgtcaatcttcttttgaaccagaattcgtgataagccctcgtccaaaggaagagccttctaatctatccatccacgtaatggacggcgagttggacgacttttctctggaagaagcactgctcctcgaggaaactgtacaaaaagagcagatggagactaaggaactccagcccctgacatttaaccgcaacgccgaccgatcaattgagagattttctcacaatcctaacacaaccaacaatttctctctgacttgtaagaatgggaacaacaattggtccgagaagaatgtgagcgaacagatgacaaacgaagataagtcatttggctgccctagtgtgagggaccagaatcggagcatctttagtgttcactgcaatgttcctttagctcatgatttcacatag

SEQ ID NO: 59476 - DNA, 1020 bp, Artificial Sequence
  Description of Artificial Sequence: Synthetic coding sequence
atgagctcagagatgctccctgccttcatcgaaaccagcaatgtggacaaaaaacagggaatcaacgaggatcaggaagagtcacagaagccccgtctgggcgaggggtgtgaacctatttccaaaaggcagatgaagaaactcatcaagcagaaacagtgggaagagcaacgcgaactccgtaagcagaagaggaaagagaaaagaaaacgcaagaagctcgaaagacagtgccaaatggagcctaatagcgatgggcacgataggaaaagagttcgccgagacgtcgttcactctaccttgagactgattatcgattgttctttcgaccacctcatggtgctgaaagacattaagaagctgcacaagcaaatacagcggtgttacgcagagaaccggcgagcccttcacccagtgcagttctacctcaccagccatgggggacaactgaagaagaatatggatgagaatgataaagggtgggtgaactggaaggacattcatatcaaaccagaacattattcagagctgataaaaaaggaagacctcatctacctgacgagcgactcccccaatatcttgaaagagcttgacgaatcaaaggcctacgtcatcgggggtctagtggatcacaatcatcacaagggcctgacctataagcaagcaagcgactatgggatcaaccacgcgcagctccccttaggaaacttcgtcaagatgaacagcaggaaagtgctcgcggtgaaccacgtattcgaaatcattctggagtaccttgaaaccagagactggcaagaagctttttttactattctgccccagcgcaagggggctgtgccgactgacaaagcgtgtgagtcagctagtcacgacaatcaatcagtgagaatggaggaggggggaagcgactcagactcaagcgaagaagaatactctcgtaacgagttagactcaccccatgaggaaaagcaggataaagaaaatcacacagagtctaccgtaaactcactgccacactag

SEQ ID NO: 59477 - DNA, 1020 bp, Artificial Sequence
  Description of Artificial Sequence: Synthetic coding sequence
atgtcttccgaaatgttaccagccttcatagaaaccagcaatgtggacaagaagcagggaatcaatgaggaccaagaggaatcgcagaagccaaggctgggggaaggctgtgaacccatctcaaaacgtcagatgaaaaagctgattaagcagaaacagtgggaagagcagcgcgagctaaggaaacagaagagaaaagaaaagaggaaacggaaaaaactggagaggcagtgccaaatggagcctaatagcgatggacacgatagaaaacgtgtcaggcgagacgtggttcattccactctacgtctaatcatagattgcagctttgatcacctgatggttctcaaggatataaaaaaattacacaagcaaatccaaaggtgttacgcagagaatagaagagcactccacccggtccagttctacttgacttctcacgggggacagctcaaaaagaacatggacgaaaacgataaagggtgggtgaactggaaggacatccatatcaagccggaacattactctgagctaatcaaaaaggaggatctaatttacctaaccagtgacagccccaatatcctaaaggagttggacgagagcaaggcctatgtgatcggaggcctcgtagatcacaatcaccataagggccttacgtacaaacaggcatccgactatggcatcaatcacgcccagctaccgctcggtaactttgtaaagatgaatagtaggaaagtgctggctgtgaaccatgttttcgaaattattctggagtatctcgaaacgagggactggcaggaagctttctttacaatcttgccacaacggaaaggcgcagtgccaacagataaggcttgcgaatcagccagccacgataaccaatctgtgagaatggaagaggggggttctgattccgacagtagtgaggaagagtactccaggaatgagctggactctccacacgaggaaaagcaagacaaagagaaccacaccgagtccactgtcaactcgctaccgcactag

SEQ ID NO: 59478 - DNA, 1020 bp, Artificial Sequence
  Description of Artificial Sequence: Synthetic coding sequence
atgtcctccgaaatgttgcctgcattcattgagacgtctaacgtggacaagaaacaaggcatcaatgaggaccaggaagagagtcagaagcctcgcctgggggaggggtgcgaacctatctccaaacggcaaatgaagaaactgattaagcagaagcaatgggaagagcagcgcgaactgcgcaaacaaaagcggaaagagaaaagaaagagaaaaaaactggagcgtcagtgccaaatggaaccgaactccgatggccacgaccgaaagagggttagacgtgacgtagtccattccacattgagactcattatagattgtagtttcgatcacttaatggttctcaaagacatcaagaagctgcataagcagatccagcgatgttacgcagaaaaccgacgagcgcttcaccccgtgcagttctacctgacgtcgcacggaggccagctcaaaaagaatatggacgaaaatgacaagggatgggttaattggaaggacatccatattaagcctgaacattacagcgagcttataaagaaggaggaccttatttatttgacctcagactcgccaaacattttgaaagaactcgacgagtcaaaagcttacgtgatcggtggcctggtagaccacaatcaccacaaaggcctgacttataagcaggccagtgactacgggatcaaccacgcccagctaccgctgggcaatttcgttaagatgaattcacgaaaagtcctggcagtgaaccatgtcttcgagattatactcgagtatctggaaactagggattggcaagaggcgttttttaccatcctcccccagcgcaagggggcagtgcctaccgacaaggcgtgcgaatccgcttctcacgacaaccagagtgtgcgaatggaggagggcggatccgactccgatagcagcgaggaggaatacagcaggaatgagttggactcaccccatgaggaaaagcaagacaaggaaaaccacacagagagtaccgtaaacagtctcccgcattag

SEQ ID NO: 59479 - DNA, 621 bp, Artificial Sequence
  Description of Artificial Sequence: Synthetic coding sequence
atgtcttctgagatgctacccgcattcattgagacttccaatgtggacaagaaacagggcattaacgaagaccaggaggagtctcagaaaccgcgacttggagaggggtgtgaacctatttcaaaacggcagatgaagaagttaattaaacagaagcagtgggaagagcaaagggaactgaggaagcagaagaggaaggaaaagcgcaaacgcaaaaagcttgagaggcaatgccagatggagccaaatagtgatgggcatgaccgcaagagagtcaggcgcgacgtagtgcattccaccctgaggctaattattgattgtagctttgatcacctgatggtgctaaaggacataaaaaaactccataagcagattcagcggtgttatgccgagaaccgccgtgcgttacaccccgtgcagttctacctcactagccacggagggcagctgaagaaaaatatggatgagaatgacaagggttgggtaaactggaaggacatccacattaagcctgagcactactccgagctaatcaaaaaagaggatctgatttacctgacctccgatagccctaatatcttgaaggagctggacgaaagtaaggcttacgtcatcggttag

SEQ ID NO: 59480 - DNA, 603 bp, Artificial Sequence
  Description of Artificial Sequence: Synthetic coding sequence
atgagcagcgagatgctaccagccttcattgagacttcaaatgtggacaagaagcagggaattaatgaggaccaggaggagtctcagaaacctaggctgggcgagggatgtgagcctattagtaagcgacaaatgaaaaaattaattaaacagaagcaatgggaagagcagcgcgaattgagaaaacagaagaggaaagagaaacggaaacgaaagaagctggaaaggcagtgccagatggaaccgaactcagacggccacgatcgtaagagggtcaggcgcgatgtcgtccattcaactctgaggctgataatcgactgctctttcgaccacctaatggtgttgaaggatattaaaaagctgcacaagcagattcagagatgctatgccgaaaatagaagagctctccacccagtgcaattctacctgaccagccacggaggccagttgaagaagaacatggacgagaacgacaaagggtgggtcaactggaaagacatccacattaagcccgagcattacagcgagcttattaaaaaggaggatctcatctacctgaccagtgactctcctaatattctgaaggaactcgatgaatcttag

SEQ ID NO: 59481 - DNA, 951 bp, Artificial Sequence
  Description of Artificial Sequence: Synthetic coding sequence
atggactggaaactggaggggtcgactcagaaagtggagtctcctgtgctgcagggccaggagggcattcttgaagagactggcgaagatgggttgccggagggattccagctgctgcagatagatgctgagggagaatgccaggagggcgaaatcttggccacgggctccaccgcctggtgttctaagaacgtgcagcgcaagcagagacactgggaaaagatcgtcgccgctaagaaaagtaagcgaaagcaggagaaagagcggagaaaagctaacagagccgaaaatcccggtatttgccctcagcattccaagcggtttttaagagctctgactaaagataagctgctggaggctaagcattctggtcctcgcctgtgtattgatttgtctatgacacactacatgagcaaaaaagaactgagccgactggcaggtcagattaggcgactctacggatcaaacaaaaaggccgaccgtccattttggatctgtcttacggggtttacaactgacagcccactatacgaggagtgtgtccgcatgaatgacggtttcagttcctacctgctagatataacagaggaggattgcttctcgttgtttcctctggagacactggtgtatctcacccccgattctgaacatgcactcgaggatgtggatctcaacaaggtttatatcctcgggggtctggtcgatgaaagcattcagaaaaaagtgaccttccagaaggcacgcgagtattccgtcaaaaccgccagacttcctattcaggagtacatggtgagaaatcagaatgggaagaactaccactcagagatcctcgcaataaatcaggtcttcgacattctaagtacctatttagagacccacaattggccggaagccctgaagaagggcgtaagttcaggaaagggctatattctacggaactcagtcgaatag

SEQ ID NO: 59482 - DNA, 690 bp, Artificial Sequence
  Description of Artificial Sequence: Synthetic coding sequence
atggactggaaactggagggcagcacccagaaggtagagtcccctgtccttcagggccaggaaggaattctggaggaaacgggagaggacggtctgccagaaggcttccaactcctgcaaattgatgctgagggcgagtgccaggaaggtgagatcctggccacaggtagcaccgcctggtgttcagaactgtccagattagctggtcaaataaggcggctttatggctccaacaaaaaggctgacagaccattctggatatgtctgactggattcaccaccgacagccctctttacgaggaatgcgtacgcatgaacgacggatttagtagctatcttctcgacatcacagaggaggattgtttctcactgttccctctagagaccttagtgtatctaaccccagattctgaacatgccctagaggatgttgacttgaacaaggtgtacatattggggggactggtggacgagtccatccagaagaaggtgacctttcagaaagccagggagtattccgtaaagaccgccaggctccccattcaagaatacatggtgagaaatcagaacgggaaaaactatcattccgaaatcctagccattaatcaagagacgcacaactggcccgaggccctgaaaaaaggggtgagttccggaaagggctacatattgcgcaactctgtagaatag

SEQ ID NO: 59483 - DNA, 771 bp, Artificial Sequence
  Description of Artificial Sequence: Synthetic coding sequence
atggactggaaactcgagggcagcacccagaaagtggaatcacctgtgcttcaaggacaggaagggatattagaagagacgggcgaagacgggctgcctgagggctttcagcttctacagattgacgccgagggtgagtgccaagagggcgagattctggcgacagggtccacggcttggtgttccaagaacgtgcagcgtaagcagcggcactgggagaagatcgttgccgctaagaagagtaagagaaaacaggaaaaggagcgtcgtaaagctaacagggctgaaaatccgggaatctgtccacagcactccaaaagattcctccgcgctctgacaaaagataaactgctcgaggcgaaacatagtgggcctagattatgtatcgaccttagcatgacacactacatgagcaagaagcttgatatcaccgaggaggactgctttagcctctttccactggagacccttgtatatttaacccccgacagcgagcacgccctggaagatgtcgacctaaacaaggtctatattctcgggggactcgtagacgagtcaattcagaaaaaagtcactttccagaaagcccgagagtattctgtgaagacagcacggctgccgattcaggagtacatggtgcgaaaccagaacggaaagaattatcattctgagatcctcgctattaatcaggagacccacaactggcctgaggccctcaaaaaaggagtgtcctcagggaaaggatacattctgcgcaattccgtggagtag

SEQ ID NO: 59484 - DNA, 474 bp, Artificial Sequence
  Description of Artificial Sequence: Synthetic coding sequence
atgtcaagtgaggaaggcaagcttttcgtgggcggtcttaatttcaacaccgatgagcaagctttagaagatcatttctcatcctttggaccaatttcggaggttgtagtcgtgaaagatcgagagacacagcggtccaggggctttgggtttatcactttcacgaaccccgagcatgcatctgtggcaatgagagctatgaatggggaatcactggatggtcgccaaatccgggtggaccatgctggaaaatcagctcggggaaccagaggcggaggatttggggcacacgggagaggcaggtcttacagccggggaggaggtgatcagggctatgggtccggccgatactatgactcacggcctgggggatacgggtatggatatggtcggagccgggactacaacggaagaaatcaaggaggctacgataggtacagcggaggcaattaccgcgacaattacgataactag

SEQ ID NO: 59485 - DNA, 846 bp, Artificial Sequence
  Description of Artificial Sequence: Synthetic coding sequence
atgttccctgcgcaggaagaggctgataggacagtctttgtcggaaacctcgaagcaagagtgagggaagaaatcctgtacgaactgtttctgcaagctggacctctaactaaggtgacaatttgtaaggaccgcgagggaaaaccaaagtcgttcggctttgtttgttttaaacatccagagtctgtttcctatgctatcgcgctgttgaacggcatcagactgtatgggcgtcccatcaacgttcagtatcgctttgggtctagccgctcctctgagcccgcaaaccagagcttcgagtcctgtgtgaaaatcaatagtcataactaccggaatgaggaaatgctcgttgggcgttctagcttcccgatgcagtattttccgatcaataataccagtctaccccaggaatacttcctatttcagaaaatgcagtggcatgtgtacaatccagtcctgcagcttccatactacgagatgacagcacccctgcctaacagtgctagtgtttctagttcactgaatcacgtcccagatctggaggccggacccagctcctacaagtggacacatcaacagccgagcgactctgacttgtatcaaatgactgccccacttcccaactcagcaagcgtgagcagctcccttaaccatgtgccagacctcgaagcagggcctagctcctataagtggacccatcagcagccctctgatagcgatctataccaaatgaacaagagaaagcgtcagaaacagacatctgatagcgattcaagcactgacaataaccgtggcaacgagtgtagtcagaagttccgtaagtctaaaaagaaaaagaggtattag

SEQ ID NO: 59486 - DNA, 3006 bp, Artificial Sequence
  Description of Artificial Sequence: Synthetic coding sequence
atggctgttgttattcggcttctgggattgccttttatagctggaccggtggatatccgccattttttcacgggcctcaccattcctgacgggggagttcacattatcggcggtgagatcggcgaggcttttatcatcttcgcaaccgacgaggatgcaagaagagcgatttcgcgatcaggtggttttatcaaagacagctccgtggaattattcctctcctcaaaggctgaaatgcagaagacgatcgaaatgaagcgcacggaccgggtgggcaggggcaggcctggatcgggaaccagcggagtcgattcactttctaacttcattgagtcagtgaaagaggaagcatcaaactcaggttatggttcctcaatcaaccaggacgctggcttccatacaaacggtaccggacacggtaacttgaggcctaggaaaactcgccctctcaaggccgagaacccttatttatttcttagaggactgccatatctcgttaacgaggatgacgtcagggtttttttcagtggcctctgtgtggacggagtgatctttctgaaacatcacgatgggaggaataacggcgatgctattgtcaagttcgcgagctgtgtggatgccagtggagggctgaagtgtcatcgcagtttcatgggaagtcgattcatagaagtgatgcagggcagcgagcagcagtggattgagttcggcggaaacgcggtgaaagagggagacgtgcttcgcaggtccgaggagcatagccctccaaggggcataaatgatcgacactttcggaagcggagtcattctaagagccccaggagaacaagatccaggtcccctctgggattttacgtgcatctgaagaacctgtctctttccattgatgagagggacctgagaaatttcttccgcggaaccgacctcactgacgaacagattcggttcttatataaggatgagaatcgcaccaggtacgcattcgttatgttcaagactctcaaagattataacacagcactgtctttacacaaaactgtgctgcaatatcggcctgtccatatcgatcccatctcccggaaacagatgctgaagtttattgcaaggtacgaaaagaagcgcagtggctcactggagagagacaggccagggcatgtgtctcagaaatactcccaggaaggaaatagtggccagaagctgtgcatctatatacgaaacttcccctttgatgttacgaaggtggaggtgcaaaagtttttcgccgacttcctgctggcagaggacgacatttaccttctctacgatgataagggggttgggcttggggaagctctggtaaagtttaagagcgaggagcaagctatgaaggccgaaagacttaaccgccgtcgcttcctcgggacagaggtgcttctccgactgatatctgaagctcagatccaggagttcggagtaaacttctccgtgatgagctccgaaaagatgcaggcccgatcgcagtcacgcgagaggggagatcattcgcatctgtttgactcaaaggatccacccatctatagcgttggtgccttcgagaactttcggcaccaactggaagacttgaggcaattagacaattttaaacatccccagcgcgatttccggcagcccgatagacatcctccagaggactttcgtcatagttcggaggatttcagatttcccccagaggactttcgccatagtccggaggatttccgaaggccacgtgaagaggacttcaggcgcccatctgaagaggatttcaggcgcccttgggaagaagattttagaagacccccagaggacgacttccgtcatcctcgcgaggaagactggaggcgtccattagaagaggactggaggagacccctggaggaagattttagaaggtctccaacggaggacttcaggcagctcccagaggaggatttccggcagcctccagaagaggatctgcggtggttaccagaagaggactttaggaggcctcccgaagaggactggcgcagaccacccgaagaagactttcgcagacccctccagggggaatggcggaggcctcccgaagacgacttccgacgccctcccgaggaggacttcaggcacagtccagaggaagatttccggcagagcccacaggaacatttcagacggccaccacaggagcattttcggcgtcctcctcccgagcactttcgccgaccccctccggaacacttccgcaggccaccccctgagcacttccgcagaccaccaccagaacactttcgtaggccaccaccagagcacttccggaggcctcctcctgagcacttccggaggcccccacaggagcacttccgtaggcctcctcaggaacatttccggaggtccagagaggaagattttcgccatccccctgacgaggacttccggggtccgccagacgaagacttcagacaccctcctgatgaagattttcgaagtccgcaggaggaggactttaggtgccctagcgatgaagacttcagacagctgcccgaggaggacctaagggaggcacccgaggaagaccccaggctgcccgacaactttagaccgccaggcgaagacttccgctctccaccagacgattttcggagtcaccgacctttcgttaacttcggtcgaccagaaggcggaaagttcgatttcggcaagcataacatggggtctttccctgaggggagatttatgcccgatccaaaaatcaattgtggatccgggagggtgacgcccattaagattatgaatttgccatttaaagctaatgtcaatgaaatcctggatttctttcacggttaccgcataattcctgactccgtgagcatccagtacaatgagcagggactgccaaccggcgaggccattgtagcaatgattaattacaacgaggctatggctgcgattaaggatttgaacgatcggcctgttggccctcgcaaggttaagcttactttactctag

SEQ ID NO: 59487 - DNA, 2646 bp, Artificial Sequence
  Description of Artificial Sequence: Synthetic coding sequence
atggctgtcgtaatcagattactgggtctccccttcatagccggacctgtcgacatccgacacttcttcacagggctaactatccctgatggtggagtgcatataattggaggcgaaatcggggaagcatttatcatcttcgccaccgatgaagacgctcgcagggccatatctcggagtgggggattcatcaaggattccagcgtagaactcttcctatcgtctaaagccgaaatgcagaagactatcgagatgaagaggactgatcgcgttggtagggggagaccaggctccggcaccagcggggtggactcactgtcaaattttatcgagtctgtgaaagaggaagcctccaactcaggctacgggtccagcattaaccaggatgccggattccatacgaacggcaccggccacggaaatctgcgcccacggaaaacccggccacttaaagctgagaatccatatctgttcctgcggggtctgccatacctcgtcaacgaggacgatgtcagggttttcttttctggtctgtgtgtggatggcgtaatctttctcaagcatcacgacgggaggaataatggggatgccattgttaaattcgccagctgcgtcgatgcttccggtggactgaaatgtcaccgctctttcatggggagccggttcatcgaggttatgcagggcagtgagcaacaatggatcgagtttgggggaaatgcggtgaaagagggcgacgtgctgagacgatccgaagagcattcacctccgagagggattaatgatcgccactttcgcaagagatctcactctaagtctccgaggaggacaagatccagatcacccctaggcttttacgtacaccttaaaaacttgagtctttcaattgatgagagagatctgagaaattttttcagagggaccgacctcacagatgaacagatcaggtttctctataaggacgaaaataggaccagatacgcttttgtgatgttcaagaccctgaaggactataacaccgcattaagcctgcataagaccgtcttgcagtataggcccgtgcacatcgatccaatttctcgcaaacagatgttaaaattcatcgctcggtatgagaaaaaaaggtctggcagcttagaacgcgatcgaccagggcacgtgagccaaaaatattcgcaagagggtaatagtggacaaaagctttgcatctacatacgaaatttcccttttgatgtaacaaaagtggaggttcagaagttttttgctgactttctgctggccgaggacgatatatatctactttacgatgataaaggggtgggcctcggtgaagccctcgtaaagttcaaaagcgaagagcaagctatgaaagctgaacgcctcaacaggcgcagattcctcggcacggaagtgctgttaagacttatttccgaagctcagatacaggaatttggagtcaattttagtgttatgtcgtctgagaagatgcaggccaggtctcagtcccgcgaaagaggtgaccactcgcatcttttcgacagtaaagacccacctatctacagcgtaggagccttcgagaattttagacaccagctggaagatctgagacaacttgacaattttaagcatccgcagagagatttcagacaacctgatagacatccccctgaagactttcggcacagttctgaagattttcgatttccccctgaggacttccgccactcccccgaggacttccgtcgacccagggaggaagatttccgcagaccctccgaggaagacttccggagaccttgggaggaggacttcaggcgcccacccgaggatgactttagacacccaagggaagaggactggcgacggccaccccctgagcactttaggcgcccaccaccagaacacttcaggcggccaccacctgagcatttccgcagaccaccacctgagcattttagaaggccgccacctgaacactttcggaggcccccacaggaacatttcaggcgtcctcctcaagagcactttaggcgcagcagggaagaagactttaggcatccacctgatgaggatttccgcggacccccagacgaagactttcgacacccacccgacgaggattttcggagtccccaggaggaggactttcggtgcccgtccgatgaggacttccggcagctgccagaagaggaccttcgcgaagcccctgaagaggaccccaggctgccagacaatttccgaccgccaggagaagatttcaggagtcctcctgatgactttcgttcccacaggccctttgtcaacttcggaagacctgaagggggaaagttcgatttcggaaagcacaacatgggatcatttccagagggcaggtttatgcccgacccaaagattaattgtggaagcgggagggtcacaccgattaagattatgaatttgccatttaaggccaacgtgaacgaaattctggatttctttcatggctaccgaatcatcccggactctgtgagtatccagtataatgagcagggtttgccaaccggggaggccatagttgccatgatcaactataatgaggccatggccgcaattaaagatctgaatgaccgtccagtaggccctcgcaaagtcaaattaaccctgttatag

SEQ ID NO: 59488 - DNA, 432 bp, Artificial Sequence
  Description of Artificial Sequence: Synthetic coding sequence
atggcggtggtgatacgtctgctgggcttaccctttattgccggtccagtggatatcaggcactttttcactgggctcacaatccctgatggaggcgtgcacataataggcggtgagattggagaggccttcattatttttgccaccgacgaagatgctagacgagcaattagccgaagcggaggttttataaaggattctagtgtcgaactatttctgtcttcaaaggccgagatgcagaagaccatcgaaatgaaaagaacagaccgcgtcggtcgaggacgccctggttccggaacaagtggggtagattccctgtcaaatttcatcgaaagcgttaaagaagaagcttccaactcgggatacgggagctctatcaaccaggacgccggattccataccaacggaacgggtcacgggaacctgagatag

SEQ ID NO: 59489 - DNA, 450 bp, Artificial Sequence
  Description of Artificial Sequence: Synthetic coding sequence
atggccgtggtgatccggctattgggactccctttcatcgccggtcccgtagacattagacattttttcaccgggctgacaataccggatggtggcgtccacattatcgggggagagattggggaggcctttatcatctttgcaaccgatgaggatgcacggcgtgccatttcacgatccggcggttttatcaaggatagcagcgtggaactgttcttatcatctaaagccgagatgcaaaagactatagagatgaaaagaaccgaccgcgtgggacgaggtcgccctggctcgggcacaagcggtgtggatagcctctcaaactttatcgaatctgtaaaggaggaggctagcaactcaggatacggatctagtatcaatcaggatgccggtttccacaccaatgggaccggtcacgggaacctccgaccacgtaagactcgcccttag

SEQ ID NO: 59490 - DNA, 369 bp, Artificial Sequence
  Description of Artificial Sequence: Synthetic coding sequence
atggcggttgtgattaggctgctcggcctgccttttattgccggaccagtggacattcgacacttttttaccggtctcacaataccggacgggggtgtgcacattatcggcggtgaaattggagaagcatttatcattttcgcaactgatgaggatgcgagacgcgcaatttcaagaagcggaggcttcattaaggattccagcgtggaactgttcctttctagcaaggctgaaatgcaaaaaacaattgagatgaaacgaactgaccgagtaggacggggtagaccaggaagtggcacatccggcgttgacagtctgagtaatttcatcgagagcgtgaaagaagaggccagtaatagcggttactag

SEQ ID NO: 59491 - DNA, 249 bp, Artificial Sequence
  Description of Artificial Sequence: Synthetic coding sequence
atggcggtggttatacgtttactcggtctccccttcattgcgggtccggtagacattcgccatttcttcacggggctaacaattcctgacggaggtgtccatattataggcggtgaaatcggtgaggccttcattatttttgctaccgatgaggatgctagacgtgccataagccggagcggaggcttcatcaaggacagttccgtagaactcttcctttcctctaaggcagagatgcagaaaacctag

SEQ ID NO: 59492 - DNA, 573 bp, Artificial Sequence
  Description of Artificial Sequence: Synthetic coding sequence
atggaagctgagacaaaaacactgccacttgagaatgcatcaatcctaagcgagggcagcttacaggaagggcaccgcctttggatcggcaatctcgacccaaagataaccgagtaccatttgctgaaactgctgcaaaaattcggcaaggtgaagcagtttgactttttgtttcacaaatcaggagcgttggaaggtcagccaagggggtattgctttgtcaacttcgagaccaagcaggaagctgagcaggctatacaatgtctcaatggaaaacttgcactgtctaagaaactggtggtgagatgggctcatgctcaggtgaagcggtacgatcataataagaatgacaaaatcctcccaataagccttgagcccagctcctccaccgaacccacccagtctaatttgtctgtcaccgccaagatcaaagcaattgaagcaaagctcaagatgatggcggagaaccccgacgcagagtaccctgccgcacctgtatatagttatttcaaaccgccagataagaaacgcaccacaccctattcccggaccgcgtggaaaagtcgcagatag

SEQ ID NO: 59493 - DNA, 2943 bp, Artificial Sequence
  Description of Artificial Sequence: Synthetic coding sequence
atggtttccaagatgatcattgagaactttgaggccttgaaaagttggttatccaaaactttggaacccatctgtgacgcggacccttccgccctggccaaatatgtactcgcactcgtcaagaaggataaatccgagaaggagttgaaagccctctgtatagatcagctcgacgtctttctacagaaggagactcagattttcgtggagaaattgtttgacgccgtaaatacaaaaagttacctgccacccccagagcaaccgtcgagtggcagcctgaaagtggagttctttccacaccaggaaaaggatattaaaaaagaggagattacgaaagaagaggaacgagaaaaaaaattcagcaggcggctgaaccactcacctccgcagagttcttcccgttaccgcgaaaatcggtcgcgcgacgaaagaaaaaaagacgatcggtctagaaaaagagactatgaccgcaatcctcctcgaagagactcatatagagatagatacaaccgtagaagaggaaggtcacgcagctattctcgctcccggtcacgaagctggtctaaagaaagactgagggaaagagaccgggacaggtcacggacccgctctcgatcccgaactaggagcagagagcgggacctcgttaaacctaaatacgatcttgaccgaacagatcccttggagaataattacaccccggtgtcctccgtgcccagcatatcttcgggtcactacccggtgcctaccctgagctcaacaataaccgtgatcgcgccaactcatcacggaaacaataccactgaaagctggagcgaatttcatgaagatcaagtggaccacaacagctatgtgcggcctcctatgcccaagaagaggtgcagggactatgacgagaagggtttttgcatgcgaggcgacatgtgcccgttcgaccatgggtctgacccagtggtggtagaggacgtgaacctgccagggatgcttccgtttcccgcacagcccccagtggtcgaaggaccgcctccacctggattgccacctccccctccaatactgacccctcctcccgtaaacctgcgccctcccgtcccacctccaggcccacttccccctagcctgcctcccgtgacaggccctccaccaccgctgccaccgctacagccatctggcatggacgcccctcccaattctgctacttcctcggtacctacggttgttactaccggtattcatcaccagcccccacctgccccaccatccctgttcacagccgatacatatgacaccgatggatacaaccctgaagcccctagcataacgaacacctcccgccctatgtatcgccaccgagtccacgctcagaggcccaacctgatcggattgacctctggtgatatggatctgcctcctcgtgagaaaccaccgaacaaatcctccatgagaattgttgtagatagcgaatctagaaaacggactattggttcaggggagccaggagtgcccaccaagaagacatggtttgacaagccgaactttaaccgcactaatagcccagggttccagaagaaggtgcagttcggcaatgagaatacaaagctggagcttagaaaagtccctcctgaacttaataacatatcgaagctcaatgagcatttttccaggttcgggacactggtcaatctacaggtcgcctataatggtgatccagagggggcactcatccagttcgctacttacgaggaagctaagaaagccatatcttctacagaagctgtgcttaataacaggttcattaaggtctactggcatagagaaggtagtacccagcagctgcagactaccagcccaaaacccctggtgcaacagcccatcctccctgttgtaaaacagtccgtaaaggagcggctcggcccagtgccttcctccaccatcgagcctgcggaagctcagagtgcatccagcgacctaccgcaggtgctttctaccagtacagggctgactaagacagtttataatcctgcggcattaaaggctgctcagaagacgctactggtgagcacaagcgccgtcgataataatgaagctcagaaaaagaaacaggaagcgctgaaactgcaacaggacgtgcggaaacgaaaacaggaaattctcgaaaagcacatcgagacgcaaaagatgctgatcagcaagttagaaaagaataaaacaatgaaatccgaggacaaggctgagattatgaagactctggaggttctgaccaagaacatcaccaagctgaaagatgaggtaaaggctgcctcccctggacgatgtctgccaaaatccattaaaaccaaaacccaaatgcagaaagagttgttagacaccgagctagatctgtacaaaaagatgcaagccggagaggaggtgactgaactgaggcgtaagtatactgagctccaacttgaagcggcaaagagggggattctttccagtggcagaggtcgcggtatccacagtaggggcagaggagcggtgcatgggaggggacgcggacggggaagaggaaggggggtgcccggacacgccgtggttgatcatcgccctcgtgcactggagatctccgccttcacagagtctgatcgcgaggatttactgcctcattttgcccagtacggcgagattgaggactgccagatagatgactccagtttgcatgcagttatcacattcaagacaagagcagaagctgaggccgctgctgttcatggggcaaggttcaaggggcaagacttgaaattagcgtggaataaacctgtgaccaacatctcagccgtggaaaccgaagaggttgaacctgacgaagaggaattccaggaggaaagcttggtcgacgatagcctgctgcaggacgacgatgaagaggaggaggacaatgagtcacgatcctggcggcgatag

SEQ ID NO: 59494 - DNA, 3024 bp, Artificial Sequence
  Description of Artificial Sequence: Synthetic coding sequence
atggtgagcaaaatgatcatcgagaattttgaggccctgaagagctggctgtccaagacattggagccgatctgcgatgccgaccctagcgccctggccaagtatgtgcttgcactggtcaagaaagacaagagcgagaaagagctgaaagcactgtgtatcgaccagctggatgtcttcttacagaaggagacccagatatttgtggaaaaactgttcgatgcagtgaataccaagtcctacctgcctccccctgaacagccaagctcaggatccctcaaggttgaatttttcccccaccaagaaaaggacatcaaaaaagaggagattacaaaagaagaggagcgcgagaaaaagttcagccgtagacttaatcattccccaccccagtcctcctcccgctacagggaaaacagatctcgcgatgagagaaagaaagacgaccgatcccgcaagagagactacgacagaaatcccccaaggagggattcataccgcgataggtacaacaggcggcgtgggaggagtagatcgtatagtcgcagccggagccgcagctggagcaaggagagattaagagagagagatagggaccggtcaagaacacgctcccggtcacgcacaaggtcgagggaacgcgatcttgttaaacccaaatacgacctcgatcggacggatcccctggaaaataattatactcccgtgtcgtccgtgccgagtatttcatcgggacattatccagtgccaaccttatcttccaccataaccgtcatagccccaacccaccacggtaacaacactaccgaatcttggtccgagttccacgaagaccaagttgatcacaattcctatgtaaggcctcctatgcctaagaaaaggtgccgggattatgacgaaaagggcttctgcatgcgtggcgacatgtgcccttttgaccacggcagcgaccccgttgtggtggaggacgtaaatctgccgggaatgctgcctttcccagcacagccccctgtggtggaggggccaccccctcctggccttccaccaccaccgcctattcttacacccccacccgtgaatttgaggccgcctgttcctccgcctggccctctgcctcccagccttccgcctgtgaccgggccacctccccctctgccccctctccagccttcaggcatggatgcacctcccaattccgctacttctagtgtgcctaccgtggtgaccaccggaatacaccatcaacctccgccagcgccaccaagcctttttacggccgacacctacgacacagatggatacaatcccgaggccccatctattaccaacacctctcggcctatgtatcgacacagagtacacgctcaaaggccaaatctgattggcttgacaagtggcgacatggatctgccacccagggagaagccacctaacaagagtagcatgcgtatcgtcgtggactccgaatctaggaaacgtacaatcgggtctggagagcctggcgtcccaaccaagaagacatggttcgacaagcccaactttaatagaacaaactcacccggattccagaaaaaagtacagtttggtaacgagaatacaaaactggaactacgcaaggtgcccccagaactcaataacattagtaaattaaacgaacatttctcaagatttggaaccctcgttaaccttcaagtcgcatataacggtgaccctgaaggggctttgatccagtttgccacctacgaagaggccaagaaggccattagcagtactgaagccgtacttaataatcgctttatcaaggtttactggcaccgagagggttcaacccagcaactccagaccacatcacctaaggtcatgcagcctttggtgcaacaaccaatccttccagttgtgaaacagtctgttaaggaacgtctggggcctgttccatccagcacaatcgagcctgcggaagcacaatctgccagtagtgacctgccccagaatgtgacaaagctgagtgtcaaagataggctggggtttgtctcaaagccaagtgtcagcgctactgagaaggtgctaagcacgtccactggcctgaccaagactgtgtacaatcccgctgctctaaaggcggctcagaagaccctgctggtgagcacatccgcagtcgacaataatgaggctcagaagaagaagcaggaggccctgaaactgcagcaagatgtgagaaagcgaaaacaagagattttggagaagcatatagaaacacagaaaatgctgatatctaaacttgaaaaaaacaagaccatgaagtctgaggataaggccgagatcatgaaaaccctagaggtgttaaccaaaaatatcaccaagttgaaggacgaggttaaggccgcatccccaggcaggtgcctgcctaaatcgatcaagaccaaaacacagatgcagaaggaattgctggatactgaactggatctgtacaaaaagatgcaggccggagaggaggttacggagctgcggcgaaagtacaccgaactgcaactcgaggcggctaagcgcggtattctcagcagtgggaggggcaggggaatccacagtagagggagaggagccgtgcatgggcgaggcagagggagaggaagaggcaggggggtgcccggtcatgctgttgtggatcaccgccctcgagcattagagatttccgcgtttaccgagtcggatcgtgaagatttactgccacattttgcacagtatggtgaaatcgaggactgtcagatcgacgattcctcgctgcatgccgttataacgtttaaaacacgcgcagaggcggaggcagccgcagtacacggcgcaaggtttaagggacaggacttgaaattggcatggaataagcccgtgaccaacatttctgctgtcgagactgaagaggttgaacccgatgaggaggaattccaggaagagtccttggtcgatgacagtctcctgcaagacgacgatgaggaggaggaggacaatgaaagtaggtcttggagaaggtag

SEQ ID NO: 59495 - DNA, 2952 bp, Artificial Sequence
  Description of Artificial Sequence: Synthetic coding sequence
atggtttctaagatgatcatcgagaactttgaggccctgaagagctggctgtccaaaacacttgagccaatctgtgatgccgaccctagcgccttagcgaagtacgtgctggccctggtgaagaaggacaaatccgaaaaggaattaaaggccttatgtattgatcagctcgatgtgttcctacagaaagagacacaaattttcgtggaaaagctgtttgacgcggtgaacacgaagagctatctgcctcctcccgaacagccaagttccggcagcctcaaggtggaatttttcccccatcaggagaaggacatcaagaaggaggaaatcacaaaggaagaggaacgcgaaaagaaattttctaggcgcctgaatcacagccccccacagtcttctagcaggtatcgcgagaacaggtccagggacgagagaaaaaaggacgaccggagcagaaagcgggactacgatcgtaatccacccaggagggatagctaccgggatcgttataataggagaaggggaagatcacgatcctactccagatcaaggagtaggagctggagcaaggagcgcctgcgcgagagggaccgcgatagaagccggacccgctcaagaagtcgcacacgctctcgagaacgtgatctggtaaagcccaagtatgatttggataggactgatcccttggagaacaattacaccccagtcagctccgtgccttccatcagcagcggccactaccctgtccctactctctcctcaacaatcaccgtcattgccccaacacaccatggtaataacactaccgaaagttggtctgaattccatgaggatcaggtggatcacaactcctacgtgcgccctccgatgcccaaaaagagatgtcgggactacgatgagaaagggttttgtatgaggggcgatatgtgtccctttgatcatggctccgacccagtggtggtggaggacgtgaacctgccagggatgctgccctttccagctcagccccctgtggtcgagggacctccaccaccgggactgcctccccctccccctatattaacacccccacctgtaaacctccgtccacccgtgcctcctccaggccctctacccccatccctccctccagtaactggccctcctccacccttaccacccctccagccttccgggatggacgcacccccaaatagcgccacctcctccgttcctactgtcgtgacgacaggcattcatcaccagccaccacccgctccaccttccttatttacagcggacacatatgatacagatgggtataacccagaagcaccatctataaccaacacttctcgccctatgtatagacatcgtgtgcatgctcaaagacccaatttgatcggccttacatccggcgacatggacctgcccccaagggagaaacctcccaataagtcctccatgcgcattgtcgtagattcagagtctcgcaagagaacaatcgggagcggcgagcctggagttcctaccaaaaagacatggtttgacaaacctaacttcaaccgtactaattccccagggttccagaagaaggttcagttcggaaatgagaacaccaaattggaattgcggaaggtccctcccgaattgaataatatttcaaagctgaacgagcattttagccgctttgggacactggtaaatctgcaagtggcatataacggtgacccagagggagccttgatacaatttgcgacctatgaggaagccaaaaaggctatcagctccaccgaagctgtactgaataacagatttattaaagtatactggcaccgggagggctccacacagcagctgcagacaacatcaccgaaggtaatgcagcctctggtccagcagcccattctgccagttgtcaaacagtctgtgaaagagagactggggccagtacctagctctacaatcgagccggctgaagcgcagagcgcatcctctgacttgccacaagtcctcagcacaagtaccggtttgactaagacagtgtataaccctgccgctcttaaggccgcacagaaaactctcctggtgtccactagcgccgtggacaacaacgaggcgcagaagaagaaacaggaggctttgaaattgcagcaagacgtgcggaaacggaaacaggagatacttgagaaacatatcgagactcagaagatgctgatctcaaagctcgaaaagaataaaacaatgaagagtgaggacaaggcggagatcatgaagactctcgaagtgttgacgaagaacatcaccaagctgaaagacgaagtgaaggctgccagcccagggagatgcctcccaaaaagcatcaaaaccaaaacccagatgcaaaaggagctgttggacaccgagttagacctgtataaaaaaatgcaggcgggtgaggaggttacagagctcaggcgcaaatacacagaacttcaactggaggctgcgaaaagggggatactgtcaagcgggagggggaggggaatccatagtagaggcaggggagccgtccacggacgaggcaggggtagagggcgaggcaggggggtgcctggacatgcagtggtggatcatcgtcccagagctctcgagattagtgccttcactgagtctgacagggaggatcttctgccccactttgctcagtacggagagatcgaagattgccagatcgatgattcatctcttcacgcagtaataaccttcaagacacgggcagaagccgaagctgcggcagtgcatggagcgaggttcaaaggacaggatttgaaactggcctggaacaagcccgtgaccaacatttccgcggttgaaactgaggaggttgagccagacgaagaagaattccaggaagaaagtctagttgatgactctctgctacaggacgacgacgaggaggaggaggataatgagtctcgatcttggcgacggtag

SEQ ID NO: 59496 - DNA, 807 bp, Artificial Sequence
  Description of Artificial Sequence: Synthetic coding sequence
atggctgccgcactgggtgccagtggtggcgcaggagctggagatgacgactttgatcagttcgataaacccggagccgagagaagctggcgtagacgcgcagccgatgaggactgggattccgaattggaagatgacttgttgggggaggatctgctctccgggaaaaagaatcaatccgatctgtccgatgaggaactaaatgatgatctcctgcaatcagacaatgaagacgaggagaactttagttcacagggagttacaataagtttaaacgcgacgagcggcatggttacgagctttgagctctccgataacactaatgaccaatccggtgaacaggagtccgaatacgagcaggagcagggtgaagatgaacttgtctatcacaagtccgatggctctgagctgtacacacaagagtacccagaggaagggcagtatgaaggtcatgaagcagagctcacggaggatcagatcgagtatgtagaagagcctgaggaggagcaactgtacactgatgaggtcctggacattgaaatcaacgagcctctggatgaatttaccggaggcatggaaaccctggaactccagaaagatatcaaagaggaatccgatgaagaggaagaagacgacgaggagagcggcagactgagatttaagaccgagagaaaggagggtaccattatccgcctaagcgacgtcacacgagaacgcagaaacattcctgagacccttggcaacttcttcgcatgtttgcccagctccttcaccctgatttctactagcagtattgtgcttctatag

SEQ ID NO: 59497 - DNA, 321 bp, Artificial Sequence
  Description of Artificial Sequence: Synthetic coding sequence
atgcacggaagggggcgtggagtggccggacccatgggcaggggcagattgatgcccaacaagcagaacttacgtgttgtggagtgcaagccgcagccgtgcgtggtctcagtggaaggcctgagcagctccacaactgatgcccagctcaagtccctcctgatgtccgttggcccaatccagagcttgcagatgctaccacagcagaggaaagccatcgctaaattcaaagaacctgcacacgcgcttgcatttcagcagaagtttcatagacacatgattgatctgtcacacataaatgtggccctcatcgtggagtag

SEQ ID NO: 59498 - DNA, 3513 bp, Artificial Sequence
  Description of Artificial Sequence: Synthetic coding sequence
atggccgctgcactcggcgctagcgggggtgcaggcgctggcgatgacgattttgaccagttcgataagcccggtgcggagcggagttggaggcgtcgagctgcagatgaagattgggattctgaactcgaggatgatctgcttggtgaggacctcctgtctggcaagaagaatcagagcgacctcagcgatgaagaattgaacgacgacctgctgcagtctgataatgaggacgaggaaaacttctctagccagggggtgactatctccttgaatgccacgtcaggcatggtgacttcatttgaactatcagataataccaacgaccagagtggggagcaggaatctgagtatgagcaggagcaaggcgaggatgagctggtctatcacaagagcgacggatccgagctctacacccaggagtatccagaagaaggccagtatgagggtcacgaggccgagttgaccgaggaccagatcgagtatgtggaggagccagaagaggagcaactatacacagatgaggttctggatattgagattaacgagcccctcgatgagttcacagggggtatggagaccttggaattgcagaaggacattaaggaggagtcagatgaggaagaagaagatgatgaggagagcggtagactgaggttcaagacggagaggaaggaggggacaattatccggctgtcagacgtcacacgcgagagaaggaacataccagagaccctcgagctaagtgccgaagctaaagcagccctgctggaatttgaggagcgggaacgacagcataagcaggggcgatattcttcccgacggggtgggaggcgtggcggtcccctgatgtgtaggggcgttggggatcagcgcagggagagtacggagcgaggcaggatgaaggaccaccgacccgctctactgcctacccagcccccagttgttccgcaggcccctcccccaccgcctcctccgcctcagcagcagccaattaggtccctgtttcagccacagcccttacagcctctcttgcccgtgcaacaccctcaccatccatcccctccccagggtatgcacatgccacctcagctggagacacccagaatgatgatgacaccaccacccgtcactccacagcaacccaaaaacatccacatcaacccacacttcaagggtaccgtcgtcacccctgtccaggtgccactgctgcctgttccatcacagcctaggcctgcggtcgggccacagagattccccggtcctccagagtttccccagcatactccgggtcctgtccccaacagtttctcccagccaccaaggctgcctttgcaagatcagtggagagcccctccgccacctcaggatcgcgatccattctttcttggggtttccggagagcctaggttcccctcacatctgtttctggagcaaagaagtcctcctccacctccaccaccgccaacacttttaaacagcagccacccagtgccgacccagtccccattaccctttactcagcccggacccgcattcaaccagcaggggcagcaacctgtgtttccaagggaacgcccagtccgccctgcgctgcagcctccaggacccgtgggaatactccatttctcacagccaggttctgccactacccgcccattcattccacccaggcaaccgttcttgcctggtcctggccaaccttttctgccaacccacacccagcctaatctgcaaggcccactgcatcctccactcccaccgccacaccagccacagccacagcagccccagcagcagccacctccccaacaccagcctcctcaccagcctcctcaccagcccccaccgcaacaccaacccccaccccagcaccccccacaacaccctcctcagcatcagcatcatcatcaccatcaccacctcagcgttccacctcccccactgatgccgatgtcccaacctcagttccgcccacatgttcagaccgcccaaccccaggcatcaagtagccgcatgcagtgcccacagcggcaggggctccggcacaataccacatcccagaacgtgagtaaacggccaatgcagcagatgcagcctacagctccgcgaaacagcaacctcagggaattacctatcgcgccaagccatgtcatcgagatgtccagtagccggtgttccgcgaccccgtccgctcaggtaaagccaattgtgagcgcttcccccccatctcgcgctgtggccggatcacgatcaagccagggcaagaccgaagtaaaggtgaaacctgcatccccagtggcccagcccaaagaggaagcaaaaaccgagacggaattcccagacgaggacgaagaaacccggttgtataggctgaagatagaagagcaaaagaggttgagggaggagattttgaagcagaaagagttgaggagacagcagcaggccggtgctagaaagaaagaactgctggagaggctggctcaacagcagcagcagctgtacgctcccccacccccagccgagcaggaagaacaagctttgagtcctagtccaacaaacggtaatcccttactgccttttccaggggcacaggtccgccaaaatgttaaaaaccgactgctggtgaagaatcaggatgtgagcatctctaacgtgcagcctaaaacttccaactttgttccttccagcgccaacatgcagtaccagggccagcagatgaaggcgttaaagcatttaaggcagacgcgaaccgtaccacagtctcagactcagcccttgcacaaggtgctcccaattaagccggcagatgtggaggagcccgcagtcccgcagacccccagagtggcatctatccaggggagaccacaggacacgaagcctggggtcaaacgaacagtcacccataggaccaacagtggcggaggggacgggccacatatcagctcaaaagtcagagtcataaaactgtctggcggaggaggtgaaagcgacggttttttccaccccgagggacaacctcagcgcctgccacagccccctgaagtcggcccacagccagctcgcaaagttacactcacccgcggaggactgcagcagcctccccatctgccagccggtccacacgctcactctccagtgcccccagggattaaatctatccagggaatccacccagccaaaaaggcgattatgcacggcaggggacggggtgtggctgggccaatgggtagagggagattgatgcccaacaaacagaatctgagagtggttgaatgcaaacctcaaccttgtgtcgtcagcgtggaagggttgtcttctagcacgactgatgcacagctgaagagcctcttgatgagcgtcggtccaatacagtcgctacagatgctgccacaacagcgtaaggcgattgctaagtttaaagaacccgcacatgctcttgcgttccaacagaagtttcacaggcacatgatagacctgtcgcatataaacgtagctcttatcgttgagtag

SEQ ID NO: 59499 - DNA, 87 bp, Artificial Sequence
  Description of Artificial Sequence: Synthetic coding sequence
atgcacgggagaggaagaggtgtggcgggacccatgggtcgcggacggctgatgccaaacaagcagaatctgcgagtcgttgagtag

SEQ ID NO: 59500 - DNA, 1278 bp, Artificial Sequence
  Description of Artificial Sequence: Synthetic coding sequence
atgtcaaagcggaagcgcaaacggagtgtgcaggagggagaaaacccggatgatggagttcgagggtcacctcctgaggactatcgcctcgggcaagtggcaagttctctttttcggggtgaacaccactctcgtggcggtacaggccgtcttgcctcactgttttcttcgctggagcctcaaatccagcctgtgtacgtccctgtgccaaagcagactattaaaaaaacaaaaagaaatgaggaagaggagtcaacgtcccagatcgaaaggccgctatcacaggaacctgccaagaaggttaaagcaaagaaaaaacacaccaatgccgaaaagaaactggctgatcgcgagtcagcactggcttccgctgacctggaggaagaaattcatcagaaacagggccagaaaagaaagaactcacagcccggagtgaaggttgcagatagaaaaatcctcgacgatacagaagacactgtggtgagccaacgcaaaaagatacagataaaccaagaggaagaaaggttgaagaacgaaaggaccgtgtttgtgggaaatcttccagtgacttgtaataaaaaaaagctgaagagcttcttcaaggaatacgggcaaatcgagtccgtaaggtttcgctctctcatccctgctgaagggactctctctaaaaagcttgcggcaattaaaagaaagattcatccggaccaaaagaatattaacgcatacgtggtgttcaaagaggagtcggccgcaacacaagcccttaaacgtaacggcgcacagatagccgacggatttaggatacgggtggatctagctagcgaaacttccagtcgagacaagaggtccgttttcgtggggaatctgccgtacaaggtggaagaaagtgcaattgaaaaacactttctggattgcgggtccatcatggcagtaaggattgtgagggacaaaatgacagggatcggcaaggggtttggatacgtgctcttcgaaaataccgactcagtccacctggcccttaagctcaacaacagcgagctcatgggtcgcaagttgagagtaatgaggtcagtgaataaagagaagtttaagcaacaaaattccaaccccaggctgaagaatgtttccaaacccaaacagggacttaattttacttcgaagactgcggagggccatccgaagagcctgtttatcggcgagaaggccgtactcctcaagaccaagaagaaaggacaaaaaaaatccggcagaccaaagaagcagcggaagcagaagtag

SEQ ID NO: 59501 - DNA, 936 bp, Artificial Sequence
  Description of Artificial Sequence: Synthetic coding sequence
atgaagcgagtgaactcttgcgtcaagagcgatgagcacgtgctcgaagagcttgaaaccgagggggagcgccagttgaagtccctcctccagcatcagcttgatacatctgtctcgatcgaagagtgtatgtcgaagaaggagtcttttgccccagggaccatgtataagccgttcgggaaggaagcagcgggtaccatgaccctgtcacaatttcaaaccctccatgaaaaagatcaggagaccgcctctctgagagagttggggctgaatgaaactgagatccttatttggaaaagccacgtgtctggcgagaagaagacaaaattgagggcaactccagaagccatccagaaccgcctccaagacatagaagagaggatctccgagcgtcagagaatcctttgccttcctcaaaggtttgccaaaagcaagcagctcacgaggcgcgagatggagatagagaagtctctgtttcagggagcagatagacactcatttctgaaagcactgtactatcaagcctatcacaaaaagacctcagccgacaaatatatgactagcatgaaacgtaagatcaagcttggtaccaaagacgaacctcagaagaaaaataaaggagatcccatgaataatttagagagcttctaccaagaaatgattatgaaaaagaggctggaggagttccagttgatgagaggactgacttccttccctagagaagattttcagaacctatcctatgagggaaccactagtgtgctgggtgcgaaatggcagaaacgaacaggacgaacatcgactttttcgatcctgcttgtaagtctgctctcagagaccgtgtttaccagcagcgcgatgtatggcattcctcacttgctgactatgtccctgaaatttagcactagaatcggcaaattgagtttcactccttag

SEQ ID NO: 59502 - DNA, 1242 bp, Artificial Sequence
  Description of Artificial Sequence: Synthetic coding sequence
atgaagagggtaaattcatgtgttaaatcagacgaacatgtgctagaggagctggagaccgaaggagagcgccaactcaaatccttgctccaacaccaactcgacacttcagtgtccattgaggaatgtatgtcaaaaaaagaatctttcgcccctgggacaatgtataaaccgttcggaaaggaggccgcaggcactatgaccctttctcaattccagaccctgcatgagaaagaccaagaaacagccagtctgagggaactgggattgaatgaaaccgagatcctaatctggaaaagtcacgtgagcggagagaagaaaaccaagttacgggcaacccctgaagcaatccaaaacaggctgcaggatatagaagaaaggatttcagaaaggcagaggatactatgccttccacagcgcttcgctaagtcaaaacagctgacaagacgagagatggagatcgaaaaaagtctgttccagggagccgatcgccatagttttctgaaggcattgtattaccaggacgagccgcagaagaagaataagggcgacccaatgaacaatctggaaagcttctatcaagaaatgatcatgaaaaaaaggcttgaagaatttcaacttatgcgaggtgagcccttcgcttcccactctttggtgtcagcaaccagcgtaggtgattcaggaacagccgagtccccaagcctgttgcaagataaaggtaagcaggctgctcagggcaagggcccatccctccacgtggctaacgtcattgacttcagcccagaacagtgctggaccgggccaaagaaactcacgcagcccattgaattcgttcccgaggacgagatacagcggaacagacttagcgaggaggagatcagaaaaattcctatgtttagctcctacaatcctggagagcccaacaaggtgctgtacctgaagaacctgtcccccagagtgacggagcgggatttggtctccctatttgctaggttccaagaaaaaaaaggaccacctattcagttccgcatgatgacagggagaatgagggggcaagcattcataacttttccaaataaagaaattgcctggcaggccctccatttggtcaacggctataagcttcacggaaaaatactggtgatagaatttggaaagaacaaaaagcagaggtctaacctccaggctacaagtctgatttcttgcgccacggggtctactactgagatcagcggatcctag

SEQ ID NO: 59503 - DNA, 618 bp, Artificial Sequence
  Description of Artificial Sequence: Synthetic coding sequence
atgaagcgagtgaactcttgtgtgaagtcggacgagcatgtattagaagagctagagaccgaaggggaaagacagttaaagagcctactccaacaccagctagatacatctgtgagtatcgaagagtgcatgtccaagaaggaaagttttgcccctggaactatgtacaagcctttcggaaaagaagccgctggaaccatgaccctaagccagttccagactctgcatgaaaaagaccaagaaaccgcgtccctgagggagttagggctaaatgaaacagaaattcttatctggaaaagtcacgtgtccggagaaaaaaagaccaagctgcgggctactcctgaggcaatccagaaccgactccaagacatcgaggagaggatctccgagaggcagagaatcctttgtttgccccaacgttttgctaagagcaagcagctgactcgaagggagatggaaattgagaagtccttattccagggcgctgaccgccactcttttctgaaggccctctattaccaagcttatcacaagaagacctcggctgataagtacatgacatccatgaaaaggaaaatcaagctgggaactaaagggatcatccctaaccctccgtag

SEQ ID NO: 59504 - DNA, 1218 bp, Artificial Sequence
  Description of Artificial Sequence: Synthetic coding sequence
atgaagcgtgtgaactcgtgtgtgaagagcgacgaacatgtgctcgaagaactggagacggagggcgagcgccagctcaaatcattactccagcaccaactggacacatccgtgagcatcgaagaatgcatgtcaaaaaaagaatcttttgcacctggcaccatgtacaaaccctttggaaaggaagccgcaggaaccatgactctgtcccagtttcagacactgcacgagaaggaccaggaaactgcttccctccgtgaactgggattaaacgaaaccgagattctcatctggaagtcccacgtgtccggagagaagaaaaccaaactccgggcaacaccagaagcaatccagaacagactgcaggatattgaggagagaatctcagagcgtcaacgtatcctgtgtcttccacagaggttcgctaagagcaagcaactcacccggcgtgaaatggagattgagaaaagtcttttccaaggcgcagacaggcattcattcctaaaggccttatattatcaggacgagcctcagaaaaagaataagggcgatccaatgaataacctagagtctttttaccaagagatgataatgaagaagagactagaggagtttcaactgatgcggggagaacctttcgcatcccattctctcgtcagcgccactagcgtgggcgacagcggtacagccgaatcaccttccctgctgcaggacaaaggtaagcaggccgctcaagggaaaggacctagcctgcacgttgccaatgtgatcgatttctcaccagaacagtgctggacagggccaaaaaagctcacgcaaccgatcgaattcgtccctgaggatgaaatccagaggaataggctttctgaggaggagatcaggaaaatcccaatgttcagcagctacaacccaggcgaacccaataaagttctgtatctaaaaaatctcagtccaagagtgaccgaacgggatctcgtgagcctgtttgccagatttcaggaaaagaaaggcccaccaattcaattcagaatgatgacaggtagaatgcggggtcaggcctttattactttccccaataaagagattgcctggcaggcactccaccttgtgaacgggtataaactgcatgggaagattcttgtgatagagtttggaaaaaataagaaacagcggtccaacctgcaggccactagtttaatttcgtgcgccaccggttag

SEQ ID NO: 59505 - DNA, 612 bp, Artificial Sequence
  Description of Artificial Sequence: Synthetic coding sequence
taggtcaatagctgcgttaagagcgacgaacacgttcttgaagagctcgagaccgaaggagagcggcaactgaagtcgctgcttcagcaccagcttgacaccagcgtttctatcgaagagtgcatgtctaagaaagagagcttcgctcctgggacaatgtataagcccttcggaaaggaagcggctggcacaatgaccctgtcgcagtttcagaccctgcacgaaaaggaccaagagacggcctccctgcgagaactgggcctgaatgaaaccgagatcctgatttggaaatcacacgtgagcggcgagaagaaaacaaagctgagggcaacacctgaggctattcagaatcgcctgcaggacattgaggagcgcatttcagagaggcagcggattttgtgtctgcctcagcggtttgctaaaagtaaacagcttactcggagggaaatggaaattgagaagtccctgtttcagggggcagacagacatagtttcctcaaggccctgtattatcaagcataccacaaaaagacgtcggccgacaagtatatgacatcaatgaaaagaaagattaagctcggaaccaaagggattatccctgaggagccatag

SEQ ID NO: 59506 - DNA, 3159 bp, Artificial Sequence
  Description of Artificial Sequence: Synthetic coding sequence
atgatgcaagctaccgcagtcgtcgaaactgctagcggaaaaggctaccactcgaatggcggaaatttacagaaagataagcctagcaaccccaagaaggaaaacctgctgctgagttccaatggctgcgatgaggtaaagttaactttccccgacgatgattggaatagcagcacacttgaacagagggctaacaacaaagaaatttccaatatagataaaatggatctgctcgaacccttcttcagcgtgagtcaggacacaaacacggagagcacccagtttcagtccagcgagttagaagattcaacagactacgctttccttaataaaacctatagcattccttattcagaaagtaaacttaagaaagagtccctcactcccttatctagcgaactcgatccagaagtccagaaaaaagaggaggttttttttaacattttggagcatcaggataaaactgtggggcttgaaaggatctacaatatttctgatgctaattatcgggagtcggccgaggatacgcagaagcacgatacggacgaggattcccagcaggagtaccattcagccgaagagcaggagtacatcagcaaccatctgtcttttgatcagacaaaagccctggatatcagcaacccggaggtggtcgaactcggcaactccgggtacgaggtgaagtgcgcgagtaacgtggaggacaatcgagttaacagtggtagcgggagcatcatctcattcgattctctggatgtctacggtcaggaggaatctttacacgtaagtaagttccagaactcagtgatgctgagggaataccacgaccttaagcacgagaagtataaggaacaggagacgaatagtatgtatcatacggtcttcgacggatcagtcctgcgcagtaactcccccggaaaccaagagagccaatcaaaaagtggcagcctgtcgccccaaaaagtcctgaagatgaaaatctatacagaaaatatgaagagccaaatcaacgagggaaaagacttttgcggaaacaaaatagtagagaacaagattctgctccacctcgaaaacccctccaccctgccacaggacaaagcactggagacccttttacagccatgcaaagactgtcagacttcctggacttcagtattcgacgactcaatcatctccgcttgcggttattatgagtccctacagaatacagcggatagtgccctggacttttcagctatgttgccaaaaatcgccgtgcgagacaaccaggccatagaggacaatacatctctgaaagtcgcccattcctctacaaccaaaaaaacatgctttcataatattggcgagatgtgtactaaatcgctcaccgacgcagccagctgtaccgtgaccataaaccaaactgtcgatgtttccaccgactttcgcgcttgtttcacaacctctagagctacatcagcccgtccatctgtggtgagtacgtcttccaacaccgaaatcacgatgatgaacaagaaaaggcctgacgagtggcaaaacgaaaagcagaaatcagttgcctgtagtaccgactggtcatattctgaagattgcatcgacactcaaatggcaatcactaaggggagcggaaaatcactgagtgttgattcactgaaacccaacggcaattttctgaataaggacttcttggaattacggaaggcctgcggaatcacagatttgaagaagcacccagagagggagtttcagctgttcaaggataccgagaaggatctgcccagtatgtgctgtcagaagatcatgcagcgcgctatcaaggccgaactgcatttgctaaacgtgcattatcagatgtgccgacggcactgttgcgatatttataaattggtcatggagaatcgggaaggcctgaacatgaatctctcttcaaacagcgccaagaaagaacttgggagcgccctgctctctttgttgggagatctcaaggttaggtacgtcacacttaaggagaagatccacaaggggattccattagaggaacttcctccactgagccttgagagtaaactgctctccacctttagcacatttgccagcagactgatgaaaaaagagacacatgtcttctcagaagcagatgccgagcaagataatcaaagagcacatgacgtcgatgtctcatccaatctcaaaaaaaccctgtctcagatgagcttgagttccgataactcccacgcgacccaaaatattagtccaaaaaaggacgacttcaaaaatggggatatcaacgctgatttcagtcagctcaaattaggggacaaagattgccgccactaccaggagacttctgaggattggagcgacgctaaggagagcctgaccggagtggacgtctctggtactcaggggaatcaggtcgagcaggatacctggaatctcgatcttaccggagagatgaaaaacgtggaaccatctcaacgagataagggttacctgatccatgtcggcggactctgcccgtcagtcagcgaagccgatttgcgctctcactttcagaaatatcaggtgagtgaaatttctatctatgattccaccaattaccgttatgcgagtttggcgtttacgaaaaactctgacgccaaaatcgcagtgaaagagatgaatggcatcgaaattaacggaaaatcagtcaacgtttggccagtcaaaatacttggagagtataccagcccccttagtagtaagaacgggaacaggatctcctccaataatttggagaaaagcacaaataaacaaatccacagcgagtttagtatcagccgcttgcctcggacacggcctaggcagctgggctccgaacaagatagtgaggtctttccctctgaccagggcgtgaagaagaattgtaaacagatcgagtcagccaaacttctccctgacacgcctgtgcagttcatacctcccaacaccctaaacctaaggagctttaccaagatcataaaacgcttggccgaactccaccctgaggttagcagagaccatatcattaacgccctccaggaggtaagaatacgtcacaagggtttccttaacggtctttctattaccacgatcgtggaaatgacctcttcactccttaaaaacagtgcctcatcatag

SEQ ID NO: 59507 - DNA, 3159 bp, Artificial Sequence
  Description of Artificial Sequence: Synthetic coding sequence
atgatgcaggcaaccgccgtggtggagacagcctccggaaagggttaccactcaaacggcggaaacctacagaaggataagccttctaacccaaagaaggaaaacttactgttgtcgagcaacgggtgcgacgaggttaagctgacctttccggatgacgactggaattccagcacactggagcagagagccaacaacaaagaaataagcaatatcgataagatggatctcttggagccatttttctctgtttcccaagatacgaacactgaatctacccaatttcagtcgtctgagctggaggattcgaccgactacgcttttcttaacaagacctacagcattccatattcggagtccaagttgaaaaaagagtcccttacccctctgagctccgaactggatcccgaagtgcagaagaaggaggaagtattcttcaatatcctagagcatcaggataagactgtgggccttgagcgaatctacaacatttcagatgcaaactatagagagtccgcagaggatactcagaaacatgatacagacgaagattctcagcaggagtaccactctgcggaagagcaggaatacatttcaaaccacctgtccttcgatcagacaaaggctttggacatctcaaaccctgaagttgttgagctgggtaattctggatacgaagtcaaatgcgctagtaatgtggaggataaccgggtaaatagcggcagcggcagtattatcagttttgactccttggacgtgtacggtcaggaggaaagtctgcatgtcagcaagtttcagaactcggtgatgctgagagaatatcatgacctcaagcatgagaagtataaggaacaggaaacgaacagtatgtaccacacagtgtttgacgggtccgtgctgaggtccaactccccgggtaaccaggaatcccagagtaaaagcggaagtttatcaccgcagaaagtgctcaaaatgaagatctatacagagaatatgaagtctcagattaacgaaggcaaagacttctgcggtaacaaaattgttgaaaataaaattctgcttcatctggaaaaccccagcactctcccacaagacaaggcactggagaccctgctccaaccttgcaaagactgccagacaagttggacgagcgtgtttgacgactctatcatctctgcctgcggttactatgagagcctgcagaacactgccgactctgcattggatttcagcgctatgctgcccaagattgcagtcagggacaatcaagccattgaggataacacctccctgaaggtagctcactcgagcacaacaaagaagacctgctttcacaacattggcgagatgtgcacaaagagtctcactgatgcggcaagctgcaccgtgaccatcaaccagaccgtcgatgtgtctaccgatttcagggcctgctttactacttcccgggctactagcgccagaccgagcgtcgtgtcaacctctagtaataccgagataaccatgatgaataagaagcgacctgacgagtggcagaatgagaagcagaaaagcgtggcatgctccactgactggagctatagcgaggattgcattgacactcagatggctattacaaaaggatccggaaagagtctttctgtggatagtcttaagcctaacgggaactttctgaacaaagactttctggaacttagaaaggcttgcggcatcacagacctgaagaagcaccctgagagagaatttcagctgttcaaggatacagagaaggaccttccatccatgtgttgccagaaaatcatgcagagggcaattaaggccgaattgcatctgttgaacgttcactatcagatgtgccgccgacactgctgtgacatctacaagttggtaatggaaaatagagagggcctaaacatgaatctgtcctctaacagcgctaaaaaagagctcgggtctgccctcctttccctcctgggcgatctcaaggtccggtacgtcacattaaaagaaaagattcacaagggtataccgctagaagaactgccccctctttctttggaatccaagctactgtccacgttctcaacttttgcctcacggctgatgaaaaaagaaactcacgtcttctctgaagcagacgctgaacaggataaccagcgcgctcacgacgtagatgtgagctccaaccttaaaaaaacactgagccaaatgtctctttcttcagacaatagtcacgcgacacaaaatatcagccctaaaaaggatgacttcaagaacggtgacataaatgccgatttttcacagctgaagctcggcgacaaggattgcaggcattaccaggagacgtctgaagactggagtgacgcgaaggaatcactaacaggggtggatgtgtctggcacccagggaaatcaggtcgaacaggatacgtggaacctggatcttactggcgaaatgaagaacgtggaaccaagccaacgggacaaggggtacctaatccatgtcggcggtttgtgcccctctgtctctgaagctgacctgaggagtcactttcagaagtaccaggtttctgagatttccatctatgactctaccaattatagatacgcatcgctggccttcacgaaaaacagcgatgccaagattgctgtcaaggagatgaatggaatcgagatcaacggaaagagcgttaacgtttggccagtaaagatcctaggagagtacacatcaccgctctcctcaaagaacggaaaccgaatttctagcaacaaccttgagaaatctacaaacaagcagattcattccgaattcagcatcagccgcctccctagaacaaggcctagacagctgggatcggagcaggattcggaggtatttccatccgatcagggtgtgaaaaagaactgcaaacagatcgagtctgccaagctgctgcctgacaccccagtgcaattcatcccgccaaatacattaaatctgcgctcttttaccaagattatcaaacgacttgccgagttgcaccccgaagttagccgagaccacattattaatgctctgcaagaagttagaattcgacataaggggtttttaaacgggctgtctatcaccaccattgttgaaatgaccagttctctcctcaaaaacagtgctagcagctag

SEQ ID NO: 59508 - DNA, 1602 bp, Artificial Sequence
  Description of Artificial Sequence: Synthetic coding sequence
atgaatgaagaaaatatcgatggcaccaacgggtgcagcaaagttcgtacagggatccaaaacgaagcggcactgctcgctttgatggagaaaaccggatataatatggttcaggagaacggccagagaaagtttggagggccaccgcctggttgggaagggcctccgccaccccgtggctgcgaagtcttcgtaggaaaaattccaagggacatgtatgaggacgagctggtgccggtctttgagagggcaggcaaaatatacgagttccgcttgatgatggagttttccggtgaaaacagggggtatgctttcgtgatgtacaccaccaaggaggaggcccagctagcaattagaatcctaaacaactacgagatcagaccagggaaattcatcggagtgtgcgtgagtttggacaattgccggctgtttatcggggctattccaaaggaaaaaaagaaggaagagattttagatgagatgaagaaagtgacggagggggtggtcgatgttatcgtctacccctcagcaaccgataagacaaaaaatagagggttcgcatttgtggagtacgagagccatagggccgctgccatggctcgtcgaaagctgattcccggtacatttcagttgtggggccatacaatccaggtcgactgggctgaccccgagaaagaagtggatgaagagactatgcagagagtcaaagtgctctatgttcgcaatcttatgatctcaactacggaggagacgatcaaggctgaattcaacaaattcaaacctggcgcagtcgagagagtgaaaaaactccgcgactacgcttttgttcacttctttaatagggaggatgccgtcgcggcaatgtctgtaatgaacggaaagtgtattgacggtgccagcatcgaggtaacgttggccaagcccgtcaataaagaaaatacatggcggcagcacctaaatgggcagatatcaccaaatagtgagaatctgatcgtgtttgcaaataaggaagagtcccatcccaaaacccttggcaaactacccacactaccagctcggctgaatggacagcattccccaagtccgcctgaagtcgaaagatgtacctaccccttctaccccggaacaaaactgactcctatctcaatgtacagcctgaaatcaaatcacttcaattccgcagtgatgcatctcgactattactgcaataaaaacaactgggctcccccagaatactatctttattcaaccaccagccaggacggcaaagtgttgctagtatacaagatagtcattcccgcaatcgctaatggctcccaatcatattttatgccggataaattatgtacaacgttagaagatgccaaagagctagctgcacagttcacactgttacatttagactacaatttccataggtcgagtataaacagtctgtctcccgtgtcagccaccttgtcttcaggaacgcccagtgtattgccatatacctctcggccatacagctaccctggataccctctgagtcccactatttccctggcgaacggatcacatgttgggcaaaggctttgtatcagtaaccaggcctcatttttttag

SEQ ID NO: 59509 - DNA, 1104 bp, Artificial Sequence
  Description of Artificial Sequence: Synthetic coding sequence
atggccagttccggcggagagctgggaagcctcttcgaccaccacgtgcagcgagccgtttgtgataccagagccaagtacagggaaggtaggcgtccaagagctgtcaaggtatatactattaatctggagagccaatacctgctgattcagggtgtaccagccgtcggtgtcatgaaagagcttgtcgagcgattcgcactgtacggtgcgattgagcaatataacgccctggatgagtatcctgctgaggacttcaccgaggtgtacctgatcaagttcatgaatctgcagtctgcgagaacagccaaacgcaagatggacgagcagagtttctttggaggacttctccatgtatgctacgccccagaattcgagactgtggaggaaactagaaagaagctgcagatgcgtaaggcctacgttgtgaaaaccaccgaaaataaggaccattacgtgaccaaaaagaagctggtgacagaacacaaagataccgaggactttcgccaggatttccattccgagatgtctggcttctgtaaggccgctctgaatacatccgcgggaaactccaatccttaccttccttattcttgtgaacttcccctttgctacttctcttccaaatgcatgtgcagtagtggagggccagtggatcgggctcccgactcatccaaagatgggaggaaccaccacaagaccatgggccactacaaccacaacgactccctgcgcaaaacacagattaactcgctgaagaactcagtcgcgtgccctggcgctcagaaagctattacaagtagtgaagcggtggatcgcttcatgcccaggaccactcagctacaagagcggaaacgaaggcgggaagacgatcgcaagctcggaacttttctgcagaccaaccctactgggaatgaaatcatgatcgggcctctcctgcccgatattagtaaggtggacatgcatgacgatagccttaataccaccgctaacctgattaggcacaagctaaaggaggtgatttccagcgtgccaaaacccccagaggacaagccagaggatgtgcatacctcacaccccttgaagcagcggcgaagaatctag

SEQ ID NO: 59510 - DNA, 1083 bp, Artificial Sequence
  Description of Artificial Sequence: Synthetic coding sequence
atggcttctagtggcggtgagttggggagcttatttgatcaccatgttcaacgcgctgtttgtgatacccgcgctaagtaccgtgagggtcgaaggcccagggctgtgaaagtgtacaccatcaacctagaatcacagtatttgttaatccaaggcgttccagcagtcggagtgatgaaggaactggtcgaaagattcgccctgtacggtgccattgaacaatacaatgcactggacgagtatcccgctgaagacttcacggaagtatacctgatcaaattcatgaatctgcaatccgcacggacagctaaaagaaagatggacgagcagtcattctttggagggttactccacgtgtgctacgctcccgagttcgagaccgttgaggaaacccggaagaagttacagatgcggaaggcgtacgtggtaaagacgactgaaaataaagaccattacgtaaccaagaagaaactggtgactgagcacaaggacactgaagatttccgacaggattttcacagtgagatgagtgggttttgtaaagccgcactcaacactagcgctggtaactcaaacccatacttgccatattcctgtgagcttcctctatgctacttcagttccaaatgtatgtgtagctccggcggtccagtggaccgcgcaccggattccagcaaggacggtcgcaaccatcacaaaaccatgggtcactataaccacaacgactctctgcggaagacacagatcaattccctaaagaactctgttgcgtgccccggtgctcagaaagcaataactagttccgaagctgtggacaggttcatgccacgaacaactcagcttcaggaaagaaaaagacggcgagaggatgaccgcaagctgggaactttcctccaaacaaatcctactggcaacgaaatcatgatcggcccacttctgcccgatatctccaaagtcgatatgcatgacgattctctcaatacgaccgcgaatcttatcaggcataaactcaaagaggtgtttcacctatgtcagtccttgcaacgcacgtctcagaaaatgtatatacaggtgatccactag

SEQ ID NO: 59511 - DNA, 381 bp, Artificial Sequence
  Description of Artificial Sequence: Synthetic coding sequence
ggcaaaatggcttctagcgggggagagctcgggagtctctttgaccatcacgttcaacgagctgtgtgtgataccagagcgaaataccgcgaaggacgcagacctagggccgtgaaggtgtataccatcaacctggaatcccagtatcttctgattcagggcgtacccgcagttggagtgatgaaggaactggtggagaggttcgctctgtacggagcgattgaacagtacaatgccttggatgagtatcccgcagaagattttactgaagtgtatttgatcaagttcatgaatctgcagagtgcccgtactgctaagaggaaaatggacgagcagagttttttttggattgctagctgcgtgctgtgttcccggatctag

SEQ ID NO: 59512 - DNA, 969 bp, Artificial Sequence
  Description of Artificial Sequence: Synthetic coding sequence
atgaatccccttaccaaggtgaaactcatcaatgagctcaacgaaagggaagtccagctgggggtggccgataaggtatcttggcattccgaatacaaagatagcgcctggatcttcctcggtggactgccctacgagttgaccgagggagatatcatttgcgtgttttcccagtacggcgagatagtcaacatcaacctggtcagggataagaagaccggaaaatcaaagggtttttgcttcctctgctatgaggatcagcgctctaccatcctggccgtagataattttaatggcataaaaatcaagggcaggactatccgggtggatcacgtgagtaattaccgcgctccaaaggattcggaggagattgatgatgtgacacggcagctccaagagaagggctgcggcgctcggactccatctcctagtctgagcgaaagtagtgaagatgaaaagcccactaaaaagcataaaaaggataagaaagaaaagaagaagaaaaagaaagagaaggaaaaagctgacagagaagtgcaagccgagcagccatcctcaagtagcccaagaaggaaaacagtgaaggaaaaggacgacacaggtccgaaaaagcactcgtctaagaacagcgagcgagcccagaagtcagaacccagggaaggacagaagctgccaaaaagccgaaccgcctatagcggcggtgcggaagatctggaaagagaattaaagaaggaaaagcccaaacacgaacacaaatccagttcaagaagggaggcccgtgaggagaaaactaggattagggataggggaagatcgtccgacgcacattcaagctggtacaacggtcggtccgaggggagatcctacagaagtcgttcgcggtcccgagataagtctcacaggcataagcgcgcaaggcgatcgagggagagagaaagttccaacccgagtgacagatggcgacactag

SEQ ID NO: 59513 - DNA, 177 bp, Artificial Sequence
  Description of Artificial Sequence: Synthetic coding sequence
atgaatcccctgactaaggtgaaactcattaacgagctcaacgagcgagaagttcaattgggggttgcagataaagtctcttggcacagcgaatacaaagactctgcttggatttttctcggcggactcccatacgaactgacagaaggtgacatcatctgcgtcttttctcagtag

SEQ ID NO: 59514 - DNA, 828 bp, Artificial Sequence
  Description of Artificial Sequence: Synthetic coding sequence
atgaacccccttacgaaagtgaagctgataaacgaactgaatgagagggaagttcaactgggtgttgctgataaagtgagttggcactcggagtacaaggacagcgcgtggatcttcctcgggggacttccctatgaattaactgaaggagacattatctgtgttttctcccagtacggggagattgttaacatcaacttggtaagagacaaaaagaccggcaagagcaagggattctgctttctctgctacgaggaccagcgttccactatcctggctgtcgataatttcaacggtatcaagatcaagggcaggaccatccgagtggaccacgtcagtaactaccgagccccaaaagactctgaagagattgatgacgtcacgaggcaacttcaagaaaaggggtgcggggcaaggacgcctagcccatctctgagtgaaagcagcgaggacgagaagcctactaagaaacacaagaaagacaaaaaggagaagaaaaagaagaaaaaggagaaggagaaagccgaccgcgaggtacaggcagagcagcctagtagtagctctccacggaggaaaaccgtaaaggagaaggacgataccggcccaaaaaaacattcctcgaagaactccgagcgggctcagaaatccgagcccagggaggggcagaagctgcccaaatcgcggaccgcctattctggaggtgccgaagacctagagcgtgagcttaagaaggagaaacccaagcatgaacacaagagcagctccagacgggaggccagagaagagaaaacaagaatcagagatagaggcctgaggtgtactttctag

SEQ ID NO: 59515 - DNA, 3204 bp, Artificial Sequence
  Description of Artificial Sequence: Synthetic coding sequence
atgatggaggcagatcggcctgagaagctgtttatcggaggactgaaccttaagactgatgaaaaagctcttaaagcagagtttggtaaatacgggcacataattaaggtgttccttatgaaagatcgaaagacaaataagagtcggggttttgcctttgtgacctttgagtccccagctgatgcgaaggcagccgctagggatatgaatggaaagtatctggacggtaaagcgattatggtagcccagacaattaaacctgcttttaagtcttcccggtgggttccgccaacccccggatccggcagccggagtaggttttcgcaccggacccggggtggagggagctccccccaacgcccaccctcacagggtaggccagacgatggacgcggatatgcgggatacttcgacctctggccttatagggctccaatgccacgtaagagagggccaccaccaaggcactgggcatcacctccacacaaacgcgcaacgccaagttccctggcccatagtgtgggctgtgggatgaggggtaaggcgcctacggtgagcggtcaagatggttactctgggctgcagccacgtaggtgggcaggccctccacataaacgggcagtcccccgtagtagcctggcccgaattggtgggagtggcatgccaggcaaagcaccggcagtttggggccaggacggatattctggaccgagggttcgcgaaccgctccctccctgtagagacccgggtgacttcgtacccgctctaagggactactcccgccgttattacggacacagttcagtcccagattacaggccactgaggggggacggtaaccagaatggctataggggccgagatcatgaatacacagatcatccaagcaaaggcagttaccgggaaccccttaaatcgtatggtggaccatgcggcgctgccccagtgtggggcacacccccttcctacggaggcggatgccgctatgaggaatatcagggaaacagtccggatgcctgctctgaggggagatcaagcgaagctctgcctgtggtgctccccgacgcttacagtagggatcacagtccgaaggcctacagcggcggtcgaagcagcagcagcaacggctacagtagatccgatcggtacggggaggaggggtgttatgaagaatatcgcggacggtccccagatgcccactccggagggaggaacagcagttctaatagttatgggcaatcccaccattatgggggagagggtagatatgaggaataccggggtagatcgcatgaggccaggtctggaggtagatcaacagatgctcattctcgcggtcggagcgatgatgcctactctggcggacacgattcatcttcatggagtgactgttgcggaggtgggggaagatacgaagagtaccaaggacgctcacttgacgctaacagtgggggttgttctccagaagcctactcggggggtcatgataactcttcctggtcagacaggtacggtgtgggcggacattacgaggagaataggggacatagcctggacgccaactcggggggtaggtctccggacactcatagtggcggtcactcaagcagcagcaacagttacggccaaagtcacaggtatggtggagaaggccgatacgagtatcgtgggagaagccacgatgcgcacagcggtggctgtagcgcagatgcttattcaggcggtcacgactccagttcccagtctaatagatacgggggaggaggttgctatgaggagtatcgaggccgaagcctggacgccaattctgggggtcggtcccctaatgcctattcggggggacatgattcctccagttggtctcataggtatgggggtggcggacgctatgaagaatatagggggcgaagcctcgacgcaaattctggcggaagatccccagatgcttacagtgggggacacgactccagcggccaatccaactgctatgggggtggaggcagatatgaagaataccgagggagattgttagatgccaattccggtggacggagccccgacgcctactccggcggtcacgacagcagttctcagtccaatcggtacgggggtgggggaagatatgaggagtatcggggacattcccttgacgcgaattccgggggacggtctccagacacttacagcaggggacacgactcttcgtcacagagtgaccattatggcggtggaggccgatctctcgacgccaactcttcaggacgcctgcctgatgcctattcaggtggccacgattcctcttccaggtcacacaggtacggtggcggaggtcgctatgaagaatacaggggtcgatcactggatgccaactcagggggacgcagtcccaatgcgtattctgggggacataactcctccagcagaaacgacccatgccggggagggggacgctacgaggagaaccgtggacactcccttgacgcgaacagcgggggacacagcccaaacgcttactctgggggtagggacagcagttcaaacagctatgatcgcagccacagatatggaggcggaggccactatgaagagtaccgaggccgtagtcatgacactcactcccgcggacggagccctgacgcacattctggggatcactatacagaggcttatagcagaggtcgcgatagtttctctaattcctacggcaggagcgatcactacggtaggggcggatgctatgaagagtatcagggccgatcacctaacgcatatggcggtggtcggggattaaattccagtaacaactcacacgggaggtctcaccgatacggtggagggggtaggtatgaggagtatcgcggtccaagtccagacgctcacagcggtggcagggacagctctataaaatcgtatggcctgtcagacaggtatggcggaggcggacattacgaggagtatcagggaagcttgcccgacgcctactccggcgatcacgatcgctcaagcaactcttatggcagaagtgaccgctactctcgcggacgcgatagggtgggcagaccggatcggggtctgcctctgcccatggaaactgggtcccccccactgcacgatagttactcacgatccggctgccgggtgccaaggggagggggacgacaggggggaaggtttgagagaggagaggggagatctcggtattag

SEQ ID NO: 59516 - DNA, 1491 bp, Artificial Sequence
  Description of Artificial Sequence: Synthetic coding sequence
atggtggaggcagatcacccaggcaaactcttcatcggtggtctgaaccgtgagacaaacgagaagatgttgaaggcggttttcggcaagcacgggcctatcagtgaggttctgctgatcaaagaccgtacttcaaagtccagaggctttgccttcattaccttcgaaaatccggcagacgcaaaaaatgcggctaaggatatgaacggaaaatcactgcacggcaaggccatcaaggtcgaacaagcgaagaagcctagttttcagagcggtgggaggcggagaccaccggcaagcagcagaaaccgctcacccagtgggagcctgcgaagcgcacgcggtagccgagggggaacaagaggttggctaccatcccaggaaggccacctggacgatggaggctatacccccgacctgaagatgtcctactctagaggcttaatcccggtcaaacgaggcccttcttcccgctctgggggaccaccacccaagaaaagcgctccgtccgccgtggcgcgtagcaatagttggatgggctctcagggtcctatgtcccagcgcagagagaactacggcgtgccacctaggagggccaccatttcaagttggcggaacgacagaatgagcacacgccacgacggatatgccaccaacgatggcaatcatccttcttgtcaggagaccagggactatgctccgcctagtagaggctacgcctaccgggataatggacactccaacagagacgaacactcctctcgagggtatcggaatcacaggtcctctagggaaacccgggattacgcgcctcccagccgtggacacgcatatagagactatggtcactccaggcgcgacgaatcctactctagagggtacaggaatagaagatcatcacgtgaaactcgcgagtacgcacctcccagtcgtgggcatgggtacagagactatgggcacagcagacggcatgagagctactcccggggatatcgcaatcacccttctagtagggaaacccgggactacgccccaccgcaccgggattatgcctatagggattatggccatagctcatgggacgagcacagcagccggggatattcctatcacgacggctacggcgaagccctcggcagggatcacagtgaacatctgtccggttcttcatatcgggacgcgttacagcgatatggaacaagtcacggcgctcctcctgccagaggcccacgcatgagttacggaggctcaacgtgccacgcttactccaatacccgggatcgctatggcagatcatgggagtcttactcctcttgcggagacttccactactgtgacagagagcacgtctgccggaaagaccagcggaatcctccatcattgggccgagtattgcctgatcctagggaagcctatggctcgtccagttatgtcgcttccattgttgatggcggagaaagtcgttccgagaagggagattcctctcggtattag

SEQ ID NO: 59517 - DNA, 1491 bp, Artificial Sequence
  Description of Artificial Sequence: Synthetic coding sequence
atggtggaagccgatcaccccggaaaactcttcattggcggactgaaccgggagaccaacgaaaagatgctgaaagcagtcttcgggaagcacgggcctatttcagaagttctgttaatcaaagaccgcaccagcaagtcacgtggcttcgcatttatcactttcgaaaatccagcagatgccaaaaacgccgctaaagacatgaatggtaagtctctgcacggcaaagctattaaagtcgagcaggcaaagaagcctagcttccaatcagggggacgcagaaggccccctgccagttcgcgcaatagatcccctagtggttccctaagatcagcacgaggcagtagaggtggaacgaggggctggctgccttcccaagagggccatctggatgacggcggatacacaccagatcttaagatgtcatattcacggggactgattcccgtgaagcgcggaccttcaagtaggtccggtggcccaccgcctaagaagtccgcaccttccgctgttgctaggagtaacagctggatgggttcccaagggccaatgtcacaaaggagagaaaattacggggtgcctcctcggagggccacgatctctagttggcggaatgatcggatgtccacaaggcatgatggatatgctacaaatgatggcaaccatcccagctgccaagagacacgtgattacgctccgccatctagagggtatgcttatagggacaacggacactctaatagagacgagcactcctctaggggatatcgaaaccaccggagtagtcgggagacgcgagactatgctccccctagccgcggacatgcttacagagactacgggcattctcggcgtgatgaaagctacagcaggggataccgcaatcggcgatcctcccgcgagacgagagaatacgccccaccgagccggggacatggatacagagattacggccattctagaagacatgagagttacagccgcggataccgcaaccacccgagcagccgggagaccagagactacgcaccgcctcacagagactacgcatatcgcgattatggccactcctcctgggacgagcattcaagcagaggatacagttatcacgacgggtatggagaggcattgggccgagaccattctgagcatctcagcggttcctcatacagagacgcccttcagcggtatggcacgtctcatggggctcccccagccagaggacctcgtatgtcctacggagggtccacgtgccatgcgtatagcaatacccgcgataggtacggtcggagctgggagagctatagctcctgtggcgatttccattattgcgaccgcgagcacgtatgccgcaaagaccagcggaatcctcctagcctggggcgtgtgctaccagacccgagagaggcgtgcggctcctcctcatatgttgcttcgatcgtcgatggcggagaatctcggtctgaaaagggtgattcctcacgctattag

SEQ ID NO: 59518 - DNA, 1491 bp, Artificial Sequence
  Description of Artificial Sequence: Synthetic coding sequence
atggtggaggccgaccaccccggaaagttattcattggaggccttaaccgcgaaaccaatgagaagatgctgaaggcagtcttcggcaagcacggacccatctcagaagtgctgttgatcaaagatcggaccagcaagagccggggattcgcgttcatcacctttgaaaatccagccgacgccaaaaatgctgcaaaggacatgaatgggaaatccctgcacggcaaggcgatcaaagtagagcaagctaagaaaccttcattccagtcaggcggtaggaggcgccctccagccagcagccggaaccgatcgcctagtgggtcccttagatctgctcgtgggtctcgcggaggaactaggggttggcttccgagtcaggagggccaccttgatgatggaggctacacacccgaccttaaaatgtcctactcaagaggcctgatccccgtaaaacgcggacctagtagtaggagcgggggaccccctcccaagaaatcagccccatccgccgttgcccgatcaaactcctggatgggaagccagggacccatgagccagcgccgtgagaattacggggttccgcctcggcgtgccacgatttcttcttggcgcaatgacagaatgagcaccagacacgacggctatgcgaccaatgatggaaaccatccctcttgtcaggagactcgggactatgcacccccatctcgaggatatgcttacagggacaatggccatagcaatcgcgatgaacacagctcacgaggataccggaatcatagatcatctcgggaaaccagggattacgctccaccctctagaggacacgcatatagagactatggccacagtagacgggatgagtcgtatagcagaggatacaggaacaggcgaagttcgcgcgagacacgagagtatgccccacccagtcgtgggcacggatacagggactatggccattctcggaggcatgagagctactccaggggctatcggaatcaccccagcagtagagagacccgggactatgcccctccacacagagactatgcatacagggattacgggcacagctcatgggacgaacactcctcccgaggctattcctatcacgacggctacggggaggccctgggacgcgaccactcagaacacctgtctggtagtagttaccgggatgctctgcaaagatatggcactagccatggtgctccacctgccagggggccaagaatgtcctacgggggtagcacttgccatgcatattcaaatactcgtgaccggtacgggagaagctgggagagctattcgtcgtgcggtgatttccactactgcgaccgcgaacacgtgtgcagaaaggaccagagaaatccccctagcctcggcagggtgctacccgaccctagggaggcctgtggctccagcagctatgtcgccagtattgtggacgggggagagtccagatccgaaaaaggagactcctcaagatattag

SEQ ID NO: 59519 - DNA, 1380 bp, Artificial Sequence
  Description of Artificial Sequence: Synthetic coding sequence
atggtcgaggcggaccaccccggaaagttgttcatcgggggactcaacagggagaccaatgaaaagatgttgaaggccgtgtttgggaagcacggccctatttccgaggttcttctgatcaaagatcggacatccaagtctaggggtttcgcgttcattacctttgaaaacccagccgacgccaaaaacgccgctaaagatatgaacgggaaaagcctgcacgggaaggccattaaggtcgagcaggccaagaagccctcgtttcaaagcggcggtagacggagacccccagcaagttctcggaatagaagtcctagtggctctctgcgcagcgctagaggaagccggggtggcacacgcggatggttgccatcacaggaaggccacctcgatgatggtgggtataccccagatctgaagatgtcttattctagaggactgatcccggtcaaacgaggacctagcagccgttcggggggtcccccaccaaagaagtcagcaccaagcgccgtggcccgttctaattcttggatgggctcgcaaggtcccatgagccagcgtagagaaaattacggcgtgccaccacgtcgcgcaacaatttcctcatggagaaacgaccgaatgagtacacgccatgacggctacgcaacgaatgacggaaaccaccctagctgccaggaaactagggattatgcccctccaagtcgcggatacgcttatcgagataacggacatagtaaccgcgacgagcacagctctcgcggatacagaaatcacagaagttcccgcgaaacgcgggattacgcccctcccagcaggggacacgcctaccgcgactatggacactcccgaagagacgagagctattctcgcggataccggaacagaagatcatcacgcgagacacgggaatatgcccctccgtcgagggggcatggataccgggattacggccactccaggcgccatgaaagctattcccggggatactcctatcatgatggatatggggaggcgcttggacgcgatcactctgagcatctaagcggatcatcttaccgcgacgctctgcagagatacgggacaagccacggagccccacccgcacgtggtccacggatgtcctatggaggttctacatgtcacgcgtattcgaatactcgggaccgctacggccgaagctgggagagttactcatcctgcggtgactttcattactgtgatagagagcatgtgtgtcggaaagaccagcgtaacccaccctccctgggccgagtgctgccggacccacgggaggcgtgtggctcctcatcttatgtggcctcaatagtggacggtggggaatctaggagcgagaaaggagacagctctcgatattag

SEQ ID NO: 59520 - DNA, 1380 bp, Artificial Sequence
  Description of Artificial Sequence: Synthetic coding sequence
atggtggaagctgaccaccctggcaagctttttatcggtggactcaatagggaaactaatgagaaaatgctcaaggccgttttcggaaaacacggcccaatttccgaggtgttgctgatcaaagaccgcacatctaagtctcggggatttgcttttatcacatttgagaaccctgccgatgccaaaaacgccgctaaagatatgaacggcaaatctctccacggcaaagccattaaagtggagcaggctaaaaagccatccttccagagtggaggcaggcgcagacccccagccagctctagaaatcggtcaccaagcggatccctcaggtccgcacgaggcagcagaggagggacccggggatggctgccttcccaagagggacatctcgatgacggtgggtacacacccgatcttaagatgagttactcccggggattgataccagtgaaaagagggccttcatctagaagtggcggtcctcccccaaaaaaatcagccccatctgctgtcgcaaggtcaaattcgtggatgggcagtcagggacccatgtctcagaggcgcgaaaattatggggtgcctccgcgtcgcgctactatctcttcctggcggaacgaccgaatgagcactagacacgatggctacgcaactaacgacgggaaccatccaagctgtcaggagacccgggactacgccccaccttctcgcggatacgcctatcgcgacaacggccatagcaatcgagatgaacactcaagccgcggttatcggaaccaccggtccagcagggaaacacgagattatgcgcctccctcgcgcggacacgcgtatagggactacggccattctcgccgagacgaatcttattcacgaggctacagaaatagacggtcttcccgcgaaactagggaatacgcacccccatctcgcggtcatggataccgcgattatgggcatagtcgtcgacatgaatcctattcaaggggttactcctaccatgacggttatggggaagctcttggaagggaccacagcgaacacctctccggctcgagctatagagatgcgctgcagcggtatggcaccgcccatggggcaccacccgcaagaggaccacggatgagttacgggggttctacctgccatgcctactcgaacactagggaccgctatggcagatcttgggaaagctactcttcctgtggagactttcactactgcgatcgggagcacgtttgtcgtaaagaccagcgaaacccccctagcctaggtagggttttgccagatcctagggaggcatgcggtagctctagctatgtcgcctccatcgtcgatgggggtgaatcgcgctcagaaaaaggagacagctccaggtactag

SEQ ID NO: 59521 - DNA, 1491 bp, Artificial Sequence
  Description of Artificial Sequence: Synthetic coding sequence
atggtggaggctgatcatcccggaaaactgttcatcggcggtttgaaccgagagacgaacgagaaaatgctgaaggccgtgttcgggaagcatggaccaatcagcgaagtgctgttgattaaggaccgcaccagcaagtcaaggggtttcgctttcattacttttgagaatccagccgatgctaagaatgcagcgaaggacatgaacggaaagagcctccacggtaaagccatcaaggtcgagcaagctaagaagccaagttttcagagtgggggacgtagacggccacccgcaagcagccgcaataggtccccatccggcagcctgcggtctgcacgcggttcgcgcggaggaacacgtggctggctcccatcacaggagggacatctggatgatggtggttacacccctgacctgaaaatgtcttactcacgcggtctcatccccgtgaagcgcggaccttcttccagatctggcggtcctccgccaaagaaatccgccccaagcgcggtggcacgctctaatagttggatgggtagccagggtcctatgtcacagcgcagagaaaactacggagtgcccccacggagggccactatcagcagctggcggaacgatagaatgtcaacaagacacgatggttatgctacaaatgacggcaaccacccctcctgtcaggagacacgggattatgccccaccgagccgcggttacgcctaccgcgataatggccacagtaaccgcgacgaacattcatccagaggataccgcaatcatagaagttcccgggaaactcgggattacgcccctcccagccgtgggcatgcttatcgtgattatggccacagtcgaagggatgagagctacagccggggttatcggaatcggcgaagctctcgcgagaccagggaatatgcacctccatctcggggtcacggctaccgtgactacgggcactcacggaggcatgagagctacagtcgcggatacaggaatcacccgtctagccgtgaaacgagagattatgccccacctcatagagattatgcttatagggactatgggcactctagctgggacgagcattcttccaggggctactcatatcatgatggctatggggaggctctaggacgagatcatagcgaacatctctcaggtagcagctaccgggacgcactgcagaggtacggcaccgctcacggcgcaccacccgcacggggaccacgcatgtcgtacggcggtagtacttgtcatgcttacagcaatacgcgggatcggtacggacggtcttgggagtcatatagctcatgcggcgattttcactattgcgatagagaacacgtatgccggaaagaccagcgaaatccaccaagccttggcagggttctcccagatcctagggaggcctgcgggagtagtagctatgtggcaagcatagttgacggaggcgaatctagatctgagaagggcgactccagccgctactag

SEQ ID NO: 59522 - DNA, 1491 bp, Artificial Sequence
  Description of Artificial Sequence: Synthetic coding sequence
atggttgaggccgaccaccctggaaaactgttcataggcggattgaatcgtgagacaaatgagaagatgctgaaggccgtgtttggaaaacatggtccaatatcagaagtcctgcttatcaaggaccgaacctccaaatctagagggttcgcttttatcacgtttgaaaaccctgcagatgcaaagaatgcggcaaaggacatgaacggaaagagcctgcacggaaaggccataaaggttgagcaggccaaaaagccgtcatttcagtcagggggaaggcgtaggccacccgcatcatcgcgcaaccgatcaccctctggttcactgcgttcggctagggggtcgcgcggaggcaccagagggtggcttcctagccaagagggccatctcgacgatggcggttatacaccggacctgaagatgagctactctcgaggcctcattcctgtgaagagaggcccatctagtcggtccggaggcccacctcctaagaaatccgcgcctagcgcggtggcaagaagcaactcatggatgggttcccaggggcctatgtctcagagacgcgagaactatggcgtgccaccccgaagagcaactatctcttcgtggcgaaacgatcggatgtccacccggcatgatgggtacgccacgaacgatggaaaccaccccagctgtcaggagacacgtgattatgcacctccttcaaggggctacgcttacagagacaatgggcactccaatagggacgaacacagctccagaggctacaggaatcacaggtcttctcgcgaaacccgggactatgccccaccctctagagggcacgcatatcgggactacgggcactcacgaagagatgaatcttatagccgagggtataggaaccgccgatcaagcagggagacacgtgaatatgcacccccaagcagaggacatgggtaccgggattatggccactcaaggaggcacgagtcatactcaaggggataccgcaatcatccatcatctcgggaaactcgcgactacgccccacctcatagagattatgcgtatcgggactacggacattcctcatgggacgagcactcttcacgaggatactcctaccatgacggatatggtgaagctctcggacgcgaccactcggagcacctgtctggatcgagttaccgtgacgcgttacaacggtatggcacaagccatggagcccctccagcacgaggccctaggatgagctacggcggttctacatgccatgcttactctaatacaagggacaggtatggtaggagttgggagtcatacagtagttgcggagatttccattactgcgatcgggagcacgtctgtcggaaggaccagaggaatccaccatctttaggaagggtcctcccagaccctagggaagcatgcggcagctcttcatacgttgcctccatagtagacgggggtgagtctcgttctgaaaaaggagactccagcagatactag

SEQ ID NO: 59523 - DNA, 630 bp, Artificial Sequence
  Description of Artificial Sequence: Synthetic coding sequence
atgtccaatttgaagccagacggagagcatggtggcagcaccggaactggcagtggggctggatcaggaggtgcacttgaagaggaggttcggacccttttcgttagtgggctgccagtagatattaagccacgtgagttatatcttttgttccgcccattcaaaggctacgaagggagcctgattaagctgacagcacgacagccagtcgggtttgtgattttcgactcccgtgcaggggctgaggcagcaaaaaacgccctgaatgggattcgctttgatccagagaatccccaaacgctgcggctcgagtttgctaaggccaacactaagatggcaaaatctaaacttatggccaccccaaacccctctaacgtacaccccgctctgggcgctcattttattgcccgagatccatatgacctcatgggtgcagcattgatacctgcctcgccagaggcctgggctccttaccccctgtacaccaccgagctcacaccagcaatcagtcatgccgcatttacttaccccacggccactgccgcagccgctgccctccacgcccaagtgcgatggtacccaagctccgataccacccagcagggatggaagtatcgtcagttctgttag

SEQ ID NO: 59524 - DNA, 1731 bp, Artificial Sequence
  Description of Artificial Sequence: Synthetic coding sequence
atggacgtgaggttctatcccgctgcggctggcgatcctgctagcctggacttcgcccagtgcctgggctattacggatacagcaaatttgggaacaataacaactacatgaacatggcggaagccaataatgccttcttcgcagccagcgagcagacatttcacaccccctctctgggcgatgaagagtttgaaattccaccaatcacaccccctccagaatcagaccccgctctgggcatgcccgatgtcctgctgccgtttcaagcgttgtccgacccccttccaagccagggcagcgaatttacaccccaattcccccctcagtcactggaccttccctctatcaccatttcaagaaatttggtcgagcaggatggtgtacttcacagtagcggcctccacatggatcagtcccacacccaggtgtcccagtacaggcaggacccctcacttatcatgcgttcgatagtccacatgacagatgccgctcggtctggagtaatgccgccagcccagctgaccactatcaatcagagtcagctttccgcccagctcggcctgaacctgggtggggcatcgatgcctcatacgtccccaagccccccagccagcaaatctgccactcccagcccctcctcttctattaacgaagaagacgcggacgaagccaatcgagcaatcggcgagaagcgcgctgcacctgattctggcaagaagcccaaaactccaaaaaagaagaaaaagaaagaccccaacgaaccccaaaagccagtgtcagcgtacgcactgtttttcagagacacccaggctgccattaagggccagaatccaaatgccacctttggggaggtgagcaaaatcgtcgcctctatgtgggattcactaggcgaggagcagaagcaagtgtacaaacggaagaccgaggctgctaaaaaggagtacttgaaagccttagccgcatacagagcttcactagtatccaaagccgctgctgagagtgctgaggcccagacaatccgatctgtgcaacagaccttagccagtaccaatctgacctcttcgttgctactgaataccccgctgagccagcatggtaccgtgagtgcatcaccccagacattgcagcaaagcttgcctcgatcaatcgcaccaaagccgctgacaatgaggttgcccatgaaccaaattgtcacatccgtcaccattgcagcaaacatgcctagtaacatcggagccccactcatctcctccatggggacaactatggtggggagcgcacctagtacccaggtttcaccatccgtgcaaacacagcaacaccagatgcagctccagcaacagcagcagcagcagcagcaacaaatgcagcagatgcagcagcagcaactgcagcagcatcagatgcatcagcaaatacagcagcagatgcagcaacagcatttccagcaccatatgcagcagcacctacagcagcaacagcagcatttgcagcagcagattaaccaacaacaactgcaacaacagctccagcaacggctgcagctccagcaactccagcacatgcagcatcagagccagccatctcccaggcagcactctcccgtggcatcccagataacgtcccccatccccgctataggcagccctcaaccagcaagccagcaacatcaaagtcaaatccaatctcaaacacagacacaagtgctaagtcaggtgtccatcttctag

SEQ ID NO: 59525 - DNA, 1023 bp, Artificial Sequence
  Description of Artificial Sequence: Synthetic coding sequence
atggccgctccattgctgcacacgcggcttcctggcgatgcagcagcaagtccatcggcagtcaaaatgttgggtgccagcaggaccgggattagcaacatgcgcgctctggaaaatgacttcttcaacagcccccctaggaagactgtgcaatttggcggaaccgtgacagaagtgttgctgaagtacaagaccggcgagacaaacgactttgagctgctgaaaaaccagctgttggacccggacatcaaagatgaccagatcatcaattggctgctggagtttaggagttccataatgtacttgaccaaggacttcgaacagctgatatcgatcattctgcgcttaccatggctaaacagatctcagacggtcgtagaagaatatcttgccttcctggggaatctcgtttcagcccagacagtcttcttgcgcccttgtctcagcatgatcgccagtcatttcgtgcccccaagggtcataatcaaagaaggcgatgttgacgtgtccgacagcgacgatgaggacgataatcttccggcaaacttcgacacaagccagagtctggccaacaactccaagatctgcaccattgagtgttatgtccataatcttctgcgcattagtgtgtattttccaacacttagacacgaaatactggagcttatcatcgaaaaactgctgaaactggatgtgaatgccagtagacaaggcattgaggatgctgaagaaactgccaatcagacatgcgggggtaccgattccacggaaggattgtgtaatatgggttttgcagaggcatttctggaaccactctggaagaaacttcaggacccgtctaaccccgctattattagacaggccgctggtaactacataggtagcttcctggctcgcgcaaaattcatccccctgatgattagggagcagaggcattcggctatgttgctctcgatggatcacttcacccagcccgcaaagctgtgctctactcccttatttcttgacacgtcttccttctag

SEQ ID NO: 59526 - DNA, 1461 bp, Artificial Sequence
  Description of Artificial Sequence: Synthetic coding sequence
atggccgcaccattgctccacaccaggctgcctggagacgcagcggctagtccttcagctgtgaaaatgctgggggcatcccgcaccgggatcagtaacatgcgagcactggaaaatgacttttttaattccccgcctagaaagactgtacagttcggaggcacagtcacggaagtcctcctgaagtataagactggtgaaacgaatgacttcgaactgttaaagaatcagctgctcgatcccgatataaagaggcttccatggctgaatcgatcccaaaccgttgtcgaggaatatcttgcgtttttggggaatctggtcagtgcccaaaccgtcttcctccgcccttgtttgagcatgatcgcctctcatttcgttcccccacgggtaatcattaaggagggagatgtggatgtgtcagactccgacgatgaggacgacaaccttccagccaatttcgacactagtcaatcccttgccaacaattctaaaatttgcactatagagtgttatgtgcacaatcttctccggatcagcgtttattttccaaccttgcgccatgaaattctcgagttgataattgaaaaactgttaaaactcgatgttaatgcctcccggcagggcatagaggatgcagaggaaacagctaaccagacctgtgggggaactgatagcacagagggactgtgtaacatggtatcttcgctgctgatgaaggtagaaatgaaatttatcatcataaagggatggaagcagctagtgctgttgatcttcggatttgccgaggcgtttttggaaccactttggaagaaattacaggatcctagcaatccggctatcattaggcaggccgcaggaaactacatcggcagctttctcgcacgagccaaattcattcccctaatcaccgtgaaatcctgcctggatctgctcgtgaattggttgcacatttaccttaacaaccaggactccggcacaaaggccttttgcgatgttgccctgcacggccctttttattccgcttgccaggcagtattctatacatttgtttttaggcacaagcagcttttgtctggaaaccttaaagagggacttcagtacctgcagtcacttaacttcgagtggatcgtgatgtctcaactgaaccctctgaaaatctgtctgcctagtgtggtgaatttctttgctgcaatcacgaacaagtatcaattagtgttctgttacacaattatcgagagaaacaatcggcagatgctgccagtcattagatctacaaccgggggagactccgtgcagacgtgcactaatccattagatacgttcttccctttcgacccttgtgtcttaaagagatcaaagaaattcatcgatcctatctatcaggtgtgggaggacatgtcggctgaggagttgcaggagtttaagaagccgatgaaaaagctgttctggaggatcatgtag

SEQ ID NO: 59527 - DNA, 939 bp, Artificial Sequence
  Description of Artificial Sequence: Synthetic coding sequence
atggagccaggaagcgttgaaaatcttagcatcgtatatcggtcccgcgatttccttgtggtcaacaagcactgggacgtccgtatcgactcaaaggcctggagagaaacactgaccttacaaaagcagttgagataccgcttccccgagttggccgaccctgatacatgttacggttttcgattttgccatcagttagacttttctacctcaggagctctatgcgtagcactcaataaggccgcagcagggtccgcttatcggtgctttaaagagagaagggttaccaaagcctatctcgccctactgcggggtcacatccaggagtcccgggtgaccatttcacacgccattgggaggaactcaacagaagggcgagctcatacaatgtgtatcgaggggagccaaggttgcgagaatcccaaaccatccctgacggatctggtggtcctggagcatggcttgtatgctggagatccagtgagcaaagtcctgctgaagccactgaccggacgaacccaccagttaagagtgcattgctctgctcttgggcacccagttgtcggagatctcacctacggtgaggttagcggtcgggaggatcggccatttcggatgatgctccatgctttttacctgcggatcccaaccgatacagaatgtgtagaagtctgcacaccagatcctttcctcccctcgctggacgcctgttggagtccccatacactactgcagtccctcgatcagctggtccaggcgcttcgcgctacacctgatcccgacccagaggatagaggccctagacccggttccccaagcgccctgctgcccggaccaggacgccctcctcccccaccaacgaagcctcctgaaacagaggctcagaggggcccttgtctccaatggcttagtgaatggacgctggagcctgactcctag

SEQ ID NO: 59528 - DNA, 1638 bp, Artificial Sequence
  Description of Artificial Sequence: Synthetic coding sequence
atgtggctagataggagaggttggctgcgagtactcgggcactggaggtacgatctgagacggcctagcttcacacggacctggtccggagacaaaggcccaatggccgagacggtttccacgcaggtcgggactgaaggaggcctgagggcttcccaccagcagaacggtgacgcaggtggcgacgcgaaggttgagctctcaccgggacccccaaaacctgccggaagggaagtggaacctgccccagttgggggagagcacccttccgctgctgctccaggccctggaaagcataaaaaaaggcgcggagcgaccagggagagagtagtgccccctcccaagaaacgcagaacaggagtgagtttcggggacgagcacttcgctgaaactagctactattttgagggcggactgcggaaagttcggccttattacttcgattttcgaacttactgtaaaggaaggtgggttgggcatagcttgttgcacgtattttcaactgaatttcgggcacagcccctggcctactacgaagccgctgttcgggcaggtcggctccagctgaatgaaaaacccgtgcaggatttgaatatcgtccttaaagacaatgatttcctgagaaatacagtgcatcggcacgaaccacctgtgaccgccgagcccattcgcttgctggcagaaaacgaagacgtcgtcgtggtggacaagccaagcagtatccccgtgcacccatgtggacgcttccgacacaataccgtgattttcatcttgggcaaggagcaccagctgaaggaactgcaccccctacatagactcgacaggctgactagtggcgtactgatgtttgcgaaaactgctgccgtatccgagaggatccacgagcaagtccgggatcgacagctcgaaaaggagtatgtgtgccgcgtcgaaggcgagttcccaacggaggaggtgacgtgcaaggaacccatactagtggtgtcttataaggtgggcgtatgcagagtggatccaagggggaagccatgtgaaactgtgttccagaggctttcatataacggccaaagcagcgtcgtcaggtgccgacctctgacaggaaggacgcatcagattcgggtacacctgcaatttttgggtcaccctatcctaaatgatcccatctacaattctgtcgcctggggtccatcaagaggtcgcggtgggtacatacccaaaacgaacgaggaactgctcagggacttagtggctgagcaccaggctaagcagtcactggatgtactagatttgtgcgagggagatctgtcccccggtctgacggattcaacggccccaagttccgaactgggcaaggacgacttagaggagttggcagctgcagcccagaaaatggaagaagtggcggaggctgctccccaggagctggatacaatcgctctcgcatccgaaaaggccgtcgaaactgacgtgatgaaccaggagacagatcccctctgcgctgaatgccggctcgtgcggcaggaccctctacctcaggatcttgtcatgtttctgcatgcactacgatacaaggggcctggattcgagtatttttctccgatgcctgcctgggcccaggatgattggcagaaggactag

SEQ ID NO: 59529 - DNA, 1575 bp, Artificial Sequence
  Description of Artificial Sequence: Synthetic coding sequence
atgtggttggaccggcgtggctggctgcgcgttctgggtcactggcgttacgatttgcggcgaccgagttttactcgaacttggagcggtgataaagggcctatggctgaaacagtatcaactcaggtgggaaccgagggtgggctccgagcatcccaccaacagaacggggacgctggtggtgatgcaaaagtggagctcagtcctgggccaccaaaacccgctggtagggaggtggaaccagcaccggtggccagggaacgcgtggttccacccccaaagaagcggagaacgggcgtatctttcggggacgaacatttcgcagagacttcttattacttcgagggcggactccgaaaagtcaggccgtactacttcgatttccgcacgtattgcaaaggccgatgggtcggtcactccctgctacatgtcttctccacagagttcagagcgcaacctttggcttactatgaggctgcagtgagggcgggtaggctgcaactgaacgagaaaccagtgcaggacctaaacattgtgctaaaggataatgatttcctccgcaacacagtgcacagacacgagcccccagtgacagccgaaccgattcgcctcctcgcggaaaatgaggacgtggtcgttgtggataaaccgtcctccataccagtgcacccttgcggccgattcagacacaacacagtgatctttattcttggtaaggagcaccagctcaaagaacttcatcccttgcaccggctggacaggctcaccagcggggtgctaatgtttgccaaaacagcagcggtctctgagaggatacacgagcaggtccgggaccgacagctggagaaagagtacgtgtgccgggtcgaaggtgagttcccaacagaggaagtcacctgtaaagagccgattctggtggttagctataaggtgggcgtttgcagggtcgatccccgtggcaagccctgcgaaactgtctttcaacgcttaagttataacggacaatcctcagtggtgcgctgcagaccgctcaccgggaggacccaccagattagggttcatctgcagttcctgggccatcccatcctgaatgatccgatctataactcagtggcctggggcccttcaaggggacgcggaggttacattccaaaaaccaacgaagagctgctgcgggatctagtggctgagcaccaagccaagcagagcttggacgtgctagatctgtgcgaaggagatttgtccccaggcttgacagatagtaccgcaccctcaagtgaactaggcaaggacgacttggaagaactggctgctgccgctcaaaagatggaagaagtggcggaagctgccccacaggaacttgacacgatcgccttggccagcgagaaggctgtggaaacagacgtcatgaatcaggagacagaccctctttgtgccgaatgcaggcttgtacgtcaggaccctctgcctcaggatctcgtaatgttcctgcatgcattaagatacaaaggaccaggctttgagtatttttcaccaatgcctgcctgggctcaggatgattggcagaaagactag

SEQ ID NO: 59530 - DNA, 1056 bp, Artificial Sequence
  Description of Artificial Sequence: Synthetic coding sequence
atgagggcagtattggctcgcgagatggatggcaggcgggtcctcggacggttctggtcgggatggcgaaggggcttgggcgtgcgccctgttcctgaggatgcaggatttggtaccgaagcccgacaccagcggcagcccagagggagctgtcaaagatccggacctttaggagatcagccctttgccggtttattgccaaaaaacctctcacgcgaggagttagttgatgccttacgagcagcggtggtggaccgcaagggcccactggtgacacttaacaagccacaaggtctacctgtcaccggcaaaccaggcgagttgacacttttctcagtgcttccggaactcagccagagtttggggttgcgcgagcaagagttgcaggtggtgcgagcctctggcaaggaatcttccgggttagttctgctcagctcatgtccccagactgcctcacgactgcagaagtacttcacacatgctagaagggcccagcgtcccacagcaacatactgcgccgtgacagatggcataccggctgcttcagaaggcaaaatccaagccgcattaaaacttgagcacatagatggcgtgaaccttaccgttccagtgaaggcccctagcagaaaggacattttagaaggtgtgaaaaagaccctgtcccattttcgggtggtggctacaggttccggatgcgcactggtgcagctgcaacctctgaccgtgttttcatcccagttgcaagtgcacatggtcttacaactgtgtccagtccttggggaccacatgtactccgcaagagtggggactgtacttggccagaggtttctcctgcctgccgaaaataacaagccccagagacaggttttagacgaggcccttctgcgcaggctacatctgaccccttctcaagcggcacaattgcctctgcacctccacctacaccgattgctgctccctgggacccgagcaagggatacccccgtggagctccttgctcccctccccccatatttctcccgtaccctgcaatgcctgggactgcggctgcaatag

SEQ ID NO: 59531 - DNA, 1011 bp, Artificial Sequence
  Description of Artificial Sequence: Synthetic coding sequence
atgagagccgtcttggccagagagatggatggtagaagggtcctcgggagattctggtctggctggcgcagaggattgggagtgcgcccagtgcctgaggacgccggatttggcaccgaggcacgccaccagagacagcctcgcggatcttgccagaggtcagggcctttaggggaccagccattcgctggcctcttgccaaaaaatctcagccgcgaagagcttgtcgatgctttgagagccgcagtcgtcgataggaaaggaaaaccaggtgagctgacactgtttagcgtgctgccagagcttagccaaagcttaggcctccgggagcaggaacttcaagtggttcgagcctccggaaaggaaagtagcgggctcgtgttgctctcttcttgtccacagactgcttctaggctacagaagtactttacacacgccaggagagctcaaagacctaccgcgacctattgcgctgttactgacggcatccctgcagcttctgaaggaaaaattcaggccgcacttaagctggaacatattgatggcgtgaacctgacagtgcctgtgaaggccccatcgaggaaagatatattagagggtgttaaaaaaaccttgtcacatttccgagtggtcgctaccgggtctggctgcgccttggtgcaattgcagccactgacagttttttcatctcaactgcaagtacacatggtcttgcaactgtgtccagtcctgggggatcacatgtactccgcccgtgtaggcactgtgcttgggcagcgcttcctacttccggctgaaaataataagccacagcgccaagtgctggatgaggctctgctaaggcggttgcatctcacgccgtcacaggcggcacagttgccactgcatctccacttgcaccgactgctcctgcccggtacacgcgctcgagacacacctgtggaactgctggcgcctcttccaccatatttcagcaggacccttcagtgcttggggcttcggcttcagtag

SEQ ID NO: 59532 - DNA, 864 bp, Artificial Sequence
  Description of Artificial Sequence: Synthetic coding sequence
atggcaacggttatggcagcaactgctgccgagagagctgtgctcgaagaagagtttagatggttactgcacgacgaggtgcacgccgtgttgaaacagcttcaagacattctgaaggaagcttcactgcgattcaccttgcctgggtcgggaaccgaaggtcccgcaaagcaagagaacttcatcttgggatcctgtggcaccgatcaagttaagggtgtgcttactttgcagggagacgcccttagccaggctgacgtgaacttgaaaatgcccagaaataaccagttactacacttcgcattccgcgaggataagcagtggaagctccagcagatacaggatgcgaggaaccacgtgtcacaggcgatctacctgctgacatccagggaccagtcataccagttcaagaccggagcggaagtactgaagttgatggatgcagtgatgctgcaattgacacgagccaggaaccgcctgaccacccccgctacgctcactcttcccgaaatagcagcgagcggattaactaggatgttcgcacctgcacttccttctgacctgctggtcaacgtgtacattaacctcaacaagttatgcttgactgtgtaccaactgcatgccctgcaacccaattccacaaagaacttccggccagccggtggggctgtcctccactctccaggtgccatgtttgagtggggatcccagcgtctcgaggtgtcccacgtccataaagtagaatgcgtcatcccctggttgaacgatgctcttgtatatttcactgtgtcactccagctgtgtcagcagcttaaagataagatcagtgtgtttagctcatattggtcgtaccgcccattttag

SEQ ID NO: 59533 - DNA, 6680 bp, Artificial Sequence
  Description of Artificial Sequence: Synthetic coding sequence
atggttcttgcaggtctaatcaggaagctcggacatcagctcgcagagatcagagaacgtgctcttaagtctattctctgtaaaatagagcataaccttatatgttacgccgacttgattcaggagcgccagttgttcctccacttgctggagtggttcaatttccctagcgtgccaatgaaggaagaggtacttaacctgctttctaggctggtcaagtatccaccggctgtgcagcatttggttgacgttggagctgtggaatttctctccaagttgagatcgaacgtggagcccaatttgcaggctgaaattgatggcatactggacgggttatttctgcttccttccgaggtccccgctctgtcctctgcctcttaccagaccaaccaaacagaactcagcaaaaatccagagatcttgacaggatacttcccccaggacaagtccaatttccagcagatggaagtgcccccacgaccggttgtaaaccagacggtgaagtgcctcaagttttccactttcccgtggctccccctgaccaccaccgaccgtcacgttctctctagcaatgagtctagcctgcgctcctccaatcatacattaatatggaacacttgcgagttactgaaagatgttatcatgcaagactttcccgctgaaatattccttcaacgaccaaagatcgttcaaagtttattgagtctcttgaagctggcatttggcgatggaaagcacaggctggcactgcagagtgtgagctgcttgcagcagctgtgcatgtatctgcgcaatagactgaacttccaccgagatccgggtttcttttctaataaacacgacaccgtgagccagaacagctcactgagttactgccacgaagctagaggcactcaccactcccagaatccgtctccaggcagctcgagtcctcggccatccgtggtgggacggacaggtcagcgacctcgcggagacggacaggactgggatgcagcatcatcaagtgggtccagttcccacgcacacgtcaactcaaggatcagcgtgcattcacccctggatatggggcacatcgatttacctgaactagaaacagaggacaccctggagctgcagtttcaacagttgagtctaccacagttttgcgttagcattctcgagagcgccgtgcctctgctgcgaaccggcagtcgccaggtgataattagagtcctggagttgctgactgaagatatgacactgatcggcgaggcaatttccaccgatatctgggatgatagctctctatttggaatagacatgaaggaaaagctcctcctggtcctaggcgctttgggcgaaactatgtgctatcacaagagcagcatcagtttggaacagcctgaagtgatgctggtgcaccatcgaatggccttcataagtattagtctatttgctgttcggcttctgcagacactgctccctgtcgaaaaagccagcgagtttcttagtgaacctatgtcaacggccctctttctgttatccctggacatgccgatctcactagagtatccaaatattcacgaagcggtcgtggcctacctggagcagttgaattcagagaactatagcatatacaagagaacagccgaagctgtctattctatcgagtgcacctgcaatttcctcagtgacattggaaaggagggggaaaagaatctactcgagctggtagagctcgccgaccaagccctgcgcagcttctcctatcatcagcactttcctcttatcaaggagattatcagcatctgctccaagatctggaaatccgctcaggcctccccactgctgcaaggtgagagccaaaaagttctgctacacatgctgtcacaccctctacccagggtcaaggccgagacttaccactgttgcctcgagatcactaaggaatgcctcggagtccacaacgtcacaaaaccagtaagcagcctttgcaatggaattcactttctcctgcacccaaaggtgctctatgagatttcagtgtttgggatacaggaaccagaatcggaggtaaatactgcagcaaaggccattcttctctatttgctgcaagggaggctgatgatgacagccctgacctggaataagttcattgagtccctgtgcccagtaatcccaatccttcaggggtacgcagacactgaagatcccctcgggaactgcatactgcttttgtccaaggcaagctcagatacagaagagatgctgccgtgcacgactcggctgaaaagcatgttgagactgctgctggtgaaaaagccttctgtgaggtcactggcccttaagctacttgcgttccacctaacctccgaagaaggtgctgacaccaaacggcctttaattgacgcgagagtattgagtcgcgtgacagatcttttcattggaaaaaaaccgatagagctgcgactcgacgatcggagagaactcgtcattaagctagagacggttgaaaaagtgtacgaaatatttaccagcgacgacgtcgaccttgtcctacgcaaaagtgctgctgaacagctagcggtgattatgcaggacatcaagatgcatgcagtggtgaaaaagctatgcctgattgataagattattgagtatcttaacgaatgtgtgtctcaagatggcaaggttgtcgaatgcctggtgcagccttgcttgacactcctcagaaaggtgctctgcggtgaccctgtgatgagagtctcactgtcccagcagagctccctattaactgtgcttttccgcgtgtcactgatttttcacgaggactgcagtgtagttactgaggtcggagctctgttctgcctgctcttgttcgatgaggtgtcgcgtatggatatgtggagcgtgaaccccagcaacaagcccagtctgccctccgtatttagtctgccggtctcagtctttcggcgttatcatttaccagtgcacgtgatcgggcatcatgccgttagtccgtacagcattgtgctccctctatcagcagattgtcttgccctcaagcccgtgagtgatatgcttcggatcgcctggaatttatcctggtaccacgggagcgataatttgctgaagcagatgaactccgagaccaaaactcaggaaatcctggacgcactcaagttatctactgaggatattctgactctgaaaattactcatatggcgtcaggacttcaggattgcttgcattctattgttcaagctgctacgcacagagaagtcagggccgcagtcacaaggatgagcttctatctgttgaacgaccgcctgagcctgaaggggtgccccggtccctgcggcgtgaccctcaaatctttggcctggcatactgctttgaaccgatttctgcaggtgcttccagcctgcaccgaggacgaaaagctgcttattgatattattcactttctcaataaattgataaaggaacagcggaaaaactcatccttagagctgctgaactggatcttagagctgctgttacggcacagtgcaaatccgctgttggatctcctggttttaaccgagagtcaggctagggaggagaccgacgatatcaggaccgcggtccgccagcaactgcaaaaagagctgatcgcacttttcgataccctcctcctgaacttcatggaagtcacagatcggaagtgtagtgagctcttatacgtttttcagactcaactggccctgaagctcctgcagtgcctaaaagtcacggatgccccacacttctatggacttcccagcctcgagaggacactgcgcggaatggcgaatctcaccgccttcccaggatggagcagccacagccctctcaccaaacctttagatatttgcgttaaatatctgtctggactgctggaggtgattacgagtttctacgtggaacgcggaggcaatgcaatgagttttatggggaagggagtaaccaagtccaccattctgtgtctgttgcacctatcccacgagatgatggcacaggccggatctctggagtggatgtctctgtggtttctgccactagggtcgcacagcgaggaacacatccccacacagcagggcctggcctggctcatcccactttgggttgaccgcgatcccgaagtgcggtttacctcccttggcttggggtccgcccttactacgctggagaccggatgcgtggcacttgcaaacagctgtcagaacatttcagggggactgtgggggacagtggtgaacatccttttggatcagagcgagtgcagcatggttcgcagggaggcagccttcatactccagaatcttctggtgatcccaatgcccacagaaattattaaggattacacatggcagggcccttgtgtccacgacgaagattccggattgtccctaattggcaaaccagcccttcaggccctcctctaccactgtcatttttatgagcacctgaaccagatggtcaaacattgttatctcggaaggtgcatgttcgatcttaacttttctgccttcgacagaaattcagaatcaaatgaccttaatggcctcgacgatagctttaaattttggcgagctccatctcgcaccagccaagaccgcgatccaagctcactgagcacaagtgagacaactgtagcaccctccttagggtccacggagttccagccccttgtgcagtctaccactctgctaccagaggccagtcatgatcagttcgtcgcccagggccaccaggagtccacctcccctaggcctccgcacgattcgtctttatccgccccacttcccaagttatgtgtctttgttacaccctccctcttgagtgccatgtgttctctcctggataatttgctcaccatcgcaccacgcgatactgccaaagccttccgccaggcacatctcattgaactactctgttctattgcggatgcaaccctgatacagacctgcgtccaggaactgagggcactccttccaagctcccctcctgccgagcatacccaagcacaggttagcttcctcctcgagtacctgagtagccttagtcggctcctgcagagctgcttgctggtggaacccgacctcgtcattcaggacgaactggttaagccactcatcactaacattattggcatcttaaccatctgtacaaaagacgtcctggataaggaactgatcagcgccttctaccacacatggacccatctttttaatctcttagccatgctactgagaaaagctggggcaattaccctaccattcgtgaccgtcgctctggctaagcactggaccgcagcgatcgatatgttctgcacctgcgctggactcagcgctacgtgtccagccctctatacggccagcctgcaatttctatctgtgctgctgactgaggaagccaagggacacctgcaagccaaatccaagacccatctttgttgttctccaaccgtggcttctctgttggacgattcacaagagaatcagaagtctctcgagcagctgagcgatgtcatattgcagtgttatgagggtaaatctagtaaggatatacttaaaagagtggccgctaatgctctgatgtctctgctcgcagtgagtcgaagagctcagaaacatgcgcttaaagcgaacctgattgataattgtatggagcagatgaaacacatcaacgcccagctgaatctggactcactccgtcccggtaaggctgctctgaagaaaaaggaagacggtgtgatcaaggagctgtcaatcgccatgcagctgctcagaaattgcctctatcagaacgaagaatgtaaagaggccgcactggaggcccatctcgtccccgtgctgcatagcctatggccctggattctgatggacgacagtctaatgcagatttccctgcagctgctgtgcgtgtatactgcaaacttcccaaatggatgttcgagtctctgctggagttcttgcggtcagcacccagtccaggcaactcatcgtggagctgtgtcaaactccttgatgctgtgcatcctgaagctggccagtcagatgcccttagagaataccaccgtccagcagatggtgtttatgcttctctctaacctcgctctgtctcacgactgcaagggtgtgatccaaaagagcaatttcctgcagaacttcctgtcactcgccttgcccaaggggggaaataaacatctgagcaatctgacaatcctgtggttgaaactcctgctcaacatcagttctggcgaagacggacaacagatgattttgagacttgatggctgccttgatcttctgacagaaatgagcaagtacaaacacaagtcaagtccactgctgcctctgctgattttccataacgtctgcttctcacctgctaacaagccgaaaattttagccaacgagaaggtgattaccgtgctggctgcctgtttggaaagtgagaaccagaatgctcagcgcattggtgcggcagcgctctgggccctgatctacaattatcagaaggctaagactgcactgaagtctccttccgtgaagcggagggtagacgaagcttattccctcgcaaagaagaccttcccaaactcagaggcaaatcccctcaatgcgtattatttgaaatgtctagaaaacttggtgcagctcctgaactcctctta

SEQ ID NO: 59534 - DNA, 4782 bp, Artificial Sequence
  Description of Artificial Sequence: Synthetic coding sequence
atggtgctcgcaggactgatcaggaaactaggtcaccagttggccgaaattagagaaagggcccttaagtccatcctttgtaagatcgagcacaacctgatttgttatgctgatttaatacaggaacgtcagctgtttttgcacctgctggaatggtttaactttccgagcgttccaatgaaggaggaagtgctgaatctgctgagtaggctggtgaagtaccctcctgccgtgcagcatttggtggacgtaggggctgtcgagtttctgagtaagctgaggagcaacgtggaaccgaatctgcaggctgaaatcgacggaatcttagatggtctgttccttcttccttcggaggtgcccgcactgtcgtccgcctcataccaaaccaaccagactgaactttccaagaaccccgaaattcttacaggctatttcccgcaagacaaatctaactttcagcaaatggaagtaccaccacgaccggtagtcaatcaaaccgtaaaatgtctcaagttttccacctttccatggctgcccctaacaacaactgaccgtcacgtcctgagcagcaatgaatcatctctgagatcttcgaatcatactttaatctggaacacttgtgagttgctgaaggacgtcataatgcaggatttcccagctgaaatcttcctccaacgacccaagattgtacagagcttactctctctgctgaagctggcattcggcgacggaaaacatcgtttagccctgcagtctgtcagctgtctacagcagctgtgcatgtacctgagaaacagacttaatttccatagggaccccggattcttttcgaataaacacgacacagtcagtcagaactcctctctctcctactgccatgaagctcgaggcacccaccatagccaaaatccgagccctggatcaagctcacccaggccgtcagtggtagggaggaccggccagcgtccaaggggtgacggccaggattgggacgcagcctcatcatctggaagctcttctcacgcacacgtgaactcccgtattagcgttcactcacctttagatatgggacacattgatttgccagaacttgagacggaggatactctcgaactacagttccagcagctgtcactgcctcagttttgtgttagtattctcgagagcgctgtgccccttctgagaaccggctcccggcaggtgattattagagttctagagcttctcactgaggacatgacgctgattggtgaagcaatcagcaccgacatttgggatgattctagcttattcgggatagatatgaaggaaaaattgctgctggtcttaggcgcactcggggaaactatgtgttaccacaaatcttccattagtctagaacaacccgaggttatgttggtccaccaccgaatggcgtttatttcaataagcctgtttgccgtcagacttctccagactttattacctgtggagaaagcaagcgagtttctgagcgagcccatgtccaccgccctttttcttctgtcactcgacatgcctataagcttggagtatcccaacatccatgaagcggtagtcgcttacctcgagcaactcaatagcgaaaattattctatatataaacgcactgccgaggccgtctactctatcgagtgtacctgcaacttcctgtcagacattggaaaggaaggagagaaaaatttactggaattagtggaacttgctgaccaggcccttcgcagcttctcataccaccagcacttcccactgattaaggaaataatctctatctgctcaaagatctggaaaagcgctcaggcttcccccctgctccagggtgagtcacagaaggtgctgttgcacatgctctctcacccacttcccagagtaaaagccgagacttatcactgttgcttggagatcactaaagagtgtctgggcgtgcacaatgtgactaaaccggtatcaagtttgtgcaacggcattcactttcttctgcacccgaaagtcctctatgaaattagtgtgtttggcatccaggaacctgagtccgaagtgaacactgcagctaaagctattctactgtacttgcttcagggaaggctgatgatgactgcacttacctggaacaagtttatagagagtctatgcccagttatcccaatcctgcaaggatacgccgacaccgaagatcccctgggaaactgtatccttttgctgagtaaggccagctcagacacggaagagatgctgccttgtactactcggctgaagtccatgttaagacttctactggtgaagaaacctagtgtacggagtctggccctgaaactgctggcttttcacctgacgagtgaggaaggtgcggacactaagcgccctttgatcgacgccagagtgctgtcacgagtgaccgatttgtttatcggaaagaagccgattgaactcagattggacgaccgaagggagctggtgataaaactggaaaccgtcgaaaaagtgtatgagattttcaccagcgacgacgtggatcttgtactgaggaaatctgcagcagagcagcttgccgtcattatgcaggacatcaagatgcatgcagtggtcaaaaaactgtgtctgatcgacaagatcattgaatatctgaacgagtgcgtaagtcaagatggaaaggtcgtggagtgtctggtgcagccctgtcttacactgttgcgcaaagtgctgtgcggggatcccgtcatgcgagtaagcctgtcccagcaaagctccttacttaccgtgctttttcgcgtcagcctgatattccatgaggactgttccgttgttactgaggtgggcgctttgttttgtcttctgctgttcgacgaggtgagcaggatggacatgtggagtgtcaacccctcaaataaacccagtcttccctcggttttctcactgcctgttagcgttttcaggaggtaccacttgcccgtgcatgtgatcggccaccacgctgtgtccccctactcgatcgttctgcccctgtctgctgactgcctcgcacttaaacctgtttctgacatgttaagaattgcttggaacctcagctggtatcacggatctgacaacttgctgaaacagatgaactctgagactaaaacccaagaaatacttgacgccctgaagctatcaactgaagacattctcacactcaaaattactcacatggcctctgggctgcaggactgtctacatagcatcgttcaggcggctacccaccgcgaagttcgcgctgccgtgacacgaatgtccttttaccttctaaacgatcggctctctctaaaaggatgtcctggcccttgcggggtcaccctgaagagcctggcctggcatactgcactcaacagatttctgcaggtgcttcctgcctgtacagaggatgagaaactactgatcgacattattcatttccttaacaagctgatcaaggaacaaagaaagaatagctcccttgaactgctgaattggatcttagagcttttgttgagacatagcgcgaatcccctactagatttactggtcctgacggagagccaggctagagaggaaacagacgacatcaggactgctgtgcgccagcaattgcaaaaagaacttatcgctctgtttgatacgctgctcctcaactttatggaagttacagaccgaaaatgttccgaacttctttacgtgtttcagactcaattggcattgaagcttctccaatgcctgaaggtgacggacgcccctcatttctatggcttgccctctctggagcggaccctaaggggtatggcaaatcttactgcattcccaggctggtccagtcatagtccgctcactaagccgcttgatatatgcgtcaaatatttgagcggcctgctggaagtcattacgtccttttacgttgagcgcggaggaaatgccatgagtttcatggggaagggtgtgacaaaatccaccattctgtgtctgttgcatctgtcccacgaaatgatggcccaggcgggatcactggaatggatgtctttgtggtttcttcccttaggcagccactcagaggagcacatccccacccagcaagggctggcttggttgattcctctgtgggtggacagagatcccgaggtgcgtttcacctctctcggactgggctccgccctcaccacactggagaccggctgtgtcgcactggccaatagctgtcagaatatttctgggggactctggggcacagtggtcaatatccttttggaccagtctgaatgctcaatggttcgccgtgaagccgctttcatcctccagaatcttctggtcatccctatgcccactgaaattataaaggactacacatggcagggcccatgcgtgcacgacgaagattccgggttatcactgataggtaaacccgcattacaagcactcctgtaccactgccacttttacgagcacctgaatcagatggtgaagcattgttacctgggacgctgcatgtttgacctgaactttagtgcatttgaccggaatagcgagagcaacgatctcaacggactggacgactcgttcaaattctggagggccccaagcaggactagccaagaccgcgacccatcctccctgtccacttcagagaccactgtcgcaccgagtctaggctctactgagtttcaaccattagtgcagagcaccactcttctcccagaagcctcccatgatcaattcgtggctcagggcaaccgacactttggaacaaatatccagttttag

SEQ ID NO: 59535 - DNA, 2640 bp, Artificial Sequence
  Description of Artificial Sequence: Synthetic coding sequence
atggtgctggctggtctcatcagaaagttaggtcatcagctggctgaaattcgggagagagcccttaagtctattctgtgtaaaatcgaacacaacctcatctgctacgccgatttaattcaggaacgacaacttttcctacatctcctggagtggtttaacttcccttctgttccaatgaaagaggaggtgctcaatctccttagtagactggtcaagtatccacctgctgtgcagcatcttgtcgatgtgggcgctgttgaatttctaagcaaattgaggtctaacgtagagccgaatctgcaggccgaaatagacggcattctcgacggtctcttcctcctgccatcagaagtgcccgcactgagttctgcctcctaccaaacaaaccagactgagctgagcaagaatcccgagatactcacaggatacttcccccaagataagtctaacttccaacagatggaggttcccccacgtcccgtggtgaaccagactgtgaaatgtctcaagttcagcacatttccttggctgccgctgaccaccactgacagacatgtgctgtcaagcaatgagtctagtctgaggtcctccaatcacacgcttatatggaatacctgcgaactgctaaaggatgtaattatgcaggattttcctgctgaaatttttctccagaggcccaagattgtccagtctctgttgtcgctactgaagcttgcttttggggacgggaaacatagacttgctctccaatcggtgtcttgcctgcagcagctgtgcatgtacctcagaaaccgactcaactttcatcgggatccaggctttttcagtaacaagcacgataccgtctcacagaactcaagcttgtcctattgtcatgaagccagaggtacgcatcattcccagaatccttcacctgggtcctccagccctcgtccatctgtcgtcggccgaacaggccagcggcctcgaggagacggccaagactgggacgcagcgtctagctctggcagttctagtcacgctcacgtgaatagtcggatctccgtccattcacccttagatatgggtcacattgatctgcccgaactcgagactgaggacacgctggaactgcaattccagcaactgtccctcccacaattctgcgtgtctatcctggaatccgcggtacctctcctccgcacagggtcgcggcaggtgatcattcgagtcctggagctcctcacagaggacatgaccctaatcggggaagctattagcaccgatatttgggatgatagtagtctgttcgggattgacatgaaagaaaaactgctactggtgttaggagctctgggagagacgatgtgttatcataaatcctctattagcttagaacagcctgaggtcatgctcgtgcatcataggatggctttcatctctatctctttgttcgccgtgaggttactccagaccctactgccagttgagaaagctagtgaatttctgagcgaacctatgtcgaccgcacttttcctactaagtctcgatatgcccatctccctggagtatcctaatattcacgaggctgtggtggcctatctggagcagctgaactcggagaactactccatctataaacggactgccgaagctgtatactccatcgaatgtacttgtaacttcctatccgatattggcaaagagggcgagaagaatctgctggagctggttgagctggccgatcaagcgctgcgatccttcagttatcatcagcattttcctctgatcaaagagatcatctctatctgctctaagatctggaagagtgcgcaggccagcccactcctgcagggagaatcccagaaggtgttactgcatatgctgagtcatccgctgccccgagtgaaagcagaaacctatcactgctgtctggagatcaccaaggagtgtttgggcgttcacaacgtgaccaaaccagttagtagcctctgcaacggtatccattttttgctgcaccccaaggtgctctacgagatctctgtgtttggcattcaagagcctgagagcgaggtgaacacagccgctaaagctatattgttataccttctgcaaggcagactaatgatgacagcgttgacgtggaacaaatttattgagagcctatgtcccgtgattccaatcctgcaaggatatgctgataccgaggatcccctggggaactgtatcctcctgctctccaaggcctccagcgatacagaggaaatgctcccctgtaccacccgcctaaaaagtatgttaagactcctgttggttaagaagccttcagtgcgttccctggctttgaaactgcttgccttccacctcacctccgaagagggtgccgacactaaaagacccctcattgatgccagagtgctgagtagagtgactgacttgttcatcggcaaaaagcccatcgagctcagattggatgaccgtcgagagctcgtgatcaagctcgaaaccgtagaaaaagtgtatgagatcttcacgtctgacgatgtagatcttgtgttaagaaaatcagctgccgaacagctcgctgtcattatgcagggctgtagaatgttcggcaccacaatgccgcatacactcgaggagggctttatgtggtag

SEQ ID NO: 59536 - DNA, 438 bp, Artificial Sequence
  Description of Artificial Sequence: Synthetic coding sequence
atggcagaaagcctccgtagtccacgcagaagcctatataagctggtgggctctcctccttggaaagaagcattccgccagagatgtctggagagaatgcgcaattcaagagacaggctgctgaataggtatcggcaggctggaagcagtgggcctggcaatagccaaaatagtttccttgtccaggaagttatggaagaggaatggaatgcgctccagtcggtagagaattgtcctgaggacctcgcccagctggaagaactgatagacatggctgttctcgaagagattcaacaggagctcattaatcaagaacagtccataatctccgaatatgaaaaaagcctccagttcgatgagaaatgcctgagcatcatgttggcggagtgggaagcaaatcccctcatttgtcccgtctgcaccaatttactcagctag

SEQ ID NO: 59537 - DNA, 519 bp, Artificial Sequence
  Description of Artificial Sequence: Synthetic coding sequence
atggcggaaagccttaggtcccctcggaggtcgttgtataaactcgtcggctctccaccatggaaggaagctttcagacagaggtgtcttgagagaatgagaaacagtagggatcggctactaaacagatacaggcaggctggatcatccggaccgggaaacagccagaatagctttcttgtccaggaggtcatggaagaggaatggaacgcgctgcagagtgtggaaaactgtccggaagatctggcacagctcgaagaactaatcgatatggcagtactggaggagatccagcaggagttgatcaaccaagaacagtcaattattagtgaatatgagaagtctctgcagttcgatgagaaatgcctcagcatcatgctcgccgagtgggaagctaaccctctgatttgcccagtctgtaccaaatacaatctcagaattacgtccggggtcgtcgtatgtcagtgcggtttgagtatcccatcacatgcctgtgatacctgggctgtgatcctctag

SEQ ID NO: 59538 - DNA, 660 bp, Artificial Sequence
  Description of Artificial Sequence: Synthetic coding sequence
atggccgagagcctgaggtccccaaggaggagcctctacaagttagtcggctcccccccatggaaggaagcgttcaggcagaggtgcctggagcgcatgagaaacagccgggatcgcctactgaaccgctaccggcaagccggtagcagcggtcccggaaattcccagaattccttcctagtccaggaagtgatggaggaggagtggaatgctctgcagagcgtcgagaactgccctgaggatcttgcacaactagaggaactgatagacatggcagtccttgaagagatacagcaggaattaatcaaccaggaacagagcataatatccgagtacgaaaaaagtcttcaattcgatgagaagtgtctgagcatcatgctcgccgagtgggaggcaaacccacttatatgtccagtatgcacgaaatacaaccttcgtatcacttcaggggtggttgtatgccagtgtggcctgagcattcctagtcattcatcggaactgactgaacagaagttgagggcttgcttggaggggagcatcaacgaacactcagcgcactgtccccacacgcctgagtttagtgtgactgggggaactgaggaaaagtcatctctgttgatgagctgtctggcttgtgacacatgggccgtcatactttag

SEQ ID NO: 59539 - DNA, 696 bp, Artificial Sequence
  Description of Artificial Sequence: Synthetic coding sequence
atggccgaaagcctgcgctcaccgcgtcgctcactatacaagttggtcggtagtccaccctggaaggaggcctttcggcagcgatgcttggaaaggatgagaaacagtcgcgatagattattgaaccgatataggcaggccggttcgagcgggccaggcaactcccagaattccttccttgtgcaggaagtaatggaggaggaatggaacgccctgcagagcgtggaaaattgtccagaagacttggcccagctggaggagcttatagatatggccgtgctggaggaaatacagcaggaactaatcaaccaggagcaaagcattatcagcgaatacgagaaatcccttcaatttgatgagaaatgtttatccattatgctggcagagtgggaagccaaccctctgatatgcccagtgtgcactaaatacaacttgcggattacaagcggcgtggtcgtctgccagtgcgggttatctatccctagccactcttccgagctaaccgagcagaagctgagagcttgcttggaaggttcaattaacgagcacagcgcccactgtccccacacccccgagttctcagtaactggaggcaccgaagaaaagtcatctctgctgatgagctgcctggtttcggttagctgggacccgttatgtggaaaacgagacctgtggttagttctcttcccaccgtag

SEQ ID NO: 59540 - DNA, 321 bp, Artificial Sequence
  Description of Artificial Sequence: Synthetic coding sequence
atggccgagtctctgaggagtccgaggaggagtttgtataagctagtgggatctcccccttggaaggaggccttcaggcagagatgcttggagcgcatgcggaacagcagggatcggctgctgaatagataccggcaggccggtagctcaggccctgggaatagtcagaactcatttttggtgcaggaggtcatggaggaggaatggaacgctctgcagagcgtcgaaaattgtccagaggacctggcccagctcgaggaattgattgacatggccgttttggaagaaatccagcaagagttaattaaccaaggattgtag

SEQ ID NO: 59541 - DNA, 447 bp, Artificial Sequence
  Description of Artificial Sequence: Synthetic coding sequence
atggcggagagcctacgcagtcctcgcaggagcttatacaagctggtcgggtcacccccttggaaagaggcatttaggcagcgctgcctcgaaagaatgaggaattcgagggaccggctgctgaatcgctaccgacaagcaggctcaagcgggcctggtaattctcagaacagcttcctggtccaggaagtgatggaggaggagtggaatgcgctgcagagcgtggaaaattgcccagaagatctggcccagctagaggagcttatagatatggccgtgcttgaggagatccaacaagagttgattaatcaggaacagtccatcatttccgagtatgaaaagagcctgcagttcgacgagaaatgtctctcaatcatgctcgccgaatgggaagcgaatccgttgatctgtcccgtgtgtacaaagcccgtgattcttggtctgtag

SEQ ID NO: 59542 - DNA, 321 bp, Artificial Sequence
  Description of Artificial Sequence: Synthetic coding sequence
atggccgaatcccttcggagccccaggcgctcgctctacaaacttgtgggtagtccgccttggaaagaggcattccggcagaggtgcttagagaggatgagaaacagccgcgataggttgttgaataggtaccgacaggccggaagctctggccctggcaatagccagaacagtttcctggtgcaggaggtcatggaggaagaatggaacgccctacagtctgtagagaattgcccggaagatttggcacaacttgaagaactgattgacatggccgtgctagaagaaattcagcaagagctgatcaatcaggtcttttag

SEQ ID NO: 59543 - DNA, 591 bp, Artificial Sequence
  Description of Artificial Sequence: Synthetic coding sequence
atggaggcagaggacgaggacgagaagtacctgcaggaatgcctctcaaagagtgacagtctacagaagcagatctcccagaaggagaagcagttggtacagctggagacggacctcaagattgaaaaggaatggcgccaaaccctccaggaggatctccagaaggagaaggatgcactgtcccacctccgtaacgagacacagcagattatcagtctaaagaaggagtttctcaaccttcaggatgaaaaccaacaactcaaaaaaatctaccacgagcaggagcaggctctgcaggaactcggaaacaaactctccgaatcaaaactcaagatcgaagacataaaggaggctaataaagcactgcaaggcctggtgtggctgaaggataaggaggcgacccactgcaaactgtgcgaaaaagaatttagcctgtccaaacgtaaacatcattgtaggaactgcggggagatcttctgcaatgcctgctctgataacgagcttccactgccttcgagcccaaagccagtgcgagtgtgtgatagttgccacgcgctgctgatccagagatgtagcagtaacctcccctag

SEQ ID NO: 59544 - DNA, 699 bp, Artificial Sequence
  Description of Artificial Sequence: Synthetic coding sequence
atggctacaaaggaccctactgcagtcgaacgagctaatctcctcaacatggcaaaactgagtattaagggtctaatcgaatccgctctctctttcggcagaaccttggatagcgattatccaccacttcagcagttctttgtggtgatggaacactgcctcaaacatggtctgaaggtacgcaaatcttttctgagttacaataagactatatggggcccactggaactggtcgagaaactttacccagaggcagaggaaataggtgcctcagtgagggatctcccagggcttaagacccccctagggcgtgctcgagcctggcttcgcctggcactgatgcagaaaaaaatggctgattatctgcgctgcctgataatccagcgtgacctgctgagcgaattctatgaatatcatgccctcatgatggaggaagagggtgccgtaatcgttggcttgctggtgggacttaacgtgattgacgccaatctgtgcgtcaagggcgaggacctggatagtcaggttggcgtgattgacttcagcatgtacttgaagaatgaagaagatatcgggaacaaggaaagatacgatttccataagttgtttcacatcttgggtttcctttatagttccctccagattattattcggtctatatacctccagtgtggctttattttgctgttttctccactgtag

SEQ ID NO: 59545 - DNA, 1926 bp, Artificial Sequence
  Description of Artificial Sequence: Synthetic coding sequence
atgacttttcaggtatgggggtggcgcagggaagacgccagccaggtattggcctgggtccccgatgccgaagggggtcggagagggatgctaaccaggcggtcacttgccaccaaggaccctactgccgttgagcgcgcaaatctgctgaatatggccaagctgagtattaaaggcctcattgaaagcgccttatcctttgggaggactctggatagcgattatcccccactccagcagttcttcgtggttatggaacactgtctcaaacacggtctgaaggtgaggaagagttttctgagctataataagacgatttgggggccactggaactcgtagaaaagctgtaccccgaggctgaggaaattggcgctagcgtgagggacctgccgggacttaagacaccattaggcagagccagagcatggcttcggttagcactgatgcaaaaaaaaatggctgattaccttcggtgcctgataatacaacgtgatctcttaagcgagttctacgagtaccatgccctgatgatggaggaggagggggcagttattgtggggctgctcgttggactgaatgtgatagatgcgaacctctgcgtaaagggcgaagatctggactcacaggtgggcgtaatcgacttcagcatgtatctcaagaatgaagaggatatcggtaataaggagcggaacgttcagattgccgctatcctcgatcagaagaattacgtggaggaattaaaccggcagctgaacagtactgtctcttctctgcatagccgggtagacagtctcgagaagtctaatacaaaactgattgaagagcttgctattgccaaaaacaatatcatcaagctccaggaagagaatcaccagctgcgcagcgagaacaaactgatcctcatgaagactcaacagcacctggaggtcactaaagtcgatgttgaaaccgagctgcagacatataaacattccagacagggcctggacgagatgtacaatgaagccagaagacagctgagggatgaatctcagctccgccaagacgtcgagaatgaacttgccgtacaggtgagcatgaaacatgaaattgaactggcaatgaaactgctcgagaaagatatccatgagaagcaggataccctcattggacttcgacagcagctagaagaggtgaaggcgattaacattgagatgtatcagaagctccaagggtctgaggacggcctcaaagaaaaaaacgagattatagccaggctggaggagaagactaacaagatcacggccgctatgcgacagctggaacagaggctgcagcaggccgagaaggcccagatggaggctgaggacgaggacgagaaatatctgcaggagtgtctgtccaagtcggattcgctgcagaagcagatatctcagaaggaaaaacaattagtgcaactcgagaccgatttaaaaatcgagaaagaatggaggcagacactgcaggaggacctgcaaaaggaaaaagacgcactgagccatctgcggaacgaaacacagcagattatctcgcttaaaaaggagttcctcaacttgcaggatgaaaaccagcagctgaagaagatttaccatgagcaggagcaggctctccaggagttgggtaataaattgtccgagagcaaactgaaaatcgaggatatcaaagaggctaataaggctctgcagggactcgtctggctcaaagacaaggaggccacacattgtaagctgtgcgaaaaagagttttcgctgagtaaacggaagcatcattgcaggaattgcggcgaaatcttctgtaatgcatgctctgataacgagctacccctcccttcctctccaaaacctgtgcgagtgtgtgactcctgtcacgccttgttgattcagcgatgcagttctaatctgccttag

SEQ ID NO: 59546 - DNA, 1212 bp, Artificial Sequence
  Description of Artificial Sequence: Synthetic coding sequence
atggcgacaaaggacccaacagctgtcgagcgtgccaatctacttaacatggccaagttaagcatcaaggggctcattgagtcagccctgtcttttggcaggactctggactccgactatcctccactgcagcagttctttgtagtgatggagcactgtctgaagcatggccttaaagtgcggaagagtttcctctcttataacaagacgatttggggtcccctcgagcttgtcgagaagctgtatccagaagcagaggagatcggcgcaagcgtcagagacttgcccggactgaacgaattctacgaataccatgccctgatgatggaggaagagggcgctgtgatcgtgggactcctggtcgggctcaacgtcattgacgcaaacctttgcgtcaagggggaagatctcgactcacaagtgggcgtaattgatttttctatgtatctcaaaaatgaagaagacattgggaataaggagcggaacgttcaaatcgctgccatcttggaccaaaaaaattacgtcgaggagttgaacaggcagctgaattcgacggtcagtagtcttcacagtagggttgatagtctggagaagtcaaataccaaactcatagaggagctggcaattgcaaagaataatatcatcaagctccaagaagagaatcatcagttgcggtctgaaaacaaattgattctgatgaagacacagcaacacctggaggtgacaaaggtggacgttgagaccgagctgcagacttacaaacatagcaggcagggactcgatgagatgtataatgaagcaagaaggcagctgagagacgagagtcagcttaggcaggacgtagaaaatgagctggcagtccaggtgagcatgaaacatgaaatcgagctggccatgaagctgctcgagaaagatatacacgagaaacaggatacgctgattggtcttcgccagcagttggaggaagtaaaggccattaacatcgaaatgtaccagaagctccaaggctcagaagacggactgaaggagaagaatgagattatagctcgtctcgaggagaagactaataaaattacagctgccatgagacaactcgagcaatctgacaatgatctgctgacacagacccggacaatcgctatgtccttggtcaagtgcgcttcttccgatactcaggaccagtacaagttggtgaaagacatcagcttttag

SEQ ID NO: 59547 - DNA, 1140 bp, Artificial Sequence
  Description of Artificial Sequence: Synthetic coding sequence
atggtgcgaaaatctttcctgtcctataataaaaccatttgggggccattggaactggtggagaaactatatcctgaggccgaagaaatcggggcatcagtaagagaccttccaggcctgaaaacccccctcggcagggccagggcttggctgaggctggcactgatgcaaaagaaaatggccgattatctgcgctgtctgattatccagcgcgatttgttaagcgagttttacgaatatcacgccctcatgatggaggaagaaggggcagtgatagtagggcttcttgtcggactcaacgtaattgacgcaaatctgtgcgtaaaaggtgaagaccttgactcacaggtgggtgtgatcgacttttccatgtatctcaaaaatgaggaagatatcggtaacaaggagcgtaacgtgcagatcgccgctatactggatcagaagaattatgtcgaggaattaaatcgccaactgaatagtacggtgagctccctgcactctagagtcgacagcctggagaaaagcaatactaagctcatcgaagagctggcaatagctaagaacaacataatcaagttacaggaggaaaaccaccagctgcgctctgaaaataaacttattctgatgaagacccaacagcacctggaagttacaaaggtcgatgttgagaccgaattacaaacatataagcattcccggcaggggctggatgagatgtacaatgaggctcggaggcagcttcgggatgagtcacagctgcggcaagacgtggaaaatgagctggccgtgcaggtgtcgatgaagcatgagatagagcttgcgatgaagctgctcgagaaggatatacacgagaagcaagatacactgattggcctaagacagcaattggaggaagtaaaagccatcaacatagaaatgtaccagaaactgcaggggtccgaagatggtctgaaggaaaagaacgaaatcatcgcaaggttggaggagaagactaacaagataactgcagccatgcggcaactcgagcagtccgataacgatctcctaacccagacacgaacgatcgccatgtccctcgtgaagtgtgcatcctccgacacgcaggaccagtataaactggtgaaggacattagtttctag

SEQ ID NO: 59548 - DNA, 2529 bp, Artificial Sequence
  Description of Artificial Sequence: Synthetic coding sequence
atgaagagaggacggcttccaagtagctctgaggatagtgatgataatggaagtttatccacgacctggtcacagaattcccggtctcaacatcgcaggtcatcttgctccaggcacgaagacagaaagccctcagaagtcttccggaccgacttgattactgctatgaaactccatgactcttaccagcttaatcctgacgagtactacgttctggccgacccgtggcggcaggagtgggagaaaggggttcaggttcctgttagcccaggaacaatcccacagcctgtggctagggtcgttagcgaggaaaagtcgctcatgttcatcaggcccaagaagtatattgttagttctggctctgaacctcccgagctgggatacgttgatatcagaactctggccgactccgtttgcagatacgacctgaatgatatggacgccgcatggctcgagcttacaaatgaggagttcaaagaaatgggaatgcccgaactagacgaatacacaatggagagagtgctcgaggagttcgagcagaggtgttacgacaatatgaaccatgctattgagacagaggagggtctgggcatcgaatacgacgaggatgtggtctgcgacgtgtgccagtcccctgatggcgaagacggaaatgaaatggtgttttgcgacaagtgtaacatctgtgtccaccaggcatgctacggaatcttaaaggtcccggaaggctcctggctttgccgcacctgcgcccttggtgttcagcccaagtgcctactttgccctaagaagggaggggcaatgaagccaacaaggtcggggactaagtgggttcatgtcagttgcgctttgtggatacctgaggtgagtatcggatcccccgagaagatggaacctatcactaaggtgtctcacattccatcaagcaggtgggccttagtttgcagcctttgtaacgaaaaattcggcgcatctatacaatgctccgttaagaattgccgaacggcctttcacgttacctgcgccttcgatcgcggacttgagatgaagacaattttagccgagaacgacgaagtgaaatttaaaagctattgccccaaacattcatctcaccggaagcccgaagaatccttaggcaagggggcagcgcaggaaaatggcgcaccagaatgttcaccacgaaacccgctggaacccttcgcctccctggagcagaacagagaggaggcacatcgggttagcgtccggaagcaaaaactccagcagctcgaggacgaattttataccttcgtgaatttattggatgtcgcccgtgcactccggctacctgaggaggtcgttgatttcctgtaccagtattggaagcttaaaaggaaagtgaactttaataagcccttgatcacccccaagaaagacgaagaggataacttggctaagagagagcaggacgtgctattcaggagactccagcttttcacccacttgcgacaggatcttgaaagagtgcgaaacctgacttacatggtaacccgcagagaaaaaataaaaaggtcggtgtgtaaggtgcaggaacagatattcaacctctacaccaagctgctggagcaggaacgcgtcagcggtgtcccctcctcctgcagcagttcttcactggaaaacatgctcctgttcaactctcccagcgtgggcccagacgccccaaaaatcgaggacctgaaatggcattccgcattcttcagaaaacagatgggaacaagtttggtccacagcctcaagaagccgcataaacgagaccctctgcagaacagcccgggaagcgaaggcaagaccctcctgaagcaaccggacctctgcggacgtagggaaggtatggtagtgcccgaatcattccttggcctggagaagacttttgcagaagcgaggctgatatcggcacagcagaagaacggtgtcgtcatgcccgaccatggaaaaagaagagacaaccggttccattgcgacctgatcaaaggcgacctgaaggataaatcttttaaacagagccacaagcctttgaggtcaactgatgtgagccagcgccacctcgataacactcgcgctgctacgtcacctggagtcggccagtctgcccctggtacgaggaaggaaattgtaccgaagtgtaatggttcgctgatcaaggtcaattacaatcagactgccgtcaaagtcccaaccacccctgcctcccctgtgaagaattggggcggatttcgcatacccaaaaagggcgaaagacaacaacagggagaggcgcatgatggcgcatgccaccagcactcagattacccctatctcgggctgggccgagtgccagctaaagagcgggctaaatctaagctgaagtccgacaacgagaatgacggatacgttcctgacgttgagatgtccgactccgagtctgaggccagtgagaaaaaatgtattcacacaagttcaaccatctctcgtcgcacagacatcatcagaagatccatcttagcatcctag

SEQ ID NO: 59549 - DNA, 1521 bp, Artificial Sequence
  Description of Artificial Sequence: Synthetic coding sequence
atggccgagacgccgccacccccaactgctggagccgaaagttgcagtgaggagcctgcacggggtggagaatggcgtccggaggagccacgccgagccccagccggaggcactgatcgcgaaggtgaggcaggtccacccccagcatccccggctggccagagtgagccagattccccggtggcagcaccattcttcctgctataccccggagatggaggagccggatttggagtgagaccacctccacagcagcagcggtcctggaggacccctccttctccagggtcaccgctcccttttctgctgctcagctacccttccggtggcggaggctcctcagggtcggggaaacatcacccgaactatcttatggccaacgaacgaatgaacctgatgaatatggccaaactatcaattaagggccttatcgagtcagcactgaatctcgggagaacattggacagcgattatgccccactccagcagttttttgtggttatggagcattgcctcaagcacggattaaaggctaagaaaacattcctggggcagaacaaaagcttctggggccctttggagctggtcgagaagctagtccctgaggcagctgaaataacagcatcagtgaaagacttacctggattgaaaaccccagtgggaaggggacgtgcctggctgcgcctcgccctgatgcagaaaaagctctccgaatacatgaaggcccttattaacaaaaaagaactgctcagcgaattctacgaacccaatgccttgatgatggaggaagaaggagccatcatcgcagggctgttagtcggactgaacgtcatcgatgctaatttttgcatgaaaggagaagacctcgattcccaggtcggggttattgatttttccatgtacctgaaagatggcaactccagcaaggggaccgagggggacggacagattactgccatactggatcagaaaaattatgttgaagaactgaataggcacctgaacgctactgtcaataacctgcaagccaaggtggatgcactggagaagtccaacactaagctgacagaagaattggcagttgccaataacagaatcataaccctgcaggaagagatggaacgggtaaaagaggagtcatcttatatactggaatccaatagaaagggacctaaacaggatcggaccgccgagggacaggccctctccgaagctagaaagcacctcaaagaggagacacagttaagattggatgtagaaaaggagctcgaaatgcagatcagtatgaggcaggaaatggagcttgcaatgaaaatgctcgagaaggatgtgtgcgaaaaacaggatgctttagtaagcctgcgacagcagctcgacgatctgcgggcactcaagcatgaactggcattcaagcttcagagttctgacctgggagtaaaacagaagagcgagctgaacagtcgtcttgaagagaaaaccaaccagatggcggctacaatcaagcagctagagcagcgctag

SEQ ID NO: 59550 - DNA, 297 bp, Artificial Sequence
  Description of Artificial Sequence: Synthetic coding sequence
atggccgagacgcctcctccacccaccgctggagccgagtcctgctctgaggagcctgctagaggaggagagtggagacccgaagaaccgcgacgcgctccagcaggtggtacggatcgggagggcgaggcagggccaccacccgcaagccccgcagggcagagtgaaccagatagccccgtggcggcacccttctttttactctaccccggagatggcggtgccggattcggcgtccgccctccccctcaacaacagaggtcctggcgcacccctccttctcccggaagcccctag

SEQ ID NO: 59551 - DNA, 1362 bp, Artificial Sequence
  Description of Artificial Sequence: Synthetic coding sequence
atggatggcgagtggctctgcctcagagagctggacgatatctcactgacccctgacccagagccaacacatgaagatagctgggaggatctgacagacctcgtggagcagatgcgtgacgacacagaggatccaaactaccttatggcaaatgagcgaatgaacctcatgaacatggcaaagctttccatcaaggggctaattgaatcagcactgaacttaggtaggactctcgattctgattatgcccctctccaacagttttttgtggttatggagcactgcctcaaacatgggctgaaagctaaaaagacgtttctaggacagaataaaagcttctggggtcctctagagctcgtggagaaattggttcctgaagctgcggagatcacagcctctgtcaaagacctcccaggactcaaaacccctgttgggagggggagagcatggctccgtcttgcgcttatgcaaaagaaactgagtgagtacatgaaagctctgataaataagaaggaactactcagcgaattctatgagcctaacgcactcatgatggaagaagaaggggctattatcgccggactccttgtagggttgaacgtgatagacgctaatttttgtatgaagggggaggatctggactcacaggttggcgtgatcgatttttccatgtatctaaaggatgggaactcaagcaagggcactgaaggagacgggcaaataacggcaattttagaccaaaaaaattacgtggaagagctcaaccgtcacctcaatgctaccgttaacaaccttcaggcaaaagtcgacgcattagagaaatctaataccaaacttacagaggaattagctgtggcaaacaacaggattattacactgcaggaggagatggaacgggtcaaggaggagagcagctacatcctggagtcaaataggaagggcccaaaacaggaccgaaccgctgaaggtcaggccctctcagaggcaagaaaacatctgaaggaggagacacagctccggctggacgtagaaaaggaattggaaatgcaaatttccatgcgccaggaaatggagctagccatgaagatgttggagaaagacgtgtgtgagaaacaagacgcactcgtttctctgcgccaacagcttgatgacctacgagctctcaaacatgagttagcattcaagctgcagagttccgaccttggcgtgaaacaaaaaagcgagcttaactctagacttgaagagaagacgaatcagatggccgctacgatcaagcagctcgagcagtcggaaaaggatctggtcaaacaggcaaaaacccttaactctgctgctaacaaactcatccctaagcaccactag

SEQ ID NO: 59552 - DNA, 1863 bp, Artificial Sequence
  Description of Artificial Sequence: Synthetic coding sequence
atgtctgcacttactcccccaactgacatgccaacccctaccaccgacaaaataacccaagctgccatggagaccatctacctgtgcaaattcagggtgtccatggacggcgagtggctgtgcctgagggaactggatgatatctctcttactccagaccctgaacccacacacgaagatccaaattacctaatggcaaatgaaagaatgaacctgatgaatatggcgaagctatccatcaaaggtctgatagaatccgcactgaacctgggacgcacactcgatagcgattacgcgccactacagcagttttttgtggttatggaacactgcctgaagcacggcctcaaggcaaaaaaaacattcctcggccaaaataagtccttctggggtcctttagaactagtggagaaattggtgcctgaagcagccgaaatcacagcatctgttaaggacctccctggccttaagacccccgtgggacgcggtagggcttggttgagactggccctcatgcagaagaaactgtctgagtacatgaaagcacttatcaacaaaaaggaactccttagcgagttctacgagccaaatgccctgatgatggaggaagaaggggcaatcatcgccggtctgctggtcgggttgaatgtaattgacgctaatttttgcatgaagggcgaagatctggactcccaggttggcgttatagatttttcaatgtacttgaaggacggcaattctagtaagggcacggagggagacggtcagatcacagcaattctggatcaaaaaaactacgtagaggaactgaacaggcacctcaatgccactgttaacaatctgcaggctaaagtggacgcgttggaaaagagcaatacaaaactaaccgaagagctggctgtagccaacaatcgcatcataactctgcaggaagaaatggaaagagttaaagaagagagttcatacattttagaaagcaatagaaagggcccaaaacaggaccgcaccgcggaaggacaggcactcagcgaggcccgtaagcatctgaaggaggagacccagctgcgccttgatgttgagaaggagttggagatgcagattagtatgagacaggaaatggagctagctatgaaaatgctcgagaaagatgtgtgcgagaagcaagacgccctggtgagcctgagacagcaactggacgatctacgcgctctgaaacacgaactggctttcaaactccagtcatccgatctgggcgttaaacagaaaagtgaattgaactctcgattagaggagaagacaaaccagatggccgctactataaaacaactggaacagcgcttgcgccaggctgagcgctcaaggcaaagtgctgaacttgacaaccggctgttcaagcaggatttcggcgacaagataaattctctccaactcgaggttgaggaactaactagacagcggaaccaactggagttggaactgaagcaggagaaggaacggagactccagaatgaccggtctattccgggtagagggtcacagaaatcagagtccaagatggacggaaagcataaaatgcaagaagaaaatgtcaagctcaaaaagcccctggaggagtcacaccgcctccagccccaccctatggacgagcaagatcaactactgctgtctgaaaagcctcagctttgtcagctgtgccaagaggacggttccctgaccaagaacgtctgcaagaactgcagtggcaccttttgcgatgcttgctctactaatgaactcccacttccgagtagcatcaagctcgagcgcgtatgcaatccatgtcataagcacctgatgaagcaatactccacttcaccgtcatag

SEQ ID NO: 59553 - DNA, 1716 bp, Artificial Sequence
  Description of Artificial Sequence: Synthetic coding sequence
atggctgaagagggagccatcctgaaggtaactaaggatctgagggctgccgtctctgcaatcctgcaaggctatggagatggccaggggccagtgacagatacatcggctgagttgcaccggctttgcggatgcctcgagctgctgctccagttcgaccaaaaagagcagaaaagtttcttgggtcccagaaaggattattgggactttctgtgcaccgctctgcgacggcaacgtggaaacatggaacctattcatttcgtccgttcccaagacaaactgaagaccccactcgggaagggacgtgcctttatccgattctgtctggctcgaggccagttggcagaagctctgcagctgtgccttcttaattctgaactgacacgcgaatggtatggcccaaggtcacccctcttatgtccggagaggcaggaagacatcctggactcactgtatgccctcaacggagtagcgttcgagctagacctccagcaaccggaccttgacggggcttggcctatgttttccgagtcaaggtgctcaagttccactcagacccagggacgcagacctagaaaaaataaagatgcccctaagaaaatacctgcagcatacgggggacctgagaatgtccagatagaagactcccacacttcacaggctatctgcttgcaagatgctccttcaggccaacaactggctggtcttcctcggtcacagcagcaacgacacttgcccttcttccttgagaagaagggagagagttcacgcaaacaccgctatccgcaatccatgtgggagcctgagggcaaagaattgcagctggaccaggaggagagagctccgtggatcgaaattttcctaggaaacagcactccctctacacaggggcaggggaagggtgctatgggaacacaaaaggaagttattggcatggaggctgaggtcaccggcgtactacttgttgcagaaggacaacggaccacggagggaacccataaaaaggaggccgagtggtcccacgtgcagaggttgctgatgccatctccccgaggcgctgtcgaaggcgctgtgagcggttctagacagggttcgggcggtagttccattcttggagagccctgggtcctacagggccatgcaaccaaggaggattccaccgtggagaacccgcaagtccagaccgaggtgacacttgtggctaggcgggaggagcaagctgaggtgagccttcaggacgaaatcaaatcactgagattaggactacgcaaggctgaagagcaggcacagcggcaggagcagcttcttcgtgaacaggagggagaactccaggctttacgggagcaattgtccaggtgtcaggaggagagagcggaattacaggcccagctggaacagaagcagcaggaagctgaacggcgagacgccatgtaccaggaggaacttgggggacagagggatctcgtacaggccatgaagaggcgcgtgttggagctgatccaggaaaaagacagattgtggcaacggttgcagcaccttagtagcatggcccctgaatgttgcgttgcttgtagcaagatttttgggagattctcgagacggtatccttgtagactgtgcggaggactgttgtgccacgcatgttcaatggattacaaaaaacgcgaccgttgctgtcccccttgtgcccaaggcagagaggcccaggtgacctag

SEQ ID NO: 59554 - DNA, 1824 bp, Artificial Sequence
  Description of Artificial Sequence: Synthetic coding sequence
atggctgaggagggggcaattctaaaagtgaccaaagatttgcgggctgctgtctctgccatcctccaggggtacggagatggccaaggaccggtaacagatacaagcgcggaactgcacagattatgtggctgcctagagttactcctgcagttcgatcagaaggaacagaaaagtttcttgggcccaaggaaagattactgggacttcctttgcactgcattaagaagacaaagaggaaacatggagcctatccacttcgtaagatcccaggacaaacttaaaacccccttaggcaaggggagagcttttatcaggttttgtctcgcacggggtcagctggctgaggccctgcagctatgcttgctcaactcagagctgacacgcgagtggtatggacctagaagtccgttactgtgtcccgagcgccaggaggatatcctagacagcttgtacgctttaaatggcgtggcatttgagctagacttgcaacagccggacctggacggggcatggcctatgttcagtgagtccaggtgctcctctagcacacaaacacagggtagaagacctcggaaaaacaaggatgcgcctaaaaaggtcccgttgccatgtctgcactccgaactgcccctgccacacctgctcggtatactgaagatcccagctgcgtatggaggcccagaaaatgtgcagattgaggactcacacacttcccaggctatttgtttgcaggatgccccttccggacagcaactcgcgggattgccgaggtcacagcaacagcgtcaccttcctttctttctggagaaaaaaggagagtcttcccggaaacaccgctatccccaatccatgtgggagcctgaaggtaaggaactgcaattggaccaggaggagagagcaccatggattgaaatattcttgggaaattccacaccttccacccagggtcagggcaagggtgctatggggactcaaaaagaggttatcggaatggaagctgaggttaccggggtacttctggtagccgagggccaacggaccaccgagggcacacacaagaaggaggccgaatggtcccatgtacagagactcctgatgccctcccccagaggcgcagtcgagggtgccgtaagtggatcgcgccaggggtcaggagggtcctctattctcggggagccctgggtgttgcaaggccatgctactaaggaggattcaacagtggaaaacccccaggtgcagacggaagtgacactagtagcgaggagagaagagcaggctgaagtaagcctgcaggatgagattaagagtctgcggctcgggctgcgcaaagccgaagagcaggcccaaaggcaggagcagctattgcgagaacaggagggagaactgcaggctctaagagaacagctcagccggtgccaggaggagcgggcagagcttcaggcccagctcgagcagaaacaacaagaggcggagcgacgtgacgcgatgtaccaggaagaattagggggacagagagatttggtgcaggccatgaaaaggagagtgctggaacttatccaggagaaagataggctgtggcagcggcttcagcaccttagctctatggcgcctgagtgctgtgtggcctgttcgaaaatattcggtcgctttagcagaaggtacccctgttccgcaagaacatcattgggcagagaagaatccgagccccctggcgaggcagcaatgtggagatggcggctgtggagaggtagggcatctggacatccatcaggtgaagggaggcccccagagactaaccagggccattctacagggcgatag

SEQ ID NO: 59555 - DNA, 519 bp, Artificial Sequence
  Description of Artificial Sequence: Synthetic coding sequence
atggcggaagagggtgccattctgaaagtgacaaaggacctgcgcgcagcagtcagtgcaatcctgcagggctacggggatggtcagggacctgtgactgacacttccgctgagcttcatagattatgcggctgcctggagctcctgctgcagttcgaccagaaggagcaaaagagcttcttgggtcctcgtaaggactattgggattttctgtgcacagctctacgccgacaaaggggaaacatggagccaattcacttcgtgcgcagccaagacaaagggatggtgtggacacccgagccttctgcactgcccagaacccccagacggcatcccggactctctctctgtagccagtggggcggtctgcgggtcgggccacccgcagccagaccaggctggagtctggctcacgtgttacgggttacactgcttcaattccatcccaacccaggcaaggaaactcagaaaaagcaacggtgtcctaaggaagacccatcaaggatctggcgagcatag

SEQ ID NO: 59556 - DNA, 1842 bp, Artificial Sequence
  Description of Artificial Sequence: Synthetic coding sequence
atggcggctgtggaggctgccgcagagccagtgactgttgtcgcagccgtgggcccaaaagctaaggatgaagaagaggaggaagaagagccgctacctccgtgtgaagccgtgcgatgggctcctgtgggggctgtggccgaggccaggccgggtgctacagcttttctagaagaggcaacagccgaggagcccggtgctgcaccgggttcgccaccggatagcccgggacgcacgctgcgaaggctgagggctgagaggcgaaggttggactcagccttactggcactgagttcgcacttcgcgcaggtccagttcagactcagacaggtggtcagaggcgcacctgctgagcagcagcgtttgctacgggagctcgaagacttcgcttttcgcggatgtcctcatgtcctggggtatgaaggccctggggaccctgcctctgacgagggtgacgggctacccggagaccgaccctggctgcgcggagaggatcagagcgagcaggaaaagcaggaaaggttggaaactcagagagagaagcagaaggaactcattctgcagctcaaaactcagctggacgatctcgagacgtttgcttaccaggagggaagctacgattccctgccgcagtctgttgtgctcgagagacagagggttattatcgatgaacttattaaaaagctggacatgaacttgaacgaggatatcagcagcctgtctaccgaagagctacgccaaagggtggatgccgcagtggcccagatcgtaaaccccgcaagagtaaaagaacaattagtcgagcaactgaaaacccagatcagagatctggagatgtttataaattttattcaagacgaggtcggctctcctctacagactggaggcggacattgcgaatgtaaggcaggcggtaaaacaggaaacggctgttcacggactggatcgtccaggactccgccaggtaattcgaagacaaaggccgaggacgtcaagaaagtcagagaaaccggcctgcatctgatgaggcgtgccctggccgtgcttcagatctttgcagtgtcgcagttcggctgtgccacaggacagatcccgccaactttatggcagcgggtccaagccgatcgtgactattcaccactcctgaagcgcctggaagttagcgtggaccgtgtcaaacagctcgccttgcgtcagcagccgcatgatcatgttatcaccagtgcaaacctgcaggatctgagtcttggcggaaaggacgagctgaccatggcagtcagaaaagaactcactgtggccgtcagggacttgttggcgcacgggttatacgcttcgtccccaggcatgtctctcgtgatggcccctatcgcctgtctcttgccagccttttcctcagcaccagaggctatgcacccttgggaactcttcgtaaagtattatcacgccaagaacggcagagcttacgtggagagccctgctcgaaaactgagccagtcattcgcgcttccagtgactgggggtacagtggtcactcccaaacaatctttgctcaccgccatccacatggtgctcacagaacatgaccctttcaaaaggtcggccgactcagagttgaaggcactggtgtgtatggctctgaatgaacagaggctggtcagctgggtgaacttaatatgcaaatccggaagcttgatcgaaccacactatcagccatggtcatacatggcccacaccggcttcgagagcgccctgaatctgttatcccgcctgtcctcgctgaagttctcactccccgtagatcttgcagtccgccagttaaagaacattaaggatgcattctag

SEQ ID NO: 59557 - DNA, 1422 bp, Artificial Sequence
  Description of Artificial Sequence: Synthetic coding sequence
atggcctctcgctcactcggcggtctgtcaggtatcagaggcggtggtggcggaggaggaaagaagtccctgtcagcaaggaacgccgctgtggaaaggaggaatctgattaccgtctgtaggttcagcgtcaaaacactgatagacaggagctgtttcgagaccatcgacgatagctcaccagagttcaacaacttcgcagccatccttgaacagattctgagtcacagactgaaagaaatttcccagagctgccgctggctcgcccatctccagatcccactccagggacaagtgacttggttcggatacgaaagcccacgctccttttgggactatattcgggtcgcctgcagaaaggtctctcagaattgcatctgctccattgagaatatggaaaacgtgtctagcagccgagctaagggtagggcatggattagagttgccctgatggagaagcacctgtcagagtacattagtacggccctgcgggatttcaaaacaacccgcagattttatgaagacggcgcaatcgtgcttggtgaagaggccaacatgctggcgggtatgctgctgggtcttaatgccatcgacttttctttctgcctgaagggagaaggcttagacggttccttccccgctgtcatcgactacaccccctatctcaaatacattcaaagcagtgacagtatcagtagtgacgaggaggagctccggactctgggttcctcagggagtgagtccagtaccccagagaatgtaggtcccccatttctcatggacgaaaatagctggttcaacaagtgcaaaagagtgaaacaaaagtatcagttgacactggaacaaaaggggtacctggaggagttactcaggctacgagaaaatcagctgagcgagagcgtttcccagaacaagatcctccttcagcggatcgaggattccgatctggcccacaaactcgaaaaggaacagttggagtatatcatagttgagctgcaggaccagcttaccgtcctgaagaataatgacctccgcagccggcaggagttaacagcccatctcaccaaccagtggccatcccccggtgcactggacgtcaacgctgttgcactcgacactctgctgtatcgtaaacacaacaagcagtggtacgagaaaagttatcaatctctggatcagttatccgccgaggtgtccctgtctcagacctctctagaccctggccagtcccaggaaggggatggtaagcaggataccctgaatgtgatgtctgaaggcaaggaggatacccccagcctgttggggctgtgcgggtctctgacatccgtcgcctcatacaagagtctcacatctctcaaatcaaatgactatctggcttcacctacaaccgaaatgacttctcctggtctgaccccatcttag

SEQ ID NO: 59558 - DNA, 1371 bp, Artificial Sequence
  Description of Artificial Sequence: Synthetic coding sequence
atggcttccagatccctgggaggcttgagcggaattcgaggtgggggaggcggaggcggaaagaagtccctcagcgctaggaacgccgcagttgaaagaaggaacctgattacagtctgcaggttttccgtgaaaacccttatcgatagatcctgtttcgagactatcgacgactcatctcccgaattcaataacttcgccgcaattctcgagcaaattctctctcatcgcctcaaggggcaggtcacctggttcgggtatgaatcccccagatcattttgggactatattcgggtggcctgtaggaaggtatctcagaactgcatctgttccatcgaaaacatggagaacgtgagtagttctagggccaagggtagagcatggattcgcgtagcactgatggaaaaacatctctctgaatacattagcacggctctgagggatttcaagaccactcgtaggttctatgaggatggggcaatcgtgctgggcgaggaggctaacatgctagctgggatgttgctggggcttaatgcaatcgatttctcattttgcctgaagggcgaagggctcgatgggagcttccccgctgttatcgactatactccttatctgaagtatattcaatccagtgacagcatctcatcggatgaagaagagctgaggaccctcgggagcagcggcagtgagagtagcaccccagagaatgtgggaccacctttcttaatggatgagaattcatggttcaataaatgtaagcgagtcaagcagaagtaccagttaactctggaacagaaggggtacctcgaggagttactccgtttaagagagaaccaactatcagagtctgtgagccagaataagatcctcctgcaaagaatagaggactccgacctggcccacaaactcgaaaaagaacagttggaatacatcatcgtggagttacaagaccagctgaccgtacttaaaaataacgaccttaggagcagacaggagctgacagctcatttgacaaaccagtggccttctccgggtgctctggacgtaaacgctgtcgctttagacacactactgtatagaaaacataacaaacagtggtacgaaaagtcctatcagagcctggaccagctgtctgctgaagtgtccttatcacaaacgagcctagacccagggcagtcccaggagggagatgggaagcaagacacactgaatgtaatgtccgagggcaaggaggacactccttcactgttggggctttgcgggtctctgacatccgtcgcctcctacaagtctctgacctccctcaagtccaacgattatctagcctcacccaccacggaaatgacctcccccggtctgacaccatcatag

SEQ ID NO: 59559 - DNA, 1224 bp, Artificial Sequence
  Description of Artificial Sequence: Synthetic coding sequence
atggcctcaaggagcttgggcggactctccgggattagagggggaggtgggggtggaggaaaaaaatcacttagcgctcggaacgccgctgtggagaggagaaacctgattacagtctgccgcttttcagtgaagacactcatcgatagatcatgtttcgaaactatcgatgattctagccccgaatttaacaactttgctgccatcctcgagcaaatcctttctcaccgactgaaaggccaagtcacttggtttgggtacgagtctcccagatctttctgggactatattagagttgcctgtcgaaaggtttcacagaattgtatctgtagtatcgagaacatggagaacgtgtcctcttctagagccaagggtcgcgcttggatcagggtggcgctaatggagaaacaccttagtgaatatatcagtaccgcactgagagacttcaagaccacccggcgattttacgaggacggggctatcgtcctgggagaggaagccaacatgcttgccggaatgttattgggcctgaacgccatcgatttcagcttctgtctgaaaggtgaaggcctggatggatcttttccggctgtgattgattatacaccttatctgaagtacattcagtcaagtgacagcatctctagtgacgaagaggagttgcgcaccctcggttcttctggtagtgaatcatcaacaccagaaaacgtcggaccgccattcctcatggacgaaaactcctggtttaacaagtgtaaacgggtaaaacaaaagtaccagctgaccttagagcagaaaggatacctagaggagctgctccgcctgcgcgagaatcagctgtcagaatctgtgtcacagaacaagatcttattacagagaattgaggactcagacttggcgcacaaactggagaaagaacagttagaatacatcattgtggaattgcaggaccagctcaaatcctatcagagcctagatcaactgtccgctgaagtgagtctgtctcagacatcactcgatccgggtcaatcacaggagggggatgggaagcaagatactctcaacgtcatgagtgaaggaaaagaggacactccctcactactaggcctctgcgggtctctgacaagtgtagctagttataagagtctgacatccctgaaatcaaacgattacctggcatctcccacgacagagatgaccagccccggtctgacgccatcttag

SEQ ID NO: 59560 - DNA, 156 bp, Artificial Sequence
  Description of Artificial Sequence: Synthetic coding sequence
atggttatgatttttactctagtgacagccgtgcaggagaaactgaacgagatcgtggatcaaatcaaaactcgtagggaggaagagaagaaacagaaagagaaagaagcagaggaggcggagaagcagctctttcatggaacaccagtgacctag

SEQ ID NO: 59561 - DNA, 444 bp, Artificial Sequence
  Description of Artificial Sequence: Synthetic coding sequence
atggtgatgatctttacactcgtgacggcggtgcaggagaaactgaatgaaattgtcgatcaaattaagactaggagggaagaagagaaaaagcagaaggagaaagaagcggaggaagctgagaagcagctgtttcatggtactcccgtgaccatagagaacttcctcaattggaaggccaaattcgacgccgagctcctggaaatcaagaagaaaaggatgaaagaggaggaacaagctggcaaaaacaaactttctggaaaacagctgtttgagacggatcataacttggatacatcggatatacagttcttggaagatgccggaaacaacgtggaggtcgatgaaagcctgtttcaggagatggacgacctcgagctggaggatgatgaagatgatcccgactacaaccccgctgacccagagtccgactcagcggattag

SEQ ID NO: 59562 - DNA, 732 bp, Artificial Sequence
  Description of Artificial Sequence: Synthetic coding sequence
atgacagattatggagaagaacagaggaatgaactcgaggcactggaaagcatctaccccgattcttttaccgtccttagtgaaaaccccccttcttttaccattaccgtgacctctgaagcaggtgaaaatgatgagaccgttcagacaacattgaagtttacatatagcgaaaaataccccgatgaggcccctctgtacgagatttttagtcaggaaaacctcgaggacaacgacgtatcggacatacttaagttactggcgttgcaagctgaggaaaacttaggtatggtaatgatctttaccttagtgacagcagtccaggaaaagctgaacgagattgttgaccagatcaagacgcgtcgcgaggaggaaaagaaacaaaaggagaaggaggctgaggaagccgagaagcagcttttccatggaactcctgtcaccatcgagaattttttaaattggaaggcgaaattcgatgcagagctgctcgagattaagaagaagaggatgaaggaagaagagcaggctggaaagaacaagttgtccggcaagcaacttttcgaaaccgatcacaacctggatacatccgatattcaattcctggaagacgccggtaacaacgttgaagttgacgaaagtctttttcaggaaatggacgacttggagctcgaagatgacgaggatgatccagattacaaccccgcagaccctgagtctgactcagccgactag

SEQ ID NO: 59563 - DNA, 204 bp, Artificial Sequence
  Description of Artificial Sequence: Synthetic coding sequence
atggtgatgatctttacactcgtgaccgctgtccaagagaagcttaacgagattgtcgaccagatcaagaccaggagggaagaagaaaaaaagcagaaagagaaggaggcagaagaagccgaaaagcaactgttccacggtacaccggtgacaatcgagaattttctcaactggaaagctaagttcgacgctgaactgctgtag

SEQ ID NO: 59564 - DNA, 444 bp, Artificial Sequence
  Description of Artificial Sequence: Synthetic coding sequence
atggtgatgatatttacgcttgtcactgccgtgcaggaaaagctaaacgaaattgttgaccagatcaaaacccgcagagaggaagaaaagaagcagaaagaaaaggaggccgaggaggctgaaaagcagctgttccatggaacccctgtgacaatagagaatttcctgaactggaaggccaagtttgatgccgagctgttggaaattaaaaagaagcgcatgaaagaggaggaacaggcaggaaagaataagctgtctggaaaacagctttttgagacagaccacaatctggatacctcagacatacagttcctggaggacgcaggcaacaatgttgaagttgatgagtcactgttccaggagatggatgatctggaactggaagacgacgaagacgaccctgattacaatcccgctgatcctgagagcgactctgcagactag

SEQ ID NO: 59565 - DNA, 219 bp, Artificial Sequence
  Description of Artificial Sequence: Synthetic coding sequence
atggtgatgatctttactcttgtgaccgccgtgcaggagaaacttaatgagatcgtagaccagatcaagaccagacgtgaggaagagaaaaaacagaaggagaaggaagcggaggaagctgagaagcagttattccacggcacacccgtgacgattgaaaacttcctcaattggaaagctaaattcgacgcagagctactggagattaagaagaaatag

SEQ ID NO: 59566 - DNA, 879 bp, Artificial Sequence
  Description of Artificial Sequence: Synthetic coding sequence
atgagtgcctcagtgaaggaatctctgcagctccaactgctcgaaatggagatgctgttctctatgttccctaatcagggcgaggtgaagctcgaggatgttaatgctctgacaaacattaaaagataccttgaggggacccgcgaggctctaccgccaaagatcgagtttgttattacgctccagattgaagaacctaaagtgaaaattgatttgcaggtaaccatgccccacagttacccttacgtcgcactgcagctgtttggaagatcctcagaacttgatcgacatcagcagctcctcctcaataaggggctgacttcttatattgggactttcgatccaggcgaactttgcgtatgcgccgctatacaatggctccaggataactcagcgtcatattttctgaacaggaaactggtctacgaaccttctactcaggctaagcctgtcaagaacactttcctccgcatgtggatatactcccaccatatctatcaacaagatttacgcaaaaagatcctcgacgtgggtaagaggcttgatgtcacggggttctgtatgactggcaagccaggcatcatatgcgtcgagggcttcaaagagcattgcgaagagttctggcacaccattaggtatccaaactggaaacacatctcttgcaagcacgccgaatctgtggagacagaaggcaacggggaggacctacggctgttccattcatttgaagagctcctgcttgaggcccatggagactatggccttcgaaacgattatcatatgaacctggggcagtttcttgagtttctgaagaaacacaaaagtgaacacgttttccagatcctatttgggatcgagtccaaaagcagcgactcgtag

SEQ ID NO: 59567 - DNA, 717 bp, Artificial Sequence
  Description of Artificial Sequence: Synthetic coding sequence
atgctgtggtacctgaacctgttcgacttccactttaaggtcaagattgacctgcaggtgactatgccacactcctacccctacgttgccttacagctgtttggacgatcctccgagcttgaccgccaccagcagttgctcttgaacaagggcctcacctcctacatcgggacctttgaccccggagagctgtgcgtgtgcgctgctatccaatggctgcaggacaactccgcttcttatttcctgaatagaaaattggtatacgaaccgtctacccaagccaagcctgtgaagaataccttcctgcggatgtggatctattctcatcacatctaccagcaggatctccgcaagaagattcttgacgtcggtaagcggctggacgtgactggtttttgcatgaccggcaaacccggaattatatgcgtcgaaggattcaaggagcattgcgaggaattttggcatactatcaggtatccaaattggaaacatattagctgcaagcacgctgagagtgtagaaaccgagggcaatggagaagacttgcgactcttccattcattcgaagaactgctgttggaagcgcatggggactatggcctcaggaacgactaccatatgaatctgggtcaattcctggagttcctgaagaagcacaaaagcgaacacgtgttccagattctctttgggatcgagagcaaatcatccgacagctag

SEQ ID NO: 59568 - DNA, 960 bp, Artificial Sequence
  Description of Artificial Sequence: Synthetic coding sequence
atgaagatagagctttcaatgcagccctggaatcccggatacagcagcgaaggtgccacagctcaggagacctacacatgtccaaaaatgattgaaatggagcaggcagaagcccaactggccgaattggaccttctggccagtatgtttcccggagagaatgagctgattgtaaatgaccagttagccgtagccgagctcaaagactgcattgagaaaaaaacgatggaggggagaagttctaaggtttacttcacgatcaatatgaatctcgatgtgagtgacgagaaaatggcgatgttcagtctcgcatgcatcttgcctttcaagtacccagccgtcctccccgagattaccgtgcgtagcgtgttgctgtcaagaagccagcagacccagctcaatacagatctcaccgccttcctgcagaagcattgtcacggagatgtgtgtatcctgaacgccacagaatgggttagagagcatgcttctggatacgtaagccgagacaccagtagtagtcctactaccggcagcactgttcagagcgtcgatttgattttcactcgattgtggatctattcacaccacatctacaacaaatgtaagcggaaaaatatattggaatgggctaaagagctgagtctaagcggtttctctatgccgggaaagcccggagtcgtttgtgttgaaggacctcaaagtgcatgcgaggagttttggagccgcctgaggaagttgaactggaagcgaattttgatccgacatcgcgaagatatcccttttgatggaacaaacgatgagaccgagagacagcgcaaattctcaatatttgaagaaaaagttttctccgttaatggggctaggggaaaccatatggacttcggccaactgtaccagtttctgaacactaaggggtgtggtgacgtatttcagatgtttttcggcgtggaaggtcaatag

SEQ ID NO: 59569 - DNA, 567 bp, Artificial Sequence
  Description of Artificial Sequence: Synthetic coding sequence
atgagcgccaatgaggaccaggagatggaactggaggcgctgaggagtatttatgaaggagacgagtcatttcgggaactaagccccgtgtcattccagtaccggattggcgagaatggcgaccctaaagcatttttaattgagatctcctggacggagacgtacccacagacaccacctatactatccatgaacgcgtttttcaacaacaccatttcctctgcagtcaaacaatccatcttggcaaagctccaggaagccgttgaagcgaatttggggactgctatgacgtatactttattcgagtacgccaaggacaataaggagcaattcatggaaaaccacaatcccattaacagcgcaacttcgatctccaatattatcagcattgagacccccaacactgccccatcctccaagaagaaagataagaaggaacagctatctaaggctcaaaagcggaaactcgcggataagactgaccacaagggcgagctccccaggggatggaattgggtcgatgtcgtgaaacatctgtctaagactggatcaaaggacgatgagtag

SEQ ID NO: 59570 - DNA, 564 bp, Artificial Sequence
  Description of Artificial Sequence: Synthetic coding sequence
atgtctgcaaacgaagaccaggagatggaattagaagcgcttcgtagcatctacgaaggcgatgagtcgtttcgggaactgagtcctgtgtcgtttcagtatcggataggggaaaatggagaccctaaggcgtttttgattgagatatcttggacagagacatatccacagaccccgccaatactatctatgaatgcattctttaataacacaatctcttcagccgtgaagcagagcatcttggccaagctgcaggaggcagtggaagccaatctgggcaccgctatgacctatactctgttcgaatatgccaaggacaacaaggaacagtttatggagaatcacaatccaattaattccgccacaagtatctcaaacatcataagcatcgagacgcctaatacagcaccatcttcaaagaagaaggacaagaaggagcaactgtccaaagctcagaagagaaagctggctgataagacggatcataaaggtgagctgcccagggggtggaattgggtggatgtcgtgaagctgtcaaagactggttcgaaagacgacgaatag

SEQ ID NO: 59571 - DNA, 2988 bp, Artificial Sequence
  Description of Artificial Sequence: Synthetic coding sequence
atgtcttcactgcccaggcgagccaaagtgcaggttcaggacgtggttctgaaggatgaattttctagcttctcagaattgtcgtccgctagcgaggaggatgataaggaagattccgcatgggaaccacagaagaaggtccctcgctcacgtaagcaaccaccccctaaggagtcgaagccaaaacggatgcctagggtgaaaaagaacgcaccccagataagcgatggctcggaggtggtcgttgttaaagaagagttgaactcctccgttgcaatcgctgatacagcgctcgaggaccgaaagaataaactggacacggtgcagaccctgaaaaccgctaagactaagcaaaaatgcgccgctcagccccacacagtgcgaagaacaaagaagctgaaggtcgaggaagagaccagtaaggcatcaaacctcgaaggggagtcaaacagcagcgaaaccccgagtaccagcacagtgtgggggggtacatgtaaaaaagaggagaacgacgacgattttactttcggacagtctgcccttaaaaagatcaagaccgagacgtacccccagggacagcctgtgaagttcccggcaaacgctaacagcactaaagaggaggtagagatgaactgggatatggtgcaagtgcttagcgagcgcacaaacatcgagccgtgggtctgtgccaacatcatccggctgttcaacgacgataacaccataccgtttattatccggtataggaaggagctcatcaataatctcgacgccgattccttgcgggaggtgcagcagaccctggaagaactgagggccgtcgctaaaaaggttcacagcacaattcagaagatcaagaaggagggcaagatgagcgagtgcctcttaaaggcgatgttgaactgcaaaactttcgaagagcttgaacacgtgtctgcgccttataaaacgggatccaaggggacgaaggcacagcgggcacggcagctcggcttggagggcgctgccagagcgctgctggagaagcccggagaactttccctgctcagctacataagaccggatgtaaagggtttaagtacacttcaagacatcgaaatcggcgttcaacatatcctggcagacatgatagcaaaagataaagacacgctcgattttatcaggaatctgtgccagaaacgccatgtgtgcatccaaagctccctggccaaagtatcttcaaagaaggttaacgaaaaggacgtagacaagtttctcttgtaccagcactttagctgtaacatcaggaatattcaccaccatcagatcctggccatcaaccggggagaaaacctcaaagtactcacagtgaaagtgaacatttctgacggcgttaaagacgaattctgccgctggtgtatccagaaccgttggaggccacgctcatttgccagacccgaactcatgaaaatcttgtacaattctctaaacgacagttttaagaggctgatctaccctctcttgtgcagggagtttagagctaagcttacgagcgatgctgagaaggagtcagtgatgatgtttggtaggaatcttcggcagctgctgcttacaagtcctgtcccaggcaggactttaatgggggtggatcctggttacaagcacggctgcaagctggcgattatctctccaactagccaaatattgcacaccgacgtagtttacctccattgtggccagggcttccgtgaggcagagaaaatcaaaacactgttattgaattttaactgttctaccgtagtgataggaaacggaaccgcttgccgagagactgaagcctactttgctgatttgataatgaaaaattatttcgcacctctggacgttgtgtactgcattgtgagtgaggctggcgctagcatttacagcgtgagtccggaagctaataaagagatgccaggacttgaccctaacttacgcagcgcagtatcgatcgcaaggagagttcaagatccactggccgagttggtcaagatcgaacccaagcacatcggggtcggaatgtaccaacatgatgtgagccagacactcctgaaggccaccctggactctgtcgtggaggaatgtgtgagcttcgttggggtggacattaatatatgttcagaagtgctcctacggcatatcgctgggctgaacgccaatcgagcgaaaaatattatcgagtggcgcgagaaaaatggtcctttcatcaaccgcgagcaactaaagaaagttaaggggctgggcccaaaaagcttccaacagtgtgccggttttatacgaattaatcaggattacatacggactttttgttcacaacagactgagacctccggccagatccagggcgtggccgtgacttcttctgccgatgtggaggtgacgaatgaaaagcagggtaagaaaaaaagtaagacagctgtcaacgtgcttttgaagcctaacccgctagaccagacttgcattcacccggagagctatgacatagcaatgcggttcctctccagcatcgggggtactttgtatgaggtcggtaaacctgaaatgcagcaaaagatcaacagttttcttgaaaaagaggggatggaaaagattgccgagcgcctgcagactaccgtgcatacacttcaggttatcatcgacggcctgagccagcccgaatctttcgattttcggactgactttgacaaaccggattttaaaagaagcatcgtgtgcctggaagacttacaaatcgggaccgtcctgactggcaaggtagagaacgccacactatttggcatctttgttgatataggagtgggtaagtcgggcctgatccccattaggaatgtgacagaggccaaactaagtaagaccaaaaagcgaaggtctctaggtctcgggcctggcgagcgcgtggaggtacaggtgctcaacatcgacattccacgatcgcggatcactctggacctcattcgagtgttatag

SEQ ID NO: 59572 - DNA, 1545 bp, Artificial Sequence
  Description of Artificial Sequence: Synthetic coding sequence
atgaagatcctatacaattccttaaacgacagttttaagcggttgatctacccattgctttgccgcgaatttcgtgccaagttaacttctgatgcagagaaagaaagtgtgatgatgtttggcagaaatctgaggcagctgctgctgacttctccagtcccagggaggaccctgatgggagtggacccaggatataagcatggatgcaagctagctataatttctcctactagccagatcttgcacacggacgttgtatatctgcactgtgggcagggcttcagagaagcggagaaaattaagacacttttactcaattttaactgttcgaccgtggtcatcggcaatggtacagcctgccgagaaaccgaggcatacttcgcagacttgattatgaagaattacttcgctcccttggacgtggtgtattgcatagttagtgaggcaggggcaagcatctactccgtttcaccagaggccaataaggagatgccgggtctggaccccaatttgcggagtgcagtgtctattgccaggcgggtgcaggaccctctggcagagctggtcaagattgagccaaagcacatcggcgtgggcatgtaccagcatgatgtgagtcaaaccttactaaaggctaccctggactccgtcgtggaggaatgcgttagttttgttggtgtggacatcaatatttgttctgaggtgttacttcgtcatatcgcaggcctgaatgcgaatcgggcaaagaacattattgagtggcgagaaaaaaacggcccttttatcaatcgggaacaacttaagaaagtgaaaggactcggcccaaagtccttccagcagtgtgccggattcatcaggattaatcaggattatatcagaacattctgtagtcagcaaactgaaacatccggacagattcagggagttgccgtcaccagctctgcagacgtcgaagttacaaatgagaaacaagggaaaaaaaaaagcaagacggcagtgaacgtgctgctcaagcctaatcctctcgatcagacctgtatccatcccgagtcttacgatattgctatgcgcttcctatcctccatcggcggaactctttacgaggtcggtaagccagaaatgcagcagaagataaatagttttcttgagaaggagggcatggagaaaatcgctgaacggctgcaaacgactgttcacacactccaggtgattattgacgggttaagccaacccgaaagcttcgatttccggacagacttcgacaaacctgacttcaaacgctcaatagtgtgtctggaggatctgcagattggaactgtcctgaccggcaaggtagaaaacgctaccctgtttggtatctttgtggacatcggcgtcggcaagagcggcctgatcccgataaggaacgtgactgaagctaaactgtctaaaaccaaaaagcgccgatcacttggccttggtcctggagagcgtgtggaggtacaggtgctaaacatagatatccccaggagccgcatcacactggacttgatcagggtcctgtag

SEQ ID NO: 59573 - DNA, 306 bp, Artificial Sequence
  Description of Artificial Sequence: Synthetic coding sequence
atgaatatccccctgggcgagaaagtaatgctcgatatcgtggcgatgttccgtcagtatagcggggatgacgggaggatggacatgcccggactggtcaatcttatgaaggaaaattttccaaattttctgtccggttgtgaaaagtcagatatggattacttgagcaacgctctggagaaaaaggatgataacaaggacaagaaagtaaactacagcgaatttttaagcctgctcggcgatataaccatcgaccatcataagattatgcacggcgtggccccttgctccgggggaagccagtag

SEQ ID NO: 59574 - DNA, 306 bp, Artificial Sequence
  Description of Artificial Sequence: Synthetic coding sequence
atgaatattccactgggggagaaggtgatgctggatattgtcgctatgttcagacagtattcgggcgacgacggccgtatggacatgcccggactggtcaacctaatgaaggagaatttccccaacttcctatctggctgtgaaaaatcggatatggattatctgtccaacgctttagagaagaaagacgacaataaggacaagaaggtgaattacagcgaatttctcagcctgttaggcgatataacaatagaccaccacaagataatgcatggggttgccccatgttctggtggctcccaatag

SEQ ID NO: 59575 - DNA, 339 bp, Artificial Sequence
  Description of Artificial Sequence: Synthetic coding sequence
atgctccctagctccggatttctgaaagccaaaatgaacattccactcggggaaaaggtaatgctcgacatagtggctatgttcagacagtactcaggagatgacgggagaatggatatgcctggactcgtgaatctcatgaaggaaaatttccccaactttttgtccggttgtgagaaatcagatatggactacctgtcaaatgccctagagaagaaggatgataataaggataagaaggtgaattactccgaattcctgagtcttttaggggacatcacaattgatcaccacaagataatgcacggcgtcgccccatgtagtggaggatcccagtag

SEQ ID NO: 59576 - DNA, 2715 bp, Artificial Sequence
  Description of Artificial Sequence: Synthetic coding sequence
atgcaggctagtcccttacagacctcacaacccacaccacctgaggagctacacgcagccgcttacgtattcacaaatgatggccagcaaatgcggtccgacgaagtgaatttggttgccacaggtcaccagtcaaagaagaagcacagccggaaatctaaaaggcattcatcctcaaagcggcgaaagtccatgtctagttggttggataagcaggaggatgccgcagtgacgcatagcatatgcgaagaaagaataaataacgggcagccagtcgccgataatgttctgtcaacagccccaccatggcctgacgctactatcgcccataacatccgggaagagcgtatggaaaatggccagtcccggactgacaaggtgctgtctaccgcccctccacaactagtccacatggccgcagccggaattccttcaatgagtactagagacctgcattcaacggtgacgcataatattcgggaagagcgcatggaaaacggtcaaccacagcccgataatgtcctgtccacaggccctacgggcctgataaatatggccgctactcctattcccgcaatgtctgccagagatctctacgccactgtaacccacaacgtatgcgagcagaagatggagaacgtgcagcctgcccctgacaacgtgctgctcacgctacgacctcggcgaattaacatgaccgacaccggtatttctccaatgtccaccagggacccttacgccacgataacttacaatgtgcctgaggagaagatggagaaaggacaaccccagccggataacatcttatctactgcttcaacagggctcatcaacgtggctggagccggaacacccgcaatctctacgaacggcttatatagtacagtgccccataacgtctgtgaggaaaagatggagaatgaccagccccagcctaataacgtgctgtccactgttcagccagtgatcatctacctgaccgccaccggtattcctggcatgaacacacgcgaccaatatgctacaattacccataacgtgtgcgaagaacgggtcgttaataaccagcccctgcccagtaacgcattatcaacagtgctcccaggcttggcctatttggcaacagccgacatgcctgccatgagtaccagagaccagcatgcgacaatcatccataatctgagagaggaaaaaaaagacaattctcaaccaaccccagacaatgtgctttccgcggtcacaccggagcttattaatttggcgggagcaggcatccctcctatgtccacgcgcgaccagtatgctacagtgaaccatcatgtgcatgaggcaagaatggaaaacgggcagaggaagcaggacaatgttctttccaacgtgttgagcgggctgattaatatggccggagccagcatcccggctatgtcctcacgtgatctgtacgcaactatcacccacagtgtccgggaagaaaagatggaaagcggtaagcctcagacagataaagtcatatctaacgacgcccctcaattgggacatatggccgctggcggaatcccctctatgtctacaaaggacctatacgcaaccgtgacgcagaacgtgcatgaagaacgcatggagaacaaccaacctcagccctcctacgatctgagcacagtcctcccaggcctgacctacctcaccgttgcagggattccagccatgtctacacgtgaccagtatgcaactgtgacccataacgtccacgaagaaaaaattaagaacgggcaggccgcaagtgataatgtgttcagcacagttcccccagcttttatcaatatggctgccaccggggtctcaagcatgtcaactcgcgaccagtatgctgctgttacacacaatatccgagaggagaagataaataatagccagcctgcccctggcaacatcctgagcaccgcaccaccctggcttcgccacatggcggctgcgggaatctcctccacgatcacccgggacttatacgtgacggctacccactctgtccatgaagagaaaatgacaaacggccaacaggccccagataattccctgagcactgtgcctcctggctgcatcaatctgtccggcgcagggattagttgccggtccacccgggatctgtacgcaaccgtaatccacgacatccaggaagaggaaatggagaacgatcaaactcctcctgacggctttctctctaactctgattcccctgagctgataaacatgaccggacactgtatgccacccaatgctctcgattccttctctcacgacttcacttcgctgtccaaggatgaacttctgtacaagccagacagtaatgagtttgcagtcggcacaaagaactacagtgtctcagctggcgatcccccagtgaccgtgatgtctctggtcgagaccgtgccaaatacaccgcaaataagccccgctatggcaaagaagatcaacgatgacatcaaatatcagttgatgaaagaggtgagaagatttggtcagaactacgagcggattttcatactgctggaggaggttcaggggtctatgaaagtcaaaagacagttcgtggaatttaccatcaaggaagctgctcgtttcaagaaagtggtccttatccagcagctcgaaaaggcactgaaagagatagactcccactgccatctccggaaagtcaagcacatgcggaagagatag

SEQ ID NO: 59577 - DNA, 2715 bp, Artificial Sequence
  Description of Artificial Sequence: Synthetic coding sequence
atgcaggcctcaccccttcagacctcacagcccacccctcctgaggaactacatgctgctgcctacgtgtttacaaatgatggacagcagatgcggtctgacgaagtgaatctggtggccactggacatcagagcaaaaagaagcacagccggaagtcaaagcgacactctagctccaagagaagaaagagtatgtcgtcttggcttgacaaacaggaggacgccgctgtcactcacagcatctgcgaagaaagaatcaataatggacagcccgttgctgacaacgtcctatctacggcgccaccttggcccgatgccaccatagcccacaacatccgagaggagagaatggagaatggccaaagcaggaccgataaagtgctcagcacagcacctcctcagctcgtgcacatggcggcagccggtattccctctatgagtactcgggacttgcactctacagtgacccacaatatacgggaagaaagaatggaaaatggccaacctcagcccgacaatgtgctgtctaccggtccaactggtctgatcaatatggccgctacccccatccccgctatgagcgccagagatctgtacgccaccgtgacgcacaatgtttgcgagcagaagatggaaaacgtgcagcctgccccagataacgttttgttaaccctgaggccccgtagaatcaacatgaccgatactggcatttcccccatgtctacccgggacccctatgccaccattacttacaacgtgccggaagaaaagatggagaaagggcagcctcagccagataatatactctccaccgctagcaccggcttaataaacgtcgcaggcgctggcaccccggcaatcagcactaatggattatacagtactgtaccacacaatgtctgtgaggagaagatggaaaatgaccagccacagccaaacaatgtcctgagcaccgtgcagcccgtgatcatctatctgaccgccaccgggatacctggaatgaatacgagagaccagtacgcgactatcactcataacgtctgcgaggagagagtggtaaataaccagcccttgccttccaacgccttgtccaccgtgctgccagggctggcctacctagcgacagctgatatgccagccatgtctacccgcgaccagcatgctactattattcacaacctgcgcgaggagaagaaagacaactcacaacctactcccgataatgtgctgagtgccgtcacacctgaactgatcaacctagccggtgcaggtattcctcccatgtcaaccagagatcagtacgcgactgtcaaccatcatgtgcacgaagctaggatggagaacggccagcggaagcaagataatgtgctatcaaatgtactatctggactgattaacatggccggtgcctctattcctgctatgagttcacgcgacctctacgcgactataactcactcggttcgcgaagagaagatggagagtggcaaacctcaaactgataaggtcatatccaatgacgcgcctcaactgggacatatggccgctggcggtatcccctccatgtccaccaaagacctttacgccaccgttacccagaatgtgcatgaggaaagaatggagaacaaccagccccagccctcatatgacttgtctaccgtcttgcctggactgacatacctgaccgttgccggaatcccagctatgagtactcgtgaccaatatgcgactgtcacccataacgtgcacgaagaaaaaatcaagaacggccaggctgcgtccgacaacgtcttctccacagtgccaccagcattcataaacatggctgcaacaggggtgagtagcatgtccacgagggatcaatacgccgcagtcacccacaatatccgggaggagaagattaataacagccaacccgcacctggaaacattctatccactgctcctccttggttgcgacatatggcagccgcagggatcagcagcactataaccagagacctgtacgtcacggcaactcacagcgtccatgaagagaagatgactaatgggcagcaggctcccgataattcactctcaaccgtgcctcccggttgcatcaacctctctggtgccggaatctcttgtcgcagtacacgggatctgtatgcaacagtaatccacgacattcaggaagaagagatggagaacgaccagactccgcctgacgggttcttgtctaattcagactctcccgagcttatcaacatgacgggacattgcatgccaccaaacgccttggatagcttctcacacgattttactagtctgagcaaggatgagctgctatataaacccgacagcaatgagtttgccgtcgggacaaaaaattatagtgtgtcagcgggagaccctcccgtaacggtcatgtccctggtcgagacagtgccaaacactccccagatcagtcccgctatggcaaagaaaatcaacgatgacattaaatatcagctgatgaaggaggtgcgcagatttggtcagaactatgaaagaattttcatactgctcgaagaagtccagggatccatgaaagtcaaacggcaatttgtggaatttactatcaaggaagccgcaaggtttaaaaaagtcgtgctcattcagcaacttgaaaaggcgctaaaggaaatcgactcccattgccatctacgcaaagtgaagcatatgaggaaaagatag

SEQ ID NO: 59578 - DNA, 2715 bp, Artificial Sequence
  Description of Artificial Sequence: Synthetic coding sequence
atgcaagctagccctttacagacaagtcagccaacaccacccgaggaactacatgcagcagcctacgtatttacgaatgacgggcagcaaatgcggtccgacgaagtgaacttagtggctacagggcaccagtctaagaagaaacacagcaggaaatccaaacgccattcttcatccaagcggagaaaatcaatgtcttcgtggctcgataagcaggaagacgcagccgttacccactccatctgcgaggagcgtatcaacaacgggcaaccagttgctgacaacgtgctcagcacagctccaccatggcctgacgcaaccatcgcccacaatatccgggaagagagaatggaaaatggccagtcccgaacggacaaagtcttaagcactgctccgccacagctggttcatatggcagcagcaggcatcccttctatgtccaccagggatctgcatagcacagtgacccacaacatacgggaagagcgaatggagaatggccaaccccagccagacaatgtcttgagcacaggcccaacagggctgatcaacatggctgccacacctatcccggcaatgtctgcccgagacctctacgccaccgtgacccataacgtctgcgaacagaagatggaaaacgtccagccggcaccggataatgttctattgactctgcgcccacgaagaattaacatgacagacaccggcatatcccccatgtcaacaagagatccgtacgccacaatcacctataacgtgcctgaagagaaaatggagaagggtcagccacagccagacaatatcttgtctaccgcgagcacagggctgatcaacgtagccggagccggaacacctgccatatcaaccaatggcctgtacagtaccgtgccccataatgtgtgcgaagaaaaaatggaaaacgatcagcctcagcctaataacgttctctccactgtacagccggttattatttatctcaccgctacggggatccccggtatgaacaccagggaccagtatgccaccatcactcataatgtatgtgaagagcgcgtggtgaacaatcaaccccttccttccaatgccctgtcgactgtcctgccaggactcgcatatctggcaacggctgatatgcctgctatgtctactcgtgatcaacacgcgacaattattcataacctacgcgaagagaagaaagataactcccaaccaacaccggacaacgtgctgtcagcggtgacaccggaacttattaatctggccggtgcgggaatcccccctatgagtacgcgtgaccagtacgccactgtcaaccaccatgtccacgaggcccgaatggaaaacggccaacgcaagcaggataatgtgctgtctaacgtgctcagcggcctaatcaacatggctggcgcatctattcctgctatgtcttcacgagatctttacgccactatcacccactccgtgcgcgaggagaagatggagagcggcaaaccccagactgataaggtgatctctaatgatgccccacagttgggccatatggcagccggtggaattccctcaatgtctaccaaggacctttatgccacggtcacccagaacgtgcacgaggaaagaatggagaacaatcagccccaaccttcttatgacctgagcactgtactgcccggtcttacatacctcactgtcgctggcattcccgctatgagcacccgtgaccagtatgccaccgtcacacacaacgtacatgaggagaaaattaaaaacggacaagcggcttccgataatgtcttttctactgtgcctcctgctttcataaacatggccgcaacaggcgtttcttcgatgtccactagggaccagtacgccgcagtgacgcataacattcgtgaagagaagattaacaactcccagcccgctcccggtaatattctgtccactgctcctccttggttgagacatatggccgcagccggaatctcaagcacaataaccagagatttgtatgttactgctacacactccgtgcacgaggagaagatgactaatggccagcaggccccagataattctctaagtacggtgccccctggctgcataaatctgagtggggcagggattagttgtcgcagtacacgggatttatacgccactgtcatacacgatattcaggaggaggaaatggagaacgatcaaacacccccagatggctttctgtcaaattccgactcgccggaattgatcaacatgactggccactgcatgcctcctaatgcactcgactcattttctcacgatttcacctctctgagtaaagatgagctgctatacaagccagactccaacgagtttgcagtcggaacaaagaactactccgtgagcgcaggggaccccccagtgaccgtgatgagcctggtcgaaactgtgccaaacactccccagatttctccagctatggccaaaaagattaacgatgacatcaagtaccagttaatgaaagaggtccggaggtttggccagaattatgaaagaatcttcatactcctggaggaagttcagggctctatgaaggtgaagcggcagtttgtggaatttacaattaaagaggcggcacgctttaaaaaggtagtgttgatccagcagctggagaaggctctcaaagaaatcgactcccactgccacctgaggaaagtaaaacacatgcgtaagcgctag

SEQ ID NO: 59579 - DNA, 1587 bp, Artificial Sequence
  Description of Artificial Sequence: Synthetic coding sequence
atgcaggcgagccctcttcagacaagccagcctaccccacccgaggaactgcatgctgctgcttatgtcttcactaacgatggacagcagatgcggtccgatgaggtcaatctggtggccaccggacaccagagtaagaagaaacactccaggaagtccaagagacattcatcaagcaaacggagaaaatcaatgagttcatggctggataagcaagaggatgccgctgtcacgcactctatttgcgaggagcgcatcaacaacggccagcccgttgctgataatgtgctctcaactgccccaccttggcccgacgctaccatcgcccacaatattcgggaggagaggatggagaacgggcagtcaaggaccgataaagtactgtcaacggcgccaccccagctcgttcacatggcggcagccggtatcccatctatgagcacccgggatcttcatgctacagtcacacagaacgtgcacgaggagagaatggagaataatcaacctcagccatcatatgatttatccactgtgctgccaggccttacttacctgacagtggccggaattccagccatgtcgactcgggaccagtacgcaacagtaacacacaatgttcacgaggagaagataaaaaatggacaggctgcctcagacaatgtattctctacagtgcctcctgcatttattaatatggcagcaactggagtgtccagtatgtccacgcgagaccaatacgccgctgtaacacataatatcagggaggagaaaatcaataacagtcagcccgctcctggcaacatcctctccaccgcacccccatggctacgccatatggccgcagctggcattagtagcacaataaccagggacctgtacgttactgctacccacagtgtccatgaagagaaaatgacaaacggacagcaggcccctgataacagcctgagcaccgtcccacctggttgtattaacttgtccggggctgggataagttgccgcagcacgcgcgatctgtacgccaccgtaattcacgacattcaggaggaagaaatggaaaatgatcaaaccccgccagacggtttcctgtccaatagtgattctccagagctgatcaacatgacaggacactgtatgccacccaacgctcttgactctttttcccacgacttcacaagtctatctaaagacgaactgttgtataagcctgactcaaatgagtttgccgtaggaactaagaactattctgtctctgcaggggatccgcctgttaccgtgatgagcctcgtggagacagttccaaacacacctcaaatatctccagcgatggccaagaagattaatgatgatataaaatatcaactcatgaaggaagtcaggcgattcggccagaattatgaacggatttttatactcttagaggaggttcagggcagcatgaaagtgaaaagacagtttgtggagttcactataaaagaagcagcccgatttaaaaaggtggtgctcatacagcagctggaaaaggcactgaaggagatcgattcacattgtcatctgcggaaagtaaaacacatgcgcaagagatag

SEQ ID NO: 59580 - DNA, 2715 bp, Artificial Sequence
  Description of Artificial Sequence: Synthetic coding sequence
atgcaggcttcacctctgcagaccagtcagcctactccacccgaggagcttcacgctgccgcttatgtcttcactaacgatgggcaacagatgcgttccgacgaagtcaatctcgtggcaactggacaccaaagcaagaaaaagcacagtagaaagagtaagcggcattcgagcagcaagcggcgaaaaagcatgtcgagctggctcgataaacaagaggacgcagccgtgacacatagcatttgtgaggaaaggattaataacggtcagccagttgccgataatgtgctcagcacggcccctccttggcccgatgccacaattgctcacaatatccgcgaggaacggatggagaacggccagtcccggaccgataaggttctgtcaacagccccaccccagttggtccatatggccgcagcaggtatcccttcaatgtcaacacgtgatttacacagcactgttacacataatattcgcgaggaacgtatggagaacggccaaccgcagcctgacaacgtccttagcacgggcccaacgggcttgattaacatggcagcaactccgatcccggctatgtctgccagggacctctacgcaacggttacccataacgtgtgcgaacagaagatggagaatgtccagcccgctcctgataacgtcctcctgacactgcggccacgccgtattaatatgacagacacgggcatatcacccatgagtacacgagatccatacgccacaattacatacaatgtccctgaggaaaaaatggagaagggccagccacagcccgataacattctgtccaccgcttcaaccggccttattaatgtggccggtgccggaacgccagcaattagtaccaatggcctttacagcaccgtcccccataatgtgtgcgaagagaagatggagaacgatcaaccacagcccaacaacgtgctctccacagtccaacctgtgattatatacttgactgcaaccggcattccaggtatgaatacccgtgaccagtatgcaaccataactcacaacgtgtgtgaagaacgagtggttaataaccagccacttccctcaaacgccctgtcaaccgtgctcccgggtctggcatacctagctactgcggacatgccagcaatgtctacaagggatcagcatgctaccatcattcacaacctccgggaagagaagaaggacaactcccaacctaccccagataacgtgctctccgcagtcactcctgagctcattaacctggctggtgctggcattccccctatgagcacccgcgatcaatacgcgaccgtgaaccaccacgttcacgaggcgaggatggaaaacggccaacgaaagcaggacaacgtcctgagtaacgtgctgtcaggacttatcaatatggcaggggctagtattcctgctatgtcctcaagggatttatacgccacaataacccacagtgtgagggaagaaaaaatggagtccggcaagcctcaaaccgataaagtgatctctaacgatgcgccacagctcggacacatggcagccggtgggataccaagtatgtccacaaaggacctgtacgccaccgtcacgcagaacgtgcacgaagaaaggatggagaacaaccaacctcaacccagctatgacctgagcaccgtattgcctggactgacatacctgactgtggccggaattcccgcaatgagtacccgagaccaatatgccaccgtcacacacaatgtccacgaggaaaagatcaagaatggacaggccgctagcgacaacgtcttttcaaccgtaccacccgcattcataaatatggccgcaactggcgtctcttccatgtccacacgcgatcagtacgccgctgtcacccataacatcagggaggagaaaattaacaattctcaaccagctcccggtaacattctaagtacagctcccccatggctgagacatatggcagctgccggtatctcttccaccatcactcgggatctgtacgttactgcgacccattctgttcatgaggagaagatgaccaatggccagcaggctcccgataactcattatccaccgtgcctccgggatgtattaacctgtcgggagcaggcatttcatgccggtccacaagagacctgtacgccacggttattcacgatatacaggaagaggagatggagaacgaccagaccccccctgatggtttcttgagcaatagtgactcgcccgaactcattaacatgaccggccactgtatgccgccaaatgctctcgactccttttcccatgatttcacctccttgtctaaggacgaacttttgtataaacccgactctaatgaattcgcagtgggcaccaaaaattactcagtctccgccggagacccaccagtgacagtaatgagtttggtggaaacagtgcccaacacccctcagatatctccagcaatggccaaaaagattaatgacgacattaagtaccagcttatgaaggaggtgaggcgattcggtcaaaactacgaaaggatattcattttgctcgaagaggtgcagggatcaatgaaggtgaagcgtcagtttgtggagttcaccattaaagaggctgcgaggtttaagaaggtggtcctcatccagcagctggaaaaggcactgaaggagatcgattctcactgccatctccgaaaggtgaagcacatgaggaaacggtag

SEQ ID NO: 59581 - DNA, 225 bp, Artificial Sequence
  Description of Artificial Sequence: Synthetic coding sequence
cgcggatctcgtggacggcaccactggtccggaggggctgccgtgagcagcggatacccctcaaacattgagaaaaaagagtatcaagaacagtccgtgctgtcttgctgctcagaacgcaaggatgccaaccccaaatcggttgtttgctccttcttcatgcaggagcaatgtacaaagggggagaaacaggctgtcgttatttctgattttggtgagtcgtag

SEQ ID NO: 59582 - DNA, 2385 bp, Artificial Sequence
  Description of Artificial Sequence: Synthetic coding sequence
atggaagctgtgagtcgtgtttttcccgctttggctggccaagctcctgaggagcagggagagataataaaagtgaaagttaaagaggaagaccatacttgggatcaggagagtgcactgaggcggaatcttagctacacccgcgaactgtccaggcaacgttttagacagttctgttaccaagagactcctggcccacgcgaggctctgtcccagcttcgcgaactgtgtcgccagtggctgaacccagagatccacacaaaggaacagattctggaattattggtcctggagcagttcttaaccatcctgcccgaagaacttcagagctgggtccgagagcacaatcccgagtcaggagaagaggtagtgacattattggaagacctcgagagggaactggatgagcccagacaacaggtgagccagggaacctacggacaggaagttagtatggaggaaatgattccactggacagtgccaaagagtcacttggcacgcagctgcagagcatggaggacaggatggagtgcgagagcccagagccgcatccactgcaggacaatgggtcttttctgtggtttagtatgatgtcccagtcaatggggggagacaacttgtcgtcgttggatactaacgaagctgaaatagagcctgaaaacatgcgcgagaaattttttaggtccctggccagacttctcgagaataagtctaacaacacgaaaattttctccaaggccaagtattgtcaactcataaaggaggtgaaagaagctaaggcaaaggctaagaaggaaagcgtagactaccgtaggctcgcgaggttcgatgttattctagttcaagggaatgaaaaactcattgaggccgtgaacggcgaaacagacaagattaggtactatttgcattccgaagatctgtttgatattctgcacaacactcacctctcaattgggcatggcggacgtacccggatggagaaggagctccaggcgaaatataaaaatatcaccaaggaggttattatgctgtacctgaccttatgcaagccctgccaacagaaaaatagcaagttgaagaaggtgcttacaagcaagagtattaaagaagtctcttccagatgtcaagtcgatctgatcgatatgcagctgaatccggacggggagtacaggttcatccttcattatcaggacctgtgcacgaagctcactttcttacgttctctaaagtcgaaaagacccactgaagtcgctcacgcgttactggatattttcaccatcattggggctccgtctgtgctgcagtctgacaatgggcgtgagttttcctcccaagtcgtgtcagagctttccaatatttggcccgaattaaaaattgtgcacggtaagtcgcagacttgccagagtcagagctcagctgagcagacagaggatatcagaaagcgcatcttttcatggatgcaaacgaataattcttcacattggacagagttcctgtggtttattcagatgtctcagaaccagccatatcatcgatccatgcaacagaccccatgcgaatctgccttctcttcagaagctaagctggggctgtcacacagccagttgaccgaagagctggttgccagtcttcatactgagaacgagcttgaccaggccgacaaggaattggaaaataccttgagagcccagtacgaggagaacatagagacaggcactgattcttctgacatcgaggagaacctgagcgttacccctaaggttgccgaaaagtctccccctgagtccagacttcgatttttgtcctgtgttgtgtgcgaaaaagagtgtaccggcgtcaattcttgtattagttgcgacggcaacatccacgcaatatgcggggtgccctcccaacacgggacggaggggtgtggcagacagattacttgtagtctctgctacgagacatccacgatgaagcgcaagcatgacgaaattcaaaggtctttgcccgtgaagcccagcaagatgctaaagccctctggcacacccttctcgcccgataaagttggggactggatggcaaaacaggcctcactggacttctttgtcaaaaagaggcacgcattctccgagcacagctcatcaaacaagcgcaacgtcaacaatcggagctatcctgaggaaggaaaaacaaaacgagtccatgctagttttacacgcaagtatgatccctcctacattgagttcggttttgtagctgtaatcgacggagaagtactcaagccacagtgtataatttgtggagacgtcctcgcaaatgaggcaatgaaaccttctaaacttaaacgccacttatacagcaaacacaaagagatatcatcccagcctaaagaattttag

SEQ ID NO: 59583 - DNA, 1737 bp, Artificial Sequence
  Description of Artificial Sequence: Synthetic coding sequence
atgaatatatctgtagacctggagaccaattacgcggaactagttcttgacgtcggtagggttaccttaggggaaaattcacggaagaagatgaaggactgtaaactgcgcaagaagcagaacgaaagcgtgagtcgtgcaatgtgcgcactattaaattctggtggcggtgtcataaaagcagagatcgagaacgaggattattcttatacaaaggacgggataggcttggatcttgagaatagtttcagtaacatccttctgttcgtgcctgagtatctggactttatgcaaaatggcaactattttttgatattcgtgaagtcttggagtctgaacacgtcaggactccggattactactctgagttcaaacctctacaaaagggacatcacttccgctaaggttatgaatgccactgcagccctagaattcctcaaagatatgaaaaagacgcgcggaagactttatctcagacctgaattgttagctaagaggccatgcgtggatattcaggaggaaaataatatgaaggctctagccggtgttttttttgacaggacggagctggacagaaaggagaagttgaccttcaccgaatcaacgcacgtggaaatcaaaaacttctcgacggagaaattgctgcagcggattaaagaaattctgccgcagtacgtctccgctttcgccaataccgacggcggttatctctttataggattgaacgaggacaaggagatcatcggctttaaggcagaaatgtcggacttagacgatctcgaacgcgagatagagaaaagtattagaaaaatgccagttcaccatttttgtatggagaaaaagaagataaactattcctgcaagtttctcggcgtttatgacaaggggtcgttgtgcggctacgtgtgtgccctccgcgtggaacgcttttgttgtgccgtatttgctaaagagcccgactcatggcacgtgaaggacaatcgagtgatgcagctgacccgaaaggagtggattcagtttatggtcgaggcagaaccgaaattttccagcagttatgaggaggtcatcagtcagataaataccagcttaccagctccccacagctggcccctgctggagtggcaacgtcaacggcatcactgccctggactctctggacgtatcacttacacgcccgagaatctgtgccgaaagttgtttctgcagcatgagggactgaagcagctgatctgcgaagaaatggatagtgtgaggaaaggttcccttatatttagccgcagctggtctgtagacctgggcctccaagagaatcataaggtactgtgcgatgccctgctgatctctcaagatagcccgccagtcctgtatacattccatatggtccaggacgaggagttcaagggatattcaacccagaccgcactcacactcaaacagaagttggcaaagattggcggttatacaaagaaggtttgcgtgatgactaagattttctatctaagtccagaaggaatgacatcatgccagtacgacctccgcagccaggtgatctatcctgaatcctattactttacacgcagaaaatacctgctcaaggcactgttcaaagcactaaagagactgaagagcctgcgagaccaattctcctttgctgaaaatttgtaccagatcatcggcatcgattgctttcagaaaaatgataaaaaaatgtttaagagttgcagaagattgacatag

SEQ ID NO: 59584 - DNA, 1737 bp, Artificial Sequence
  Description of Artificial Sequence: Synthetic coding sequence
atgaatatctctgtggaccttgagaccaattatgctgagctcgtgttggacgtggggagagtcacattgggagagaactcccgcaagaagatgaaggactgcaaactcaggaagaaacagaacgagtctgttagtcgggcaatgtgcgctctcctgaattccggagggggagtgattaaggctgagatcgagaacgaggactactcctacaccaaggatggcattggtctggatctggaaaattctttctccaatatcctgctttttgtgcctgaatacctggatttcatgcagaatggtaattatttcctgatcttcgtcaagagctggagtcttaacacatctgggctacgaattacgacactgtcatctaatctctataaacgcgacataactagcgctaaggttatgaacgctaccgccgctctggagttcttgaaggatatgaagaagacgagagggagattatatctgcggccagagcttctggccaagaggccatgtgttgatatccaggaggagaacaacatgaaagcactcgccggagtctttttcgatcggacagagctcgacagaaaggagaagttaacatttacggagagcacccacgttgagatcaagaatttctcaactgagaaattacttcaacgtatcaaggaaatactaccgcagtatgtgtccgcatttgccaacactgatgggggttatctctttattgggctcaacgaagacaaggagattatcgggtttaaggccgagatgagcgacctagatgatctggaaagagagatcgagaaatccattcgtaagatgcccgtgcatcacttctgcatggagaagaagaagataaattactcatgcaagttccttggagtttacgacaaaggaagtctctgcgggtacgtctgtgcactccgtgtggaacggttctgctgcgcggtgtttgcgaaggagccagattcctggcacgtcaaggataacagggttatgcagctgacccgcaaggagtggattcagtttatggtcgaggccgaacccaaattttcctcgagctacgaggaggtgattagccaaatcaacacgtcgcttccagccccacatagctggccgttgctggagtggcagagacaacgccatcactgtcccggactgagcggtcggataacctatactcctgagaatttgtgccggaagcttttcctccaacatgaaggcttaaagcaactcatctgcgaggagatggacagcgtcagaaagggatcattgattttctctaggtcatggagcgtagatttaggtctgcaggagaaccataaagtcctatgcgatgcacttctgatcagtcaagactctccacctgtcctctacacctttcacatggtccaagacgaggagtttaaggggtatagcacccaaaccgccctaaccctaaaacaaaaactggctaagatcgggggatatactaaaaaagtctgcgtgatgaccaagatcttctacctgtcacccgagggcatgaccagctgtcagtacgatctgcgctcgcaggtgatctacccagaatcctactacttcacccgcagaaagtatctgctcaaggcccttttcaaagcactgaagaggttaaagtcactccgcgatcagttctccttcgccgaaaatctgtatcaaatcatcggaatcgactgttttcaaaaaaatgataaaaagatgttcaagagttgccggcgtttaacgtag

SEQ ID NO: 59585 - DNA, 48 bp, Artificial Sequence
  Description of Artificial Sequence: Synthetic coding sequence
atgaacatttctgttgacttagaaaccaactacgccgagttagtatag

SEQ ID NO: 59586 - DNA, 210 bp, Artificial Sequence
  Description of Artificial Sequence: Synthetic coding sequence
atgaacattagcgtggacctggaaaccaattacgcagagcttgtgttagacgttggccgagtgacgttaggggagaattcccgaaaaaaaatgaaagactgcaagttgcggaaaaagcaaaacgaaagcgtgagccgagccatgtgcgccctgttgaatagcggagggggtgtgatcaaagccgagatagaaaacgaggattatagctag

SEQ ID NO: 59587 - DNA, 387 bp, Artificial Sequence
  Description of Artificial Sequence: Synthetic coding sequence
atgaacatctccgtggacctcgaaaccaactatgcagagttggttttagacgtggggagagttacgctaggagagaactctagaaagaagatgaaggactgtaagctccggaaaaaacagaatgagagcgtgtctcgggcaatgtgtgcgttattgaatagtgggggaggagttattaaagcagagatcgagaatgaggattactcctataccaaagatggcattggtctggacctggagaattcattctccaatattttgctatttgtgcctgaataccttgacttcatgcagaacggaaattactttctcattttcgtgaaatcttggtcacttaatacttctgggcttcgcattaccactctttcctcaaacctgtataagtag

SEQ ID NO: 59588 - DNA, 1737 bp, Artificial Sequence
  Description of Artificial Sequence: Synthetic coding sequence
atgaacatctcggtcgatcttgaaaccaattacgcagagctagtgctggatgtgggacgagtgacacttggggagaattcccggaaaaaaatgaaggactgcaagctgaggaagaaacagaatgaatccgtttcgagagcaatgtgtgctctgctcaacagtgggggaggggtcataaaagcagagattgaaaacgaggattattcatataccaaagatgggatcggactggaccttgaaaattcattcagcaatatactcttgtttgtcccagaataccttgatttcatgcagaatggtaattacttcctgatttttgttaagagttggtcactgaataccagcggactaaggatcactacgctgagtagtaacctgtataaacgtgacataacaagcgcgaaggtgatgaatgcaactgcagcacttgagttcctgaaggatatgaaaaagacacggggacgtctctacctccgtcctgagctgctcgcgaagcgaccatgtgtggatatacaggaagagaataacatgaaagctcttgctggggttttcttcgaccgcaccgagctcgacagaaaggagaaattgacctttacagagagcacacacgtggagatcaagaacttttcaacagagaaacttctgcaaagaataaaggaaatcctgccacagtacgtgtccgccttcgctaataccgatgggggatatctgtttatcggcttaaacgaagacaaagagatcattggcttcaaggctgagatgtccgacctggatgacctggagcgggagatcgagaagtctattcgtaagatgcccgtgcatcacttctgcatggagaagaaaaagatcaactactcctgtaaattccttggggtgtacgataaggggtctctctgtgggtacgtgtgcgctctgagagtcgagagattttgttgtgctgtattcgccaaggaacctgacagctggcatgtcaaagacaatcgcgtgatgcaactcacccgaaaggaatggatccagtttatggtggaagccgagcccaaattttcatcctcatacgaagaagttataagccagatcaatacctccctccctgccccacattcctggccgctactggagtggcagagacagaggcaccactgccctgggctttcgggcagaattacatatactccagaaaacctgtgtcgtaaactcttcttacagcacgaaggtttaaaacagctcatctgtgaggaaatggatagcgttcgcaaggggtccctcatttttagccggagctggtccgttgatctgggactgcaggagaatcacaaagtcttatgcgatgccctgttgatatcccaggatagcccgccagttctctacacatttcacatggtgcaggacgaggaatttaaggggtacagcacacagactgcccttacgctcaaacaaaagctggcaaagattggtggctatactaaaaaggtctgcgtaatgaccaaaattttttaccttagcccagagggaatgacgtcctgtcaatatgacctgcggagccaggttatctatcctgagtcttattacttcacccgaagaaagtacctgctgaaggccctgttcaaagctcttaaacggctaaaaagtcttcgcgatcaattctccttcgccgaaaacctctaccagattattggaattgactgcttccaaaaaaatgacaagaagatgttcaagtcctgccgacgactgacatag

SEQ ID NO: 59589 - DNA, 1854 bp, Artificial Sequence
  Description of Artificial Sequence: Synthetic coding sequence
atggcaatgaaaattatggaaaagattcgcaacgtcttccactgcgaggcacacaggattctctacatttgtgaatctcaatttctgcgaaacttcatcaggaaggagtttctcagagggaatggtctggctgcaggaaagatgaatatcagcatcgacctggacacgaactacgctgagctggtgctgaatgtgggtcgggtgacactgggagaaaataacaggaagaaaatgaaagattgtcaattgagaaagcaacaaaatgaaaacgtgtcccgggctgtttgcgctctgctcaattcaggtggtggggtcatcaaagcggaagttgaaaacaaggggtattcctacaaaaaggatggtattgggctggatctggaaaactccttctcaaatatgctccctttcgtcccaaatttcctggatttcatgcagaacgggaactacttccacatctttgtgaaatcctggtccctcgagacttccggaccccaaattgcgaccctcagtagtagtctgtataaacgcgatgttacttccgcgaaggtgatgaacgcaagtgccgcacttgaatttctcaaggacatggagaaaacaggcggaagggcctacttgcgtcccgaattcccagcgaagagggcctgtgtggacgtgcaggaagagagcaatatggaggcactagcagccgacttttttaatcgcactgaattaggttacaaggaaaaattgacctttacagaatcaacccatgtcgaaattaagaatttctccaccgagaagctactgcagagaatcacagagatcctgccacagtatgtatccgcctttgccaatacggatggaggttatctgttcgtcggcctgaatgaggataaggaggtgatcggattcaaggcagagaaaagctacctgaccaagctcgaagaagttacaaaaaatagtataggcaagctgcccgtgcaccacttttgcgtggagaagggcacaatcaattacctgtgtaagtttctgggagtgtatgacaagggaagactctgcggctacgtttatgcattgagagtggaacgcttctgttgcgcagtgttcgccaaaaagcccgacagctggcatgtaaaggacaaccgagtcaaacagctcacagaaaaagaatggatacagtttatggtagactcggagccagtgtgcgaggagctcccttccccagcatcgacctctagcccagtgtcccagagctaccccctgcgcgagtatattaactttaaaattcaaccgttacgctatcatcttcctgggttatcagagaaaattacgtgcgcaccgaagacattctgtagaaatcttttttcccagcatgaggggctgaagcagttaatctgcgaggagatggggtctgtgaataaagggtctctgatcttctctagatcatggagtctggacctgggactccaagagaatcataaggtgctctgcgacgcactgctaataagccaagacaagccgcctgtcttatatacatttcacatggtccaggacgaggagttcaaagattattccacccagaccgcgcaaactcttaaacagaaactggccaagattggtggatatacgaagaaggtctgcgtgatgactaagatcttctatcttagtcccgaaggaaagacttcgtgccagtacgatctgaactctcaggtcatttatcctgaatcgtattactggactacagcacagacgatgaaggacctggagaaggccctcagcaacatactcccaaaggagaatcagattttcctcttcgtttgcctgtttcgtttttgccttttcgtatgctggttcgtatgttttttcctccggtag

SEQ ID NO: 59590 - DNA, 1860 bp, Artificial Sequence
  Description of Artificial Sequence: Synthetic coding sequence
atgcagctttccgagggcctggctgcacacacccggagagctggtaagtggaagagaacccaagtcccactacttggtgaagagtgtgcagacatggatttggctcgcaaggagttcctcagaggcaacggcctcgctgccggtaagatgaacatctccatcgacttagatacgaattatgcagaacttgtattaaacgtgggcagggtcaccttgggagaaaacaaccgcaagaaaatgaaggattgtcagctgcggaagcagcagaacgaaaacgtcagccgggcagtgtgcgctttgctgaattccggaggcggagtgattaaggccgaagtagaaaataagggttacagctataagaaggacggaatcggacttgatctagagaactccttctctaatatgttgccattcgtcccgaattttttggactttatgcagaacggcaattatttccacatcttcgtgaaatcttggtccctcgagaccagcggccctcaaattgctacgctatcgtcctcgctctataagcgagacgttacatctgcgaaggtgatgaatgcttcggccgctttggagtttttaaaggatatggaaaagaccggaggcagggcttacctgcggcctgaattccctgctaaacgggcatgtgtggacgtgcaagaggagtctaacatggaagccttggcagcggacttttttaatcggacggagctgggctataaagagaagttgacttttacagaatcaacccacgtggagatcaaaaattttagcactgagaagctgctgcagcggatcaccgagatactcccccaatacgtttccgcattcgccaacaccgatggcggttatttattcgtgggcctcaacgaggacaaagaagtgattgggttcaaggcagagaaatcatacctgacaaagctagaagaggtgacaaagaatagtataggcaaactgcctgtgcaccacttctgcgtggaaaaaggtactatcaactacctgtgtaagttcttgggtgtgtatgataagggaaggttgtgtggatacgtgtatgcgctgcgggtggagcgattttgttgcgccgtctttgcaaagaaaccagacagttggcacgtgaaggacaatcgcgtcaaacaattaactgaaaaggaatggatccagttcatggtggactcagagcccgtttgcgaggagctgcccagcccagcaagcacttctagccctgtgagtcaatcctacccattgagagagtacataaatttcaaaattcaaccattgcgctatcaccttcccggactcagtgagaaaatcacatgcgcaccaaagactttttgtagaaatttattcagccaacacgagggtctcaaacagcttatttgtgaggaaatgggctcagtgaataaaggctccctaattttcagccgctcctggagcttagacttgggcctgcaagagaatcataaggtgctgtgtgacgcgttattaatcagtcaagacaagcctccagtactctatactttccacatggtccaggatgaggaatttaaggactatagcactcagaccgcccagacacttaaacagaagttggctaagatcggtggttataccaaaaaagtgtgcgtgatgaccaagatcttttacctttctccggaggggaagacttcctgtcaatatgacttgaacagccaggtcatttaccccgagagctattactggaccacagctcagacgatgaaggacctggaaaaagctctctccaatattttgcccaaagagaaccaaatctttctctttgtatgcctgtttcggttttgcctatttgtgtgttggttcgtttgtttctttctgagatag

SEQ ID NO: 59591 - DNA, 2694 bp, Artificial Sequence
  Description of Artificial Sequence: Synthetic coding sequence
atggaggccaaccactgttcactgggcgtttatccgtcatatccagatctagtgattgacgttggagaggtgaccctcggagaagagaaccgaaagaaacttcagaaaacacagagggatcaggaaagagccagggtgattcgcgctgcctgcgccctgcttaattctgggggaggggtcatccagatggagatggcaaatcgagacgagagacccacggaaatgggtctcgacctggaagagtcgctacggaagcttattcaatatccttacctgcaggccttcttcgaaaccaaacagcatggacgatgcttttacattttcgtgaagagctggtccggcgacccttttctgaaggatgggagcttcaacagtcgaatttgctccctctcttcatccctgtactgcagatccggcacatccgtgctgcacatgaatagtagacaggctttcgatttcctcaaaaccaaggaaagacagtccaagtataatctgatcaacgaaggtagccctcctagcaaaattatgaaggctgtataccagaacatcagtgagtcaaaccctgcctacgaagtgttccagaccgacacaatagagtacggcgagatcttgtctttcccagaaagcccttctatcgagttcaagcagttttctaccaaacatatacagcagtacgttgagaatatcattcccgaatatatctccgcttttgcaaataccgagggaggttacttgttcatcggggtggacgacaagtctcgaaaggtgcttggttgcgccaaggagcaggtcgatccagattccctaaagaatgtgatcgctagagcgatttccaagctcccaatcgtgcacttctgcagcagcaaacccagagtcgagtactcgactaaaatcgtggaagttttttgtggaaaggagctttatggctacctgtgcgtgatcaaagtgaaggcattctgttgcgtcgtcttctccgaagcccctaagtcctggatggtgcgcgagaaatacattaggcccttgactaccgaggaatgggtagagaagatgatggatgctgaccctgaattcccccctgattttgcggaagctttcgaaagccagttgagtttaagcgattcgcctagcctctgccggccagtgtacagcaagaaaggtctcgagcataaggcagacctgcagcagcatctgtttccggtgcctcctggccatctggaatgcacgccagagtccctgtggaaagagctaagtctgcagcatgagggtttgaaagaactcatccacaagcagatgcggccattctcacaagggatcgtcattctgtcgagatcctgggccgtagacctcaatctgcaagaaaaaccgggtgttatctgtgacgccctcctgatcgcccagaattctacccctatcctgtacaccatcttgcgggaacaggacgctgaggggcaggattactgcactcgcactgccttcactctcaaacagaagcttgtgaatatgggcggatacacagggaaagtgtgcgtgcgggcaaaagttctgtgcctaagccctgagtcttccgccgaagccctagaggctgctgtgtcccctatggactacccggctagctattccctggccggaacccagcacatggaggcgcttcttcaatctttagtcatagtgctgctgggatttaggtctctgctatcggaccagctcggatgtgaggtgctgaatctgctgacagcacagcagtacgagatcttctctcggagtctgcgcaaaaatagagagctcttcgtgcacggactgccgggtagcggtaaaaccatcatggccatgaagattatggagaagatcaggaacgtctttcattgcgaggcccacagaattctctatgtgtgcgagaatcagcctttacgtaatttcatctcggatcggaacatttgccgggctgagacacgcgagacgttcctgagggagaaattcgagcacatccagcacatagtgatcgacgaggctcagaattttagaacagaggacggagactggtatcgaaaagccaaaactatcacccagcgagagaaggactgcccaggcgtgttatggatttttctggattacttccagacgagccacctcggccatagcggcttgccgccactctccgcacagtatccaagagaggagttgacaagggtggtccgtaatgccgatgaaattgcagagtatatccagcaggaaatgcagttgataatcgagaatccccctattaatatccctcatgggtatctggccatcctgtcggaggcgaagtgggtgcctggggtgcccggaaacactaaaattatcaaaaattttactctggagcagattgtaacgtacgtcgcagacacgtgcaggtgtttcttcgaacgcggttattctcccaaggatgtagctgtgcttgttagtactgtcacagaggtggagcagtatcagtctaagctcctaaaagctatgagaaaaaagatggtggtgcagttgagcgacgcgtgcgacatgctgggcgtgcatatcgtcctcgactcggtgcgcagattttcaggattggagaggagtatagttttcggcatccatcccaggacggccgatccagctatcctgcccaacatccttatatgcttggcaagccgcgcaaaacagcacctctacatctttctttag

SEQ ID NO: 59592 - DNA, 1740 bp, Artificial Sequence
  Description of Artificial Sequence: Synthetic coding sequence
atggaagctaatcactgctccctcgcacctaagtcctggatggtcagggaaaagtacattcgacctttgactaccgaggagtgggtggagaagatgatggacgcggaccctgagttcccgccagattttgcagaagcatttgaatcacaactgtctctgtctgactccccttccctgtgccgtcccgtctactccaagaaagggctagaacacaaagccgacctccagcagcacctgttcccagtgcctcccggacatctggaatgcactcctgagagtctgtggaaagaactgtccttacaacacgagggcttgaaagagctgattcacaagcaaatgcgccctttttcccaaggcattgtgatattgagccgctcctgggctgttgatctaaatctgcaggagaaaccaggcgttatatgcgatgctttgctgatagcgcagaactcaactcctatcctttacacaattctgcgagagcaggacgccgaaggccaagactactgcacacggactgcctttactttaaagcaaaaactggtcaacatgggagggtatacaggaaaggtgtgcgttcgcgctaaggtgttgtgcctgagtcctgagagctcagcagaggctctggaagccgctgtgagccctatggactatccagcctcatattcgttagccggtactcagcatatggaggctttgctgcaatcgctggttattgtcctgctggggttcaggtctctgctttctgatcagttaggttgcgaagttcttaacctgctaaccgctcaacagtacgagatttttagccggtctctgaggaagaatagggagctgtttgtgcatggcctgccaggatcaggaaaaaccatcatggctatgaaaatcatggagaagattcgaaatgtgttccattgcgaggctcacaggattctgtacgtttgcgaaaaccagccactccgcaactttatttcagaccgaaacatttgtagggccgagacccgggaaacctttttgcgcgaaaagtttgagcacatccagcacatagttatcgacgaagcgcagaattttcggaccgaggacggtgattggtatcgcaaggccaagaccattacccagcgtgaaaaagattgcccaggggttctgtggatttttctggactatttccagacatcacacttggggcatagcggtttgcccccactgagcgcccagtacccaagagaggaactgacaagagtggtgaggaacgccgacgaaattgctgagtacattcagcaagagatgcaactcattattgagaatccaccaatcaacattcctcatggttatctggcgattttaagtgaggccaaatgggtgccaggcgtcccaggcaacacgaaaattattaaaaatttcaccttggaacaaatcgttacctacgtggcggatacatgccggtgtttttttgaacggggatatagccccaaggacgtggccgtgctagtgtctaccgtgacagaggtcgaacagtaccaatccaagctcctcaaagctatgcgaaaaaagatggtggttcagctcagtgacgcttgtgacatgctgggagtccatatcgttctcgactcagttcggaggttttccggattggagcggtccatcgtctttggcatccatccccgaaccgctgaccccgcaattcttcccaatattctgatatgcctcgctagcagggcgaaacagcatttatacattttcctctag

SEQ ID NO: 59593 - DNA, 321 bp, Artificial Sequence
  Description of Artificial Sequence: Synthetic coding sequence
atggaggccaaccactgtagtcttggcgtctatccaagctaccctgacctcgtcattgacgttggggaggtgactctgggggaagaaaatagaaaaaaactgcagaagacacagcgtgatcaggagcgcgcacgggtgattcgcgctgcctgtgccctactcaattccggcggaggtgtgatccagatggagatggctaaccgagatgaacgaccaactgagatggggctggaccttgaggagtcactgcggaaactgatacagtatccctatcttcaggccttttttgagactaagcagcacggaagatgtttttattag

SEQ ID NO: 59594 - DNA, 2694 bp, Artificial Sequence
  Description of Artificial Sequence: Synthetic coding sequence
atggaagcaaatcactgcagcctgggggtctatccttcctatccagatctggtaatcgatgttggcgaagtgacccttggcgaggagaaccgcaagaaacttcagaaaacccagagagaccaggagagggccagggtcatcagagctgcctgcgcgttgttgaatagcggaggcggtgtgatccaaatggagatggccaaccgcgacgaaagaccaactgagatgggactcgacttagaggaaagcctgcgtaaactgatccaatacccatatttgcaggcgtttttcgaaacgaaacagcacggaaggtgcttctatatctttgtcaagtcttggtccggggatccctttctgaaagatgggtcattcaattccagaatttgttccttgagctctagcctctattgtagatccgggacatctgtgctccacatgaactcacggcaggcctttgacttcttaaaaacaaaggaacgccaatccaagtacaacctgatcaacgaggggagtccaccttcaaagattatgaaggccgtctatcagaacattagcgaatccaaccccgcttacgaggtgtttcagacagacacaattgaatatggcgaaatccttagctttccagagagcccttccattgaatttaaacagttctctaccaagcatattcagcaatacgtcgaaaatattattcctgagtacatatccgcctttgccaataccgaggggggttatctgttcataggtgtcgacgataaaagccggaaagtactaggctgcgcgaaggaacaagtcgatcctgattcactgaaaaatgtgattgctcgggcaatatcaaaactgcccatcgtgcatttctgcagttcaaagcctcgcgtggaatacagtactaaaatcgtggaagttttttgtggcaaggagttgtatggttacctctgtgtgataaaggtcaaggctttttgctgtgtagtgttttccgaggctcccaagtcatggatggtgcgggaaaaatacattagacccctgactactgaagagtgggtcgaaaagatgatggacgccgatccggagttcccacccgatttcgctgaagctttcgagagccagctgagtctgagcgatagtcctagcctgtgccgacccgtttattctaagaaagggctggagcacaaggccgacctgcagcagcatctctttccagttcctcccggacaccttgagtgtactcctgagtctctgtggaaggaactgagtttacagcacgaaggactcaaggagttgatccacaagcagatgaggcccttttcacaaggaattgtaatcctaagccgctcctgggctgtcgatttgaaccttcaggagaagcctggtgtcatttgcgacgcactgctcatcgcacagaattcaacgcctattctgtacaccattcttcgggaacaggacgcagagggtcaggattactgcactcggacggcctttactttaaaacagaagcttgtgaatatgggtgggtatacgggcaaggtttgtgtaagagcaaaagtcctctgtctctcccccgagagttcggcggaagccctggaggctgccgtgtctcccatggactatcctgccagctattctcttgctggtacacagcatatggaggcactgctgcaatccctcgtcattgttcttctaggcttcaggtccctactgtccgaccagttaggctgcgaagtgctcaatctcctgactgcccagcaatacgagatattttctcggtctctaagaaagaacagagaactcttcgttcacggcttgccgggatccggaaaaaccatcatggcaatgaagatcatggagaaaatccggaacgtgttccactgcgaagcccacaggatcctgtatgtttgtgaaaaccagccgctcaggaacttcataagcgatagaaatatatgcagggctgagacacgagagacctttctgcgcgagaagttcgagcacatccagcatatcgtcatagatgaagcccagaattttcgcacagaggacggtgactggtataggaaagctaagacgatcacccagcgagagaaagactgccccggagtcctttggattttccttgattattttcagacatcacatctgggccactccggcctgccgccacttagtgcacagtatcccagagaggagctgacaagggttgttcgaaatgccgacgagatcgccgaatacatccagcaagagatgcagctgattatcgagaaccccccaattaatatccctcacggatacctggctattctctccgaagctaaatgggtccccggagtgcccggtaacactaaaattattaagaacttcactctagaacaaattgtgacctacgtggccgatacttgccggtgcttctttgagagaggatacagcccaaaggacgtcgccgtgctcgtttccactgtaactgaggttgagcaataccagagcaagttgctcaaggcgatgcgtaaaaaaatggtagtgcagttgtctgacgcgtgcgacatgttgggagtgcacattgtcctcgatagtgtaagaaggttcagcgggttggagcggtcgattgtgttcggaatccatcccagaacagccgatccggcaatccttcctaacattctcatctgcctagcaagcagagctaaacaacatctgtacatctttctgtag

SEQ ID NO: 59595 - DNA, 1740 bp, Artificial Sequence
  Description of Artificial Sequence: Synthetic coding sequence
atggaggccaaccattgcagtcttgcccctaagagctggatggtcagggaaaaatacatccgacctctgacaacagaagagtgggtggagaagatgatggatgccgatcccgaattccccccagacttcgctgaggcattcgaatctcagctgtccctcagcgattctccgtcactgtgcagacccgtctactcaaaaaagggcctggaacacaaggctgatctacagcaacatcttttcccagtgccacccggtcacttggagtgcacccctgagagcctgtggaaggaattgagcttgcaacacgaaggactgaaagagctgatccacaagcagatgcgcccattctcacagggcatcgtcatcctgtccaggtcatgggccgtggacctgaacctgcaagaaaaacctggcgttatctgtgatgcgctacttattgcgcaaaactctaccccgattctttacacaattctccgagaacaggacgctgaaggacaggactactgtacacggactgcgtttactcttaagcagaagctggtgaatatgggcggttacacagggaaggtatgtgtgcgcgctaaagttctatgtctgtccccagagtctagcgctgaggcattggaggccgctgtctcacctatggattatccggcttcctacagcctagcaggcacacagcacatggaggccctgctgcagagcctggtgattgtcctgctcggcttccgtagtctgctgtctgaccagctgggctgcgaggtccttaatcttttgaccgcgcagcagtatgaaattttcagccggtccttacgaaagaatcgggagctgtttgtgcacgggttgccaggctccgggaagactataatggctatgaaaatcatggaaaagatacgcaatgtcttccattgcgaggcgcataggatcctgtacgtctgtgaaaaccagcctctgcggaactttatttccgatcgcaatatttgcagagcagaaaccagggaaacatttctacgcgagaaatttgaacatatccagcacatcgtgattgacgaggctcagaacttccggaccgaggacggtgactggtatcgcaaggccaaaaccatcactcaacgggaaaaggactgccctggagtgttgtggatctttctagactattttcaaacttcacacctgggtcatagtggactgccccctctaagcgctcagtacccccgagaggaactaacaagagtcgtacgtaacgctgacgagatcgcagagtacattcagcaggagatgcagctcatcatcgaaaaccccccaatcaacataccccatggatatctcgccattctctcggaggcgaagtgggtgcctggagttcctggcaacaccaagattataaagaattttaccttggagcaaatcgtcacctacgtcgcggatacctgccggtgtttctttgaacggggatactcacccaaggacgtggccgttcttgtgtcaacagtgactgaagtagagcaataccagagtaaattgctgaaagccatgcgcaaaaaaatggtagttcaactcagcgacgcgtgtgatatgctgggtgtccacatagtgctggattcagtgagacggttttctggcttggaaaggtccatcgtcttcggtatccacccgcgtacagcagaccccgctatactccccaacatcctgatttgtcttgcatcccgtgccaaacagcatctgtatattttcttatag

SEQ ID NO: 59596 - DNA, 2694 bp, Artificial Sequence
  Description of Artificial Sequence: Synthetic coding sequence
atggaagccaaccactgctccttaggggtgtatccctcctatcccgacttggtgattgacgtcggcgaggtgaccctgggggaagaaaatcgtaagaaactacagaaaacccaacgggaccaggagagagcaagggtgatcagagcagcctgtgccctgctcaattctggtgggggtgtcattcaaatggagatggccaacagagatgagcgtccaaccgagatgggacttgatctggaggagtctctccggaagcttatccagtacccatatcttcaagcattttttgaaacgaaacagcacgggcgatgtttctacatcttcgtgaaatcctggagtggcgatcccttccttaaggacggaagtttcaatagccgcatctgtagcctgagttcttctctgtactgtcgaagtggcaccagcgtattgcatatgaacagcagacaggctttcgactttctcaaaacaaaggagcgccaatctaagtacaatctgattaatgaagggtctcccccttcaaagattatgaaagccgtgtaccagaatatcagtgaaagtaatcccgcttacgaagttttccagacagacacgattgagtacggtgagattctgtccttccctgagagtcctagcatcgaatttaaacagttctctacaaagcacattcagcagtatgtcgaaaatataattcctgaatacatcagtgccttcgcaaacacggaaggtggatacttattcatcggagtggatgacaaatcacgaaaggttctaggttgtgcaaaggaacaggtggatcctgattctctaaaaaatgtgatcgctagggcaatatccaaactcccaatcgtccatttttgctccagtaagcctcgggtagaatacagcaccaaaatcgtcgaggtcttctgcgggaaggaactctatggttatctgtgcgtgatcaaagtgaaggcattctgctgtgtagtgtttagtgaggccccaaagtcttggatggttcgggaaaagtacatccgacctctcacaactgaggaatgggtggagaaaatgatggatgcagaccctgaatttccccctgacttcgccgaagcctttgaatcacagctgagcctgagcgactcgccaagtctctgccgcccagtatactccaagaagggcctcgagcataaagccgatctgcagcagcacttgtttcccgtcccacctggacaccttgaatgcactcccgagtcactgtggaaggagctgagtcttcagcatgaaggacttaaagaactgatccacaagcaaatgagaccattcagtcaggggatcgtaatcttgagccgcagctgggctgtggacttaaacctccaggaaaaaccaggggttatctgtgatgccctgctgatcgcacagaacagtacacctattctgtacaccattctgcgggagcaggacgctgaagggcaagactactgcactcgcactgctttcactctgaaacagaagctcgtcaatatgggagggtatacgggaaaggtttgcgttcgcgctaaggtgttatgtctgagcccagaaagtagcgccgaggccctggaagccgctgtcagccctatggactacccagcctcatattccctggctggcacacaacacatggaggccctgctacagtcactggtcatcgtactcctgggctttcgctcccttttatccgaccagcttggttgtgaggtgctgaatttgctgactgctcagcagtatgagatcttctcaagaagtctaaggaaaaatcgcgagcttttcgtgcatggtcttccgggttcgggaaaaaccattatggcaatgaagattatggagaaaatacgaaatgtgtttcattgcgaagcccaccggattttatacgtttgtgaaaatcaaccgttacgcaattttatctccgataggaacatttgtcgggctgaaacccgggagacattcctgagagaaaagtttgagcacatccagcacattgtaatcgacgaagctcagaactttagaacagaggatggcgattggtataggaaagccaaaaccatcacacagagagaaaaggactgtcccggagtgctgtggatcttcctggattatttccagaccagccacctgggccattccggtcttcctcccctatcggcccagtacccgagagaggagttgacacgtgtggtgagaaacgccgatgaaatcgcagagtacattcaacaggagatgcaactgataatcgaaaacccacctattaacatcccccacgggtaccttgctatcttgagtgaagctaaatgggtgcccggagtgccgggtaatactaagatcattaagaatttcacactggaacagatcgtgacctacgtggccgatacctgtcgatgttttttcgagcgaggctactcaccaaaagatgttgccgttttggtgagtaccgtcaccgaggtggagcagtatcagtcaaaattacttaaggccatgcgtaagaagatggtggttcaactttccgacgcctgtgacatgctgggcgtgcacatcgtgctggactccgtgagacggttctccggtctggagcggagtattgtgtttggaatccaccctcggactgctgatcccgcaattctcccaaatatcctgatctgcctagcgagtcgggcaaaacagcatctgtacatctttctttag

SEQ ID NO: 59597 - DNA, 2739 bp, Artificial Sequence
  Description of Artificial Sequence: Synthetic coding sequence
atggagagtctcaaaacagatactgaaatgccttatcccgaagtgatagtcgatgtggggagagtgatctttggggaagagaaccgtaagaagatgactaactcttgtctgaagcggtcagagaattctaggatcatacgcgctatatgcgccctcctcaacagcgggggtggcgttataaaagcggagatcgatgacaaaacttatagttatcagtgccatggcttaggacaggacctcgaaacctccttccagaagttacttccgtctggatcccagaaatacctggattatatgcagcagggacacaacctccttatcttcgtcaaatcttggtctcccgatgttttttctttgccactcagaatctgttccttgcggtctaatctgtataggagggatgttaccagtgcaatcaacctgagcgcttcctccgcccttgaacttctccgcgaaaagggttttcgagcacaacggggtcggccaagggtgaaaaagctccatccccagcaggtcctgaatcggtgtatccaggaggaggaagacatgcggatcctcgcctctgagtttttcaagaaggataagctgatgtacaaggaaaagctcaactttactgagagtactcacgtcgaattcaagaggtttaccaccaaaaaggtgattcctcgtatcaaggaaatgctgccgcactatgtttcagcttttgctaatacccagggaggctatgtgctcatcggcgttgacgacaaatcaaaggaggttgtgggatgcaagtgggaaaaggtgaatccagatttgctgaagaaagaaatagaaaactgcattgaaaaactgcctacattccatttctgctgcgaaaaacccaaggtgaacttcactacaaagatacttaacgtgtaccaaaaggatgtgcttgacggctatgtgtgcgttatacaggtggaacccttctgctgcgtcgtgtttgctgaggcccctgacagttggatcatgaaagataacagtgtcacaaggttgacagctgagcagtgggttgtgatgatgcttgatactcagtcggcacctccttcattggtgaccgattacaattcttgtctgatctcttccgccagttccgcaagaaagagtcccggttacccaataaaggtgcataaattcaaggaggctctgcagcggcatctcttccccgtgacacaagaggaggtccagtttaaacctgagagtctctgcaagaagttgttttctgatcataaggagctcgagggactgatgaagaccctcatccacccatgtagccagggaatcgtgattttttccaggagctgggctggtgacgtggggttcagaaaggaacagaatgtgctatgcgatgcactacttattgcggtgaactctcccgtagttctctacaccattttgatcgacccaaactggccgggtggtctagagtatgccagaaacacagcccaccagcttaagcaaaagctgcagacagtcggcggatatactggaaaagtgtgtatcattcctcgcctgatccatcttagtagcactcaaagccgccctggcgagatccctctccgctatccacgctcataccgcctagccgacgaggaggaaatggaagacctcctgcaggccttagtggtggtctccttgagctcacggtccttgctcagtgaccagatgggctgtgagttttttaatctccttataatggagcagagccagttgctatctgaatctctgcaaaagaccagagaattattcatctattgctttccaggtgtgaggaagacggcgctggccatcaagatcatggagaaaataaaagatctgttccactgtaagccgaaagagatactttacgtgtgcgaaagcgattctctgaaggacttcgtgactcaacaaactacgtgtcaggcagttactcgaaaaacgttcatgcaaggcgaattcctcaagataaagcacattgtaatggatgagactgagaacttttgttccaagtacggaaattggtacatgaaagccaaaaacatcacccacccgaaggccaaaggcacaggatctgagaaccttcaccatgggatcctctggctgttcctggacccatttcagattcaccatgcggacgttaacgggctgccgcctccatccgcacagtttccgagaaagaccataactagtggcatccattgcgctctcgagattgccaaagttatgaaggaggagatgaaaagaataaaagagaacccaccaagcaatatgtcacccgatactctggcactctttagcgagaccgcctacgaggaagccacatgtgctcaggcactccctggcgtttgcgagacaaagacaaatctgaccaccgagcaaattgccaactacgtggcgcgtaagtgtcactcactctttcagtgcggctatctgccaaaggacatcgctattctgtgcaggcgtggcgaagatcgcggtaggtatcgattggcgcttctgaaagctatggaattgatcgagacacataggccatccgaagtagttttttcccccgcaacgggggtgtggggttcacatatagtgcttgactctattcaacagttcagcggcctcgagcgcacagtggtctttggcttgagtcccgagtgtgaccaatctgaggaatttcataagctttgtttcgcctcccgcgcaataaagcacttgtaccttctctacgagaagagggccgcatactag

SEQ ID NO: 59598 - DNA, 2676 bp, Artificial Sequence
  Description of Artificial Sequence: Synthetic coding sequence
atgtctctgcgcattgacgtagacacgaatttcccggagtgcgttgtggacgcaggcaaagtcactctcggcactcagcagcgccaggaaatggaccctcgtctgcgggaaaaacagaacgagatcatcctgagggctgtgtgtgccctcttgaattctggaggtggaatcattaaagcagagattgagaacaaaggctacaattatgaacggcatggtgtcggtctggacgtgccgcctatcttcaggtcacatctggataaaatgcagaaggagaaccactttttgatcttcgtgaaaagttggaacacagaggcgggagtgccactggccactctctgttccaatttgtaccatcgcgagcggacatccaccgatgtaatggactcacaggaagcacttgcttttttaaagtgtaggacacagacccccactaatataaatgtgtccaactcgctgggccctcaggccgctcaggggtcagtgcagtacgaggggaacataaacgttagcgcggcagccctcttcgaccgcaagagactgcagtacttggagaaactgaatttgccagagtctacacacgttgagtttgtgatgttctccaccgacgtttctcattgcgtgaaagacagacttccgaagtgcgtgtctgccttcgcaaatacagaggggggatacgttttcttcggagtacacgacgaaacctgtcaggtcataggctgcgagaaggagaaaattgatctcacaagtctgcgagcatccattgacggctgcattaaaaaactcccggtccatcacttctgcacccagcggcctgagatcaagtacgttctgaatttcctggaggtgcatgacaaaggcgcactgaggggatacgtgtgcgctatcaaagtcgagaaattctgttgcgcggtcttcgccaaagtccccagcagctggcaggtcaaagacaaccgagttcgtcagctgcctaccagggagtggacggcctggatgatggaagcagacccagaccttagtagatgtccggagatggtactccagcttagtctgtcaagtgcaacacccagaagcaaacccgtgtgcatccataagaatagcgagtgtttgaaagaacagcaaaaacgctatttcccagtgttcagtgaccgggttgtttacactcctgagtccctgtataaggaactcttcagtcagcacaagggcctacgagacctgatcaatactgagatgaggcccttttctcagggcatcttgatttttagccagagctgggccgtggatctggggctccaggagaagcaaggcgttatttgcgatgctttactcattagccaaaacaataccccaatcttgtatacaatcttctccaagtgggacgccggatgtaagggttattcaatgattgttgcgtacagcctcaaacaaaagttggttaacaaggggggttatactggtaggctgtgtatcacgccgctggtttgtgtgctgaatagtgaccggaaagcgcaatcagtatatagttcctacctccagatttacccagagagctacaactttatgacaccccagcatatggaagctctgttacaatcactggtgattgtgttgctgggctttaaatcctttttaagcgaagagctcgggagcgaggtcctcaacctcctgacaaataagcagtatgaattgctgtccaaaaatctcaggaaaaccagggaactgtttgttcatggcctgcccggttcgggcaagacaatcctggctttgaggataatggagaaaattcgcaatgtgtttcactgcgagcccgctaacattctctacatatgtgagaaccaacccttgaagaagcttgtgagcttctccaagaaaaacatctgccagcctgtgacaagaaaaaccttcatgaaaaataatttcgaacatatacaacatattataattgatgacgcccagaatttccgcactgaagacggagattggtacggtaaagctaaatttattacccaaaccgcccgagacggccctggggtattatggatatttctcgactactttcagacataccacctctcctgttcaggcctcccgcctccttccgaccagtatccacgcgaggaaatcaacagagtggttcgcaacgccggtcctattgccaactatctgcagcaggtgatgcaggaagcgagacagaatccaccaccgaatttaccccctggctctctggttatgctttacgagccgaaatgggcccagggagtccccggtaacctcgagatcatcgaggatctcaaccttgaagagattcttatctacgtcgcgaataaatgccggtttctcttgaggaacggatacagcccaaaagatatcgcagtgctgttcactaaagcctccgaggtggagaagtataaagatagacttttaacagccatgagaaagcgaaaactgagccagctgcatgaggaaagcgacctgttacttcagataggcgacgcctcggatgtgctcacagaccacatagtgttagacagcgtgtgccgattcagtgggctcgagcggaatatagtgtttgggattaacccaggagtggcgcctcctgccggagcctataacttgctgctctgcttagcgagtagggcgaaacgtcatctatacatcctgaaagctagtgtgtag

SEQ ID NO: 59599 - DNA, 1170 bp, Artificial Sequence
  Description of Artificial Sequence: Synthetic coding sequence
atgagtctgcgtattgatgtcgacacgaatttccctgagtgtgtggtcgacgccggtaaggtcacgctgggcacccaacagaggcaagagatggaccctcgcctgagagagaagcaaaatgagatcattctgagggcagtgtgcgctctgctcaatagtgggggaggcatcattaaggccgaaattgaaaacaaaggctacaactatgaacggcatggtgtcggtctggatgtgccacctatattcagatctcatctggataaaatgcagaaggagaaccactttttgatctttgttaagtcctggaacactgaagctggggtgcctctggcaacgctttgcagtaacctctatcaccgggagcggacttccaccgatgtgatggactctcaggaggctttggcatttctcaaatgtagaacccaaacacctaccaacatcaatgtatccaatagcctgggtccacaagccgctcagggtagcgttcaatacgagggcaatattaatgttagcgcagccgctctgtttgacaggaaacgtctgcagtatctcgagaaactgaatttacctgaatctacacacgtggaattcgtgatgttttccacagatgtaagtcattgcgttaaggacagactgcccaaatgcgtatccgcatttgccaacacggagggcggatatgtattctttggcgtgcatgatgagacttgccaggttattggctgcgaaaaggaaaaaatcgacctgacaagtctgcgggcatccatcgacggctgtatcaaaaaactgcctgtgcaccatttctgcacccagagacccgagatcaagtacgtgcttaatttcctagaagtccatgataagggcgcattacggggatacgtctgcgccatcaaggtcgagaaattctgttgtgcagtttttgccaaggtccccagctcctggcaggtgaaggataatcgagtccggcagctgcccactcgcgagtggacggcttggatgatggaagccgatcctgacctcagcagatgcccagagatggttttgcaactaagcttatcgagtgcaacccctcgatctaagccggtatgtattcataaaaacagtgaatgcctgaaggaacagcagaagcgttatttccctgtgagcgcccgtaaaacctcagctagtcagtag

SEQ ID NO: 59600 - DNA, 1224 bp, Artificial Sequence
  Description of Artificial Sequence: Synthetic coding sequence
atgactccgatgaaaaggtctgttcagacacaggtgtccgaaccattcatggagagctggggggaagaatccctgcccgagttacccgcagaacaatctttgactgaatactccgatttggaggaagccccttccgcccacactctttacgtgggtcacttaaaccctcaattttcagtgccagttctggcatgcctgctccgggacactttagaaaggctggaaatgcccgtggcaagggaacacatcgaagtcgtcaggagacctcggaaggcctacgctctcgtgcaggtgacagtgcatagggacacacttgcatcactgccctggaggctgcagaccgctctagaggaacaccttattctgaaggaacttgcagcccgtggtaaagatctcctgctgtccgaggctcaggggccattttctcacagggaagagaaagaggaggaggaagaagacagcgggctcagccccggaccatcccctggttcaggagtccccctcccaacgtggccgacccatacgttaccggaccgtcctcaagcccagcagctgcagtcatgtcaaggtcggcctagcggagtttgttccgactcagcaattgtgcatcagcagattgtcggtaaagatcagttgttccagggtgcattcctgggcagcgaaacgcgtaatatggagttcaagcgcggaagcggcgagtatctcagcctagccttcaaacaccatgtgcgcaggtatgtttgtgcattcctgaattctgaaggtggcagtttattagtgggggtggaagactctggcctagtacagggcatcaggtgctcgcaccgagatgaggatcgcgcaaggctattggtagacagcatccttcagggattcaagccacagatttttcccgacgcgtacaccctcaccttcattcccgtgatttcaactagcgagactagtgtgcctctgaaagtcattagacttaccgtgcataccccgaaggcacaatcacagccgcaactataccagaccgaccagggggaagtcttcttacgacgcgatgggagtatccagggcccactgtcagctagcgccatccaggaatggtgccgacagcggtggctcgtggagctggggaaactggaagaaaaaatgaaagcattgatgatggaaaaggagcagctgcaacagcagctgcagcagcacggacctgtgagttgtacctgttgcgtgctgtag

SEQ ID NO: 59601 - DNA, 1224 bp, Artificial Sequence
  Description of Artificial Sequence: Synthetic coding sequence
atgacccccatgaagcgctcagtccagacccaggttagtgagcccttcatggaaagttggggtgaagagagcctccccgaactccccgcagaacaatcactgacagagtactccgaccttgaagaggcccctagcgcacacacactctatgttggtcacctgaacccacaattttctgtgccggtacttgcgtgcctgttgcgagacaccctggagaggttagagatgcccgtggccagggaacacatcgaggttgtccggaggcccaggaaggcatatgcccttgtacaggtcactgtccacagggatactttggcctccctgccctggaggctccagaccgccctcgaggagcacctaattctaaaagagctcgctgctcggggtaaggacctacttttgtcggaggctcaggggccattctcacaccgagaagagaaagaagaggaggaggaggacagcggactctcccccggaccgtccccgggttctggggttcccttacctacttggccgacacacacactgcctgatcggccacaagcacagcagctgcagtcttgccaggggaggccctctggcgtctgttccgatagtgctatcgtgcaccagcaaattgtaggaaaggatcaactattccagggcgcattcttggggagtgagactagaaatatggagtttaaacggggtagcggggagtatctctcccttgccttcaagcatcatgtgcgccgatatgtttgtgcctttctcaacagtgaggggggtagtctcttggtcggggtcgaagatagcgggctcgtccaagggattcgttgcagccatagggatgaagacagggcccgtttgctggtcgatagcatcctgcaagggttcaagccacagattttccccgacgcatatactctgacgtttattccagtgatctcaacatctgagacttctgtcccactgaaagtgatcaggctgaccgtgcacacccccaaggcccaaagccagcctcagctatatcagaccgatcaaggcgaggtttttcttcgaagagacggcagtatacagggaccactttccgcaagcgctatacaggagtggtgtagacagagatggctggtggagcttggaaaactcgaagagaaaatgaaagccttgatgatggaaaaagagcagcttcagcagcaactacagcaacatgggcctgtgtcctgtacctgctgcgtgctttag

SEQ ID NO: 59602 - DNA, 1047 bp, Artificial Sequence
  Description of Artificial Sequence: Synthetic coding sequence
atgactccgatgaagagaagcgtgcagactcaggtgagcgagccgttcatggagagttggggtgaggagagcctgccggagctgccagccgagcaaagcctgaccgaatattccgatcttgaggaggcccctagcgcacacacattgtacgttggccaccttaacccacagtttagtgttccagtccttgcctgcctgctgagagacacactcgagcgtctagagatgcccgtggcccgtgagcatatcgaagtggtaaggagacccagaaaggcctacgcgctggtccaggtcactgtacacagagataccttggcatccttgccttggcggctgcagacggcccttgaagaacaccttattctgaaggaattggcagcgaggggcaaagacctgctgctgtcagaagctcagggacctttctcacaccgggagcagatcgtgggaaaggaccagttatttcagggtgcatttttaggcagtgaaacaaggaacatggagttcaagcgcggatccggggaatatttatcccttgctttcaaacatcacgtcagaaggtatgtatgtgctttcctgaacagcgaggggggttcactcctagtcggagtagaagatagcggtctggtgcagggcatcaggtgttcacacagggacgaggacagagcaagactcctggtggacagcatcctgcagggatttaaaccacagatatttcccgatgcttacacactcacattcatcccagtgatcagtactagcgaaaccagtgtgcccctcaaggtcattagactgaccgtgcatactcccaaagcccagagccaaccgcagctgtaccagaccgaccaaggagaggtttttttacgcagagatggttcaattcagggcccactgtccgcgagcgctattcaggagtggtgtaggcagaggtggctggtggagctaggcaagctggaggagaaaatgaaggcgttgatgatggaaaaggagcagctgcagcagcagctgcaacagcacggaccggtcagttgcacatgctgcgttctctag

SEQ ID NO: 59603 - DNA, 1080 bp, Artificial Sequence
  Description of Artificial Sequence: Synthetic coding sequence
atgacgcctatgaaacgcagcgtgcagacccaggtgagcgagccctttatggaatcatggggcgaagaaagtttgcctgagctcccagccgaacaatcactcaccgagtacagtgacctggaggaggctcccagcgcccacacgctatacgttggccacctcaatccacagtttagtgtcccagttctcgcctgtttacttcgcgacacacttgagaggctggagatgccagtagcaagggagcatatcgaagttgtgcgacgccctcgtaaagcctacgccctcgtgcaggtgaccgtccatagagacacgttggcctccttgccttggcgcctgcaaacagcgctggaagagcacctgatcttaaaagagctggccgctagaggcaaggacctcttattgtcagaggcccagggcccttttagtcatcgcgaagaaaaggaagaggaggaggaggacagtggcttatctcccggtccaagccctggatcaggcgtcccgctcccaacctggcccacccatacactcccagatagaccccaggcccagcagttgcagtcgtgtcaaggccgtcccagtggagtgtgttccgattcggccatcgtgcatcagcaaatcgtggggaaagatcagctgttccagggggcattccttggtagtgagacgagaaacatggagttcaagcgtgggagcggggaatatctgtccctcgccttcaaacatcacgtccgacggtatgtgtgcgcctttctcaattccgaaggcggttcccttcttgtgggcgtggaggactccggcctggtgcaaggaattcggtgtagtcacagagatgaggatagggcccgtttgctggtggattctattttacaaggtttcaagccccagatctttcctgatgcctacaccctgacattcatccccgtgatcagcacaagcgagacctccgtgcccctgaagcgatggctcgttgaactcggcaagttggaggaaaagatgaaagctctgatgatggaaaaggagcaactgcaacagcagctgcaacagcacggccctgtttcatgtacgtgctgcgtgctttag

SEQ ID NO: 59604 - DNA, 1080 bp, Artificial Sequence
  Description of Artificial Sequence: Synthetic coding sequence
atgaccccaatgaagagatctgtacagacgcaggtctccgaacccttcatggaaagctggggcgaggagtctctgcctgagctccccgcagagcagtctcttactgagtactcagatctggaggaagcaccctctgctcacactctgtacgttggccacctgaatccccaatttagtgtgcctgtgctggcctgtttactgagagatactctcgagagactcgagatgccagttgctagggagcatattgaggtggtgaggaggccgcgaaaagcctacgctcttgttcaggttacagttcacagggacaccctagccagccttccctggcggttacagacagcattggaggagcatctgattctgaaggagcttgcagccagagggaaagacctcttactcagcgaggctcagggaccttttagccaccgcgaggaaaaggaggaagaggaagaggatagcgggctttctcccggaccttctcctgggtcaggagtccccttacctacttggcccacacatactctgccggaccggccacaggctcaacagctgcagtcttgtcaaggtcggccttctggcgtgtgctcagattcagctatagtccatcagcagatcgttggaaaagaccagctgttccagggggcttttttggggtccgagacccgaaatatggaattcaagaggggtagcggcgaatatctctctttggcgttcaaacaccacgttaggcgctacgtttgcgcatttctgaatagtgaaggaggtagtctgcttgtcggcgtcgaggacagcggcctggtgcagggcatcaggtgtagtcacagagacgaagaccgcgcacgcttactggttgatagtattctgcaaggtttcaagccacagatctttccagacgcttacacactgacgttcattcctgtgatttctacctcagagacttcggtcccattgaagcgatggctggttgaactagggaagctggaagagaagatgaaagccctgatgatggagaaagagcagctgcaacaacagctgcagcagcacggcccagtcagctgtacctgctgtgtcctgtag

SEQ ID NO: 59605 - DNA, 1224 bp, Artificial Sequence
  Description of Artificial Sequence: Synthetic coding sequence
atgactcctatgaagcgaagcgtccagacccaggtgagtgaacctttcatggagtcctggggcgaggaatcactccccgaactgcccgctgagcagtccctcacagaatattccgatctggaggaggctccgagcgctcacacactgtacgtgggccacctaaatccgcagttcagtgtgcctgtgttggcctgccttctgagggatactctggaacggttggaaatgccggtggcgcgtgaacacatagaagtggtccgtcggccacgtaaggcctacgctctggtccaggtgacagtgcacagagacactctagcgagcctgccttggcggctgcagactgctttagaggagcacctgatcctgaaagagctggccgcaagaggaaaagatttactcttgtccgaagcacaggggcctttttcccatagagaagaaaaagaagaggaggaagaggactctggactttctccgggacctagtcctgggagcggtgttcctctgcctacttggcccactcatacactgcctgacagaccgcaggcccaacagctccagagctgtcaaggaagacccagtggcgtatgctctgacagcgccattgttcatcagcagatcgttggaaaagaccagctctttcagggcgctttcctgggttctgaaacccgtaacatggagtttaagaggggctccggagagtatttgagtctggcttttaaacatcatgtgagaagatacgtgtgcgcctttcttaacagcgaagggggaagcctcctagtgggagtggaagatagcggattagtccaggggatccgatgctcacatcgcgacgaagatagggccaggcttctcgtggattccatactgcagggttttaagcctcagatctttccggatgcctacacactcacttttataccagttatatcaacatctgaaacttctgtgccactaaaggtgatccggctgaccgtgcacacacccaaagctcaatcgcagccacagctgtaccagaccgatcagggagaagtgttcctgcggcgagacgggtctatacaggggcctcttagtgcatctgccatccaggagtggtgtcggcaaaggtggcttgtggagttaggcaagctggaagagaagatgaaagccctgatgatggagaaggaacagctccaacagcagctacaacagcatggccctgtcagctgcacatgttgtgtgttatag

SEQ ID NO: 59606 - DNA, 1920 bp, Artificial Sequence
  Description of Artificial Sequence: Synthetic coding sequence
atgtcggcctcaggcgtcctgagcttcacacagcaagggtgggagcaggtgctcgcgaaggtcaagcgggctgtggtgtacctagacgctgcttgtgcagaaagtttacattggggatgtgggtcaacccgactcttggaagccgtgggcggacctgactgtcacctgcgcgaatttgaacccgatgccatcgggggtggggctaaacaaccaaaggcggtatttgtgctgtcttgcctgctgaaaggccgtacagtcgagatactcagagacattatttgccgcagtcactttcagtactgcgtcgtggtaacaactgtgagccatgccgtacatctcaccgccaaccacgtcccagcagccgcagctgccgagatggaaggacagcagcccgtgttcgaacagctggaagaaaagctgtgcgagtggatgggaaacatgaactacacagcagaggtgttccatgtacccctgctgttggctccagtggcccctcatttcgcgttgacaccggcttttgcttcccttttcccattgttgccccaggacgtgcacctcttaaattctgctaggcctgacaagaggaagctggggtccttaggcgacgttgattctacaacactcacgccggagctcttgctccagattagatgcctagtgagtggcttaagctctttgtgtgagcatttgggtgtgcgagaggagtgtttcgccgtcggatccctatcccaggtcatcgcagccgatttggctaattacgcacctgcaaagaatcgtaagaagactgctgccggtagagcttctgttgtgttcgtggacaggaccctggaccttacaggtgctgtggggcaccatggcgataacctcgtcgagaaaataatatccgcccttccccagttgcctgggcacacgaatgatgttatggtaaacatgattgctcttaccgctctgcacactgaagaagagaattataacgtggtagcacctgggtgccttagccaatctagcgacactaccgcaaaagccctgtgggaagctctcctaaacacgaaacacaaggaagcagttatggaggtgaggcgacatctcgtagaagctgccagtagagaaaatcttccgatcaagatgtcgatgggacgggtgacccccggtcaactgatgtcctacatccaactgttcaagaataatctcaaagctctgatgaatcattgtgggcttttacagctgggcttggcgaccgcacaaaccctcaagcacccccaaacagccaagtgggataatttcctggccttcgagaggctcctgttgcagtctattggcgagtcagcaatgagcgtggtcttgaatcagctcttgcccatgatcaagcctgtgactcagagaaccaacgaagactacagccccgaagaactcctgattctgctgatctacatctacagtgtcaccggcgagctgaccgtggacaaggacttatgcgaagctgaggagaaagtgaaaaaagccctcgcacaggttttttgtgaggagagcggtctgagtcccctgctgcagaagatcacagattgggactcctctattaacctaactttccacaagtccaagatcgccgtagacgagttattcaccagtctccgtgatattgcaggtgcccgaagtctgcttaagcagtttaagtctgtgtacgtgcctgggaatcatacccatcaggtttcgcgccctcatccctcagattatccgttgctgattttattcgtggtcggcggagttaccgtgagcgaggtcaaaatggttaaggaccttgtcgcttctctgaaacctggtacccaagtgatcgtccttagtacgcgactgctgaagccgctgaatattcccgaacttctgtttgcgaccgaccgccttcatcctgatctgggattctag

SEQ ID NO: 59607 - DNA, 2055 bp, Artificial Sequence
  Description of Artificial Sequence: Synthetic coding sequence
atgagcgcttccggagtgctgtctttcacccagcagggctgggagcaggtccttgctaaggtgaagagagcggtcgtgtacttagatgctgcatgcgccgagtctctgcattggggttgtggatcaacacggctgctggaggccgtagggggaccagattgccacctcagggagttcgagcccgatgcaattggcggtggggctaagcaaccaaaggccgtgttcgttctgtcatgtctgctgaagggccgtacagtggaaatccttcgagacattatttgtaggtcacactttcagtactgcgtggtcgtcaccacagtctctcatgcggtccatctcacagcgaaccacgtcccggcagcagcagcagcagagatggaaggtcagcagcccgtctttgaacaactggaggaaaagctctgtgaatggatggggaacatgaattacactgctgaagtgtttcacgtcccgctgttgctagcacccgtcgcccctcatttcgctctcaccccggctttcgccagcctgttccccctgcttccgcaagacgttcatctgctcaatagcgcacggccagataagaggaaactcggatctctgggagatgtggacagcacaaccctgacgccagagctgctgttgcagatccgatgtctggtgagcgggcttagttcactctgtgaacaccttggagtacgcgaagagtgtttcgccgtgggcagcctttcccaagtaatcgccgctgatctggctaactatgcaccagcaaaaaatagaaaaaagaccgcagctggacgtgcctctgtggtgttcgtggacaggacattagacctgaccggggcagtcggccaccacggagataatctggtggaaaagattatctcggctttgcctcagcttcctggtcacactaacgacgtgatggttaacatgatcgcactaaccgcacttcacacagaggaggagaattacaacgtggtggcccctgggtgtctgtcccagtccagcgacacgactgccaaagcactgtgggaagccctcctgaataccaagcataaggaagcagtgatggaagtacgcagacatcttgtagaggccgcaagtcgggaaaacctgccaatcaagatgagtatggggagagtgacacccggacagcttatgtcttatattcagctgttcaagaataacctcaaagctctgatgaatcattgtggactcttgcaactgggactggcaaccgcccagactctgaaacaccctcagacagccaaatgggataattttttggcgttcgaacgacttctcctgcagtcaatcggtgagtctgcaatgtctgtggtgcttaatcagctgctccccatgataaaacccgtcacacagcgaaccaatgaggactactcccctgaggagctcttgatactccttatctatatctatagtgtgacgggagagttaaccgtagacaaagatctctgcgaagcagaggagaaggtcaagaaagcactggcccaggttttctgcgaggagtcaggacttagccctctgctccaaaagattaccgactgggacagtagcataaacctgacctttcacaaatcaaaaattgctgtggatgagctgttcacctctctcagggacatcgcaggagctcggagcctgcttaagcagtttaagagcgtgtacgttccaggaaatcacacccaccaagcctcctacaaaccactgctaaaacaggtggtggaggaaatcttccacccagagcggcctgattctgtagatatagaacacatgtcaagcgggttaacagacctactgaagacagggttctcaatgttcatgaaagtgagtcgcccacatccatccgactaccctctgttgatcctgttcgtcgtgggaggcgttaccgtcagtgaggtgaaaatggtcaaggacctggtcgccagcctcaaacctgggacccaggttatcgtgctgagtaccagactgttgaagcctctgaacatccccgaattgctcttcgcgaccgatagactgcatcctgatctgggtttctag

SEQ ID NO: 59608 - DNA, 777 bp, Artificial Sequence
  Description of Artificial Sequence: Synthetic coding sequence
atgcagatatcgggagcggttgcacccgctccaccttcctcagggctgggatttgggcctcccaccagcctggcctctgcatctgggagtttccctaacagcggcttgtatggctcttatcctcaagggcaggctcctccactgagccaggcccagggccacccgggaatacagacacctcagcggtcggcccctagccaggctagctcatttacgccaccagcctccggcggacctaggttgccctcaatgacagggcctctgctgcctgggcagagctttgggggaccttctgtctctcaaccaaatcatgtttcttcaccccctcaggctctccctcctggaacgcagatgacaggaccactcggccctctgcctccaatgcactcccctcagcagcctggctatcagccccagcagaacgggtcttttgggcctgccagaggaccgcagtcgaactatggcggtccgtacccggctgccccaactttcggctcacagccaggtcctcctcagccacttcccccaaagagactagacccagacgccatccctagccctgcctctccttacgtcgtcgaccacggcgagagcggaccacttcgatgcaaccgctgtaaggcttatatgtgtccatttatgcagttcatcgaagggggtagacgcttccagtgttgcttctgtagctgtatcaatgatggtcgggtaggtcaaaagtctcagcagtccgccctggctctgtcccctacaatccggtgttccacaagcatcatgtag

SEQ ID NO: 59609 - DNA, 1278 bp, Artificial Sequence
  Description of Artificial Sequence: Synthetic coding sequence
atggcaagcagctctcccgattcaccttgttcgtgcgactgtttcgtgagcgtcccacctgcatctgctattcctgctgttatatttgcgaaaaattctgatcgccctagagacgaggtccaggaggttgtgtttgtacccgctggtactcatacacccggtagcagactgcagtgtacctatatcgaggttgagcaggtctcaaagactcacgcagtgattctgagcagaccatcgtggttgtggggggcagagatgggagccaatgaacatggagtctgtattggaaatgaagcagtttggaccaaggaacctgtaggcgagggcgaagccctgctcgggatggatctgctgaggctggctctcgaaaggagtagttctgctcaggaagccctccatgtgattacaggactgctagaacattatggccaaggagggaattgcctggaagatgccgctccattttcctaccattccacattcctgctggccgatcgtactgaggcttgggtgctggaaacagccggtagactatgggctgcacaacgaatccaggaaggcgcaaggaatatctcaaaccaactctccataggcacagacatttcagctcagcatccagagctcagaactcacgcccaagccaaaggttggtgggatggccaaggcgctttcgactttgcacaaatttttagtctgacccagcagccagtgagaatggaagctgctaaggcacgctttcaggcaggccgagagctcttacgtcagagacagggcggaataacagcagaggtgatgatgggaatattacgggacaaagagtccgggatctgcatggattctgggggattccgtaccacagccagtatggtgtccgtactgccacaagatcctacgcagccttgcgtgcattttcttaccgccacccctgacccttcgaggtcagtgttcaagccattcatctttggtatgggagtggcacaggcaccccaagtgcttagcccaacctttggagcccaggacccggtccggactcttcctcgttttcaaacacaggtcgatcggaggcacacactctataggggccaccaggctgctctggggctgatggaacgcgaccaggataggggacagcaactgcagcagaaacaacaggatctcgagcaggaagggctggaggccacccagggtctactggcaggtgagtgggctccgccactctgggagctgggttctttattccaggctttcgtgaagcgtgagagccaagcctacgcctag

SEQ ID NO: 59610 - DNA, 1137 bp, Artificial Sequence
  Description of Artificial Sequence: Synthetic coding sequence
atggcctcatcatctcccgattctccctgtagctgcgactgcttcgtcagcgtgcctcccgcatccgccattcctgcagtcatatttgctaagaactccgatagacccagagatgaggtccaagaggtggtctttgtgccagcaggcacccacacccccggatcccggctgcagtgtacttatatagaggtggaacaggtgtccaaaacccatgcggtgatcctgtcgaggccctcgtggctgtggggcgctgagatgggcgcaaacgagcatggcgtctgtatcggcaacgaggccgtctggacgaaggagccagtgggcgaaggagaagccttgcttggcatggacctcctgcgtttggccctggagaggtcgagtagcgcgcaagaggccctccacgttattaccggactgttagagcattacgggcagggtggcaactgtttggaggacgctgcgccattttcctatcattcaacttttttactggctgaccgcacagaagcatgggtactcgaaactgccggtaggctgtgggccgctcagcggatccaggagggagcaaggaacatatccaaccaactcagtattggcactgacatctcggcccagcatccagaacttcgtacacatgcacaggctaaaggctggtgggatggccaaggtgcttttgacttcgcccaaatattttccctgacacagcagcccgtgcgcatggaagcggcaaaggcccgatttcaagccggtcgagaactgctgcgacagcggcagggtgggattaccgccgaagttatgatgggaatcctgcgggacaaggagtccgggatctgtatggattctggaggcttcaggacaacggcaagtatggtgagcgtgctgcctcaggaccctacccagccttgtgtacacttcctaaccgccacacctgatccatctcgctccgtgttcaagccgttcatcttcggtatgggcgttgctcaggcccctcaggtcctgtcgccaacttttggagcacaggaccccgtgcggacattaccaagatttcagacccaagtggatcggcgtcacactctttatcgcggacaccaggccgctttagggctgatggaaagagaccaggtttctccacgagaatag

SEQ ID NO: 59611 - DNA, 1275 bp, Artificial Sequence
  Description of Artificial Sequence: Synthetic coding sequence
atggagccgttctcctgtgacaccttcgtcgccctgccgcctgctacagtagataaccgcataattttcggcaagaatagcgatcgactttacgatgaagtgcaggaggtggtttattttccagccgtggtgcacgacaacctgggggagcggttgaagtgcacttatatagaaatagatcaggttcccgaaacctatgcggttgttctgtcacggcctgcctggctgtggggtgcggaaatgggagccaacgagcacggtgtctgtattgggaatgaagccgtctggggccgagaggaagtgtgcgatgaggaggccttactcggcatggatctggtgaggctgggactggagcgcgctgatactgctgagaaagcactcaatgtaatcgtcgatctcttagaaaaatatgggcagggcggtaattgcactgaaggtcgcatggtcttctcttatcataactcatttttgattgccgaccgcaatgaggcatggatcttggagacagcaggcaagtattgggccgctgaaaaagtccaggaaggggtaagaaacatctctaatcagctctccattaccacgaaaatagctagagaacatcccgacatgaggaactacgcaaagcgcaaaggatggtgggacgggaaaaaggagtttgattttgcagcggcatattcttacctggacacagctaaaatgatgacatccagcggccgttattgcgaggggtataagctgttgaataagcataaggggaatatcaccttcgagactatgatggaaatcctgagggacaagccatccgggattaatatggagggggaattcctcacgacagcttcaatggtgtcaattctgccacaggactcttcgctgccgtgtatccactttttcacagggacacctgaccccgaacggagcgtgtttaagcccttcattttcgtcccccacatctcacagttattggacacaagctccccgaccttcgagcttgaggacttggtcaaaaaaaagtcccatttcaaacccgatcggaggcacccactctaccagaaacaccagcaggctctggaagtggttaacaataacgaggaaaaagccaaaattatgttggacaacatgcggaaactggagaaagaactctttagggagatggagtcaatcctgcagaacaaacaccttgatgttgaaaagattgtcaacttatttccccagtgcaccaaagatgagatccagatttatcagtccaatctgtctgttaaggtgtcatcttag

SEQ ID NO: 59612 - DNA, 342 bp, Artificial Sequence
  Description of Artificial Sequence: Synthetic coding sequence
atggaaccgttctcatgtgatacattcgtggcattacccccagccacagtggataaccgtattatcttcggcaagaactcggaccgcctttatgacgaagtgcaggaagtggtttactttcccgctgtggtccatgacaaccttggggagcgcctaaagtgtacatatatagaaattgaccaagtacccgagacctacgccgtagtcctgagcaggcccgcatggctgtggggagccgaaatgggtgctaatgagcacggagtctgcatcgggaacgaagccgtttgggggcgtgaagaagtctgcgacgaagaggcgctgctgggtatggatctagtctag

SEQ ID NO: 59613 - DNA, 408 bp, Artificial Sequence
  Description of Artificial Sequence: Synthetic coding sequence
atggaacccttctcttgtgatacgttcgtggccctgcccccagccaccgtagacaatcgaattatatttggcaagaactccgacagactatacgacgaagtccaagaggtggtctactttcccgctgtggtgcacgataatctgggcgaaaggttgaagtgtacatatatagaaattgatcaggtaccagagacatacgccgtggtgctctctaggccagcttggttgtggggtgcggagatgggagccaacgagcacggcgtgtgtattggcaacgaggccgtgtggggacgcgaagaggtctgcgacgaggaagctcttctcggtatggatttggtcaggttaggcctggagcgagccgacacggctgagaaggccctcaacgtgatcgtagatctcctggaatag

SEQ ID NO: 59614 - DNA, 33 bp, Artificial Sequence
  Description of Artificial Sequence: Synthetic coding sequence
atggaacccttctcttgtgacacttttgtgtag

SEQ ID NO: 59615 - DNA, 651 bp, Artificial Sequence
  Description of Artificial Sequence: Synthetic coding sequence
atggagccattttcgtgtgacaccttcgttgctcttcctccagcgaccgttgacaatcgtatcatattcgggaagaatagtgacagactctacgacgaagtgcaagaggtggtgtattttcctgcggttgtgcacgataacctgggcgaacggctaaaatgcacctacattgaaatcgaccaggtgcccgaaacttacgctgtggtgctatctcgccctgcttggctctggggagccgaaatgggagcaaacgaacatggcgtgtgcataggtaatgaagctgtgtgggggagagaggaggtgtgtgacgaagaagccctgctgggaatggatcttgtgcggctggggctggaaagggccgacaccgccgagaaagccttgaatgttattgtagatctgctcgaaaaatacggacaggggggtaattgcaccgaagggcgtatggtgttcagctaccacaatagttttctcatcgctgataggaatgaagcctggattctcgagactgcaggcaagtactgggccgctgagaaggttcaagaaggtgtcaggaacatttccaatcaactgtctatcaccaccaagatcgcacgagaacaccccgacatgcgcaattacgccaagcggaaggggtggtgggacggcaagtag

SEQ ID NO: 59616 - DNA, 630 bp, Artificial Sequence
  Description of Artificial Sequence: Synthetic coding sequence
atggagccattttcgtgcgatacttttgtggcacttcccccagccactgtagacaacaggattatattcggcaagaactccgatcgcctttacgatgaggttcaggaggttgtttatttccctgctgtggtgcatgacaacttgggagagaggctaaaatgtacctatattgaaattgaccaagtgcccgagacatatgcagttgtgctctcccgtcctgcttggctttggggtgcagaaatgggggcaaatgaacacggcgtgtgcattggaaatgaagccgtgtggggtcgggaggaggtctgcgatgaggaggctctcctgggaatggacttggttcgcctgggcctggagcgggctgacactgcggaaaaggctttaaacgtgattgtcgatctgttggaaaaatacggacaagggggtaattgtaccgaagggaggatggttttttcataccataacagctttctaatcgcagaccgaaatgaagcgtggatcctggagaccgccggtaaatactgggccgcagagaaagtccaagaaggggtgagaaacatatccaaccagctgagtattaccaccaagatcgcccgtgagcatccagacatgcgaaattatgctaaacgctag

SEQ ID NO: 59617 - DNA, 1254 bp, Artificial Sequence
  Description of Artificial Sequence: Synthetic coding sequence
atgccgcctctcgctactcccccaagcgtgcatctttcattgagggttgcaggcagaccggatagactatacgatgaggtgcaagaggtcgtgtatttccccgctgtcgttcacgacaatctgggtgagcggctgaagtgcacatacattgagattgaccaagtgcctgaaacatatgcggtcgtattaagtcggcctgcttggctgtggggcgcagagatgggggctaacgagcatggggtgtgcatcggcaatgaggctgtgtggggtagggaagaggtctgcgatgaggaggctctgctcgggatggacctcgttcgtctgggactcgagagggccgacactgccgagaaggccctcaatgtcatcgtggatctgcttgagaaatatggccagggcggtaactgcaccgaggggcgaatggtcttttcttaccacaattcatttctcattgcggatagaaacgaggcctggatccttgagacagcaggcaagtactgggcagccgagaaggttcaagaaggcgtgcgcaatattagtaaccagttatccatcacgactaagatcgcgagggagcacccagatatgagaaattatgccaaaagaaaaggctggtgggacggtaagaaggagttcgatttcgctgccgcttatagctatttggataccgcgaagatgatgacatcatctgggcgttactgtgaagggtataaactgctcaataagcataagggtaatattacatttgaaaccatgatggagattttgcgcgacaagccatcaggcataaacatggaaggggagttcctgaccaccgcttctatggtgtctattctaccacaggattcctccctcccctgtatccattttttcacgggcacacctgatcccgagcgtagcgtcttcaagccattcatcttcgtgcctcatatttcgcagctgctggacacttcttcccccacctttgagctcgaagatctggtgaaaaaaaagagtcatttcaaacccgacagaaggcacccgctgtaccagaaacaccagcaggccttagaggtagtgaacaataatgaagaaaaggccaagattatgctggacaacatgcgtaaattagagaaagagctatttcgcgaaatggagtcaatactgcagaataaacacctggacgtcgaaaaaattgtcaacttattcccacagtgtaccaaggacgaaatacagatctaccagtctaacctctcagtaaaggtgagtagctag

SEQ ID NO: 59618 - DNA, 3171 bp, Artificial Sequence
  Description of Artificial Sequence: Synthetic coding sequence
atggaccgggctccaacggagcagaacgtgaagttaagtgccgaagtggagccctttataccccagaagaagagccctgacacattcatgataccaatggcgctgcccaatgacaacggaagcgtcagcggcgttgagcccacaccaatcccaagttacctaatcacttgttatcctttcgtacaggaaaaccaaagcaatcgacagttcccactctataacaacgatattcgatggcagcaaccaaacccgaatccaactggcccatactttgcttaccctatcatctccgcacagccacccgtcagtaccgaatatacctattatcaactgatgcccgctccgtgcgctcaggtaatggggttctatcatccattccccactccctacagtaatacattccaggccgcaaacacggtaaatgccatcactaccgagtgtacggaacgtccttctcagcttggacaagtgttcccactgtctagtcaccgttcgcgtaactctaatcgaggcagcgtggttccaaagcaacaattattgcaacagcatatcaaaagcaagcgcccactcgtgaagaatgtagcaacacagaaagagaccaatgccgctggaccagattccaggagcaaaatagttttgctggtcgacgcaagccagcagaccgattttccaagcgacattgctaataaaagcttaagtgagactaccgcaaccatgttatggaaatccaaggggcgacgaagaagagcctctcatcccaccgcggaatcatcatccgagcagggggcaagcgaagccgacattgacagtgacagtggatactgttcgccaaaacatagcaacaatcagcctgccgctggcgcattgcggaaccccgattccgggaccatgaatcacgtggaatcctccatgtgcgctggtggggtcaattggtctaacgtaacttgtcaggctacacagaaaaagccatggatggagaagaaccaaacattctccaggggcggtaggcagaccgagcaaagaaataacagtcaagatgaagatggttttcaggaactgaatgagaatggcaatgcaaaagacgagaatatccagcagaaattatcttccaaagtcttagacgacctgcccgaaaacagtccaatcaatatagttcagaccccgatacccatcacaaccagcgtgccaaagagggcaaaaagccaaaaaaaaaaagcattagccgcagctttggcaactgcacaggagtatagcgaaatctctatggagcagaagaagctgcaggaagcgctctcaaaagccgctggaaaaaaaaataaaacacctgtgcagctggacctcggcgacatgcttgctgctctagagaagcagcagcaagcgatgaaggccagacaaattactaatacgagaccactcagttacactgtggttacagctgcctcgtttcacactaaagattctaccaatcgtaaaccactcacaaaatcacagccttgcctcacaagcttcaactctgtcgatatagcttcctccaaagcgaaaaaaggaaaggagaaggagatagcaaagttaaaacgacctaccgccctgaaaaaagtaattctgaaagagcgggaagagaaaaaggggcgactcactgtggatcataatctccttggcagcgaggaacccaccgagatgcacctcgacttcattgatgatctcccacaagagatagtttcccaggaggacaccggcttatcgatgccctctgataccagtttgagcccggcttcacagaattccccttattgtatgaccccagtgagccaggggtcaccggcatcgagcggcatcggctcacctatggcttccagtaccataaccaagatacattctaaacggttccgtgaatattgtaaccaggtcctgtgtaaggagattgacgaatgtgtaaccctcctcctgcaggaacttgtgagcttccaggagcgaatataccagaaagatcccgtccgggctaaggccagacggagattggttatgggcttacgtgaggtgactaaacacatgaaactgaataaaattaaatgcgttattatcagtccaaattgtgagaagatccagtctaaggggggactggacgaggcgctctataacgttattgccatggctcgggagcaggagatcccctttgtcttcgcgctaggaaggaaggctctgggacggtgtgtgaacaaactggtgcctgtgtcagtcgtgggaatctttaattattttggggcagagagcctattcaacaagttggtagaactcactgaagaagcccgtaaagcttataaggatatggtggccgcaatggagcaggagcaggccgaggaagcactcaagaatgtgaagaaggttcctcaccatatggggcacagcagaaacccttctgcggcaagcgcgattagcttttgctcagttatcagtgagcccatttctgaggtcaacgagaaggaatacgagacaaattggcgcaacatggtggagacatctgacggacttgaagcatcagagaatgagaaagaggtgtcttgcaaacatagcaccagcgagaagccatccaaactgccctttgacacgccaccgatcgggaagcagccaagcctggtggccaccggctctactacttctgctacttctgcaggaaaatctaccgcatccgacaaagaagaagttaaacccgacgacctggagtgggcttctcaacaatccactgaaactggctctctggacggcagctgtagggacctcctaaatagctccattacatcaacaacctctacgctggtgcccggtatgctcgaggaagaggaggatgaagacgaggaagaggaggaggattatactcatgagcctattagcgtggaggtgcagctgaatagtaggattgagtcctgggtgagtgagactcaaagaactatggaaaccctgcagctcggtaagactctcaacggatctgaagaggacaatgtcgagcagtctggcgaggaagaagctgaagctcccgaggtcttggagccaggcatggacagtgaagcttggaccgcagatcaacaggcctcaccaggccagcaaaagtcttctaactgctcttccttgaacaaggagcatagtgattcaaattacaccacacagactacttag

SEQ ID NO: 59619 - DNA, 3306 bp, Artificial Sequence
  Description of Artificial Sequence: Synthetic coding sequence
atggaccgagcacctactgagcaaaatgtcaaactatccgcggaggtggagcctttcataccccaaaaaaagtctcccgatacgttcatgatacctatggctctccccaacgataatggcagtgtgtctggagtggagcctacacctataccttcatacctgattacttgctacccttttgtccaggagaatcagagcaaccggcagttccctctgtataataacgacatcagatggcaacagccaaatccaaacccaaccggcccatatttcgcctaccctatcatcagtgcgcagccacccgtcagcaccgaatatacctactaccagctgatgcccgctccatgtgcccaagtcatgggcttttaccacccgtttcctaccccctactccaatacctttcaagctgctaatacagtgaatgccattactacagaatgcactgaacgaccgtctcaactgggccaggtcttccctctatccagccaccggtctcgcaacagcaacagaggctccgtggtgccaaagcagcagttgctgcaacaacacatcaaatctaagcgcccactcgtcaagaatgtagctacccagaaggaaactaacgcagccggaccagattcgaggtccaagatagttctgctggtagatgcttcacagcaaaccgactttccttccgatatcgccaacaagtctctgagtgagactactgctacaatgctttggaaaagtaaaggcaggcgccgaagggcttcccatcccactgcggagtcctcttccgagcagggcgctagtgaagcagacattgatagtgactcaggttactgtagccccaaacactctaacaatcagcctgccgcaggcgcattgagaaatccagatagcggaactatgaatcacgtggaaagttcaatgtgcgcagggggtgtaaactggtcaaatgtgacctgtcaggcaactcagaagaagccctggatggaaaagaaccagaccttttcccggggtgggagacaaacagaacaaagaaacaatagccaagtgggttttcggtgtagaggccactctacctccagtgagcgtaggcaaaatctgcagaagagacctgataataagcatctgagctcttctcagtcacatcgtagcgatcccaacagcgaatcactctatttcgaggatgaagatgggtttcaggagctgaacgaaaatggaaatgccaaagatgagaacatccagcagaaactgtcctctaaggtgctggatgacttgccagaaaactcgccaataaatatcgttcagaccccaatccccatcaccacgagcgttcctaagcgggctaaatcccagaagaagaaggcccttgcagctgccttggcaaccgctcaggagtattctgagatatccatggaacaaaagaagctgcaggaagccttatctaaggccgctggcaagaagaataagactcccgtacagctggacctcggagatatgctggcagccctcgaaaagcagcaacaggccatgaaggctagacaaattaccaacacccggcctctgtcctataccgtcgtgactgccgcatcttttcacacaaaggattctacaaatcgcaagcccctaaccaaaagtcaaccatgcctcaccagtttcaacagtgtggacatagcctctagcaaggctaagaagggcaaggagaaagaaatagcaaaactcaaaagacccacggcgcttaagaaagtgattctcaaggagcgcgaagagaagaagggaaggctgactgtggaccataatctgctcggtagcgaagaacctactgaaatgcacctggactttattgatgatctgccacaggaaatcgtgtcgcaggaggatacaggactctcaatgccatctgataccagtctgagccccgcatcacaaaatagcccatactgtatgacacccgtctcacagggctcgcccgcaagtagtggaatcggctctccaatggctagtagtacaattacaaagatccacagcaagaggtttagagagtattgcaatcaggttctatgcaaagaaattgatgagtgcgttactctgcttctgcaggagctggtctctttccaagagagaatttatcaaaaagacccggtgcgggctaaagcaaggcgacgcctggtaatgggactacgggaagtaaccaagcacatgaaattaaacaagattaagtgtgttattatcagcccgaactgcgagaagatccagtcaaagggtggacttgacgaagctctgtataatgttattgcaatggccagagaacaggaaatcccatttgtttttgcccttggacgaaaggctcttgggaggtgcgttaataaattggtgcccgtcagtgtggtgggtatcttcaactatttcggagccgagtctctatttaataagctcgtggaattaacggaagaggccagaaaagcgtacaaagacatggtagccgctatggaacaggagcaggctgaagaggcgctcaaaaacgttaagaaagttccccaccatatgggtcattcaagaaatccttctgccgcatcagcaatttccttctgctccgtgatatctgagcctatctctgaagtaaacgaaaaggagtacgaaaccaactggaggaacatggtggagacctctgacggtctcgaggcctccgagaacgagaaggaagtatcgtgcaagcacagcacctccgaaaagccaagcaaattaccatttgacactcctccaatcgggaaacagccatctctggtggccaccgggtctacaacctcggcgactagtgccggtaagtcgacggcgtctgataaagaagaagtaaaacctgatgatctggaatgggcctcgcagcagagcaccgaaacgggttcactcgatgggagctgcagagacctcctcaatagttcgattactagcaccactagcaccttagtccctggcatgcttgaggaagaggaggacgaagatgaagaggaggaagaggattacactcacgagcccattagtgtggaggtgcaacttaatagtagaatcgaatcttgggtctcggaaactcaaagaaccatggagactctccagctggggaagacactgaatggctcagaggaagataatgtggagcaatcaggcgaggaagaagccgaggctccggaagtgctggagcccggaatggattcagaggcttggacggccgaccagcaggcaagccctggacagcagaagtctagtaactgtagcagccttaacaaggaacacagcgattcaaattacaccacacagacgacttag

SEQ ID NO: 59620 - DNA, 288 bp, Artificial Sequence
  Description of Artificial Sequence: Synthetic coding sequence
atgaaaggaagcagagctttactgctggttgccttaaccctgttttgcatctgtagaatggctactggagaagacaatgacgaattctttatggacttccttcaaacactgctcgttggaaccccagaggagctatacgaggggacactcggaaaatataacgtgaatgaggatgcaaaggcggcaatgacagaactgaaatcatgcagagatggcctgcagcccatgcataaggccgaattggttaagctgcttgtccaggttcttggtagtcaggatggcgcatag

SEQ ID NO: 59621 - DNA, 543 bp, Artificial Sequence
  Description of Artificial Sequence: Synthetic coding sequence
atggcatccgaacgtcccgagccagaagttgaggaggcaggccaagtgttcctgctgatgaaaaaagactatcggatttccagaaatgtgcgactcgcgtggttccttagccacttacatcaaacagtgcaggctactccccaagagatgttattgcagagtgaacaggagttagaggttctctctgtactgccccctggttggcagccagatgagcccgtcgtgccgagaccatttctcctcgttccctcaacacgagtgacgtttttagcctggcagtatcggttcgtgatagagctggatttgtccccgtccactggcattgtcgatgattccacgggcgaaatcctgtttgatgaggtttttcatgctctatccagatgtttgggaggcctgctgcgcccattcagagtgcccggaagctgcatcgactttcagccagagatatacgtgacaattcaggcttatagcagcattatcggacttcaatcgcaccagagacagggattcactatgctggccagactaccctctaacttttag

SEQ ID NO: 59622 - DNA, 507 bp, Artificial Sequence
  Description of Artificial Sequence: Synthetic coding sequence
atggcgtcggagcgtccagaaccagaagtggaagaggccggtcaagtcttcctcctgatgaaaaaggactatcgaatcagccgcaatgtgcgcctggcgtggttcctgtcccatttgcatcagaccgtacaggcaacacctcaggagatgttactccagagcgagcaggagttggaggtgttatccgtccttcccccaggatggcagccagatgagccagtggtgcccaggccgttcctgctagtgccttcaaccagagttaccttccttgcatggcagtaccgattcgtgattgagctggacctctcccctagcactggaatagtcgatgatagtactggcgagattctctttgacgaagtcttccatgccctatcaaggtgcctgggcggactgctccgaccgttcagggtgcctggcagctgtattgacttccagccagaaatctatgttaccatccaggcatatagcagcatcataggcctgcaatcacaccagatgatctag

SEQ ID NO: 59623 - DNA, 7601 bp, Artificial Sequence
  Description of Artificial Sequence: Synthetic coding sequence
atggtactggaacttccaatccagaacgagccgccaggccaagccgcagcggaggagaaacacacatgcgtcgtgcaatacatactctttccacctcactctacctcaaccaaggactccttctccactgatgacgacaatgacgtcgaggtcgaagctctggagggtgattccgagctgaacctagtcaccgaagtttgggtcgagcctcagtacggccgagttggccctggtccaggcatctggaaacacttgcaggatctcacctacagcgaaatcccacaggctcttcacccgagggatgcagcctgtattgggagtatgctgtccttcgagtacctcatccagctgtgtcagtccaaagagtgggggcctctgccacccgaaccaagggtgtcagacgggctcgaccaagggggagatacatgcgtccacgagatcccatttcacttcgatctgatggggctgttaccacagtgtcagcaacttcagatgttctttctcttactggctagaggcgcagaaggcccattattaggtgtgcatggtattcccaaagagcaggcagtgggctctacacaagcaaccggtgatagcgcattcacaagcctgtccgtcggtctcccggagaccctgaagccgcttatcagtgcccagccacctcagtggaggtgctacgcacgactcgtgaacccccagcacgtttttctgaccttccttccggcaacattctctgacgtccagcgcctcgcggcttgtggcctcgagggcccaccccaggaggagactaaacctaagtttggcgactggagcggtgccccaagcctaaaggatttgggtggaactggaatcaaagcaactaagtcccatgtacccgtcttaagtgtgactcttgccagcgataacgcacagaaccagggcgagttaagtccaccattccgcagagacttgcaggcgtacgcaggtcggcaggccagtcaaactgaaagcgccgacggcccaaggacgaggtgtcctgtgtatatctattcttgctcactggaagccctcagagagcagatggttgggatgcaaccccctcaagctcctagggacctcatcttcaggacccagtttctcgatcaccctagcccatctagtgcttggatggagcccagatacaaggaagccgctaaccactgtgctctgcttcaggaacatgcgcagcgctgctacgtccgtggtctattccgaagcttgcagcaagctcagtcggtgacctcgcaggatctcttgaccgcggtggacgcttgtgaggagcttctgcaagagattgatataacacctttcctcctggctttatgcggccatacatgggggctgcctcatgctcctcctagtcctggcccactgagtccaggccctttcagctcttccatggaggagggagcagaaccccgagagcgggctatactggccagcgaatcatcaattgagactgaagacttatccgaaccagagtttcagtccacccgggtcccaggaatccctgatccgggtcctgaaatttcactcaccgatgtgtgtcagctgaggggtgaggcacacggcgctttacactccgtgattcaggagaaattcttagagatttcacgactccactttcgtacagttccctcgaatccccattactttttttactgtccaccttctagccgaagggaggacgagggtccacgcgacaccgtggatagaaagattagtgacctggagttctcagaagcagagcttatgggggaagaaggagacacttccgcatgttgcgtggtgacggagagcgaccccgaactggaggtggagtatagggaatcgcgcgagtcagatctaggacctgctggcctggactccgcctctctctcagacgtggacactgtgaaccccgacgaagatagcttctccatcctaggcggagacagtcctacaggaccagagagtttcttgcacgatctccctcctctgtttctccaccttacatgcagcgtccgcctgagggggcaacatagcagtgtgccagtatgttccctgccaacttgccttgggcaggtattaagctctcttgagggaccaccagtgggtggtagagtcccactgcgagacctgtctgttactcttgatgtgtttatgctgaccctgcccctcgaagtggaattacctacggccagcgatccacaacatcatagatccactagcgagtcctcggcttcattccccaggtcacctggtcaacccagctccttgagaagtgatgacggactgggtccccctctccccccaccagaagaggagagacaccccggtttgagcaatttggccacacctcatagactcgccatcgagaccacgatgaacgagattagatggttgttggaggatgagatggtcggagctctgcgcagagggggaatcccgcagtcacccgcattacaccgggctgctgcgcacattcactcttcgcctggaagaagtacttgccttcgtcagacactgcccctgtccttcgtcttcggccctgagcgaagcctgacccagtttaaggaagaatttaggcggctgcatctgccaggacatgtactcctcgaagaccctgattccggtttcttttttgtggctgccggacagcaacccggtggctctcacggcgagccatccagtgcggcttgggcctggcattcgcacgaggatcgggcagaaggaatcgagggagaaaccctcacagcatctcctcaagcccctggctcccccgaagatagtgagggcgttccgctcatatcccttcctcgcgtgccacaaggtgggtcacaaccagggccatcgcgaggtttgagcctaatgtcctcccagggatctgtggattctgaccacctgggctacgacgggggaagctcggggagtgacagcgaagggcctaatgataccttgggggagaaagctccgtttacgcttcggacgccacccggtccggctccaccacaaccatccctctctggacttccaggtccttgtctgcccgacttctggctgattgtgagagttctccaggaccgcgtcgaggtgtatgcacatgcaagaagcctaatccgtgaggacggcggtccaggcacagagtgtcggcatctgcagcagctcctcgtgcgtcgggtcggcgagatttgtcgcgaggttaaccagcggctgttgctgcaggatctccacgatagccacgtttgtaattctttactggtggccgaatcggaagaggatttatggaggagcgagactcctttccattcacgccaaagagcaccgttgccctcagacgattacgccgctgacgagtcctgcgcccctagaggctatctggccgcaaccatgcagtttgtcccaggccacttctcatgtgacgtggtatgggggacagtcattcgcgtgcattctcggctgaagatgggcccatccatgggagtaagtagggctatccaggccctacggtccgtgttgaacgcttttagtgtagtcaatagaaaaaacatgtttgtctatcaagagcgagctaccaaagctgtgtactatctacgcttactggaaaccagctgctctgacaggccctggaagggcgacgcccttcccccttctttggccctcagtagatctcaggagcctatctactcggaggaggcgtcaggacccaggtcaccacttgacatggtgtcatcacggagtagcgatgccgctaggcctgtcgggcaggtcgacagacacattcaactgttggtccacggagtgggccaggccggacctgaaataactgatgaactcgtgagggtgctgtgtcgcagacttgacgaggcaaccctggacgtgatcacagtaatgctggtgcgcaactgtaagctgactcctgcagatgtcgaattcatccagccaccgggatcgctcccatctgaggtgctccaccttgcactccccacttcttgcagaccctggctgccggcactagcctggtatctacgccagaacctcttgattttcctgcacagcccaaaatacactgattccaactcgcgcaaccacttccaacacccgttgcctccccaggggggtctgcctgacctggatatctatctctacaataagccgggtggccaaggaaccggcggtaagggagtggcttgcattactctggcctttgtggacgagggcggagcccctctatccctcgccctttggcctccatcctcaccaggccctcccgatccgctcagagaagaggaatttgagcagctgactcaagttattaggtgccccgtggtggttgactcttccagcgcacagaacggcgcaccacgcctccgtctcgatgtatgggagaaaggcaacatcagcattgtccagctcgaagagaaattgcgcggtgccgctaggcaagcactagccgacgccataatcgaactgcaattgctacccgcaagtctctgtacagaggacactcctaccgggtcactgcggaatgggagtcttgagactaaaagttctgcgggacgagcctcaactttcccacccgcaccagtccctggtgagcctgtgacaccaccgtccaaggcaggaaggcggtctttctgggatatgctgagcaagactgaatgtggtgacctgggctcaccaaaaacaactgatgacattgtgttggacaggcccgaagacacacgaggcaggcgacgtcacaagaccgaatcagtgcgaacccccggtggcgctgagagggcccctggctccgattccggggctcaaaggcagaagagacgcacaacgcagttggaggaaggtgaagtggggactctgcatccagtgtttgcgcgagtagcgcaacggtggatggagtttatggtgcaaattggctgtgcttctgttagcaggtcaagtgcccatatggttagccgttttcttctgccatctatcctcagtgaatttaccgccttggtgacctccatggccggagatacttccgtaaggatatttgaacagcacttaggtagtgagcctgagatcttcggcccatgtagccccggacaactggggccatctcctagacctgccgctgaacgtcatctcctgctgctggggagaaatttcctgcaatggagaaggccaacacagcaggccgcaaaagccatgcagcgtttcgaaccaggcggagatggtagctcagggagaaacgctcctagacagagattgctgctgctcgaggtggttgataagaaactacagttgctgacttacaattgggcgcctgacctaggcgcagccttgggcagggccttggtacgcctggtgcagtggcaaaacgccagagcacatctcatattctgtctgctcagccagaaattagggctgttccaccattacggccagttggacttccccgtgagggacgaaaaagagccaaatcctttcctgttaccaaccatggaagtggagacacttattaggtccgcctctcctcccctgtccagggagcagggtcggttgagtgggtcatccagaggcggagggcctcttcctctggacacctttccattcgacgaggccctgcgcgatattaccgcagccaggccgtcctccgtgttggggcctgtccccagacctcctgacccagtgacctatcatgggcagcagtttctggagattaaaatggcagaaaggcgcgagcttgaacgtcagatgaagatggaaaatctgttcgtaacctggcagcaacgttctaccccagctaccatgccaataagcgcaggtgagctggaaaccctcaagcagagttcacgactggtacattactgtgcgaccgcaatgcttttcgaccccgctgcctggctgcacggaccccctgaaacatcaggtccaccagacggacaacggaggcataggcctgagagcgggagcgggagcagagaagcacccacttcatgcgagagcctggatgtttccccacctggcgctcgggaagaaccttggctgaaggagttaagtctcgctttcctgcaacagtatgttcaatatctgcagagtattgggtttgtgctggtcccactacgcccacccagtcccgcaaggtctacttctagacctagggccatggccatcctgggcacagagggtagaggctcatttagctgtccaaagactaagactgacggcagccctaaaagcacatcctctcctgtcaccacctatcacctccagcgggctctcccagggggaatcattctcatggaactggccttccagggctgctacttctgtgttaaacagtttgctctcgagtgttccaggatcccaatgggccaggcagtcaattctcagctatcgatgctattcacagaggagtgcgacaaggtgcgagatctaatgcacgttcatagcttctcttatgactttcatctgagactcgttcaccagcacgtgctcggtgctcatcttgttttgaggcatgggtatcatttaactacctttctccgccattttctagcgcaccatcctgacggaccgcacttcggacgaaaccacatctatcagggcaccctcgaacttcctacgccactgatcgctgctcatcagctgtacaattacgtggccgaccatgcatccagctatcacatgaagccccttagaatggccagaccagggggtccggaacataatgaatatgccctggtgagcgcatggcacagctccggttcctatctggacagcgaagggcttcgacaccaggacgattttgatgtctcgctgcttgtgtgccactgcgctgcaccctttgaggagcagggggaagcggaacggcacgtgcttcggctgcagtttttcgtggtgttaacttctcagagagagcttttccctcgtttgacagcagatatgcggagattccggaaacctcctcgcctgccacctgaaccagaagctcctgggagcagtgccggatcgccaggcgaggcctctgggctgattctcgcacccggacccgctcctttgttcccgccactggccgctgaggtgggcatggcacgggctaggttagcacagttagtgcggctcgccggagggcactgccgccgagatacattatggaagagattgtttttactagaacctcctgggccagatcgacttcgtctgggtgggagactggctctcgcggagctggaggaattgctggaggccgtgcacgccaaaagcattggtgacattgatccacaactggattgctttctcagcatgactgtgagttggtaccagtccctgatcaaggttttgcttagtcgttttccacaatcttgccgccacttccaatcgcccgatctgggcacgcagtaccttgtagtcctgaaccagaaatttaccgattgcttcgtcctggttttccttgattctcacttgggaaaaacttctcttaccgtggtattcagagagccattccccgtgcagccccaagactccgagtcccccccagcacagctcgttagcacttaccatcatctggagagtgttataaacacggcctgctttacactatggaccagactactgta

SEQ ID NO: 59624 - DNA, 537 bp, Artificial Sequence
  Description of Artificial Sequence: Synthetic coding sequence
atggcttcagagagacccgagcctgaggttgaggaggctggccaggttttcttactgatgaaaaaggattatcgcattagtagaaacgtccgcctggcttggtttctgtcacacttgcatcagactgtccaggctacaccccaggagatgctatcagaacaggaactggaggtcttgtccgtcctgccccctgggtggcagccggatgaacccgtggtgcctcgccctttcctcctggtccctagcacccgagtgactttcctggcctggcagtacaggttcgtcatagagttggatctctccccttctactggtatcgtcgacgatagtaccggagagatactatttgacgaggtgtttcatgccttatctcggtgcttaggtggacttttaagaccatttcgtgtgcctgggagctgcatagattttcaacctgaaatctatgtaaccatccaggcatactcctccattattggcctgcaatctcatcagcggcaaggattcaccatgctggcacgtctcccttcgaacttttag

SEQ ID NO: 59625 - DNA, 10128 bp, Artificial Sequence
  Description of Artificial Sequence: Synthetic coding sequence
atggcttctgagcgtcccgagcccgaggtcgaggaggctgggcaagtgtttctcctgatgaagaaagactatcgaatctcgcggaatgtgcggctggcatggtttctgtcacacctgcaccagacagttcaggctactcctcaagagatgttacttcagtccgaacaagaactggaagtcctctctgtgttgcctcctgggtggcaacccgatgagcccgtcgtccccagacccttcctgttagtcccaagtacaagagtgaccttcttggcctggcagtaccgattcgttatcgagctcgatctgtcaccctctaccggcattgtggatgactctactggagagattctctttgacgaagtctttcacgcccttagcaggtgtctggggggtcttctgagaccttttagagttcctggaagttgcattgacttccaacctgagatttatgtcaccatccaggcctactcgtcaatcatcggtttgcagtctcaccaggtcttggttcagggatgtctccttgatccaagccagcgagaggtatttttacaacagatttatgagcagttgtgcctgttcgaggataaggtagctaccatgctccagcagcaatatgacccacagagtcaagctgaggaccaatcacccgattcaggcgatttactggggagaaaggtgggtgtgtcaatggtaacagccgacctggggctggtcagcatgattcggcaagggatcttggccctccagctgctcccttccaatagcagtgccggaatcatcgtcatcaccgacggcgtcacaagtgtccctgatgtggccgtgtgtgaaaccctgctcaatcagcttagaagcggtaccgtcgcctgctcatttgtgcaggtgggaggggtgtactcctatgactgctcattcggacatgttcctaatgtagagcttatgaaattcatcgccatggctacatttgggtcttacctgagcacatgcccagagcccgaacctggcaacttagggctgacagtataccacagagcgttcttactgtactctttcttgcgaagtggggaagccctcaatcctgaatactactgtggcagccagcaccgactttttaatgagcacctggtgtccgcgtcctccaatccggctctcgccttgcgtcggaagaaacatactgagaaggaagtgccagccgacctggtgagcactgtcagcgttcggctgcgtgagggatattcagtccgcgaggtcactctggccaaggggggttcacagcttgaagtgaaactggttttgttatggaaacataacatgcggatcgaatacgtggccatggcgccttggcccctggagcctgaggggcctcgtgtgacccgtgtggaagtgaccatggagggtggatatgatatcctgcacgacgtcagctgtgctctgcggcaacccattaggtccctgtaccggactcatgtcatccgcagattctggaataccctgcaatccattaaccagactgaccagatgctggcgcacctgcagtccttctccagcgttccagaacactttactttacctgattctaccaagagtggcgtgcctctgttttacatccctcccggatccacaactcccgtgctgtccctgcagccgtcggggagcgattcctcacatgcccagtttgctgcatactggaaacctgttctgtctatggatgctaatagctggcagaggtggttgcatatgcaccgcctggtactgattctggaacatgacacacctattcccaaacatttgcacacccctggttccaacgggcgatactccacaattcagtgccgtatttcacacagctctctaacatccttgcttcgggattggtccagcttcgtcctggtggagggctactcgtatgtaaaattactgagctctgcccctgatcagccccctaactctttctatatggtgaggatcatttccaaggccccatgcatggtactgcggctggggttccccatagggactcctgcaccagcccgtcataagattgtgtcaggcctgcgggaggaaatcctgagactcagatttccccaccgagtccagtcaaaagagccgaccccaaaggttaaacggaaaggacttgggggagcaggcggaggctcatccccctccaagtccccacctgttctgggccctcaacaggccttgtctgataggccttgtctcgttgttctgcacaaaccgttggataaactcttgattagatacgagaaactgccactggactatcgcgctccttttctgttgaccctggaaccccctggcccacttcccctggtgagtggcaggtctgcatcttcaagcttggcctccctatctagatacctgtaccatcagaggtggctgtggtctgttcccagcgggctggccccagcgcttcctctcagcgccattgctcagctactgtcaatcctgaccgaagtcaggttgagtgaagggtttcattttgcttgttctggagaggggataatcaacatggtcttggaactgccaattcaaaacgagcccccaggccaggccgctgcggaagagaagcatacttgtgtagtgcaatatatcctgttccctccacactcgaccagtaccaaggattcctttagtacagatgatgataatgatgtggaggttgaggcattggaaggcgactccgagctgaacctggtgactgaggtctgggtcgaaccacagtatggtagagtgggtccgggtcccggtatttggaaacacctgcaggacctcacgtatagcgagatccctcaggccctacacccgagagacgcagcgtgtattggttcaatgctttcgtttgagtatcttatccagctctgtcaatcaaaggagtggggcccactgcctcctgagcctagagtctccgatgggctagaccagggtggtgatacttgcgttcacgagatccctttccactttgacctcatgggtttactccctcaatgccaacaactacagatgttcttcctgctgctggcacgcggagctgaggggccacttctgggagtgcacggaatccccaaagaacaggcggtcggctccactcaggcgacaggcgatagcgccttcacttctctcagtgttggtttaccagagactttgaagcccctcatcagcgcgcagccccctcagtggagatgctatgctcggctggtgaatccgcaacatgtgtttctgacgttccttccggctactttctctgatgtccagcggcttgccgcttgtggacttgaagggccaccacaagaggagacgaaacctaagttcggcgactggagcggggctccaagtctgaaggatctcggcggtaccggcatcaaagcaacaaagagccatgtgcccgtgttgagcgttaccctggcctccgataatgcccagaaccagggtgagctgagcccccctttccggagggacttacaggcgtacgccggtcgccaggcatcccagacggaatccgctgatgggccacgaaccaggtgcccagtgtatatttatagctgtagtctggaggccttgagggaacagatggtcggtatgcagccaccgcaggcacccagagatctcatattccggactcaattcctagatcatccctcgccgagtagcgcgtggatggaaccacggtataaggaggctgccaatcattgtgcgctgctgcaggagcacgcccaaaggtgctatgtgcggggtctgttccgaagtctgcagcaagcccagagcgtgacaagccaggacctgcttactgccgtggacgcgtgcgaggagctactgcaagagatcgatattactccttttttactggcgttgtgtggccacacatgggggctcccacacgctcccccttcccctggtccactatcccctgggccttttagcagttccatggaggaaggcgctgagcccagggagagggccattcttgcttctgaatcgtctatcgaaaccgaggacttatccgagcctgaatttcagagtacccgagtgcctggcataccagacccagggcctgagatttcccttacagatgtctgccagcttagaggcgaagcccatggggctctccactcggtgatacaggagaagtttcttgagatttccaggctgcactttcggacggttcccagcaatccacactattttttttattgtcctccgagtagcaggagagaggacgaaggtcccagagatacggtggaccggaagatttccgatctggaatttagcgaggccgagctgatgggtgaagagggagacaccagcgcgtgttgtgttgtgaccgagagtgatcctgaacttgaagtagaataccgcgagagccgtgaatcagacctgggcccagccggactggactcagcatccctctcagacgtggacacagtgaatcctgacgaggactcattctctattctgggcggtgacagtccaactggtcctgaatctttcctgcatgatctaccccctctgttcctgcatctgacatgtagcgtgcgcctgcgaggacaacactctagcgtccctgtgtgttctctgccaacatgtttgggtcaggttctcagcagtctggagggcccacctgttggtggaagggttccccttagagacctgagcgtcactcttgatgtgtttatgttaacactgcccctggaagttgagctgccaaccgcctcggacccgcaacaccaccgatctacatcagagtcttctgcgtctttcccgagaagtcctggtcagcccagcagtctgcgctccgacgacggattagggccaccgctcccccctcccgaagaggagcggcacccgggattgtccaacctcgcaactccacacaggctcgctatcgagacgactatgaatgaaatcagatggctgctggaagatgagatggtcggcgctctccgcagggggggaattcctcagagtcccgctctgcaccgcgcagccgctcacattcactcttcccctggcagatctacttgtcttaggcagaccctgccactctcttttgtgtttggcccagagcggagccttacacagtttaaggaggaattccgcaggctacacctccctggccacgtcctcttagaggatccagacagcggattttttttcgtggcagctgggcaacagcctggcggttcccacggtgagcctagtagcgccgcatgggcttggcactcgcacgaagaccgggcagaagggatcgagggagagactctgacagcgtcaccacaagctcctggcagccctgaggatagcgagggagtgcccttaatttcgcttcctcgagtgcctcaagggggatctcagccaggcccttctcggggacttagcctcatgtcgagtcagggatctgtggacagcgaccatctcgggtacgacgggggaagtagcggctctgactccgagggcccaaacgataccttaggagaaaaggcccctttcacactgcggaccccccctggtcccgcaccaccacagcccagcctaagcggtttacccggaccctgcctccctgatttctggctcatcgtgcgggttctacaagatcgggttgaggtctacgcccacgctcgctctctcattcgcgaagatggcggacccggaactgaatgccgccacctgcagcaactcctcgtgaggagggtgggcgaaatctgtagggaagtgaatcaacgtctattgcttcaagatctgcacgattcccacgtgtgcaactccctgctggtggcggaaagtgaggaagatctgtggcggagtgaaactccgttccattctcggcaacgcgctcccctgccctccgacgattatgctgcggacgaatcctgcgccccacggggttatttggccgctactatgcagtttgtccctggccatttctcttgcgacgtcgtgtggggcactgtcattcgggttcatagccgtctgaaaatgggcccatccatgggagtgagccgtgcaatccaggctcttagaagcgtgctgaatgctttctcagtggtgaatcgtaaaaacatgttcgtgtatcaggagagggccaccaaggcagtgtattacctgcggctattggagacttcctgtagcgacagaccctggaagggcgacgctctgccgccttccctggctctgagcaggtctcaggagcctatttacagcgaagaggcctctgggccaaggtcacctttggacatggtcagctctcgctcatctgacgcagcgagacccgtggggcaggtcgatcgccatatccagttgttagttcatggtgtggggcaagcagggccagagatcaccgacgaactcgtgcgagtgctgtgccgcaggctagacgaggctacgctggacgtcattactgtcatgctggtgcgaaactgtaagttgaccccggctgacgttgagttcattcagccacccggttcactcccatctgaggtgcttcacctggcactcccgacaagttgtagaccttggctgcccgctctggcctggtatctgagacaaaatttgcttattttcctccattcccctaagtataccgactccaactccaggaaccattttcagcatcccctgcctccacaagggggactaccggatctggatatttatctctataataagccagggggtcagggaactggcggtaaaggtgtcgcttgcattacattggcctttgtagacgagggtggcgcaccgctgtccttggccctgtggcccccatcttcccctggacctccggacccgttgcgagaagaggaatttgaacaactgacccaggtaatcaggtgtcccgttgttgtggacagctcgagtgcccagaatggggctccaaggctccggctcgacgtgtgggaaaagggaaatattagtatagttcagctcgaggaaaagctccgcggagccgctaggcaagccttagcagatgccattattgagctgcagctcttgcccgctagtttgtgcaccgaggataccccaacaggatccctccggaacggctccctggaaacaaagtcttcagccggaagggcaagcactttccctcctgcccctgttcctggcgagcccgttacgcctcccagtaaagccggtcgcaggagcttctgggacatgctgtctaagacagagtgtggggacctaggctcaccgaaaacaactgatgatatcgtactggaccgccctgaggacacacggggtcgtaggcgccataaaacggaaagtgtgcgcacaccaggcggagcagaacgcgctcccggtagtgacagtggtgcacagagacagaagaggagaacaacacaactggaggagggtgaggtggggactctccatcccgtctttgctagggttgcccaacggtggatggagttcatggtgcaaatcggttgcgcctccgtttcccgctctagcgcgcacatggtaagtcgctttctgctcccaagcattctgtcagaattcacagcccttgtgacaagcatggcaggcgatacatcagtacggatatttgagcagcaccttgggagcgagccagagatcttcggcccatgttccccaggacaactgggtccatcgcccaggccagctgccgaacgccacctgttgctgctgggtagaaacttcctccagtggcggaggcccactcaacaggccgctaaggcgatgcagcgtttcgagccagggggtgatgggtcctctggccgaaatgctccaaggcaacgcttgctccttctggaggtggttgataaaaagcttcagctcctcacatataattgggcaccagacctaggagcggctcttggaagggccctggtccgcctggtccagtggcagaatgctcgggcacacctaattttctgtctcctaagtcagaaactggggttgtttcatcattatggccagctggactttccagtgagagacgagaaagagccgaatccctttctgttaccaactatggaagtcgagacgctgattagaagtgcctcacctccactgagtagagagcaggggagactctctggcagctcaagaggcggtggaccattgcctctagataccttcccttttgacgaggccctgcgcgacattactgcggctcgtccatcttcagtgctcggacctgtgccgagacctccagaccctgtcacatatcacgggcagcagtttctcgagatcaagatggccgagcgacgcgagctggaaagacagatgaaaatggaaaacctgttcgtgacttggcaacagcgcagtacacctgccactatgcctatatctgctggcgagctcgaaacactgaagcagagttcacggctggtgcactattgtgccaccgctatgttgttcgatcccgcagcttggctccacggccctcccgaaacatcgggcccacccgatggacaaagacgtcaccgccctgagagtgggtccgggtcgcgggaggctccgacctcttgcgagtcactggatgtgtccccaccaggggcacgggaggagccatggctcaaagagctaagcttggctttcctgcagcagtatgtgcagtacctccagtccattggatttgtcttagtgcccctgcgaccaccctccccggctagaagtacctcaagacccagggccatggccatcctaggcacagagggacgaggcagcttcagctgccctaagacgaagactgatggatcccccaagagtacctccagccctgttacgacctaccatttgcaaagggccctgcctggcggaatcatcttgatggaactggcgttccaggggtgctatttttgtgtcaagcagttcgccttggaatgttcaagaatccctatgggccaggcggtgaatagtcagcttagcatgcttttcactgaggagtgtgataaagttcgggacttgatgcacgtgcatagtttctcttacgatttccatctgagattagtccaccagcatgtgctgggtgcccatctcgtgttacgtcacgggtaccatcttacaactttcctgaggcattttctcgcccaccacccagatggtccacacttcgggaggaatcacatataccagggcactttggagcttccaaccccactgatagcagcgcaccagttatacaactacgtggcagaccatgcttctagctaccacatgaaacccctaaggatggctcggcctggcggtcccgagcacaatgagtatgcccttgtgtctgcctggcatagctctggaagttatctcgactcagaaggactacgacaccaagacgatttcgacgtaagcctgctcgtgtgtcactgtgccgcaccttttgaagaacagggagaagccgaacgccacgtattacgactgcagttttttgtggttcttactagccaaagggagctcttcccaagactgactgccgacatgcgaaggttcaggaagcctccacgactgccacccgagcctgaggccccagggagctctgccggaagtcccggtgaggccagcggactgattttggctcctggcccagccccattatttccacctctcgccgcagaagtcgggatggcacgtgcccgattggcacaactcgtgaggttagccggtgggcactgcaggcgagacactctatggaagagactttttctgcttgagccccctgggccagataggctgcgcttgggaggacgcttggccctcgcagaattggaggagctgctcgaagccgtgcatgcaaaaagtataggcgacatcgatccgcaactggattgctttctctctatgaccgtaagctggtaccaatcccttattaaagtgctgctgtcccggttcccccaaagctgtcgacattttcagtcgccagacctcgggacccaatatcttgtcgttctgaatcagaaattcaccgattgctttgtccttgtgttcctggattctcatcttggcaagacatctctgactgtggtgttccgagaacccttcccagtgcagccacaggactcagaatcccctcctgctcagctggtgtcaacctaccaccacctagaatcagtgattaatacggcttgctttaccctctggacccgcttgctatac

SEQ ID NO: 59626 - DNA, 696 bp, Artificial Sequence
  Description of Artificial Sequence: Synthetic coding sequence
atggctggcatggtcgatttccaggatgaggagcaggtgaaaagctttttagaaaacatggaagtcgaatgcaactaccattgctaccatgagaaagatcctgatggttgctatcgcttggtcgattacctcgaaggtatcagaaagaacttcgacgaggccgctaaggttctgaagtttaactgcgaagaaaaccaacactctgatagctgttacaaattaggggcatactacgtgactggcaagggaggtcttactcaggaccttaaagctgcggctcgctgctttttaatggcctgtgaaaagccaggcaaaaaaagcatcgcagcttgccacaatgtcggtttactagcacatgatgggcaggtgaacgaggatggacagccagaccttggcaaagcccgagattattatacgcgtgcttgtgatggaggctacacgagcagctgtttcaacctgtctgccatgtttctgcagggcgctcccggatttcctaaggatatggatctggcatgtaagtactccatgaaagcatgtgatctgggtcatatctgggcatgtgctaacgcatcccgaatgtacaaattgggtgatggggtcgacaaagacgaagctaaggccgaagtgttaaaaaaccgagcacagcagttacacaaagagcagcagaagggagttcaaccacttaccttcggatag

SEQ ID NO: 59627 - DNA, 285 bp, Artificial Sequence
  Description of Artificial Sequence: Synthetic coding sequence
  Description of Combined DNA/RNA Molecule: Synthetic coding sequence
atggtttacatttctaacggtcaggttttagacagtcgcagtcagtccccctggagactctctctgattactgactttttctggggcatagctgagttcgtcgtgttattctttaaaaccttgctgcagcaggacgtgaagaaacgcaggagctatgggaacagctccgactctaggtacgatgacggtcggggtccgcctggcaacccaccaaggaggatgggccgaatcaaccatctgcgcggaccatcaccaccgcctatggccggtggaugaggtcgatag

SEQ ID NO: 59628 - DNA, 276 bp, Artificial Sequence
  Description of Artificial Sequence: Synthetic coding sequence
atggtctatatctccaacggtcaggtgctggacagccgcagccagagcccttggcggcttagtctcattactgacttcttttggggcattgcagagtttgtggtgctttttttcaagacccttctgcaacaagacgtgaaaaagcggaggtcctatggcaactcttcagattcacgatatgacgatggccgtggacccccaggaaatccaccccgacggatgggccgaattaaccatttgcggggtccaagcccccctcccatggctggcggatag

SEQ ID NO: 59629 - DNA, 438 bp, Artificial Sequence
  Description of Artificial Sequence: Synthetic coding sequence
  Description of Combined DNA/RNA Molecule: Synthetic coding sequence
atgtctctgctgttgccacccctagccctactcctgctgttggctgcgctggtagcccctgcaaccgccgctacagcctatcgtcctgattggaacagactatctgggctcactagagctagagtcgagacctgcgggggtugacagttgaacagactgaaggaggttaaggcttttgttacgcaggatattcctttttatcacaacttggttatgaaacacttgcctggcgctgatcccgaactagtgttgctgggacgacgttatgaagaactcgaacggattcctcttagcgaaatgacacgagaagagatcaatgcgctcgtgcaggagctgggcttctaccggaaggctgcacctgacgcccaggtacctccagaatatgtgtgggcgccagctaagcccccagaagaaacatcggatcacgcagatctgtag

SEQ ID NO: 59630 - DNA, 438 bp, Artificial Sequence
  Description of Artificial Sequence: Synthetic coding sequence
  Description of Combined DNA/RNA Molecule: Synthetic coding sequence
atgagcttgctactgccaccactggctctgttattgctgctggctgccctcgtcgctcccgcaacagccgctactgcctatcgcccagactggaatcgcctaagcggtcttacacgagcccgagtcgaaacctgcggcggtugacagctgaatcgcttaaaggaggtaaaggcctttgttacacaagacatccccttctaccataatctcgtcatgaaacatttgcctggggctgatcccgagctcgtgctgttgggcagaagatatgaagaactcgagcgaattcccctttccgaaatgaccagggaagaaatcaatgccttggtacaggaattaggcttctaccgcaaggccgcaccagatgctcaggttccgcctgagtacgtttgggccccagcgaagccccctgaagaaacaagcgatcacgcagatttgtag

SEQ ID NO: 59631 - DNA, 2010 bp, Artificial Sequence
  Description of Artificial Sequence: Synthetic coding sequence
  Description of Combined DNA/RNA Molecule: Synthetic coding sequence
atggcagtgtacagggccgcactgggggcttccctagcagccgcacgcctgctccccctcggcagatgttcccctagccccgcacctcgctctaccctctcaggcgctgccatggagcccgctcctcgttggcttgccggtttacgtttcgacaacagagccctgcgtgcactgccagttgaggccccaccacccggaccggaaggagcaccaagcgcgcctaggcctgttcctggcgcatgcttcaccagggtccagccaactccactccggcagcccagactcgtcgccctgagtgagcccgcactcgcactgcttggtctgggagcgcctccagctagggaggcagaagccgaagcagcactctttttcagtgggaatgcactgcttcccggagctgaacccgctgcgcactgctattgcggtcaccagtttgggcagttcgccggtcagctcggggatggcgctgccatgtacctgggtgaggtctgcaccgccaccggggaacggtgggagttacagcttaagggggctggtccaaccccttttagccgacaggcggacggaagaaaggtcctgaggtcttcaattcgcgagttcctttgtagcgaagcaatgttccatctgggcgtcccaactacacgagctggagcctgcgtgacatccgagtccacagttgtgcgggatgtgttctatgacggaaacccgaagtatgagcaatgcaccgttgtgttgcgggtggcctctacatttatacggtttggttcatttgagatcttcaaaagtgcagacgaacatacagggagggcagggccatcagttggacgcaatgatatccgagtgcaacttctcgattacgttatttcaagcttttatcccgagattcaggccgctcatgcgtccgactctgtgcagaggaatgccgcattcttcagagaagtgactcgtcgtactgcaaggatggtggctgaatggcagtgtgtgggattttgccacggcgtgctgaacactgataatatgagtattctaggcctgacaatcgattacgggccttttggatttcttgaccggtacgacccggatcacgtctgcaatgccagcgacaacacgggcaggtatgcctacagcaagcagcccgaagtgtgcagatggaatctgcgcaagctcgcagaggctctgcagccggagctcccattggagttgggggaagcaatactggcagaggaatttgatgccgagttccaacggcattatcttcagaaaatgcgcagaaagctcggcttggtccaggtcgagctcgaagaagacggcgctctggtgtccaagctattagagaccatgcacctgaccggagccgactttactaataccttctatctcctgtcttctttccccgtggaattagaatccccaggccttgccgagttcctcgcaaggctgatggagcagtgtgcaagcctggaagaattgaggctggcttttaggccacaaatggaccctcgtcagctgagtatgatgctgatgttggcgcagtctaacccacagttgttcgcccttatgggaacgagagcaggtattgctagggaattagagcgggttgagcagcagtcacggctggaacagttaagtgcggctgaactgcagtccaggaaccagggccactgggcagattggctacaggcgtatcgagcccgactcgataaagaccttgagggcgcaggcgatgccgctgcttggcaggccgagcatgtccgagttatgcacgctaacaatcctaaatacgtgctccgtaactacattgctcaaaatgcaatcgaggccgcagaacgcggagacttttccgaggtgagaagagtacttaaactccttgagacaccttatcactgcgaagctggtgccgcaacggacgctgaggctacagaagcagatggagctgatggtcgccaaagatcttactcctccaagcctcccctgtgggcagccgagttatgtgtgacaugatccagctag

SEQ ID NO: 59632 - DNA, 588 bp, Artificial Sequence
  Description of Artificial Sequence: Synthetic coding sequence
  Description of Combined DNA/RNA Molecule: Synthetic coding sequence
atgagacttctgctgctgctgttggttgcagcttccgctatggtcagatccgaggccagtgctaacctgggtggagtgccctctaaacgcctaaagatgcagtatgccaccggacccctgctgaagttccagatatgcgttagtugagggtatcgcagggtgtttgaggagtacatgagggtgatatctcagaggtaccccgacattagaattgagggcgaaaattacctgccccagcctatttacaggcatatcgcaagtttcttaagcgtatttaaactggtcttgattggccttatcatcgtgggcaaggatccattcgccttcttcgggatgcaggcacctagtatctggcagtggggacaagagaacaaggtatatgcttgtatgatggtgttcttcctgtccaatatgatcgaaaaccaatgcatgtcaactggagcatttgagatcaccctgaacgatgtaccagtgtggagtaagctggaatccgggcaccttccttctatgcaacagctcgtgcagatcctagacaatgagatgaaactcaacgtccacatggactccatcccacaccatagaagctag

SEQ ID NO: 59633 - DNA, 1041 bp, Artificial Sequence
  Description of Artificial Sequence: Synthetic coding sequence
  Description of Combined DNA/RNA Molecule: Synthetic coding sequence
atgaacaaccaggcccgtacccccgctccatcctcagcaagaaccagcaccagtgttcgagcctccacgcccacacgcacaccaacacccctgcgtacccctaccccagtccggacacggactcctataagaacgcttacccctgttcttactccgagccctgccggaacttccccattagtgcttacccctgcccctgcccagatccctacacttgtgccgaccccagcactggctaggattcctcgccttgtgccaccccctgccccagcttggatacccacacctgtgccaacaccggtacctgtgcggaaccccacaccagtgcctacacccgctcgcaccctaacaccacctgtgcgggtgcctgctcccgctccagcacaactgctggccggaattagagcggcattaccagtgctggactcctacctggccccagccctgccgctggaccctcccccagaaccggctcccgagctccctctcctcccagaagaggatcccgagcccgcaccttctctgaagctgattccctcagtttccagtgaggcaggccctgcgccaggacctttgcctacacgaacccctctggccgcaaacagtccgggacccacacttgacttcacctttagagccgatccatctgcaatcgggttagccgacccaccgatcccctctccagtgcccagcccaattctgggcactatccccagcgccatctctcttcagaattgtactgaaaccttcccaagcagctctgaaaacttcgccctggataaaagagtcctcatacgggtgacctactgcgggctgugatcctattcgcttcggtacattctccttaaaaaaagcttggagcaacagttcccaaatcacctgctatttgaggaggatcgggcagctcaggctactggcgagttcgaggtattcgtgaatgggcgtctggtccacagtaaaaagcgtggtgacggatttgttaacgagagtaggttgcagaaaatcgtaagcgtgatcgacgaagaaattaagaagcggtag

SEQ ID NO: 59634 - DNA, 1041 bp, Artificial Sequence
  Description of Artificial Sequence: Synthetic coding sequence
atgaacaaccaggctcgtacccccgcaccgagcagtgctcgcacgtccacgtccgttcgggcatcgacccctacacggacgcctactcccctgagaactcctacccccgtccgtactcgtacacccattagaacgttgactcctgtgctgaccccatcacccgcaggcacctcacccctcgtcctgacacctgctcctgcccagatccccaccctcgtgccaactcctgctctggctagaattcccaggcttgtcccaccacccgcaccagcatggataccaacccctgtccccacccccgtgccagtccgcaacccaacccctgtcccaacacccgctcggaccctgacaccgcctgttcgtgtgcccgctccagcccctgcacaactgctcgccggaattagagcagccttgcctgttcttgacagttatctcgctccagctctacctctggatccccctccggagcccgctccagagctccctctgctccctgaagaggacccagagcccgctcctagcctgaagcttattccttctgttagctcggaggccggtcctgctccgggaccacttcctacaagaaccccattggcggctaacagccccggtcccacgcttgactttacctttagagctgacccgtctgccattggcctggccgatccccctataccctcacctgtgccaagtccaatattgggaacaattccttcagcaattagtttacagaactgtaccgaaacattcccctcttcctctgagaattttgcgctcgacaagagggtgctgatacgtgttacatattgctttatccattcttactcactgcgatatatcctgcttaaaaagtctttagaacagcagtttccaaatcacttgttgttcgaggaggatcgagctgcccaggctactggggaattcgaagtgttcgtgaatgggagactggtgcattccaaaaagaggggcgatggcttcgtcaacgagtcaagactccagaaaatcgtgagtgtcatcgacgaggagatcaaaaagcgttag

SEQ ID NO: 59635 - DNA, 2250 bp, Artificial Sequence
  Description of Artificial Sequence: Synthetic coding sequence
atgggcagggctggtgcagcagctgtcattcccggtcttgcgctattgtgggctgtgggcctgggctccgctgctccttccccccctcgcctgagattgagtttccaggagctgcaagcctggcatggtctgcagacctttagcttggagagaacatgctgctaccaggcgttacttgtcgacgaggagcggggacgtctgtttgttggggcagaaaatcacgtagcctcactcaatctcgacaatatttccaaaagggcaaagaagcttgcttggcccgctcctgtggaatggcgagaagagtgtaactgggccggaaaggacatcggaactgagtgcatgaactttgtcaagcttttacacgcctataataggactcacctactcgcgtgcggcacgggcgcatttcatccaacttgtgcttttgttgaagttggccaccgcgctgaagagccagttttgcgcctagatccagggaggatagaggatggcaaggggaagagcccctacgatccaaggcatcgcgctgcaagcgtgctggtcggagaggaattgtattctggtgtggcagctgacttgatgggtcgggattttacgatttttagaagtttagggcagaggcctagcctgaggacggaacctcacgacagtagatggctgaatgagcccaaatttgtcaaggttttctggatccctgaatctgagaatcccgatgacgacaagatctatttcttcttccgggagaccgctgttgaggctgccccagcacttggacgcttgtcagtcagtcgagtggggcagatctgcagaaatgacgtgggcggacaacgatcattggtgaacaagtggactacatttttaaaggccagacttgtctgtagcgtgcccggagtggagggcgacacacacttcgatcaactgcaggatgtgtttttgctgtccagtagggaccatcgtacacctctgctgtacgcggtgttttcaacaagtagttcgatcttccagggctcagctgtgtgcgtatacagcatgaacgatgttaggagagccttcttgggcccttttgctcacaaagaaggtccaatgcatcagtgggtgtcctatcagggaagagtcccctacccgaggccaggcatgtgtccaagcaaaacttttggaacgttttccagcacaaaggattttcccgatgacgtgatccagttcgccagaaatcacccactgatgtataacagcgtgcttccaaccgggggacggcctctgtttctacaggtgggggcaaactacacttttacgcagattgctgctgatcgggtggcagctgcggatggccattacgacgtcctgttcattggcacggatgttggcaccgtgctcaaggtaatctcggtgcccaagggatcaaggccttctgcagaaggattgcttctggaagaactacacgtctttgaagattctgctgccgttacctcgatgcagatatcttctaaacggcaccaattgtatgtagctagtcggtcagctgtcgcacaaattgccctccatcgctgcgctgcacacgggagagtgtgcacggaatgttgcttagctcgtgatccatactgcgcgtgggatggcgtcgcctgcactaggttccagccttctgctaagcggaggtttagacgccaagacgtccggaacggcgatccatctactctgtgttctggcgattcgagtagaccagcactgttggagcacaaagttttcggcgtagagggcagctcagccttcttggaatgcgaacctagatccctccaggctagagtagagtggacattccagcgtgctggagtgacagcccatactcaggtgcttgccgaggagagaaccgagcgcaccgccaggggcctcttattgaggaggcttcgcagacgcgattccggggtgtacctgtgtgccgctgtggagcaaggcttcacccagccactgaggcgactgtctctgcacgttttgtccgctacacaggcagaaaggttagctcgggctgaggaggcggctccagctgctccacctggacctaaattgtggtacagggatttccttcagctggtggagccaggtggcggaggaagcgctaactcacttcgcatgtgccgcccacagcctgcactacagagcctaccactcgagtccagaaggaagggtcggaatagaaggactcacgccccagaacctagagctgaacgagggcctcgatctgccacacattggtag

SEQ ID NO: 59636 - DNA, 444 bp, Artificial Sequence
  Description of Artificial Sequence: Synthetic coding sequence
atgggcggatgcatgcatagtacccaagacaaaagcttgcacctcgagggagaccctaacccctcagctgccccaactagtacgtgcgccccaagaaagatgccaaagagaatctccattagcaagcagctcgctagcgtgaaagccctgcgcaaatgttcagacctcgaaaaagccatcgctacgactgctttgatatttcggaactcttccgacagtgatggcaagttagagaaagcgatcgccaaagacctgttgcagactcagttcagaaactttgcagagggacaggaaacaaagccaaaatacagggagatcctgagcgagctggacgagcacaccgaaaacaaattggatttcgaggacttcatgatccttttgctgtccatcactgtgatgagtgacctgctccagaacatccgtaatgtgaagattatgaagtag

SEQ ID NO: 59637 - DNA, 279 bp, Artificial Sequence
  Description of Artificial Sequence: Synthetic coding sequence
atggagcagagtaaggtgcttattaaggaggggggagtgcagttgttgctgactatcgttgacaccccagggttcggtgatgctgtggataatagcaactgctggcagcccgctatcaattatattgactctaagtttgaagactatcttaacgccgagtccagggttaaccgctgtcagatgccagggaacagggtccaatgttgtctgtatttcatagctccctcggggcacggctggcaaaccagaaacatggattactgcgtggaatttcattag

SEQ ID NO: 59638 - DNA, 279 bp, Artificial Sequence
  Description of Artificial Sequence: Synthetic coding sequence
atggagcagtctaaagtactgatcaaggagggcggtgtccaactcctactgaccattgtcgatacccctggcttcggggatgcagtcgacaattcgaactgttggcagcctgctattaactacattgactccaaattcgaagattatctgaacgctgagagtcgagtcaaccgctgccaaatgccaggcaatcgggtgcagtgctgtctgtattttatcgccccaagcgggcacggttggcagacaagaaacatggattactgcgtcgaattccactag

SEQ ID NO: 59639 - DNA, 1269 bp, Artificial Sequence
  Description of Artificial Sequence: Synthetic coding sequence
atggagccgcctgcttcaaaagtcccagaggtgcctaccgccccagccactgacgccgctcctaagagggtggaaattcagatgcctaagccagccgaggcccctacggccccttcccccgctcagactctggagaactcggagcctgcgccagtgtcccaactgcaatcccggttggaacctaagccccagcctccagtggccgaggcgactcccaggagccaggaggccactgaggccgcaccatcttgtgtgggagacatggctgacacacctcgggacgccggtctcaaacaggcaccagccagtcgaaacgaaaaggctccggttgatttcggttatgtgggcatcgactccatcctcgaacaaatgcgacggaaagccatgaaacaaggctttgagtttaatatcatggtggtggggcagtccggccttggaaagtccacattaattaatacactgttcaagtctaagatttctagaaagtccgtgcagcccacgtctgaagagagaatccctaaaacaatagagattaagtcaatcacccacgacattgaggaaaaaggggtccgtatgaaactgacagtgatcgacaccccaggatttggcgaccatattaataatgaaaactgttggcaacctataatgaagttcatcaacgaccagtacgaaaagtatctgcaggaggaagtgaacataaacaggaagaaacggattccagacactcgcgtccattgctgcctgtatttcattcctgcgaccggccacagtctgaggccactggacattgagttcatgaaaagactctccaaggtcgtgaacattgttccagtcattgcaaaggccgacacattaacccttgaagagcgagtgcacttcaagcagagaattacggccgatttactgtctaatgggatcgacgtatatcctcagaaagagtttgatgaggacagcgaggaccgtcttgtcaacgagaaatttagagagatgattccgttcgccgtggtcggctccgatcacgaatatcaggttaacggtaaacggatactcggaaggaagacaaagtggggaacaatagaagtggagaacacgacacattgtgagtttgcctatttgcgcgacctgctgatcaggacacacatgcagaacattaaggatattaccagcagcatccactttgaggcttatcgggtaaagaggctgaacgaggggtctagtgcaatggctaacgggatggaggaaaaggaacccgaagcccctgaaatgtag

SEQ ID NO: 59640 - DNA, 1269 bp, Artificial Sequence
  Description of Artificial Sequence: Synthetic coding sequence
atggagcccccagcatccaaggtccccgaagtgccgactgccccagctactgacgccgctcccaagagagtggagatccaaatgcccaagcccgcagaggcacccactgctccttcaccagcacagaccctcgaaaatagcgagcccgcacccgtgtcacagttgcagtcacgccttgagcccaagcctcagcctcccgttgcagaagctacacctcgctcacaagaggccacagaggctgcaccctcttgtgtcggagatatggctgatactcccagggacgccggacttaagcaggctcccgcttctcggaatgagaaagccccagttgactttgggtacgttggcatagattccattctggagcagatgcgtagaaaagcaatgaaacaagggtttgagttcaatatcatggtggtcggccagtccgggttagggaagtccaccctgatcaacactcttttcaaatcaaaaattagccgcaaatcagtacagcctacttcggaagaaagaatcccaaagaccatagagatcaagagcattacacacgacatcgaggaaaaaggtgtacgtatgaaattaacggttatcgacaccccaggtttcggggaccacatcaacaacgagaattgctggcagcccataatgaaattcatcaacgatcagtatgaaaaatatctgcaggaggaagttaacattaacagaaagaagaggatcccagacactagagtacattgctgcttgtacttcatcccagccacagggcacagcctccgtcccctcgatatagaatttatgaagagattgtctaaggtcgtcaacatcgtcccagttattgcaaaagctgacacactgaccctagaagagagagttcattttaagcagcggattacggctgacttgttgtccaacggcattgatgtgtacccacaaaaggaatttgacgaagatagtgaagaccggcttgtgaacgaaaaattccgagaaatgattccgttcgcggttgtggggagcgatcatgagtatcaggttaatggcaagaggattctcggccgaaagaccaaatggggcactatcgaggttgagaacaccacccattgtgagtttgcttatctgcgcgatcttttaattagaactcatatgcagaacattaaggacatcacctccagcattcactttgaggcctatagggtgaaacgcctcaatgagggatccagcgctatggctaatggtatggaggaaaaagagccagaggcaccagaaatgtag

SEQ ID NO: 59641 - DNA, 1008 bp, Artificial Sequence
  Description of Artificial Sequence: Synthetic coding sequence
atggccgatacccctcgagacgctggattgaagcaagctcctgcttccaggaatgaaaaggcccctgttgatttcggctatgtgggaattgactccatcttggaacagatgagaagaaaagctatgaagcagggatttgagtttaatattatggtggttggtcagagtgggcttggtaaatcaactctgataaatacactgttcaagtccaagatcagcaggaagtccgtgcagccaactagcgaagagcgcattcccaaaactatagaaattaaatcaatcacacatgatatcgaggagaagggcgtgcgtatgaagcttacggttatcgacactcccggatttggtgaccatataaacaacgagaactgctggcagccgatcatgaagtttatcaacgatcagtacgaaaaatacctgcaagaggaagtgaacatcaacagaaaaaaaaggataccagacacccgcgtgcattgttgtctgtattttatccccgctactggtcactcactgcgccctctagacatcgagtttatgaagaggctgtctaaagttgtgaatattgtgcccgttatcgctaaggctgataccttaaccctggaggaaagggttcactttaagcagcggattacagctgacctcctctccaatggcattgacgtatacccacagaaagaattcgatgaagattccgaagataggctggtcaatgagaagtttcgagaaatgattccgttcgctgtggtgggttccgatcacgaataccaggtgaacgggaagagaattctgggccgtaagacaaagtggggcactattgaggtcgagaacacaacgcactgtgaattcgcatacctgcgcgatctgcttatccgaactcacatgcagaatatcaaagacataacgagctccattcactttgaggcctatagagtaaagcgcctcaatgaaggtagtagcgcaatggcaaacggcatggaggaaaaagaacccgaagcacccgagatgtag

SEQ ID NO: 59642 - DNA, 1707 bp, Artificial Sequence
  Description of Artificial Sequence: Synthetic coding sequence
atggaacgggatcgaatctccgccctgaagagatctttcgaggtagaggaggttgaaactccaaacagtacccccccacgaagggttcagactccactgcttcgcgcaacagtggcaagtagcactcagaagtttcaggatctgggcgtcaaaaactccgaaccttcggcgagacatgtggattcactgagtcagcgcagccctaaggcatcccttcgacgtgtggaactctctggaccgaaggccgctgaacctgtctcccggcgaacggaattgtctattgacatcagtagtaagcaagttgagaacgcgggagcaattggcccaagtagattcggactgaagagagctgaggtactgggccacaaaacaccggagcccgctcccagacgtacggagattacaatagtaaagccacaggaatcagcacatagacgtatggagccccctgcttccaaggttcccgaagttccaactgctccggctacggatgcagctccgaagagagtggagatccagatgcctaagcctgctgaggcgcctaccgcacctagcccagcacagaccctggagaactctgaacctgcccctgtatcccagctccagtctcggcttgagcccaaaccacagcccccagtggccgaagctacacccaggtcacaggaggcaactgaagccgcaccatcttgcgtgggcgatatggcagatactcccagggatgccggtttgaaacaggctcccgcaagtagaaacgagaaggcccctgtcgacttcggttatgtaggtatagattctattttggaacagatgcgccgaaaggccatgaagcagggttttgaatttaacatcatggtcgtggggcagtctgggctcggaaagtccaccctaattaatactctgtttaaatcaaagattagccggaaaagcgtccaacctacttcggaagaacgtattccaaagaccattgagatcaagtcgattacccatgatattgaagaaaagggtgttcggatgaagctaactgtgatagacactcccggattcggcgaccatatcaacaatgaaaattgctggcagcccattatgaagttcattaatgatcagtacgagaagtatttgcaggaagaagtgaacatcaataggaaaaagagaattccggatacccgtgttcactgctgcctttacttcatacctgcaaccggtcattccctgaggccactggatatcgagtttatgaagcgtctctccaaagttgtaaacattgtaccagtcattgctaaggccgataccctgaccctcgaagaacgcgtccatttcaaacagcgtatcaccgcggatttactttcaaatgggatcgatgtttatccgcaaaaggaatttgacgaggattctgaggacaggcttgtaaacgaaaagtttcgagagatgataccgttcgccgtagtcgggagcgaccacgagtatcaggtcaatggcaagcggatcctcgggcgtaagactaaatggggtacaatagaggtggaaaacaccactcactgtgagttcgcttatctgcgtgacctgctcataagaacacacatgcagaacatcaaagacatcacatcgtctatccatttcgaggcatacagagtcaagagactgaacgagggctcctctgccatggctaatggtatggaagaaaaagaaccagaagcaccagaaatgtag

SEQ ID NO: 59643 - DNA, 1368 bp, Artificial Sequence
  Description of Artificial Sequence: Synthetic coding sequence
atgggcgcttgcctcggggcttgtagcttgttgtcctgtgcttcctgcctctgtgggagcgctccctgcattctgtgcagctgctgtcctgcctctaggaattctaccgttagtagattgatctttactttctttttgtttctcggagtgctagtctctatcatcatgctgtctccaggggtggaaagccaactgtataaactcccatgggtctgcgaggaaggagccggaattcccaccgtgttgcaagggcatatagattgtgggtcactgcttggctacagagccgtttacagaatgtgtttcgcaactgctgccttttttttcttctttaccctattgatgctgtgtgtatcctcctcacgggatcccagagccgctatacagaacggtttctggttcttcaaattcctgatcctcgtgggcctgactgtcggagccttttacatccccgacgggtccttcactaacatctggttctattttggagtagttggctcttttctcttcatcctcatccagcttgtgcttctgattgattttgcgcactcgtggaaccagcgctggttggggaaggccgaagagtgtgatagccgggcatggtacgctggactctttttcttcactcttctgttttatctgctgagcatagcagccgtggcactgatgttcatgtactacacggaacctagcgggtgccatgaggggaaggtgttcatttcactcaacctcactttttgcgtttgcgtgagtattgctgccgtgctgccaaaggttcaggacgctcagcctaactctggacttttacaagcgtcggtgattacgctttacacaatgtttgtgacatggtcggctctgtcttcaattccggaacagaagtgtaacccacacttgccaactcagttggggaacgagaccgtagtggccggaccagaaggttacgagactcagtggtgggatgcccctagtatagtaggtctcattattttcctcctgtgcaccctgttcattagcctgaggagcagcgatcaccgacaggtgaattccctaatgcagaccgaggaatgtcctccaatgcttgatgccacacagcagcagcagcaggtggccgcttgcgagggcagggctttcgataacgagcaggacggtgtcacttattcttactccttcttccatttctgccttgttttagcatcactgcacgtcatgatgacactgaccaactggtacaaacctggcgaaacgcgaaaaatgattagtacttggaccgctgtctgggtgaagatatgcgccagttgggcaggtctgctactatacctgtggacccttgtcgcccctctgctgttaaggaatagagattttagctag

SEQ ID NO: 59644 - DNA, 294 bp, Artificial Sequence
  Description of Artificial Sequence: Synthetic coding sequence
atgaagggaatttgtagcgacgcaatactggttttagcaaccagcatgtggatggcgttcgcaatcgattttccccttcctatggcaagcgaaagaggacagctagataagaccatagttgaatgtctcaagaacgtgaacaagtgttggtttctgtcttacataaaaccctcagaacccatctgcggctccgaccaggtcacttactcttctgactgtcacctgtgctccaaaattctcttcgaaggattaaacatcacaaagctttacgacggacagtgtgaaaacagttag

SEQ ID NO: 59645 - DNA, 1794 bp, Artificial Sequence
  Description of Artificial Sequence: Synthetic coding sequence
atgtcaagtaccgtcaacaatggtgccgcatccatgcaaagcactccggacgcggcaaatggctttccacagcctagctcctcgtccgggacttggccacgcgctgaagaggaattacgcgcagcggagcccggattggttaaacgagcacatagagaaatcctcgatcacgaaaggaaacgacgcgtcgagctcaagtgcatggaactacaggagatgatggaagagcaaggctatagcgaggaggagatcaggcagaaggtgggtacctttcgccagatgttgatggagaaggaaggggtccttactcgggaagacagacccggtgggcacatcgtagcagagacaccccgtttgacagaaggagcggaacccggattggaatacgcaccctttgatgacgacgacggtcctgtcgattgcgactgtccggcatcgtgttaccgagggcacagaggatacaggaccaaacactggagctcttctagtgcctccccacctcccaaaaagaaaaagaagaagaagggagggcacagacggagtcgtaagaagcgaagattagaaagcgagtgttcttgtggcagtagctcgccacttagaaagaagaaaaaaagcgtgaaaaaacatagacgtgaccgaagtgacagcggctcccgaaggaaaagaaggcatcggtctagatctagcaaatgcaagcgcaaagaaaaaaataaggaaaagaagagacctcacactgagtcacctggtcgaagatcacatcggcactcctctgggtcgtcccacagcccatccctttcctctcattatagtgatagccgtagtccgtccagactgagcccaaaacatcgggatgaggggcgtaagacgggttctcagaggtcttccggttccagatctccgagcccttctggtggcagtggttggggaagccctcagcgaaacggcggatccggtcagcgaagcggcgcacatggaggcagaccaggttcagctcattcgccacccgataagccaagcagtccaagcccaagagtccgcgacaaggcagctgccgctgcaccgaccccaccagccaggggcaaagaatcaccctcacctcgcagcgccccttcatcccagggacgcggaggccgtgctgctggaggagcaggccgacggaggcgaagaagaagacggaggagaagaagcaggtcatccgcaagcgccccacgtaggcgcggaagaaggaggccccgacccgctcccccacgaggaagctcacgctccctttctcgcgctagaagttcgtcggattcaggcagtgggcgaggcgcacccggacctggccctgagccaggaagcgagcggggtcacggcggtcacggcaagcgagccaaggagagaccccctcgcgcacgcccagcctccactagtccttctcccggagctcacggcagacgaggcggacctgaggggaagtcttcatcccggtcccctggacctcatcctcgttcctggtctagcagtcgctcgcccagtaaatctcgtagcagatcggcggaaaaacgtcctcatagtccttcccgtagtccttccccaaagaagcccctttcacgggataaagacggtgagggcagagccagacactcagaggccgaggccacacgtgcccgacggaggagtcgttcttactccccgatacgtaaaaggcgccgagactcaccttcatttatggaaccgagacggatcacatctgctgctagcgttctgtttcataccactggccctgctccattgcctccacctgccgcttag

SEQ ID NO: 59646 - DNA, 1962 bp, Artificial Sequence
  Description of Artificial Sequence: Synthetic coding sequence
atgtcgtcgacagtgaacaatggcgcagcttcaatgcagtcgactccagatgcggcaaacggttttccgcagccctcatccagttctggtacctggcctcgtgctgaagaggaactgcgggctgcagagcctggcctggtcaagcgcgctcaccgcgaaatactcgatcacgagaggaagaggagagtagagctcaaatgtatggagctccaggagatgatggaggagcaaggatatagtgaggaagagatcagacaaaaggtgggaacatttagacagatgctcatggaaaaggagggcgtgctgacccgagaggacaggcccggagggcatatcgtggctgaaactccaagactcactgaaggcgctgaaccgggattagagtatgccccttttgatgacgatgatggcccagtcgattgtgactgtccagcttcatgctatcgcggacaccgcggataccgaacaaaacactggtccagtagctcagcttcccctcctccaaagaagaaaaaaaagaagaaggggggtcatcgccgatcccgcaagaagaggcgcctggagtctgaatgttcctgtggatcctcaagcccacttcgtaagaagaaaaaatccgtgaaaaagcatcgcagagaccggtctgatagcggttccaggaggaagcgcagacacaggtcccgaagtagtaagtgcaaacgaaaagagaagaacaaggagaaaaagcgcccacataccgagagtcccggacgcaggagtcaccggcattcctcaggcagttctcacagcccctcactgtcctctcactattccgattcccgctccccatccagattgagcccgaaacatagggacgaggggaggaagacaggaagtcagcgaagcagcggttcgaggtccccttccccatccggtggttcaggttggggatctccgcaacggaacggagggtcaggtcagagatccggggctcacggcggacggcctgggagcgcgcattcaccccctgacaagcccagtagcccatcaccacgggtgcgcgacaaagctgccgctgctgccccaacacctcccgctcggggaaaagagagccctagcccccgatcggccccttcatctcaaggacgtggaggccgagccgcagggggtgccggacgccgaagaagacggaggcggagacggaggaggtcacgctcaagcgccagtgcccctcgccgtagagggaggaggcgccctcgcccagccccaccgagggggagttcacggagcttatcccgcgcacgatcttcatcggactccggctcaggccgtggagcccctggcccaggtccggagcccggatctgagcggggtcatggtggccacggaaagcgtgccaaagaacggccaccgagggccaggcctgcctcaacgagtccttctcccggtgctcatggtcgtaggggaggtccagagggaaaatcatctagcaggtcccccggtcctcaccccagatcgtggtcatcctccaggagccccagcaagagcaggtccaggtcagccgaaaagagaccccattccccttctaggagcccgagtcctaaaaagccactgtccagggacaaagacggggagggtcgcgctaggcactcggaagccgaagctaccagggcaagacgaaggagcaggtcatactctcctataaggaaacggaggagggacagcccatcattcatggagcctaggaggatcaccagacggcgaaagcgaccaattccctattataggccttcacctagcagttcctcctcctgcctctcaagtgattattcaactcgatcccatagccgctctcctagtccgggacatagtcacgggagttattcctcgaggagtcacgggacccggagccgaactaggtccccctcgaggaccccgagtcccagctatcattcacggtcttctagcgagtcagggggattttag

SEQ ID NO: 59647 - DNA, 1794 bp, Artificial Sequence
  Description of Artificial Sequence: Synthetic coding sequence
atgagcagcacggtgaataacggggcagcctccatgcagtccacccccgacgctgccaacggattccctcagccatcgtcctcaagcgggacgtggccgagagcagaggaagagcttcgcgcagccgaacccggtctggtaaagcgcgcacatcgagaaattctcgatcatgagagaaaacgcagggttgagctgaaatgcatggagctgcaggaaatgatggaggagcaggggtattctgaggaagagatccgtcagaaggtgggaacattccgacagatgttgatggaaaaggaaggagtactgaccagggaagatcgcccaggcggtcatatcgtggctgagaccccacgcttaaccgaaggggctgaaccaggcttggaatacgctccattcgacgatgacgacggacccgtggattgcgattgccctgcaagctgctatcgcggtcaccgcggttaccgaactaagcactggtcctcgtcatcagcatctcctccaccaaagaagaagaagaagaagaaggggggacacagacgctctagaaaaaagcgcaggctcgagtctgaatgcagctgcggctctagctctccactgcgaaaaaaaaaaaagtcagtgaagaaacacagacgtgacagaagtgactctggtagtaggcgcaaaagaaggcatagaagcaggtctagcaaatgtaagcgcaaggaaaagaataaggagaagaaaaggcctcacacggagagcccaggacgcaggagccacaggcactcgtcaggcagctcacatagccctagcctgagctcgcattacagcgacagcaggtccccttcccggctctcccccaagcaccgggatgagggaaggaagacgggttcccagaggagctcaggcagcaggagtccctctccttccggaggcagtggatgggggtctccacaaagaaacggaggatccgggcagcgatccggggcacatgggggaaggcctggctctgcccattcccctcccgataagcccagttctccatctcctagggtccgggataaggcggcagccgcagccccaaccccacctgcacggggaaaagaatctccttcacccaggagcgcaccgagttctcaggggaggggaggacgcgctgcaggtggcgcaggcaggagaaggaggcgcaggcgccgaagaagaagatctaggagcagcgccagtgcaccacggagacgcggtcggaggcgaccgagacctgctcctccccgaggcagtagccgctctctgagtagggctcgctctagctccgacagcgggtctggccgtggtgcaccaggccctggcccagaacctggatctgagcggggtcacggtggacacgggaagcgcgcaaaggagaggcctcctcgcgctcggcctgcctctacttccccgagtcccggtgctcatggtcgacgaggcggtcctgaagggaaatcatcgagtcggtctcccggaccccaccctcgcagttggagctcttccaggtctccttccaagtctcgtagtcggagtgctgagaagcggccacatagtccgagtaggtcccccagtccaaaaaagcccctctcgagggataaggacggggaaggaagggctaggcattccgaagccgaagcaacgagggcacgtaggcgaagtcgctcctattctcctataagaaagcgaagaagagatagtccttcattcatggagccaaggcgcatcacctccgccgctagtgtgttgtttcataccactggtcccgcaccactccctccacccgctgcgtag

SEQ ID NO: 59648 - DNA, 1962 bp, Artificial Sequence
  Description of Artificial Sequence: Synthetic coding sequence
atgtccagcaccgtaaacaacggagcagctagcatgcaatctacccccgatgcagccaatggtttcccccagcccagttcttcctctggaacctggccccgagccgaagaggaactaagggccgctgagccaggacttgtgaaacgcgctcatagagaaatcctcgatcatgagcggaaaaggagagtggaactgaaatgcatggagctacaggagatgatggaggaacagggctactcagaggaagagatcagacaaaaggtcggtacctttagacagatgctgatggagaaggagggggtcctgactagagaagacaggcccggtgggcacatcgtcgcagaaaccccacggttgaccgaaggagctgaacccggacttgaatatgcgccttttgacgacgatgatgggccagtcgattgcgattgcccggcttcctgttacaggggccatcgtggctaccgcaccaaacactggagttcttctagtgctagccctccccctaagaaaaaaaaaaagaaaaaggggggacatagacgctctcgcaagaagcgcaggttggaaagtgaatgctcgtgcggtagcagcagccccctcagaaagaagaaaaaatcagtcaagaagcaccggcgtgaccggtccgatagtggaagccggcgtaagaggcgacatagatccaggtcgagcaagtgcaaaaggaaagagaaaaacaaggagaagaagcgtcctcacacagaaagcccgggacggaggagccacaggcactcctccgggtcaagccactctccatctctgtccagtcactacagcgacagcaggtctccatctagacttagtcccaagcacagagacgaaggtagaaaaacaggaagtcagcggtcctcaggatctcgatctccctccccatcaggaggctccggttggggtagccctcagaggaacgggggttcaggtcaacggtcaggggcacatggcggacggcctgggtctgcccactcaccaccagacaagccaagcagcccatctcctcgagttcgggacaaagcggctgccgcagcccctactcctcccgctcgcggtaaagagagtcccagtcccaggagcgctccaagctcccagggaagaggcggaagggccgctggaggggctggcagacgcaggaggaggagacgtcgtaggaggcgaagcagatcgtccgcctctgcgccacgcagacgtggaagacggagaccacgcccagcacccccacgcggtagctctcgctccctgtctcgcgcaaggtcttctagcgattcaggaagtggtcgaggcgctcctggcccaggcccagaacccggatcggagagaggacatggcggtcatggaaagcgagccaaggagaggcctcctcgagcacggcctgcttctaccagcccttctcctggagcccatgggaggaggggaggcccagaaggcaaaagcagcagtcggagtccgggaccccatccacgaagctggagctcaagcagatccccatctaaaagtagatctcgcagcgcggaaaagagaccccattctcctagcaggtcccccagcccaaaaaaacctctaagtcgggacaaagacggcgagggccgtgcgcgacactctgaggcggaagctaccagagctaggcgacgatcaagaagctacagccccatacggaagcgcagacgagacagcccatcatttatggagcctcgccgaataacacggcgtaggaagaggccaattccctactaccggccaagcccgtctagtagttcctcctgcctctcttccgattattccactagatctcacagtcgttcgccctcccctggacactctcacggctcttacagtagcagatcacacggaacgcgtagcagaaccagatctccctcccgcacaccgtctccttcataccactctcgcagctcttccgagtccggtggattctag

SEQ ID NO: 59649 - DNA, 2148 bp, Artificial Sequence
  Description of Artificial Sequence: Synthetic coding sequence
atgagctctcctaagagatcatcaaaaccatccatgtcccttgcaccttcgggttcctctatgccaacagccgatccaaaaccccctgccagcttaaagtcaaccaagtcagctacccccaaccgtagcctcgttccgactaagcccgctacatcacgcaattcagtcatgagtccgtcctctagtaagagtacaaagtcaacatctacgaaacgggctcccagtaatcgacccagctctcgttctcgggtgcggagcaaggccaggacaccgtctcgtgtaagtactgataccaggacgagtaaagcttccaaagcaagcgacgttcggtgccatcagaggcgaggtacccattctagggggagaactcccggtcgtcgcggtagccggtccagcaagagaagtccatcacgggctagtactcccggacgcatccgaacccacggcgctaggccaggtatggcgtcccgggtaaggacacctacttcacagcagaaggggtccaggggcaagagctatggccgacctaggacctctaatagggagaggagtgactcccagccgaggaacctgtctaagaagagttataggcccccaggaggaagcggaatcggaaggtcaagtgaactggcagtgacacctagcaccgctaaatgccagaccccaaccggcatcccgtccaaggaaaagtcagataatccttccccctcttcctcacgaaaggtgaagagctatgggcagatgatcatcccttcacgcgaaaagtcctactccccaactgagatgtcatccagggttaaatcttataatcaggcaagtacccgcagtagaccccaatctcacagtcagtcacgatctccacgtaggtcaaggagtggctcccagaaacgaactcattcgcgcgtgaggtcccactcctggaagaggaatcacagcagagcacgctctagaaccaggaaaggtatccttagtcagatgggcaggcattcccaatcccgaagccatagtaagggaaaatctcagaatcagagtcgaacacctcggagagggaggagtcacaattggtccagaaacccttctaaggagcggagccattcccattcacggtcatcttctaaggagagggatcatcgcggaagcagtagtccacggaaagagagcggccgttcgcagtctggctcgccgaacaagcagcgggaccattccagaagcaggagtcctaacaaagctcgtgaccggtccagaagccgaagtccttataaagctcgcgacaggtcacggagtcgatctcccaataaggccagagactgctctagatcccgttccccatataaagcgagggaccgttcccgatctcggtccccaaacaaagcccgtgaccacagccggtcccgctctcctaacaaggcacgcgatcggtccaggtctaggagcccgtcaaaggaaagagatcactcacagctggggtccccctccaaagaaagggatcatagacggtctcgctccccttcaaaggaacgccaatgtaggcagtcacggtcctcttcaaaggagcgtgatcaccgccgttcccgcagtccttccaaggagaggcaaagacggcaatcccggtcccccaataaagaacgggatcgctcgcagtcacggagtccttctgaggagagggaacaccggcagagtagaagcccatcaaaagagagagaccgacggagatggaggagcccatcaaaggagcgtgagcggcgacaatcaaggagctctagcgaagagagagaccattctaggtcacgaagccctaataagcaatcagggtactcaagacctagggcctcttctaaggaaaaagcacacagcagatccaggactccttcaaaagagggaaaccattctcagtcccgcacctcaagcaaggagtcggatccttctcaatcgaccgtacccaggtcccccgactggaagcgctcacccaccaggacctcctccttgtcacagaatagaactcctagtaagaccagctcacactccccaagcacttttccttcagggggacaaacgttgtcccaagacgactcccaagctgatgcaacaacatccaaagctacactgcctggggaaaggtctagcagctccagcagtaagctcgcctag

SEQ ID NO: 59650 - DNA, 2193 bp, Artificial Sequence
  Description of Artificial Sequence: Synthetic coding sequence
atgagtaccgtgactagtaggactacatctccctttgccccaaccatgtcctctccaaaacgatcatccaagccctcgatgagccttgctccttcagggtcatcaatgccaacagctgaccccaagccacctgcctccctgaaatctacaaaaagcgcgacccctaatcgctctctggtcccgaccaagccagcaacctctagaaactcggtaatgtccccctcatcctctaaaagcaccaagtcaaccagtaccaagcgagcaccctcaaatagaccgagttcgcgttcaagagtgcgcagcaaagcgaggacacctagtcgggtttcaactgatacgcggacttccaaggcctccaaggcaagcgacgtgaggtgtcatcaaaggaggggtacgcactctcggggacgaactccaggaagaagaggctccaggagttcaaaacgctcgcctagtcgagccagtacccctggccgtatccgtacccacggagctcgacccggaatggcaagtagggtgaggacacccactagccagcagaagggcagtcgcggaaaatcatacgggaggccacgaacctcgaatcgcgagcgctctgactcacagccaaggaatctcagcaagaagagctataggcctccagggggtagcgggattgggcgaagcagcgaactcgccgtgacgcctagtacagccaaatgtcaaacacccacgggcataccaagcaaggaaaagtccgacaatccctctccctcctcctctcgcaaggttaagtcctacggacagatgattattcccagccgcgagaagagttactcgcccactgaaatgtcctctcgggtcaagtcatataaccaggcttcaactcggtctaggcctcagagccatagtcagagtcgctcgccccgtaggtctcgcagtggcagccagaaacgaacccatagtcgtgtaaggtcccatagttggaagcgcaaccactcgcgagcacgctcccgcacgagaaagggaatcctctctcaaatgggccgtcattctcagagcaggagccacagcaaaggcaagtctcagaaccagagtagaaccccaagaagagggaggtcacacaactggtcacggaatccgtccaaagaaaggagtcactcccacagccggtcctcatcgaaagagcgggaccaccgtggttcaagcagtccacgaaaggagtcagggaggtctcaaagtggcagccccaacaaacaacgcgaccactcgcgatcaaggagcccgaacaaagccagagaccgctctcgttcacgctctccatacaaagccagagacagaagtcggagccgcagtcctaataaggctagagactgctctcgaagccgcagtccatataaagcaagggaccgcagtcgctcccgctctcccaacaaagcaagggaccattcaagatcccgctccccaaataaggccagggatagatcacgctccaggtccccctcgaaagagcgagatcattcccaactcggcagtccgtccaaagagcgggatcacaggagatcccggtctcccagtaaggagagacagtgtaggcaaagcaggtctagcagcaaggagcgagatcataggcggagtaggtccccatcaaaagagaggcagagaaggcagtctagaagccccaacaaagaaagagatcgtagccaatcaaggtcccccagcgaagaaagagaacatagacagtcccgcagcccatcaaaggaacgcgacaggcggagatggcggagcccttcaaaggagagggaaaggcggcagagcaggagctcaagtgaggaacgggaccacagcagatcgagaagtcccaacaagcagtccgggtattccaggccgagagccagtagcaaagaaaaagcacacagccggagtcgcaccccatcgaaagagggaaatcattcgcagtccaggacctcatcaaaagagagcgaccctagccagtcaacggtgcctcgcagccccgattggaagaggtcacccacccggacgtcatcactgagccagaaccgaacgcccagcaagacctcctcacatagcccctcaaccttcccaagcggaggccagacactgagccaggatgactcccaagcggatgccaccaccagcaaggccacactgccgggtgaacgcagttcatctagctcatcaaagctggcctag

SEQ ID NO: 59651 - DNA, 1191 bp, Artificial Sequence
  Description of Artificial Sequence: Synthetic coding sequence
atgggagctaatacttcacggaagccacctgtctttgacgaaaatgaagatgtaaactttgaccactttgagatcctcagagccattggtaagggctcctttggaaaagtgtgcattgtacaaaagaacgatactaagaagatgtatgctatgaaatacatgaacaagcagaagtgcgtggaaaggaatgaagtgaggaacgtgttcaaggagctccaaattatgcaaggcttagagcaccccttcttggtgaatctttggtacagctttcaagacgaggaggacatgttcatggtagtagatctgctgttaggcggtgatctacgctaccatctgcagcaaaatgttcactttaaggaagaaaccgtgaagctgtttatctgtgaactggttatggctctcgattacctgcaaaatcagagaattatacaccgggatatgaagccagataacattttattagacgagcatggtcatgtgcatatcacagactttaacatcgccgctatgctccccagggagacacagattaccaccatggccggaacaaagccatacatggcaccggagatgttctcaagtaggaaaggagctgggtattcctttgcagtagattggtggtccctgggcgtgaccgcctatgagctcctgagaggcaggcggccataccacatccgaagcagcacctcatccaaagagatcgtgcacacattcgagaccactgtggtgacataccccagcgcttggtcacaagagatggtctcactgctgaaaaaactcttggagcctaacccagaccagcgattctcacagttatctgatgtacagaactttccttacatgaacgacatcaattgggacgcagtgtttcagaaacgactcattcctggattcatccctaataaggggcgactgaactgcgatcccacattcgagcttgaagagatgatactcgaatctaaacccctgcacaaaaagaaaaaaagactggccaagaaagagaaagacatgcggaagtgcgattcctctcaaacttgcctgttgcaggagcatctggacagtgtccaaaaggagttcataatcttcaaccgagagaaggtgaatagagatttcaataaaagacagcctaacttggctctggaacaaactaaggatccacagggcgaggatggacagaacaataacctgtag

SEQ ID NO: 59652 - DNA, 501 bp, Artificial Sequence
  Description of Artificial Sequence: Synthetic coding sequence
atgggagccaacacttccaggaagccccctgtgttcgatgaaaatgaagatgtgaacttcgatcatttcgagatactgagggcaatcggcaaagggtcattcgggaaagtgtgtattgttcagaaaaatgatactaaaaagatgtacgcaatgaaatacatgaacaaacagaaatgtgtggagcggaatgaggtcagaaacgtgtttaaagaacttcagatcatgcaggggttagagcacccatttctcgtcaatctctggtatagctttcaggatgaagaggatatgtttatggtggtcgatcttctgctgggcggtgacctgcggtaccacctccagcagaacgtccacttcaaggaagagacagtcaagctttttatttgcgaattggtcatggctctggactacctgcagaaccagcgtatcatccaccgagatatgaagcccgacaacatcctgttagatgaacacgttcaacaatacaccctaaaaagtcattag

SEQ ID NO: 59653 - DNA, 501 bp, Artificial Sequence
  Description of Artificial Sequence: Synthetic coding sequence
atgggagccaatacctctcgaaaacctcctgtgtttgacgaaaatgaagacgtaaactttgaccactttgaaatcctcagagctatcggcaaaggtagcttcgggaaagtgtgtattgtgcagaagaacgacactaaaaaaatgtatgctatgaagtatatgaacaagcaaaaatgcgtcgaacggaacgaggttagaaacgtctttaaagagttgcagatcatgcagggactggaacatccttttttagtgaacctgtggtactccttccaggatgaagaggatatgtttatggtcgttgacctgctccttggaggagacctcagataccatctgcaacagaacgtacacttcaaggaggagacggtgaagttgtttatatgcgagctggtgatggcacttgactatttgcagaaccagaggatcatccaccgagatatgaagccggataatattctgttggatgaacatgacacctggctgtcctacaagtcccattag

SEQ ID NO: 59654 - DNA, 1245 bp, Artificial Sequence
  Description of Artificial Sequence: Synthetic coding sequence
atgggcggaaatcactctcacaaaccacccgtgtttgatgagaacgaagaagtcaattttgatcactttcaaatcttacgcgcaatcggcaaaggcagctttggtaaggtatgcattgtgcaaaagagggataccaaaaagatgtacgctatgaaatatatgaacaaacagaagtgtatcgaacgcgacgaagtgcggaacgtgttccgtgagctccaaattatgcagggactcgagcacccttttcttgtaaatctctggtactcctttcaagatgaggaggatatgttcatggtcgtggatcttctgctgggcggtgatttgcgctaccacctgcagcagaatgtacacttcactgagggtactgtcaaactttacatctgtgaacttgcccttgctctggagtacctgcagcgttatcatatcatccatcgggacattaagcctgacaacatcttattagacgagcacggtcacgttcacatcactgatttcaacattgccactgtggtgaagggggctgaaagagcctcctcaatggccggaacaaagccctatatggctccagaggtgtttcaggtatacatggacaggggtccgggatatagctatccggtggattggtggagccttggtatcactgcctatgagctcctgcggggatggcggccttacgagatccactcagtgacccccatagacgagattctcaacatgttcaaagtggaacgggtccattacagctcaacctggtgcaagggcatggtcgcacttctgcggaagctcctgaccaaggacccggaaagccgcgttagtagcttgcatgacattcagagtgtgccgtacctcgctgacatgaattgggacgcggtgtttaagaaggcactcatgcccggatttgtccctaacaaagggcgtctgaactgcgaccccactttcgaattagaagaaatgattttggaatcaaagccgctgcacaaaaagaagaagcggctcgctaagaaccgttccagggacggaaccaaggactcctgccctcttaatggccatctgcaacactgtttagaaaccgtgcgcgaggagtttatcatttttaatagagaaaaacttaggaggcagcagggtcaaggcagtcagctcctcgataccgattcaagaggaggaggccaggcccagtctaaactgcaggatgggtgtaataataatctccttacccacacatgtaccagaggctgtagctcatag

SEQ ID NO: 59655 - DNA, 1104 bp, Artificial Sequence
  Description of Artificial Sequence: Synthetic coding sequence
atgtacgccatgaagtacatgaataaacaaaaatgtatcgagcgcgatgaagtgcggaacgtctttcgggagctgcagattatgcaagggctcgagcacccatttctcgttaacctgtggtatagtttccaggatgaggaggatatgtttatggtggttgacttgctcctggggggagatcttcggtatcacctgcaacagaatgtccatttcactgaggggacagtcaagttatacatctgcgagctggctttggccctggaataccttcagcgatatcacatcatccatagagacatcaagccagataacatcctattagacgagcacggccatgtccatataaccgactttaatatcgcaactgtggtcaagggcgcagagcgggcttccagcatggctggtaccaagccatacatggctccagaggtcttccaagtgtatatggatcgcggaccgggatactcataccctgtagactggtggtcgctaggcattactgcctatgagctccttaggggctggcgcccttatgaaatccacagtgtaacgcctatcgacgagattcttaacatgttcaaagttgaacgcgtgcattacagtagcacttggtgtaaaggaatggtggctttgttacgaaaactactgacaaaagatcctgagagtcgggtgagcagcctacacgatatccagtccgtgccgtacctcgcagatatgaattgggatgcagtgttcaagaaagcactgatgcccggattcgtaccgaacaagggccgattgaattgcgatcccacctttgagcttgaagagatgatcctcgaatccaaacccctccacaagaaaaagaaaaggctagcgaaaaaccgcagcagagatggcaccaaggacagctgccctcttaatggccatctgcagcattgtctggagactgtgcgggaagaatttatcatctttaacagggagaaattgcgcagacagcagggccaggggtcgcaacttctagacacagacagcagaggcggtggtcaggctcagagcaagttgcaggacggttgcaacaataatcttctgacacacacttgcacacgcggatgctccagctag

SEQ ID NO: 59656 - DNA, 1461 bp, Artificial Sequence
  Description of Artificial Sequence: Synthetic coding sequence
atgcgtagcggagcagaaaggcggggaagttctgcggcagccagccccggaagccccccacccggacgcgcaagacctgctggttccgacgccccaagcgcgctgcctccgcctgcagccggtcagcctcgcgcacgagactctggagatgtgcggtcgcagcctaggcccctctttcagtggagtaaatggaagaagagaatgggcagctcgatgtccgctgccacagctagaagacccgtgttcgacgacaaggaagatgtcaatttcgatcattttcagatcctgcgggcaatcggcaaaggctcctttggaaaagtatgcattgtgcaaaaacgtgatacagagaaaatgtacgcgatgaaatatatgaataaacagcagtgcatcgagagggacgaagttcgaaatgtgtttcgggagctggagatcctgcaagagatcgaacacgtttttctagtcaacttgtggtactcatttcaagatgaggaagatatgtttatggtggtagacttgctgctcgggggagacctgcgttaccatttacagcaaaacgttcagttttcggaggatactgttaggctgtacatctgcgaaatggctctggcattagactatctgcggggtcagcatatcattcatcgtgatgtcaagcccgataacattcttctggacgagcgaggccatgctcacttgactgattttaatatcgccacaatcatcaaggacggagaacgagccaccgccttagctggaaccaagccctatatggctcctgaaatctttcattcctttgtgaatggaggtactggctattcattcgaggtcgattggtggagcgtgggagtgatggcttacgagctcttacggggatggagaccctacgacatccactcctccaatgctgtcgaaagtctggtgcagctgttcagcacggtgtcagtgcagtatgtacctacctggtcaaaagagatggtcgctttacttagaaagttgctgaccgtgaatccagagcatcgcctctctagtcttcaagatgtccaggcagccccagctctggccggagtactttgggaccatttatccgaaaagagagtggagcccggattcgtgcccaacaaagggaggttgcattgtgaccccaccttcgagttagaagagatgattctagagtccagaccgctccataagaagaagaagcggttggctaagaacaagagccgtgacaactccagagactcgtcccagtccgaaaacgattacttgcaggattgtctggacgctatccagcaggactttgtgatcttcaaccgtgaaaaactgaaacggtcacaggacctcccgagggagcctctgccagccccagagtcacgggacgccgcagagcccgtagaggatgaggcggaacgcagcgcgctcccaatgtgtggtcctatctgtcccagtgccggatccggatag

SEQ ID NO: 59657 - DNA, 537 bp, Artificial Sequence
  Description of Artificial Sequence: Synthetic coding sequence
tgaggtctggagggcgtggtggtcgacggacaggtagagacagctcgcgtgtggcgaggcgacagacctggaacagaaggcaaggaagagtcgggcatgctaagcgccgtgtggggcgctgggggaccgggagccggaggtgcagctagaggtcagccctctcgcaaagagctgcttctgcgacatcacctctggtctggacctagatgtctgagctttcctctgggttccctgcctgcgtctcttttaggcttgcccggagccacatctcacagatcctgcctttcccccaacttggcaagcggactcgctgcccgtgggacacaaactcagtcagtcctgttcggagaagtccgccttccactggacggaggagttcgcggagctagaaaacggtctttgctgagagctcatccaaggacaggaatcctacccggtcgctgtggaatggtttggaaagacaaaaaactgcagccttcaggctgccatgagaaagcaggaggggtcttctgcgggccttccagggggggagtgtag

SEQ ID NO: 59658 - DNA, 834 bp, Artificial Sequence
  Description of Artificial Sequence: Synthetic coding sequence
cctttttttcgcgctagaggtctggagggcgtggtggttgacgggcaagtggaaacagcaagagtgtggaggggcgatcgacctgggaccgaaggtaaggaggaaagcggaatgttaagtgccgtgtggggagccggtggacctggggcagggggagcagcgcgaggccagccttcacgcaaggagctgctcttgcgccaccatctctggtctggccctcgttgcttgagcttccctctaggctctcttccagcttcccttctcggccttcctggggcaacttcacacagatcgtgtctgtcccccaacctggcgtcagggctcgccgctagaggcacccagacccagtctgtcttatttggggaggttcggctgcccctagatggcggtgtgagaggtgcgaggaaaagaatgaattttgatcactttcagattctgcgcgcaattgggaaggggagcttcggcaaggttagtcccagggtcccaagacgcccacaagcttcctgtcggactgcgctttgtcctccgggtgtgcattgtgccgaagctggccacggcgaagatgttcgtcatgaagtgcatgaacaagcggctgtgcacagagctcgcaggggaccccagcgcctacccggagctggggaccccgctggtgatagggcccgtctccctggagaacccctggtgcttctgcccggacgcggaggtcacgtccacgggagaggcccagccaccggacggggtccagcactgccccctgccgctgaacgggcagtgctgcgcggacacggagaagccgtgcacctgcgggatggtactggctcaggacttccttag

SEQ ID NO: 59659 - DNA, 1110 bp, Artificial Sequence
  Description of Artificial Sequence: Synthetic coding sequence
atgtatgcaatgaagtatatgaacaagcagcagtgtattgaaagggatgaagtgcgaaatgtcttccgcgagctggaaatcctccaggaaatagagcacgtgttcctggtcaatctgtggtattcttttcaggacgaggaggatatgttcatggtggtagacctcctgctggggggagatctccggtaccacctccagcagaatgtccagttttccgaggataccgtacgcctgtatatttgcgagatggctctggccttggactatttgagaggccaacacattatccatagagacgttaaacccgacaatattttgctagacgagcggggacacgcccatctgactgacttcaacatcgctactatcataaaagatggagagagggccaccgcactggccggtacgaaaccttacatggccccagagatcttccatagctttgtcaatggtgggacaggatactcattcgaggttgattggtggagcgtgggcgtgatggcctatgaactgttaagaggttggcgtccatacgatattcactctagcaacgcagtggaatcacttgtgcagctgttcagcaccgtgtctgtgcagtatgtgccaacatggtccaaggagatggtggcccttctaaggaaactcctgacagtgaatccagagcacagactcagctcgctgcaggacgtgcaagcagccccagctttggccggagtactgtgggaccacctttcagaaaaaagagtggagcctgggttcgttcccaataagggaagactccattgtgaccccacgtttgaacttgaggagatgattcttgaatcacgcccactccacaagaaaaagaagcgcctggccaagaataaatcccgcgataactcacgggacagttctcagtctgagaacgattacctccaagactgtttagacgcgatccaacaggactttgtcatattcaaccgggaaaagttaaagcgctcccaggatttgccaagggagcccctccccgctcccgagtcccgcgacgccgctgaaccagtcgaggatgaagccgagcgctccgccctcccgatgtgcggccctatttgtccaagcgccggaagcggctag

SEQ ID NO: 59660 - DNA, 1500 bp, Artificial Sequence
  Description of Artificial Sequence: Synthetic coding sequence
atgctgagtgccgtgtggggcgcagggggacccggtgccggaggggcagccagggggcaaccttccagaaaggagcttctcctgcgtcaccatctatggagcggccctcgctgtctctcattccctcttggcagcctgccagccagcctccttgggctgcctggagccacaagtcatcgtagttgcctgagtcccaacctggcctccggcctggctgcaagagggacccaaacccagagcgtcctcttcggcgaggtgcggctgcctctcgacggcggtgtccgcggtgccaggaaacgaatgaattttgaccacttccagatactgagagccatagggaagggctcgttcggcaaagtttgtattgtgcagaaacgcgatactgaaaagatgtatgcaatgaagtacatgaacaaacagcagtgcatcgagagagatgaagtccggaatgtttttagagagctggagatcctgcaggagattgagcatgtcttcttggtcaacctgtggtatagtttccaggatgaagaggacatgtttatggtggtggatctgttgttaggaggtgacctccgctatcatttacaacagaacgtgcagttcagtgaggacactgtgaggctgtatatctgtgaaatggcactggcactcgattaccttcggggtcagcatatcattcacagagatgtaaagcctgacaatatactgctggacgagcgcggtcatgcacatctcaccgacttcaacattgccactattattaaggacggagagcgcgctactgctctcgccggaaccaagccctacatggcccctgaaatcttccactccttcgtgaatgggggtactggatactcttttgaagtggactggtggagtgtgggtgttatggcctatgagctcctcagaggatggaggccatatgatattcactcgagtaatgctgtggaatccttagttcagttgttttccaccgtgtctgtccagtatgttcccacttggagcaaagagatggttgccttgctcagaaagctcttaacagtgaatccagagcacagactaagctcgcttcaagacgttcaggccgctcccgctttagccggtgtgctgtgggaccacctgtctgagaaacgagtggagcctgggttcgtgccgaacaaaggcagactgcattgcgatcctacctttgagctagaggagatgatactggaaagtcggccacttcacaagaagaaaaagagactcgccaagaacaagtctcgggataactcccgggacagttcccaaagcgagaatgattatctccaagattgtttggacgccatccagcaggatttcgtgatatttaacagggaaaagcttaaacgctcacaagacttgccgcgagagcccctgcctgctcctgaaagcagagacgccgctgagccggttgaggatgaggcagaacgaagcgctctccctatgtgcggacctatttgcccctctgctggctccggatag

SEQ ID NO: 59661 - DNA, 411 bp, Artificial Sequence
  Description of Artificial Sequence: Synthetic coding sequence
taggctcggggtctcgaaggagtggttgtggacggtcaggttgagacagcaagagtgtggcggggtgaccgccctggtacagagggtaaggaagaaagcggaatgctgtctgcagtttggggagctggaggccctggggctggcggagccgcacgagggcagccctccaggaaggagctgctgttacgccatcatctgtggtcgggtccgagatgtctgtcattccctctggggtcgctgcccgcatccctcctggggcttcctggagccactagccacaggtcatgtctgtcacccaatctggctagcggcctcgccgctcgagggactcagactcagtcagtactgttcggcgaggttaggttgccccttgacggaggggtacggggagcgaggaaacggaggtcgtag

SEQ ID NO: 59662 - DNA, 942 bp, Artificial Sequence
  Description of Artificial Sequence: Synthetic coding sequence
atgcctggcctgctgttatgcgaacccactgagctgtacaacattcttaatcaagcaacgaaactgtcccgactgactgaccccaattatctgtgtttactggatgtgcgaagcaagtgggagtatgacgaatcacatgtcatcacggctttgagggtgaagaagaaaaacaatgaatacctcttgcctgagtccgttgacctcgagtgtgtgaagtactgtgtggtttatgacaataacagttcgacactagagatactgctgaaagacgacgatgacgattcagattctgacggcgacggcaaggatctggttccacaggccgcaattgagtacggtagaatactgacgcgactcactcatcaccccgtgtatattcttaaagggggatacgagagatttagcgggacctatcacttcctgaggacacagaagattatctggatgcctcaggagctggatgcatttcagccgtaccccatcgagattgtccctggaaaagtgttcgttgggaatttcagtcaggcctgcgacccaaagatccagaaggacctcaagatcaaggcccacgtcaacgtgagcatggacacaggtccgttcttcgccggagatgctgataagctgctgcacatcagaatagaggatagcccagaagctcaaatccttccattcttgcgtcacatgtgccactttattgagattcaccatcaccttggaagcgtcatcctcatcttttccacccaggggattagtaggtcatgtgccgctataattgcctatctcatgcattccaatgaacagacactccagaggtcgtgggcctatgtgaagaagtgtaagaataatatgtgcccaaacaggggccttgtgagccagctcctcgaatgggagaagactatcctcggagacagtattaccaatatcatggatcctctgtactag

SEQ ID NO: 59663 - DNA, 654 bp, Artificial Sequence
  Description of Artificial Sequence: Synthetic coding sequence
atgcctggcctattactctgcgaacctaccgagctttacaatatactgaatcaggctaccaaactgagtaggctgacggaccccaattacctgtgtctgctggatgtccgttccaagtgggaatacgatgaatctcacgtgataaccgcccttagggtcaaaaaagagcttgacgcttttcaaccttatccgatcgaaatcgtgccaggcaaggtcttcgtggggaatttttcccaggcctgtgaccccaagatccaaaaggaccttaagatcaaggcacacgtgaacgtctccatggacacgggcccttttttcgcaggagatgccgacaagctgctacatattagaattgaggacagtccggaagcacagattctgccctttttacgacatatgtgccactttattgagatccaccaccatctgggctccgtgattctgattttctcaactcagggtattagccgctcttgcgccgctataatcgcttatctaatgcattctaatgaacaaacattgcagcggagttgggcatatgtcaagaagtgtaaaaataatatgtgccccaacagaggcctggttagtcagttgctcgaatgggagaagacaatcctaggcgattccataacaaatatcatggaccctctttactag

SEQ ID NO: 59664 - DNA, 942 bp, Artificial Sequence
  Description of Artificial Sequence: Synthetic coding sequence
atgcctggcctcctgttgtgtgagccaactgaactctacaatatactgaatcaggctacaaaactgtccagattgacagatccgaattacctctgtctgctcgatgtgaggtccaagtgggaatatgacgagtctcacgtgataacagccctgcgggtgaaaaaaaagaataatgagtacctcctgcccgagagcgtcgatctggagtgtgtaaaatattgcgtggtctatgataacaattcctcaacgctcgagattctgttgaaagatgacgatgacgattctgactccgatggtgacggaaaagatctcgtgccccaggccgctattgagtacgggcgaatcttgacaaggttgactcaccacccagtctatattctgaaaggcggttacgagcgatttagcggtacgtaccattttcttagaacccagaagattatctggatgcctcaggaactcgacgcatttcaaccataccctattgagatcgtgcctggaaaggtattcgttggaaacttcagccaagcatgtgatccaaaaatccagaaggacctgaagattaaggcccatgtcaacgtctccatggatactgggccattctttgccggtgacgccgacaagctgcttcacatcaggatcgaggatagtccagaagcccagatactccctttcctacggcacatgtgccactttatcgagattcaccatcacctgggctccgtcattttaatcttctcaacacaaggcatcagcagatcatgcgctgctatcatagcatatctgatgcactccaatgaacagaccttgcagaggtcgtgggcttatgtgaagaagtgcaaaaacaacatgtgtcctaaccggggactcgtgagccagcttctcgaatgggaaaaaactattctgggagatagcattactaatattatggaccccctttactag

SEQ ID NO: 59665 - DNA, 339 bp, Artificial Sequence
  Description of Artificial Sequence: Synthetic coding sequence
atgcctgggctgctgctctgcgagcctactgaattgtataacatactcaatcaagcgaccaagttgtctagacttactgaccctaactacttatgcctcctggatgttaggtccaagtgggaatacgatgaatcccacgtgattaccgccctccgggtgaaaaaaaagaacaatgagtatcttctgcctgagtcagtcgatctcgagtgcgttaagtactgcgtggtgtacgacaacaactcctctaccctggagattttactgaaggacgacgacgatgactctgactcagacggtgacggcaagggtactggctgcattagtgccattccacattag

SEQ ID NO: 59666 - DNA, 957 bp, Artificial Sequence
  Description of Artificial Sequence: Synthetic coding sequence
atgcccggactattactgtgcgaacctacagaactgtataatattcttaaccaagccaccaaactctctagattgacagatcctaactacctctgtcttttagatgtgcggagcaaatgggaatacgatgagagccacgttattacggctttgcgggtcaagaagaagaataatgaataccttctgcccgaatccgttgacctcgagtgtgttaaatactgtgtggtctatgacaacaactccagtacccttgaaatcctgctgaaggatgatgacgatgattccgacagcgatggggacgggaaagacctggtgcctcaagccgctatcgagtacggcagaatcctaactaggttaacccatcatcctgtgtacatattgaaggggggatacgaacgattctcaggtacctaccattttcttagaacccagaagattatttggatgcctcaagaacttgatgcttttcaaccgtatccaatcgagattgtaccagggaaagtgttcgtgggcaattttagccaggcgtgtgatcctaaaattcagaaggacctgaagatcaaagcccacgtaaatgtaagcatggacaccggcccttttttcgccggagacgccgataaactgctgcacattagaattgaagattcaccagaggcccagattctgccctttctacgccacatgtgtcacttcattgaggtcttaggcctgtgccaggaagttcagaaacagcacgtgagtaagtccggcatcggagagcctgcagccggaatgggggaagattacccttggcgttttcatcacaagcaccatggctctgcccttctcattttctccgaagctcaccggagagtgttgaaaagtcttacgtgggggcattttgttggaggaggccctgagtgtgtgtatcccggattatcgggcaggaggcgcccactacttccagaatcactctag

SEQ ID NO: 59667 - DNA, 942 bp, Artificial Sequence
  Description of Artificial Sequence: Synthetic coding sequence
atgcctggtctcctgttgtgcgagcctactgaactatacaatatactgaatcaggctacaaagctctcacggctgaccgatcccaattacctctgccttttagatgtccgatctaagtgggaatacgacgaaagccacgtaatcaccgctcttagagtcaaaaagaaaaacaacgagtacctgttaccggaaagtgtagatttggagtgcgttaagtattgcgtggtgtacgacaataattccagcacacttgaaattctcctgaaggacgacgacgacgactcagactccgatggtgatgggaaggatctcgttcctcaggcagcgattgagtatggccgaatcctcaccaggctgacacaccaccccgtgtacatactgaagggtggatatgaacggttcagcggaacttaccatttcctacggacccagaaaatcatatggatgccgcaggagttagatgcgtttcagccctaccccattgaaattgtccctggtaaggtgttcgtgggtaacttttcccaagcctgtgaccctaaaatacagaaggatttgaaaatcaaggcacatgttaacgtgtccatggacacaggcccattctttgctggtgacgcggacaagttgctgcacattagaattgaggactctccagaggcgcagattctgccgttcctgcggcatatgtgccacttcatagagattcaccaccacttgggaagcgttattctaattttttcaacccagggaatctctagatcctgcgccgctattattgcctatctgatgcacagcaacgaacagacactacaacgatcctgggcatacgtgaaaaagtgcaagaataatatgtgccctaaccgaggtttagtgtctcaactgctcgagtgggaaaaaacgatactgggagactccatcaccaatatcatggaccccctgtattag

SEQ ID NO: 59668 - DNA, 942 bp, Artificial Sequence
  Description of Artificial Sequence: Synthetic coding sequence
atgcccggactactattgtgtgaacctacagagctgtataatatcctgaaccaggcaaccaaattaagtcggctgaccgatcctaactatctgtgtttactagacgtccggtcaaagtgggaatatgatgaaagccatgtgattaccgcactgagggtcaaaaagaagaataacgaatacctgctacccgagagtgtggaccttgaatgcgtgaagtactgcgttgtgtatgataataattcctcaacactggaaattctgctgaaggatgacgatgacgacagcgactctgacggtgatggcaaggacctcgtccctcaagctgccattgagtacggccgaattctgaccagacttactcatcaccccgtttatatccttaagggaggctatgagcgttttagcggtacataccacttccttcggacccaaaagattatatggatgcctcaggagctggacgcgttccagccctacccaatcgagatcgtccccggaaaggtcttcgtgggaaatttcagtcaggcttgcgatcccaaaatacagaaagatctgaagattaaggcccacgtgaacgtcagtatggatacaggacccttctttgccggtgacgcggataaactactgcatatcagaatcgaagattcaccagaggcccaaatcctgccctttctgcgtcacatgtgccattttatcgagattcaccaccatctagggtccgttattctgattttctctacccaaggaatctccaggagttgcgccgcaattattgcatacctgatgcactccaatgaacagactcttcagcgctcatgggcttacgtgaaaaagtgtaaaaataatatgtgtcccaacagaggcctcgttagtcagctgctggagtgggagaaaaccatcctaggcgactcgataacaaacatcatggatcctctgtactag

SEQ ID NO: 59669 - DNA, 1311 bp, Artificial Sequence
  Description of Artificial Sequence: Synthetic coding sequence
atgacggctgtgtacatgaacggcggtggactggtgaatcctcactatgccagatgggaccgcagggactcagtagaatctgggtgccagacagagagctctaaagagggtgaagaaggacagccgaggcagcttacaccgttcgagaaattaacccaagatatgagccaggacgagaaggtcgttcgcgaaataacactcgggaaaaggatcggcttctatcgcattcgaggagaaattggatccggaaatttttctcaagtcaagttggggatccactccttgacaaaagaaaaagtggccatcaagattctggacaagacaaagctggaccagaaaacccagaggctcctgagccgcgagatatcgtccatggagaagctgcaccaccccaacattatccgcctttacgaggtagtggagactctgtcaaaactgcacctcgttatggagtacgctggtgggggtgagttgtttggaaaaatctccacggagggaaaactttctgagcctgaaagcaaattgattttctctcagattgtgtctgcagttaagcatatgcatgagaatcagatcattcaccgcgacctgaaagccgagaatgtgttctacaccagcaacacatgcgtcaaagtgggcgacttcggcttctcaacggtgtctaagaaaggagagatgctcaacactttctgcgggtcaccgccttacgccgcaccagagctgtttcgggacgagcactacattggaatctacgtcgacatctgggcgcttggggtgttactctatttcatggtgacaggtaccatgccttttcgcgctgagaccgtcgctaaactaaagaaatctatattggaagggacctacagcgttcctccacatgtgtctgaaccatgccatcgcctgattcgtggggtgctgcagcagatcccaactgagagatatggcattgattgcatcatgaatgacgagtggatgcagggagttccataccccactcctttagagcccttccagctggatccgaagcatctgagcgaaacctctaccctgaaggaggaggagaatgaggtcaaatcgacactggagcacttggggataaccgaagaacatataaggaacaatcaaggtagggacgcccgttcctccattacaggcgtctataggatcatcctgcacagagtgcagcggaaaaaagctttggagtccgtcccagtaatgatgctgcccgatcctaaggaacgcgatcttaaaaaagggagtagggtctatcgcggtattcggcatactagcaagttctgtagcattttatag

SEQ ID NO: 59670 - DNA, 1311 bp, Artificial Sequence
  Description of Artificial Sequence: Synthetic coding sequence
atgactgctgtctacatgaatggcggagggctggttaatccacattacgcacgatgggacaggcgggactcagttgaaagtggatgccagacggagtcatctaaggagggcgaagaaggtcagccgaggcagttgacccccttcgagaagctgacacaggatatgtcccaggatgaaaaagtcgtgcgagagatcacacttggcaaacggatcgggttctatcgtattagaggcgaaatcggatcaggcaatttcagccaagtgaaactagggattcatagcctgaccaaagaaaaagttgcaataaagatcctggataagaccaaactcgaccaaaagacacagcggctcctttcacgtgaaatctcttctatggaaaaactccaccaccccaacatcattagattgtacgaagtggtggagactctttccaagttacacctggtgatggagtatgctgggggaggggaactgttcggtaaaatctcaacagagggcaagctgtctgaacccgagagcaagctcattttttcacagattgtatcagcagtcaagcacatgcacgagaatcaaatcattcatcgggacctgaaggccgagaacgtgttctacacgtcaaacacttgcgtgaaggttggcgattttggtttctctacagtgtcaaaaaagggtgagatgctcaacaccttctgcgggtcaccaccttacgccgctccagagttgtttcgtgacgagcattacataggcatttatgtggatatttgggcactcggcgtgctgctgtacttcatggtgaccggcacgatgcctttcagggccgagaccgtggcgaaactaaagaagtcaatcctagaaggaacatacagtgtccccccacatgtgagtgaaccctgtcaccgactaatcagaggtgtgctgcaacaaattcccactgagaggtacgggattgattgtatcatgaacgacgaatggatgcagggagtaccttaccctactccccttgagccatttcagctggatccgaaacacttgtcagaaacctccacccttaaggaagaagagaacgaagttaagtcgacgctcgaacacctcggcataactgaggaacatattaggaacaaccagggcagggacgcccgtagctcgattactggagtgtaccggatcattctgcatagagtgcagagaaagaaagcactcgaatccgtgccagtgatgatgcttccagaccctaaggagcgggatctcaaaaagggcagccgcgtatacagggggatccgccacacctccaaattttgtagcatcctgtag

SEQ ID NO: 59671 - DNA, 1140 bp, Artificial Sequence
  Description of Artificial Sequence: Synthetic coding sequence
atggagcagctgtcttctgccaatactaggtttgccctcgacctcttcctggccctttctgaaaacaatcctgctggtaatattttcatttctccgttcagcatctcttcagctatggctatggtcttcctcggcactcgcggaaatacggccgcacagctgtccaaaacctttcactttaacaccgtcgaagaagttcattcccgctttcagtccctcaatgcagacatcaataagagaggtgcctcatacatactaaagctcgctaatcgcttgtacggagaaaagacatacaacttcttgccggaattcttggttagtacccaaaaaacgtacggtgctgacctggctagcgtggacttccagcatgcttctgaagacgccagaaagacaattaaccagtgggtcaaaggccagaccgagggaaagattcctgagctcctcgcgagcggaatggtggataatatgacgaagctcgtgcttgtaaatgcaatttatttcaaaggtaattggaaagataaatttatgaaggaagcaactacaaatgctccattcagattaaataaaaaggacagaaagaccgtcaaaatgatgtatcagaaaaagaagttcgcatatggatacatcgaggacttgaaatgccgagtactggagctgccataccagggcgaggagctgagtatggtcatcctgctgccggatgacattgaagacgaatctaccggtctaaagaaaatagaggagcagttgactttggagaagctgcacgaatggaccaagcccgaaaacctcgatttcatcgaggtcaacgttagcctgccacgatttaagctggaagaatcctacacgttaaattcagaccttgcacgccttggcgtgcaagatttgtttaacagtagtaaggctgacctgtccggcatgagtggggctagggatatctttataagcaagattgttcataagtctttcgtagaagtcaacgaagagggcacagaagccgcagccgctactgctggaatagctacattctgtatgctaatgcctgaagaaaatttcacggcagaccatcccttccttttttttatccgacataatagctctggctctatccttttcctgggacggttctctagtccctag

SEQ ID NO: 59672 - DNA, 687 bp, Artificial Sequence
  Description of Artificial Sequence: Synthetic coding sequence
atggtcgacaacatgacaaaacttgtgctcgttaacgcgatttacttcaaggggaactggaaggataaatttatgaaggaggcgacgacgaacgctccttttcggctcaacaaaaaggatagaaagacagtcaaaatgatgtaccaaaaaaaaaagttcgcctacggttatatcgaagaccttaaatgtagagtgctagagctgccgtatcagggagaggagctttctatggtcatcctgctgcctgacgacatcgaagatgaatcaactggcctcaagaaaatagaggagcagctgaccctggagaagctgcacgagtggaccaagcccgaaaacctggacttcatcgaagtgaacgtgagcctgcccaggtttaagctggaggagtcctatacactcaattccgacctcgccaggctgggagtgcaggatttgtttaattccagcaaggctgacttaagtgggatgtcaggggcacgcgacatttttatctccaaaattgtgcataagtccttcgtcgaagtaaatgaggagggaaccgaagcagctgcggctacggcaggaattgctacattctgtatgctcatgcccgaggaaaactttactgctgaccatccttttctgttcttcattcgccacaactcatctggaagcatactgtttctcggcaggttctcaagcccgtag

SEQ ID NO: 59673 - DNA, 1026 bp, Artificial Sequence
  Description of Artificial Sequence: Synthetic coding sequence
atggccatggttttcctcggaactaggggcaacacagccgcacaattgagtaagaccttccacttcaatacagtagaggaagtccactcgaggtttcagagtctgaacgccgacatcaacaagagaggggcttcatacattcttaagcttgccaacaggctctacggggaaaagacttataatttccttccagaattcctggtcagcacccaaaaaacatacggagcagacctggcctccgtggattttcaacatgcatctgaagatgcaagaaagacaattaaccagtgggtcaagggccagaccgagggaaagatacctgaactactggcctccggcatggtggataatatgacgaagctggtgcttgttaatgcgatttattttaagggtaattggaaggacaaatttatgaaggaggccacaactaacgcacccttccgactgaataagaaagataggaaaaccgtgaagatgatgtaccagaagaagaaatttgcctacggatacatcgaggacctaaagtgtcgcgtactcgagctcccataccagggcgaagaattaagcatggtgatccttctccctgatgatatagaggatgaatccacaggtctgaagaagatcgaagagcaactgactcttgagaaactgcacgaatggaccaagcccgaaaacttagacttcattgaggtcaacgtgtcactgccgaggtttaaactagaagagagctatacactgaacagcgatctagcacgccttggcgtccaggatttatttaactcatcgaaagccgatctctccggcatgagcggcgctagagacatctttatctccaagatcgtccacaagtccttcgttgaggtgaacgaagagggtaccgaagccgcagccgctacagctggcatagctacgttctgtatgctgatgccagaggaaaatttcacagcagatcatcccttcctctttttcattagacataacagctccgggagcatcctgttcctgggtcgcttcagctctccgtag

SEQ ID NO: 59674 - DNA, 654 bp, Artificial Sequence
  Description of Artificial Sequence: Synthetic coding sequence
atggttctcgtgaacgccatctacttcaagggccagtggcagaacaagttccaagtgcgagaaacggtcaagagcccttttcagctgagtgaagggaagaatgtcaccgtggaaatgatgtaccaaatcggtaccttcaaactagcatttgtaaaagagccccaaatgcaggtgctcgagttgccatatgtcaataacaaactaagcatgatcattctgctcccagtgggtatcgccaatctgaagcaaatcgagaaacagttgaacagcggcacctttcatgagtggactagcagctcaaatatgatggagagggaggtggaggtgcatttgcctagattcaagttggaaaccaagtacgagctcaattccttgctgaagtccctaggggtgactgaccttttcaaccaagtcaaggccgacctgagcggcatgagcccaacaaaagggctctacctctccaaggccatacataaaagctacctggatgtgagcgaagagggaacagaagcagccgcagctacaggagattcaatcgcagtcaagtctcttcccatgcgtgctcagttcaaagccaaccaccctttcctgttcttcattcgccacacccataccaacacaatcctcttttgtggaaagttggcctcaccttag

SEQ ID NO: 59675 - DNA, 573 bp, Artificial Sequence
  Description of Artificial Sequence: Synthetic coding sequence
atgggctcactatccaccgccaacgtggagttctgcctggacgtgtttaaagagcttaacagtaataacattggcgacaatatatttttttcctccctctccttgctatatgctcttagcatggtgctgctgggggctcgaggcgagactgaagaacagctcgagaaaatcgagaagcagctcaacagtgggaccttccatgagtggacatccagctcaaacatgatggagcgggaggtggaggtgcatttgcctcgtttcaaacttgagaccaagtatgaactgaattccttgctgaaaagcttaggggtgaccgatctattcaatcaagtgaaagcggatctgtctggcatgtcacccacgaaaggcttgtacctgtcaaaggctatccataaaagctacctcgacgtgtccgaggaagggacagaagctgccgcagctaccggtgacagtatcgctgtaaagtccttgcccatgcgtgctcagtttaaggcgaaccatcccttcctattcttcatacggcatactcacactaacacaattctattctgtgggaaattagcctccccgtag

SEQ ID NO: 59676 - DNA, 1179 bp, Artificial Sequence
  Description of Artificial Sequence: Synthetic coding sequence
atggggtcactgtctactgcgaatgtcgagttctgtctagatgtcttcaaagagctgaatagcaataacatcggagacaatatcttcttttctagcctctccctgctgtatgcattaagcatggtgcttctgggagctagaggggaaactgaggaacagcttgagaaggttctccatttctcgcatactgtggatagccttaagcctgggttcaaggactcccccaagtgctcccaggcgggacgtattcactccgaatttggggtcgaattttctcagattaatcagccagatagcaattgcacgctgagcatcgcgaacaggttatatggtacgaaaaccatggccttccatcagcagtacctgtcatgttctgaaaaatggtaccaggcacggcttcagaccgtggactttgaacagtcaacagaggaaacccggaaaaccatcaatgcttgggtcgagaataagaccaatggaaaagtggctaacctctttgggaagtccaccatcgacccatcttccgttatggtgctggtgaacgctatttatttcaaaggccagtggcaaaacaagttccaggtccgggagacagtgaagagcccgttccagttaagcgagggcaagaatgtgaccgtggagatgatgtatcagataggaacgtttaagctggcatttgtcaaggaaccacagatgcaggtcctcgaactcccttacgtcaacaataaactgagtatgatcatcctgctgcctgtgggcatcgctaacttaaagcagattgaaaaacagttaaacagcggtacgttccatgagtggacaagctctagtaatatgatggagcgcgaggtagaggtgcacctgcccaggtttaagttggagacgaagtacgagctaaattctctcctcaagtcccttggcgtgaccgacctcttcaatcaggttaaggccgacctcagcggcatgtcaccaactaaaggcctctacctctctaaagcaatccataagtcttacttggatgtgtctgaggagggtacagaggctgcagctgcaacaggcgactccattgccgtgaaatccctgcccatgagagcacagtttaaagcaaaccatcccttcctcttttttattcgccatactcataccaacactatccttttttgcggcaagcttgcaagtccctag

SEQ ID NO: 59677 - DNA, 1071 bp, Artificial Sequence
  Description of Artificial Sequence: Synthetic coding sequence
atgaccttggttctgtcaatgaaccggttctgtgaacccatcgtgagtgaaggtgccgctgaaatagccggttatcaaacattatgggaagccgacagctatggcggaccctctccccctgggccagctcaggcacccctgcaaggtgaccgcggagcagggccacccctggcagggtcgcactacaggggaatttctaatccgattactacttctaaaattacatacttcaagcggaagtacgtcgaggaggaggacttccaccccccactgagttcgtgttctcacaagacaatcagcatcttcgaagaaagggcccacatcttgtacatgtcactggagaagttaaagtttatagatgacccagaggtctatttaagacgtagtgtgctaattaacaatttgatgaaaagaatccacggtgaaattatcatgcagaacaattggtgcttccccgcttgctctttcaacgggacttctgcccaggagtggtttatggcacaggattgcccataccgcaaaaggcctcggatggcaaaggaggagtgtgagaagttccatgcttgttgcttttaccaggaatgtggtggccattatttgaatctgccgctgtcagtgaatgctaacgtgggatctgcaagcaccgctgcttcctctcccagtgccagttcctccagcagttccagctctagtagcccacctttaccgttgccctcatgttcccgacaggttgacttcgacgtgggctccgcctccatctacaagagcgacggccagattcctgccaacgagatcttcgtgacgaatgtaagatcccttggggtgcaagagaaagcgaagctcaacgatgagaaagccaatgacgataccaaccgcgatggagggccactgtctcacgagccggtgggaaacgatctagccttcgaatgcaagggccagttttatgactatttcgagacagggtataatgaaagaaacaatgtaaacgaatcctggaagaagagcctacgcaagaaagaagcgtcacctccgtcaaacaagctgtgctgcagcaaaggctctaaaatctag

SEQ ID NO: 59678 - DNA, 447 bp, Artificial Sequence
  Description of Artificial Sequence: Synthetic coding sequence
atgcaggaagtcggagtcggcttgtacccctcaatctctctgctgaaccactcttgcgaccccaattgttccatcgtgttcaatggtccgcatctcctgttgcgggcagtcagagatattgaagtgggagaggagctgactatttgctacttggatatgctgatgaccagtgaggagagacgaaaacaactcagggaccaatattgcttcgaatgcgactgcttccggtgtcagacgcaggataaggacgccgatatgttgaccggggacgagcaggtgtggaaggaggtgcaggagagcttgaagaagatcgaggagttaaaagcccactggaaatgggaacaggtcctcgcaatgtgccaggccatcatctcatctaactccgaaagactgcccgacataaacatttaccagcttaaggtcctggactgtgccatggatgcttag

SEQ ID NO: 59679 - DNA, 396 bp, Artificial Sequence
  Description of Artificial Sequence: Synthetic coding sequence
atgaggtgcagtcagtgtagggtcgctaaatactgttccgcgaaatgccagaaaaaggcgtggcctgatcacaagagagagtgcaaatgcttgaaaagctgcaagcccaggtacccacctgactctgttagattgctgggtcgggttgttttcaagttgatggatggagcgccatctgaaagcgaaaagttgtactccttttacgacctggagtcaaacattaataagctgacggaggacaaaaaggaggggctgagacagctcgtgatgaccttccaacacttcatgcgagaggaaatccaggacgcttcgcaactgcccccagcctttgacctcttcgaggccttcgctaaagtcatttgcaatagcttcaccatctgcaatgctgagatgtag

SEQ ID NO: 59680 - DNA, 225 bp, Artificial Sequence
  Description of Artificial Sequence: Synthetic coding sequence
atgcgatgctcccagtgcagagttgctaagtattgctcagccaagtgtcagaaaaaggcgtggcctgaccacaaacgcgagtgcaagtgcctcaagagctgcaaaccccgatatccaccagacagcgttcgccttttaggacgggtggtgttcaaattgatggatggcgctccaagcgagtccgaaaaattatatagcttctacgatttggagtccaatatttag

SEQ ID NO: 59681 - DNA, 1110 bp, Artificial Sequence
  Description of Artificial Sequence: Synthetic coding sequence
atgcgttgcagccagtgccgcgtggccaaatactgtagcgccaaatgtcagaaaaaggcctggcctgaccacaaaagagagtgcaagtgtctgaaaagttgtaagcctcggtatcctccagactctgtgagactcctggggcgagtagtttttaaactgatggatggagcaccttctgagtctgagaaactttactctttctacgatttagagtccaacataaacaagctaaccgaagacaaaaaggaaggattgcgtcagctggtaatgacattccagcactttatgcgcgaggaaatccaggacgctagccaactaccaccagcttttgacctgtttgaagcctttgcgaaggtgatctgcaatagctttaccatctgcaacgcagaaatgcaggaagttggtgtggggttgtacccctcaatttctctgctaaatcactcttgtgatccaaactgctccattgtctttaatggccctcaccttctgctcagggccgtgagagatatagaggtcggcgaggagcttaccatatgttaccttgatatgttgatgaccagtgaggaaaggcgaaagcagctgagggatcagtactgtttcgaatgcgactgtttccgatgtcagacacaagataaggatgctgatatgcttacgggcgacgagcaggtgtggaaggaggttcaggaaagcctaaagaagatcgaagaattaaaagctcactggaagtgggaacaggttctggcgatgtgccaggccatcatttccagtaattccgaaagactgcctgacattaacatctatcagctgaaggtgctagattgcgctatggatgcgtgcattaatcttggactgctcgaggaggcccttttctatggcactagaactatggagccctataggattttttttcctggcagtcaccctgtgcgcggtgttcaggtgatgaaggtcggcaaactgcagttgcaccaagggatgtttccacaggctatgaaaaacctccggttagcttttgacatcatgagggtgactcacggcagggagcactctttgatcgaagaccttattctcctgttagaagaatgcgacgctaatattcgcgctagctag

SEQ ID NO: 59682 - DNA, 1110 bp, Artificial Sequence
  Description of Artificial Sequence: Synthetic coding sequence
atgcgctgcagccaatgccgcgttgctaaatattgcagcgctaagtgccagaaaaaggcctggcctgatcacaaaagagagtgcaaatgcctgaaaagttgtaaaccaagatatcctccagattctgtccgcctcctaggcagagtggtcttcaagctgatggacggggcacctagcgagagcgagaaactgtacagcttttatgatctggaaagcaacataaataaacttacagaagataaaaaggaaggactgcgtcagctagtgatgacatttcagcatttcatgagagaagaaattcaggacgcttctcagctcccccctgcttttgatctatttgaagctttcgcaaaagtgatttgcaacagcttcacgatttgtaacgcagagatgcaggaagtcggggtaggcctatatcccagcatttccctgctgaatcactcctgtgatcccaattgttctattgtgttcaacgggcctcacctgctgctgcgcgctgtgcgcgacattgaagtcggggaggagctgacgatctgctaccttgacatgctcatgacgtcagaagaacgcagaaagcaattgagggatcagtactgtttcgaatgcgactgcttccgctgtcaaacacaggacaaggacgcggatatgctcaccggggacgaacaagtctggaaggaggtccaagaatctctcaagaagattgaggagcttaaagcccattggaaatgggaacaggtgctggcaatgtgccaggctattattagtagtaactcagagcggctgccagatattaatatttatcaacttaaagtgctggattgtgccatggacgcctgtattaacttgggtctgttggaagaggctttattctatggaacccgaactatggaaccatatcggatctttttccccggtagtcaccccgttagaggggtgcaggtgatgaaggtcgggaagcttcagctgcatcagggtatgttcccacaagccatgaaaaacctaagactcgcctttgacataatgagagtgacccacggccgagagcattcgctgatcgaagatctgattctgctgctggaggagtgtgatgctaacattcgcgcaagctag

SEQ ID NO: 59683 - DNA, 777 bp, Artificial Sequence
  Description of Artificial Sequence: Synthetic coding sequence
atggaggaagatagggacaaagtcatttgtaatagcttcactatttgtaatgctgagatgcaagaagtgggcgtggggctgtatcccagcatctcacttctgaatcatagctgcgaccccaattgtagcattgtgttcaatggacctcacctgctgctcagggctgtgagggacatcgaagtgggcgaagaacttacgatctgttacctcgatatgctcatgacctcagaggaaagaaggaaacagctgcgcgaccaatactgtttcgagtgtgattgttttaggtgccagacccaagataaagatgctgacatgttaaccggggatgaacaggtgtggaaagaagtgcaggagagcttgaagaaaattgaggaactcaaggcacactggaaatgggaacaggtactcgccatgtgccaggccataattagctctaacagtgaaagactgcctgacatcaacatttaccagctcaaggttttggattgtgcaatggatgcttgcatcaacctgggactcctcgaagaggccctgttttatgggactagaacaatggagccctaccggatattttttccgggatcccaccctgtcaggggcgtgcaggtcatgaaggtcgggaaactgcagctgcatcaaggcatgttcccacaggccatgaaaaacctgcggctggccttcgacattatgcgggtaacccacgggagagaacatagcctgattgaagaccttattctcttactcgaagagtgtgatgcaaatatacgcgcatcttag

SEQ ID NO: 59684 - DNA, 2415 bp, Artificial Sequence
  Description of Artificial Sequence: Synthetic coding sequence
atggacctgcctgtggatgaatggaaaagctatctgctgcaaaagtgggcctcgttgccgacctccgtccaggtgacaattagtacagcagagactcttagagacatttttttgcactcttcctctctgctgcagccagaggatgaacttttcctgaagcgcctgtccaaaggctacttggtgggcaaagatagcgatgcaccgctattctacagggaagagggtaacaagaagtttcaggagaaggattacacaggtgccgcagtgctttattcaaaaggcgtgtctcatagcaggcccaatacggaagacatgtcactttgtcacgcaaaccgctcggctgctctcttccacctgggacagtatgaaacttgcctgaaagacatcaaccgcgctcagacccatggatatccagagaggctccaaccaaaaatcatgctgagaaaggccgagtgcctggtagccctaggccgtctgcaggaggcctcacagaccatcagcgatttggagcggaacttcaccgccactcccgcactcgccgacgtgctcccacaaacattacaaagaaaccttcatcggttgaagatgaagatgcaggagaaagatagcctcacagagagtttcccagcagcactcgcaaagactctggaggacgccgctcttcgagaagagaatgagcaactttccaacgcgtcctctagcatcgggttgtgtgtggatccgttgaagggtcgctgtctggtcgccactaaggatattctcccaggcgagttgctggtgcaagaggatgcttttgtaagtgtcctgaatcctggcgaattgccacccccacatcacgggttagactccaagtgggatacccgcgtcacaaatggcgatttgtattgtcatcgctgcctgaagcacacacttgccacggtgccatgcgatgggtgttcctatgccaagtactgctcccaggaatgtttgcaacaggcttgggaactatatcaccggactgagtgccccctgggaggacttttgttgacgctgggagtcttttgtcatattgcactaagactcacattgctggtgggattcgaggatgtgagaaagatcataacgaaactgtgcgacaagatttctaacaaggatatttgcctgccagaaagcaataaccaggtgaagacattgaactacggccttggagaatcagaaaaaaatggtaacatcgtagagacacctattccgggatgcgacataaatggtaagtacgagaataactataatgccgtcttcaacctactcccacatacagaaaaccatagtccggaacataaattcctgtgcgccttatgcgtcagtgctctctgcaggcagttagaagctgcatctctccaagccatcccaaccgagagaatcgtgaacagctctcagctgaaagccgcagtgacccccgaactttgccccgacgtgaccatttggggcgtggccatgctacggcacatgctgcagttgcagtgtaacgcccaggccatgacaacaattcagcatacgggtcctaaggggtccattgtgacggactcacgccaagttagattggctactggaattttccctgtgatttccctcctcaatcatagttgtagccctaacactagtgtttctttcatctctaccgttgccaccatcagggcatcccagcgtatcaggaaagggcaggaaatcttacactgctatggcccacacaaatcacggatgggagtcgctgagcgccagcagaagctgcgctcacagtattttttcgactgtgcttgtcccgcttgccaaaccgaagcacacagaatggccgctggaccgagatgggaggccttttgctgtaattcttgcggcgctccgatgcagggtgatgatgttttgcggtgtggatcccgctcatgtgcggagagcgctgtctctcgcgatcatctcgtgagccgcctgcaggacctccagcagcaggtcagggttgcacagaagctgttacgcgatggcgagctggaaagggccgtacagcgtctatcaggttgtcaacgtgacgctgagtcttttttgtgggccgagcacgccgtggtgggcgagatcgcggacggactggcgagagcctgtgcagcactcggagattggcagaagtccgctactcacctgcaaaggtcactgtatgtcgtagaggtgaggcatggaccatctagcgtggaaatggggcacgaactattcaaactggcgcagatcttttttaatgggttcgctgtgcctgaagctctctcaaccatccagaaggcagaagaggttctctcactgcactgcggaccttgggatgatgagatccaggaactccaaaagatgaaatcttgtcttctggacctaccccctacaccagttggacccgctctctag

SEQ ID NO: 59685 - DNA, 1059 bp, Artificial Sequence
  Description of Artificial Sequence: Synthetic coding sequence
atggcccgtggacggaagatgagtaagcctagggccgtcgaggccgctgcggctgccgcagccgtcgcagcgacagcacccggacccgagatggttgagaggcggggtccgggtcggcctcgcacagacggagaaaacgtatttaccggccagtccaaaatatattcttacatgtcccccaacaagtgtagtggcatgcggtttcctctgcaggaggagaattccgtgacccaccatgaagtcaaatgtcagggcaaacccctggccggtatctaccgaaagagggaagagaaacggaatgccggtaacgctgtaaggtcggcgatgaagtcagaggagcaaaagatcaaagacgctcggaaggggcctttggtgccattccccaaccaaaaaagcgaggccgctgagccaccgaagacaccgccaagttcttgtgatagcacaaacgccgcaatcgcgaaacaggcattgaagaaacccatcaaaggtaaacaggctcccagaaagaaggcacagggcaagactcagcaaaatcgcaaattgactgacttttatccagtcagacgcagtagccgaaagtccaaagcggaactccagtcggaagaacggaagcgtattgatgagctgattgaatccggaaaggaagagggaatgaagattgacctgatcgatgggaaaggtcggggagtcatcgcaaccaagcagttttcccgcggtgactttgtggtcgagtaccacggggacctcattgaaattacggatgcaaaaaagcgggaggcattgtacgctcaggaccctagtacgggatgttacatgtactattttcagtacctgagtaagacctactgtgtagacgctacacgcgaaacgaaccgtctcggccgactgattaaccatagcaaatgcggcaactgccagactaaacttcatgatattgacggagtgccccacctgatcttgatagcttcccgcgatattgctgccggagaagagctgctgtacgactacggggaccgcagcaaggcttccattgaggctcacccctggctcaagcattag

SEQ ID NO: 59686 - DNA, 1059 bp, Artificial Sequence
  Description of Artificial Sequence: Synthetic coding sequence
atggcacgtggccgaaagatgtccaagcccagggcggtagaggccgcagctgccgcagctgctgtggctgctactgccccagggcctgagatggtcgaacggagggggccaggcaggccaagaaccgatggcgaaaatgtgttcactggccagagcaaaatctatagctatatgtcgcctaacaagtgtagcggaatgcgattcccgctccaggaagagaattccgtgactcatcacgaggtaaagtgtcagggaaaaccattggccggtatttaccggaaaagagaagaaaaaagaaacgcaggcaacgcagtgagaagcgctatgaaatctgaggagcagaaaatcaaagacgccaggaaggggccactggtgccttttcctaaccagaagagcgaggccgcagaaccaccgaagacacctccgagttcttgcgattctaccaatgctgctatagccaagcaggccctcaagaagccaattaaaggcaagcaggcccctcggaagaaggcgcagggtaagacccagcaaaatcggaagcttaccgacttctatccagttaggaggtctagccggaaatctaaggccgagcttcagagcgaagagagaaagcggattgatgagcttattgagtccggaaaagaagaggggatgaaaatcgatctgatcgatgggaaaggtcgaggggtaatcgccaccaaacagttcagccggggtgacttcgtcgtggaatatcacggagacctaatcgaaatcaccgatgccaagaagcgcgaggccctttacgcccaggacccatcgactggttgctatatgtactactttcaatacctgtctaagacttactgtgtcgatgccacgagagaaaccaaccgactcggacggcttattaaccactctaaatgcggcaattgtcagaccaagctccacgacatcgatggggtgccccacttaatccttatcgcgagccgagacattgctgccggagaggaactcctttacgattacggagaccggtccaaagcttctatagaggcccacccatggcttaagcactag

SEQ ID NO: 59687 - DNA, 1323 bp, Artificial Sequence
  Description of Artificial Sequence: Synthetic coding sequence
atgcagaaaggcaaaggtcgaacttctagaattcgacgcagaaaactttgtgggtccagcgagtcgcgtggcgtcaatgagagtcataagtctgagtttatcgagttgcgtaagtggctgaaggcacgtaaattccaggactccaatctagcaccggcatgtttccccggtacagggagggggctcatgagccaaacatccctgcaggaggggcagatgatcatcagtctgccagaatcatgcctgctgaccacagacaccgtgatcaggtcgtacctgggcgcttacatcaccaagtggaagccccctccatcacccctattagccctgtgtaccttcctcgtgagcgagaagcatgcaggacaccgttctctctggaaaccgtacttggagatcctgccgaaagcctacacttgccccgtatgcctggaacctgaggtggtcaacctcctccccaaaagtctgaaggccaaagccgaagagcagcgggcacacgtccaagaattttttgcttcctctcgggacttctttagctctctgcagcccttgtttgcagaagccgtggactcgatttttagctactctgctctcctgtgggcatggtgcacagtaaatacacgggcagtgtaccttcgccctcggcagcgggaatgtctctccgccgagcctgacacatgcgctctggccccttacctggacctcctaaaccacagccctcatgtccaagttaaggctgcctttaacgaagaaacccattcatatgagatcaggacgacatcacgttggcgcaagcacgaggaagtgtttatatgctacggtccgcatgacaatcaaagactttttctggagtacggcttcgtgagcgtgcacaacccccacgcatgcgtgtacgtgagccgagaaatcctggtcaaatatttgccctctactgacaagcagatggataaaaagatcagcattttgaaagatcacggatacattgaaaatctcaccttcggttgggacgggccttcttggcgccttctgactgctttgaagcttctttgtctggaggccgagaagttcacctgctggaagaaggtccttctgggagaggtgatctcagacaccaatgagaagacttcccttgacatcgcccaaaagatctgctattattttattgaggaaaccaacgcagtcctgcaaaaagtttcacatatgaaagacgaaaaagaggccttgattaaccagttaactctggtggagtcgctgtggactgaggaactcaagatcctgcgggctagtgccgagacacttcatagcttgcagacagcttttacttag

SEQ ID NO: 59688 - DNA, 852 bp, Artificial Sequence
  Description of Artificial Sequence: Synthetic coding sequence
atgaatgagagtcacaaatctgagttcattgagctgaggaagtggctgaaggctagaaaattccaggacagtaacctggcgcctgcctgttttcctggaactggtaggggtctcatgagccagacctccctgcaagaaggccagatgattatctctctgcccgaaagctgcctgctgacaacggacaccgtgattcggtcgtatctgggggcttatattaccaagtggaaacctcctcctagccccttattagccctctgcacatttctggtgtcagagaaacatgccggacacagatccctctggaagccctacctggaaattctgcctaaggcctatacctgtcctgtctgtctcgaacctgaggttgtcaacctcctcccaaagtccctaaaagctaaggcggaagagcagcgcgctcacgtgcaggaatttttcgctagctctcgggacttttttagttccctgcagcctctgtttgccgaggcagtggacagcatcttctcttactccgccctgctttgggcatggtgcaccgtgaatacccgcgctgtgtatcttcgcccacggcagcgagagtgcctgtctgccgagcctgacacttgcgctctggctccgtatttggatctgctcaatcattcccctcacgtgcaggtgaaggcggctttcaacgaagagacgcattcctacgaaattcgtaccacctccaggtggcgtaaacatgaagaggtcttcatctgctatgggcctcatgacaaccagcgtttatttctggaatacggctttgtaagcgtgcacaatccacatgcatgtgtatatgtatctcggggatggaatcagctgtgctcatag

SEQ ID NO: 59689 - DNA, 852 bp, Artificial Sequence
  Description of Artificial Sequence: Synthetic coding sequence
atgaacgagtctcataaatcagagttcattgaattaagaaagtggttgaaagccaggaagtttcaagactctaatctggctcctgcatgtttccccggaacgggccgaggactcatgagccagaccagcttgcaggagggccagatgattatttcattaccagagtcatgtctgttaactaccgacaccgttatcagaagttacttgggagcttatattacaaaatggaaacctccaccctctcctctgctcgcgctctgtacatttttagtgagtgagaagcacgcgggacaccggagcctctggaagccctacttggaaattctgcccaaggcatacacctgtccagtgtgtctcgaacctgaagtcgtcaacttgctgcctaaaagtttgaaagctaaagcagaggaacagagagctcacgttcaggagttttttgcttcgtcccgagacttcttctcatccctgcagcccctctttgctgaagccgttgactcaatcttctcttatagcgcgcttctttgggcctggtgcactgtcaatacacgagccgtgtatcttagacctaggcagcgggagtgcctgagtgccgagccagatacttgcgccttggcgccatacctagacctgcttaaccattctccccacgtccaggttaaggcagccttcaatgaagagacacattcatacgagatccgcacgacttctcgttggagaaaacacgaggaagtgttcatttgctacggccctcacgataaccagagactcttcttagaatacgggtttgtttccgtacacaaccctcatgcctgcgtgtatgtgagtcgcggatggaatcaactgtgttcgtag

SEQ ID NO: 59690 - DNA, 924 bp, Artificial Sequence
  Description of Artificial Sequence: Synthetic coding sequence
atgcagaaaggcaagggccgtacgagcagaattcgccgaaggaagctatgcggctcctcagagtccagaggggtcaatgaatctcacaagtcggaatttatagagctgcgcaagtggctcaaggcacggaagttccaggatagcaacctggcccctgcctgcttcccaggtactgggaggggcctgatgagccagacttcactgcaggaaggccagatgatcatttctcttcccgagagctgcctcctgaccactgatacggttattcgctcctacctgggggcttacatcacgaaatggaagccaccaccctccccccttttggcgctgtgtaccttcctggtttctgaaaagcatgctggacacaggtccctgtggaaaccgtaccttgagattcttcctaaggcctacacctgtcctgtctgtcttgagcctgaggttgtgaatctgttgcctaaatccctgaaggcaaaggccgaggaacaacgagcacacgtgcaagaattttttgccagctcacgggacttcttttccagcctgcagcctctctttgctgaggccgtggacagcattttcagctatagcgcactactgtgggcttggtgcacagtgaacactcgggctgtgtatcttaggcctcgccagcgcgaatgcttgagcgccgaacctgatacatgcgctctggccccttacctggatctgctcaatcacagcccacatgtgcaggtgaaggctgcctttaacgaagaaacccattcttatgaaatcaggacaacctcgcgttggcgaaagcacgaggaggtattcatttgttacggtccccacgacaatcagagactgttcctggagtacgggttcgtcagtgtccacaatccccatgcatgtgtgtatgtttcccggggatggaaccagttgtgttcctag

SEQ ID NO: 59691 - DNA, 924 bp, Artificial Sequence
  Description of Artificial Sequence: Synthetic coding sequence
atgcagaagggaaaaggcagaacgtcgaggattcggagacgaaagctgtgtggatcttcagagagccgcggtgtgaacgaatcgcacaagtcggagtttattgagctgagaaaatggctgaaagcacggaagtttcaggactcaaatttggcccctgcctgtttcccgggtaccgggagaggtttgatgagtcaaactagtcttcaagagggtcaaatgattattagtctgccggaaagctgcctgttgacgactgatacagtgatccggagctatctgggtgcttatattaccaaatggaagccaccccctagtcctttactggccttatgtaccttccttgtgagcgagaagcatgccggtcatcggtccttatggaagccctacttagaaatccttccgaaagcatatacatgccctgtgtgccttgagcccgaggttgtgaacctcttgccaaaatctctaaaagccaaagccgaggaacagcgagcacacgttcaggagtttttcgcgtccagcagagactttttttctagcctgcagccattgtttgcggaggcagtggacagcatcttctcctactccgccctgttatgggcttggtgtaccgtgaatactagagcggtgtacttgagacctaggcaacgggagtgcctgtcagccgaacccgacacgtgcgcgttggccccttacctagacttactaaaccatagtccacatgttcaggtgaaggccgctttcaatgaggagacccacagttacgagatccgtactacctcccggtggaggaaacatgaggaggtctttatctgttatgggccacacgacaatcaaaggctattccttgagtatggctttgtttcagtccacaaccctcatgcatgtgtgtacgtgtcccggggatggaatcagctgtgttcctag

SEQ ID NO: 59692 - DNA, 1251 bp, Artificial Sequence
  Description of Artificial Sequence: Synthetic coding sequence
atgaatgaaagccataagagtgagtttatagagcttcgcaagtggctgaaagccagaaagtttcaggactccaacctggccccagcctgcttccccggaaccggtcggggtctgatgtcccagacctccctccaagagggacaaatgatcatctctctgcccgagtcgtgcctgcttaccacggacacagttatacgatcctacctgggcgcttacattacaaagtggaagccaccaccaagccctttgctggccctgtgcacattcctcgttagcgagaagcatgcagggcaccgctcgttatggaagccgtaccttgagattctgcctaaggcctacacgtgcccagtgtgtctagagcccgaagtggtgaacctgctccccaagtccctgaaggccaaggccgaagagcagagggcccacgtccaggagttctttgcgtcctcccgagactttttcagctctcttcaaccactctttgcggaagccgtagacagtatcttctcatactcagcattgctctgggcttggtgcacagtcaacacacgggcagtctatctccggccacgccaaagggagtgcttgagcgctgagcctgacacctgcgctctagccccttatttagatcttctaaatcacagcccccatgtccaagttaaggctgcttttaatgaggaaacccactcttatgagatccgcaccacctcccgctggagaaaacacgaggaagtcttcatctgctacggtcctcatgacaatcagagactttttctggagtacgggtttgtgtccgtacataatcctcacgcttgtgtctacgtgagtagagaaattcttgttaaatatttaccaagtacagacaagcagatggacaaaaaaattagtatcttgaaagaccatggctatatcgagaatctaactttcggttgggacggacccagttggagactcctaacagctctgaaactgctgtgtttagaggctgagaagtttacatgttggaagaaggtcttgctgggtgaggtgatctctgacactaatgagaaaacttcactggacattgcccagaaaatttgttactattttatcgaggagaccaacgccgtgcttcagaaggtaagccatatgaaggacgaaaaggaagcgctgataaaccagctgacactggtggagtcattgtggacggaggaactcaagatcttgcgcgcttctgctgagaccctgcactctcttcaaaccgcatttacctag

SEQ ID NO: 59693 - DNA, 1323 bp, Artificial Sequence
  Description of Artificial Sequence: Synthetic coding sequence
atgcagaagggaaaagggagaacaagtcgaattcggagaagaaaactctgcggcagctcagaaagccgcggtgttaacgagtctcataaatcagagttcatcgagctacggaaatggctgaaggctcgtaaattccaggactctaacctagcacccgcatgctttcccggaacaggacggggactaatgtcccagacaagtcttcaggaagggcaaatgatcatatcgctccctgagtcttgtttgctgacaacagatactgtgatccggtcttatttgggtgcgtacatcacaaaatggaagccccctccttcacccttattggctttatgtacatttcttgtgtccgagaagcacgccggacaccggtctctgtggaagccctatctagaaatcctaccaaaagcttatacatgccctgtttgtctggagcccgaggttgtcaatctgttgcccaaaagccttaaggcaaaagcagaggaacagcgcgcacatgttcaggaattttttgcttcctctcgggactttttctctagtcttcaacccctcttcgcagaagccgtcgacagcatcttctcctacagcgccttgctgtgggcgtggtgtaccgtgaatacccgagccgtgtatttgcgccctcggcagagggaatgcttgtctgccgagcccgatacctgcgccctggctccataccttgatctactcaaccactcgccgcacgtacaggttaaggccgcttttaacgaagaaactcatagctatgaaattagaaccacatcacggtggcggaagcacgaggaggtctttatctgctatggccctcacgacaaccaaaggctgtttctggaatacgggttcgtgtccgtccataatccgcatgcatgcgtgtatgtaagccgtgagattttagtgaaatacctgccatcgacagacaagcagatggacaagaaaattagcatcttaaaggatcacgggtacattgagaatctgacctttggctgggatggtccgtcatggcggctgttgactgcactcaagctcttgtgcctcgaagccgagaaattcacctgttggaagaaagtactccttggggaggtgatttctgataccaatgagaagacatcactggatattgcccaaaagatttgctactacttcatcgaggagaccaatgcagtgctgcagaaagtctctcacatgaaagatgagaaagaggcactcataaatcagctgactcttgtagaaagcttatggactgaggagctgaagatcctgcgtgcatccgcagagacactgcactccctccagactgccttcacgtag

SEQ ID NO: 59694 - DNA, 696 bp, Artificial Sequence
  Description of Artificial Sequence: Synthetic coding sequence
atgcaaaagggaaaaggcaggacctcacggattcggcgacgcaagctgtgtggatcttctgaatctagaggggtcaacgagtctcacaagtccgaatttatcgagcttcgaaagtggctaaaggctagaaaattccaagattcaaacctggctcctgcttgctttcctggcaccggaagggggctcatgtcacagacatccctgcaggagggacagatgatcatcagccttccagagagttgtctgctgacaacagatactgtcattcgatcatacctcggcgcatatattactaagtggaaaccccctccgtctcctttactggcgttatgtaccttcctggtgagcgaaaaacacgcagggcacagaagtctctggaaaccctatctagagatcttacccaaggcatacacttgcccggtgtgcctggagccagaagtggtgaatttactgccgaagtcactcaaggcgaaggccgaagaacagcgcgctcacgttcaagaattcttcgcctcttcccgcgacttcttctctagtttgcagcccctctttgccgaagctgttgactctatcttttcttacagtgccctgctgtgggcctggtgtactgttaatactcgggctgtatacctgcgccctcgccagcgagagtgtctctcggccgaacccgatacatgtgctttggctccctattag

SEQ ID NO: 59695 - DNA, 678 bp, Artificial Sequence
  Description of Artificial Sequence: Synthetic coding sequence
atgcagaaaggcaagggcagaaccagtagaattaggcgtcggaaactttgtggcagcagcgagtccagaggcgtaaatgaatcccacaaatccgagttcatcgaactgagaaaatggctcaaggcacgaaaatttcaggactccaatttggccccagcctgcttccctgggacaggcagagggttgatgagtcagacctcactgcaggagggccagatgatcatctctcttcctgagtcgtgcctgcttactactgatacggttatcaggtcgtacctgggcgcatatataactaagtggaagcccccaccttcacctcttctggcgctgtgtacatttttggtctcggagaagcacgccggacaccgatccctgtggaagccctatctggaaattctacctaaagcctacacgtgtcctgtttgcctggagcctgaggttgtgaacctcctgcctaagagcttaaaggctaaagcagaggagcagagagctcacgtacaagagttcttcgcatctagcagggacttcttttcaagccttcagcctctattcgctgaggctgtcgatagcatcttctcctactccgcactgttgtgggcctggtgcactgtcaatactcgggctgtgtatctgcggcctcgtcagcgcgagtgcctaagtgccgaacctgatacctag

SEQ ID NO: 59696 - DNA, 213 bp, Artificial Sequence
  Description of Artificial Sequence: Synthetic coding sequence
atgaatgaaagtcacaaatcagagtttattgaattgcgcaaatggctcaaggctcggaaatttcaggactcaaaccttgctccggcttgttttccgggtaccgggaggggcctaatgtctcaaacaagtttgcaggaaggacagatgataatctctctccccgaaagctgtctgttgaccaccgacacagtcatacggtcatacctggggtag

SEQ ID NO: 59697 - DNA, 204 bp, Artificial Sequence
  Description of Artificial Sequence: Synthetic coding sequence
atgcagaaaggtaaggggagaacgagccgtattcgacggaggaagctctgcgggtcttccgagagtagaggtgttaacgagtctcataaaagcgagttcatagagcttagaaaatggctgaaggcgaggaaatttcaggactcgaacctagccccagcctgttttccagggaccggcagggggctgatgagtcagacctcctag

SEQ ID NO: 59698 - DNA, 375 bp, Artificial Sequence
  Description of Artificial Sequence: Synthetic coding sequence
atgaacgaatcacacaagagtgaattcatcgaactacggaaatggctaaaggcgcgaaagtttcaagatagtaatctggcccctgcttgctttccgggaaccgggcgtgggctgatgtcacagaccagtctgcaagaaggacagatgatcatatcccttccagagagctgtctgctcactaccgacacggtgataagatcttatttgggcgcttacatcaccaaatggaagcctccccctagccctctgctggcactgtgcactttcttagtttccgaaaagcatgcaggccatcgctctctctggaagccctaccttgagatcctcccgaaggcatacacctgtcccgtatgcctggagcctgaggtggtgtag

SEQ ID NO: 59699 - DNA, 4035 bp, Artificial Sequence
  Description of Artificial Sequence: Synthetic coding sequence
atgagtagaggaaaggtgattaggctgcatcgtaggaagcaagataacatttctgggggtgactcgtctgccacggaatcctgggatgaggagctgtcaccgtctaccgtactttataccgccacacagcataccccaacaagcatcactctgacagtccgtcggacaaagcccaaaaagaggaagaaaagcccagagaaaggtcgagctgccccaaaaactaaaaaaataaaggcattccgcgagggctctagaaaatcactgaggatgaagaatagtccatccgaggctcagaacctggacgaaaacacgaccgaagggtgggagaatcgtattagactttggacagatcagtatgaggaagcttttacaaaccagtactctgcagatgtgcagaatgccctggaacagcacctacacagcagtaaggaatttgtgggaaagccaacaatcttagataccataaataaaacagaactcgcatgcaataataccgtcatcgggtctcagatgcagctacaactgggtcgagtgactagagtgcagaagcaccggaagatccttcgcgctgcccgagaccttgccctcgacaccctgattattgagtatcgcggaaaagtgatgttgcggcaacaatttgaggttaacggccatttcttcaaaaaaccatacccattcgtgttgttctattccaagttcaatggggtggagatgtgtgtggatgctagaacgttcggcaacgacgctcgatttattagacgctcttgcaccccaaacgccgaagtacgccacatgatagccgatggcatgatccatctgtgtatttacgctgtctcagcaataacaaaagatgctgaggtgaccatagcctttgactatgaatactccaactgtaactataaggtggactgcgcctgccataagggcaatcggaactgccccatacagaagcggaatcccaacgccacagagcttccattactgccccctccgcctagtctccccacaatcggggcagaaacccgaagaagaaaggcgaggcgaaaagagttagaaatggagcagcagaacgaggccagcgaagaaaataatgatcagcaatctcaggaggttcctgaaaaggtgactgtgagcagcgaccatgaggaagtggacaatccggaggaaaagcctgaggaggagaaagaagaggtgatagatgatcaggagaacctcgcccattctaggcggacccgagaagacaggaaagtagaagctataatgcatgccttcgagaacctagaaaagagaaagaaacgcagggatcagccgcttgagcagagcaactcagacgtcgaaatcacaaccaccactagcgagactcccgtcggcgaagaaactaaaacagaggcccctgaatctgaggtaagtaactcggtatctaacgtcactataccatcaacaccccaaagcgttggtgtgaatacccggaggagctcacaagcaggagacattgcagccgaaaaactcgtgccgaagccgccaccagccaaaccatcacgcccacgacccaagtctcgcatctcaaggtacaggacaagctctgctcaaaggttaaagcgacaaaagcaggcgaatgcccaacaggctgaactaagtcaagctgcactggaagagggcggttccaatagcctggtaactccgacagaggcagggtcactagacagttcaggcgaaaatagaccacttaccggttcggatccaacagtcgtctctattaccggtagccacgtcaatagagccgcttccaagtacccaaagacgaagaaatatcttgttacggaatggttgaatgataaagccgaaaaacaagaatgcccagtggaatgtcccctgcggattacaaccgaccccacggtcctagctacaacgctgaatatgctgccaggtctcattcacagtccattaatatgcaccacccccaagcattatattaggttcgggtctccttttatcccagagcggcgaaggcggcctctgctgccagatggtaccttcagttcatgtaaaaagcgatggatcaagcaagccttggaggaagggatgactcagacctctagcgtgccccaggagacacgaacacagcatctctaccagagcaatgagaacagctcatccagcagcatttgcaaggacaatgcagacctcctaagcccccttaagaaatggaagagtcgctacctgatggagcaaaacgtgaccaagttactgcgcccactgtctcctgtgactccaccacccccaaattcagggagcaagagtccccagctggccaccccaggctctagccatcctggagaggaagaatgccgaaacggctactccctaatgtttagtcctgtgacttctttaacgaccgcgtcccgttgtaacactcctttgcagttcgagctgtgccaccgcaaagacctggatttggcaaaggtgggataccttgattctaacactaattcttgtgctgaccgtccttcccttttgaactcaggacactccgatttagctccacatccaagtctcggaccaaccagtgaaacgggattcccctcaagaagtggcgacggtcaccagacattggtgcgtaactccgatcaggccttcagaacggagtttaatctgatgtatgcatactctcccctcaacgccatgcccagagccgatggactataccgaggaagccctttggtgggggacaggaagcctctccatttagatggaggttattgcagtccggctgaaggattctcttccagatatgaacacggcctcatgaaagacctgtccagggggtcactgtcaccaggcggagaaagggcttgcgaaggtgtaccgtctgcacctcaaaaccccccacagagaaagaaggtttctctgctagaatatcgaaaacggaagcaggaggctaaagagaacagcgcgggtggcggtggcgattctgcacaatctaaatccaagtcggcaggagccggacaggggagttccaactctgtctccgatacaggcgctcacggggtccaggggagttccgctaggaccccaagcagccctcacaaaaaattctctccctcccacagctcaatgtcgcacctggaggccgtgagcccgtccgattcaaggggcacttcctctagtcactgtcggccacaggaaaacataagttctaggtggatggtgcccacctccgttgagaggctgcgagaggggggatcaataccgaaggtcctgcgatcttcagtgagggttgcccagaagggtgaaccttcgccgacctgggagagcaatattactgagaaggactcggaccctgcagacggtgaagggcctgaaaccctttctagcgctctttccaagggggcaacggtatattcgccatcacgctattcataccagctgctgcagtgcgattcgccgcgtacagaatcccaaagcttgctgcagcagagcagctccccttttcgcggacacccgacgcaatcacctggctatagctaccgaacaaccgcccttcgtcctggcaaccctcctagccacggctcctctgagtccagcctgtctagcacgtcgtacagttcacctgctcatcctgtgtcaacggattccctggccccttttacaggaacacctggttacttttcatctcaaccccactcgggaaatagcaccgggagtaatctgccacgtaggtcttgcccgtcttctgcagcatcgcccaccctccaggggccttccgattcaccaacgtctgacagtgtttcccagagcagcacggggaccttaagttctacctctttcccgcagaactcccggtctagtcttccatccgacctgcggaccatcagcctgccctctgctgggcaatccgccgtttatcaggccagccgggtctcggctgtcagtaacagtcaacactatccgcaccgcggatcaggaggggttcaccagtataggctacagcctctccagggttctggtgtgaaaactcagaccggccttagctag

SEQ ID NO: 59700 - DNA, 4329 bp, Artificial Sequence
  Description of Artificial Sequence: Synthetic coding sequence
atgagcatcgccatacccctaggtgtgacaacctctgacacctcttatagcgatatggccgctggctcagatccggagtcagtcgaagctagtcctgccgtgaatgagaaatccgtgtattcaactcacaactatgggactacgcagagacatgggtgtcgtggactcccatacgccaccatcattccccgatccgatctgaacggccttccctctcctgtagaggaaaggtgtggcgattcaccaaattcagaaggcgagacagtgcctacctggtgtccttgcgggttgtctcaggacggattccttttaaattgcgataagtgtagaggcatgtcacgtggtaaagtgatcagactgcacaggcgaaaacaggacaacatttctggcggagacagcagcgccactgaaagctgggacgaggaactgagtccctctaccgtgttatacaccgcaacacagcacacacccacaagcatcacccttacagtcagacggaccaaaccaaaaaaacggaagaagagtcccgaaaagggtcgcgcagcccctaagacaaagaaaatcaagaactccccgagcgaagctcagaaccttgatgaaaacacgaccgagggatgggagaatcggatacgcctatggaccgaccaatacgaggaggccttcaccaatcagtactcagcagacgtccagaacgcgctcgagcagcacctgcattccagcaaggagttcgtcggcaagccaacaatactcgacacgattaataaaactgaactggcatgcaacaacacggtcataggctcacagatgcagctgcagctcggtcgagtaactagggtccagaagcacagaaagatcctgagagctgcccgagatctggcgctggacaccctcatcattgaatataggggcaaggtgatgcttcgccagcagtttgaagttaatggacacttttttaaaaagccttatcccttcgtgcttttttactcaaagtttaatggggtagagatgtgtgtggacgccaggacctttggaaacgacgcaaggttcattcgccgttcatgcacacccaacgcagaagttagacatatgatagccgacgggatgatccacctgtgtatctacgctgtgagcgctatcacaaaggatgctgaagtcaccatcgcatttgattatgagtacagtaactgtaattacaaagttgactgcgcttgtcataaaggcaatcgcaattgtccaatccagaaacgcaacccaaacgccaccgagctgcctctcctgcctccccctccctctctccccaccatcggcgcagagacacggagacggaaagcccgacggaaggaactcgaaatggagcagcagaacgaagctagtgaagagaacaacgatcagcagtcccaagaggttccagaaaaggtcactgtaagttccgatcatgaggaggtcgataatcccgaggagaagccagaagaggagaaagaggaggtaatcgacgatcaagagaacctagcccattcaaggagaacccgcgaggaccggaaggtagaagccataatgcacgcctttgaaaacctggaaaaacggaagaagcggcgagaccagccacttgaacagtccaattctgacgttgaaatcaccaccacaacaagtgagacgcccgtgggggaggagaccaagacagaggctcccgaatccgaggtttcaaacagcgtgagcaacgtaacgatcccctccactccgcaatctgtaggggttaatacaaggaggagttctcaggcgggagacatcgcagctgaaaagctcgtgcccaagcctcctcctgccaagcctagtagaccacgaccaaagagccggatatcccggtacagaacaagttccgcacagaggttgaaaaggcagaaacaagccaacgctcaacaggccgagctgtcacaggcggcactcgaggagggcggatcgaacagtcttgtgaccccaaccgaggccggatctttggacagctccggcgagaaccgcccactcaccggttctgaccctactgtggtctcgatcaccggtagccacgtgaatagggcagcctccaagtaccccaaaaccaagaaatatttagttacagagtggttgaacgacaaagccgagaagcaggaatgtcctgtcgaatgcccactgagaattacgaccgacccgacagtgctggccaccaccctgaacatgctgcccggacttattcattctcccttgatctgcacaactccgaagcactacatcaggttcggcagtcctttcatcccagaacgcaggcgaaggcccctcttgccagatggcacattttcatcctgtaaaaaaagatggatcaagcaggcccttgaggaggggatgacacagacttcatctgttccccaagagactcgtacccagcacttgtatcagagcaatgaaaattcttcttcttccagcatttgcaaggacaatgccgatctgctgtctcccctgaaaaaatggaagtcaagatacctcatggagcagaatgtcacgaagctccttcggccattgtctccagtgaccccgcctcccccaaattcaggaagcaagagtccccagctcgccacccctgggagcagccaccctggagaagaggaatgccggaacgggtactctctgatgttttctcctgtgacttcgcttacaacagcatcgagatgcaatacacccctccagttcgagctgtgtcaccggaaagacctggatctggctaaggttggttacctcgatagtaatacaaattcctgcgcagatcggccaagcctactgaactcgggtcatagtgacctggcaccgcacccttccctcggtcccactagtgaaacggggttcccatcgcgcagcggcgatggccatcagacgcttgttcgaaacagcgatcaggcttttcggaccgagttcaacctcatgtatgcctactctcctctaaatgccatgccaagggcggacggcctctaccgcggttccccattggtaggcgaccggaaacccctccacctggatggagggtactgtagtcctgccgagggctttagctctcgttacgagcacggtctaatgaaggatttgtccaggggatcactgagcccgggaggagagagagcctgcgagggggtgccctcagcccctcaaaaccccccacagcgaaaaaaggtttctcttctggaataccggaagaggaaacaggaagcgaaggagaactcagcgggaggtggaggagatagtgcccagagcaagagcaaatctgccggagcagggcaagggtcctccaacagtgtgagtgatactggagcccacggggttcaaggcagctcggctcgtacaccgtcttctcctcataagaaattctccccgagccattcatctatgtctcacctggaggcagtgagcccaagtgatagtcggggaacctctagtagtcactgcaggccccaggaaaacatatccagtaggtggatggttccaacctcagtcgaacgcctgagagaggggggatctatacctaaagtgcttcggtcatccgtacgggtcgcacagaaaggcgagcctagcccaacatgggagagcaacatcacggaaaaggatagcgaccctgctgacggggaggggccagagaccctgtcctctgcgttatctaaaggagccaccgtttatagtccgtcccggtattcctaccagctcctgcagtgtgattctcccaggactgagtcccagtctctcttacagcagtccagctctccattccgaggccatcccacccagagtcccggatatagctatcgtactaccgccctccgtcctggcaaccctccatcccatggctctagcgaatccagtttgtcttccacctcttactcaagtcccgcacaccccgtgtccaccgattctttggcacctttcactgggaccccagggtactttagtagccagccacactccggaaactcaactggatccaacctgccccgaaggtcgtgtccctcaagtgctgctagcccaaccttgcagggacctagcgattccccaacaagcgactctgtgtcgcaaagctctacgggaacactatcaagcacctcgtttcctcagaattcgaggtcctcactaccgagtgacctcagaacgatttcgctccctagtgccggacagagcgctgtgtaccaggcctccagagtgtcagctgtatccaattcacagcactaccctcaccgcggttctggtggagtacaccagtaccgccttcaaccactccaggggagcggcgtcaaaactcagaccggcctgagttag

SEQ ID NO: 59701 - DNA, 4035 bp, Artificial Sequence
  Description of Artificial Sequence: Synthetic coding sequence
atgtctaggggcaaggtaatacgactgcacagaaggaagcaggacaacatatcaggaggtgacagtagcgcaaccgagagttgggacgaggaactcagcccttccactgtgctttacaccgctacacagcacaccccaacatccatcacacttactgtcagacggaccaagccaaagaaacgtaagaaaagcccggagaagggaagagccgctcctaagaccaaaaagattaaagccttccgggaaggcagtaggaagtcgctgcggatgaaaaattcgccaagcgaggcccagaacctggatgaaaatacaaccgagggatgggagaataggatcagactgtggaccgatcaatacgaggaggcctttacaaaccagtatagcgcagacgttcagaatgctctcgaacaacatctgcacagttccaaggagtttgttgggaaaccaactatactagacaccataaataagacggagttggcttgtaacaacaccgtgatcggtagtcaaatgcagttacaactgggacgggttacacgggtgcagaaacatcgcaaaattctgcgagccgcaagggatctggctctggataccctgatcattgagtaccggggtaaggtaatgcttcggcaacagtttgaagtgaatggacacttctttaaaaaaccttacccatttgtcttattttacagcaagtttaacggcgtggagatgtgtgtggatgcacgcacatttggtaatgatgctcgattcatccggaggtcatgcacacccaacgccgaagtgcgccatatgattgccgatggaatgattcacctctgcatctacgccgtatccgcgatcacaaaagatgccgaagtaacaattgccttcgactacgaatactccaattgcaattacaaagttgattgtgcctgccacaaaggtaatagaaattgccctattcagaagcggaatccgaatgctactgaactcccattgctcccgcctcctccatcactgccgaccattggggctgagacccgccgaagaaaggcaaggcgtaaggaacttgagatggaacagcagaatgaagcatccgaagaaaataacgaccagcagtcgcaagaggtgcctgagaaggtcaccgtgagttcagaccatgaggaggtcgacaatcctgaggaaaagcccgaagaggagaaggaggaagtgatcgatgaccaggagaacctggcacattcccgtcggacccgggaggacaggaaggtcgaggcaatcatgcacgcctttgaaaatctggagaaaaggaagaagagaagggaccaaccactggagcagagtaactccgacgtcgaaatcacaactacaacttctgagaccccagtgggtgaggagaccaagacagaggcacccgaaagtgaggtgagcaattccgtgtctaacgtgacaatcccatcgaccccccagtccgtgggggtgaatactcggagaagcagccaagccggagatatcgctgcagagaagctggtgcccaagccccctccggctaagccttccaggcccaggcctaaaagccgcatatctcgatatcgaacatcaagcgctcagagattaaaaagacagaagcaagccaatgctcagcaagctgaactatcccaggcagccctcgaagaaggcggtagcaactcccttgtgacgcccactgaggccggaagtctggattcttcaggggaaaaccgccctctaaccgggtcggatccaaccgttgtgtccatcactggctcccatgtcaatcgggcagcaagcaaatatcccaagacaaagaagtatttggttacagaatggctgaatgacaaagcggaaaaacaggagtgcccggtggagtgtccgctgcgaattaccacagacccaaccgttctcgccaccactctaaacatgctgccaggtttgatccactcccccctgatttgtacgacaccaaagcattacatccgttttggttcaccattcatcccggagagacgccgacgcccactgctccccgacggtacattctcatcctgcaagaagaggtggattaaacaagccttagaagagggcatgactcagacctccagtgtgcctcaagaaactcgcactcagcatctataccagagtaacgaaaattccagctctagtagcatatgcaaagacaacgctgatttgctcagtcctttaaaaaaatggaaatctcgctacttgatggaacagaacgtgacaaaactgcttagaccgcttagccctgtgacaccccctcccccaaactctgggagcaaatctccccagttggccaccccgggaagctcccatcccggtgaggaggagtgtcgcaatggctatagcctgatgttttctcctgtgacctctcttaccacagcctctcgctgcaatactcctctccagtttgagctgtgccatcgaaaagacttggacttggccaaggtgggttacctggacagtaacaccaattcgtgtgcggataggccatccctgttaaatagcgggcacagcgatctcgcccctcacccatccttggggcctacctccgagaccggttttccatcaagatccggcgacggacaccagactcttgtgcgaaactctgatcaggccttccggactgagttcaacttgatgtatgcgtactcacccctgaatgcaatgcctcgagcagatggcttataccgcggttcacccctagtcggtgatcgcaaacccctacacctggatggcggttactgctctcctgctgaggggttctccagccgctatgaacacgggctgatgaaagatctgtctaggggcagcctgtcgccaggcggtgaacgagcatgtgaaggagtgcccagcgctccccagaaccccccacaaagaaaaaaagtgtcactcttggaatataggaagagaaaacaggaggcaaaagaaaactcagcaggaggcggtggggattccgcgcagtccaagtccaagtccgcaggggcaggacagggttcgagcaatagtgtgagcgacacaggagcgcatggggttcagggcagtagcgcaaggacccccagcagcccacataagaaattctctcctagtcactcttccatgtcacatctcgaggccgtgtcaccaagtgacagccggggaaccagttcaagtcactgtagacctcaagagaatatctcatctcggtggatggtgcccaccagcgtggagagattgcgagaaggaggcagcatcccaaaagtgctgaggtccagtgtgagagtcgctcagaaaggggaaccgtcacccacttgggagagcaatatcactgaaaaggacagcgatcctgctgatggagaaggtccagaaaccctgtcatctgctctgagcaaaggagccacggtgtattccccttcacggtacagttatcagttactgcaatgcgactccccacgaactgagagtcagagtctgctccagcaaagctccagcccgtttcggggacatcccactcagagccccggatactcttacaggaccaccgcactgaggccaggcaacccccctagccatggcagttctgagtcatctctatcctctaccagctatagctctcccgctcatcccgtctctaccgactcattagcccctttcacagggactcctgggtactttagctctcagccgcattctggcaattcaaccgggtctaacctgccacgtcggtcctgtcctagctctgctgcgtctcctaccctgcaggggccttccgacagccccacgagcgatagcgtgtctcaatcgtctaccggaaccctttctagcacaagtttcccccagaactctaggagctccttgccaagcgatctccgcaccatatcacttccaagtgctgggcagagcgctgtctaccaggcttcacgagtctctgcagttagtaacagccagcattatccccaccggggttctgggggtgtccatcagtaccgactacaacccctgcagggctctggggtgaagactcagacaggtcttagttag

SEQ ID NO: 59702 - DNA, 4329 bp, Artificial Sequence
  Description of Artificial Sequence: Synthetic coding sequence
atgagcattgccattcccctcggggttaccacttccgacacgtcttatagcgacatggctgctggctctgatcccgagtcagtcgaggcatcacccgcagtgaatgaaaagagcgtgtactcgactcacaattacggcaccacccaaagacacggctgcagagggttgccctatgccacaatcattccacgttcggacttaaacggcctcccaagtccggtcgaggagcgttgcggagattcaccaaattccgagggcgagacagtccctacttggtgtccctgcggattgtctcaggacggctttcttttaaactgcgacaagtgcagaggcatgagtaggggcaaggtcatcagacttcaccgaaggaaacaggacaatatctctggtggggattcgtctgccactgagagctgggacgaagagctcagcccaagcactgtgctatataccgccacgcagcatactcctacttctattacattgactgtgagaagaacaaagccgaaaaagcggaaaaagagtcctgagaagggccgtgctgcaccaaaaactaagaagatcaagaatagtccttctgaagctcagaatctggatgagaatacaactgaagggtgggaaaatcgtatccggctatggactgaccaatacgaggaagcgtttactaaccagtattctgcagacgtccagaatgcactagagcaacacctgcactcttcaaaggagtttgtcggaaaacctaccattttggatacaataaataagacagagctggcctgtaataacactgtaataggtagtcagatgcagctccagctcggacgcgtaacacgggtacagaagcataggaagattctccgggctgcaagggacctcgccctggacacattaatcatcgaatacagaggtaaggtgatgttgcgccagcagtttgaagtgaacggccacttttttaaaaaaccttatccgttcgtcctgttttactcgaagttcaacggggttgagatgtgcgtagatgcgaggacgttcggaaatgatgcacggtttattaggaggtcgtgcacccctaacgctgaggttcggcatatgatcgctgatggaatgattcacctttgcatatacgctgtgtctgctattaccaaagatgccgaggtgaccattgccttcgattatgaatactccaactgtaactacaaggtcgattgcgcctgtcacaaggggaaccggaactgtcccattcaaaaacggaaccctaatgctacagagctacctctactcccaccgcctccctctctgcccaccatcggggcagaaacccggagaagaaaggctaggagaaaggaactggagatggaacagcagaatgaggcaagcgaggagaacaacgatcagcagtctcaggaagtgcctgagaaagtgacagtgtcatccgaccatgaggaagtggacaacccagaagagaagcccgaagaagagaaagaggaagtaattgacgatcaggagaatctggctcacagccgcaggacccgcgaggataggaaagtcgaggcgatcatgcacgccttcgagaacctcgagaagcgcaagaagcgccgagaccaaccactggaacaatccaactccgacgtagaaatcacaaccacaacttcagaaaccccagtgggtgaggaaacaaagactgaggccccagaatctgaagtttcgaattctgtgtccaacgtgaccatcccatccaccccccagtcggtgggcgtcaatacacgaagatcttctcaggccggagatatcgccgctgaaaaactcgtgcccaagcccccacccgctaaacccagtagaccacggcctaagtctcggataagccgctacaggactagctcagcccagcgactgaaacggcaaaagcaagcgaatgcacagcaggccgagttgagtcaggcggcactggaagagggcggaagcaattcactggtcacaccgaccgaggctgggtccttagattcatccggtgagaatcgcccactgacaggaagcgatccaaccgtggtgagcataaccggtagccacgttaatagggcagcaagtaaataccccaagaccaaaaagtatcttgtgactgaatggttaaatgataaagcggaaaagcaggagtgccccgtggagtgtcccctgcggataactactgatccaaccgtgcttgctacaaccttgaacatgctccccggtctgatccactctcccctcatatgcaccacccccaagcactatatccgatttggcagcccttttattcccgagcgtcgcaggcgacctctgcttccagacgggacattcagcagctgcaagaagaggtggataaaacaagccctggaagaaggaatgacacagacatctagcgtccctcaggaaactagaacacagcatttataccagagcaacgaaaatagctcttcttcaagcatatgcaaagacaacgcggacctgttgtccccgttaaagaagtggaagagcaggtacttaatggagcagaatgtaaccaaactgctccggccactgagccctgtgacccctcctcctcctaattctgggtcgaaaagcccccagctcgctactccgggatcttctcatcctggcgaagaagagtgccgaaatggctatagtctcatgttctctcccgtcacctctcttaccacggctagccgctgtaatacacctctgcagttcgagttgtgtcaccggaaagacttggacctggctaaagtgggatacctcgatagcaacacgaactcttgtgctgatagaccgtctttgctgaacagcggccattcagatctggctccacacccctctctgggcccaacctccgagacaggattcccatctcgtagcggggacggccaccagacactggtgagaaattccgaccaggcctttagaaccgagtttaatctgatgtacgcgtatagccccctgaatgccatgccaagagctgacggcctgtacagaggatcaccactggtgggcgaccgaaagcctcttcacttagatggcggttattgctcccccgctgagggattcagttctagatatgaacacgggctgatgaaggaccttagtcggggaagccttagcccgggaggagaacgcgcttgtgagggagttccttccgcaccacagaatccaccacagaggaagaaagtgtcactgctcgagtaccgcaaaagaaagcaggaagccaaagaaaacagcgctggcggaggaggagactcggctcaatccaaatcaaaatccgctggggctgggcagggctcttcaaacagtgtgtctgacacgggagcccacggcgtgcaaggatcatcggccagaaccccctcttctccccacaagaagttcagcccctcacatagcagcatgtcccatcttgaagcagtgtctcctagcgattccagaggcacgagcagctcccattgcaggccccaggaaaacatcagtagcaggtggatggtgccaactagtgtcgagcggctgagggaggggggatctatcccaaaagtgctgcgcagttcagtgagagtcgctcaaaagggcgagccttctcccacttgggagtccaacattacagaaaaggactccgaccccgctgacggggagggtcccgaaaccttaagcagcgccctgtcaaaaggggctactgtgtacagccccagtagatactcctaccagttattgcagtgcgatagtccccgaacggagtcacagtctctgctgcagcagtccagtagtcccttccggggtcatcccacccagagtcctggttactcgtaccggactacagccttacgcccagggaaccctccatcccacgggagctccgagtcttctctgtcaagcacaagttactcttcccccgctcaccctgtctcaaccgacagtctggcccctttcactgggacccccggttactttagctcacagccacactctggaaattccaccggatccaatctaccgcgtcgttcatgccctagttcagccgcatccccgacgctccagggaccttctgatagcccgacttctgattctgtctcccagagctctaccggaacgttgtctagtaccagcttcccccagaattcccgctccagcctgccatccgatctgagaactatttcacttccatctgccggacaaagtgctgtttaccaggcgagccgcgtgagtgctgtttcaaattctcagcactatccccatcgtggcagcggcggtgtgcaccagtacagactccagccgttacagggttcaggcgtgaaaacacagaccggactgagctag

SEQ ID NO: 59703 - DNA, 489 bp, Artificial Sequence
  Description of Artificial Sequence: Synthetic coding sequence
atgtctattgccatccctttgggcgtcacaaccagtgatacttcatactccgatatggctgctgggagcgatcctgaatcggtagaggcttccccagcggtaaatgagaaaagtgtgtacagcacgcacaactatgggacaacgcagcggcacggatgtagaggtttgccttacgcgacaatcatccccaggagcgatctgaatgggctgccgtcccctgtggaggaacgatgtggtgactctcccaattccgaaggtgaaaccgtaccaacatggtgtccatgcggactgtcgcaggatggctttctactcaactgcgacaagtgccgcggaatgtctcgcggaaaagttatccggctccatcggagaaagcaggataatatctcgggcggagactcctcagccaccgaaagttgggacgaggaactgagcccttcgactgtcctctatacggctacacagcatacgcctacttcaatcactctgtag

SEQ ID NO: 59704 - DNA, 1731 bp, Artificial Sequence
  Description of Artificial Sequence: Synthetic coding sequence
atgcaagttccccaggacggcgaggacctggccggacaaccctggtaccatggtctgctctccaggcagaaagctgaggctctgctgcagcagaacggcgatttcctggttcgcgcttccggtagccggggaggcaatcccgtaatctcttgtcgctggagaggatctgccctccactttgaggtgtttcgggtggccctccgtccacgcccagggaggccaactgcactgttccaattagaagacgagcagttcccttccattcctgcactcgtgcatagctatatgacgggacgtcgaccgttaagccaggccaccggtgccgtggtctccagaccagtcacttggcagggccctttacggagatctttcagtgaagatacactgatggatggcccagcacggatcgaacctcttcgggctcgtaaatggtctaactctcagcctgcagacctggcccacatgggaagatcgcgcgaagacccagcgggaatggaggcaagtactatgccaatcagtgcactgcctaggacaagcagcgaccctgtactcttgaaggccccagctcccttgggaactgtggcagatagtctgcgcgcttcagacggccagctgcaggccaaagcccctacgaaacctcccaggacaccgtccttcgaactgcctgatgcaagcgagcgccctcccacctactgcgagctggtgccacgcgtgccttcagtacagggcaccagtcccagtcagtcctgtcccgagcccgaggcgccttggtgggaggcagaggaggatgaggaagaggagaacaggtgcttcactcgccctcaagcagaaatctccttctgtccccacgacgctccatcctgcttgctgggtccccagaatcgtcccctggagccacaagtgctccacacactcagaggactcttcctagagcaccacccaggctctactgcactccacctccttctcgtagactgtcaggccacaggcctgctgggagtcacccgcgaccagagagggaacatgggagtctctagcggcttggagctcttgaccctgccccatgggcaccatctgcggctggaactcctggagaggcaccagacactggcactagccggagctctggctgtgttagggtgcagcggaccgctagaagagcgggctgcagcactccgcggtctggtggaactggcactggctctccgcccaggtgcagctggcgacttacctgggctggctgccgtcatgggcgctctgctcatgcctcaagttagtcgcctggagcacacttggcgacagttacgccgatctcatacagaagccgcactcgcttttgagcaagagttaaaaccactaatgcgggcactagatgagggagcaggcccttgcgaccccggagaggtcgctttacctcatgtggctccgatggtgcgattgctcgaaggggaggaagtcgccggacctttggatgagtcttgcgaaagactgctcagaactctccatggcgctcgccatatggtccgggatgctcccaaattcaggaaggtagccgcacagagactgaggggattcaggccgaatccggagctgagggaggccctgacaaccggattcgttaggcgactgctctggggatctaggggcgctggggctccaagagccgaacgtttcgagaaatttcagcgcgtgctaggagtcttatctcaacggctcgagccggaccgctag

SEQ ID NO: 59705 - DNA, 1452 bp, Artificial Sequence
  Description of Artificial Sequence: Synthetic coding sequence
atggagaagaccctgctcgcaaacttggggactaccgcatcttgtccagctagagcgagaaaatggtccaacagccagccggctgacttggcccacatgggacgatcccgagaggaccccgctgggatggaggcctccacaatgccaatttccgctctgcccaggaccagcagcgacccagttctgttaaaagctcctgccccactgggtactgttgccgattctctcagagctagtgacgggcaattacaggccaaggctcccactaagccccctaggacacccagcttcgagctgcccgacgccagcgaacgcccacctacctactgcgagttggtccctcgggtcccatccgtgcagggcaccagtccctctcagtcttgtccagagccagaggcaccatggtgggaagctgaagaagacgaggaggaagaaaacaggtgcttcacccgtcctcaggcggagatatctttctgccctcatgatgctccatcctgcctgctgggcccacagaaccggcctctcgagccacaggtgctgcatacactgagaggactctttctggagcatcacccaggtagcaccgccctccaccttttgctggtcgactgtcaagctacaggtctcctcggtgttacccgggaccagcggggtaacatgggcgtgtcctcaggactggagcttctcacccttccccatgggcaccacttacggctggaactgttggaaaggcatcaaacgctagcgcttgccggtgccctggccgttctaggctgtagcggacccctggaggagcgcgctgcagcactccggggtttggtagagctggccctggccctccggcctggagcagccggtgatctgcctggcttagccgcagttatgggcgctctcctgatgccacaggtgcgtggtgagcagggtctggaggaagccggtgttcgggttaccgggaaaactggcgaggaagcatgttccgacttgttcagtcaggtctctcggcttgagcatacctggcggcaacttcgtcgcagccatacggaagcagctttggcctttgagcaggaactgaagcccctgatgcgggcacttgatgagggcgctggaccctgcgatccaggagaagtggcactcccacatgttgcccctatggtacggttactggaaggggaggaggtggctggccctctggatgagagctgtgagcgactgctgcgtaccctgcatggtgccagacacatggttagagacgctcccaagtttcgtaaggtggcagcccagagactcagaggtttccgcccaaatccggagctgcgcgaggctctgacaacagggttcgtccgccgactgttgtgggggtctcgcggagctggggcaccccgtgctgaaaggttcgagaagtttcaaagggtgcttggggtcttgagccagcgattggagccagatcggtag

SEQ ID NO: 59706 - DNA, 930 bp, Artificial Sequence
  Description of Artificial Sequence: Synthetic coding sequence
atgctcccagaggattctgggggaagccccgatgccgcagccagtgataaacacatacaatggctgctgggggctgatggggaagtctgggtctggattatgggtgaggggccaggcgataaaccgtacgaggagatcagcgaggaactcattgctgagagggcgcgattgcaggcccagcgcgaggcggaagagctgtggcgccagaaggaggccgaaataactaaaaaattccgtgacgcactcgccaatgagaaggccaggatcctggccgagaagtggaaggtggagatggaggacaggaaggccgcaaaggtccttgaagagaggatccatgaggagttcaaacgcaaggaagaagaggagagaaagcggggtgaggaacaaatcaggctgcaggaggaacaacgtgctaaggaactctattggaccctgaaacaggctcagctgcattgccaggcatccgaaaaggaggaaagagaatgggaggagcagcttcggcgatccaaggcggcagacgaggagagatcaaggcgggctcagagggctagggacgagtacaggcatcactccctgcgcgcaatccagaaaggaaccgtcgccggactcagctcgatgtttagagagttaggacaaagtcatgagcaggaagcccgattataccaccatttgcccgaccctgggctcccacagcccctggctctccctgtgtcgagaacatgggaacgtccactccgcccagtgagcagggacgttatcgtcaggtggttcaaagaggagcagctccctaggcgagcgggtttcgaacgcaatacaaaattcatcgccccttggttccacggtgggaactaccactgctttcgcagacgcgtcacatctgggacgctccggaccgaaggacagcctactagattgccttccgtagtgtag

SEQ ID NO: 59707 - DNA, 1074 bp, Artificial Sequence
  Description of Artificial Sequence: Synthetic coding sequence
atgctgcaacagatcttgcatgacatgtacatcgaccctgaactgttagctgaactttccgacgtgcagaagcacattttgttctataagatgcgagaggagcagctccggcgatggaaggaacgcgagacatgggaggcactggcacaggacgaggggctgagacccccaaagaccaaaagggccgctagcgataagcacattcagtggctgttaggtgccgatggcgaggtttgggtgtggattatgggggaagggccaggagataagccttacgaggagatatctgaagagttgattgccgagagagcccgtcttcaggcccagcgcgaagctgaagaattgtggcgccaaaaggaggcagagattacgaagaagttccgcgatgccctggctaacgaaaaggcaagaattctggctgaaaaatggaaagtggagatggaggaccgtaaagccgctaaagtcctcgaagaacgcattcatgaggagttcaaaagaaaagaggaagaagaaaggaagaggggcgaagaacaaattcgccttcaggaagaacagcgtgccaaggaactgtattggaccctgaagcaggcccagctccactgtcaggcctccgagaaagaagaaagagagtgggaggagcagctgcgcagaagtaaggctgcggatgaggaacggagccgccgtgcccaaagagcgagggacgagtatcggcatcactctctgcgtgccatccagaagggcaccgtcgctgggctgagttcgatgttccgagagttagggcaatcccatgagcaggaagcgagattgtaccaccacctacccgacccaggtttgccccaacctcttgcactgcccgtgagaacatgggagcgcccacttcggccagtatcccgagatgttatcgtgcggtggttcaaggaggagcagctgcccaggcgtgccggatttgagcgcaacactaaattcattgcgccttggttccatggcggaaactatcattgctttaggaggcgagtgacttctggcactttgcgaaccgaggggcagccaactcggttgcctagcgtcgtgtag

SEQ ID NO: 59708 - DNA, 648 bp, Artificial Sequence
  Description of Artificial Sequence: Synthetic coding sequence
atgctccagcagatcctccacgatatgtatatcgatccggaactgctggcagagctgtctgatgtacagaagcatatcctcttttacaaaatgcgggaggaacagcttaggagatggaaagaacgtgagacttgggaagccctggcacaggatgagggactccgcccaccaaaaacaaagcgggcttccgacaagcacatacaatggctgctgggcgcagacggcgaggtttgggtttggattatgggagagggacctggagataagccatatgaggagatttcagaggagctgattgctgagcgggctcgactgcaggcacagcgggaggctgaggagctgtggagacagaaggaggccgaaattacaaaaaaattccgggatgctttggccaacgaaaaggcaagaatcctggccgagaagtggaaggtggagatggaagacagaaaagccgctaaagtgttggaagagagaatccatgaagagttcaagagaaaagaggaggaggagaggaagagaggtgaagaacagataagacttcaggaggaacaacgcgcaaaggagctttactggaccttaaagcaagcacagcttcattgccaggcgtctgagaaagaggagcgcgagtgggaggagcagtgcgagtag

SEQ ID NO: 59709 - DNA, 1296 bp, Artificial Sequence
  Description of Artificial Sequence: Synthetic coding sequence
atgctgcagcagatcctccatgatatgtacatagaccctgagctgctagccgaactgagcgatgtgcagaaacatattctcttttataagatgagggaagagcagctcagacggtggaaagaacgtgaaacatgggaagccctcgcccaggacgaaggcttaagacctcccaaaactaaaagggccagcgataagcacattcagtggttgctgggagcagatggcgaagtttgggtctggatcatgggcgaaggaccaggcgataagccttacgaagaaattagcgaagagctcatcgccgaacgggcacggttgcaggcccaaagagaggccgaagagttgtggcgacagaaagaggcagagattacgaagaagtttagggatgcactcgcaaacgaaaaagcacggattttggccgagaaatggaaggtggagatggaggatagaaaagcggcaaaagtcctggaggagcggatccacgaggaattcaaacggaaagaggaagaagagaggaagcgtggcgaggaacagatacgtctgcaagaagaacaacgagccaaggagctctattggacgctgaaacaggcccagttacattgtcaagcgtcagagaaggaagagagggaatgggaagagcagctccgcagaagtaaggccgcagacgaggagcggagccggagagcccagagagctcgcgacgagtatcgacaccactcccttcgtgctatacagaaagggacagtcgccggactctcttccatgttcagagagcttggccagagccatgagcaggaggcaagattgtaccatcacttacccgaccccggactgccccagccactggcgctgcctgtgcggacatgggagcgccctctgcgacccgtcagtagagacgtgatagtccggtggtttaaagaagaacagctgccaagacgcgcaggcttcgagcgcaacacgaagttcatagcgccatggtttcatgggattataagtcgcgaggacgcagaggccctcctggagaatatgaccgaaggtgctttcctggtgcgagtatccgagaaaatctggggctacacactgtcttacaggctgcagaaggggtttaagcacttcctcgttgacgcctccggagacttctacagcttcctaggggttgaccccaatcggcatgcaactctcaccgatctggttgattttcacaaggaggagattatcactgtgtctggtggggagctcttgcaagaaccgtgtggccaaagggactccccaccagactatcacctgttattcgagtag

SEQ ID NO: 59710 - DNA, 1020 bp, Artificial Sequence
  Description of Artificial Sequence: Synthetic coding sequence
atggcgcatgctctgaggagaattctttactctacttggtgccccgctgattgccaatttgcctttatggccagaaaccctcggtcgcccgctagcaaattgttttgccatttattcgtgggcagccaacctggggaagttcagatcctgcacttgctgctctgtagatcgttccagttggcctatctcctgcaacatcctgaagaaagagcacagcctgaaccatgcccagggccaacgggagaggttcctctgaagcccctgtcatcgagcggaggcctggtgcgtgaaccgttcggtcgcgaccagctttcacagaacgttcacgccttggtgtcatttaggcggctgcctgccgagggtcttgtgggcagtggcaaagagcttcccgaatccgagggaagggcacggcacgctcgactggggaacccgtactgctcaccgacattagtaagaaagaaggccatccgcagcaaagtcatcagatccggcgcatatcgagggtgtacctacgaaactcagctacaactaagcgcgagagaagccttccctgcagcctgggaagcttggccgcgtggacccggtggccatagctgcctcgtcgagagcgaaggctcccttacggagaacatctgggcttttgcagggatctctagaccgtgcgccctagccctgctccgccgtgacgtgctcggggcttttctcctgtggccagaactaggggcttcaggacaatggtgtctaagcgtgaggacacaatgcggcgtagtgccacatcaggtgtttagaaatcatctgggccgatactgcctggaacacctacctgccgagtttccctcacttgaagcactggttgaaaatcatgcagtcaccgaaagatcacttttctgccccctggatatggggcgactcaacccaacctatgaggagcaggactgtgggccacccggacggccaccaagaaccctaagaccactgtcccatgctaagtctgaggctgaacttcagggtttgggctag

SEQ ID NO: 59711 - DNA, 1272 bp, Artificial Sequence
  Description of Artificial Sequence: Synthetic coding sequence
atgcagaaagccggagcagggggtaggcgggcttcagactgtggtctggctccccaccgacctcggtgtataactaaattcgcccagtacgtcggatctttcccagtcgatgacttggacacccaagagtctgtatggttggtgcaacagcagctttgggccttgaaggattgcccacgcaggcgagcagtgatccttaaattttcccttcaggggttaaaaatctactctggggaaggcgaagtgctgctgatggcacacgctctgcgcaggattctgtactccacctggtgccctgcagattgtcagttcgcatttatggcacggaatccacgaagccccgcatctaaactattttgccatctctttgtagggagccagccaggcgaggttcaaatactgcacttactcttgtgtaggtcatttcaactggcttacctgctacagcaccccgaagagcgagcccagcctgagccttgtcctggtcctaccggcgaagtgccactgaagcctctctctagctcaggagggctggtaagagaaccattcggaagagatcagttgagccagaatgtacatgcgctcgtctccttcagaaggctacctgctgaggggcttgtgggcagtgggaaagaactgcccgagtccgaagggcgagctcggcacgcgagactcgggaacccatactgcagccctaccttggtccggaagaaagcaattcgatccaaggtgattcgttcaggcgcttacagaggttgcacatacgaaacccagcttcagctatccgcgagggaggcctttccagcggcatgggaggcatggcccagaggcccaggcggacactcttgtctcgtcgagtccgaaggctcgctgaccgagaacatctgggcctttgctggcatatcacgcccttgcgccctggcacttctgcgcagggatgtgctcggggcatttttgctctggccagagctgggggcaagtggacagtggtgtttatctgttagaactcagtgtggggtggtgccccatcaggtgttcaggaatcacctgggaagatactgcctagagcacctgccagcggagtttccttctctagaggcgctcgtcgagaatcatgctgtcaccgagcgctcccttttctgccctcttgacatgggccgattgaaccccacctatgaggagcaggattgtgggccaccgggacgccctccacgcactttgaggccgctgagtcacgctaagagcgaggcagagctccaggggttaggatag

SEQ ID NO: 59712 - DNA, 381 bp, Artificial Sequence
  Description of Artificial Sequence: Synthetic coding sequence
atgcagaaggcaggggctggaggtcgacgggcttcagactgtggccttgcaccgcacaggcccaggtgcatcactaaattcgctcagtacgtgggaagcttccctgtggacgacttggatactcaggaatcagtgtggctggtccagcagcagctgtgggctctcaaggattgtcctcggaggagagcggtaatattaaagttcagcctccaggggctgaagatttactctggagaaggagaagtgctgctaatggcccatgccctcagaaggatcctctactctacatggtgcccagccgactgccagtttgcttttatggcgagaaacccgaggagccccgcatctaaactgttctgccacctttttgtgggatcctag

SEQ ID NO: 59713 - DNA, 396 bp, Artificial Sequence
  Description of Artificial Sequence: Synthetic coding sequence
atgcagaaggccggagcaggtggacggcgtgcgtccgattgtgggcttgccccacaccgcccaagatgtataactaaattcgcccagtacgtgggatccttccccgtggatgacctggacacccaggagagcgtgtggttggtgcaacagcagctctgggccctgaaggactgccccaggcgaagggctgtcatactcaaattctcgctacagggactgaaaatttacagcggagagggagaagttcttctaatggcacacgccctccgtcgcatcctgtacagcacctggtgccccgctgattgtcagttcgctttcatggccagaaacccacgctcacccgcttcgaaactgttctgtcacctgtttgtcgggtcccagccaggggaggtttag

SEQ ID NO: 59714 - DNA, 213 bp, Artificial Sequence
  Description of Artificial Sequence: Synthetic coding sequence
atgcaaaaggcaggcgcaggcggaaggcgtgccagcgattgtgggctggctccccaccggccaagatgcataacaaagttcgcgcaatacgtgggaagtttccccgtcgacgacttagacacccaggagagcgtgtggctcgtgcagcaacaactttgggccctaaaggactgtccaaggcgacgggctgtgattttgaagttcagcctgtag

SEQ ID NO: 59715 - DNA, 528 bp, Artificial Sequence
  Description of Artificial Sequence: Synthetic coding sequence
atgtacgcgagtagctaccccccacctccacagctgtcaccacgctcacatctttgtccaccaccacctcatcccactccaccgcagcttaataacttactgctgctcgaagggcgaaagtcgtccctaccgtccgtagctcctacaggatccgcatcggccgcagaggacagtgatctgctaacacagccatggtatagcggcaactgtgacaggtatgccgtggaatccgcgttgttgcatctacagaaagacggggcttatacggtcaggcccagtagtggccctcatggaagccagcctttcacattggccgtgcttctgcggggaagggtgttcaacattcctatacggagactcgacggcggacgtcattatgccctcggcagggagggtcgcaatcgcgaggagctgttcagcagcgttgctgccatggttcagcactttatgtggcacccattaccacttgtggacaggcactccggcagccgcgaacttacttgccttctcttccccaccaaaccttag

SEQ ID NO: 59716 - DNA, 432 bp, Artificial Sequence
  Description of Artificial Sequence: Synthetic coding sequence
atgccttccggcccattaccaaggactagcgtcgttcctcggcctaccacggctccccaggaaacccgtaatggcacagctgatgctgcttctaaggagggcaggaaatcctctctaccttccgtggcccctaccgggagcgccagcgccgcagaggatggcgcttataccgtccgtccatcaagtgggcctcacgggtcacaaccgttcacactggctgttctgcttcgaggacgcgtttttaatattcctattcgcagattggacggtggaaggcactacgctctgggccgtgaggggagaaacagggaagagttgttctccagcgtagcagcgatggtgcagcattttatgtggcatccactgccacttgtcgaccgccacagcgggtcacgtgaactcacatgtctgttgttccccacaaaaccgtag

SEQ ID NO: 59717 - DNA, 1896 bp, Artificial Sequence
  Description of Artificial Sequence: Synthetic coding sequence
atgaatggagccggtccaggacctgccgctgctgcgcctgttcccgtgcctgtgccagtcccagattggaggcagttttgtgagctccacgcgcaggctgctgccgttgacttcgcccacaaattctgcagattcctgcgcgacaatcctgcttatgatacaccagacgccggagccagtttttcgcgccacttcgcagcaaacttcctcgatgtctttggggaagaagtacggagggtgctcgtggcgggtcccactacccgtggtgctgcagtttccgctgaggccatggaaccagagcttgctgacacctcagctttgaaggctgctccatacggacattcccggagctccgaagacgtgtccacgcatgcggctacaaaggcaagagtgcgcaagggcttctcgctccggaatatgagtttgtgcgttgtcgacggtgtgcgtgatatgtggcaccggagggcctcgcctgaacccgatgcggctgcagcacctcgcaccgccgaacccagggacaaatggacaaggcgcttgcggctgtccaggacgctggctgcaaaggttgaactagtcgacatccagagagagggcgcattacggttcatggttgcagatgatgccgcagctggtagcggaggcagcgctcaatggcagaagtgtagactcctgcttcgtagggctgtggccgaagaacgcttccggctcgagttttttgtgcctcctaaggcatcaagaccaaaagtgagcatccctttatctgcaatcatcgaggtccgaacaacaatgccactcgagatgcccgaaaaggacaacactttcgtgctcaaagtggagaatggtgccgaatatatcctggaaaccattgattctctacagaaacactcctgggtggctgacattcaggggtgcgtggaccctggacccggacccggagacctagaaggtagctggacgaggtcttgcttgcaccctaaacgggcttcggaacactgggagctgggtcgcgatggaagtgaaagtcccaagggctggggacctggagctgttgcgcatatctgtgacccaaatacactcggaggacccgcagtcgaaacaggatttcaccatgtggggcaggccggtctcgagctccagaccagctcggatcccccaaattctgccagcagatctgcaaccagtggggagcagggagcggaaaccgaccctgaagctgagccggaactggaactttctgattatccttggttccatggaaccctgagccgagtgaaagctgcccagctcgtgctggccggaggtccaaggaatcatggcctgtttgtgattaggcagtctgaaacccgccctggtgaatatgtcttgactttcaactttcaggggaaagcaaagcatctaagattatcacttaacggtcacggacagtgccatgtgcagcacctgtggttccagtctgttctggacatgttgcgccactttcatactcaccccattccactcgagagcggcggatctgccgatataacccttcgcagctacgtccgggctcaggatcctcccccagagcctggccctactcccccagcagcccctgcatcccctgcctgttggtccgactccccgggtcaacactattttagctccctcgccgctgcagcttgccctccggcaagcccatcagacgcggctggggctagctcatcctcagcgtcttctagctcagccgctagtgggccagcgcctcctaggcctgtggaaggccagctgtcagcgagatcacgcagtaacagtgccgaacggttactagaggccgttgcggctactgccgcagaagagccacccgaggccgcaccaggccgagcacgcgcagttgaaaaccagtactctttttactag

SEQ ID NO: 59718 - DNA, 714 bp, Artificial Sequence
  Description of Artificial Sequence: Synthetic coding sequence
taagaacagggcgcagagaccgatcccgaagccgagcctgagctggagttgtctgactacccttggtttcacggaactctgtctcgagttaaggcagcacagctcgtattggccggtggtccgaggaaccatgggctgtttgtcattcgacaatccgaaactagacccggagagtatgtcctgacttttaacttccagggtaaagcaaagcatctgcgactgagtctcaacgggcacgggcaatgtcacgtacagcatctgtggttccagtcagttttggacatgctgcgacactttcatactcaccccattccacttgagagcggaggctccgcagatattacattaaggtcttacgttagggctcaggatccacctccagagccgggtcccacccccccagccgctccggcaagccctgcttgctggagtgactcacctggccagcactacttctctagcttggccgctgccgcatgtccacccgcttcccccagcgacgccgctggtgcttcttcgagctccgcgagcagttcttctgccgcttcaggacccgctccacccagacctgtggagggacaattgagtgcaagatcgagaagcaacagtgcggagcgactgctcgaagctgtggcagccaccgccgcagaggagcctcctgaggccgctccagggagggctcgcgctgttgaaaaccaatactctttctactag

SEQ ID NO: 59719 - DNA, 927 bp, Artificial Sequence
  Description of Artificial Sequence: Synthetic coding sequence
atgaacggggctggtccgggtccagcggcagctgctcccgtcccggtacctgtgccggtacctgattggcgccagttttgcgagctccatgctcaggcggctgcagtggatttcgctcacaaattttgtcggtttctcagggacaatccagcttacgatactccggatgcaggagctagtttttctcggcacttcgctgccaacttccttgacgtgttcggagaggaggttcggagggttctggtcgctggcccaacgactcgcggagcagctgttagtgcggaggctatggaacctgaactcgcagacacctcagcactgaaagccgcaccctatggccattcccgctcatccgaagacgtaagtactcacgctgccaccaaggcaagagtacgcaaaggctttagtctaagaaacatgtccctgtgcgtggtcgatggcgttagggacatgtggcacaggcgggcttctccggaacccgatgctgcggctgctcccaggactgctgagccacgcgataagtggactcgcagactacggttgtctcgtactctggcagcaaaagtcgaactcgtggatattcagcgggaaggagcacttaggttcatggtagctgacgatgctgccgcaggatccggcggtagcgctcagtggcagaagtgtagactattacttagaagggcagtggccgaggaacgcttccgcctcgaatttttcgtcccacccaaggcatctcgtccaaaggtgtccatcccactctccgcgattatcgaagtgagaaccacaatgccgcttgagatgcccgaaaaggataatacgtttgtgctgaaagtcgaaaatggcgctgaatatattctggaaacaatcgatagtctgcagaaacattcttgggttgctgacatccagggctgtgtcgaccccggatag

SEQ ID NO: 59720 - DNA, 2016 bp, Artificial Sequence
  Description of Artificial Sequence: Synthetic coding sequence
atggatccaagctactgtccagcccatgggtttccaagtcaggacgcgttatggccgctcagcagtcaacagtggagcagcgcccactactctgaacccgcagcaggaggctgcgatggaacggaagcaatgaatggtgccggacctggcccagccgcagccgcaccagtccctgtgcccgtcccagtgccggattggcgccagttctgcgagttgcacgcccaagctgcagcggtggatttcgcccacaaattctgccggttcctacgcgacaaccccgcatacgacacccctgatgccggagcaagtttttctcgccactttgccgcaaatttcctggacgtgtttggggaggaggttcggagagtccttgtggccggaccgaccacccggggagccgcagtcagtgccgaggctatggaacccgagctggcagatacctccgctctgaaggctgccccttacgggcatagtaggagtagcgaggacgtgtccactcacgccgcaacaaaagctagagtacggaaggggttctcactccgcaatatgagtctgtgtgtggtggacggagtacgcgatatgtggcaccggagagcctcgcccgagcctgacgccgctgcggcacctaggactgctgagccacgggataagtggacgcgaaggctgagactctctaggacactggccgcaaaagtcgagctcgtggacatacagagagagggtgcgctgagattcatggtcgccgacgatgcagctgcagggagcggaggatctgctcagtggcagaagtgtcgattactgctccggcgtgccgtggctgaggagaggtttcgacttgaatttttcgtgccaccaaaggccagtagacccaaagtgtccatccccctctcagcaattatcgaggtccgaaccaccatgcctttagaaatgccagagaaagacaacacatttgtgctgaaagtcgagaatggggcagagtatattttagagaccattgactccttgcagaagcatagctgggtggccgacattcagggatgcgtggaccctggtctgtggccaggcgatcttgaaggttcctggacaaggtcatgtctgcaccctaagcgggctagcgagcactgggagttgggtagggatgggagtgagagcccaaaaggctgggggccaggagccgtggcccacatttgttggagccgaacccctgatctgaagaggcatctgagctcccacatttacctgttcgtgcccttaagcccctccccccatgtgcctcacaccgtcattcctacgtctggggagcagggggctgagaccgatccagaggcggaacccgaactggaactgagcgactacccctggtttcatggcaccctgtctagagtgaaggcagcgcaactggtcctcgcaggcggtccaaggaaccacgggctcttcgttataagacagtctgaaactcgcccaggtgaatacgtgctcacctttaattttcagggaaaagccaaggcaagccatctgaggttgtccctgaacggtcacgggcagtgccatgtacagcacttgtggttccagtccgtcctcgatatgctgcgccactttcacacgcaccctatacctttggagagcgggggaagtgccgatatcacccttagaagttacgtccgcgctcaagatccgccacccgaacctggtcccacacctccagcagcccctgccagtcctgcttgctggtcggactcacctggacaacactatttcagttctctggccgcagctgcctgccccccagcctctccctctgatgctgccggtgcaagcagctcctccgcttctagtagcagcgccgcatccggcccagcccctcctcgacccgtggaggggcaattgtcagccaggtcaagatctaattccgccgaacgactgttagaggcagtagctgcgacagccgcagaagagccaccagaagccgctccaggtcgagcaagagctgttgagaaccagtactcattctactag

SEQ ID NO: 59721 - DNA, 1899 bp, Artificial Sequence
  Description of Artificial Sequence: Synthetic coding sequence
atgaatggcgcaggaccaggtccagccgctgccgcaccagttcccgtgccagttccagtgcccgactggaggcagttctgtgagttgcacgcccaggccgcagcggtagactttgcgcacaaattttgccgattccttcgcgacaaccctgcctacgatactcctgacgcaggtgcctcattctctaggcatttcgccgcaaattttctggacgtatttggtgaggaggtcagacgagtgctcgtcgccggacccacaactcggggtgctgccgtctcagctgaagcgatggagcccgagctggccgatacaagcgcactaaaagccgctccgtatggacacagtcgtagctctgaagatgtatccacccatgccgctacaaaagccagggtgaggaagggattttccctcagaaatatgtctttatgcgtcgtcgatggcgtccgcgatatgtggcatagacgggcatctccagagcccgacgcagcagctgcaccacggacagcggagccgcgagataagtggactaggcgactgcgactctcacggacactggcagccaaagtggagctggttgacattcaaagagagggcgcactcaggtttatggttgcagatgacgccgctgccggatccggaggatccgcccagtggcaaaagtgcagactgttattaagacgcgcagtcgccgaagagcgcttcaggctggagttcttcgtgcctcccaaggcaagtaggcccaaggtttccatacccctgagcgcgattatagaagtgaggaccaccatgccgctggaaatgcccgagaaggacaatacttttgtcctcaaggtggaaaacggagccgaatacatactcgagactatagattccctccagaaacacagttgggtagccgacatccaaggttgcgtggaccctggagacagcgaagaggacacagaactgtcctgtaccaggggcggatgcctggcatctagagttgcgtcatgcagttgcgaactactgaccgacgctgtggatttgcctcgcccacccgagacaaccgctgtgggggcagtggtcacggccccacactcaaggggtcgcgatgctgtaagggaaagccttattcatgtgccgctcgaaaccttcctgcagaccctggaaagcccaggaggcagtgggagtgatagcaataatacgggcgaacagggcgctgaaaccgatccagaggcggagccggagctggagctatccgactatccttggttccatggcaccctctctagggtaaaagccgcacaattagttctagctggaggacccaggaaccacggcttgttcgtgatccgccaatccgaaactagacctggcgagtatgttttgacgttcaattttcagggaaaggcaaagcatttgcggctatctcttaacggacatggccagtgccacgtccagcacctttggtttcagtccgttttggacatgctgcgccattttcatacacatcctataccattggaaagcgggggatctgcagacattacgttgaggtcatacgtcagagcacaggaccctcccccagagccagggccaacccccccagctgctccagcttcacccgcatgttggagcgacagtccaggccagcattacttcagttctctggcagccgcagcctgcccacctgcaagcccatctgacgctgctggagcctccagctcaagcgcttctagcagcagtgcggcatctggtccggcacctcccagacccgtcgagggacagttgtcggctcgctctaggtctaattccgcagaacggcttcttgaggctgtggccgctacagcagcagaggagcctccagaagcggctccgggtcgagccagggcggtggagaaccagtacagcttctattag

SEQ ID NO: 59722 - DNA, 1236 bp, Artificial Sequence
  Description of Artificial Sequence: Synthetic coding sequence
atgacagaaatgagcgagaaggagaatgaacctgacgatgccgctacccacagcccgcctgggacggttagcgccctgcaggaaacaaaattgcagaggtttaaacgcagcctgagcctcaagacgatcttgcgctcgaagtccctggagaatttttttctcaggtccggctccgagctcaagtgtcccacagaagtcctgctcactccacccacacctctacctcccccttctcctccaccaaccgcaagtgatcgtggactcgccaccccatctccaagcccctgtcctgtacccaggcccctggccgcattaaaacccgtcaggctgcactctttccaagagcacgtgttcaaaagggcatccccctgcgaactgtgccaccagctcatcgttggtaatagcaagcagggcttgcgctgtaaaatgtgtaaagtttcagttcatctgtggtgcagcgaagagatttcacaccagcaatgtcctggaaaaacaagtacctcttttaggcggaatttctccagccctcttctcgtgcacgaaccacccccagtgtgtgccaccagtaaggagtctcccccaacgggcgactctgggaaggtcgatcccgtatacgagacccttaggtacggcacatccctggccctgatgaatcggtcctccttctcgagcacatctgagagcccaactagatcgctgtccgagcgagacgaacttacggaggacggtgaaggcagcatcagaagttctgaagagggtcctggagactctgctagtcccgtgttcacagctcccgcagagagcgagggccctgggccagaagaaaaatcccctggccagcaactgcctaaggcgacactgcggaaagatgtagggcctatgtattcctatgtggccctgtataaatttctgccacaggagaacaacgacctagctttacagcccggagatcgcatcatgttggtggacgatagcaacgaggactggtggaaaggtaagattggcgatcgcgtgggttttttccccgcaaattttgtccagagggttcgcccaggcgaaaatgtgtggaggtgttgtcagcccttctctgggaacaaggaacaaggttatatgagcctgaaagaaaaccagatctgcgtgggagttgggaggagcaaagatgccgatggctttatacgggtctccagcggcaaaaaaagaggccttgttcccgtggacgccttgacggaaatttag

SEQ ID NO: 59723 - DNA, 1095 bp, Artificial Sequence
  Description of Artificial Sequence: Synthetic coding sequence
atgacagaaaaggaggtgctggaaagcccaaagccctccttcccagcggagacacgccaatcgggactgcagagactgaagcagctgctccgtaagggttctacggggaccaaagagatggaacttccgccagaaccacaggcaaatggtgaggcggtgggggcagggggtggaccaatctactacatctatgaagaggaggaggaggaagaggaagaggaagaggagccccctcccgagccacctaagctggtaaatgacaaaccgcataagtttaaagaccacttcttcaagaagccaaaattctgtgatgtgtgcgcaagaatgattgtcctcaacaataagtttggcctgcgctgcaagaactgtaagacaaatatacacgaacactgccagtcatatgtggagatgcaaaggtgcttcggaaagatcccacccggtttccatcgtgcctacagttcaccgctctatagcaatcagcagtacgcttgtgtcaaagacctgtcagctgccaatcgaaatgacccagtattcgagacactgcggaccggtgtcatcatggcaaataaggagcggaaaaaaggacaggctgacaaaaagaaccccgtggcggcaatgatggaagaagagcctgagagcgcccgacccgaggagggcaagcctcaggacggaaatcctgaaggggacaagaaggcggagaaaaaaacaccagacgacaaacataagcagccaggctttcaacagtctcactacttcgttgctctgtatcgttttaaggcattggagaaggatgatctggatttccccccaggggagaagataacagttatagatgacagcaacgaggagtggtggagggggaaaatcggcgagaaagtgggctttttcccaccgaattttattattcgtgtgagagccggagagcgggtccacagagtgacgcgatcctttgtgggcaacagggagatcggtcagattaccttaaagaaggaccagatagtagtgcaaaagggagacgaagccggtggttatgtcaaagtctacactggccgaaaggtcggtctctttcctactgatttcttggaggagatttag

SEQ ID NO: 59724 - DNA, 507 bp, Artificial Sequence
  Description of Artificial Sequence: Synthetic coding sequence
atgaccgaaaaggaggtgctggagtccccaaagcccagttttcctgctgagacacggcagagtgggctgcaacgcctgaagcagcttctaagaaaagggtctaccgggactaaagaaatggaacttccgcctgaacctcaggccaatggggaggctgttggtgcaggaggcggtccgatctattacatttatgaggaagaggaggaggaggaagaggaagaagaggagccaccgccagagcctcctaaactggtgaacgataagccccacaaatttaaggatcacttcttcaagaaaccgaaattttgcgatgtgtgcgctcgaatgattgtcctcaataataagttcggactgcgctgcaaaaattgtaagaccaatatacatgaacactgtcagtcatatgtcgaaatgcaaaggtgcttcggaaagataccacctggattccaccgtgcttactccagcccactttacagcaaccaacagtacgcctgtgtgaaagacctgtag

SEQ ID NO: 59725 - DNA, 978 bp, Artificial Sequence
  Description of Artificial Sequence: Synthetic coding sequence
atggagctgcctccagagccccaagccaacggtgaagccgtgggtgccggaggagggcctatatattacatctatgaggaggaggaggaagaggaggaggaggaggaagagccacctccagaacccccaaagctggtaaacgacaagcctcacaaattcaaggaccattttttcaaaaagcccaagttctgcgacgtctgcgccagaatgattgtgctgaacaacaaatttggattaaggtgtaagaactgcaaaacaaatatacacgagcattgtcagagctacgtcgaaatgcagagatgcttcgggaaaatccctcccggttttcaccgagcctattcatccccactttattcaaaccagcaatatgcatgcgttaaggatctgagcgcagctaataggaacgacccagtcttcgagacccttcggacgggtgtgatcatggctaacaaggagagaaagaaggggcaggctgataaaaagaatcccgttgccgcaatgatggaggaggagcccgaatccgcaagacccgaggagggtaaaccccaagacggtaacccggaaggcgacaaaaaggcagaaaaaaaaacacccgatgataagcacaagcaacccggatttcagcagtctcactactttgtggccctctaccggtttaaggctctcgaaaaggacgacttggactttccccctggagaaaagatcactgtgatcgatgattcaaacgaggaatggtggcgtgggaagattggggagaaggtgggcttttttcctcctaattttattatacgggtgagagccggagagagagtccaccgagttacccggtcattcgtgggtaatcgggagattggacaaattacgctgaagaaggatcagatcgtggtccagaagggagacgaggccggtggctatgtcaaagtgtacactgggagaaaagtggggctttttcccactgattttctggaggagatctag

SEQ ID NO: 59726 - DNA, 4193 bp, Artificial Sequence
  Description of Artificial Sequence: Synthetic coding sequence
atgcctagcaagccagagggcgctgcaaagacaatcgggagctatgtgccgggtcctcggtcccgctcacctagtctgaatcggttaggcggtgccggtgaagatgggaaacgccctcagccactgtggcatgtgggaagtccgttcgctttgggcgctaataaagattcactgtctgccttcgagtaccctggcccaaagcggaaactgtatagcgcggtgcccggaagactttttgtggccgtcaaaccttatcaaccccaggtggatggcgaaattccgctgcaccggggtgaccgcgtgaaagtcttgtcaatcggtgaaggcggattctgggaaggaagcgctaggggacatatcgggtggtttcccgcagagtgtgtagaggaagtgcagtgtaagccgcgagatagtcaggccgagacacgtgccgatcggagcaaaaagctgtttcgacactacacggtcggttcgtacgacagctttgatactagttctgactgcatcatagaggaaaagaccgtcgtactgcaaaaaaaggacaacgagggattcggatttgtactgaggggcgcaaaggccgatactccaatcgaagaattcacacctacccccgctttcccagcgttacagtatctggagtctgtcgacgaaggaggcgttgcgtggcaggcgggacttcggactggtgatttcctaatcgaggtcaataacgaaaacgtggtgaaggtagggcataggcaagtcgtgaatatgatccgtcaagggggtaatcacctggtgctgaaggtggtcactgtgacccgtaacctggatcccgacgacacagcccgaaaaaaagcccctccccctcctaagcgcgctcccaccactgcactcacactgagaagcaaatccatgacctcagagctggaggaactcgtggacaaggcgagcgtgaggaagaaaaaagataagccagaagagattgtgcctgctagcaagccttctagagccgcagagaacatggccgtggaacccagggtggcaacaattaaacagagaccgtcctcccgatgtttcccagctgggagtgacatgaacagcgtttacgagcgtcaaggaatcgccgttatgacacccaccgtgcccggatcaccaaaggctccctttttaggaatcccacggggaaccatgcggagacagaaaagcatcgacagccgcatatttttgtctgggatcaccgaagaggagaggcagttcctggccccacccatgcttaagtttacccgctctctttctatgcccgacacgagcgaggatattccaccaccgccacaatcggtacctcccagtcccccacctcccagtccaaccacctataattgccccaaaagtccaacacctcgcgtctatgggaccattaaaccagccttcaaccagaatagcgcagcgaaggtctctcccgctaccaggagtgacactgtggcaaccatgatgagagagaagggcatgtacttccgccgagaacttgataggtacagccttgactctgaggacctttattctagaaacgcgggtccccaagctaatttccgtaataagagaggccagatgcctgaaaacccatattccgaggttggtaagatcgcgtccaaggccgtgtatgttccagccaagcccgctcggcgtaagggcatgctggtcaagcagagcaatgtggaagattctccagagaaaacatgctctataccgatccccaccatcatcgtgaaggagcccagtacttccagctccggcaaatcttcccaggggtcctcaatggagatcgatccacaggctcctgagccaccgagtcagctgaggcccgacgagagcctcacagtgagttctcctttcgcagcggctatcgccggtgcggtccgggacagggaaaagagactggaggccaggagaaattcgcccgctttcctatcgacagatcttggcgatgaggacgtaggtctgggccctcctgcccctcgtactcggccatctatgtttcctgaggagggcgactttgccgacgaagacagtgctgagcagctttcatccccaatgccctccgctactccacgggagcctgagaaccactttgtcggaggcgcagaagcttctgctccgggtgaagctggcaggccactgaactctacttccaaagcccaggggccagagtcgtcaccagctgttcccagtgcctcctctggcaccgccggtcccggaaactatgtccatcctttgacagggcgtctgctggatccctctagccctctagccctggctttgagtgcccgtgacagggctatgaaggaaagtcagcaaggtcctaagggggaggcgccaaaagccgacctcaataagcccttatacatcgacactaagatgcgcccaagcttagatgccggattccctacggtgacacgacaaaacacacgtgggcctctccggagacaggaaaccgaaaacaagtacgagacagatctgggtcgagaccgcaagggcgatgacaagaaaaatatgctcatcgacattatggataccagtcagcagaagtccgccggactgctgatggtacacacagtagatgcaacgaaattggacaatgcactccaggaagaggacgaaaaagccgaagtggagatgaagccagattcctccccctcagaagtgccagaaggggtgtccgagaccgaaggtgcactgcagatcagcgctgcaccggaaccaactacggtgcctggccgaaccattgtggccgtaggctctatggaagaagccgtaatcctcccattcagaattcctccaccacctcttgcctctgtggatctggatgaggacttcatctttactgaaccgctacctcccccactcgaattcgcaaacagcttcgacatacccgacgatagagccgcatccgttccagccctctccgatcttgtgaaacaaaagaagagcgacactcctcagtctccatctctgaactcgagtcaaccaaccaactctgctgattcaaaaaaacccgcatcattgagtaactgcctgcccgcaagttttctgccccctccagaatccttcgacgctgttgcggattccgggatcgaagaggttgattccaggagttcctctgatcaccacctggaaacaacatccaccatctctacagtgtcctccataagtaccctgagctccgagggaggggagaatgttgatacctgtactgtctacgcagatgggcaggcattcatggtagataagcctcctgtccctcctaaaccaaagatgaaacccattatccacaagtctaacgctctgtaccaggatgcactggtcgaagaggacgtggatagtttcgtgattcctcccccagcaccacctccccctcctggctctgcacagcctgggatggcgaaggtgctccagcccaggacaagcaagctgtggggcgatgtcactgagatcaagtccccaatcttgagtggccctaaagctaacgtgatctccgagcttaacagcatcctccaacagatgaatcgagagaagcttgccaaaccgggtgagggccttgacagccctatgggagctaaatccgcctcattagctcctcgatcaccagagattatgtctacaatctccggcactcgctctactacagtgaccttcaccgtgagacctggtacatctcaaccgatcacattgcagtctcggccacctgattatgagagccgtacatccggtacaagaagggccccatctccggtagtatcaccaaccgagatgaacaaggagactcttcctgccccactgtctgccgctactgcaagcccctcacctgcgctgagtgacgtgtttagcctgccctcacagccccctagcggtgacctgttcggactgaatcctgctgggaggagccgttctccctctccttcaattctgcaacaacctatttctaacaaacctttcaccactaagcccgttcatctctggactaaacccgacgtagcagactggctggagtctctgaaccttggcgaacataaagaagcctttatggataatgagattgatggctcccacctgccaaatctccagaaagaagacctgatagacctcggggtgacaagagttgggcacagaatgaacatcgagcgcgctttgaagcagctcttggaccgtta

SEQ ID NO: 59727 - DNA, 4011 bp, Artificial Sequence
  Description of Artificial Sequence: Synthetic coding sequence
atggaaaaccttcccgcagttacaacggaggaacccacccccatgggaagggggccagtggggccttccggaggcggttccacgagagatcaggtgaggactgtcgtgatgcggccttcagtgagctgggagaaagccggtcctgaggaggcgaaagcaccagtgaggggcgacgaagccccaccagcccgagtagccggtcccgctgcaggaactcctccatgccagatgggcgtttaccctaccgatctaacactacagctactggcagtgaggcgaaaaagtagactgagagacccgggactgcagcaaaccctccgcggacagttgagacttcttgagaacgattcaagagagatggcccgagtccttggggagttgtccgccagattactgagtatacatagtgatcaggaccgcattgtcgtgacatttaaaaccttcgaagagatctggaagtttagcacttaccatgcactagggtttacccaccattgcctcgcaaatctcctaatggatcaagcgttttggctgttattaccgtctgaagaggaagagacagccatccaggtccacgtcgatgagaatgccctgcggttaacacacgagagcttgttgatccaggaaggcccttttttcgtactgtgtcctgatcaccatgtccgcgtgatgaccggtccacgggacgctggtaatggaccgcaggcacttagacaagcatctggggctccacagggggaggctgcgccagaaacagacagctcacctccatctccatccgtgagctccgaagaggtggcggttgccgcagcgccagagccgctcataccatttcaccagtgggcattaagaattccccaggacccaattgacgatgcaatggggggacctgtaatgccgggaaatcctcttatggccgtggggctggcatcagcccttgccgattttcagggcagtgggcctgaggaaatgaccttcagggggggagacctcatcgagatcctgggagctcaagttccttcacttccatggtgtgtggggagacacgcagcatccggcagggttggcttcgtaaggagcagcctcatctcaatgcaagggcctgtgtcagagctggaatccgcgattttcctgaacgaagaagaaaaatctttctttagtgaagggtgtttttcagaagaggatgcgaggcaactactacggagaatgagtggaacagatgtatgctccgtttattccctcgactccgtggaagaggctgaaacagagcaaccccaagagaaggagatcccccctccatgcctttcactggagccccaggagactctgcagaaggtaaaaaacgttctggagcagtgtaaaacttgccctgggtgcccacaagaaccagcctcgtggggcctttgcgcggctagctctgacgttagcctgcaggatccggaggagcctagcttctgtctggaagctgaggacgattgggaggatccagaggctctgagttccctgcttctctttctcaacgcgcctggctataaagcgagcttccgaggactctatgacgtggccctcccctggctatctagcgtgttcaggtcttttagcgatgaggaagagcttactggcaggctcgctcaggctagaggagctgccaaaaaagctggtctgctgatggcactggcacgcctctgttttctcctgggacgactgtgctccagacgactgaaactgagccaggctagagtgtacttcgaggaggccctgggcgctcttgagggctccttcggcgatctgtttctggttgtagcggtgtacgcaaacttagccagcatctaccggaagcagaaaaatagagaaaagtgcgcccaggtggtccctaaagccatggctctcttgctgggaacacccgaccacatctgcagcactgaggcagaaggtgagctcctgcaactggctctgcgcagagccgtcgggggacagagtctgcaggccgaagctagagcatgtttcctgctcgccaggcatcatgttcatctgaagcaaccagaggaggctttgccattcctggagaggctacttctcttgcaccgagattccggcgctcccgaggccgcttggctttctgattgctatctgctgctggccgatatttactcccgcaagtgcttgccacacctggtactgtcttgcgtgaaggtcgccagtctcagaacacgagggtccttagccggatccttaagaagtgtgaaccttgttctccaaaatgcccctcagccgcactcactgcctgcacaaacctcacattacctcaggcaggcactcgcaagcttgacccctgggacaggacaggccctgagaggaccattgtacacgtccctggcacaactgtatagccaccacgggtgtcacggtcccgcaatcaccttcatgacccaggcagttgaggcctccgctattgcgggtgtgcgagctatagtcgatcatctggtggcacttgcctggctccatgttttgcacggacagagtcctgtggctctggacatcctgcagagcgtccgtgacgctgtggtcgcaagtgaggatcaggaaggggtgattgccaacatggttgccgtggccctgaaaagaactggtaggacacgccaggcagccgaatcatattacagagcattgcgggtggcgagagacctaggccaacagagaaaccaggcagttggcttagccaactttggagccctgtgcctacatgctggggcaagtcgactggcgcagcattatctgttggaggcggtcagattgtttagccggctgccactgggcgagtgcggaagggatttcactcacgtcctgctgcagctgggtcacctgtgtacacgtcaaggccctgctcagcaggggaaggggtactacgaatgggctctgttggtggcagtagaaatgggtcatgtggagagccagttgcgcgctgtgcaacgcctctgccacttttattctgcagtcatgcctagcgaggcacaatgtgtcatctatcacgaactccaactgagtctggcctgcaaagttgcagataaggtgctcgagggacagctgcttgaaaccataagccaattatacctgagccttgggaccgaaagagcctataagtccgccctggattataccaaacgaagcctcggcatctttatagatttgcaaaagaaggaaaaggaggcacacgcctggctgcaggctgggaaaatctactacatcctccgccaatctgagctcgtggatctctatatccaagtggcccagaacgtggctctctatactggcgaccccaatcttggcctggagttgttcgaggcagccggagatatattcttcgatggagcatgggaacgggaaaaagcagtatctttttaccgcgatagggcacttccattggccgttaccactggaaatagaaaggccgagctccggttgtgtaataagctggtggccttactggcaaccctggaggagccccaagagggcctagagtttgcccatatggccctcgccctctccatcaccctgggtgacaggctgaacgagagagtggcttaccaccgtctggcggcactgcagcacagactgggccacggtgagcttgctgaacacttttaccttaaagctctgagcctctgcaatagccccttagagttcgatgaagagactctgtattacgtgaaagtttatctggttctcggagacatcatattctatgatcttaaagacccctttgacgccgctggatactaccagctggcactggccgctgccgttgacctcggcaacaagaaggcacagctgaaaatttatacacgtctggccacgatttaccacaattttctactggacagagagaagtcacttttcttctatcagaaggcgaggacgttcgccactgaattaaacgtgaggagggttaacctgccccctctgcccctctgtggctgggccccttggctggcccctagccaccctcgctag

SEQ ID NO: 59728 - DNA, 2469 bp, Artificial Sequence
  Description of Artificial Sequence: Synthetic coding sequence
cctacgcgcgcttcttcttcaaagaaacagcgccctccttcgagcggctcccggtgggccctgcgtatacctcaagatcccatcgacgacgctatgggcggtccagtcatgccaggaaatccgttgatggctgtgggattggcctccgctttagccgattttcaaggaagcggtcccgaggagatgacattccgcggaggagatctgatcgagattctaggcgctcaggtgcctagtctgccttggtgcgtaggtcggcacgcagcctctggaagagtgggattcgtgaggagcagtttaatctcaatgcagggacctgtgagtgagttagagtcggccattttcctgaatgaggaggaaaagagctttttcagcgaagggtgtttctctgaagaggatgctcgccagttgcttaggaggatgtccgggacggacgtttgttctgtgtactctcttgattccgttgaagaggctgaaactgagcagcctcaggagaaggaaatcccacctccatgccttagtctggagcctcaggaaactctgcagaaggtgaaaaatgtgctcgaacagtgcaagacatgccctggttgtcctcaggagcctgcatcttggggactgtgcgcggctagctcagatgtgtctctgcaggatcccgaggagccctctttttgtctagaggccgaagatgattgggaggatccggaagccttaagcagtctacttctgttcttgaacgccccaggctataaggcttcctttcgcggtctctacgatgtggcccttccttggcttagctccgtcttccggagcttcagcgacgaagaggagctaacaggccgactcgcacaggcccgaggcgcagctaaaaaggcgggactgctaatggcgctggccagactatgcttcctgcttgggaggctgtgtagccgtaggcttaagctgtcccaagcaagggtatactttgaagaggcactgggcgcactcgaggggagtttcggcgacctcttcctcgttgttgcagtgtatgccaacctggcctccatttacagaaaacagaagaatagagagaagtgcgcccaggtggtacccaaggccatggctctcctgttgggcacgcccgatcacatctgtagtaccgaggccgagggtgagttgcttcaactggctctaaggagagctgttggaggacaatccttgcaggctgaagctcgggcatgcttcctgctcgcacgccaccacgtgcacctgaaacagcccgaagaggcactcccatttctcgagcgactgctccttctccaccgagatagcggtgctcccgaagcggcatggctgtctgactgttatctgctacttgccgacatttactctcggaagtgtctgccacatcttgtgctctcatgcgtaaaggtcgccagtctacggactcgcggaagtctcgcaggaagtctgaggtcagtgaacctcgtccttcagaacgcaccgcagccccattctctgccggctcagacttcccactatttgcggcaggcccttgcttccctgacccccggaaccggccaggcgctaagaggcccattgtacacttctctggcacaactgtacagccatcacggctgccatggccctgctattaccttcatgacccaagctgtagaagctagcgcaatcgcaggagtgagagccatcgtggatcatctcgtcgcactggcatggttacatgtcctgcatggccagtctccagttgccttagatattttgcagagcgtgcgggatgccgtggtggcgagcgaggatcaggagggcgtgatcgcgaatatggtcgcggtcgcactgaagagaacagggcgtactaggcaggcagccgagtcttattatcgggctctacgcgtggcccgagatttgggccaacaacgtaatcaggccgtgggtctcgcaaatttcggggcactgtgtcttcacgcgggtgcaagtcgactagcccagcattatttgctcgaagccgttcgactgtttagtcgattgccactcggcgagtgcggtcgagacttcacccacgtcttattgcagctgggacatctctgtacacggcaggggcctgcccagcagggaaaaggctattatgaatgggcccttctggtagctgtcgaaatgggccacgtagagtctcagctgagagcagtgcagaggctgtgccacttctactctgctgtaatgccatccgaggcccaatgtgttatttatcatgaactgcagctttcactggcgtgcaaggtcgccgacaaggttctcgagggtcaacttctggagaccattagtcagctctacctatcgttgggcacggaacgttcgtcccagccccaacagaagcagcttcacgccttctgggctgtgctgcccacgtggtggctgctgtcttctgatctctgcctgcccagagtattcacccccggactccatttaagcccctag

SEQ ID NO: 59729 - DNA, 285 bp, Artificial Sequence
  Description of Artificial Sequence: Synthetic coding sequence
atggaaaatcttccagctgtcacaaccgaagaacccaccccaatgggcagagggcctgtcgggccttccggcggaggatccacccgtgaccaagtgcggacggtggtgatgcgacccagtgtctcctgggagaaggccggacctgaagaggctaaggccccagtgcggggagacgaggcaccgccagccagagtagctgggccagccgctgggacgcctccctgccagatgggagtgtatccgaccgaccttacactgcagctgttggcggtccggcgtaaatag

SEQ ID NO: 59730 - DNA, 3195 bp, Artificial Sequence
  Description of Artificial Sequence: Synthetic coding sequence
atggaccaggcattttggctgttactccctagcgaagaggaagaaacagccattcaggttcatgtggatgagaacgccttacgcctgacccatgaaagcttgctgattcaggagggccctttcttcgtgctatgtccagatcatcacgtgcgcgtaatgactggaccccgagacgccggtaacggcccacaggctctgcgccaggccagcggagccccacaaggcgaggcggcaccggagaccgactcaagcccccctagcccctcagtctccagcgaagaagtcgcagtcgccgcagcaccagagcccctcatcccatttcatcaatgggcactgaggatccctcaggatccaattgacgacgcgatgggcggaccggtgatgcccggaaaccccctgatggcggtgggactcgcctccgcgctggcggacttccagggctccgggcctgaagagatgaccttccgcggtggggacctgatagagattttgggggcacaggtccctagtctgccatggtgcgtcgggagacatgccgcttcagggagggtgggcttcgtgaggtcatctttgatttccatgcagggacctgtgagcgaactcgagagcgcaatctttcttaatgaggaggaaaaaagcttcttctccgagggatgcttttcagaagaggacgctcgacagctattacggagaatgtccggaactgatgtgtgtagcgtatactccctagactccgtcgaggaagccgagacggagcagcctcaggagaaggaaatcccgcctccttgtttgtctctagaaccccaggagaccctccaaaaagtcaagaacgttctggaacagtgtaaaacatgtccaggttgtcctcaggagccagcctcttggggcttgtgcgcagcctcttcagacgtcagcctgcaggatccagaagagccaagcttctgtctggaagccgaggacgattgggaagatcccgaggcgcttagttctctcctgctctttttgaatgccccaggctacaaggcctcctttcggggactctatgacgtggcccttccctggctttcatcggtgttccgtagcttttctgatgaggaagagcttactggaagactggcacaagcgaggggcgcagcaaagaaggccggtctactgatggcactggcacggctctgctttcttttgggtagattatgttcgcggagactaaagttatctcaggcgagagtatattttgaagaggcgcttggggctctcgaaggctcctttggcgatctgtttctggtggtggccgtttacgcgaatttggcatccatctatcgcaaacagaagaatcgtgaaaaatgtgctcaggtcgtcccaaaggccatggcactgctgctcggcactccagatcacatttgcagcactgaggccgaaggcgagctgttgcagctggctctccggagggctgtcggaggccagtccttacaggctgaggccagggcatgcttccttctggcaagacatcacgtccacctgaagcagcctgaggaggccttgccatttcttgagcggcttctgctattacacagagactctggggctcccgaggctgcatggctgtctgattgctacttgctacttgcagacatctacagcagaaagtgtctgccacacctggtgctctcctgtgtgaaagtcgctagcctccgaacccgcggaagccttgcaggttcgctgcgctcagtgaaccttgtcttacagaacgcaccgcagcctcactctttgcccgcacagacaagccactacctccgacaggcactcgcaagtctcacaccaggcactggccaggctttgcggggtccactctatacttccttagctcagctgtattctcaccacgggtgccacggccctgccatcacatttatgacccaggctgtagaggccagcgctattgctggagtgagggctatcgtcgatcatttagtggccctggcatggttgcatgttctgcatggccagtcacccgttgccctggatatcctgcagtccgtgagggacgccgtcgtggcctctgaagatcaggagggagtgatagcaaacatggtcgcagtagctctcaagaggacggggcgaactaggcaggcagccgaatcatattatcgcgctttgcgcgtggctagggatctgggacagcagcggaatcaagccgttggcctggcgaacttcggtgcactttgtctccatgccggagcgtctaggttagcgcaacactatctgctcgaggccgtgcgcctcttttctcgtttgcctctgggcgagtgtggaagggacttcacacatgtgctattgcagctcggtcatctgtgcacaaggcagggccctgcccagcaaggcaaagggtactacgagtgggccctgctcgtcgccgtggagatgggtcacgtagaaagtcagctgagggcggtgcagaggctatgccatttttacagcgccgtcatgcccagcgaggcccagtgcgtgatttatcacgagttacaattatcgttggcatgcaaagtggctgataaagtcctagaagggcagctgcttgaaacaatctcacaattgtatctgagtctgggcacagagcgcgcttataagagcgcgctggactataccaaaaggtcactggggattttcatagaccttcaaaagaaagaaaaggaggcccatgcctggctgcaggccggaaaaatctactatattctccggcagagcgaattggtggacctgtacattcaggttgctcagaacgttgcattgtatacaggcgacccaaacttgggtctcgagctcttcgaagcagcaggtgacattttttttgatggggcttgggagcgcgaaaaagcagtgtctttctatcgcgatcgcgctctgcctcttgctgttacgacgggcaaccgcaaggccgagctcaggttgtgtaacaagctggtagcactccttgctaccttagaggagccccaggagggactcgaatttgcacacatggccctggctttgtccattaccttgggggaccgactgaatgaaagagtggcctaccataggctcgctgcgctgcaacataggctgggccacggcgagctcgcagagcatttctacctgaaggcactaagcctctgcaattctcccctcgagttcgacgaggagaccctgtatacttag

SEQ ID NO: 59731 - DNA, 3783 bp, Artificial Sequence
  Description of Artificial Sequence: Synthetic coding sequence
atgggagtgtaccccaccgatctcacactccagttactggcagtgcgcagaaagtcaaggttgcgggatcccggtttgcagcagactttgagaggccagctgcgcttgctcgaaaacgacagcagggaaatggcacgggtgctcggagaactttctgccaggttgctgtcaatccattctgaccaggaccgaatcgttgtaacttttaaaactttcgaagagatatggaaatttagcacataccacgctcttggcttcacacaccattgcctcgccaacctcttgatggatcaggccttttggttgctgctaccttccgaagaggaagaaacagccatccaggtccatgtggatgaaaatgccctgagacttacacacgagtcactattgatccaggagggcccttttttcgtgctgtgcccagaccatcatgttcgggtgatgacaggtccacgcgatgctgggaacggtcctcaggctctcaggcaagcttcaggggctccccaaggggaagccgctcccgagacagattcctcccctccctctccttccgtgagctccgaggaggtggccgttgctgccgctcctgaacccttgatcccattccaccaatgggccttgagaattccccaggatcctatagatgacgccatggggggacctgtaatgccaggaaatccactgatggctgtgggtctggcaagcgctcttgcagattttcaaggatccggaccagaggaaatgacatttagaggaggggatttgatcgagatactaggcgcacaggtcccatccctgccttggtgtgttggtcgacatgccgcttctggacgtgttgggttcgtgcggtccagcctcatcagcatgcaggggcctgtctctgaattagagagtgctatttttctgaatgaggaggagaaaagcttttttagcgagggctgtttcagtgaagaggatgctaggcagctcctgaggcggatgtctgggacagacgtgtgctctgtgtattccttagatagtgtggaggaggctgagaccgaacagcctcaggagaaggaaataccccctccctgcctatccctggaacctcaagagactctgcagaaagtgaagaatgtgttagagcagtgtaagacgtgccctggatgtccacaggagcccgcatcgtggggcctgtgtgccgcttctagtgatgtgtcattacaagatccagaagaacctagtttttgcttagaggctgaggacgattgggaagatcccgaggctctcagtagcctgctgctgttccttaatgcccctggatacaaagcttcttttaggggactctacgacgtagcccttccctggttatctagtgtattccgtagtttctcagacgaggaagagctgactggcaggctggctcaagccaggggggcagcgaagaaagccggacttctaatggctcttgcacgcctttgctttctgttaggcagactgtgctctagacgtctcaaactcagtcaggcacgcgtctactttgaggaagcactcggcgctttggaaggtagttttggagacctgttcctcgtcgtagccgtttatgccaaccttgcttcgatatatcgcaaacagaagaatagggagaagtgtgcacaggtggttcctaaggccatggccctattgttggggacccccgatcatatctgctcgaccgaggctgagggcgaacttctccagctcgcgctccggcgtgcagtaggcggtcagtcgctgcaagctgaagcaagagcctgtttcctgctggcacgccatcatgtgcacctcaagcaacccgaggaagccctgccatttttggagaggttgctcctgctgcacagagattctggcgctccagaggcagcttggctttccgattgctatctcttgcttgcagatatctattccaggaaatgtctcccccacttggtcctctcttgcgttaaagttgcgtcactgcgcacccgtggcagcctcgctggcagcctgcggtctgtaaacctggtgctgcagaatgcccctcaaccacacagcctgccagcacagacgtctcactacctgcgtcaggctctcgctagcctgactcccggaactggccaggcacttcgtgggccactctacacctctcttgcacaattatattcacaccatggttgtcatggccctgccattactttcatgactcaagcagtcgaagcatccgccatcgccggagtgagagccatagttgatcaccttgtggccttagcctggttgcatgtgctacacgggcaatctccagtcgcattagacattttacaaagcgtacgggatgccgtcgtggctagcgaggaccaggaaggcgtgatcgcaaacatggtggcagtggcactgaaacgcaccggaagaacacggcaggctgccgagtcctactaccgtgcgttacgagtagcccgtgatctggggcagcagaggaatcaggcggtaggactggcaaacttcggagctctgtgtctccacgccggagcctctcgcctggcacagcattaccttttagaagctgtgcggttgttctcccggctgcctcttggagagtgtggcagagacttcacgcacgtcctgctccagctggggcacctttgcaccagacaggggccagctcagcagggcaaggggtattacgaatgggcacttctggtagccgtggagatgggccatgttgaatctcagcttagggctgtgcagaggttgtgccatttttactccgctgtgatgcctagtgaggcacagtgtgtgatctatcacgaattgcagctctcccttgcatgcaaagtggcagacaaggtgctggagggtcaactcctggaaaccatatctcagctgtacctctcccttggcaccgagcgagcctacaagtccgccctggactacaccaaacgctctctgggtattttcatagacctccagaaaaaagaaaaagaagcccacgcttggttacaagccggaaaaatctactatatcctgaggcagtccgagctggttgatctgtacatccaggtcgcccagaatgtggccctgtatacaggggaccctaacctgggacttgagctgttcgaggcggcaggcgacatcttctttgatggggcatgggagcgcgagaaggccgtgtctttctatagagatagagctctccccctcgccgtgacgaccggaaacagaaaagccgaactgcggctctgtaataaactggtggccctgttggccactctcgaagagcctcaagaaggactggagtttgcccatatggccctagcgctaagcattacgctcggagatagactgaatgagagagtagcctatcataggttggcggcattgcagcacagactgggccatggagagctcgccgagcatttctacttaaaggcactgagcttgtgcaatagcccactggagtttgacgaggagactctatattacgtgaaggtgtatcttgtgctcggcgatatcatattttacgatttgaaggaccccttcgacgctgccggatactatcaattagcactggctgccgctgtcgatttaggcaacaaaaaggcacagcttaaaatatacacaagactggccaccatttaccataactttctcttggaccgggagaaaagtttgttcttctaccaaaaggcacggacattcgcaacagaactcaacgtccgccgagtaaacttgccaccattgccactgtgcggctgggcgccttggctggctccatcacacccaaggtag

SEQ ID NO: 59732 - DNA, 1209 bp, Artificial Sequence
  Description of Artificial Sequence: Synthetic coding sequence
atgcccgacaaaacagccactcccgaacggcctcctgcacccgaaaacgcaccaagctctaagaaaatcccggctcccgataaagtacccagtcccgaaaagaccctgacattgggcgataaggctagcatacccggaaactccaccagcggcaagattcccgctcccgacaaggtccctaccccagagaagatggtcacacccgaagataaagctagcatcccagagaatagtattatacccgaagagacactcacagttgataaaccatccacccccgaacgcgtgttctcagtggaggaatcccccgcactggaagcccctccgatggacaaggtacctaaccctaaaatggctcctctcggagacgaggcccctacgctggaaaaggttctgacccctgaactgagcgaagaagaagtgtcaacacgagacgacattcagtttcaccatttttcctccgaagaagccctgcaaaaagtcaaatatttcgttgcaaaagaggaccctagtagccaggaggaggcgcacacccccgaggctcctcctccacagcccccaagttccgaaaggtgcctgggcgaaatgaaatgcaccctcgtgaggggggacagctctccacggcaggctgagctcaaaagtgggccagcaagtaggccagccctggagaagccacatccccacgaggaagccaccactcttcccgaggaggccccatctaacgatgagagaactccagaagaagaggcccctcctaatgagcaaaggcccctccgggaagaggttcttcccaaggaaggggtggcctctaaagaagaggtcacccttaaagaagagctccccccaaaggaggaggttgccccaaaggaggaagtcccgccaatcgaacgtgcttttgcacagaagactcgccctatcaagcccccaccggacagccaggaaaccctggctctgccttccctggtgccgcagaactatactgagaacaagaacgagggagtggatgtgaccagccttcggggagaggtcgagagcctccgtcgagctctggagctgatggaagtccaattagaacgaaagctcactgatatttgggaagagctgaagagcgaaaaggagcagcgacggcgtcttgaagtgcaggttatgcaggggactcagaaaagccaaactccccgagtgatccatacacaaactcagacttattag

SEQ ID NO: 59733 - DNA, 1923 bp, Artificial Sequence
  Description of Artificial Sequence: Synthetic coding sequence
atggtccagagcgagctccagctgcagccacgcgctggaggcagggccgaggccgcttcttggggagatcgcggtaacgacaaaggcggactggggaatccagatatgcccagtgtttcccctggccctcagcgccctcctaagctgagtagtctagcttatgacagcccacctgactatcttcagacggttagccatccagaggtctatcgggttctgttcgactatcagcctgaagcacccgacgagctggcattgcgaagaggcgatgtggtcaaggtgctttcaaagactaccgaggacaagggatggtgggagggggaatgtcaaggtagacgtggcgttttccctgataatttcgttctgcctccccctccaatcaagaagctcgtcccgcgaaaggtggtgtcccgcgaaagcgccccaataaaggaacctaagaagcttatgccaaaaaccagcctgccaacagttaaaaagctggccaccgctacaacaggaccctccaaggctaagacctcaagaacgccatcccgggattcccaaaaactcactagccgagatagcggtcccaatggcggattccagtccgggggttcataccatcctggccgaaaacggtccaagacccaaacacctcaacagcgatccgtcagctcgcaagaggaagagcactccagcccggtcaaagctccctccgtgaagcggaccccgatgcctgacaaaacagcaaccccggaaaggccccctgcccctgagaacgctccttcgagtaaaaagatccccgcacccgataaggtcccctcgcccgagaagacactgacactgggtgataaagcctcaatcccaggtaactccacctctggtaaaatacccgcacctgacaaggttcccacgccagaaaagatggtgactcccgaagataaagcatccatccccgagaactctataatccctgaggaaactctgacggtggacaagccgtccactcctgagcgcgtattctccgtggaggagtctcctgcattggaggcccctcctatggataaggtccccaaccctaagatggctccactgggagacgaggcacccaccctcgaaaaagtgctcacccccgagctttcagaggaggaagtgtcaactcgcgacgatatccaatttcatcactttagcagcgaggaggccttacagaaggttaagtactttgtcgcgaaggaagacccttctagtcaggaggaagcgcacactccggaggccccacctcctcagcctcccagcagcgaacggtgcctgggcgagatgaaatgtacactggtaaggggcgattcatccccacggcaagctgaattgaagagcggtcctgccagccggccagcattggagaaaccacacccgcacgaggaggcaaccaccttacccgaggaggcacccagcaatgatgagaggacgccagaggaggaggcaccccctaatgagcaacgacctctaagagaggaagttctgcccaaggagggcgtggctagcaaagaggaggtcactctgaaagaggaattaccacccaaggaggaagttgcacccaaagaggaggtgccacccattgaacgggcttttgctcagaagacccggcctatcaagccccctcccgactcccaagagacattagcactcccgtcacttgtccctcagaactataccgagaataaaaacgaaggcgtagatgtcacaagcttgaggggcgaggtcgaaagtctgaggagggccttagagctgatggaggtgcaactcgagagaaagttgacagatatctgggaggagctgaagagtgagaaagaacagagacgcaggctcgaggttcaggtgatgcaggggacccaaaagtctcaaaccccgagggtgatccacacccagacacagacgtactag

SEQ ID NO: 59734 - DNA, 2271 bp, Artificial Sequence
  Description of Artificial Sequence: Synthetic coding sequence
atggaagtgcttgttctggctgggtaccgagctcagaaggaggacgagctgtccctggcccctggtgatgttgtgcggcaggttaggtgggtgcccgctcggggatggctgagaggggaattcggcggacggtacggactgttcccggagcggctggttcaggaaatcccagagactttgagaggttcaggggaggcgagacgccctcgttgcgcaagacgacgtgggcaccccgcaaaacatccacggcctcagcggtggtgcaaggtgaattttagttacagtcccgagcaggccgatgaattgaagctacaagccggagaaatcgtggagatgataaaggagattgaagatggatggtggcttggcaaaaagaacgggcaactgggggcattcccttccaacttcgttgagttactcgactcaggcccaccatccttgggcaacccagatatgccttccgtcagcccgggtccccaacgacctccaaaactgtcctctctcgcttacgatagccctcccgactacctgcaaaccgtgagccatcctgaggtctatcgggttctgtttgactaccagccggaggcccctgatgagcttgcgctgcggcgaggagacgtagtgaaggtgctgtcaaagacaactgaggataaggggtggtgggagggggagtgtcagggtagaaggggcgttttccctgacaatttcgttcttcctccccctcccataaagaagctggtaccacggaaagtcgtcagcagggaatcggctccaatcaaggaaccaaagaaactcatgccaaaaacttccctcccaaccgtgaagaagctcgctacggccactacagggccatccaaggccaagacctcccgcacaccttcccgcgactctcagaaacttacatctcgggacagcgggcctaacgggggatttcaatccgggggtagttaccacccaggaaggaaacgttccaaaacacagaccccgcagcagagaagcgtaagtagtcaggaagaagagcactcctcaccggtcaaggctccctccgtcaagcgtacacccatgcctgacaaaactgccacccctgagcggccacccgctcctgagaatgctcctagctcaaagaaaattcccgctcctgacaaagtgcccagccctgagaagacactaacactgggagacaaggcaagtatccctggcaactcaacatcagggaaaatccccgctccagacaaggtgccgactccagagaaaatggtgaccccagaagataaagccagcataccagagaactcaatcatcccggaggaaacattgacagttgacaagccctccactccagaacgagtcttctcggtggaagagtcccccgctctggaagccccaccaatggacaaggttcccaatcccaaaatggcaccccttggcgacgaagcacccactctcgagaaggtccttaccccagaactctcagaagaagaggtgagcacacgggacgatattcagttccaccatttttcttcagaagaagcgcttcagaaggtaaagtacttcgtggcaaaagaggacccatcctctcaggaggaagcccacacgccagaagctcctccccctcagcccccatcgagtgagagatgcctgggcgagatgaagtgtactctcgtacgcggagacagttccccacgacaggccgaactgaagtctggccctgcctctcggcctgccctggaaaagccccatcctcatgaagaagccactactctcccagaagaggccccttcaaatgacgagagaactcccgaggaggaggcaccgcctaacgagcaacggccactgcgggaagaggtcctgccaaaagagggagtggcttcgaaggaagaggtgacactgaaagaggaacttccacccaaagaagaagtggccccaaaagaggaagttccaccaatcgagcgggcatttgcccagaagacacggcctataaagcccccaccagatagccaggagactctcgctcttccctctcttgtgccccagaactatacggagaataaaaatgagggagtcgatgttacttcactgaggggagaggttgagagtctaaggagagcccttgagcttatggaagttcagctggagaggaagctgaccgacatttgggaagagttaaagagtgagaaagagcagaggcgcaggctcgaggtgcaggtgatgcagggaacccaaaagagccaaaccccccgagtgattcatacacagacacaaacttattag

SEQ ID NO: 59735 - DNA, 1938 bp, Artificial Sequence
  Description of Artificial Sequence: Synthetic coding sequence
atgatcaaggaaatcgaagatggttggtggctgggcaagaagaatgggcaactcggcgctttccccagcaatttcgttgaactccttgactcaggcccaccatctctggggaaccccgatatgccatctgtgtctccaggtcctcagagaccgcctaagctctccagtctggcttatgattccccaccggattaccttcagactgtgagtcacccggaagtgtaccgcgtcctgtttgactatcaacctgaagccccagacgagctggcattacgacgcggagacgtcgtgaaagtgctgtcaaagacaaccgaggacaaaggctggtgggagggagagtgtcaagggaggcggggagtgtttcctgacaattttgtacttccacctcctccaatcaaaaaacttgttcctcggaaggtagtctcaagagaaagcgcccctataaaagaacctaaaaaactcatgcctaagacaagcctacctaccgtcaaaaagctggccactgctacaacagggccatccaaagccaagacatcccggacacctagtcgcgactcccagaagctgacatctcgggactccgggcctaatggcggatttcagagcggtggatcctatcatcccggtcggaaaagaagtaagactcagactccacaacagcggtccgtgagttcccaagaggaagagcatagtagcccagtgaaggctccgtcggttaagcggacaccgatgccggataagaccgccactcctgaaagacctcctgcaccagagaatgcccctagcagcaagaagatcccggctccggataaggtgccctcaccagaaaaaaccctgaccctaggagacaaagcaagcatccccggtaacagtacttcgggaaaaatcccagcccctgacaaggttcctactccagagaagatggtgacacctgaggataaagcctctatccccgaaaacagcatcattcctgaggagaccttgactgttgacaagcccagcacacctgaacgggtcttttccgtcgaagaatcacccgctctggaggcccctcctatggacaaggtgcccaacccaaagatggccccactaggggacgaggcacctactctggaaaaagtgcttacaccagaattgagcgaagaagaagtgagcacaagagacgacatccagttccaccactttagcagcgaggaggcccttcaaaaggtgaaatattttgtggcaaaagaggatccctcatctcaggaggaggcacacactccagaggccccacctccacagccgccttcgagcgagcggtgcctaggtgaaatgaaatgtactctagtgaggggtgactctagcccccgacaggccgaactgaagtcgggacccgcaagtcgtcctgccctagagaaaccccatccacatgaggaggcaacaacactgccagaggaggcccctagcaacgacgaacgcactcccgaagaggaggctccacctaatgaacagagaccactccgcgaggaggtgttacccaaggagggcgtggctagtaaagaagaggtaactctgaaggaggagcttccccctaaagaggaggttgcaccaaaggaggaggtcccacccattgagagggccttcgcccagaaaactcgcccaattaagccacccccagactcgcaggagaccctggccctaccttctctggtacctcagaactacacagagaataagaacgaaggagtggatgttacctctctccggggagaggtggaaagtctgcgccgtgcattggaactgatggaggtgcagctcgaaaggaagttgacagacatttgggaagagcttaaatccgagaaagaacaacgcagacgactggaggtgcaggttatgcagggtactcagaaaagtcaaacaccccgtgtcattcacacgcagactcagacatattag

SEQ ID NO: 59736 - DNA, 2649 bp, Artificial Sequence
  Description of Artificial Sequence: Synthetic coding sequence
atgctgctaggcgcttcctggctttgtgccagtaaagctgccgcagccgctgctcagtccgagggcgacgaagatagacccggagagcgccgacgaagacgagccgctgcaactgccgcaggagccggagaagacatggatgagagctcattgctggatttgctcgagtgttcagtttgcctggaaagactggacaccacagctaaagtactcccttgccagcataccttttgcagaagatgcctggaatccatcgtgtgttcccggcatgaactgagatgcccagagtgtagaattctggtaggctgcggagttgatgaattgcctgcaaacatcctgcttgtcagactgttggacggcattcgacagaggccaagggcgggaaccagccctggaggatccccaccagccagacccattccaggtcagtctgcggctccaacactggcaggtggtggcggtggagcagcagggagcacccctggctcaccagtgttcctgtccgccgctgccggatcaacggccggtagtctgcgggaattggccacttcccgaactgccccagccgctaagaatccttgccttctcccctacggaaaagccctctattcctatgagggtaaagagcctggcgacttaaaattcaataaaggggacatcatagtcctgagaagaaaggtggacgagcagtggtaccacggggagctgcatggtacccagggctttttacctgcaagttatatccagtgcatccagcctttgcctcatgctcccccacaggggaaggcactgtacgattttgaaatgaaagacaaagaccaggataaggactgcctcacgtttactaaggatgagatcctgactgtgttgcggagggtggatgagaattgggctgaaggcatgctcggggataagatcggaatatttcctctcctctatgttgagttgaatgactcagcgaagcaactcatagagatggataagccctgcccagctgctgcgtcttcttgcaacgcgtcattgccctcggattccggcgctgtggcttcagtcgctccctctcccacactgtccagctccggggcagtctccgcattccaaagacgcgttgacggcaaaaagaataccaagaaaaggcactcatttacagctctgtctgtaacccaccgcagttcccaggcagcctcacaccggcactccatggaaatttcagctcctgtactgatcagttcctcagatccccgagccgcagcccgaatcggcgatctggctcacctgagctgtgctgctccaacgcaggatgtctctagctctgctggatctactcctactgcagtcccgagggcggcttccgtgagcggagaacagggcactccgcctaaggtccagctgccattaaacgtctacctcgcattgtatgcatataaacctcaaaagtctgatgaactcgagctgcacaaaggggagatgtaccgagtgttagagaagtgccaggatggatggttcaaaggcgcaagtctcagaactggtgtgtcaggcgtctttccaggcaactatgtgacacctgtgagcagggttcctgctggcggtgctgggccaccgaggaacaacgtggtggggggaagtcctctcgccaagggaattacgaccacaatgcatcctggctccggttctctatctagcctagccaccgcaacccgcccagcactgccaattactacaccgcaggctcacgctcaacacccaacagcctcgcctcctaccggcagttgtctgcggcatagcgcccagcctactgcaagccaggcccgaagtacgatctcgacagcggcacactccgcggcacaggcccaggacaggccaacggccactgtatctccactgaggacgcaaaattctccctccagattgcccgcaacgtctctgcgcccacacagtgtggtgagtccacagcacagccaccagccaccagtccaaatgtgccctcgacctgcgatccctctaacatctgccgcatctgccatcactcccccaaatgtttctgccgctaatcttaacggggaggctggcggaggtccgatcggcgtgctttctaccagtagtccaactaacaccggatgcaagctggatgagaagaagtcagaaaagaaagagaagaaaagcggtctgttgaagctcctagccggagcaagcactaagaagaagtctcgatcccccccaagtgtgagccccacacacgacccccaggtggctgtggacgcactcctacagggcgcagtcgggcctgaagtgtcttccctttccatacacggaagagccggatcctgccctatagagtctgaaatgcaaggcgctatgggaatggagcccctgcacaggaaagccggatcgctggacctgaactttaccagccccagcagacaggctcctcttagtatggcagccattcgcccagagcccaagctgcttcctcgggagaggtaccgggtggtcgtgtcctatccaccacagtctgaagctgaaattgagctcaaggagggggatatcgtgttcgtgcacaagaagagagaggacggctggtacaaggggacactgcagcggaatggacgcaccggactcttcccaggctcctttgtggaatcgttctag

SEQ ID NO: 59737 - DNA, 2151 bp, Artificial Sequence
  Description of Artificial Sequence: Synthetic coding sequence
atgttgctcggggcaagttggctgtgtgcttctaaagccgcagccgctgcggcacagagcgagggcgatgaagaccggccaggcgaacgacgaagaaggagggccgctgctaccgcagctggcgcaggggaagatatggacgaaagcagtctgctcgacctcctggagtgctccgtgtgtctcgaaagattagacaccacggctaaagttctgccttgccaacacaccttttgccgcagatgcctggagtctatcgtgtgtagccgccatgaattgcgctgcccagagtgtcgtatcctggtgggctgcggcgtggatgagcttcctgctaacatcctcctcgtgcgtctgctagacggaatcaggcagcgaccccgtgctggtaccagcccagggggaagcccaccggctaggcctattcccggacagagtgccgcaccaacattggccggaggcggtggcggagcggctggctccacaccaggaagccccgtgtttctgagcgcggctgcgggtagtactgctggttccctgcgcgaactcgccacctctaggactgcgcctgccgcaaagaatccttgccttctcccgtatgggaaggcactgtactcttatgagggcaaggagcctggagatctcaagtttaataaaggcgacatcattgtgctccgcaggaaagtcgatgagcagtggtaccacggagaactgcacggcacgcaaggcttcctgccagcttcctatattcagtgtatccagcctctgccacacgcacccccacaaggaaaagctctttatgactttgagatgaaggacaaagaccaggacaaagattgcctgactttcacaaaggacgaaatcttaaccgtgctaaggagggtggacgagaactgggccgaaggaatgctgggagataaaatcggaatctttccactgctatacgtggagctaaatgatagtgccaagcagctcatagagatggataagccatgtcctgccgctgcgtcatcgtgtaacgcaagcctcccaagcgattcaggggctgtagccagcgtcgcacctagtccaactctgtcctccagtggggctgtttcagcattccaacggcgtgttgacggtaaaaaaaatacaaaaaaaagacattcctttactgctctcagtgttacccaccgctcttcacaggctgccagtcaccgccatagtatggagattagcgctcccgtcctcatctctagttccgacccaagggcggctgcgcgtatcggcgaccttgctcacctgagctgtgctgcgccaacacaggacgtcagtagtagtgccggtagcacccctaccgcagtgcctcgcgctgcgagtgtatcaggggaacaagggacccccccaaaggtgcaactgcccctgaacgtgtacctggccctgtatgcgtacaagcctcagaaatcagatgagctggaattacataagggggagatgtatcgtgtgctcgagaagtgccaggatgggtggttcaagggcgcttcattgcggaccggcgttagcggcgttttccctgggaattacgtgacccccgtttcacgcgtgcccgctggcggagccggtcccccacgtaataatgtggtgggcggatcacctctggctaaggggatcacaaccaccatgcaccccggatccggcagccttagctcgctggccacagcaacaaggcccgcattacctattactacgcctcaagctcatgctcagcaccccaccgcttcacctcctactggtagttgcttaagacactccgcacaaccaactgcaagccaagcacgttccaccatatccaccgctgcccactctgccgctcaggcacaggatcggcctaccgccactgtctctcctctgcgaacccaaaactccccatctcgactcccggctactagtttaaggcctcactccgtggtttccccacaacattcccaccaaccacccgtgcagatgtgcccacgcccagcaatcccactgacctccgctgcttcagcgataaccccacccaatgtatcagctgccaatttgaacggcgaagctggtggaggcccaataggcgtcctttccacgagttccccgaccaatacaggctgtaagcttgacgagaagaaaagtgagaaatag

SEQ ID NO: 59738 - DNA, 171 bp, Artificial Sequence
  Description of Artificial Sequence: Synthetic coding sequence
taataccgagtggtggtgagctatcctcctcagagtgaagctgagattgagctcaaggaaggcgacatcgttttcgtgcacaagaaaagagaagatggctggtacaagggcaccctccagaggaatgggcgaaccggcttattccccggttcgttcgtcgagtcattctag

SEQ ID NO: 59739 - DNA, 1029 bp, Artificial Sequence
  Description of Artificial Sequence: Synthetic coding sequence
atgaataacccaattccgagcaacttaaaatcagaggctaagaaagctgctaagatactgcgagagttcactgagattactagtcggaacgggccagacaagattatccccgctcacgtcatagctaaggctaaaggcctcgcaatacttagtgttataaaggctggctttctggtcactgcaagagggggttccggcatcgtggtagcccgtctacccgacggcaaatggagcgcaccatccgcaatcgggattgccggtctcgggggaggatttgagatcgggatagaagtctcagatcttgtaattatcctgaactacgatcgcgctgtggaggcgtttgcaaaagggggaaacctaacgctcggcggtaatctaactgtcgcagtgggccctttgggccgaaatctcgagggcaatgtcgccttaaggtcaagcgccgctgtcttcacatactgcaagagccggggtttgttcgccggtgtgtcactagaaggcagctgtctgatcgaacgcaaggagactaacaggaagttttattgccaggacatccgagcgtatgacatactgtttggagatacacctcgcccagctcaggcagaggatctgtatgagatcctcgactcatttacagaaaaatacgagaacgaaggacagagaattaacgcccgaaaagcagctcgggagcaacgcaagagttctgccaaggaactaccgccaaagcccctctcaagacctcaacagtcctctgccccagttcagcttaactcggggagccagagcaatagaaacgagtataaactatatccagggctgagcagctatcacgagagagtgggcaacttgaatcagcccatcgaggtgacagccttatatagctttgagggacagcagccaggcgacctgaactttcaggcaggtgaccgcattaccgtcatctcgaaaacagattcgcactttgactggtgggagggtaagcttagaggacagacaggtatcttccctgctaactacgtgacgatgaattag

SEQ ID NO: 59740 - DNA, 684 bp, Artificial Sequence
  Description of Artificial Sequence: Synthetic coding sequence
atggtctctgatcttgttattattcttaactatgaccgagcggttgaagccttcgccaagggtggaaatctaaccttgggcggaaatttgaccgtggcagtaggacccctcgggcgaaacctcgaaggcaatgtggcgttgcgatcttccgccgcagtttttacatactgcaagtccagagggttgttcgccggagtgtccctagagggttcgtgcctgattgagcgaaaagagacaaacagaaagttctattgccaggacatacgagcctatgatattttgttcggcgatacccctaggcctgcacaggctgaagatctgtacgaaatcctcgacagctttacagagaagtatgaaaacgaagggcagagaattaacgcgaggaaagcagctcgcgagcagcgcaagtcttcggctaaagagctgcctcctaagccactgtcaagacctcagcagtcgagtgcccctgttcaactcaacagcggcagccagagcaacctgaatcagcctatcgaggttacggcactctatagtttcgagggtcagcaacctggcgacctgaatttccaggccggagataggatcacggtgatctccaaaactgattctcactttgactggtgggaaggcaagttacgcggtcaaactggtatatttcccgctaattatgttacaatgaactag

SEQ ID NO: 59741 - DNA, 684 bp, Artificial Sequence
  Description of Artificial Sequence: Synthetic coding sequence
atggtgtccgatctggtgatcattcttaactacgatcgggcagtcgaggcatttgccaaaggtggtaacctgacccttggcggaaatctgaccgtggcggtgggccctttgggacggaacttggagggtaacgtcgccctccggtcatcagcagctgtgtttacatactgtaagtctagggggctctttgccggtgtgtccctcgaagggtcctgtttaatcgaaagaaaagagactaacagaaagttctattgtcaggatataagagcctatgacatcctgttcggcgacacacccagaccggcacaggctgaggatctatacgagattctcgattcgttcacagaaaaatatgagaatgaagggcagcgcatcaatgccagaaaagcggcacgcgagcagcgtaaatcaagcgcaaaagagcttccccctaagcctctgagcaggcctcagcagtcatcagcacctgtgcagctcaactctggcagccagagtaacctgaatcagcccatagaggttaccgctctgtacagtttcgaaggccagcagcctggggatctaaatttccaggcaggagatcggataaccgtaatcagcaagaccgactctcacttcgactggtgggaaggaaagctccgcggacagactggaatctttcccgctaactatgtgacaatgaactag

SEQ ID NO: 59742 - DNA, 972 bp, Artificial Sequence
  Description of Artificial Sequence: Synthetic coding sequence
atgaacaaccctattccctcgaatcttaagtccgaggccaagaaagctgccaaaatcctgagggagtttacagagatcacttctaggaatggcccagacaaaatcatcccggcacatgttatcgcgaaggcaaaaggcttggccattctatccgttataaaggcaggctttctggtcactgccaggggtgggtccgggatagtagtggcacgcctgccagacggaaagtggagtgctccctcagctatcgggatcgccggtctcggcggaggctttgagattggcatagaggtctccgatttagtgatcatcctgaactatgatcgcgcagtcgaagccttcgcaaagggtggaaacctgacgctggggggtaacttaaccgttgcagtaggacctctaggcagaaatctcgaaggaaacgtggccctaaggtcatcagccgctgtgttcacctattgtaagtctcgtggactcttcgcgggagtatccctggaagggagttgcctgattgaacgaaaagaaactaaccggaaattttattgtcaggacattcgggcttacgatatcctttttggcgacacccccaggccggctcaggcggaagacctctacgagatcttggattcgtttacagagaaatatgagaacgaagggcagcgcatcaatgcgcgaaaggcagcccgagaacaaagaaaatcttctgcgaaagagttaccgcctaagccactgtcacgacctcaacagagtagcgcccctgtacaacttaattccgggtcgcaatctaacctcaaccagcccattgaggtgacagctctctactcctttgaaggacaacagccaggcgatcttaattttcaggcgggtgacaggattaccgtgattagcaaaacagattcgcactttgactggtgggaggggaaactgcgtggtcagactggcatctttccagctaattacgtgacgatgaactag

SEQ ID NO: 59743 - DNA, 1029 bp, Artificial Sequence
  Description of Artificial Sequence: Synthetic coding sequence
atgaacaatcccattccatctaaccttaagagcgaagctaaaaaagccgcaaagattcttcgggaattcaccgagatcacgtctcgcaacgggccagacaaaatcatcccggcacacgtcatcgcaaaggcaaaaggtctagctatactctctgtgatcaaggcaggttttttggtaactgccagggggggttcaggaatagttgtcgcacggctgcccgacgggaaatggagcgcgccttcggcaatcggcatagctggtttaggcggaggcttcgaaattggaatcgaagtctcagatctcgttattatccttaattacgaccgggcagtggaagcctttgcgaaaggtggcaatctaacattgggcggaaacctgactgtagctgtgggccctctgggtcggaatctggaaggcaatgttgccctgcggagctctgccgctgtctttacctactgcaagtctcgtggattgtttgccggagtgagtttggagggctcttgcctgatcgagaggaaggagacaaacagaaagttttattgccaagacatcagggcctatgatatattgttcggcgacacccctcggccagcccaggctgaagacctgtacgagatccttgacagcttcaccgaaaagtatgagaacgaaggacaaaggatcaacgccaggaaagctgccagggagcaacgaaaaagttccgcaaaggagctcccccctaagcctctgtctaggccccagcagtcatcggcccctgtccagctgaactccgggtctcagtcaaatcgtaatgagtacaagctgtaccccggtctctccagttatcatgaacgggttgggaacctgaatcagcccatcgaggtgaccgctctctattccttcgaaggtcagcaaccaggggacctgaacttccaggcaggagacagaataacagtgatctccaaaaccgatagccactttgattggtgggagggaaagcttaggggacagacaggaatctttccagccaattatgtcaccatgaactag

SEQ ID NO: 59744 - DNA, 741 bp, Artificial Sequence
  Description of Artificial Sequence: Synthetic coding sequence
atggtgagcgacctggttattatcttgaactatgacagggccgtggaagcgttcgcaaaggggggaaacttaacgctgggaggcaacctgactgtggcggttggtcctcttgggcgaaacctggagggcaatgttgccctccgcagctccgctgccgtgttcacctactgcaagtcccgcggtctgtttgctggcgtgtccctggaaggaagttgcttgattgagaggaaggaaactaaccgaaaattctattgtcaagatatccgggcatatgacattctattcggggatacaccaagaccagcccaggcagaggatctctacgagatcttggacagtttcaccgagaagtacgaaaacgaaggccagcgcattaatgcccgaaaggctgctcgcgagcagaggaagagtagtgccaaggaactacccccaaagcccctttcacgccctcagcagtcttccgcaccggttcaactaaacagcgggagtcagtcgaaccgtaatgaatataagctttatccaggtctgagctcataccacgaacgggtgggcaatctgaatcagccaatcgaggtgaccgcactgtatagcttcgaaggacagcagcccggagacctgaatttccaggccggagaccgtattactgtgataagcaaaactgatagtcattttgactggtgggagggtaaacttcgtgggcagactgggatctttcccgcaaactatgtgaccatgaattag

SEQ ID NO: 59745 - DNA, 156 bp, Artificial Sequence
  Description of Artificial Sequence: Synthetic coding sequence
atgaacaaccccattccctctaatctcaaaagcgaagcaaagaaagctgctaagatcctgagagagttcactgagataactagtcgaaatgggcctgacaaaatcattccagcacatgtgatagctaaggccaaaggtctggctatcctgtcgtag

SEQ ID NO: 59746 - DNA, 1047 bp, Artificial Sequence
  Description of Artificial Sequence: Synthetic coding sequence
atgcccggtaagcagtctgaggagggtccagctgaggcaggggctagcgaggatagtgaggaggaagggctagggggtcttacacttgaagaactccagcaaggtcaggaggctgctagagccctggaggatatgatgaccctgtctgcgcaaacacttgtgagggccgaggttgacgaattgtatgaggaggtaaggcctctgggtcagggatgttacggaagagtgctcctcgttacccaccgacagaaaggcactccgttggccttgaaacaactgcccaagcctcgcacttcactgcggggatttctttatgaattctgcgtcgggctgtcattaggggctcatagcgctattgtcactgcatacggtatcggaatcgaatcggcccactcttactcattcctgaccgagccagtcttgcacggtgacctgatggcctttatccaaccaaaggtaggactgccacaacccgctgtgcatagatgtgcagcccaactggcttccgctctagagtacatccacgccagaggccttgtgtaccgtgacctgaaacccgaaaacgtgctcgtctgcgatccagcatgccggcgatttaagctcacagactttgggcacacgcgcccacgaggcacattactgcgccttgctggcccacccattccttacaccgccccagaactctgtgcgcctcccccattacccgaaggtttgcccatccagcccgcactggacgcgtgggccttgggcgtgctcctgttttgtctgctcacaggatacttcccatgggacagacccttggctgaggccgatcccttctatgaagattttttgatatggcaagcctcgggccaaccaagagaccgtccacagccctggtttggacttgcagcggctgctgacgccctgctgagaggacttctcgatcctcaccccagaagacgatcagccgttatcgcaatccgagagcaccttggtcgtccatggaggcagagggagggagaggccgaggcggtaggggcagtcgaggaggaggcaggccagtag

SEQ ID NO: 59747 - DNA, 1047 bp, Artificial Sequence
  Description of Artificial Sequence: Synthetic coding sequence
atgccagggaagcagtccgaggaggggcctgcagaagcgggtgcatcagaagattcagaggaagaaggcttggggggtctgacgttagaggagttgcagcaggggcaggaggcggcacgggctctagaagatatgatgaccctgtctgcacaaacgctggttagggctgaagtcgacgaactgtacgaagaggtgaggcctcttggccagggatgctatggtcgcgtcctgctagttacacaccgtcagaaagggacccccctggctctaaaacagcttcctaaaccccgtacgagcttaaggggtttcctgtatgagttttgtgtaggcctttccttaggagcgcattcagccattgtaacagcttatggcatcggaattgagtctgcacatagctattctttcctaactgagcctgttttgcacggagaccttatggctttcatccagccaaaggtgggtctgccccagcccgctgtgcacagatgtgccgcacagctggcctctgctttagagtacatacacgctcgcggactggtgtacagagatcttaaacctgaaaatgtgttggtctgtgatcctgcatgccggcgatttaaattaacagacttcggccatactagaccgcgtggcacccttctgcgactggcaggccctcctatcccttacactgcccctgagctgtgcgctccacctcctctccctgaagggctcccaatccagcccgctctcgacgcatgggctctgggagtcctactcttctgtttgctcacaggatattttccgtgggacagacctttagccgaggccgacccattttacgaagattttctgatttggcaggcctcaggccagcctagggatcggccacagccatggttcgggctggcggctgccgcagacgccctgctcaggggtctcttggatccacatccacgcaggaggagtgctgttattgcaatacgggaacacttggggcgaccttggaggcaacgcgagggagaagccgaagccgttggcgctgttgaggaggaggcagggcagtag

SEQ ID NO: 59748 - DNA, 1182 bp, Artificial Sequence
  Description of Artificial Sequence: Synthetic coding sequence
atggcagaattacggcaagtacctgggggtcgtgagacgccacagggtgaactgcggcctgaggtcgtggaggatgaggtgccacgctctcctgtggcggaggagcccggagggggaggatctagttcaagcgaggctaaactttcaccaagagaggaagaggaactggatccccgtatccaggaggagctggagcatctgaaccaggccagcgaggaaatcaaccaagtagaattgcaactagatgaggctaggacaacttatcgccgtatcctgcaggaaagcgccagaaagttgaatacccagggttcccatttgggctcctgtatcgagaaggctcgcccatactacgaagccaggagactcgccaaagaagctcaacaggagacgcaaaaagctgccctccgttacgaacgcgctgtatcaatgcacaacgcagcgagggagatggtttttgtggctgaacagggagttatggctgacaaaaatagactggacccaacctggcaagaaatgctcaatcacgccacttgtaaggtcaatgaggcagaggaagaacgtctgagaggcgaaagagagcaccagcgagtaacccgcctatgtcagcaggccgaggcacgagtgcaggccctccagaaaaccttacggcgtgccatcgggaaaagccgaccctatttcgagctaaaagctcagttctctcagatacttgaagaacataaagcaaaggtgaccgagctggaacaacaggtggcacaggctaagaccagatacagtgtagccctgcgcaacctggaacagataagtgaacagattcacgcccgacgccgtggcggtctgccccctcatccattgggaccacggaggtctagccccgttggggcagaggccggtcctgaggatatggaagatggagactctggcatcgaaggcgctgagggcgcagggcttgaggaaggctcatctctgggccctggccctgccccagataccgataccctgagccttctaagtctgcggaccgtagccagcgatcttcagaagtgcgactccgtcgaacaccttcggggtctttcagaccatgtttcacttgacggtcaggagttgggaactcggtctgggggtagaagggggagcgacggtggagccaggggagggagacatcagaggagcgtgtcgctgtag

SEQ ID NO: 59749 - DNA, 1086 bp, Artificial Sequence
  Description of Artificial Sequence: Synthetic coding sequence
atgtaccaggtgcctgaccggcaggagagtttctggcagtccccatacctcctgagcttccccgagtgtctcacatcatttccgtgggaagagctggagcacctcaatcaggcctccgaagagattaatcaagtggagcttcaacttgatgaggctcggaccacttaccgacggattctgcaggagtctgctagaaagctcaatacccaaggaagtcatctgggcagctgcatagagaaagcgaggccttattacgaagccaggcggcttgccaaggaggcccagcaagagacccaaaaagccgcactgcgttacgaaagagcggtgagtatgcacaacgccgctcgcgaaatggtttttgtggctgaacaaggagttatggccgataaaaatcgcctggacccaacctggcaggagatgctgaatcatgctacctgtaaagtaaatgaggccgaagaagagagactcaggggcgagagagagcatcagagagttacacgactgtgtcagcaggccgaagcgagggtgcaggccctgcagaaaacgttaaggagagcaatcggaaagtctcggccttacttcgagctcaaggcccaattcagccagattctggaggagcataaagccaaggttacagagctagaacagcaggttgcacaggccaagactaggtactcagtcgccctccgaaacctggagcagatttcagagcagatccacgctcgcagaagaggcggactgcctccacaccccttgggccctcgacgatcttcacccgtgggggcagaggctggaccggaagacatggaggacggagactccggaatcgaaggcgctgagggcgcaggacttgaagaggggtccagcctagggcctggtcctgcaccagatactgatacgctgtcactgctttctttaagaaccgttgcaagtgacctgcagaaatgcgattcagttgagcatctaagagggttgtctgaccatgtgtctctcgacggtcaagagctgggcacacgaagcggcggaaggcggggaagtgacggcggagcacgtggaggcagacaccagcgcagcgtatctctttag

SEQ ID NO: 59750 - DNA, 2169 bp, Artificial Sequence
  Description of Artificial Sequence: Synthetic coding sequence
atgcgccctcaggaccccgcactgtaccctcaggcccctcaccctctcgccctgggacgcgcatctcatccatctcagtcaaggaacactccacctgggagacccagagcagctgccagatgcggaccgaggcgcgctccaattggacagagcggaaggggacgcgagaaatggccaacagctgcctcagccctcggactgcttcggcgatggagaaggagcaaagcaagcgtgcccgctgacagcttcagaacaatctcacccgatcgcagaggagagaagtcggcatctgcagtgagcggcgacaccgcagccgcaacaaccctgaaaggcacggcaattcccgtgcgatcagtggtggctagtcctcgtccggttaaaggcaaggcgggaagagaaacggcgcgactgcgcttgcagcggctcccagcagctcaggctgaagataccggagaggccgctgcagctgccgctgaagaaccgttactgcctgtccctgaggatgaggaggaagctcagccgttaccacctgtctgtgtgtcacgtatgcggggaatgtggcgcgatgaaaaggtgagtttgtattgcgacgaagtgctgcaggattgtaaggctgaggacgccgacgaagtcatgggaaagtatctgtccgagaagcttaagcttaaggacaagtggctcggtgtgtggaagacaaatccaagcgtgttttttgttaagtacgaggaggcatccattccttttgttggaatactagtcgaagttacctgcgagccttaccaggacagtagctcccgattcaaggtcaccgtgtccgtggctgagcctttctcatcaaatatagccaatatcccacgcgacctagtagacgagatccttgaggagctcgagcattcagtcccgcttttagaggtttatcccgtggaaggacaggacaccgatatccacgtgatcgccttagccctagaagttgttcgctttttctacgactttttatggcgggactgggatgatgaggaatcatgtgagaattacactgcactgatcgaggaacggatcaacctgtggtgcgatatccaggatggcaccatcccaggccctatcgctcaacgcttcaaaaagaccctcgaaaagtacaaaaataagagggtggaattgattgaatatcagagcaacataaaggaagaccccagcgctgcggaggctgtggaatgctggaagaagtattacgaaatcgtgatgttatgtggactgctaaagatgtgggaggacctcagactacgtgttcacggcccttttttccctcgaatccttcggcgaaggaaggggaagcgggagttcggaaagaccattacccatattgtggctaagatgatgacgaccgagatgattaaggatctgagtagcgacacactgttacagcagcacggagatctggacttggcactggacaattgttacagtggcgataccgttatcatttttcctggggagtaccaggccgcaaacctggcactcctaaccgatgacattatcattaagggtgtgggaaagcgggaggagattatgattacttcagagccaagccgggactccttcgtggtatctaaggccgacaacgttaaacttatgcacttgagtctaatccagcagggaacagttgacgggatcgtggtggtagagtctggtcatatgacccttgagaattgtattctgaagtgtgagggtactggcgtgtgtgtgcttacaggcgcagctttgacaatcacagattcagagattacaggtgcccagggagctggagtagagctctatcccggttccattgccatcctggagcgcaacgaaattcatcattgtaacaacctgagaaccagtaatagttccaaaagtacgctgggcggagttaacatgaaggttctgcccgcaccaaaactgaaaatgacaaacaaccatatctactccaacaaaggatatggggtttcgatactgcagcccatggagcaattctttatcgtagctgaggaggctctgaataaacgcgcttccagtggtgacaagaaagatgataagatgctgttcaaagtcatgcagaatctaaacctcgaaatgaacaacaataaaatagaggccaacgtgaaaggtgacatacgcattgtgacgtcttag

SEQ ID NO: 59751 - DNA, 1962 bp, Artificial Sequence
  Description of Artificial Sequence: Synthetic coding sequence
atggcctccggatccaaggcgagcgtgccagccgactcattcaggactatcagcccagacaggagaggcgagaaatccgcatccgccgtgtccggagacacagccgctgccactacattgaaggggactgctattcctgtgcggagtgtggtggcaagccctcgcccagtaaaaggcaaggcaggaagagagacggcgcgtctgcgtctgcagcgcttgcccgcagcccaggccgaggacactggggaagccgctgctgcggcagcagaggagcccctgctacccgtacccgaggacgaggaagaggcacagcccctgccacccgtctgtgtgtccagaatgagggggatgtggagggacgaaaaagtgtccctgtactgtgatgaggttcttcaggactgcaaagccgaagacgctgacgaggtaatgggaaaatacctctcggagaaactcaagcttaaagacaaatggttgggagtgtggaagaccaatccgagtgtgttctttgtgaagtatgaggaagcgagcattcccttcgtcgggatactcgtggaggtgacctgcgagccctaccaagacagttcaagcagatttaaggttactgtttcggtggctgagcctttttcatccaacattgcgaacattccccgtgatctggtcgacgagatcctcgaggagctagaacactccgttcctctgctcgaagtctacccggtggagggtcaagataccgacatccacgtgatcgccctggcgctcgaagtcgtgcgtttcttttacgactttctgtggcgggattgggacgacgaagagtcttgcgagaactacacggccctgattgaggagaggattaatctttggtgcgatatccaagatggcacgattcccggtcccattgctcagcggtttaagaaaactttagagaagtacaagaataaaagggttgagctgatcgagtatcagagtaatataaaggaagacccctcagccgcagaagctgtagaatgctggaagaaatattacgaaatcgtcatgttgtgtggtttactgaaaatgtgggaggaccttcggctccgcgtacacggaccatttttcccgagaattctcagaaggaggaaaggaaagcgggagttcggcaaaactatcacacatattgttgccaagatgatgaccacagaaatgatcaaggatctgagctccgacaccctcctccagcagcacggcgacctggacttagcactcgacaactgttattcgggagacacagttatcatttttcccggagagtaccaggccgctaatctggctctgctgacggacgatatcatcatcaaaggcgtcggcaaacgagaagaaatcatgataaccagcgagccgtcacgggactcttttgtggtcagtaaagctgacaatgtgaagcttatgcatctcagccttattcaacagggcaccgtggatggcatcgtcgtggtagagtccggtcatatgaccctcgagaattgtatattgaagtgcgagggaactggcgtctgtgtcctcactggagctgcattaacaattacagattctgagattaccggggcacaaggtgcaggcgtcgagctctacccaggctcaatcgccatcctcgagcgtaatgagatacatcattgcaacaatcttcgcaccagcaattccagtaagtctaccctgggaggcgtgaacatgaaggtactccctgctccaaaactgaagatgacaaacaatcatatttattcaaataaaggatatggggtttccatccttcagcctatggaacagttctttatcgtggcagaagaagccctgaacaaaagagcctcaagtggcgacaaaaaggatgacaagatgctgttcaaggttatgcagaacctcaacctggagatgaacaataataaaatagaggccaacgtaaagggggatatacgaattgtcacgtcctag

SEQ ID NO: 59752 - DNA, 1605 bp, Artificial Sequence
  Description of Artificial Sequence: Synthetic coding sequence
atggggtttctgcagctcgtgcggctcgattccaacagccgtcctcaagctgaggacgcggatgaggtgatggggaaatacttgagcgagaagttgaagttaaaggacaaatggctgggtgtgtggaagacaaacccttcagtgttctttgtgaagtatgaagaagctagcatcccttttgtcggaatcctggttgaagtcacctgtgaaccttatcaggatagctcttctagatttaaggtcactgtatctgtggcagagccgttctcttctaatattgcaaacattccaagagatctcgtcgacgagatcctggaagaactggagcacagcgtgcccttactggaggtctaccctgtggaggggcaggacaccgatatacacgtgatagctctggcactagaagttgtcagatttttttacgactttctgtggcgagactgggatgacgaggaatcttgtgagaactacaccgcccttattgaagagaggattaatctctggtgcgacatccaggacggcacaattccaggcccaattgctcaacgcttcaaaaaaactctcgaaaagtacaaaaacaagcgcgtggagctcatagagtatcagtctaatatcaaggaggacccaagcgccgctgaagctgtagaatgttggaaaaagtactacgagatcgtcatgctttgcggactgctcaaaatgtgggaggaccttagattgcgggtgcatggacctttcttccctcggattctgcggagaaggaagggcaaaagggaatttggaaaaactatcacacacatcgtggcaaaaatgatgaccaccgaaatgattaaagatttgtcctcagacaccttacttcaacagcatggggatcttgatcttgcccttgataactgttactccggcgacactgtgatcatattccccggagagtaccaggccgcaaacctcgcccttctgactgacgacatcataattaagggggtcggaaaaagggaagagataatgatcacgtcagaaccaagtcgtgactctttcgttgtctcgaaggcggataatgtgaagctgatgcatctgtctttgatccagcagggcaccgtggacggtatcgtggtggtcgagtctggacacatgaccctcgaaaactgtattcttaaatgtgaggggactggggtatgtgtgttgaccggagccgctctgaccataacagattcggaaattacaggggcacaaggagctggggtcgaactgtatccgggatccatcgccattctcgaacggaatgaaatccaccactgtaataatctgcgtacttctaatagctccaagtcaacgctgggaggggtgaacatgaaggttctgcctgcaccaaagctgaagatgactaataatcatatctactccaacaagggatacggagtctctatcctccagcctatggaacaattcttcatagtggcagaggaggcgctgaataaaagggcatcctcaggtgataaaaaagacgataaaatgctatttaaggttatgcagaacctgaaccttgaaatgaataacaacaagatcgaagccaatgtgaaaggcgacatcaggatagtgactagctag

SEQ ID NO: 59753 - DNA, 1617 bp, Artificial Sequence
  Description of Artificial Sequence: Synthetic coding sequence
atgcctgcattattgttactcgtgctccttgcatccagtgccggacaagcccgagccaggccatctaatgccacaagcgcagagcctgccggacctctgcctgccctcctggcccacctcaggagactgaccggggcacttacaggaggtgggggagcagcttccccaggcgcaaatggcacccggaccggccctgccggtggcgctggagctgccgcaagagctccaccccctgccgagctgtgccacggctactacgatgtgatggggcagtacgacgccacttttaattgttcgactggctcctacagattctgctgtgggacgtgccattatcggttttgctgcgagcaccggcacatgcggttggcccaggcatcctgcagcaactacgacacgcccaggtgggcgacaacccccccaccccttgccggaggggctggaggggctggcggagcgggagggggaccgggacctggacaggcaggatggttggagggcggacgaactgggggtgccggaggcagaggaggcgaaggtcccggagggtctacagcatacgttgtgtgtggcgttatttccttcgctctcgctgttggcgtgggagccaaggtcgcctttagtaaggccagtcgcgcacctagagcccatcgtgacatcaacgtccccagagccttggttgatattcttagacatcaagccggaccgggaacccgccctgaccgagcccgatcgtcttctctcacccccggaataggagggccagattcgatgccccctaggactcccaagaacctttacaataccgtaaagactcccaatcttgattggcgcgctctgcccccaccctctccatctctccactactccactctgtcatgttcaagaagttttcacaacctgtcacatctccctccatcatatgaagctgcagtcaagagcgagctgaacagatatagcagtttgaagcgacttgccgagaaggatttggacgaggcgtatttgaagcgccgacctcttgagcttcctcggggaacacttcccctgcacgctcttagaagaccgggtacagggggaggttacagaatggaggcctggggcggtccagaagaactgggcctggcaccagcgccaaatccgaggcgggtcatgtcacaagagcaccttctgggagacggtggtcgcagtcgttatgagttcacccttccaagggccagattggtgagccaggagcatctcttgctgtcttcccctgaagcccttcgccagagcagagagcacctgctatctcctccccgaagtccagccctgcccccagatcccactgccagagcttcccttgcagcaagccactccaacctccttctgggaccagggggacctcctacccccctcaggggtttgcctcctccatcctcattgcatgcccatcatcatcacgcgctgcacggctccccccagcccgcatggatgagtgatgctggtggtggcggtgggaccctggcacggagaccgccatttcagcggcaggggactttggagcaactccaattcatacccggacaccaccttcctcagcatctgagaacggctagtaaaaatgaagtgaccgtgtag

SEQ ID NO: 59754 - DNA, 960 bp, Artificial Sequence
  Description of Artificial Sequence: Synthetic coding sequence
atggggtggagaagaaagcgagtgccccagaggggcaggaaggctccacccccacagctgcacggtaacatcaacaatttatacttccccattaggtggcgagatagactccactgggacagtccaaatcccgctgcggagtgtcaacgtcacgaagtcaccctcgtcagccgaaagcctggccctgggaggatcacatgggatgagctcgccgcatccggattgccaagctgcgacgccgctgtcaaccttgcgggtgagaatatattgaacccgctcaggagatggaacgaaacctttcagaaggaagtgatcggctcccggttggaaaccacccagttgctggcgaaagcaattacaaaagcccctcagcctccgaaggcctgggtgcttgtgactggggtagcctattatcagccctcattgaccgccgagtacgacgaggactcacccggaggcgacttcgactttttcagcaatcttgtgactaagtgggaggctgccgctcggctccccggagattctactagacaagttgtagtcaggtccggggttgttcttggtcggggaggtggagccatgggtcacatgctgctgccatttagactgggattgggtggtcccataggttccggtcatcagtttttcccttggatccatattggggatctggccggaatcttgacacacgcccttgaggccaatcacgtccacggcgtcctgaatggcgttgcgccaagctctgccaccaacgctgagttcgctcagaccctgggcgcagccttgggacgtcgcgcttttatacccctcccttcggcagtggtgcaggctgtctttgggaggcagcgcgctatcatgttgttggagggacagaaggttatcccacagcggaccctcgcgactggttaccagtactcatttccagagttaggcgcagcactcaaggagatcgtggcttag

SEQ ID NO: 59755 - DNA, 597 bp, Artificial Sequence
  Description of Artificial Sequence: Synthetic coding sequence
atggccttgtccccaaacggggagatactgagagcacgcgaagcctactaccagccaagtctgaccgccgaatatgacgaggacagccccggtggggattttgacttcttctcaaacctcgtaaccaaatgggaggctgcggcacggcttcccggagatagtaccagacaggttgttgtgcggagtggagtggtgctcggtaggggcggaggcgcaatggggcacatgctgttgccatttagactgggcctaggtgggcctattggctctgggcatcagttttttccctggattcacattggggacttagccggtattctcactcatgccctggaggctaaccacgtgcatggcgtgttgaatggtgtggcacccagtagcgcaactaacgctgagttcgcgcagacacttggagctgcccttggcagacgggctttcatccccttgccatcggcggtagtgcaggctgtcttcggtcgtcaacgagccattatgttgctcgagggccagaaggtaattccccagagaacccttgccacagggtaccaatatagcttccctgagctgggagctgctttgaaggaaatcgtggcgtag

SEQ ID NO: 59756 - DNA, 882 bp, Artificial Sequence
  Description of Artificial Sequence: Synthetic coding sequence
atgagagtgctggtaggtggaggtacgggctttatcggaacagcactcacccagctgctgaatgccagggggcacgaggtaaccctggtgtcgcgcaaaccaggacccggtcgcattacctgggacgaactggcagcctccggtctcccttcctgtgacgcagccgtgaatctggcaggggaaaacatcctcaatcccttgaggcggtggaatgaaacctttcaaaaggaggtgattggatctcgcctggagacgacacaattactggctaaagccatcaccaaggcccctcagccacctaaagcctgggttctagtgacaggcgttgcttactatcagccgtcgctgaccgcagaatacgacgaggactcacccggtggcgactttgacttcttttccaaccttgtgacaaagtgggaagccgctgccagactcccaggggattctactcggcaggtagtggtccggtcgggcgtcgtgctggggcgtggcggtggtgctatgggccatatgttactgccctttcgcctgggccttgggggtccaatcgggagtggtcaccagtttttcccatggattcacattggcgacctcgctggcattctcacacacgctctggaggccaaccacgtccacggcgtgctgaacggagtcgcaccttctagtgccaccaatgccgagttcgcccagactctgggagcagccctgggaaggagagccttcatccccctaccctcagcagtcgttcaggccgtgtttggacgccagcgcgctattatgctgctagagggtcaaaaagtcataccacaacggacattggcaaccgggtatcagtactctttccccgagctcggcgcagcactaaaagagatcgtcgcctag

SEQ ID NO: 59757 - DNA, 468 bp, Artificial Sequence
  Description of Artificial Sequence: Synthetic coding sequence
tttcatgtggcgagctacggaatgtccggagccgagaagttacaaaaggaacaaatcgaatcaatcaacgtgggaggcacaaagttggtgatagacgtttgcgtccggagacgcgtccctcggctgatctatacctccaccgtgaacgttgcctttggcggtaaaccgattgaacagggagacgaggacagtgtaccttattttccactcgacgaacacgtcgatcactactcaaggaccaaagcgatcgcagatcaacttacgcttatggccaacggtatgcccctgccgggaggaggaacactcagaacctgcgtgctgcggcctccaggaatatatgggccagaggaacaacggcatctgcccagggtggcaggccacatcaagaagaggctgttcatgttccgattcggcgatcataaggcaagaatgaattgggtgcacgtacacaatcttgttcaggcatag

SEQ ID NO: 59758 - DNA, 4481 bp, Artificial Sequence
  Description of Artificial Sequence: Synthetic coding sequence
atggagaatagacctggcagctttcagtacgtcccagtccagctccaaggtggtgccccttggggcttcaccttgaaaggagggctagagcattgtgagcctctgactgtgtccaaaattgaagatggaggcaaggccgctttgtcccaaaaaatgcggaccggggacgaattggtcaacatcaatgggactccactgtacggatctcgtcaggaggccctgatcctaattaaggggtctttccgtattctgaaactcatagtcagacgccgaaatgccccagttagcaggccgcattcctggcacgtggccaaactgttggaagggtgcccagaggccgcaactactatgcacttcccaagtgaggcattttctctctcttggcactcaggatgtaacacctcagatgtgtgtgtccagtggtgtccgttgagccgtcactgttctacagagaagtcctcttcaattggatctatggagagcctggaacagccaggccaggccacttacgagagccacctcttacccattgatcagaacatgtatcctaaccagagggactccgcgtacagtagtttttccgccagctcgaacgcatccgattgcgcactgtcactgaggcccgaagagcctgccagtaccgactgcattatgcagggacccggaccaacaaaggccccttcaggcagaccaaatgtcgctgaaactagcgggggtagccgcaggacgaacggcggacacctcacccctagttcgcagatgagcagtaggccacaagaggggtaccaaagcggtccagcaaaggccgtgcgaggaccaccccagcctccggtgagaagggatagcctccaggcatctcgtgctcagttattaaacggggaacaacgtcgagcaagtgaacctgttgtgccgctgccacagaaagaaaagctaagcctcgagccagtactgccagcccgtaaccctaaccgcttctgttgccttagcggccacgatcaggtgactagtgaaggccaccagaattgcgaattttctcagcccccagaatctagccagcaggggtccgagcaccttctgatgcaagctagcaccaaggccgtcggcagtccaaaggcctgcgaccgagcttcaagcgttgatagtaaccccctgaatgaggcctctgccgagctggcaaaagctagctttggcaggccccctcacctgattggaccaacagggcatcgtcattccgcacctgagcagctgcttgcctcacacctccagcacgtgcaccttgatacccgtggcagcaaaggcatggagctccctccggtccaagacggtcatcaatggactctttctcccctacattcctcacataagggcaaaaagagtccttgcccacccaccggcggtacccacgaccaaagttccaaggagcgaaaaaccagacaggttgatgaccgctctctcgttttgggccaccagagccaatcttcacctcctcacggagaggccgacggacaccctagcgaaaaggggttcttagacccaaatcggacttctcgtgccgcttcagagctggctaaccagcagcctagcgcttcgggaagtttggtacaacaggccactgactgtagctctaccactaaagccgctagcggcaccgaggccggagaagagggggactcagagccaaaagagtgctctcggatggggggaaggcggtccggtggcactcgtggtagatctattcagaacagacgcaaaagcgaacgtttcgctacaaatctgcggaatgagatccaaaggcggaaggcacagttacaaaagtctaagggtcctttatctcagctgtgtgacaccaaagagcctgtggaagaaactcaggagcccccagagagccctcctttaaccgccagtaatacaagcctgctctcttcgtgtaaaaaacccccttcaccacgagataaactgttcaacaagtccatgatgctgcgcgctcggtctagcgagtgtctgtcccaagcccctgaaagccatgaatcaagaaccggccttgagggtcggatttccccgggtcagaggcccggacaaagctcactgggactgaacacctggtggaaggcacctgatccctcgagctctgatcctgaaaaagctcatgcccattgcggcgtcagaggtgggcactggcgttggtctcccgaacataattctcaacctctggtggcggctgctatggagggcccatccaaccccggtgataacaaggaacttaaggcctccaccgctcaggcaggcgaggatgccatacttcttcctttcgccgacagaagaaagtttttcgaggaaagctctaagtctctttcaacctctcacttgcccggactgaccacacatagcaataaaacttttacccagcgtcccaaacccattgatcagaactttcaacccatgtcaagcagctgtagggagctcagacgtcaccctatggatcaaagttaccattctgccgaccagccataccacgctaccgatcagtcttaccattctatgtcaccattgcaatcagagactcctacctattccgaatgttttgccagcaaagggctggaaaactcgatgtgctgcaaacccctgcactgcggcgactttgactaccacaggacatgcagttattcttgttcagtgcaaggagcactagtacatgatccatgcatctattgctctggcgagatttgccccgctctgctgaagaggaacatgatgcccaattgctacaactgccgatgccatcaccatcagtgtatacggtgctccgtctgttaccacaacccccagcactccgcactcgaggatagctcattggcacccggtaatacatggaagccaagaaagctcaccgtacaagaatttcccggagataagtggaatcccatcacgggcaaccgcaaaactagccaatctggaagagagatggcgcacagcaaaacctcattctcttgggccacgccctttcacccgtgtctggaaaatcctgcactggacctgtcctcgtatagagctattagctccctggacctactgggggactttaaacacgccctgaagaaaagcgaggagacttcagtttacgaggagggcagctctttagccagtatgccgcatccacttcgttctagagctttttctgagtcccacataagcttggcaccccagtccacacgcgcttggggacaacaccgcagggaactgttctctaagggagatgagacacagagcgatctactgggagcccgtaaaaaagcctttcctcctcccagacccccaccgccaaactgggagaagtatagactgttcagagctgcacagcaacagaagcagcagcagcagcagcaaaaacaacaggaggaggaagaggaggaggaagaagaggaggaggaggaagaagaggaggaagaagaagaggcggaagaggaggaagaagaactgcctccacagtacttctcatccgaaacatcaggttcttgcgctctgaacccagaggaggtcttggagcaaccccaaccactcagttttggccatctggaagggagtcggcagggctctcagagtgttcctgctgaacaagagagtttcgctctgcacagttccgattttttaccccctatcaggggtcatttggggagccagcccgagcaggctcaaccgccttgctactacggaatagggggtctgtggcggaccagcgggcaggaggctactgagtccgccaagcaggagttccagcacttctccccccctagcggtgcccctggaattcctacaagttacagcgcttactacaatatcagcgtggcaaaagctgagctactgaacaagctgaaggaccagccggagatggccgagattggactcggcgaggaggaggtcgatcatgagttggcccaaaaaaaaattcagctcattgagtccatctcccggaagctctcggtgctgcgggaggctcagcggggactgttggaggatattaacgccaactccgctttgggggaggaagtggaagctaatctgaaagcagtttgcaagagtaatgagttcgagaaataccacctgttcgttggggatctggacaaagtggtgaatctcctgcttagtttgagcggaaggctggcgcgagtcgaaaatgcgttaaacagtatagactccgaagccaaccaggagaagctcgtgctcatcgagaagaagcagcagctgacaggccaactcgcagatgcaaaggagctgaaagagcacgtcgacagaagagagaaactggtgttcggaatggtgtcccgctacctcccacaagaccagctccaggattaccagcactttgttaagatgaagagcgccttgatcatcgagcagcgagagctggaggagaaaatcaagcttggggaagagcaactcaagtgcctgcgggagtctcttctgcttggtcccagtaactttta

SEQ ID NO: 59759 - DNA, 1365 bp, Artificial Sequence
  Description of Artificial Sequence: Synthetic coding sequence
atggttcccggacaggcacagcctcagtctcctgagatgctgctgctccccctccttctgccagtgctcggagccggatcactgaacaaagatcccagttactctctccaggtgcagagacaggtgccagtgccggagggtctgtgtgtgatagtgtcctgcaatttaagctacccgcgtgatggatgggacgaaagcaccgccgcttacggttattggttcaaggggtggacctcccccaagaccggagccccagtcgcgaccaacaatcaatccagggaggtggaaatgtccactagggatcgttttcagctaaccggggacccaggcaaggggagctgtagtctcgtcattcgggacgcacagagagaagatgaagcgtggtacttttttagggtggaacggggatcacgggtcagacatagcttcgtgaataatttgttctcggtcagcgcaccggctttgacccaaaaaccggatgtttacatccctgagacactggagccagggcaacctgtaaccgtgatttgcgtgtttaattgggcgttcaaaaaatgtcccgctcccagcttctcctggacaggggctgccctgtcccccaggcgaaccagaccaagcacctctcatttctctgtactgagttttacaccgagccctcaggatcacgatactgatctcacctgccacgtagattttagtcgcaagggagtatcagctcagcgaacggtgcgtttacgcgtggcttatgcccctaaggacttaattatttcaatatctcacgacaacacatctgctctggagctacaaggtaatgtaatttacctggaggttcaaaaaggccagtttttgagattattgtgcgcggcagatagccagccacctgcgactctgagctgggtacttcaagaccgggtcctcagcagcagccatccgtggggccctagaacgctcggcttagagctgaggggagttcgcgctggagacagcgggcgttacacttgccgggctgagaaccgacttgggtcacagcagcgggctctggacctctctgtgcagtatccaccagaaaacttaagagtgatggtatcccaggccaatagaacagttcttgagaatttgcgtaacggcacatcactgcgtgtgttagaagggcagagcctgaggcttgtgtgcgtaacgcattcatcccctcctgctcggttatcgtggaccagatggggacagaccgttggcccttctcagcccagcgacccgggtgttctggagcttccgagagtacagatggaacacgaaggcgagttcacatgccacgcccgtcacccgctaggcagccaaagggtttcattgagcttttctgtgcattag

SEQ ID NO: 59760 - DNA, 1446 bp, Artificial Sequence
  Description of Artificial Sequence: Synthetic coding sequence
atgcttctgctccccctcttgctccccgtgctcggggctgggtcactgaataaagatccgtcttattcgctccaggttcaacggcaggtgccagtcccggagggcttgtgcgtgatcgtctcatgcaacctgagttatcctcgtgacggatgggacgagtctaccgctgcctacggttactggtttaaaggctggacttcacctaaaactggtgcacccgtcgccactaacaatcaatctagggaggtcgagatgtcgacgcgagaccgcttccagctcaccggggaccccggaaaaggctcctgtagtctagtgatcagagatgcgcagagggaagacgaggcttggtatttcttcagggtggagaggggcagccgtgtgcgacatagttttgtcaataaccttttttctgttagcgcacccgcactaacacagaagcccgacgtgtatataccggagacacttgagcctggccagcctgtaacagttatttgtgtatttaactgggctttcaaaaaatgtcctgcaccctcgttttcctggactggcgctgcactttcgccaagaaggactagaccttccaccagccatttctctgtgctttccttcaccccgtcacctcaggatcatgatacggatctgacctgtcacgttgacttttctcgcaagggcgtgtccgctcagaggaccgttagactcagagtggccagcttagagctgcagggcaacgtcatttacctggaagtgcagaaggggcagtttcttagactgctttgtgctgcagacagccagccacccgctaccctgtcctgggtcttacaggaccgggttctcagcagttcccacccatggggtccccgaaccctaggactggaactgcgcggagtcagggcaggagattctgggcgatacacttgccgtgccgagaaccgtctcggatcacagcaacgtgcgctggacctgtctgtccagtatccgcctgaaaatctgagggtcatggtgagtcaggccaaccgtaccgtgcttgaaaatttgcgcaacggcacgtcactccgcgtgctcgagggccagagcctgcgtctggtctgcgtgacacatagctcccccccagctcgcttatcctggacccggtggggacagacggttggaccaagccaacccagcgacccgggtgttttggaactgcctcgagttcagatggagcacgaaggcgaatttacatgccacgcccgtcaccccctggggagtcagagagtttcactgagtttttcagtgcactgtaaaagcggacccatgaccggcgtggtcttggtcgctgtaggggaagtcgctatgaagattctgctgctatgtctgtgtttaattctcttaagagtcaggtcgtgtcgtaggaaggccgctcgcgcagccctcggcatggaggcagctgatgcggtaactgactag

SEQ ID NO: 59761 - DNA, 924 bp, Artificial Sequence
  Description of Artificial Sequence: Synthetic coding sequence
atggccgctgctgtggccgctgcacttgccaggttgctggccgcattcttactcttagccgcacaggtcgcatgcgaatatggcatggtgcacgtcgtctcccaggccggtggcccagagggcaaggattattgcatattatacaatccacagtgggcgcatcttcctcacgatttatcaaaggctagtttccttcagttacggaactggacagcgtcacttttatgttctgctgcggatttaccagcacgcggtttcagtaatcagattcctctggtggccagaggcaattgcactttttatgagaaagtcaggctagcccaggggagtggtgcacgtggcctactgatcgtctcaagagagcgtctggtgccaccgggaggtaacaagacccagtatgacgagatcgggatacctgtggcactgctgagctacaaggatatgctggatattttcacacgttttggcagaaccgtgagagccgctctgtatgcacctaaagaacccgtcctggattataatatggtgataatttttattatggcagtgggaacagtggcgattggtggctactgggccggatcacgtgatgtcaagaagcggtatatgaagcacaaaagggacgatgggcctgaaaaacaagaagatgaggctgtagacgttacaccagtgatgacctgtgtgtttgtggtgatgtgctgctccatgttagtgcttttgtactacttctatgacctactcgtctatgttgtcattgggatattctgcctcgcttccgccaccgggctgtattcttgcctcgccccttgtgttcgcaggttaccgtctggaaagaaacgtccccaggcgaggatgctgctcctggcattattctgcgtcgcggtgtccgtcgtgtggggtgtgtttcgcaacgaggatcagtag

SEQ ID NO: 59762 - DNA, 1533 bp, Artificial Sequence
  Description of Artificial Sequence: Synthetic coding sequence
atggctgccgcagtggcagcagcccttgcaaggttgctggccgcatttctactattggcggctcaggtagcctgtgaatacggaatggtgcatgtggtgtcccaggcaggcggtcctgaagggaaggactactgcatactgtacaacccacagtgggcacacctgccccatgatttgtcaaaggcctctttccttcagctccgcaactggactgcctctctgctctgcagcgctgcggacctccctgccaggggcttctccaatcagatcccattggtagcccgtgggaactgtaccttctacgagaaggtcaggctcgctcagggatctggtgcacggggtctcctcatagtgagtcgtgaaaggttggttcccccaggaggcaacaagactcagtacgacgagattgggattccagtcgcacttctcagctataaagatatgctggacattttcacacgctttggtcgaaccgtccgtgccgcactatacgccccaaaagaaccagtgctggactacaatatggtgataatttttatcatggcagtcgggacagtcgccatcggtggttattgggcgggtagtagagacgttaaaaaacgctatatgaaacacaaacgcgatgacggaccagagaaacaagaggacgaggcagtggatgttactcccgtcatgacatgcgtgttcgtggtcatgtgttgctctatgttggtgcttctctactacttctacgaccttttggtgtacgtagtgatagggatattctgtctggccagcgctaccggcctctacagttgtctggctccatgtgtgaggaggctttttgggaaatgtcgcatacccaacaactccttgccatacttccacaaaaggcctcaggccaggatgttactccttgcgttattttgtgtcgcagtttcggttgtctggggcgtcttccgcaacgaggatcagtgggcctgggtgctccaggacgctttaggcattgcattttgtctttatatgctgaaaaccatacgattaccaacctttaaagcgtgtaccttgctcctccttgtgctcttcctgtacgacatcttctttgtcttcatcactccctttctaaccaagtcagggtcaagtatcatggtcgaggtggccacggggccttcagactccgctacacgggagaaactgcccatggtgctgaaggtccctcggctgaactccagcccgctagcactgtgcgacagacccttctccctgctcggtttcggtgacattctggtgccaggtctgcttgtggcctactgccatcggtttgacattcaggttcagtcctccagggtctatttcgtggcatgtacaattgcctacggcgttggcctgctagtgacattcgtagcgctggcactgatgcagcggggtcagcccgctctcctttaccttgtcccctgcaccctagttacctcttgtgccgtcgccctgtggaggcgcgagctcggggttttctggaccggcagtggatttgcagtgaatacatcgctcctgtag

SEQ ID NO: 59763 - DNA, 522 bp, Artificial Sequence
  Description of Artificial Sequence: Synthetic coding sequence
atggctgcgatggcatcactaggagccttggcgctgctgctcctctctagtctgtcaaggtgctccgccgaagcatgccttgagccacagataacaccgagttactatacaacgagcgatgctgtgattagcaccgagactgtttttatcgtcgagatctcgctcacatgtaaaaacagagtgcagaatatggctctgtacgctgacgtgggcggaaagcagtttcctgtcaccaggggacaggatgtgggtcgatatcaggtgagttggagtttagatcacaaatccgcacacgccggtacatacgaagtgagattctttgatgaagagtcttactctttgcttagaaaggctcagcgcaataatgaggacatcagtatcatccccccactgttcaccgtgagcgtcgaccatcgtggtacctggaacggtccctgggtttcgactgaggtgctggccgcagccattgggttagtcatatactatctggcattttccgccaagagtcacatccaagcatag

SEQ ID NO: 59764 - DNA, 522 bp, Artificial Sequence
  Description of Artificial Sequence: Synthetic coding sequence
atggcagctatggcctctcttggagcgctcgcccttctattgctttcttcactcagcagatgtagcgccgaggcgtgccttgaaccccaaattaccccctcttattatactacctcagacgccgttatttcaacggagacagtgttcatagttgagatctctttaacgtgcaagaaccgggttcagaacatggctctttacgctgacgtgggcggaaagcagtttcccgtgacccgtggacaggacgtgggaaggtatcaggtctcttggagcctagaccacaagagtgctcatgccggaacatatgaggtgaggttctttgacgaggagagttatagtctcttgcgtaaagcccagaggaacaatgaggacatctcaatcattccgcctctctttacagtttctgtagaccacagagggacgtggaacggaccttgggtctccacagaagtcctcgctgccgctatcggattagtaatctactacctggcgttctctgctaagtcgcacatccaagcttag

SEQ ID NO: 59765 - DNA, 522 bp, Artificial Sequence
  Description of Artificial Sequence: Synthetic coding sequence
atggcagcgatggcctcactgggtgctctggctctgttgttgctatccagcctgtcccggtgctctgctgaggcgtgtcttgaacctcagataacgcctagctactatactaccagcgacgcggttatcagcacagagaccgtatttatagtagaaatctctctcacatgtaaaaacagagtgcaaaacatggctctgtatgctgacgttggcggaaaacagttcccggtgactcgtggccaggacgtgggacggtaccaggtttcctggtcactggatcacaagtcagctcacgcaggaacttatgaggttcggttcttcgatgaggaatcctactctctgctaaggaaggcccagcggaataacgaggatatcagcataattccccctctttttactgtgtccgtcgaccacagagggacatggaacgggccatgggtttctactgaggtcttagcagccgctatcgggctggttatctactatctcgcattttccgctaaatcacacattcaggcttag

SEQ ID NO: 59766 - DNA, 2961 bp, Artificial Sequence
  Description of Artificial Sequence: Synthetic coding sequence
atgccccgtgccacttgggccaactcgaaggagagaagttgggcagagtcagagcgaggaccccgtgacacaggaaatggcggatccaaggcagaacgacacatacaggagatcgagacaggacggggaggcgatagggcgaaagctcatcggcgacagcgcatgcgcctgagaggcacagagcgggcttcactcggcccaggaagacgccttggagactcccgaggcacagacatgcctggggcacgagcacaagggcttgctgctgccatgaccgaggaatccgaggagactgtactgtacatcgagcaccggtacgtgtgctccgagtgcaaccaactttatggctcccttgaggaggttttgatgcaccagaacagccacgttccacagcagcactttgagctggtgggcgtcgcagatcccggagtaacagttgctacggacaccgcttcaggtacaggtctttaccagacccttgtacaggaatcccaataccagtgccttgagtgcggccaactcttgatgagccccagccagttgctggaacaccaggagcttcatctgaaaatgatggcccctcaggaggccgtcccggctgagcctagtcctaaggcaccccctttaagttcctcaaccatacattatgaatgtgtggactgcaaagccctattcgcaagccaggaactgtggttgaatcatcgacaaacacatctgcgggctacaccgacaaaagccccagcaccggtcgtcctgggtagccccgtggttcttggccctcccgtgggccaggccagggttgccgtggagcacagctatagaaaagctgaagaagggggagagggcgctactgtcccaagcgcagccgctaccaccacagaggtggtgactgaagttgaactgctattgtacaaatgctccgagtgttcccaactatttcagttgcccgcagatttcctggagcatcaggctacgcacttccccgctcctgtgcccgagtcgcaggaacctgccctgcagcaagaggtgcaagccagcagccctgccgaagtgccagtctcacagcccgatcctcttcctgcttccgatcacagctatgagctcagaaatggggaggcgataggtagagatagacggggaagacgcgctcggaggaacaatagcggagaagcaggcggtgccgctacacaggagcttttttgttccgcttgtgaccagttatttcttagcccacatcaactccagcagcacctgcgctcccatagggagggagtctttaaatgccccctatgctctcgcgtgttcccatcaccgagctctctggaccaacacttgggagaccactcaagcgaatctcacttcctgtgcgtcgactgcggactggcatttggtacagaagcacttctgctggcacataggagggcacacactcccaacccattacattcctgcccctgtggcaagacatttgttaacttgactaagttcttataccaccgccgaactcacggcgtgggtggtgtacccctccctaccacacccgtccctcccgaggaacctgtgatcggtttccccgaacctgcccctgctgagactggcgagccggaagcgccagagccacccgtctcagaagagacatccgcaggtcctgccgctccagggacctataggtgtttattatgttcccgggaatttggcaaagctttacagttaacgagacaccaacggtttgtgcacagacttgagcgcagacataaatgttctatctgcggtaaaatgttcaagaagaaaagccacgtccggaaccatcttcgtactcacactggagagcgcccatttccctgccccgattgctcaaagccgtttaatagtcctgccaaccttgccaggcaccgtcttacccacactggggaacggccttatagatgtggcgactgtggaaaagctttcacccaaagtagcacactgcggcagcatagacttgtccatgcacagcacttcccatataggtgccaggaatgcggggtccggtttcaccgcccatatagactgttgatgcatagataccatcacactggtgagtacccatataagtgtcgggagtgccctcgatcattcctgctgcgcaggctgctcgaggtgcaccagctcgtggtccatgcagggaggcaaccccacaggtgcccttcatgcggggcagcatttccttcatcactgcgcctacgcgaacaccgctgcgcagcggcagcagctcaggcgcctaggaggttcgagtgcggcacctgtgggaagaaggtaggaagcgctgccaggttgcaagcccatgaagccgctcacgctgccgcaggaccgggtgaagtcttggcaaaagagcccccagcacccagagctccaagagccacacgggctcccgtcgcatcccccgctgcgctggggagcactgctacagcttcaccggcagcacctgcaagaaggaggggattggagtgctctgaatgcaaaaaactgttttcaaccgagacaagcttgcaggtccacaggcgcatccacacaggcgagaggccgtatccttgtcccgactgcggaaaggctttcaggcagagtacacacctcaaagatcaccggagactacacaccggagagcggcctttcgcctgcgaagtgtgcggcaaggcatttgcgatttccatgagattggctgaacacagacgtatccacacaggcgaacgcccttacagctgtcccgactgcgggaagtcttacaggtcgttcagtaacctctggaaacaccggaaaactcatcagcagcaacaccaagcagccgtacgacagcaactcgccgaggcagaggccgctgtcggattagctgtcatggagaccgcagtggaggctctgcctctggtggaagccattgaaatatatcctttggcagaagccgagggagtgcagatttcgggctag

SEQ ID NO: 59767 - DNA, 447 bp, Artificial Sequence
  Description of Artificial Sequence: Synthetic coding sequence
atgttccgtaggccagtgctgcaggtgcttagacagttcgtaaggcatgagtcagaaaccaccacttccctggtgctggaacgcagcctgaatagagtgcacctcctcggcagagtgggccaggatccagttctcagacaggtcgagggaaagaatcctgtcacaattttctcacttgccacaaatgagatgtggcggagcggagatagtgaggtgtaccagctgggcgatgtgtcgcagaaaaccacatggcaccgaatttcggtgttcaggcctggtttgcgtgatgtcgcctaccagtatgtcaaaaaaggttcccgcatatatctggagggcaaaatcgactatggcgagtatatggataagaataatgttcgcaggcaggctactaccattatcgccgataacatcatcttcctgtctgatcagacgaaagagaaagagtag

SEQ ID NO: 59768 - DNA, 447 bp, Artificial Sequence
  Description of Artificial Sequence: Synthetic coding sequence
atgttcaggaggcctgtgctgcaggtgctgagacagtttgttaggcatgagtccgagacgaccacatcccttgtcctggagaggtcattaaatagagtgcatctccttggcagagtgggccaggatcccgtgctgagacaagtggaaggcaaaaaccccgtgaccattttttcactggctacaaatgaaatgtggcgctccggggatagcgaagtgtaccagctcggcgacgtctcccagaagactacttggcacaggatctccgtgttcagacccggactaagagatgtggcttatcagtatgtcaagaagggctctaggatctatctggagggtaaaattgactatggagagtatatggacaaaaacaatgttagacgtcaggctaccacaattatcgcagataatattatctttctgtcagatcagaccaaagagaaggaatag

SEQ ID NO: 59769 - DNA, 408 bp, Artificial Sequence
  Description of Artificial Sequence: Synthetic coding sequence
atgtttaggcggcctgtcctgcaggtgttgcggcagttcgttcggcacgaatcagagacgacgaccagtcttgttctggaacgatctttaaatagggtgcacttgctcggaagggtcggacaggacccagtgctgcggcaggtggaaggcaagaacccagtgaccatcttctctttggctacaaacgagatgtggcggtccggggattcagaggtctaccagttgggcgatgtgtctcagaaaactacgtggcatagaatatcagtgttccggccaggcctgcgggacgttgcatatcagtatgtgaaaaagggctcacggatctatctggaagggaaaatcgactacggggagtatatggataagaataacgtgagacgccaggccaccacaatcatagcagactag

SEQ ID NO: 59770 - DNA, 447 bp, Artificial Sequence
  Description of Artificial Sequence: Synthetic coding sequence
atgttccggaggcctgtgcttcaagtcctccgccaatttgttagacacgagagtgagacaactacatctctggtgctggaaagaagcctgaatagggtgcacttacttgggcgagtggggcaggacccagtactgcggcaggtggaaggaaaaaaccctgttacaattttcagcctcgctacaaacgaaatgtggcggtccggggattcagaggtgtaccagcttggcgatgtgagtcagaagactacatggcacaggataagcgtgttccggcctgggctacgggacgtcgcatatcagtatgtgaagaaagggtctcgaatctacttggagggtaaaatagactacggagagtacatggataaaaataatgttaggagacaggccaccaccattatcgccgataatataattttcctgagtgaccagaccaaggagaaagagtag

SEQ ID NO: 59771 - DNA, 576 bp, Artificial Sequence
  Description of Artificial Sequence: Synthetic coding sequence
atgggatacaagctccaagacctcacagacgtgcagattatggccaggctgcaggaagagaataaactgagaagatccatgcctaacctggccaggatgccatctactactgctatctcctcaaacatctcaagtccagttactgtgcgtaacagtcagtcattcgactcttcccttcacggcgctgggaatggcatctctcgcatccagtcctgtatccccagcccaggacaactgcagcacagggtgcatagcgtaggccacttcccagttagtattcgccagcccctgaaggccactgcgtacgtttcacctactgttcagggctcatccaatatgccattatccaatggtctgcaactatactcaaataccgggatacccactccgaacaaagccgctgcgtcaggtattatggggaggagtgctcttcctcgaccctcccttgccatcaacggcagtaacctcccaaggagcaagatagctcagccggtccggagtttcctccagccccctaaaccactgtcatcactgtctacgctgcgggacggaaactggcgcgatgggtgctattag

SEQ ID NO: 59772 - DNA, 918 bp, Artificial Sequence
  Description of Artificial Sequence: Synthetic coding sequence
atgggctacaaattgcaggacctgactgatgtgcagattatggccagactccaggaggaatctcttcggcaggattacgcatccacgtctgcttctgtcagtaggcactcaagcagtgtatccctgagtagcggcaagaaaggcacctgctccgatcaggagtacgaccaatattccctggaagacgaggaggagttcgatcacctgccacccccacagccccgtctgccacgatgctcccctttccagcggggtattccacactcacaaacattcagctcaatccgagagtgtagacgctcaccgtcctctcagtattttccatccaacaattaccagcaacagcagtattacagcccccaggcccagacccctgatcagcaaccaaatagaactaacggcgacaaacttcggcgatccatgccaaacctggcaagaatgccaagcaccactgcaatttcaagcaatatcagctcaccagtgacagtgagaaatagtcagagcttcgactctagcctgcacggtgccggtaacggcatctccaggattcagtcctgtatcccttccccgggtcagcttcagcatcgcgtgcactcagttggccatttccccgtctccattcgccagcccctaaaagccactgcgtacgtctctcccactgtgcagggctccagcaacatgccattgagcaatggcctccagttgtattccaatacagggattccaacgcccaacaaggctgctgcctcaggcattatggggcgatcagcattgccccgtccctcccttgcgattaacgggtccaatttgcctaggtctaaaattgcacaacctgtgcggtccttcctacagcccccaaaacctttgagcagtcttagtaccctgcgggacggcaattggagagacggatgctattag

SEQ ID NO: 59773 - DNA, 918 bp, Artificial Sequence
  Description of Artificial Sequence: Synthetic coding sequence
atgggatacaaattgcaagacttaacagatgttcaaataatggctaggctgcaagaagagtcccttagacaggactacgcaagtacatctgcttctgtgagtcgccattcctcttccgtcagcctctccagcggcaaaaagggaacctgttccgaccaagaatatgaccagtatagtttagaggacgaggaagagttcgatcaccttccaccccctcagcctaggcttccacgctgctcaccctttcaaaggggcatcccgcactcccagacattttcaagtattcgagagtgtagacggtccccttccagccaatacttcccctccaataattaccagcaacagcagtactattccccccaggcccagacaccagaccaacaaccaaacaggactaacggcgacaaattacgaaggtccatgcctaacttggccaggatgccttccaccacagcaatcagctccaatatcagcagtcccgtgactgtgcggaacagtcagagtttcgacagtagcttgcatggcgcagggaatggtatcagcagaattcaatcatgtataccgtctccaggacagctccagcaccgtgtccatagcgtgggccacttccccgtatctatccggcagccattgaaagctaccgcgtatgtgtctcccactgtccaggggagttctaacatgccgctatctaacggtttgcaactttatagcaatacaggaatcccaactccaaacaaggccgcagcatcagggatcatggggaggtctgcgctacctcgaccaagcttggcgattaatggttcaaacctgcctcgctccaagatcgcccagcccgtgcggagtttcctgcaaccccctaagccgctttccagcctttctaccttaagagatggaaactggagagatggatgttattag

SEQ ID NO: 59774 - DNA, 255 bp, Artificial Sequence
  Description of Artificial Sequence: Synthetic coding sequence
atgtaccggtatcagagctgtcgatggaagaacaccctgttcttatgtgtgtccggatacacctcaagaggcagtcctttatccccacagagctcgattgattctgagttgtccacctcagagctggaagatgactcaattagtatgggatacaaactgcaggacttgacggatgtgcagatcatggctcggcttcaagaggagtcacttaggcaagattatgccagtactagcgcctcggtaagcagacattag

SEQ ID NO: 59775 - DNA, 1707 bp, Artificial Sequence
  Description of Artificial Sequence: Synthetic coding sequence
atgatggccgagcaagttaaatgcgcgtcagccggagtcagtagtggtgccggatctggcccagttgttaacgcggaattggaagtcaagaagctgcaggaactggtacggaagctagaaaaacagaatgaacagctgagatcaagggctgccagtgcagccgcagccccacacttactcttgctgccaccgccaccacctgccgctcctccgcctgctggactgcaaccgctgggccctcgaagtcccccagctgccacagccaccgccgctgcgtcaggcggtctcggccctgctttccccggaaccttctgcctgccatcgcccgcacccagcttgctctgctcccttgcccagcctcctgaggcacccttcgtatacttcaaacctgccgcaggcttctttggcgcaggtggcggtggcccagagccgggaggcgctggaactccgcctggcgctgccgctgcccctcccagtccccctcctacccttttagacgaagtggagctccttgacctggaatcagtcgcagcttggcgggatgaagacgactacacttggctttatattggttcttccaagactttcacgagtagtgaaaagtcactaactcctcttcaatggtgtagacacgtcttggacaatcccacacctgaaatggaggcagcgagacgctctctgtgctttcgcctcgagcaaggctacaccagtagaggatctccactgtcaccacagtcaagtatcgattctgagttaagtacctcggaattggaggatgattcaatttccatgggttataagttacaagaccttactgacgtccagattatggccagactgcaggaagaatctttaaggcaggactacgccagtacgtcggcttctgtgtctaggcatagctctagtgtgtccctgagcagtggcaaaaagggcacgtgtagcgaccaggaatacgatcagtactcactagaagatgaggaagagtttgaccatctcccccctccacagcctagactgcccaggtgctcaccttttcagcgaggaatcccacactcacagactttttcctcaattcgggaatgtagacgcagcccatcctcccagtattttccctctaacaattatcagcagcagcagtactatagtcctcaggcccagactccagaccaacagcctaaccggacaaacggggacaaactgcgtagatcaatgccaaatctggctcgcatgccctccacaaccgctatctcgagcaacatttctagccctgtgaccgtgaggaactcccagagcttcgacagttctttgcatggagctggtaacggtataagcagaatacaatcttgtattccctcacctggacagctacagcaccgggtccatagtgtaggtcatttccctgtctcaatcaggcagcctcttaaggctaccgcatatgtgtcccctactgtccagggctcctccaacatgcctttgtcaaatggcctgcagctctattcaaatactgggatcccgacccccaataaggcagctgctagtggcataatgggacggtccgcgctgcccaggccatctttagctatcaatggctccaatctcccgcgtagcaaaatcgcccagcctgtgcggagttttctgcagccccctaaacccctgtcaagtctctcaaccctacgggatgggaactggcgtgacggttgttattag

SEQ ID NO: 59776 - DNA, 1050 bp, Artificial Sequence
  Description of Artificial Sequence: Synthetic coding sequence
atggaagctgctcggcgatcgctgtgtttcagactggaacaaggatacactagtagggggtcacctctgtctccacaaagctcaatagacagcgaactgagcacgtcagagctggaagacgacagcatcagcatgggctataagttacaggacctcacagatgtccagatcatggccagactccaagaagagtcactgaggcaggattacgcctctacatccgcttcagtatccagacatagcagctctgtttctctatcctccggcaaaaagggcacatgctctgatcaagaatacgaccagtattccctcgaagacgaggaggaattcgatcacctgccacctcctcagcctagactgcccaggtgctctcccttccagaggggcatcccccatagccagactttctcctcaatcagggagtgcaggcgctccccttcctcccagtacttccctagcaacaactatcagcagcagcaatattacagtccacaggcccaaacccctgaccagcagcccaaccggaccaacggcgataagctgcggcgaagcatgccaaaccttgcacgcatgccaagtactacagctatcagttccaacatcagttctcctgtgactgttcgtaattcccagtcattcgactctagccttcatggcgctggaaacgggattagccgtatccagagttgcattccgtcaccaggccagctgcagcatcgcgtgcacagcgtaggtcactttcccgtctctataaggcagcctttaaaggcaaccgcttatgttagcccaactgtgcagggcagcagcaacatgcccttgagcaacggtttgcagctgtacagcaataccggtatccccacacctaacaaggccgcagccagtggcattatgggccgaagcgccttgcctcgaccgtccttggcaatcaatggctccaacttgcctaggtctaaaatcgctcaaccggtgagatcgtttctgcagccgccaaaaccactgtccagtctctcaacgctacgcgatggaaactggcgggacggctgttactag

SEQ ID NO: 59777 - DNA, 723 bp, Artificial Sequence
  Description of Artificial Sequence: Synthetic coding sequence
atgggttataagcttcaggacttgaccgacgtgcagatcatggccaggcttcaggaggagtcgcttaggcaggattacgcttcaaccagtgcatccgtgtcaaggcattcctctagtgtgtctctgagctccggtaagaagggaacttgcagcgatcaggaatacgatcaatactcattggaggatgaagaggagtttgatcatttgccaccccctcagccccgacttccacggtgcagccccttccagcgcggaattccgcactcgcagactttctcaagcatcagagagtgccgtcgcagcccttcctctcagtacttcccatcaaacaattatcaacagcagcagtattattccccacaggctcagactccggaccaacagccaaacaggaccaacggggataagctcagacggagcatgccaaatctcgccagaatgccatcaaccacagctatctccagtaatatctccagccctgtgaccgtccgaaactcccagtccttcgatagcagtctgcacggagcaggtaacggcatttctcggatacagagttgcatcccgagtcctgggcagttacaacaccgtgtccatagcgtgggccacttccctgtgagcatccgccagcctttaaaggccaccgcctatgtgtcccccacagtgcaaggctcaagtaatatgccactcagcaacggcctgcaactgtacagtaacacaggctag

SEQ ID NO: 59778 - DNA, 1707 bp, Artificial Sequence
  Description of Artificial Sequence: Synthetic coding sequence
atgatggcagaacaggtgaaatgtgcgtcagcgggagtttcctcaggagccggttccggaccagtggtgaatgccgagttggaagtaaaaaagcttcaggaactggtccgcaaactagagaagcaaaacgaacagctcaggagcagagctgccagcgccgctgcggctcctcacctgctgctcttaccgccaccccctccagccgcaccacctcccgctgggttgcaacctctgggaccgcgatccccgccagcagcgaccgcaaccgcagccgcaagtggaggactgggaccagcctttcctgggaccttctgcctcccctcccctgccccaagcttactgtgttccctcgcccagccccctgaggctccgtttgtgtatttcaagccggcagcaggtttttttggagctggcggtggcggacctgagcctggtggcgctggaacccccccaggtgccgcagccgctcccccaagccctcctcccaccttactggatgaggtggagctgcttgatttggagagcgtggccgcttggcgcgacgaagacgattatacttggctgtacatcgggtcctctaaaacattcacgagttccgagaagagtctgactcccttgcagtggtgccgccacgttctcgacaatccgactccagaaatggaggcagcaaggagatccttgtgcttccggctggagcagggttatacaagtcggggaagcccattaagcccccagtcaagcatagactcggagctttcaactagtgagcttgaggacgactctatctctatggggtacaaactgcaggatctaacggacgtgcagatcatggctcgactgcaagaagaatcccttaggcaggactacgcatccacttctgcctcggtgagcaggcattctagttccgtatccctgagctccggtaagaagggaacctgcagcgatcaagagtatgaccaatattccctcgaagacgaagaggaattcgatcacctgccaccacctcagccaagacttcccaggtgttctccattccagagagggattccccactcacaaaccttcagcagtatccgagaatgcaggaggagcccgtcgtcccagtattttccctccaataactaccaacagcagcagtactacagcccccaggcacagaccccagaccagcagcctaaccgaactaatggcgataagctgagaagatcgatgccgaacttggcacggatgcccagcacaaccgcaatttctagcaatatctcctcacctgtaactgtacgcaactctcagagtttcgattctagcctgcatggagctggaaacggtatctcaagaattcagagttgcattccttcaccgggtcaattacaacaccgagtacacagcgtcggacacttcccggttagcatacggcaacccttgaaagccaccgcatatgtgtcaccaacagtgcagggatcaagcaacatgccccttagcaatggcctccagttgtactctaacaccggcataccaacacccaacaaagcagctgccagcggtattatgggacggagtgcactgccacggccaagtttggccattaacggaagcaatttacccaggagcaagattgcccagccagtccgctctttcttgcagccaccaaagccactgagcagtttgtcgaccctgcgagatggcaactggcgcgacgggtgttactag

SEQ ID NO: 59779 - DNA, 444 bp, Artificial Sequence
  Description of Artificial Sequence: Synthetic coding sequence
atggggtacaagctgcaggacttaaccgatgtccaaatcatggctagattacaggaggaatctttacggcaggactacgcctccaccagtgcgtctgtgtctcgtcatagttcttccgtgtcactgtcatccgggaaaaaagggacctgctcggaccaggagtacgaccaatattccctcgaggatgaggaagagttcgatcaccttcccccaccgcagccccgtctgccacgatgttcaccatttcagcgaggtattccccactcacaaacattttcatctatccgcgaatgtaggagaagcccatcttcgcagtatttcccatctaacaactaccagcaacaacagtattactctccccaggcccaaacacctgatcagcaacccaatagaacaaatggcgacaagcttaggcgatccatgcctaacctggccagaatgtag

SEQ ID NO: 59780 - DNA, 39 bp, Artificial Sequence
  Description of Artificial Sequence: Synthetic coding sequence
atgggatacaaactgcaagacctgacggacgtgcagtag

SEQ ID NO: 59781 - DNA, 1281 bp, Artificial Sequence
  Description of Artificial Sequence: Synthetic coding sequence
atggtgggggttgggttgtgccttaggcttctcctgttctttagattcaagcgcactctggaccgcatctgtgttttgtttttgctaggatggcaccgcaagccacgctcggacggtagcttattcatagaaaggttgtatataggttcttctaagaccttcacatcaagcgagaagagtctcacacctcttcaatggtgccggcatgtgctggacaaccctaccccagagatggaagccgcaagacgaagtctgtgtttcagacttgagcagggctacacctccagagggtcccctttgagtccccaaagctccattgactctgagctctctacctctgagctggaggatgatagcatttctatgggatacaagctgcaggatctgaccgatgttcaaatcatggcgaggctgcaggaagaatccctgcgacaggactacgcttcgacttcagccagcgtcagccggcatagttcctctgtttccctttctagtggcaaaaagggcacttgttcagatcaggagtacgatcaatactccctggaagatgaggaggagttcgatcaccttccccctccgcagcctcgcctccctaggtgcagccctttccaaaggggcatcccgcacagccaaaccttttctagcatccgtgagtgtcgcaggtccccatcatcgcagtattttcctagtaacaattaccaacaacagcagtattactctcctcaagcccagaccccagaccagcagcccaacaggaccaatggcgataagttgcggcgaagcatgccgaatctcgccaggatgccctcaactactgcaatctcttccaatattagcagtcccgtgacagtcaggaacagccagagcttcgatagcagccttcatggagccggtaacggaatttcccggatccagagctgtataccatcccccggacagcttcagcatagagttcacagcgtgggccatttcccggtgtccattaggcagccgctgaaagctaccgcctacgtcagccccaccgtgcagggctccagtaatatgcccctttctaacggcctgcagctctatagcaacactggcatcccgacaccaaataaagcggctgcctctggaatcatgggacggtccgccctgccacgaccaagcctggccataaatgggagtaatttacccagaagtaaaattgcacagcctgtgcgttccttccttcagcctccgaaacccctgtcctccttgtcaacgctgcgggacggcaattggagagacggctgctattag

SEQ ID NO: 59782 - DNA, 408 bp, Artificial Sequence
  Description of Artificial Sequence: Synthetic coding sequence
atggggtacaagcttcaagatctgacggatgtccagataatggcccgtctgcaggaagaatcgctacgccaagactatgccagcacttccgcctctgtgtcgcggcacagcagctcggtctccttaagctctgggaaaaagggcacttgtagtgatcaggaatacgatcagtacagcctggaggatgaagaagagtttgatcacctgcccccacctcagcccagactgccaaggtgttccccttttcaaagaggaatcccacactcccagaccttcagctcaatcagggaatgccgtagatccccatcttcacaatacttcccctcgaataattatcagcagcagcagtactacagccctcaggcccagacacccgaccagcaacccaaccgtaccaatggaggctag

SEQ ID NO: 59783 - DNA, 2538 bp, Artificial Sequence
  Description of Artificial Sequence: Synthetic coding sequence
atgctcagcggtgtatggtttttgtccgttctcacagtggctggcatcttgcagactgaatcccggaaaactgccaaagacatctgtaagattcgctgcctatgcgaagaaaaggaaaacgtcctgaacatcaactgcgaaaacaaaggctttacaactgtgtccctgttgcagccaccccagtatcgcatatatcagctcttcctgaacggcaacttgctgacccggttgtatccaaatgaatttgtgaactattctaacgctgtcactctgcacctgggcaacaatggattacaggagatccggacaggcgcattcagcggtttaaaaactctgaagcgtcttcacttgaacaacaacaaactggaaattttacgtgaagacacattcctgggtctggagtccctggaatatctgcaagccgactacaactatataagtgctatcgaggcaggagccttttctaaactgaataaactcaaggtactaatactaaacgacaacttgttgcttagcctgccaagcaatgtcttccggttcgtcttactgactcacctagacttaagaggtaaccggctaaaggttatgcctttcgctggggtcctggagcatataggcggaattatggaaatacaattggaagaaaacccgtggaattgcacgtgtgatctgctgcccctgaaggcatggctggatacgataacggtctttgtcggagaaatcgtttgcgagacccccttcagactgcacggaaaagacgtgacacagctgactagacaggatctttgtcccaggaagagcgcgtctgactcttcacagcgcggtagccatgccgacacacacgtgcagagactctctcctacaatgaatcccgctctaaacccaacgcgcgctccgaaggcctctcgcccaccgaaaatgaggaatcggccaacgcccagagtgacagtatcaaaggacaggcagtctttcggtccgattatggtctatcagacaaaaagcccagtgcctctgacgtgtccctcaagttgtgtctgtacctcacagtcctcagacaatggactgaatgtgaattgccaggagcggaagtttaccaacatctcagatctgcagccaaaaccaacttctcccaagaagctgtatttaacaggcaactatctgcagactgtctataagaacgacctgctagaatactcctcgctggacttattgcacctgggaaataaccgcatcgctgtcatacaggaaggagccttcactaacttaacaagtctgaggcgattgtacctgaacggaaactatctggaggtgctctatccaagcatgtttgacggtctgcagtctctgcagtacctgtatctcgaatacaatgtgattaaagagataaaacctctgaccttcgacgccctcataaacctccagcttctgtttctcaacaacaacctgttgcgcagtctacccgacaacatttttggaggaaccgccctcactagactgaatttgaggaataatcatttttcacatttacccgtgaagggtgtcttggaccaactgcccgctttcattcaaatcgacctgcaggaaaacccctgggactgtacatgtgatatcatggggcttaaggattggaccgagcacgcaaacagcccagtaatcattaacgaagtgacttgcgagagtccggctaagcatgccggagagatccttaagtttctgggcagagaggctatttgccccgattctcctaatctgtccgacgggacagtactctccatgaaccacaacacagataccccacgatcactgagcgtttccccaagctcctacccagagctgcacactgaagtgcccctctctgtgcttatactgggactactcgtggtcttcatactctccgtatgcttcggagccggacttttcgtttttgtgttaaagcgcaggaagggcgtgccgagcgtccctcgcaataccaataatctcgacgtttcatctttccaattacagtacggaagttataacaccgaaactcatgataagaccgacggtcacgtttataattatatccctcctccagttggtcaaatgtgccagaatccgatctacatgcaaaaggaaggggatccggtagcttactatagaaatctgcaggagttctcatacagtaatctagaagagaaaaaagaagaaccagcaacccccgcttatactatcagtgccaccgaactactagagaagcaagctacgcccagggagcctgaattgctgtaccagaacatagccgaacgcgtaaaagagctgcccagtgcaggcctggtgcactataatttttgcacattgccaaagcgtcaattcgcaccctcctacgaaagccggcgacagaaccaagaccgcattaataagacagtgctctatggtacaccaaggaagtgcttcgtcggacagtctaaaccaaatcaccctctgctgcaagccaaaccgcagtctgagccagactatctggaggtcctggagaaacagaccgcaatctcacagctgtag

SEQ ID NO: 59784 - DNA, 2538 bp, Artificial Sequence
  Description of Artificial Sequence: Synthetic coding sequence
atgttatcgggtgtgtggtttctgtctgtcctcacggtggccggaatcctacaaacggaaagcagaaagactgccaaggacatttgcaaaatccgctgcctgtgtgaggagaaggaaaacgttctaaacattaactgtgaaaacaagggattcacaacggtatccttgctccaacctccgcaataccgcatctatcagttgtttcttaatggcaatctccttacaaggctgtaccccaacgagttcgtcaactactctaacgctgtgactctacaccttggtaataacgggctgcaggaaatccggaccggcgctttcagcgggctcaagacgctgaaaagacttcaccttaataataacaagcttgagattttgcgagaggacaccttcctggggttagagtcccttgaatatctccaggctgactacaactatatcagcgccatcgaggctggagcatttagcaagctgaacaagttgaaggtgctgattcttaatgacaacctcttgctgagtctcccgtccaacgtgtttcgcttcgtgttgctgacacacctggatctccgcggaaaccgcctgaaagtcatgccctttgccggagtcctggaacatatcggcggaataatggaaattcaacttgaggagaatccatggaactgcacttgcgatctcctacctctcaaagcttggctcgacaccataacagtgtttgttggtgagattgtgtgtgagacacccttccgtctgcacggtaaagacgtgacccaactgacaagacaagacctgtgtcccaggaaatctgcaagcgatagctcacagaggggctcacatgctgacacacatgtgcagaggctaagcccaaccatgaacccagctctgaatcctacgagagcaccgaaagctagtcggcctcctaagatgcggaataggccaaccccacgggtgacagtttccaaagaccggcagtctttcggtcctattatggtataccagacaaaaagtccagtgccccttacatgtcccagttcgtgtgtgtgtacctcccagagctccgacaacgggctgaacgttaattgccaagagcggaaattcacgaacatttccgacctccagccgaaaccaactagccctaaaaaactgtatctcacgggaaactatcttcagacagtatacaagaacgatctgctcgagtactcctctctcgatctgcttcacctgggtaataatcgcatcgctgttatacaagaaggcgcatttaccaatctaacctccctacgacgcctttatctgaatgggaactacctcgaagtgctctacccatccatgttcgacggccttcagtcactgcagtatctgtacctcgaatacaatgtcattaaggaaataaagccgctcacctttgacgctctcattaaccttcaactcctgttcctgaacaacaatttactacggagcttacctgacaatatcttcgggggaacagccctaacccgcttgaacttacgaaacaatcacttctcacacctcccagtgaagggtgtcttggaccagcttcctgcatttatccagatcgacctgcaagaaaacccctgggactgtacgtgtgacataatgggtctgaaagattggacagagcacgctaacagtcctgtaatcatcaacgaggtgacttgcgagtcccccgctaagcacgccggtgaaatccttaaattcctggggagagaggctatttgccctgactcacccaacttgagcgacggtacagtactctctatgaatcataataccgacacccctcgatcgctgagtgtgagcccatcgagttaccctgaattgcacaccgaggtcccattgtctgtacttatcctggggttacttgtggtctttatactcagcgtctgctttggtgctggcctgtttgtctttgtcctcaagcggcgaaagggggtaccatccgttccgagaaataccaataatcttgatgtttctagctttcagctacaatacgggagttacaataccgaaactcatgacaaaactgacgggcacgtttacaattacatcccacccccagtcggacagatgtgccagaatcccatctatatgcagaaagagggggatccggtcgcctactataggaatctgcaggagttctcctactccaaccttgaagagaaaaaagaggaacctgccacacctgcatacacaattagcgcaacggagctcctggagaaacaagctacacctagggagccagaattgctttaccaaaatattgccgagcgagtgaaggagctgccatctgccggtctcgtgcactataacttctgtacgctcccaaaacgccaattcgcccctagttatgaatctcgcagacagaatcaagaccggatcaacaaaaccgtcctgtacggaacccctaggaagtgctttgtggggcaaagtaagcccaatcaccccctcctgcaggcaaagccacagtccgaaccagactacttggaagtacttgagaagcagacagctatttcccaactatag

SEQ ID NO: 59785 - DNA, 2538 bp, Artificial Sequence
  Description of Artificial Sequence: Synthetic coding sequence
atgctgtcaggtgtttggtttctgagtgttctcaccgtggccggaatcctgcaaaccgaaagcagaaagaccgctaaggacatttgtaagatccggtgcctctgcgaggaaaaagagaacgttttaaacattaactgcgagaacaagggctttactacagtgagcctccttcagcccccacagtatcggatctatcagctgttcctaaatggcaacctcctcacccggctctatccgaatgaattcgtgaactactctaacgcagttaccctgcacttgggaaataatggactccaggagatccggacgggagcgttcagtggcttgaagactctcaaaagactccatctgaacaacaataagctcgaaattcttcgagaggacacttttctgggattggagagtctggaataccttcaagcagactataattacatcagcgcaattgaggctggcgctttctcaaagcttaacaagctcaaggtgctgatcctcaacgataacttactgctgagtctgccatccaacgtgtttcgatttgtgcttctgacccaccttgatcttcggggaaatcgattaaaagtgatgcccttcgcaggggtattggagcatattgggggaattatggagattcagctggaggaaaatccctggaactgcacctgtgacttgttgcccctgaaggcttggctcgataccatcaccgtattcgtaggggaaatcgtctgtgagactccttttcggctgcatggcaaagatgtgacccagctcacacgacaagatctttgtcctagaaagagtgcatcagactctagccagcggggatctcatgctgacacacacgtgcaacgattatcccctactatgaatccagccctgaaccctaccagggcacccaaagccagtcgcccaccaaaaatgaggaataggccaaccccacgcgtgacagtcagcaaagatagacagagttttgggcctattatggtttaccagaccaaatctcccgtgccattaacctgccccagtagctgcgtgtgtaccagtcagtcaagtgataacgggctcaatgtaaattgtcaggagagaaagttcactaacatctcagacctgcagccaaagccaacctcaccaaaaaaattgtatctcaccggaaactacctgcagactgtgtacaagaatgacctgttggagtacagttcactggatctgttgcatctggggaacaacaggatcgctgtcatacaagagggtgcctttaccaacctcacaagtttaagacgtctgtaccttaacgggaactaccttgaggtgctctatccatcaatgttcgacgggttacaaagcctccagtatctttatctggaatacaacgtgattaaagaaatcaagcccttgaccttcgatgcccttatcaacctacaactactgttcttgaataataacctcctccgatctctccccgacaatatttttggcggtacagccttaactcgtctgaatcttagaaacaaccacttcagccacctgcccgtaaagggcgtgctcgaccaactccccgcattcattcaaattgacttgcaggagaatccctgggattgtacgtgcgacattatggggctgaaggactggactgaacatgccaatagcccggtgataattaacgaggtgacatgtgaatcccccgcaaagcatgccggtgagatactgaagtttctgggcagagaggccatttgtcctgacagtccaaatctgagtgacggaactgttctctcaatgaatcataatactgacacgccaaggtcactcagtgtctcacccagttcgtaccccgagctccatacagaggttccactgtcggtgctgatcctgggccttctggttgtcttcatcctgagcgtctgtttcggagctggactttttgtgtttgtgcttaaacgacgcaaaggggtgccctcagtacctagaaacacaaataatctggacgtgagctcctttcagctccagtacgggtcctacaatacagagacgcatgacaaaaccgacggccacgtgtacaattacatcccaccacccgtggggcagatgtgccagaatcctatctatatgcaaaaggagggcgatcctgtggcctactatcgcaatttgcaggaattctcgtactctaacctagaggaaaaaaaggaagaaccggctaccccggcttatacaatatccgccactgagctgctggagaagcaggcaaccccacgggagcctgagctcctgtaccagaacatcgcggaaagggtgaaggagcttccatctgccggactggttcattataacttctgtaccctacccaagcgacagtttgcaccatcttatgagagcaggagacaaaatcaagaccgaatcaataaaactgtactctatggcactcctcgtaagtgctttgtgggccaatcaaaacctaaccacccactgttacaagctaaaccccagtctgagcccgactatctagaggttctcgagaaacaaaccgctatcagtcagctgtag

SEQ ID NO: 59786 - DNA, 333 bp, Artificial Sequence
  Description of Artificial Sequence: Synthetic coding sequence
atggcgcgaggcaaccagcgggagctcgcaaggcagaagaacatgaagaagacccaagagattagtaagggaaagcgcaaagaggactcactgactgcttcacagaggaagcagagtagtggtgggcaaaaatcggaatcaaagatgtctgcagggcctcatctcccactcaaggccccacgcgagaacccctgctttccgctgcctgcagctgggggatcgcggtattacctcgcttacggctctatcacacctatatcagcattcgtctttgtcgtcttctttagtgtgttctttccctccttttacgaagacttttgctgctggatctag

SEQ ID NO: 59787 - DNA, 189 bp, Artificial Sequence
  Description of Artificial Sequence: Synthetic coding sequence
atggctcgcggtaaccagcgggaactggccagacagaaaaacatgaagaaaactcaggagatctctaagggcaaaagaaaggaggattccctgacagcgtcccagaggaaacagagagattctgagatcatgcaggagaagcagaaagctgctaatgaaaagaaatcaatgcaaactcgcgagaagtag

SEQ ID NO: 59788 - DNA, 915 bp, Artificial Sequence
  Description of Artificial Sequence: Synthetic coding sequence
atgagttccatcaagcacctggtgtacgctgtgatcaggttcttacgcgaacagagccaaatggatacctacacctctgatgaacaagaatctctggaggttgctatccagtgtctagagaccgtgtttaagatatcccctgaagacactcacctcgcagtctcccagcccctcaccgaaatgtttacgtcatcattctgcaagaatgacgtgctaccattgagtaactctgtgccagaagacgtgggaaaggcagaccagctgaaagatgaggggaataatcacatgaaggaagaaaattacgccgctgctgtggactgttatacgcaggcaatcgaactggatccaaacaacgccgtgtattactgtaatcgggctgcggctcaatccaaactggggcactatacagatgcaatcaaagactgtgaaaaggcaatcgcaattgactctaaatactccaaggcatatggcaggatgggattagcactcacggcgctcaataaattcgaagaggctgtgacatcttaccagaaagctctggacctggatcccgaaaacgattcttacaaaagcaacctcaagattgctgagcagaagctcagagaagttagctcccccacaggcaccggcctgtcattcgacatggcctcattgatcaacaatccagcattcatctcaatggcggcatctttgatgcagaaccctcaggttcaacagctgatgagtggcatgatgaccaacgcaattggaggccctgcagccggagttggtgggctgactgacctctcgtccttgatccaagctgggcagcagtttgcacagcagattcagcagcagaatccggagttgattgagcagctccgcaatcacatccgaagtcgaagtttctcatcaagcgccgaagagcattcttag

SEQ ID NO: 59789 - DNA, 588 bp, Artificial Sequence
  Description of Artificial Sequence: Synthetic coding sequence
atgtctagcatcaagcacttggtgtacgctgtgattcggttcctccgggaacagtctcaaatggacacatatacaagcgatgaacaggagtctctggaggttgccatacagtgcttagagacagtcttcaaaatcagcccagaagacacgcatctggccgtgagccaaccactgactgagatgttcacctcttccttctgcaagaatgacgtgttgcccctgtcaaactccgtgccggaggatgtgggtaaagctgaccagctgaaagatgaagggaacaaccacatgaaagaggaaaactacgcggcagcagtcgattgctatacacaggcaatcgagctggacccgaacaatgctgtgtactattgtaacagggccgcagctcaatccaagcttggccactatactgatgccattaaagactgtgagaaagccatagctatcgactcaaagtattccaaggcctacggtcgcatgggcttggccctgacagctctgaacaagttcgaggaagcggtaacatcctaccagaaagctctcgatctggatcctgagaacgattcatataaatcgaacttaaagatatag

SEQ ID NO: 59790 - DNA, 237 bp, Artificial Sequence
  Description of Artificial Sequence: Synthetic coding sequence
atgcagcctcaggaatcccacgtgcattattcgcgatgggaggacgggagtcgcgacggcgtgtccctcggagccgtgtcatcaactgaggaagcctccagatgccgcagaattagccagagactctgtactggaaagctgggcattgcgatgaaagtgctcggcggtgtggctctgttttggatcatctttattttgggttatctgaccggatactatgtccacaagtgcaaatag

SEQ ID NO: 59791 - DNA, 189 bp, Artificial Sequence
  Description of Artificial Sequence: Synthetic coding sequence
atggaccaactggtgttcaaggaaaccatatggaacgacgccttctggcagaacccctgggatcaggggggtctcgccgtgatcatcctgtttattactgcagtactcttgcttatcctctttgcaattgtctttggattgctgaccagcaccgagaatacgcagtgcgaggctggggaggaggagtag

SEQ ID NO: 59792 - DNA, 279 bp, Artificial Sequence
  Description of Artificial Sequence: Synthetic coding sequence
atggcgtactccggccagggacaaaaagtgcagaaagtcatggtgcagcctatcaacctcattttcagatacctgcagaatcgaagtcaaatccaggtttggctctacgagcaagtgaatatgcagatagaagggtgtatcattgggttcgatgagtacatgaatctcgtgctggatgacgccgaagaaatacatagtaagactaaatctcgaaaacagctcggaaggattatgctcaaaggggacaatattaccctgctccagagtgtcagcaattag

SEQ ID NO: 59793 - DNA, 297 bp, Artificial Sequence
  Description of Artificial Sequence: Synthetic coding sequence
atgcaagtcccccttacacctctttgggagttggggttggggcgagttgttgaaaatgccgatgcgcttgctatcgctattgtgcttaacaaccagtggtctctcgtgccgaatcggggaatactttacttcctgcccgtatccatgaagctcgggggtgaccgcgtgtcctgtcagttccttaccgccacctcacaccaatggctacattctgtgagcttaacacagcatatggctcaagaatgtctcccctccgtaagcgtcagcactgcagccatacctcgatgctggtcttag

SEQ ID NO: 59794 - DNA, 423 bp, Artificial Sequence
  Description of Artificial Sequence: Synthetic coding sequence
atgaggcgttgtctccgagtcaagacccgccgaggacagctggggctcgccagttcctgtttcgagcaacattcctgcttttcacccagagtgaatcgcatactgagtgctgtgcagaacacactctgcaccgggccttcctctcaggcaccaccgcaacccccacaggccagcccacctgcagccgcagatcacagcagaacaccgtcactcctcgcgtcatcacacagtgcttcagggggtgagtccttatttcaactgtacatcgcgagcctagcatggccccaaaattgttgtgttttggaatcgtgccgtcgaatccctctcggcggtctctcaagcatggagaatcgacgccctcttctccgcaagggacgtcttttgcggggacagatccatcactctcagaccaatgaactgtag

SEQ ID NO: 59795 - DNA, 2814 bp, Artificial Sequence
  Description of Artificial Sequence: Synthetic coding sequence
atgatctcggcccctgatgtcgttgcttttactaaggaagaggagtacgaggaagaaccctacaacgagccagctcttccagaggaatattccgtgccactatttccattcgcctcgcaaggagctaatccatggtccaagctgtcgggcgcaaaattcagcagggatttcattctcatctctgaattttccgagcaggtgggcccacaaccccttctgaccattcctaacgacacaaaagtgttcggcacttttgatctgaattatttctccctccgcatcatgtccgtggactaccaggctagttttgtgggacacccccctggaagcgcttatcccaagttaaattttgtagaggacagcaaggtggtgttgggagacagtaaggaaggcgcattcgcatatgtccatcatttaactctctacgacctggaggcaaggggatttgtgcgccctttttgcatggcttacatctcggcagaccaacataaaattatgcaacaattccaggaattatccgctgaattctccagggccagcgagtgcctgaaaactggtaaccgaaaggcctttgccggtgagcttgagaaaaagctgaaagacctcgattacacgcgaaccgtgctccacactgagactgaaattcagaaaaaggccaacgataagggtttctattcctcccaggcaatcgagaaggccaacgagctggcctcagttgagaagtcaattatcgagcaccaggacctcttaaagcaaattcgctcttaccctcaccgcaaactgaaaggacatgacctgtgtccgggtgaaatggagcatatccaggatcaagcctcccaagctagtactacatccaacccggatgaatccgccgatactgatctgtatacctgcaggcccgcttatacgcctaagttgatcaaagctaagtctaccaaatgttttgataaaaagttaaagaccctggaagagctttgtgataccgaatacttcacgcagaccctggcccaattgtcacatatcgaacacatgttccggggagatctgtgttacctgcttacttcccaaatcgaccgtgctctgcttaagcagcagcatatcaccaactttttgttcgaggactttgtggaggtagatgaccgcatggtcgagaagcaggaatcaatccctagcaagccttctcaggatagaccccctagctcttccctggaagagtgtcccatccctaaagtgcttatcagtgttggcagctacaagagcagcgtggagagcgtgttgatcaagatggagcaggagctcggcgatgaggaatacaaagaagtggaggttactgaactttcttccttcgatccccaagagaatctggattatcttgatatggacatgaaaggtagtatcagttctggagagagcatcgaagtactgggcactgaaaagtcaaccagtgtgctgtcaaagtctgacagtcaggccagtctgactgtgccattgagcccccaggtggttagatctaaggctgttagtcaccgaaccataagcgaggactccatcgaagtgctgtccacttgccctagcgaagccttgattcccgacgattttaaggccagctacccaagtgccataaatgaggaagaatcttacccagatgggaatgagggagccatccgattccaggcctctatttccccccctgaactgggagaaaccgaggaagggtcaattgagaacaccccatcccagatcgactccagctgctgcatcggtaaggagtctgatggacaattggtacttccttctacaccagcgcacactcattcagacgaggacggggtggtgtcaagtccgcctcagcgacatagacaaaaagaccaaggtttccgcgtcgactttagcgttgaaaatgccaatcccagctctagagacaactcctgcgagggattcccagcctatgagttggaccctagtcatctgctggctagccgggatatcagcaaaacctctcttgacaactactctgatacaaccagctacgtcagctctgtggcctcaacttcttccgacaggataccctctgcttaccctgcgggtctgtcctcagatcggcataagaaacgtgcaggacagaacgctctgaagtttattagacagtatccctttgctcaccctgcgatctacagtctcctgagtggccgaacccttgttgtgctgggggaggacgaagcaatagtgcgaaaattagtaaccgcgcttgctatttttgtgcccagctacgggtgctatgcgaagcctgttaagcactgggcgtcctccccactgcatattatggattttcagaaatggaaactcataggattgcagcgggtcgcctctccagccggagcaggtaccctccatgccctatcaagatactctcgctacacatccatcctggacctggataacaaaaccttgcggtgcccactctacaggggcaccctggtgcccagactcgcagaccatcgcactcagattaagagaggaagtacatactaccttcatgtccaatcaatgctgactcagctgtgctcaaaagctttcttatacaccttctgccaccacctccatctaccaacccacgataaggaaacagaagaactggtggcatctcgtcagatgtcctttctgaagctcacactcggcttggtgaacgaggacgtgcgggtggtccaatatctggccgagttattaaaactgcactacatgcaagagtctcctggcacgtcgcaccccatgcttcggtttgactatgtgccatcattcctgtacaaaatttag

SEQ ID NO: 59796 - DNA, 954 bp, Artificial Sequence
  Description of Artificial Sequence: Synthetic coding sequence
atgagaaaaacatcaaacagctgtattatggagaacgggcaccaaccaggcgcaggacctggagacggcccacccgagatcgcccagaatttttccgccccagaccctcctcggcctcgcccagtgtctctttccctgagactaccccaccagcccgtgactgccatcaccagagtcagtgaccgctttagtggggagacatcggcggctgcattatctccgatgtcggccgctaccttaggcggtcttaatccctcaccctcagaagttattaccccctggactcccagcccctcggaaaagaattcctcattcacttggtcagtcccgtcttccggctacggggctgtgacagcatctaaacactctaactcgccacctctggtcacacctcctcaaagtccagtgtctcctcagccaccagccatcacacaagtccatcggcagggggagaggagaagggaactggtacgctcccaaacattacccagaacctctgaagcccaggccagaaaagccctttttgagaagtgggaacaggagaccgcagccggtaaaggcaagggtgaggccagggcgcgtcttaagcggtcccagtcctttggggtcgcatcagcctccagtatcaagcagatcctactcgaatggtgtcgatccaagactctgggatatcagcatgtcgatttgcaaaacttctcctctagctggtccgacgggatggcattttgtgctctcgtgcacagctttttccctgatgctttcgattacaactctctcagccccacccagcgccagaagaactttgagttggctttcacaatggcagaaaacctggctaattgcgagaggctgattgaagttgaagatatgatggttatgggaagaaaaccagatcccatgtgcgtgttcacctacgtgcaatctctatacaaccaccttcgcaggttcgagtag

SEQ ID NO: 59797 - DNA, 1386 bp, Artificial Sequence
  Description of Artificial Sequence: Synthetic coding sequence
atggagccagctccagacgcccaggaagctcggacggtccgagaagccctgggacgctacgaagccgcactggagggagccgtgcgtgcactccatgaagacatgcgcggtctgcagcgcggagtcgaacgtcgggtcgcagaagcaatgaggcttgccggtcctctggctcgtaccgtcgcagatttgcagcgagataaccagcgactgcaggctcaactggaacgccttacacgccaagtcgaggccctgggcctagcttccggaatgtcaccagttcctggtactcctggaaccccaagtcctcctcccgcacccggtgtgcccgatagggccccacgtttgggaagtgcacggttcgcgtcccatgctactttttccttgagtggacgtggccaaagcctggatcatgatgaggcctctgaaagcgagatgaggaagaccagcaactcatgtattatggaaaacggtcatcagccgggagctggcccaggtgacggtcccccagaaattgcccaaaatttctcagcccctgacccacctagaccacgacccgtctctctctcccttaggctccctcaccagccagttaccgcaatcacaagagtatcagaccggttctccggcgagacatccgccgctgctctgtcccccatgtctgctgcgaccttgggagggttaaacccgagccccagcgaggtgatcacaccatggacaccttccccatccgaaaagaactcaagttttacatggtctgtgccttctagcgggtacggcgctgtgactgccagcaaacacagcaacagccctcccctcgtaacaccacctcaatctcctgtctctccccaaccgcctgctataactcaggtgcacagacagggcgagcggcgtagggaactcgtgaggagccagactctccccagaacatccgaggctcaggcgcgaaaagccctattcgagaagtgggagcaggaaacagccgcaggaaaagggaaaggagaggctcgtgcaaggctaaaaaggtctcagtcatttggggttgcttctgcatctagcattaagcagattctgcttgagtggtgtcggagcaagacgctcgggtaccagcacgtggatctacagaatttctctagttcttggtccgacggtatggctttctgcgccctggtccattcttttttccctgatgcgtttgactataatagtctgagccctactcagcggcagaaaaactttgaactagcattcaccatggccgaaaacttggctaactgtgagcgtctgatcgaggttgaagatatgatggtgatgggtcgtaaacccgaccctatgtgcgtgtttacctacgtccagagcctatataaccacctccggcgattcgagtag

SEQ ID NO: 59798 - DNA, 216 bp, Artificial Sequence
  Description of Artificial Sequence: Synthetic coding sequence
atggccgatgaaaaaccgaaggaaggtgttaagaccgaaaacaatgatcacataaacctgaaagtggccggacaggacggaagcgtcgtccagtttaagatcaagcggcataccccacttagtaaactgatgaaagcttactgcgaacgacagctggagatggaagacgaggacactatcgacgtgttccagcagcagaccggtggggtgtattag

SEQ ID NO: 59799 - DNA, 288 bp, Artificial Sequence
  Description of Artificial Sequence: Synthetic coding sequence
atggcggacgagaaacccaaagagggcgtgaagaccgaaaacaatgaccacatcaacctcaaggtcgcgggacaggacgggagtgtggtgcagtttaagattaagcggcatacaccactttccaaactgatgaaagcctactgcgagagacaaggtttatcgatgagacagatcagattccggtttgacggccagcctattaacgagacagatacacctgcccagttggagatggaggatgaggatacaattgatgtctttcagcagcagactggcggtgtgtactag

SEQ ID NO: 59800 - DNA, 1257 bp, Artificial Sequence
  Description of Artificial Sequence: Synthetic coding sequence
atggccgctagcatgtgtgacgtattcagcttttgtgtgggcgtggccggaagggctagggtgagtgtcgaagttcggtttgtgtcaagcgcgaagggcaagggcctttttgctacacagctcattagaaagggagaaacgatcttcgtggagcgacccctcgtcgctgcccaattcctctggaatgcgctatacagatatcgtgcatgtgaccactgcctgcgcgcactggaaaaggctgaggagaacgcccagagactcacaggtaagcccggtcaagtcttaccccatccagaactgtgtacagtgagaaaggatctgcaccagaattgcccccactgtcaggtaatgtactgttctgcggagtgtcgtctggcagccaccgaacaataccaccaggtgttgtgccctgggccatctcaggatgatcccctccaccccttaaacaaattgcaggaagcgtggcgaagtatccactatccccctgagaccgcatcaatcatgctgatggctagaatggttgctactgtcaagcaggctaaggacaaagacagatggattcggttatttagtcagttctgtaataaaaccgcaaatgaggaggaagaaattgtgcataagctcctgggggataaatttaagggccaacttgaattgctcagacgactgttcaccgaagccctgtacgaggaggctgtcagtcagtggttcacacccgacggcttcaggtccctgtttgcactcgtcggtaccaatggccaggggatcggtacttcaagtctttctcagtgggtccatgcctgcgatacattagagctgaaaccccaagaccgagaacagctggatgcttttatagaccagctgtacaaggacattgaagccgcaacaggcgagttcctcaactgtgagggaagcggactattcgtgctgcagagctgctgcaaccacagctgcgttcccaacgcagagacatccttcccagagaacaattttcttctccacgtgacggccctagaggacattaagcccggagaagaaatctgcataagctatctcgactgctgtcagcgagagagaagcagacattccaggcacaagattctgagggaaaattacctattcgtgtgttcttgtcctaagtgtctggccgaggccgacgagccaaacgttaccagtgaggaagaggaggaggaagaagaggaggaagaaggagaacccgaagacgcagagctgggtgacgaaatgacagacgtgtag

SEQ ID NO: 59801 - DNA, 285 bp, Artificial Sequence
  Description of Artificial Sequence: Synthetic coding sequence
atggagcaggcgagggatcacttacacctccgttggacaacagaacagcacatgcccgaggtggaagtccaagttaaatacaggaccgcagcactctccaatcaagagtgccaactgtatctccgccactcacagcaacagcaggtgttggtggtggactttcaagctaagctgcgtcaggttttcattactgaaactcctaggtgtggtaaaaagccatattggaacaacgaggaggccgaatcgaaacagaatcccggatccatctactgcctgctgttgtag

SEQ ID NO: 59802 - DNA, 1128 bp, Artificial Sequence
  Description of Artificial Sequence: Synthetic coding sequence
atggcaggtttcaatatgggcggagatctccgggagcccgctgcttcaatcccacccggatctctggccgctgtgggaattagttggttcctgtacattatcttcgtgtttttgttaggcgcaatatgcacgcgggaggctctccggtacgacttcctgattgcagagaaggtctctctgatggggtttttgtttctgcttggtctgtatatcagcagcctcgcttcatgcatgggcggactctacggtgcccctcgcattctccagtgcatcgcccaagaaaaagtgatccccgctctggcctgcctgggccagggtaagggaccgaacaagacccccgtagctgcaatctgcctcaccagtctggtaactatggctttcgtgtttgtcggccaggtaaacgtcctggctcccattgtgaccattaacttcatgctgacgtatgtcgcagtggactactcatacttcagtctgtccatgtgcagttgtagcctgacacccgtcccagaacctgtattgagggaaggggcagaggggctgcattgcagtgaacacttgctcctggagaaggcccctagttatggatctgaaggccctgcccagcgagttcttgagggcactcttctggagttcactaaggacatggaccagctgctccagctgacacgaaagttagaatcatcacagcctcgtcagggggagggcaaccgaactcccgaatctcagaagcggaagtccaaaaaggccaccaaacagaccctacaagactccttcctgctcgatttaaaaagtcccccaagtttcccagtcgaaataagcgataggttgcctgcggcttcctgggagggacaggaaagctgctggaacaaacagacttccaagtctgaagggacacaacctgagggtacgtatggggagcagctagtgccagaactgtgtaatcagagcgagagctccggggagggcgatttgaggagcccccaagaacagattatactggcaccaagtctggcaaaagtggacatggaaatgacacagctgactcaggaaaatgccgatttcgccacccgagataggtaccatcactcaagcttagtgaatcgtgagcagttgatgccacactactag

SEQ ID NO: 59803 - DNA, 2232 bp, Artificial Sequence
  Description of Artificial Sequence: Synthetic coding sequence
atgctgccgctcgaacggactattacgtacagagacatgagctcatttattcaggtgaagaaccactttaacgttgtgaacgtcacctgcgttagctatagatctacatgctttcgtgatatgaggcgcttcatccttgacgccctcgcccagccacaaccgtggtggaaaactcaacttttcatgtgggagccagtcttgtttgggacctgggacggggtgttcaccagctgcatgatcaacatattcggagtagtgttgttcctcaggaccggctggctagtgggaaacacgggagttcttctgggaatgttcctcgtctctttcgttattctggtggcgctggtgacagtgctcagtggcattggggtcggtgaaagaagttccatcggctccggaggagtgtatagcatgatttcctctgtgctgggtggacagacaggcggaaccatcggcctgctctacgtgtttggccagtgcgtggccggtgccatgtatattacaggatttgccgaaagcatttccgacctgcttggcttaggaaacatctgggctgttcgaggaatttctgttgccgttcttctcgccctcttaggaattaacctagccggagtgaagtggattatcaggctgcaattgctgctcctgtttctcctggctgtgtccacactcgattttgtggtcgggagctttacccacctagatcccgaacatggctttatcgggtattcgcccgagttattacagaacaacactttaccagattatagccctggggagagcttctttacggttttcggggtattctttccggctgcgacaggtgttatggcaggcttcaacatgggtggagatttgcgagagccggctgcgtctattcctcctgggagcttggcagcagtgggtatctcttggtttctttacatcatatttgtttttttgctgggggcaatctgcactagagaggctctcaggtacgactttttaatcgccgagaaagtgagcctgatggggttcctctttcttctagggctgtatattagcagtctcgcctcatgtatgggagggctgtacggcgctcctagaatccttcagtgcatcgcacaggagaaggtcatcccggcattggcctgcttgggccagggtaaaggaccaaacaaaactcccgtagcagccatctgcctgacatcactggtgacaatggcgtttgtgtttgttgggcaagtaaacgtgctcgctccaatagtgactatcaattttatgctcacctacgtcgctgtggattactcatatttttctcttagcatgtgtagctgctcacttaccccagtgccagagcccgtccttagagaaggcgctgaagggctgcactgctctgaacacctgctgctggagaaggctccctcttacggctcagaagggcctgcgcagcgggtgctcgagggtaccctgctggagttcacgaaggacatggatcagcttctgcagctgaccaggaagttggaaagcagccaacccaggcagggtgagggcaatcgtacccctgagagtcagaaaagaaagagcaaaaaggccactaagcaaaccctgcaggactcgttcctgcttgacctgaaatcccccccatcatttcctgtggaaatttccgacagactgcccgcagcttcctgggaaggccaggagagctgttggaacaagcagacctccaagagcgaagggacacagcccgagggtacttacggcgagcagttagtgcccgaactgtgcaaccaatctgaatcctctggcgaggacttctttctgaaatcacgcctgcaggagcaggatgtttggcgacggtctacatcattctacactcatatgtgtaatccctgggtctcattgctgggcgctgtgggttctctgctgattatgtttgtgatccagtgggtgtatacactggtgaacatgggcgtggcagccattgtgtatttttacattggcagggccagtccgggtcttcacctgggctctgcgtccaacttctctttcttcaggtggatgagatcccttctgcttccatcgtgtaggagcctcaggagccctcaggagcagattatcctggcccctagtttggccaaagtagatatggaaatgactcagttaacacaggaaaatgcagacttcgcaacacgtgataggtatcaccattctagtctggtgaaccgggagcagttgatgccgcactactag

SEQ ID NO: 59804 - DNA, 1548 bp, Artificial Sequence
  Description of Artificial Sequence: Synthetic coding sequence
atgcggagggctgccgcagggggactcgctgtaggacagctccccggtgagggaccggcaggagaagagggtgctgcattaggcaaggcgatgagggggggaggatgtagtcctcacagcccgagtggctgtttatctggtgttatggccggattcaatatgggaggcgatctgcgtgagcccgcagcctccattccgccaggtagccttgccgctgtagggatctcctggttcctctacatcatttttgtgttcctcctcggcgctatatgcactcgcgaggcactaaggtacgactttcttatagccgagaaggtaagcctcatgggatttctgtttcttctcgggctgtatatttccagtttggcaagttgcatgggcggtctctacggagcccctcggatcttgcagtgtatagcccaagaaaaagttattccagctctagcctgcctggggcagggaaaagggccaaacaaaaccccagtagccgctatctgcctgacctccctcgtcacaatggcctttgtattcgtgggtcaggtcaacgtgttagccccaatcgtgaccatcaattttatgctgacatacgtggccgtggattatagttacttcagcctttccatgtgctcatgttcgctgactcccgtgccagaacccgtgctccgagagggggcagagggattacattgttccgaacacctgctgttagagaaagccccatcttacggaagcgaaggacccgctcagcgcgtgcttgagggcacactgttagagtttaccaaagacatggatcagctcctgcaactaactaggaaattggagagcagtcagccccgtcaaggcgagggaaatcgaactcctgagagtcagaagcggaagtcgaagaaggctaccaaacagacgctgcaggattcatttctcctggacctcaagagccccccatcttttccggttgaaattagcgaccgcttacccgcagcctcatgggaaggccaagaaagctgctggaataaacagacatccaaatcagaaggcacccaacctgaaggtacatacggagagcagcttgtgcccgagctttgtaaccagtctgagtcgtccggggaagatttcttcctaaaatcgcgcttgcaagagcaggatgtctggcgcaggtcgacgagcttctacacacatatgtgcaacccatgggtttccctgttaggcgctgtcggtagcctcctgattatgttcgtgattcagtgggtgtacacccttgttaatatgggcgtggcagctatagtatatttttacattgggcgtgccagtcctggactccacctggggtcagccagtaatttctctttttttaggtggatgaggtcactcctgctgccttcttgtaggtcactcaggtccccccaggagcagattatccttgctccctcactggccaaagtggatatggagatgactcaacttacccaagagaacgcggactttgctacaagagatcgctatcaccattcgtcattggttaatcgagagcaactgatgccacactattag

SEQ ID NO: 59805 - DNA, 723 bp, Artificial Sequence
  Description of Artificial Sequence: Synthetic coding sequence
atgcagacaacatacgtcctgcagtctctgcaccttaggattcctgaaatcagcaatatcaccaccacccctcataccttgcctgctgcttggctgacaatgttcgatgccgttctcattttgctacttattccactgaaggataagctggtcgacccaattctgcggcgacacggtttactcccatcctctttgaaaagaattgctgtcggtatgtttttcgtcatgtgcagtgcttttgctgctggaattctcgaaagcaaacgattgaatctcgtcaaggaaaaaacaatcaatcagactattggcaacgtcgtttatcacgccgctgatctaagcctttggtggcaggttcctcagtatctccttataggaatctcggagattttcgcctcaatcgccggtttggaattcgcctactccgctgcacctaaaagcatgcaatctgccattatggggctctttttctttttttcgggggttggctccttcgttggaagtggcttattggctctggtgagcataaaagccataggatggatgagctcacataccgactttgggaatatcaacggctgttacctcaattattacttcttcttacttgccgcaatacagggcgctacgctgctgctgtttttaataatctcggtaaagtatgatcaccacagggaccatcaacgttcgcgggctaacggcgtacccacctctaggcgcgcatag

SEQ ID NO: 59806 - DNA, 1572 bp, Artificial Sequence
  Description of Artificial Sequence: Synthetic coding sequence
atgactcagaacaagctgaagctctgctctaaggccaatgtctacaccgaagttccggatggcggatggggctgggccgttgctgtcagtttcttttttgtagaagtgtttacatacggcattattaaaaccttcggggtgtttttcaatgacctcatggactcttttaatgaatccaattcacgaatttcctggatcatctcgatttgcgtgtttgtactgactttttcggcccctctggctacagtgctgagtaaccgtttcgggcaccggctggtcgtcatgttgggcggattgcttgtttccaccggaatggtggccgcatcgttttcacaggaggtttctcatatgtacgttgcaattgggatcatatctggactggggtactgtttctcatttctgcccacagtgactatcctgtcacagtactttggcaaaagaagatccatagtgacagcagtggctagcacaggcgagtgtttcgcagtgtttgcattcgcccctgctataatggcattgaaggaacgcattggctggaggtattccctcctgtttgtaggactgctccagctcaacattgtgattttcggagctctgctgagacctattttcatccgtggtcctgctagccctaaaatagtcatccaggaaaatagaaaagaggcccagtatatgctggagaacgaaaaaacacgcacatccatcgactctatcgactcaggtgtagaactgactacatcgccgaaaaatgtccccacacatactaacctggagctggagccaaaggctgacatgcagcaggtgctcgttaagacctcacccagaccgtctgaaaagaaggctcccctcctggactttagtattctcaaggagaagtccttcatatgctacgctctgttcggcttgtttgccacgctgggcttcttcgctccatctttgtacatcatcccactcgggatttctctcggcattgaccaggacagggccgctttccttctgagcacgatggcaattgcagaagtattcggcaggattggggcaggctttgtcctgaaccgagagcccataagaaagatctacattgagctgatatgcgtgatcttgctgacagtgagcctcttcgcctttacctttgccaccgagttctggggtcttatgagctgcagtatcttcttcggcttcatggtcgggacaattggcggaactcacataccactgctagcagaggacgacgtagtaggcatcgaaaagatgtcctctgcagcaggagtctatatttttattcagagtatagctggccttgccggacctcccctggcaggtctgttggtggaccagtccaaaatctatagccgcgctttctacagctgtgcagcagggatggccctggccgcagtttgcctcgcactggtcaggccttgcaaaatgggcctgtgccaacaccaccattccggagaaactaaagttgtgagtcatcgcggaaagacgctgcaggatatccccgaggactttctggagatggatctggctaaaaacgaacacagagtgcatgtccaaatggaaccagtatag

SEQ ID NO: 59807 - DNA, 453 bp, Artificial Sequence
  Description of Artificial Sequence: Synthetic coding sequence
atgaggtgtgcggagggcgcatggtggttttctccagacggccctgccggatccgcagcgtcaatctggcctgccgagggcgctgaggggctccccggtcagcttggtcgggacagacttgaagtggtgtatagtgtgccagacaacgtgccaggccagaacggctcccgccgacccctcgtatgcaaaatcaccggtaaatgcctctcagtatgttcagaggagaatgcgaaggcgggaggctgcagtgcctttcctttgttgttgagccagcttggggctcgcatgaccggcagagaacatgctcacaaaggccctgaactcactacacctgattccgggctgccacgcccaccaaaccctgccctcgctggatttcgggctctggcgcagcactcccctcctctcgggacctcaacgccaagtgccgtactgttgagtgccgctacatag

SEQ ID NO: 59808 - DNA, 453 bp, Artificial Sequence
  Description of Artificial Sequence: Synthetic coding sequence
atgcgatgcgcggaaggagcatggtggttttctcctgatgggccagcagggagtgccgcttcgatctggcccgcagaaggcgctgaaggactacccggacagctggggagggaccggctagaggtagtatatagtgtgccggataacgtgcctggtcagaacgggtccagaagacccctggtgtgtaagatcaccggcaaatgcctatccgtttgtagtgaggagaatgcgaaagccggagggtgctcagccttcccactcttgttaagccagctcggtgctcgaatgaccgggagggaacatgcacacaaaggccctgaactgacaacccctgatagtggactgcccaggcctcctaacccagcccttgccggttttcgcgctttggctcagcattctccaccactgggtactagtacgccaagcgcggttctcttgagcgccgcaacctag

SEQ ID NO: 59809 - DNA, 762 bp, Artificial Sequence
  Description of Artificial Sequence: Synthetic coding sequence
atgggcgaacttcccggtagcgaaggaatgtgggagaactgcccgctcggctgggtgaaaaagaaggccagcgggacgctggccccactggactttctgctgcagcgcaagaggctgtggttgtgggcttctgagccagttcggccacagccgcagggcatccataggtttcgggaggctagaaggcaattctgccgcatgagaggcagtagattaactggcggtagaaagggctttggatcctccgggctgcggttcggcagaggcggattctctgaggaggttatgcctcagccagtgctgaaggccatgcgctgtgccgaaggcgcatggtggttctcccctgatgggcctgcaggatccgctgcgtcaatctggccagcagagggagcggaaggtctccccggacagctgggcagagatcggctggaagtggtgtacagcgttcccgataacgtgccaggacagaatggtagtagaaggccactggtttgcaaaatcacggggaaatgcctttcggtctgctcggaggaaaatgctaaggcaggaggatgttctgctttccccctgctactgtcccagctgggagcccgaatgacaggtagggaacacgcccataaaggacccgaactgacgacccccgactcaggcctgcccagaccacccaatccggcactggcaggctttcgcgctctggcccagcatagccctcccctaggcacatctacaccctccgctgtcttgttgtctgcagccacatag

SEQ ID NO: 59810 - DNA, 825 bp, Artificial Sequence
  Description of Artificial Sequence: Synthetic coding sequence
atggatcggcctggttttgtcgccgcactggtcgcgggtggagtcgccggagtgtctgtcgacttgattctgttcccgctggatactatcaagacacgcctgcaatccccccagggcttctctaaggcgggtggattccatgggatttacgcaggcgtgcctagtgcagccattggatccttcccaaatgccgcagcgttcttcatcacttacgaatatgtcaaatggtttctgcacgctgactcttcctcatatctcaccccgatgaaacacatgctggccgcaagcgcaggggaagtggtggcatgcctcataagagtaccctctgaagttgtgaaacaaagagcgcaagtgtcagcatctaccagaacgttccagatcttcagcaatattctatatgaggagggtatccagggcctgtaccggggttacaagagtaccgtactgagggaaattccattcagcctggtacagtttcctctttgggagagtctgaaggccctatggtcttggcggcaggatcatgtggtagactcttggcagagcgctgtgtgtggagctttcgcgggtgggttcgccgcagccgtcacaaccccactcgatgtggccaaaactaggattacactagctaaggccggatcttccacagctgatgggaacgtgctgtccgtgttgcatggggtctggcgctcccaagggctggccggactgtttgcaggcgtgttcccccgtatggctgccatcagcctggggggttttattttcttgggggcttacgataggacgcacagtttgctactggaggtgggcaggaaatcaccctag

SEQ ID NO: 59811 - DNA, 927 bp, Artificial Sequence
  Description of Artificial Sequence: Synthetic coding sequence
ctgctcgtcgcactgctgggcggtggactgcccgcaggtttcgtgggccctctgagtcggatggcttaccaagcatctaatctaccttccctggaactcgtgatttgcaggtgcctctttcatctgccaatcgccctactgctgaaactcaggggagatccactgttaggacctcccgatattagaggcaggacctgcttctgcgccttgcttaatgtgctcaatataggctgtgcctacagcgccgtccaggtggtccccaccggaaacgcagctactgtgcgcaaacacagcagcaccgtgtgctccgccattctaactctttgcctggagagccaggtcctcagcggctacgattggtgcggcctgctaggctctattctgggcctcataatcattgtcgggccaggcctgtggacgctgcaggaggggaccaccggcgtttatacaggtctgggatatgtacaggcctttctcggcggactcgccctgtctctgggtcttctcgtttatcggtctttacattttccatcatgtcttcccactgttgcctttctttccggcctcgttggcctgctgggctcagtgccgggactgtttgtactgcagtcccctgtcctccctagcgatttactgagttggagttgtgtgggagcagtgggcatccttaccttggtgtcttttacatgtgtagggtacgcagtcaccaaagcacacccagctctagtctgcgctgtgctccacagcgaagtcgtcatggcgttgattctgcaatactttatgttgcacgagaccgttgctcctagtgacatcatgggtgcaggcgttgtgttgggatcgatagcaatcattaccgcaaggaatcttatttgtgagaggacggggaaggttgaggagcagagactgaaaacgaaaaaaaaaaagtag

SEQ ID NO: 59812 - DNA, 1017 bp, Artificial Sequence
  Description of Artificial Sequence: Synthetic coding sequence
atggctgggagccacccctacctcaaccctccagattccacgcatccatcccccccatcagcacccccatcattaaggtggcatcagtgctgccagccttctgatgctaccaatggactcctggtggcattgcttggaggcggactgccggcagggtttgtcggccctctgtcccacatggcctaccaggctagcaacctgccatccctcgaattgcttatttgccgatgcctgtttcatctgcccattgcgttactgcttaagctgcggggtgatcccctcctgggtcccccagatatcagaggcagggcctatttctatgccctccttaacgtcctgagcatcggatgcgcctacagtgccgtccaggtggtgcccgctgggaatgcggctacggtgagaaaaggttcgagtactgtgtgttccgccgtgctaactctctgcctcgagtcacagggcctgtctgggtacgattggtgcggcctgctgggatctatactgggactgattattattgttggcccaggcctgtggaccctccaggaggggatcactggagtttataccgccttgggatacggccaggctttcgtaggaggccttgccctcagcctcggcctcctcgtgtatcgaagcctccattttccctcctgtttgcctacagtggccttcctgtctggtttggtcggtctcttgggctctgtgcccggtctgttcgttctgcagcccccagtgctcccctccgacttgccctcttggtcttgtgtgggcgctgttggtatactcgccctggtctcatttacgtgtgtctcttatgcagttaccaaagctcatcctgctctggtttgcgcggtgctgcactccgaagtggtggttgctctgatcttacaatattatatgctgcacgaaaccgtcgcccctagtgacatcgtaggtgccggagtggtcttggggagtatagctattatcaccgcatggaatttaagttgcgagcgggaaggcaaagtcgaagagtag

SEQ ID NO: 59813 - DNA, 1308 bp, Artificial Sequence
  Description of Artificial Sequence: Synthetic coding sequence
atggaggggcagacaccaggctcacgcggtctccctgagaagccccatccagccactgccgcagccaccctctcctccatgggcgctgtgttcatactgatgaagagtgccctgggagccggacttctcaatttcccgtgggctttttccaaagccggaggcgtggtgcctgcattcttggtggagctggtctcactggtattcctgatttccggactcgtgatcttgggttacgccgctgccgtttccggccaggccacctaccagggggttgtccggggactttgtgggcctgcaataggtaaattgtgcgaagcttgtttcttgctcaacttgttaatgatttccgtagcattcctgagggtcatcggcgatcagctggagaaactctgtgacagtctcctgtccggcactcctccagctccacagccatggtacgcagatcaacgcttcacactaccacttctcagcgttttggtgatactcccgctgtcagcccctcgggaaattgcctttcagaagtacaccagcatcctggggaccctggccgcatgttacctggctctggtcatcacggtacaatactatttgtggccacagggccttgtgcgggagtcacatccgtctctctcccctgcttcttggacctccgtgttcagtgtgtttcctactatttgtttcggcttccagtgccacgaggcagctgtctctatctattgctctatgcgcaagcggtcccttagtcactgggcacttgtgagtgtattgtctctactcgcttgctgcctgatttacagcctgaccggagtgtacggttttctgaccttcggaaccgaggtgagtgcggatgtgctgatgtcctatcctggtaatgacatggtgatcatcgttgcgagagttttatttgcagtgagtatcgtcaccgtctaccccatcgtgttatttctgggcaggagcgtgatgcaggacttctggagaagatcgtgtttgggcggttggggtccttcagcacttgccgaccctagcggcctctgggtccgaatgccactgaccatcctctgggtgacagtgaccttggcaatggcgctattcatgcccgatctctctgagatagtgtcaatcatcggtggaattagttcctttttcatcttcatcttccctggactgtgtctgatctgtgctatgggtgtcgagcctattggccctagggttaaatgttgtctcgaagtgtggggagtagtctctgtgcttgtcgggacgttcatattcggccagagtaccgcagcagctgtctgggagatgttttag

SEQ ID NO: 59814 - DNA, 2397 bp, Artificial Sequence
  Description of Artificial Sequence: Synthetic coding sequence
atgggtaaggcctctcccgcaagcgggctgagtcgtcccaaaaccctggtgtctcctctccggagcaaccagtggtctctgcagaagggattacccgagcagtattactcactgacctggttcttatccccaatccttggcctgatattcactcccttaatagggtccgcaagcgacaggtgcaccctttcttgggggaggagaagacctttcatcctggcgctctgcgtcggtgtgctctttggagtagccttgttccttaacggatccgccatcggtctggccctcggagacgtaccaaaccggcagcctataggcattgtcctgactgtgctgggggtagtggtccttgatttcagtgctgatgccacggaaggcccaatacgggcttacttgcttgacgttgtggactccgaagagcaagacatggctcttaacattcacgccttcagtgcgggattgggcggagctataggttatgtgcttggtggacttgactggacacagacgttcctcggctcctggttcagaacacagaaccaggttctgtttttctttgctgctatcatattcaccgtgtcagtagcccttcacttgttcagcattgatgaggagcaatattctccccagcaagagcggtccgctgaagaaccaggcgctttggacggcggtgagccgcacggagtgcctgcatttcccgacgaggtgcagtccgaacacgaacttgctcttgactacccagacgtggatatcatgcgttccaagtctgattccgcgctgcacgtgccagataccgcactggatctagagcccgaacttttatttttgcacgatatcgagccttccatcttccatgacgcatcctaccccgctaccccgagaagcacgagccaggagcttgcgaagaccaagctgcctcgtttagccactttccttaaagaggccgcaaaggaggatgagaccctgctcgacaatcatttaaacgaggcgaaagtgcccaacgggagcgggagccccactaaagatgcccttggagggtacactcgcgttgacacaaaacccagcgcaacgtcgagttcaatgagaaggcggaggcacgcttttaggaggcaagcctctagcactttctcgtactacggcaagctggggagccactgttaccggtacaggcgcgcaaatgctgtggtgctcattaaacctagtcgctcaatgtctgacctgtacgacatgcaaaagcggcagaggcagcacagacaccggaatcagagtggggcaacaacctctagcggggatactgaatcggaagaaggagagggagagactactgtgagactgctctggctctctatgctgaaaatgccgcgtgaactgatgcgactgtgcctctgccacctgctgacttggttctctgtgatcgctgaagcagtgttttatacagatttcatgggccaagtgatttttgaaggtgatccaaaagcaccttctaatagcacagcttggcaagcttacaacgccggagtaaagatgggatgttgggggctggtcatctacgccgcaacaggggcaatctgcagcgcactcctccaaaaatatctggataattacgacctgagcgtccgcgtgatttacgtgcttgggaccctcgggttttcagtcgggacagccgttatggcaatgttccctaatgtgtatgtagccatggtcactatatctacgatgggcatagtaagcatgagcatatcgtattgcccatacgccctattagggcaatatcacgatattaagcagtatatccaccacagtcctggtaatagcaaacgcggtttcggcatagattgcgccatcctgtcttgccaagtatacattagccaaatactggtagcgagcgctcttggcggtgtcgtggacgctgtcggaacggtgcgcgtgataccaatggtggcatccgtgggatcatttctaggatttctcactgccacctttctagtgatctaccccaacgtttcagaggaggctaaggaggaacagaaggggctgtccagccctctggctggagaagggagggctggcggtaacagcgagaagccaacagtgctgaaactaactagaaaggagggcttgcagggccctgtggagactgagcgccttcaggtcctcacgtctgtgcgcagcaggcacataggctggtgcagatcatgttggcgcgttttctttttcatgataattttggagaaaaagttcagcttccctcagtgcgggtctctgcgcaggatgacgtacctcctgtttttatcggaactcgatacgttgtgtcccggtcagccatgcccatgggccgcaacggcacaccagtcatgggaggaagccggacctggcggactcggacggagacaatag

SEQ ID NO: 59815 - DNA, 2253 bp, Artificial Sequence
  Description of Artificial Sequence: Synthetic coding sequence
atgtttgggagggaattttgctatgccatggaaacagcgcttgtgacacctatcttgctgcagattgggctgcccgagcagtattatagcctcacctggtttctttcccccatactcggcctaatttttactcccctgatcggcagtgcctcagataggtgtaccctgagctgggggagacgcagaccctttattcttgctctctgtgtgggtgtcctgtttggggtggccctgttccttaacggctccgccatcgggctggcgctgggcgacgtccccaatcggcagcccatcggtattgtgctgaccgttctgggagtggtggtgcttgactttagtgccgacgcaaccgagggccctattagagcgtatctgttggatgtggtcgattctgaagagcaggatatggccctgaacatccatgcattctccgccggattgggtggtgctataggctacgtgcttggaggactcgactggactcagacctttttgggcagttggttccggacgcaaaatcaggtcctctttttctttgccgcaatcatatttactgtctctgtggccttgcacttgttcagcattgatgaagagcagtattcgccacagcaggagcggtccgcagaggaacccggtgcactggatggcggtgaaccacacggggtgcctgcatttccagacgaagttcagtccgagcatgagctggctctggattatcccgacgttgatatcatgcggagcaagtcggattcagccctccatgttcccgacaccgcacttgacctggaacccgagttgttgtttctgcatgacatcgagcctagcatctttcacgatgcctcgtatccagcaaccccacggagcacaagtcaggaattagccaagacgaagctgccaaggcttgccacatttctgaaagaagcagctaaagaggacgagactctactggacaaccacctgaatgaagctaaagtgcccaacggctcaggctcaccaactaaagacgccctgggaggatatactagggtcgacactaaaccgagcgctacctcttcgtccatgaggagacgccgtcatgccttccgacgacaagcttcatcaactttcagttattatggtaagctgggatcccactgttacaggtacaggagagcaaacgctgtcgtgcttatcaagcccagcagaagcatgtccgacttgtacgacatgcagaaacgacagagacaacatcgtcacaggaatcagtccggagccaccacaagttccggcgacacagaaagcgaggagggggagggagagacaacggtcaggcttctgtggttgagcatgttaaaaatgccgagagaactcatgagattgtgtctttgccacctgctaacatggtttagtgtgatagcggaagcagtgttctacaccgactttatgggacaggttatcttcgagggcgaccccaaggcgccatcaaatagcacggcctggcaggcttataatgctggagtcaaaatgggctgctggggcctggtgatctatgcggcaactggtgccatctgctccgcgctgctgcagaagtacttggataattacgacctctcagtgcgggttatttacgtgctggggacattagggttctccgtcgggactgccgtaatggcgatgtttcccaatgtgtacgttgccatggttaccatttcaacgatgggaatagttagcatgtctatctcttattgtccatatgctctgcttggccagtatcacgacattaagcagtatattcatcattcaccagggaactccaaaagaggatttggtattgattgcgccatcctaagctgccaggtttatatctcacagatactggtcgcttctgccctcgggggagtagtcgacgcagtcgggaccgtgcgggtgatacccatggtagcatcagtagggagctttctcggattcttaaccgccaccttcttagttatctatccgaatgtaagcgaagaggccaaggaggagcaaaagggtctgagtagtcctctcgccggtgaagggagagcaggaggcaattctgaaaaacccaccgtgctaaagctgacacgcaaggagggactgcaaggcccagtcgagaccgaaagcgtgacccctgctggcatcgatgtatgccagattagctctcactggttggtgccacagctgttagagagtattttcctctacgactattttcgaaaaaaaatatttttttccacaatgtggttttcatag

SEQ ID NO: 59816 - DNA, 2427 bp, Artificial Sequence
  Description of Artificial Sequence: Synthetic coding sequence
atgaaaatggcgccacaaaatgctgacccagagtccatgcaggtgcaggagctgagcgtcccactgcccgatccgcagaaagccggaggtgcggaggccgagaattgtgaaaccataagcgagggctccattgatagaatccctatgcggctgtgggtcatgcatggtgccgtcatgttcggtcgagagttctgctatgccatggagactgcgcttgtaacccccatcttactccaaattggactgcctgagcagtactacagcttgacatggttcctgagtccaatcctgggactcatttttacccctctgatcggcagtgcttctgaccgctgtactctgtcatgggggagacgcagaccattcattctggcactgtgcgttggagttctgtttggagtggccctgttcctgaacggatctgctatcggccttgcacttggcgatgtgccaaaccggcagccgatcggtattgtgctgactgtgttgggagtagtggtcctggatttcagcgctgacgccactgagggccctattcgggcttacctcttggacgtggtggactcggaggaacaggatatggcccttaatattcacgcattctccgcgggactcgggggtgccatcgggtacgtcctcggcggtttagattggactcagaccttcctggggagctggttccgtacgcaaaatcaggttttgttctttttcgccgcaatcatttttacagtgagtgttgccctccacctgttttccattgacgaggaacaatactctcctcagcaggaaaggtcagctgaggaacctggtgccctggatggaggcgagcctcatggcgtgcctgccttccccgatgaagtccagagcgaacacgaactagctttagactaccccgacgtcgacattatgaggtctaaaagcgattcagctctgcatgtgccagatacagctctagatctggaacctgaactgctgtttctgcacgacattgaaccgagcatcttccatgacgcttcctaccccgcaaccccccgttccacatcacaggagttggccaaaacaaaattgccccgtctggctacttttttgaaagaagcagctaaagaggacgaaaccctgctcgacaaccaccttaacgaggccaaggtccctaacggaagcggatccccgacaaaggacgcgcttggtggctataccagggtcgataccaaacccagcgcaacaagctcaagcatgcggaggcggaggcacgctttccgtcgtcaagcttcctctactttctcttattatggaaagttaggtagccattgctatcgctacaggagagccaatgcagtcgtccttattaagccaagtaggtccatgagcgacttgtacgatatgcagaagcggcagcgacagcaccgacaccgcaatcagagtggggcaactacttccagcggcgataccgaatcagaggagggagagggggaaaccacggtaaggttactctggttatcaatgttaaaaatgccacgtgagctgatgaggctgtgcctgtgccacctgttgacctggttctccgtaattgccgaggctgtcttctataccgactttatgggccaagttatattcgaaggcgaccccaaggcgccatcaaacagtactgcgtggcaagcgtacaatgcaggcgttaaaatggggtgttggggattggtcatttatgccgctaccggtgccatttgttcggcgctactccaaaagtatctcgataactatgacttatctgtgcgagttatctatgtgctgggcaccctcggctttagcgttggaaccgcagttatggctatgttccctaacgtttacgtcgcaatggttaccataagtactatggggatcgtatcaatgagtataagctattgcccctacgccctgctgggccagtaccacgatatcaaacagtacatccatcatagcccaggaaactcaaagagggggttcggaattgactgtgcaatcttatcatgtcaggtatacatcagccagatcctcgtcgcaagtgcacttggcggagtcgtggatgcggttggcaccgtgagagtgatcccgatggtagccagtgtggggtcattcttgggcttccttaccgccacattcctagtgatttatccaaacgtgtctgaggaagccaaagaggagcagaaaggattatcaagccctcttgcaggtgaaggacgcgcaggcggaaattcagagaagcctacggtgctcaagctgacccgcaaggagggtctgcagggacctgtcgagacggagagcgtcacgcccgctggcatagacgtatgccagatctcgagtcattggcttgttccccagctcctagaaagtatctttctgtatgattacttcaggaagaagattttcttctccacaatgtggtttagttag

SEQ ID NO: 59817 - DNA, 2154 bp, Artificial Sequence
  Description of Artificial Sequence: Synthetic coding sequence
atgggtaaggcatcaccagcgtccggactgtcaaggcccaaaaccctggtgtcccctctgagatcaaaccagtggagcctacagaagggcctaccagaacagtattacagtctgacatggttcttatcgccgatcctcgggctaatctttactccattgattggctccgcctctgacagatgcactttgtcttggggacgccgaagacccttcatcttggccttatgcgtaggcgttcttttcggcgtggccctgtttctgaatggcagtgccataggactggcactaggggacgttcccaataggcagcctattggaattgtgctgaccgtattgggagtagtcgttcttgatttctccgcagacgccacagagggaccaattcgggcatatcttttagatgtggtcgattcagaagagcaggatatggctctaaatatccacgccttctccgcaggcttgggcggtgcaatcggttacgtgctgggcggtctggactggactcagacatttttaggatcctggttcagaacacagaatcaagtgctgttcttttttgccgcaattatttttaccgtctccgtggccctgcatctgttcagcattgatgaggagcagtactccccgcaacaggaaagatccgcggaggagccgggtgcactggatgggggagaacctcatggagttcccgcatttcccgacgaagtccagtcagagcacgaactggcactggactaccccgatgtggatatcatgcgatctaagtccgactcagctttacacgtaccggatactgctctggacctggagcccgagctcttatttctgcatgatatcgaaccgagtatctttcatgacgccagttacccagcgaccccacgtagcaccagtcaggagctggccaagactaaactccccagattggctaccttcttaaaagaggccgctaaggaggatgagaccctgctagacaatcatctcaacgaggccaaggttcccaacggcagcgggagcccaacgaaggacgccctcggaggatatacacgcgtggatacaaagccctctgccaccagttccagtatgcgacgtaggaggcacgcgtttaggagacaagcttcatcaacgttcagctactatggcaaattagggtcgcactgctatcgatatcggagagctaatgctgtggtacttataaagccttcacgttccatgtcagatctgtacgatatgcagaaaagacagcggcagcataggcaccgtaaccagtccggggctactacgtcttccggggatacggaaagcgaagagggcgagggcgaaaccacagtgaggctgctttggctatcaatgctgaagatgccacgggagctgatgagactatgcctatgtcacctccttacctggttttccgttatagccgaagctgttttttatacggacttcatgggacaggtaatcttcgagggggacccaaaggcaccctccaacagcacagcctggcaggcctacaatgctggcgtaaaaatgggatgttgggggctcgtgatctatgcggctacaggggcaatctgcagcgcacttcttcagaagtacctggataactacgatttgagcgtccgcgtgatttacgtcctcggcacccttgggttttcagtcgggactgcggtgatggcgatgtttccaaatgtgtacgtggccatggtaactatttccactatgggcattgttagcatgagcattagttactgtccttatgctttactgggtcaataccacgatatcaaacagtacattcatcatagtccaggcaactccaaaagaggattcggtatcgactgtgccattttgtcctgtcaggtgtacatctcgcagattctggtggcatcagccttgggaggcgtagtggatgctgttgggacagtcagggtcatccccatggtggctagcgtcgggtcttttctaggatttttgaccgcgaccttccttgtcatctatccgaatgtgagtgaagaagctaaggaggagcagaaaggactctcctctcccctagcaggagaagggagagctggcggtaacagtgaaaagccaacagtgttaaagctgacaaggaaagagggcttgcaaggacctgtggagactgagtccgtagtttag

SEQ ID NO: 59818 - DNA, 1338 bp, Artificial Sequence
  Description of Artificial Sequence: Synthetic coding sequence
atggctgcccctacacctgccaggccagttctgacccacctgttagtggctctgttcggtatgggcagctgggccgctgttaatggcatttgggtcgaattgcccgtggtcgtaaaagagcttcctgagggctggtcactgccctcgtacgtgagcgtacttgttgcccttgggaaccttggcctgctcgtcgttacactgtggagacgccttgccccaggaaaggatgaacaggtcccaatacgcgtggtgcaggtcttgggaatggtgggcaccgccctcctggcgtccctttggcaccacgtagccccagtggctgggcagctccactcagtcgcttttctagccctggcctttgtgctggcgctcgcctgctgtgctagtaatgtgaccttccttcccttcctgtcccacctgccacctcgctttctgcgttcattctttcttgggcaggggctgagtgccctgcttccatgcgtgttggctctggtgcagggcgtaggcagactggagtgtcctccagcacccattaacggaacaccaggaccccctctggactttcttgaacgatttccagcctctactttcttctgggccctgacggccctcctggtggcttccgctgcagctttccaagggttgttgctcctgttgcctcctcctccctcggtgcccactggcgaactggggagtgggcttcaagtcggggcaccgggagctgaggaagaagtagaggaatcatctcctctccaggagcctcccagccaagctgcagggacaacaccgggacctgaccctaaggcataccaattactcagcgctaggtctgcctgcctactgggactgctggcagcgactaacgcactcaccaacggcgtactgccagcagtccagtcattcagctgtcttccttatggcaggctggcatatcatctggccgtagttcttgggtcagcagctaaccccctggcgtgcttcctggcaatgggcgtgctttgtcgctctctggcaggcctcggcggtctttctctattgggcgtgttttgcggcggttacctgatggctctggcggtcctcagcccttgtccccctctcgtgggcacttccgctggggttgtcctggtagtgttaagctgggttttatgtctcggtgtcttttcgtacgttaaagtggccgcaagttccctcctgcacggcggagggagacctgcccttctggctgctggcgtcgcgatccaggtgggaagcctgctgggcgcagtggctatgttccctcccacctctatttatcacgttttccatagtagaaaggattgtgcggacccttgtgactcctag

SEQ ID NO: 59819 - DNA, 1338 bp, Artificial Sequence
  Description of Artificial Sequence: Synthetic coding sequence
atggctgcgccaaccccggcaagacccgtgctgacacatttgcttgtcgcacttttcgggatggggtcgtgggccgcagtcaacggaatttgggtggagctgccagtcgtcgtgaaagagctccccgagggatggtcactgccgtcttatgttagcgtgttagtggcacttgggaacctgggacttctggtggtgacattgtggaggcgcttggctcccggaaaggatgagcaggtgcctattagggtggtgcaggtcttgggaatggtaggtaccgcgctcctagcctctctctggcaccatgtggcgccagttgctgggcagctccactcagtagccttcctggcactggctttcgtgcttgcattggcctgctgcgccagtaacgttacattcctgccgtttttgtctcacctcccacctaggtttcttagaagcttcttcctgggtcaaggactttctgccctccttccttgtgttctggccctggtgcagggcgtgggacgcttagagtgtcctccagcacctattaatggaaccccaggccctcctctcgattttcttgagcggtttccagcatcgactttcttctgggccctcacggcattgctggtcgcatctgcagccgctttccagggcctgttactgcttctgccccctcccccttcagtgcctaccggcgagttgggatcgggcctgcaggtgggggctccgggtgctgaagaggaagtggaagagtcaagcccacttcaggaacctcctagtcaagctgctggcactacgcctggccctgatccaaaggcatatcagctactcagtgccaggtcagcttgccttcttggtctccttgccgctactaatgcacttaccaacggggtcctgcccgcagtgcagagctttagctgcttgccgtatgggcgtctcgcttaccacttggctgtggtgctggggagtgccgcaaatcccctggcatgttttctggccatgggtgtcctgtgcagaagccttgccggattagggggactgtctctgctcggcgtgttctgcgggggatacctgatggccctggccgtcttgtccccctgtccgccattagttggtacatcggctggggttgtgttggtcgttctttcctgggttctctgcctcggagtgttctcctacgtgaaagtggcagccagctctcttctgcacggcggtgggaggcccgctctactagcagctggggtagcaattcaggtaggtagcctgctgggggctgttgccatgtttccgccaacctccatttaccacgtgtttcattccagaaaagattgcgccgacccttgcgattcatag

SEQ ID NO: 59820 - DNA, 1338 bp, Artificial Sequence
  Description of Artificial Sequence: Synthetic coding sequence
atggctgcacccacaccggctcgaccggtcctgacccacttactagtggccctctttggcatggggtcctgggcagctgtcaatggaatctgggtggagctgccagtggtggtaaaggaattgcccgaggggtggtctctcccaagttacgtttcagtcctggttgcactggggaatctgggcttgctggtggttactctgtggcgccgactggccccaggaaaagatgagcaggtcccaattcgggtggtgcaggtactgggaatggtcgggacggccttgctggctagtctgtggcaccatgtggctccagtggccggacagctccactccgttgcctttctggccttggcgtttgtgctcgccttggcttgttgcgcctctaacgtgacctttctgcccttcctgtcacacctgccaccacgctttctgcggagttttttcctggggcagggcctcagcgcgctactgccgtgcgtgctcgctttggtgcaaggggtaggccgacttgagtgccctcccgcacccatcaatgggacgcctgggcctcccctggatttcctggaacgtttcccagcctccacattcttttgggcgcttaccgcgcttcttgttgcttccgcggctgcctttcaggggctcttgctgctgcttccaccgccaccatccgtccctaccggcgagttgggcagcggtctgcaggtcggcgctccaggggctgaggaggaagtggaggagagctcaccactccaggaaccgcctagccaggcggcagggaccacgccgggacctgatccaaaggcttatcagttgctcagtgcaagaagtgcttgtttgttgggcctcctcgccgcaaccaatgctctgactaacggtgtgcttcccgctgttcagtccttctcctgtctcccttacggaaggctcgcgtaccacctggcagtggtgttggggagtgccgcaaatccactggcctgttttctagccatgggagtgctctgccgatccttggccggactgggaggcctgtccctcctcggggttttctgtggtgggtacttgatggctctggctgttttgagcccatgcccaccactggtgggcaccagtgccggtgttgtcttggtggttttatcctgggtgctttgtcttggagtgttctcatatgtcaaggttgcagcttctagcttgctgcacgggggtggcaggccagccctcctggccgcaggcgtcgcgattcaggtcggctccctactgggggctgtggctatgttcccccctacctccatctatcacgtgtttcacagccgcaaggactgcgccgatccttgcgactcttag

SEQ ID NO: 59821 - DNA, 1923 bp, Artificial Sequence
  Description of Artificial Sequence: Synthetic coding sequence
atgaagatttccacaacacaaatcgagcgtaggttcgagatcagtagttccctcgtaggactgatcgacggatcattcgagatcggcaatctgtttgtcatcgtctttgtcagctatttcggtagtaaactccacagacccaaactcattggcattggttgcttcctgatgggcacaggaagcatcctcatggcgctaccccacttttttatgggttattacagatattctaaggagacaaatatcgatccttcagaaaactcaacttccaatcttccaaactgcttgatcaatcaaatgctctccctcaacaggacaccctcagaaatcatcgaaaggggctgcgttaaggaatcaggaagccacatgtggatctatgtgttcatggggaatatgctcaggggaatcggagagacccccatcgtgccgttgggcatctcctatatagacgatttcgcgaaggaggggcattcttccttatacctgggcaccgtaaacgtcatgggcatgaccgggttggtttttgccttcatgcttggctccctttttgcaaagatgtatgtggatatcggctatgtggacttgagcaccatcaggattaccccgaaagactcgcggtgggttggcgcatggtggctaggattcctagtgtccggaatcgtgtccattatttcatccatcccctttttctttttgcctctgaacccgaacaagccacagaaggaaaggaaagtgtctttgtttctgcatgtactaaagactaacgacaaacgcaaccagatcgctaatttgactaacagacgaaaatacatcacaaagaacgttactggatttttccagtcgctaaaaagcatcttgacaaatccactctatgtgatctttgtgatatttaccctgttgcacatgtcttcctatatcgcttccctgacatatatcatcaagatggtggagcagcagtacggctggtccgccagcaaaaccaacttcctgttgggagtcctggccttgcctgcagtggccatagggatgttttccggcggttatattataaaaaagtttaagctgtctctcgtcggtcttgcaaaactggctttctgctccgccactgtgcacctgctgtcccaggtactctatttctttctgatttgtgagagtaaaagtgtggctggactgaccttaacctacgatggcaacagtcccgttagaagtcacgttgacgttccgctatcctactgcaactcagaatgtaactgcgatgaaagccagtgggagccagtctgtggaaacaatggcatcacttacctgagcccgtgcttggccggttgcaaatcctcatccggtaacaaagagcccatagtgttttacaactgctcgtgcgtcgaggtgattggtctccagaacaagaactatagcgcacatctgggtgagtgtcctcgcgatgacgcatgcacccgtaaatcctatgtgtatttcgtgatacaggtcctagacgcttttctgtgcgctgttggtctgacctcttactctgtgctggtgataaggatcgtccagcctgagctcaaagctttggctattggctttcatagtatgattatgcgcagtctcggaggaatccttgtaccaatttactttggcgctcttatcgacacaacatgcatgaaatggagcactaatagttgcggtgctcgcggagcttgtcgtatatacaacagtacatatcttggcagggcctttttcgggctgaaagttgcactgatttttccagttctcgtgctgctgaccgtgtttattttcgtggtaaggaagaaaagccatggaaaagacactaaagtgttggagaatgagagacaagtgatggatgaagccaaccttgagtttcttaatgactcggaacacttcgttccctcagctgaggagcaatag

SEQ ID NO: 59822 - DNA, 2064 bp, Artificial Sequence
  Description of Artificial Sequence: Synthetic coding sequence
atggaccagcaccagcatttgaacaaaactgcagagtcagctagcagtgagaagaagaagacaagaaggtgcaatggcttcaagatgttcctggcagccctatcattcagttacatagccaaggccctgggcggaattatcatgaagataagcattacccaaattgagcgacgctttgacatttcatcttccctggccggtctcattgacgggagcttcgaaatcgggaacctcctcgtgatagtattcgtctcttacttcggatctaagctacatagaccaaaattgattggaatcgggtgtctgctgatgggaaccggctccatattaacaagtctgcctcacttcttcatgggatattataggtactctaaggagactaacatcgacccttctgagaatagtacgtccaacttgccgaactgcttaatcaatcagatgctctccctgaacagaacccccagcgagataatagagcgaggatgtgtgaaggaatctggatcccatatgtggatctacgtcttcatgggtaacatgctccgcggtatcggtgaaacacccattgttccacttggcatttcttacatagatgattttgctaaagagggacacagctcgctgtatctaggtactgtgaatgtgatggggatgaccggtctggtgttcgcatttatgcttggctcgttgtttgctaaaatgtacgtcgacatcgggtacgtggatctttctacaatccggatcactcccaaagactctcgctgggtcggagcgtggtggttagggttcctggttagtggcatcgtgagtatcatctctagcattccattcttcttcctcccactgaatccaaataagccgcaaaaagaaaggaaggtgtccttgtttcttcacgtactgaaaacgaatgataaacggaaccaaattgctaatcttactaaccgcaggaaatatatcacgaagaatgtgacaggatttttccaatctctgaagagtatcctcaccaatccgctgtatgttatctttgtgatattcacactcctccacatgtcttcttacattgccagcctgacttatattatcaagatggtggaacagcaatatgggtggagcgcctctaaaaccaacttcttactgggagtattggcgctgcctgctgtcgcaatagggatgtttagcggaggctatatcattaaaaaatttaaattgtctctggtggggctcgcaaaactcgctttctgttccgccacagtgcatttgctaagccaggttctgtacttcttcttgatatgcgagagcaaatctgtggccggactgacgctgacctacgatgggaactcgcccgttcggagccatgttgacgtcccgttgagctactgcaattcagaatgtaactgtgacgagtcacagtgggaacccgtgtgcgggaataacgggatcacgtatctctctccgtgtctggccggttgcaagtctagcagcggcaataaagagcccattgtgttctacaactgcagctgcgtggaagtcatagggctgcagaacaagaactacagcgcacacttaggagagtgtccacgcgacgacgcttgtactcggaagtcatacgtgtatttcgttatccaagtcctggatgcctttctctgcgcggtgggtctcaccagttactcagtgctcgtcattaggatcgtgcaacctgagttgaaagccctggcaatcggcttccattcaatgattatgaggagcttgggaggcattttggtaccgatctacttcggtgccctgattgacactacatgcatgaaatggtcgaccaacagttgcggcgcacggggagcttgtcgcatctataatagcacctacctggggcgtgcattttttggtttaaaggtcgcccttatcttcccggtgctcgtattactgacggtgttcatctttgttgtgcgaaagaagtcccacgggaaggacaccaaagtgctggagaacgagagacaggtaatggacgaagctaacctggaattcctcaatgactcagagcattttgtccccagtgctgaggaacagtag

SEQ ID NO: 59823 - DNA, 813 bp, Artificial Sequence
  Description of Artificial Sequence: Synthetic coding sequence
atggggttttggtgcaggatgtctgagaaccaggagcaggaagaagtaatcaccgtgagagtccaagatccacgcgtgcaaaacgagggatcttggaatagctacgtagactacaaaatctttctccataccaatagtaaagctttcacagccaaaaccagctgtgtgagacgcagatatagggaatttgtgtggctgaggaaacagctgcagagaaacgctgggctcgtcccggtaccagaactccccggaaagtcaacatttttcgggacgtccgatgaatttattgagaaacggaggcaagggctgcaacattttttagagaaagtcttacagtcagtcgtgctgctctcagattctcagctgcatctgtttcttcaaagtcagctgtcagtccccgagatcgaagcatgtgtgcaggggcgttctaccatgaccgtgtcagacgcaatcctaagatacgccatgtctaattgtggatgggcccaagaggaaagacagtcaagctcccatctcgcgaaaggtgaccaacctaaaagttgctgcttcctccccaggagcggcaggagatccagcccttcacccccaccaagcgaggagaaggatcatctcgaggtgtgggcgcctgtagtggattcagaggtgccaagtctggaatcaccgacattgcccccactatccagtcctctctgttgcgatttcgggcgtccaaaggaaggaacttctacgctccaaagcgtgaggcgggctgtcgggggtgaccacgccgtgcccctcgacccgggacagcttgagaccgtcttagaaaagtag

SEQ ID NO: 59824 - DNA, 813 bp, Artificial Sequence
  Description of Artificial Sequence: Synthetic coding sequence
atgggcttctggtgcagaatgtctgagaatcaggagcaggaggaagtaattacggttagggtccaggacccgcgagtgcagaacgaaggcagctggaactcctacgtggactataagatctttttgcacacaaatagcaaagcattcactgccaagacctcctgcgtgagacgtcgctaccgggagtttgtgtggctccgcaaacagcttcagcggaatgccggtctcgtgcccgtgccagaactacctggtaaatctacattctttgggacaagcgacgagttcatcgagaagcggagacaagggcttcagcacttcctagagaaagtcctacagtctgtcgtattgctttcagactcgcaactgcatctcttcctgcagtctcagctgtccgtgcccgagatagaggcctgcgtacagggtcggtcaaccatgaccgtgtcagatgcaattctccgatatgctatgagcaactgcggctgggctcaggaggaaagacagagcagcagccacttagccaaaggagaccaacccaagtcctgttgttttctgcccagatcaggacgtcgctccagcccctctccgccacccagtgaggagaaggatcacctggaggtctgggcacctgtggtggattccgaagtgccgtcccttgaaagccccacacttcctcctctatcatcccccctctgttgcgattttggtcgcccaaaggagggaaccagtaccctccagtccgttagacgcgctgtggggggtgaccatgctgtgcccctcgaccctggccagctggagacagtattggagaaatag

SEQ ID NO: 59825 - DNA, 630 bp, Artificial Sequence
  Description of Artificial Sequence: Synthetic coding sequence
atgcgcgctcctggtactctgatgtggattattaggtacagcagtatgcccgtgccagagctgcctggaaaaagtactttctttggaacttcagatgaatttatcgagaagcgtcgacaaggcctccagcacttcctggaaaaagtcctgcagtcagtagtccttctttccgactcgcagttgcacctgtttctgcagtcacaactgtccgtgcccgagatcgaagcttgtgtccaagggaggtccaccatgacagtgtctgatgcgatcctcaggtacgctatgtccaattgcggctgggctcaggaggaacgccagtcttcaagccatttggctaagggcgaccagcctaagtcgtgttgtttcctgccaaggtctgggaggcgctcatccccctctccaccaccatcggaggagaaggaccatctggaggtttgggctcccgtggtggatagcgaggtcccctctctcgaatcgcctacacttccaccactaagcagtcccctgtgttgtgacttcggtcgaccaaaagaaggtacctctaccctccagagtgttcgacgagcagtcggcggagaccacgccgtaccgttagatccagggcagctcgagactgtgctggagaaatag

SEQ ID NO: 59826 - DNA, 381 bp, Artificial Sequence
  Description of Artificial Sequence: Synthetic coding sequence
atgaccgtgagcgacgccatattgaggtacgctatgtcgaattgcggttgggcccaggaggaaagacagagctcaagccatcttgctaaaggggatcaacccaagtcatgctgtttcctccctagaagtggacggaggtcaagtccatccccgccaccctcagaggagaaggaccacctggaagtctgggcaccggtcgtggattctgaggttcctagcctcgagtctccaaccctgccccctctcagttcccccctctgctgcgatttcggaagacccaaagaaggcacaagcactctacagagcgttagaagagcggtcgggggagaccatgccgtccctctggatccaggccagctggaaacagtcttggaaaaatag

SEQ ID NO: 59827 - DNA, 477 bp, Artificial Sequence
  Description of Artificial Sequence: Synthetic coding sequence
atgtctgacaccgctgtggctgacaccaggcgactgaattctaagccgcaggatctgaccgacgcctatgggccaccctctaactttctggagatcgacatatttaacccccaaacggttggagtcggaagagctcgctttacgacatacgagacgaacctgcccatctttaagcttaaggagagctgcgtgcggagacggtattcagattttgaatggttaaagaatgagcttgaacgcgactccaagattgtcgttcctccactcccaggaaaggctctgaagcggcagttaccatttagaggggacgaggggatcttcgaggagtctttcatagaagagagaaggcagggacttgagcaattcatcaacaagattgccggacatcctctggcccaaaatgagagatgcctgcatatgttcctccaagaggaagcaatcgatagaaactacgtgccaggaaaggtgagacaatag

SEQ ID NO: 59828 - DNA, 489 bp, Artificial Sequence
  Description of Artificial Sequence: Synthetic coding sequence
atgtcagacacagccgtcgcggatacccgtaggttgaactcaaagcctcaggatctgacggacgcctatggaccacctagcaacttcctagagattgacatttttaatccacagaccgttggcgttggcagggctaggtttactacttacgaggtgcggatgcgtactaacctcccgatattcaaactgaaggagagctgcgtgaggcggaggtatagcgattttgaatggctaaaaaatgaactagagcgggactccaaaattgttgtgcctccactgcctggcaaagcactgaagagacagctgcccttccgaggggatgaaggtatcttcgaggagagtttcatcgaagagagacgccagggattagaacagtttattaacaaaattgccggacatccacttgcccaaaacgagagatgtctccatatgttcttgcaggaggaggcaattgacagaaattacgttccagggaaggtcaggcaatag

SEQ ID NO: 59829 - DNA, 3327 bp, Artificial Sequence
  Description of Artificial Sequence: Synthetic coding sequence
atgtcttccgtaaaacggccacggggtagaccacctagttccaaaaaatctgacggttccggtacttacaccaaactacagaacactcaggttcgggttatgtccgaaaaaaagcaacgaaaaaaagtggaaagcgagagcaagcaagagaaggctaatcgaatcatctctgaggccatagctaaggcaaaagagcgcggtgaacgcaatatccctcgagttatgtcacctgagaacttccctacagcatccgtggagggtaaggaggaaaagaagggcaggaggatgaagagcaaaccaaaggataaagatagcaaaaaaaccaaaacgtgttctaagctgaaagaaaaaacgaaaataggtaagttaattataacactggggaaaaagcagaaacggaaaaacgaaagctctgatgagatcagcgacgctgaacaaatgcctcagcatacgctgaaagaccaggactcccagaagcggcgttctaatagacagattaaaaggaagaagtacgccgaggatattgaaggtaaacagtccgaggaggaagtgaagggctctatgaaaatcaaaaagaatagtgcccctctgcctggtgaacaacccctgcaactgttcgttgagaatccatcagaagaggacgccgctattgttgacaaaattttgtccagccggacagtcaagaaagaaatcagtccgggtgtcatgatcgataccgaagagtttttcgtcaaatacaaaaattacagctaccttcattgtgagtgggcaacggaggagcaattgctcaaagataaacggattcagcaaaaaattaagcgtttcaagcttagacaggcacagagggcccacttcttcgcggatatggaggaggagcctttcaacccagactatgttgaagtggatcgagtgcttgaggtaagtttctgcgaggacaaagataccggcgagcccgtgatttattatctagtaaagtggtgttccttgccgtacgaggattccacttgggagctgaaagaagatgtagaccttgcgaagatcgaagagtttgagcagctgcaggccagccgtccggatactcgcaggctggacagaccacccagcaacatctggaagaaaattgaccaaagtagagactataaaaatggaaatcaactgcgtgagtatcagctcgaggggttgaactggctgttgtttaactggtacaatagaagaaattgcattctcgcggatgaaatggggcttggtaaaaccattcagagcatcacatttctgtacgaaatcctgctgaccgggatcaggggcccattcctaattatagcccctctgagcacgatcgctaattgggagcgcgaatttcggacatggactgacattaacgtagtggtttatcacggcagtctgatctctaggcaaatgatccagcagtatgagatgtacttccgggattcccaaggcagaatcattcggggagcttatcgctttcaggctattattaccacgttcgagatgatcctgggtggctgtggggaactgaatgccatagagtggaggtgcgtgataattgacgaagctcatcgactgaagaataagaattgtaaactcctcgagggactgaagctaatgaacttagagcacaaggtgctactaaccggaacaccattacagaatacggttgaggagctctttagccttctgcactttttggagcccttgaggttcccaagcgaatctacattcatgcaggaattcggagacctgaagacagaggaacaagtccagaaattgcaagctatccttaagccgatgatgctgcgccgattaaaagaggatgtagagaagaagctggcacctaaagaggagaccatcatcgaggtggaattaaccaatattcagaagaaatactaccgggctatcctggaaaagaatttttcttttctctcgaaaggggctggccagacaaatgtgcccaacctcgtaaacaccatgatggagctacgtaagtgttgtaaccatccctatctgattaagggcgctgaagaaaaaatcctgggagagtttcgagacacctacaaccccgctgcctccgactttcatctgcaggcgatgatccagtccgccggaaaactggtgttaattgacaaactgctgcctaaaatgaaggccggaggacataaggtgctgatcttctcccagatggtcagatgcctggacattctggaagactatcttattcacaaacgctatctgtatgaacgaatagacggcagggtaagagggaacctgcggcaagctgcgatagacagattttcaaaaccagatagcgatagattcgtgttcttgctttgtaccagagccggaggcctgggcattaatctaaccgctgctgacacctgtatcatcttcgacagcgattggaacccgcagaatgatttgcaggctcaggccaggtgccacaggatcgggcagaacaaggcagtaaaggtctatcgcctcgttacaagaaacagctacgagcgcgagatgtttgaccgcgcaagtttgaaactgggactggataaggcggtgctgcagtcaatgagcggcagggaaagcaatgtgggcggtatccagcagctcagtaaaaaggaaatcgaggatctgctccgtcggggtgcctacggggcaattatggaggaagaagatgaagggagtaagttctgtgaggaagatattgaccagatactgcttcgcagaaccaagactattaccattgagtcagaagggcgaggctcaacctttgcaaaggccagtttcgtcgcctcaggcaataggacagatataagcttggatgacccgaacttttggcagaaatgggcaaagaaagccgaaatagatatagaggccatttctggccgtaatagcttagtgatagacacgccgagaatcagaaaacaaacccggccattctcggcaaccaaggatgagcttgccgagctgtcagaagctgaaagcgaaggtgatgagaaacctaaactgaggcggccttgtgataggagcaatggttacgggaggaccgaatgctttagagtggagaaaaatttgttggtgtacggctgggggaggtggagggaaattctgtcacacgggagatttaaacgacagctaaatgagcacgacgttgaaattatctgtagggccttattagcttattgcttggtgcattataggggtgatgaaaaaatcaagggctttatctgggatttaattaccccaactgaagatggccagactagagagctgcagaatcatctagggctaagcgccccagtgccacgaggtcgttag

SEQ ID NO: 59830 - DNA, 1128 bp, Artificial Sequence
  Description of Artificial Sequence: Synthetic coding sequence
atgtcaggatcccagaacaacgataagagacagttcttgttggagagattactcgacgccgtcaaacagtgccagattcgcttcgggggtcgcaaggagatcgcctccgacagtgactctcgcgtcacgtgcctgtgtgcacagtttgaagccgtgttacagcatggcttaaaacgatctagggggctcgccctgacggccgcagccattaagcaggcagctggatttgcctcaaagactgagaccgaaccggttttctggtactacgtcaaggaagtgctgaacaagcacgaactgcagcgattctattctctgagacatattgctagcgacgtggggcgtgggagagcatggctgaggtgcgcactcaatgaacattccctggaaaggtaccttcacatgttactggctgatcggtgccggctctccacattctatgaggattggagcttcgtaatggacgaggagcggtcttccatgctgcccacaatggccgcaggcctgaacagcattctttttgctatcaatattgataataaagacctgaatgggcaaagcaaatttgctccaactgtgagcgacctgttgaaggaatcaacgcagaacgttacgagtcttcttaaggaaagtacccagggcgtgtcttcactttttcgggagataactgcaagttcggctgtgtctatcttaatcaagcctgagcaggaaaccgaccctctaccagtggtgagccgtaatgtatcagccgatgccaagtgtaaaaaagagcgaaaaaagaaaaagaaagtaaccaacatcattagctttgatgatgaagaagacgaacagaactccggcgacgtgttcaagaagacgcccggagccggtgagagttcagaggataactctgaccgtagttccgtgaatattatgtccgcattcgaatctcctttcggcccaaatagtaacggctcacagtcttcaaatagctggaagattgacagcttgagcctgaatggcgagtttggataccagaagctggatgtgaagtccatcgatgatgaggatgttgatgaaaacgaggacgacgtctatggcaactcctctggcagaaagcatagggggcacagtgaatctccagagaaatag

SEQ ID NO: 59831 - DNA, 1287 bp, Artificial Sequence
  Description of Artificial Sequence: Synthetic coding sequence
atgcactcatgggcgccactgaaggtgcttcataatgacagcgatatactgttcccggtaagcggcgtcgggagctatagtcccgctgacgcaccgctgggaagtctcgagaatggtacagggccagaggaccacgtgctgccagaccccggactgcggtacagtgttgaggccagcagtcccggacacggaagcccactgtccagtctgctgccttctgccagtgtgcccgaaagcatgacgatttccgagctccgacaggctacagtggccatgatgaacagaaaggacgaattagaggaggagaatagatcactgcgaaatctgttggacggtgagatggagcactccgccgcactacgccaggaggtggatacacttaaacgcaaggtggcggaacaggaagagcgtcagggaatgaaggtgcaggcactggccagggaaaatgaggtgcttaaggtccaattgaagaaatatgtgggagctgtccagatgcttaagcgcgagggccaaacagctgaggtgccgaacctttggtctgtggatggggaggtgacggtggccgaacaaaagcccggagagatagctgaagagctggcttcttcatacgagagaaaactcatagaggtcgctgaaatgcacggcgaactgatcgaattcaacgaaaggctccatagagccctggtcgcgaaagaagccctggtttcacagatgcgccaggagcttattgacctgcggggacccgtccctggtgacctcagccaaaccagtgaggatcagtccctgagcgattttgaaatcagcaacagagctttaattaatgtctggattccgtcagttttcctgaggggaaaagccgctaacgcatttcatgtctaccaggtgtacattaggatcaaggatgacgagtggaacatctacaggcgatacacggagttccgcagtctgcatcacaaactgcagaataaataccctcaggtgagagcttataactttccaccaaaaaaggccatagggaacaaagacgccaagttcgttgaagagcgcaggaagcagctccagaactacctgagatcggtaatgaataaggtgattcaaatggtccccgagttcgctgcatcaccaaaaaaagagacccttattcagttaatgccattttttgtagacatcacgccgccaggggagccagtgaattcacgccctaaggctgcctcgcggtttcctaaactgtctagaggccagccacgagaaacccggaacgtagagccccagtctggggatttgtag

SEQ ID NO: 59832 - DNA, 1227 bp, Artificial Sequence
  Description of Artificial Sequence: Synthetic coding sequence
atgcattcttgggctccgctcaaggtgctgcacaacgactctgacatcttatttccagtctcaggtgttggtagttatagccccgctgacgcaccactgggttctctggagaatggcaccgggcctgaggatcacgtgttgcccgatcctgggctgaggtatagcgtggaggcgtccagtccaggccatggtagtccactcagcagtctccttccttctgccagcgtgcccgagtcaatgaccatatctgagcttagacaagcaacagtagccatgatgaaccgaaaagacgaactcgaagaggagaaccggtccctcaggaacctgctagacggggaaatggaacactcagctgctctcagacaagaggtggacactctcaaaaggaaagtcgcagagcaagaggaacgacagggaatgaaagttcaggcacttgctagagaaaacgaagtgctgaaagtgcaactgaaaaagtatgttggagccgtccaaatgctgaagagggaaggccagacggccgaagtacccaatctgtggtctgtggatggcgaggtgaccgttgccgagcagaagccaggcgagattgccgaggagttggcaagttcatacgagcggaagctgattgaagttgccgagatgcatggcgagctaatcgaatttaatgagcgcctgcacagggccttagtagccaaagaggccctggtgtcacaaatgaggcaggagttgatcgacctaaggggacctgttcctggtgatttgagccagacctctgaggaccagagcttgtccgacttcgagatcagcaacagggccctgataaatgtgtggatcccttcagtgtttttgaggggcaaggctgccaatgcttttcacgtttaccaggtctacattaggataaaggacgatgagtggaacatttaccgcagatacaccgaattcagaagtctgcaccataagctccagaacaagtatccgcaggttcgcgcttataacttccctcctaagaaagccattggcaacaaggatgcaaagttcgtcgaggaaaggaggaaacaactccaaaattatctgaggtcagtgatgaacaaagtcatacagatggtccctgagttcgcagcaagccctaagaaggaaactttgattcagctcatgcccttctttgttgactggatatccctgtttggaaatggcagagactcatcgagagaggagttcagttcgagctag

SEQ ID NO: 59833 - DNA, 750 bp, Artificial Sequence
  Description of Artificial Sequence: Synthetic coding sequence
atggatgaggaaagatcatcaatgttacccacaatggccgcaggtccgaattctatcctttttgccattaacatcgataataaggacttaaacgggcagtctaaattcgcccctacagtgagcgacctgttgaaggaaagtactcagaacgtgacactcctgaaagagagcacccaaggcgtatcgagtgtgtttcgcgagattaccgcctcctcggccatttcgatcttgatcaaaccagaacaagagactgatccactgcctgttgtgtccagaaatgtaagcgctgacgccaagtgcaagaaggaaagaaaaaagaagaagcaggtcacgaacatcatcagtttcgacgacgaagaggatgaacaaaatagtggggacatgttcaagaagacaccaggtgcgggagaatcttctgaggacaattctgaccattccagcgtcaatatcatgagtgctttcgagtcaccattcggccctaatagcaatggatcccagtcaagtaactcctggaagattgactccctctctctgaatagagaattcggttaccagaagctcgatgttaagtcaattgatgacgaagacgtggacgagaacgaggatgacgtctatggaaattcctcaggtcgcaaacaccgaggccatagcgagtcacctgagaagaatggggcacacagtgtgacccaagccggagtacagtggcatgaccttagcagtctccaaccactgcctcccggatttaaatag

SEQ ID NO: 59834 - DNA, 750 bp, Artificial Sequence
  Description of Artificial Sequence: Synthetic coding sequence
atggatgaggaacgctcctctatgttgcctacaatggctgccggtccgaattcaattctgtttgcgataaatattgataataaggacctgaacggtcagagtaaattcgctccaacagtaagtgatcttctcaaggagagcactcagaacgttactctactaaaggagtccacccaaggtgtatctagcgtttttagggagattacagctagctcggctatatctatcctcataaagcccgaacaggaaaccgatccattaccggtggtatcaaggaacgtgtccgcggatgccaagtgcaagaaggaacggaagaaaaagaaacaggtgacgaacatcatttcatttgacgacgaggaagatgagcagaattccggggacatgttcaaaaaaacacccggtgcaggcgaatcaagtgaggacaactccgaccatagctctgtcaatattatgtcagcctttgagagccctttcggcccaaactccaacggtagccaatcgtccaattcatggaagatagactcattgtctctcaaccgagagtttggataccaaaaactggacgtcaagagcatagacgatgaggacgtggacgagaacgaggatgacgtatacggtaatagcagtggtagaaagcaccggggacattcagaatcaccagagaaaaacggtgcgcactccgtgacacaggccggagttcaatggcacgatttatccagcctgcagcccctgccccctggcttcaagtag

SEQ ID NO: 59835 - DNA, 807 bp, Artificial Sequence
  Description of Artificial Sequence: Synthetic coding sequence
atgctgctcgcagataggtgccgccttagtaccttctacgaggattggtcattcgtgatggatgaagagaggagttccatgctgcctaccatggccgcagggccaaactcaatactgttcgctatcaacattgacaataaagacctaaatggtcaatctaaattcgcccctacagtttcagacctcctgaaagaatctactcagaatgtgacactgctcaaggagtctactcagggagtgtctagcgtttttcgcgagatcaccgccagttccgccattagtatcctgatcaagcctgagcaggaaactgatccactgcccgtggtctctcgaaacgtgagtgccgacgccaaatgtaaaaaggagcgaaagaagaaaaagcaggtgacgaatatcattagcttcgacgacgaagaagacgagcagaactctggcgacatgtttaagaagactccgggtgccggagaatcgagtgaagacaattctgaccactcctccgtaaacattatgagcgcattcgaatcacccttcgggcctaacagcaacgggtcccagagcagcaatagctggaaaatcgacagcctctccttgaatagagaatttggctatcagaagctggacgtcaagtccattgacgacgaggacgtagacgagaacgaggacgacgtatacggaaattcctcagggcgtaagcatagggggcattcagaatctccggaaaagaacggcgcacattctgtcacacaggctggagtgcaatggcacgatctgtcgtctctgcagcctctcccgcctggctttaaatag

SEQ ID NO: 59836 - DNA, 351 bp, Artificial Sequence
  Description of Artificial Sequence: Synthetic coding sequence
atgctcctggcagaccgctgtcggctgagcactttttacgaagattggagcttcgtcatggacgaagagcgatcaagtatgttgccgactatggcagctggccctaattctatactctttgctatcaatattgacaacaaggatctgaacggacaatcaaagttcgcccctactgtctccgatctgcttaaggaaagtacccaaaatgtcactctcctgaaagagagtacccagggcgtttcctccgtgttccgagaaataaccgcctcaagtgccatcagtatcctgattaagccagagcaagagacagaccccctgccggtagtctcgcgtaacgtgagtgctggctag

SEQ ID NO: 59837 - DNA, 1323 bp, Artificial Sequence
  Description of Artificial Sequence: Synthetic coding sequence
atgaagatgcacttctgtatcccagtctcacagcagcgctcagatgctctgggaggacgctacgtgctttactccgtgcatttagatggattcctgttctgcagggtgcgttattcacaactacacggatggaacgagcagctgcggcgtgtctttggcaattgcttacctccatttcccccaaaatactacctcgccatgaccaccgctatggcagatgagaggagggaccagctggaacagtacctgcagaacgttacgatggatcctaatgtgctccgcagcgatgtctttgttgaatttctgaagttggctcagcttaatacattcgacatagccaccaaaaaggcatatctcgacatcttcctgcctaacgaacaatcaatccgaattgagataatcacaagcgacaccgctgagcgggtcctggaagtcgtgtcacacaaaattggactgtgcagggaactcctgggctattttgggttatttctgatacgcttcggtaaagaagggaaactgtccgtggtgaagaagcttgcagactttgaactgccctatgtaagcctcgggtcgtctgaagttgagaattgcaaggtcggtctgcggaaatggtacatggcaccctccctggactccgtgttgatggattgtcgcgtggcggtggaccttctctatatgcaggctattcaggacatcgaaaaggggtgggctaagcctactcaggcgcagaggcagaagctggaagcctttcaaaaggaggatagccagacaaaatttttagagctcgcacgagaagttaggcactatggttacttgcagctggacccttgtacctgtgattaccctgaatctggtagcggcgctgtcctgtctgttggaaataacgaaattagttgctgcattaccttacctgactcacagacacaggatattgtttttcagatgtcccgggtcaagtgctggcaggtgacctttctcgggactttgttggatacagatggtccacagaggacactgaatcagaaccttgaacttcggttccagtatagcgaggatagctgctggcaatggttcgtcatctacaccaagcaagccttcctgctaagctcctgcctcaagaaaatgattagtgagaaaatggtgaagctggctgctgagaacaccgaaatgcagattgaggttccggagcagtcaaaatccaaaaagtatcatattcagcaatctcagcagaaagactattcatcgtttctttctaggaaatctaaaattaagattgccaaggatgattgtgttttcggcaacattaaagaggaggacttatag

SEQ ID NO: 59838 - DNA, 1026 bp, Artificial Sequence
  Description of Artificial Sequence: Synthetic coding sequence
atgttaggcaacactgagaactggaatacttttgacatagctaccaagaaggcatatctggatattttcctcccgaacgaacaatccatcagaattgaaatcattacttccgacacagccgaacgtgtgctcgaagttgtgagccacaagataggattgtgcagagaactcctcgggtacttcggcctgtttctgattagatttgggaaagaaggcaaactctcggtcgtgaaaaagctggctgattttgaactgccctacgtgagtttaggttcttcggaggtggaaaattgtaaagttggcttgaggaaatggtatatggcaccatctttagattctgtactgatggattgtcgcgtggctgtggatctcctttatatgcaggccatacaggatattgagaagggatgggcgaaacctacgcaggctcagagacagaagctggaggcatttcagaaagaggactctcagacaaagtttcttgaattggccagagaagtcagacactacgggtacttgcagctggacccttgcacctgcgactacccggaatccggatcaggggctgtcctgtcagtgggtaacaacgagataagttgctgtattactttgcctgatagtcagacccaggatattgttttccaaatgagccgggtgaaatgttggcaggtcacgttcttaggcacattactggatacagatgggccacaacggacgcttaatcagaatctggaactgaggtttcaatattctgaagacagttgttggcagtggttcgtcatatacacaaagcaggccttccttctttctagctgccttaaaaagatgatctctgaaaagatggtgaagctcgccgcagagaacaccgagatgcaaatcgaggtccctgaacagagtaaatccaagaaatatcacatccagcaatctcagcagaaggactactcttcattcctgtccaggaagagcaagatcaaaatagctaaggacgactgcgtgtttgggaacatcaaggaggaggacctctag

SEQ ID NO: 59839 - DNA, 1212 bp, Artificial Sequence
  Description of Artificial Sequence: Synthetic coding sequence
atggaaacatatgccgaagtggggaaggaaggaaagccttcctgtgcgagcgtagatttgcagggggacagttccctgcaggtggaaatctccgatgcggtgagtgagagggataaagtgaaattcacagtgcaaaccaaatcctgcttaccccacttcgcccagacagagtttagcgtagtcagacagcacgaggagttcatttggctgcacgacgcatatgtcgagaacgaagagtacgcaggcctcatcatccctccggcacccccacgcccagatttcgaggccagcagagaaaagctccagaaactgggcgagggagattcatccgttactcgggaagagttcgccaaaatgaaacaggaactggaggccgagtatcttgccatttttaagaaaacagtggcaatgcacgaggtgttcttacagagactggcagcgcaccccaccctgcgccgagaccacaatttctttgtgtttttggagtacggccaagacctgtccgtcagggggaaaaaccgaaaagagctgctcgggggttttctgagaaatattgtgaagagcgcagatgaggccctgattacagggatgtctggactgaaggaggttgatgacttttttgagcacgagcgtactttcctactcgaatatcacacgcggattagggatgcctgtttgcgtgcagacagggtgatgagggctcacaagtgtcttgctgacgactatataccaatcagtgcggcactatcatccctggggactcaggaggtgaaccagctgcggaccagcttcttgaagcttgcagagctgtttgagagacttcggaaattggaaggcagggtcgcctctgacgaggacctgaaactcagtgatatgctgcgctactatatgcgggatagtcaagctgctaaggatcttctgtaccgcagactaagagccttggccgactacgagaacgccaacaaagcccttgacaaagccagaacccgaaatcgggaggttcggccagccgagagtcaccaacagttgtgttgccaaagattcgagcgactgtctgatagcgccaagcaggagctgatggatttcaaatcccggagggtttctagttttcgcaagaatctcatcgaactggctgaactggagcttaaacacgctaaggcatccaccttaatattgagaaacacgttggtggccctgaaaggcgagccgtag

SEQ ID NO: 59840 - DNA, 384 bp, Artificial Sequence
  Description of Artificial Sequence: Synthetic coding sequence
atggagacctacgccgaggttggcaaagaagggaaaccctcttgtgcgtctgtcgacctgcagggggactcctcactgcaggtcgaaatcagcgatgcagtgagtgagcgagataaggtgaagtttactgtgcagactaagagctgcctcccccatttcgcccagaccgagttctctgtggttcggcagcacgaagaattcatatggttacacgacgcctacgtggaagggaaggcgactgaaatcgggagaggaggtcagttgtgccatagcggccgagtctgccaagatgaggccggtgccggatcagtctccgcccctagttttccttgtcaccctcaatctccggacgtgtttccctcctatctgcccatgaacgtctag

SEQ ID NO: 59841 - DNA, 1725 bp, Artificial Sequence
  Description of Artificial Sequence: Synthetic coding sequence
atggcgctgaaaggccgagccctctatgacttccactctgaaaacaaggaagaaatctccatacagcaggacgaagacctggtgattttttccgaaacctcattagacgggtggcttcaggggcaaaattcacggggtgagaccgggctctttcccgctagctacgtggagatcgtccgatccggcatcagtacaaaccatgccgattactccagcagtcccgctgggtctcccggtgcccaggtttcgctgtacaacagtcctagtgtagctagccctgccaggtctggtgggggatccggttttctcagcaaccaggggtcatttgaagaagatgacgatgacgactgggacgattgggacgacggctgtaccgtcgtggaggagccgcgtgctggcggtctgggcaccaatggtcaccctcccttaaacctgagttaccccggtgcatacccatctcagcacatggcatttcgcccaaaaccacctctggaaagacaggactccctggcctcagccaaaagggggagtgttgtcggcaggaatctcaatcgctttagttgtttcgttaggtctggggtagaagcttttatactgggagatgtgccgatgatggccaaaattgctgaaacatatagcatcgaaatgggcccacgaggcccacaatggaaggccaatcctcacccgttcgcatgcagcgtggaagacccgaccaagcaaaccaaattcaagggtattaaaagctatatcagctataaactgacacccacgcatgccgcatcaccagtttacagacggtacaagcatttcgactggttatacaacagactgctccacaagtttacagtcatcagcgttccacacctgcctgaaaaacaagccaccggccgttttgaagaagacttcattgagaagcggaagcgtcgcctgatcctgtggatggaccatatgacatcccatccggtgctctcccaatatgaggggttccaacacttcctgtcctgcctggacgacaaacagtggaagatgggaaagcgtcgcgctgagaaggatgagatggtgggggcatcctttctcttgacgttccagatccccaccgagcaccaggatctgcaggatgttgaagacagggtcgatacctttaaggccttttccaaaaagatggacgattccgtgctccagttgtcaacggtggcttctgaactcgtgaggaagcatgttgggggatttcggaaagaattccaaaaactcggctcggctttccaggctatatctcatagtttccagatggacccaccattttgttccgaggccttgaacagcgctatatcacacactggacggacgtacgaagcaatcggagagatgtttgctgagcagccaaagaatgacttgtttcagatgctggatacgctatctctgtaccagggactgctatccaatttccctgacatcatccacctccaaaagggagcatttgccaaagtcaaagagtctcaaagaatgagcgatgaaggaagaatggtgcaggacgaggcagacggtatccgccgtcgctgtagagtagtgggctttgctctgcaagccgagatgaatcattttcatcagaggcgcgaactggatttcaagcatatgatgcagaactacctacgacaacaaatacttttctatcagcgggtggggcagcagttagaaaagacactcagaatgtatgacaatctgtag

SEQ ID NO: 59842 - DNA, 312 bp, Artificial Sequence
  Description of Artificial Sequence: Synthetic coding sequence
atgggccaacaatccagcgtacgcaggctgaaacggagcgtcccttgcgagtctaatgaagcaaatgaggcaaatgaggccaataagaccatgccggaaaccccaaccggggactcagacccacaaccagccccaaaaaagatgaagaccagcgaatctagtacaatcttagtcgtgagataccgcaggaacgtgaaacgtaccagccccgaagaactgttaaacgatcacgcgagggaaaatcgcatcaaccccgatcagatggaagaagaagaattcatcgagatcaccacggagagaccaaagaaatag

SEQ ID NO: 59843 - DNA, 294 bp, Artificial Sequence
  Description of Artificial Sequence: Synthetic coding sequence
atggataagcaatccagcgccggtggggtaaagagatcagtaccatgcgacagcaatgaagcaaacgagatgatgcctgaaacttccagcggatactccgacccccagcctgccccaaagaagctcaagaccagcgagagcagcactatcctagtagtcagatatcggaggaacttcaagaggactagccccgaagaattggttaacgaccatgcacgcaaaaacagaattaaccctctacagatggaggaagaggaatttatggagatcatggttgagatccccgctaagtag

SEQ ID NO: 59844 - DNA, 219 bp, Artificial Sequence
  Description of Artificial Sequence: Synthetic coding sequence
atggagcagcctacatctagtatcaatggcgaaaaaagaaagtccccctgcgagagcaataacgagaacgatgaaatgcaggaaacgccgaaccgggacttggctcccgagccttcattaaagaagatgaaaacttcagaatatagtaccgtgctcgccttctgttacagaaaggctaagaaaattcactcaaaccaactggaaaacgaccagtcttag

SEQ ID NO: 59845 - DNA, 543 bp, Artificial Sequence
  Description of Artificial Sequence: Synthetic coding sequence
atggaacagcccacctctagcactaatggtgagaagcgcaagtctccctgcgagagtaataacaagaagaacgacgaaatgcaagaggccccaaatcgcgtgctggcacccaaacagtctctgcagaaaactaaaactattgagtatttgactataatagtttactattacaggaaacacaccaagatcaactccaatcagctggagaaggatcagtcccgtgagaattcaattaatcctgtgcaggaggaggaagatgaaggcttggattctgccgagggttccagccaggaagacgaagatctggattccagtgagggcagctcccaagaggatgaggatctcgacagtagcgaaggttcctcccaggaggacgaggacctggactcatcggagggaagctctcaagaggacgaggacttagacagcagtgaagggtcatctcaggaagatgaagacctggaccccccagagggtagttcccaggaggacgaagacctggactctagcgaagggagttcacaggagggtggggaagactag

SEQ ID NO: 59846 - DNA, 426 bp, Artificial Sequence
  Description of Artificial Sequence: Synthetic coding sequence
atggagcagccaactagtagcactaacggagagaaaactaagtccccttgtgagagcaacaataaaaagaacgacgagatgcaggaagtcccgaaccgggtgttggcgccagagcagtcactgaagaaaaccaaaacctcagagtatccaatcatctttgtctactacctgaggaagggtaaaaaaattaacagtaatcaactggaaaatgaacagagtcaggagaattcaattaatcccatacagaaagaggaagatgaaggggtggaccttagcgagggcagctccaatgaggacgaagatctcgggccttgcgaaggtccttcaaaggaggacaaggatctggatagttctgaaggcagctcacaagaggacgaggatctggggctgagcgaaggttcttcccaggattcaggcgaggactag

SEQ ID NO: 59847 - DNA, 300 bp, Artificial Sequence
  Description of Artificial Sequence: Synthetic coding sequence
atggaggaaccaacatcctctacgaacgagaataaaatgaagagcccctgtgagtctaacaagcgtaaagtggacaagaaaaaaaaaaatctgcaccgtgcctcagcgcctgaacagtcccttaaggaaacagaaaaagctaagtatcctaccctggtgttctattgtaggaagaacaagaagcggaactccaatcagctggagaataaccagccgaccgagagtagtactgatcctattaaagaaaaaggagacctagacatctcagccggttcaccccaggacggcggacagaattag

SEQ ID NO: 59848 - DNA, 219 bp, Artificial Sequence
  Description of Artificial Sequence: Synthetic coding sequence
atggagaagccaacttcatctaccaacggcgaaaagagaaaatccccatgtgactctaactccaaaaatgatgagatgcaagaaaccccgaatagagatctggtgctggagccttccctgaagaagatgaagacttccgaatacagtacggtgctggtactttgttacagaaagactaaaaagattcactcgaaccaactagaaaacgaccagtcctag

SEQ ID NO: 59849 - DNA, 1011 bp, Artificial Sequence
  Description of Artificial Sequence: Synthetic coding sequence
atgcagaagcactatacggtcgcgtggtttctgtactctgcccctggtgttgatccttcccccccttgtcgctccctaggatggaagagaaaacgggagtggagcgatgaatcagaggaggaacccgagaaggaacttgccccagaacccgaggagacctgggtcgtggagacactctgcgggctgaagatgaaactaaaacagcagcgcgttagccccattctcctcgagcatcacaaagatttcaatagccagctggctcctggcgtggacccttctccccctcataggtccttctgttggaagcgtaaaatggagtggtgggataaatcagaagaaagtgaagaagagccaaggaaagtactcgcacccgaaccggaagaaatctgggtagcggagatgctgtgcggcctgaagatgaaacttaaaaggaggcgggtgtcactcgtcttacctgaacatcacgaggccttcaatagacttttagaggatcctgtaattaagcgttttctggcatgggacaaggatcttcgagtatcagacaagtatttgctggctatggtgattgcgtacttcagtagagctggcttcccgagctggcagtaccagcgtctgcatttcttcctggccctatatctcgctaacgatatggaggaagatgacgaggattcaaaacagaatatctttcacttcttatacggaaagaatagatctcgcatccctctcctgaggaagcgtcggttccagctgtatcggtccatgaaccctcgagctcgtaaaaataggtcccatatccctctggtccggaaacgaaggttccagttaagacgctgtatgaatcctcgggctagaaagaacaggagccagatcgtactgtttcagaagaggagatttcactttttttgttcaatgagctgccgggcatgggtgtcaccagaagagcttgaagagatacaggcgtacgatcctgaacactgggtgtgggctcgcgacagggcccgactgtcctag

SEQ ID NO: 59850 - DNA, 777 bp, Artificial Sequence
  Description of Artificial Sequence: Synthetic coding sequence
atggaatggtgggacgaatctgaggaaagtctggaagaggagccgcgaaaggtcctcgctccagaaccagaggaaatctgggtggctgagatgctttgtggcctgaaaatgaagctgaaacggcgtagagtttctctcgtgttgccagaacatcacgaggcctttaatagactcctggaagatcctgtgataaaacggttcctggcttgggacaaagatcttcgggtgtctgacaagtatctcctggctatggttatcgcttacttttctagagcaggattcccctcatggcagtaccagcgaatccatttcttccttgctctgtatctggccaacgatatggaagaagacgatgaggactccaagcaaaatatcttccattttctttataggaagaaccgctcccggattcccctgctgcgcaaaccatggttccaactgggccactccatgaacccgagggcgagaaaaaatagaagcaggataccattgttaagaaagaggaggttccagctgtatcggagcacaaatccgagagcccgtaagaatagatcgcgcatccctctgctgaggaaaagacgcttccaactgtatcggtccatgaactctcgggctcgcaagaaccgctcacagattgtgttgttccagaagaggcgctttcacttcttctgttctatgagctgtcgcgcatgggtgagccccgaagagctcgaagagatccaggcatacgatcctgaacattgggtttgggctcgggacagggcacatttgtcgtag

SEQ ID NO: 59851 - DNA, 777 bp, Artificial Sequence
  Description of Artificial Sequence: Synthetic coding sequence
atggagtggtgggacgaatcagaagagtccttggaagaagagcctagaaaggtactcgctccagaaccggaagagatttgggtggcagagatgctgtgtgggctcaagatgaaactgaagcgcagaagggtctccctggtgttgcctgagcatcatgaagctttcaatcgattgctggaggatcccgttattaagaggtttcttgcctgggataaagacctgagggtgtccgataaatatctcctcgcgatggtgatcgcatattttagtcgcgctgggttcccctcttggcagtatcagaggatccacttcttcctcgcgctgtacctcgccaacgatatggaggaagacgatgaggacagtaagcagaatatattccatttcttgtaccgaaaaaataggtctaggatacctctactacgtaaaccttggtttcagctcggacacagcatgaatcccagagcgaggaagaataggagtagaataccactcctgagaaaaaggcgctttcagttgtaccgctccacaaaccccagggcaagaaagaacagaagccgcattcctcttctccggaagcgaaggttccagctttaccgaagcatgaacagccgagcccgtaaaaatcgttcccagatcgtactcttccagaaacgtcggtttcacttcttttgtagcatgtcttgccgggcatgggtttccccagaggaactagaggagatccaagcctacgatcctgagcattgggtctgggccagggatcgggcacatttgtcctag

SEQ ID NO: 59852 - DNA, 1209 bp, Artificial Sequence
  Description of Artificial Sequence: Synthetic coding sequence
atggaccgcaccgagaccagatttcggaagaggggacagattactggcaagatcaccacatcccggcagcctcacccacagaatgaacagtctccccagcggagcacgtctggatatcccctgcaggaggttgtcgatgacgaaatgctgggaccatcagcccctggcgttgatccttcaccaccctgccgaagccttggctggaagcggaagagagagtggagtgacgaatcggaggaagaacccgagaaagaattggccccagagcccgaggagacttgggtggtggagatgctttgtggtcttaagatgaagctcaagcagcaacgggtttcaccgatattaccagagcaccacaaggactttaactcccaactcgcacctggggtggatccaagcccaccccacaggtctttctgctggaaacgaaagatggaatggtgggatgaatcagaggagtcccttgaggaagaaccaagaaaagtgctagcccctgagccagaagaaatctgggtggcagagatgctgtgcgggttaaaaatgaagctgaagcgacggagggtctctctcgtgctcccagaacaccacgaggcctttaatcggctgcttgaggatcctgtgataaaaaggtttctggcctgggacaaagatttaagggtgagtgataagtatctgttggctatggtaattgcctacttttcacgggctggatttccatcatggcaataccagcgtattcactttttcctggctctgtatctggccaacgacatggaggaagacgatgaggactcgaagcagaacattttccatttcttgtacagaaaaaatcgctctcgtatacccctcctccgaaaaccatggttccagctgggccactcaatgaatccacgggctcggaaaaatcggtcacggatacctctgcttcgtaaaagacgcttccaattgtacagaagcacgaacccaagggccagaaaaaaccgatcaaggataccactgctgcgcaagcggagattccagttatatcgcagcatgaatagccgtgcacgcaaaaaccggtcccagattgtcctcttccaaaaaagacggtttcactttttctgctcaatgtcttgcagggcctgggtgagcccagaggaattggaggagatacaggcctacgaccccgaacactgggtgtgggcgagagatcgcgctcacttaagctag

SEQ ID NO: 59853 - DNA, 1650 bp, Artificial Sequence
  Description of Artificial Sequence: Synthetic coding sequence
atgacctcccaccaaccacagccacaggaggaacagtccccacaaagaagtacatccggataccccctgcaggaagttgtcgatgatgaggtgtctgggccttctgcccctggtgtggacccatcaccaccgagaagaagtctggggtgcaaacggaagcgtgagtgcctggacgaatccgatgatgagccagaaaaggaactcgcccctgaacccgaagaaacgtgggttgctgaaaccctttgtggtctgaaaatgaaggcgaagcgtcgcagagtctcgctcgtgttgccggaatactacgaggcattcaatagactgctcgcgcctggggtcgacccaagccctccgagacgcagcctaggctgtaaacgaaagcgggagtgtctagacgagtccgatgacgaaccggaaaaagaactagctcctgagccggaagaaacgtgggtagcagaaaccctttgcggtctgaagatgaaagctaaaagacgcagagtgagtcttgtgttgccggagtattatgaggcctttaacaggttgcttgcccctggggtggacccaagtccacctaggcgtagcctgggctgcaaacgcaaaagagaatgtctggacgagtcggatgacgagcccgaaaaagagctcgccccagagcctgaggaaacgtgggtagcagaaactttgtgcggcctgaagatgaaggcaaagcggagacgcgtctccttggtcctgcccgagtattacgaagccttcaaccgattgcttgcacccggagttgatccctctcccccaaggcgctcactgggctgtaaaagaaagcgggagtgtcttgatgagagcgatgatgaaccagagaaggagttagcgcctgaacccgaggaaacctgggttgccgagactctctgtggcttaaagatgaaagccaagcggcgacgagtttcactggtactgcccgagtactatgaagcttttaaccgtttactggcccctggagtggatccttcaccgcctcgcaggtcccttggatgtaagcgcaagcgggaatgtctagatgagagcgatgatgagccagaaaaggagttggcgcctgaaccagaggaaacatgggtagcagagaccctgtgcggcctcaagatgaaagccaagaggcgcagggtgtccctcgtccttcctgaatactatgaggctttcaatcggctgctggaggaccctgtgataaagaggttcctggcttgggacaaagacctcagagtcagcgataagtatctcttagcgatggtgatcgcatactttagtagagcaggccttccctcttggcaataccaacgcattcatttcttcctggccctgtacctggcgaatgatatggaagaggatgatgaggcacctaagcaaaagatcttttatttcctgtacggtaaaacacacagtcatattcctctgaggcctaagcactggttccagctgtgccggccaatgaacccgcgtgccaggaaaaactgcagccaaatcgccctgttccagaaaagacggtttcagttcttctgctccatgcgctgcagagcctgggtaagtcctgaggagttggaagagattcaggcgtacgacccagaacactgggtgtgggcgcgagatagagcgcacctctcatag

SEQ ID NO: 59854 - DNA, 519 bp, Artificial Sequence
  Description of Artificial Sequence: Synthetic coding sequence
atgaaggccaagcggcgtagagtctccctggtgctgcccgagtactatgaggctttcaacagactactggaggatcctgttatcaaacgatttctggcctgggataaagatctgagagtatctgataaatacctgcttgctatggtcattgcttacttctctagggctggtttaccatcttggcagtatcagagaatacatttcttccttgctctatacctcgcgaatgacatggaggaagacgatgaggctcctaaacaaaagatcttctattttctgtatggtaagacacatagtcacatccctctgcgccctaagcattggtttcaactctgccgtcccatgaatcctagagccagaaaaaactgcagccagattgctttattccagaaaaggcggtttcagtttttttgctccatgcggtgccgcgcttgggtctcccccgaagagttggaagagatacaggcttatgaccctgaacattgggtgtgggcacgggatagggcacatctgagctag

SEQ ID NO: 59855 - DNA, 714 bp, Artificial Sequence
  Description of Artificial Sequence: Synthetic coding sequence
atggccagcgggcaggctagaccgcctttcgaggaagaatcaccccagccctcaacgacagtgagatccccagaagtcgtggtcgatgacgaggtgccaggtcctagcgctccttggatcgatcctagtccccagcctcagagtctaggcctgaaaagaaagtcagaatggagtgatgaaagcgaggaggagctcgaagaggagctggaactggagcgtgccccagagcctgaagatacctgggttgtggagactttgtgcggactaaaaatgaaactgaaaaggaaacgggcttctagcgtccttccagagcaccacgaggcatttaaccgactgctgggggaccccgttgtccaaaagttcctcgcctgggacaaggacctaagggtgtcagacaagtatctgctggccatggtcatcgcttatttctcaagggctgggttgtttagctggcagtaccagaggatacattttttcttggccttgtatctggcctcagacatggaggaggataaccaagcccctaagcaggatatcttttcattcctctacggaaaaaactactcacaacgtcccctcttccataagctccggtaccagctactgtgttctatgcgctggcgtacatgggtttccccggaggaaatggaagagatccaggcctacgaccctgaacactgggtgtgggctcgggatagaactctcatttcctag

SEQ ID NO: 59856 - DNA, 1209 bp, Artificial Sequence
  Description of Artificial Sequence: Synthetic coding sequence
atggatcgcaccgaaactcggtttcggaagcgcggacaaattaccggcaaaattacaactagccggcagcctcatccccagaacgagcagagtccacagcgctctacttcaggctatcctctgcaggaagtcgtcgacgacgagatgcttgggccttcggcccctggtgtggacccctcgcccccttgcagatcccttggatggaaacgaaagagagaatggtccgatgaaagtgaagaagagcctgagaaagaattggccccagagcctgaggaaacctgggtcgtagagatgctgtgtggactcaagatgaagctcaaacagcagagagtgagcagcattttgcctgagcaccataaggacttcaacagccaattagcacctggggttgatccatcccccccacaccgtagcttctgctggaaacggaagatggaatggtgggacgaatctgaagagtcccttgaagaagaacccagaaaggttctggccccagagcctgaagagatctgggttgcagaaatgctgtgcgggctgaagatgaaactaaaacggcgacgcgtttcactggtccttcctgaacatcacgaggccttcaatcgtctactagaggatccggtcatcaaacgctttctggcatgggacaaagatcttcgggtgagcgataagtacctgctcgctatggtgattgcgtacttctcccgcgctggcttcccaagctggcaataccagaggattcatttcttcctcgctttataccttgccaacgacatggaggaagatgatgaagatagtaaacagaacatcttccattttctgtacagaaagaaccgaagccgcatcccactgctcaggaagccctggttccagcttggccacagcatgaacccacgcgcaagaaaaaaccggagccgtatacctctgttgagaaaaagacgcttccagttgtacagatcaaccaacccaagggccaggaaaaatagatccagaatccctctgctgaggaaaagacgattccagctgtataggtcgatgaattcacgtgctcggaaaaaccgaagtcagatcgtcctcttccagaagaggcggtttcactttttttgctctatgagctgtcgggcatgggtatccccagaggagctggaggaaatccaggcctatgacccagagcactgggtgtgggcacgggacagagctcatctgagttag

SEQ ID NO: 59857 - DNA, 777 bp, Artificial Sequence
  Description of Artificial Sequence: Synthetic coding sequence
atggagtggtgggacgagtccgaagagagtctggaggaagagcctagaaaggttctcgctcctgagccagaggagatttgggttgccgagatgctttgcggccttaaaatgaagcttaagagacggagggtatcccttgtccttcccgagcaccatgaagcttttaacaggctactggaagatcccgtgatcaagaggttccttgcgtgggataaagacctgcgcgtaagcgacaagtacttgctggccatggtgattgcttacttttcaagagcgggattcccctcctggcaataccagagaattcacttcttcctggcgctctatttggcaaatgatatggaggaggacgacgaagattccaagcagaatatatttcactttctgtaccgcaagaataggtctcggatcccattgctgcggaagccatggtttcagctcggtcacagtatgaaccctcgggctcggaaaaatcggtccagaattccgcttcttaggaagaggcggtttcagctgtacagatcaactaacccaagggccaggaagaatcgcagccgtatcccattactccgaaagcggagattccagctttacaggtctatgaacagcagagccagaaagaataggtcccagattgttctgtttcaaaaaagaagattccattttttttgcagtatgtcatgcagggcctgggtgagccccgaggagctcgaggagatccaggcctacgatcctgaacactgggtgtgggctcgggatagagcccatttgtcttag

SEQ ID NO: 59858 - DNA, 1209 bp, Artificial Sequence
  Description of Artificial Sequence: Synthetic coding sequence
atggatcggactgagactaggttccgtaagaggggccagattactggcaaaatcaccacttcacggcagccccaccctcagaatgagcaaagcccacagcgttctacttcaggatatcccctccaggaggtcgtcgatgatgagatgctgggcccatccgctcccggagttgatccttcgcccccttgccgatcacttggttggaaaagaaaaagagagtggtccgacgaaagcgaagaggaacctgagaaggagctggctcctgaacctgaagagacctgggtcgttgagatgctgtgcggcctgaagatgaaactcaagcagcaacgagttagctccatcttacccgaacaccataaagatttcaactcacagctcgctccaggggtggacccgtcaccccctcatcgctcattttgctggaagagaaaaatggagtggtgggatgaaagtgaagagagtctggaggaagaacccagaaaagtcctcgctccagagccggaggagatctgggttgccgaaatgctttgcggattgaagatgaagcttaaacgcagacgagtgtccttagtgctgccagagcatcacgaagcttttaatagactgttggaggatcctgtcattaaacgattcctggcgtgggataaggatctacgggtttccgacaaatacctgctggccatggtcattgcctattttagccgggctggctttccatcctggcagtaccagcgaatccacttcttcttggctctatacctcgccaatgacatggaagaagacgacgaggatagcaagcagaatatcttccacttcctatacagaaagaatcggtcacgaatccccttgttgagaaaaccatggtttcagttgggccacagcatgaaccctcgcgctcgcaagaatcgaagcagaattcctttgctgaggaaaaggagatttcagctgtacagatctactaatccacgggctagaaagaacagatcgaggattcctttactaaggaaaaggaggtttcagttataccgaagcatgaactctagggctcggaagaatcggtctcagatcgtgctgtttcagaagagaagatttcattttttttgttccatgtcttgccgcgcttgggtgtcccccgaagaacttgaggagatccaggcctacgatccggaacactgggtgtgggccagggaccgagcccacctcagctag

SEQ ID NO: 59859 - DNA, 1545 bp, Artificial Sequence
  Description of Artificial Sequence: Synthetic coding sequence
atgtccgagattctctgtcaatggctgaataaagagcttaaggtgtctagaactgtgagcccaaaatcctttgcaaaggcgttttctagtggatatctgctcggagaagtcctgcacaaatttgaactacaggacgatttcagcgaatttctggattctagagtgtcttccgccaagcttaataattttagccgtctcgagcctactctgaatctgctgggagtgcagttcgatcagaatgtcgcccacggcatcattactgaaaagcctggtgttgcaaccaaactgctgtatcagttatatatagccttgcagaagaagaagaaatcaggcctgaccggcgtagaaatgcagaccatgcagcggctaacaaatttgcggttgcaaaatatgaaaagtgacacctttcaagaacgcctaaggcacatgatccctcgccagactgatttcaacctgatgcggataacatatcggtttcaggaaaaatacaaacacgtgaaagaagatctggctcacttacactttgaaaagctcgaacgttttcagaagttgaaggaagaacagaggtgctttgatattgagaagcagtatctcaacagaagaaggcagaacgagatcatggccaagatccaggctgctatcattcaaattccgaagccagcgtcaaacagaactctcaaggccctcgaggcccaaaagatgatgaaaaagaagaaggaggccgaggacgttgcagacgagatcaagaagttcgaagccttgatcaagaaagaccttcaggctaaggagagcgcgtccaagacaagtctggataccgccggacagaccaccaccgacctcctaaacacctacagcgacgacgaatacattaaaaagattcagaagcgcctggaggaagatgcctttgcccgagaacaacgcgagaaacggcgaaggaaactgctgatggatcagctgattgcgcacgaggcacaggaggaggcgtatcgcgaggagcagctcattaatcgtctcatgaggcaatctcagcaggagagacgcattgcagtccagctgatgcatgtcagacatgagaaggaggtcctgtggcagaataggatattcagagaaaaacagcatgaggagcggcgactgaaagacttccaggacgctttggaccgggaggctgcactggcaaaacaggcaaaaattgactttgaagagcagtttctcaaggagaaacgattccatgaccagattgccgtggagagagctcaggccagatacgagaaacactactcggtgtgtgctgagattctggaccaaatcgtcgacctcagcactaaagtcgcagattataggatgctgaccaacaatctgatcccatacaaactgatgcatgattggaaggaactcttttttaacgccaaacccatttatgaacaggcctccgtcaagacattacccgcaaacccgtccagggagcagctgactgagttggaaaagcgggacctcctcgacacgaacgattacgaggaatataaggtgccgacagatatgaaatag

SEQ ID NO: 59860 - DNA, 1860 bp, Artificial Sequence
  Description of Artificial Sequence: Synthetic coding sequence
atgccctctcagattggagacagaaaatggctccatggtcttcaggccgcactccagaacttcctgaagggttatccagccattgtccggcaattacatagtgccggaaggggcaaaagcgacacctctcagaagaaacctaaggaactgctggaatcattacttcaggctgatatcgtaaagttcgcacactttttgttagacgtcatgaacgttttaagcatcctatcttgtgtgaacaagaacagaaatagctccatagcggacattttcgccacacttgagagcatgcttgagatgctacaaatgtaccaaactcggcttgggccaaaggagcgaatggtggacagtgcaactcactttcacggcaactgtctgagaggtaaggagaacattagtgcagtaaggaacatagtgctcacacacttgattaagcggcttcaggggtgttttagagatgctagccagaacgttgtaagggctactgtcattgggagcttcaagttgtggcctacaaagatcaaccaggagttcggtgaaaaggaggtctcgatcctcacagctcattatgaaccagtcctagaagctgcaaatgtgaagttgtctgaggtagacacagagtggagtatgctcaaacttgaaatatatgctcgcttccagaatattagaaaacttacctgggactttgtgaattcgatatacctacataagtatcccaacattctaactctggtggacctcgtcctcaccctccccgcttcaagcgccgaggcagaacacggcttctcccaaatgaaatggacgaagagtcacatgcacgcaaaaatcaaagccgaatccatcatcggtaataaagcatttaccgatattctgatcgatctcgtgactctgaaccttggaaccaacaactttccttcgaactggatgcacctgacacagcccgaactccaggagctgacctctcttctcacagtgaatagcgagttcgtggactggagaaagtttctactggtgacctcaatgccatggcctatcccactggaggaggagcttctggagacactacaaaagtttaaggctgttgacaaggaacagctggggacaataacctttgagcaatacatgcaggccggtctctggtttacaggggatgaggatatcaagatacccgaaaatccactagagcctctgccctttaatcggcaagagcacctcatcgagtttttctttcgccttttcgccgattacgagaaggaccccccacagctggattatacgcagatgctgctgtacttcgcttgccatcccgacaccgtggaaggcgtgtaccgcgcactttctgtggccgtaggcacccatgtgtttcagcaggtgaaagcgtccataccatctgctgagaaaacttctagtactgatgcaggacctgcagaagagttcccagagccagaagagaacgcagctagagaggagaggaaactgaaagacgacactgaaaaacgggagcagaaggacgaagagatacctgaaaacgctaacaatgagaagatgtcaatggagactctgcttaaggtttttaagggaggatctgaggcgcaggattccaatcgatttgctagccatctgaaaatagagaatatttacgcagaaggtttcattaaaacgttccaggatcttggcgcaaaaaacttagagccaattgaggtagcagtactgttgaagcaccccttcattcaggacctcatcagcaactactccgactataagtttcctgacataaaaatcattctgcagcgctctgaacatgtacaagggagtgatggagaacgtagtccctcaagacacactgaggagaaaaaatag

SEQ ID NO: 59861 - DNA, 5468 bp, Artificial Sequence
  Description of Artificial Sequence: Synthetic coding sequence
atgagtgaaattttatgccagtggctgaacaaagagctgaaggtcagtagaaccgtttcccccaagtcattcgctaaagcattctcgagtggatacctcctgggggaggtgctccacaaatttgaattgcaggacgacttctccgaattcttggattcacgcgtgagctccgcaaagcttaataatttctctcggttggaacctacactgaacttgctgggggtgcaatttgatcagaatgttgcccacggcattatcaccgaaaaaccaggcgtcgccaccaagctactgtatcaactatatattgctcttcagaagaaaaaaaaatccggtctaactggggtcgaaatgcagacaatgcagcggctgaccaatttgcggcttcagaacatgaaatccgatacgttccaagagaggttaagacatatgatccctcgtcagacagactttaacctcatgagaattacgtataggttccaggaaaaatacaaacacgttaaagaagacctggcccacctccacttcgagaaactcgagaggttccaaaaactcaaagaggaacagagatgcttcgatatagagaagcaataccttaacagacgacggcagaacgagatcatggccaagatccaggccgctatcatccaaataccaaagcctgcctccaaccggactctcaaggccctggaagctcaaaagatgatgaagaagaagaaggaagcagaagatgtggccgacgaaatcaaaaagttcgaagccctcatcaagaaggatctccaggccaaggagtccgcctcaaagacctcacttgacaccgccggacagaccacaaccgacctcctcaatacttactccgatgatgagtacatcaagaagatccagaaacgcctggaggaggatgcattcgcgagagaacaaagggagaaaagacgacgcaagttactcatggaccagctcatcgcccatgaagcgcaggaagaagcttacagggaggagcagctgatcaacagactaatgaggcagagtcagcaggagagaaggatagctgtgcagctgatgcacgtccgccatgaaaaagaagtgctgtggcagaatcgtattttccgggaaaagcagcacgaggaacggaggcttaaagactttcaggacgccctggaccgggaagcggcattggctaaacaggctaagattgacttcgaggaacagttccttaaagagaaaaggtttcacgaccagattgcagtggaacgagcacaggctagatacgaaaaacactattctgtctgcgccgagatactggatcagatagtcgatcttagtaccaaggtagcggattacagaatgctcactaacaacctgattccatacaagctaatgcatgactggaaggaacttttttttaatgccaagcccatctatgaacaggcttccgttaagaccctgccagccaacccttcacgagaacagctgacggagctggaaaagcgggatctgctggataccaacgactacgaagagtacaagaacatggtaggcgagtgggccctgcccgaagaaatggttgacaatctgccgccttcgaataactgtattctgggtcatatccttcataggctggccgagaaatccctcccacctcgcgcagagtcaaccacacctgaacttcctagttttgccgtaaaaggatgtctccttggtaaaacactgtctggtaagacaaccatcctgcgtagcctccagaaagattttccaatacaaatcctgtcaattgatactctcgtgcaggaagctatacaggcttttcacgacaatgagaaagtgagtgaagtgttacctattcaaaagaacgatgaggaggatgcacttcctgttttgcaggaggagataaaggagtcacaggacccccagcacgtcttcagtgccggaccggtctcagatgaggtccttccggaaaccgagggagagactatgctgagtgcaaacgccgacaagacacccaaggccgaagaggtgaagagttccgacagcttcctcaagctcacaacccgcgcacaattgggggcaaagtccgaacagcttctcaagaagggaaagagcatccctgacgtgctattagttgatattattgtcaatgccatcaatgagatccccgtgaaccaggattgtatcttggacggattcccaatgactcttaatcaggcccaactgctggaagaggccctcaccggatgcaaccgcaacctcaccgaggtggaacggaagaaggcacagaaatccaccctggcaattgatcctgcaacctccaaagaaatccccctaccatccccagcttttgactttgtgatcctgctggatgtgagcgacaccagttcaatgtcccgcatgaatgacatcatcgccgaggagctgtcctataagactgcccacgaagatataagtcagcgggttgcagctgaaaatcaggacaaggatggcgaccagaacctcagggaccaaatccagcacaggatcatcggtttcctcgacaactggcctctgctggagcagtggttcagtgagcctgagaacatcctgattaaaattaacgccgaaattgacaaagagagcctttgtgagaaggtcaaggagatacttactaccgaaatcgccaagaagaaaaataaggtagaaaagaagctcgaagaaaaagaagcagaaaagaaggccgcagccagcctcgcagagttgcccctgccaacccccccacccgcaccaccacctgagcccgagaaggaaaaagagattcaccaatctcacgtcgcttccaagacgcctaccgccaaagggaaaccacaatccgaagccccacacggcaagcaggagtctctgcaggaagggaaaggaaaaaaaggcgaaacagctctgaagcggaagggttccccaaagggcaaaagctccggtgggaaagtccccgtgaagaagagcccagctgactctaccgacacgtcaccagtggccatcgtcccccaacctcccaaacccggatctgaagaatgggtctatgttaacgagccagttcccgaggagatgccgcttttcctggttccttactgggagctcatcgaaaactcctacatcaacaccattaagactgtgttaagacatctgagagaggaccaacatacagtgcttgcttacctttacgagatcaggacatcttttcaagagttcttgaagcggccagaccacaagcaagactttgtggcccagtggcaggcagatttcaactccctgcctgacgatctctgggacgacgaggagacgaaggcggagctgcatcagagggtgaacgatttgagggacagactgtgggatatctgcgacgcacgcaaagaagaggctgaacaggaacgtctggacataatcaacgaatcctggctccaggatacccttggcatgactatgaaccatttcttctctctaatgcaggcagagctgaataggtttcaggacacaaagcgcctgttgcaagattattactggggtatggagagtaagataccagtggaagacaataaacggtttacccgaataccactggttcagttggactctaaggataattctgagtcccaactgagaatccctctggtgcctcggattagtatcagtctggaaacagtaacacccaaaccgaagaccaagtccgtgttgaaggggaaaatggataactcattggaaaacgttgaaagcaattttgaggcggacgagaaactggtaatggatacctggcaacaagcttcactggccgtgagtcacatggtcgctgctgagattcatcagagactgatggaagaagagaaggaaaaccaaccagccgatcctaaggagaaaagtccccagatgggcgcaaataagaaggtcaaaaaagagccccctaaaaaaaagcaggaggacaaaaagccgaagggcaagtctcctccaatggccgaggcaacacctgtgatagtgactacggaagagattgcagaaattaagcgaaaaaacgagctgcgcgtaaaaattaaagaagagcacctggccgctctgcaatttgaggaaatagccacacagttccggctggagctgattaaaacaaaggctctcgctctgctagaggatctcgtcacaaaagtggttgatgtgtacaaactaatggagaagtggctgggggagagatatttaaacgaaatggcgagcaccgaaaagttgaccgatgttgcaagataccatatcgaaacgtccacaaaaattcaaaacgagctttatctgagccaggaggacttttttatcaacggtaacatcaaggtatttccagacccacccccatcgattcgtcccccacccgtcgagaaggaggaagacgggaccctcacaatcgagcagctcgactctctgagagaccaattcttagacatggcgcctaagggaataatcggtaacaaggcttttaccgacatcttgattgacctggtgactctgaacctgggcacaaacaactttccctccaattggatgcatctcacccagcctgagctccaggagctgaccagcctgctgaccgtgaactcagaatttgtggattggcgcaagttcctcttagtgactagcatgccttggccaatccctctggaagaggagttacttgagacgttgcagaagttcaaggctgtcgacaaagaacagctgggtactattacctttgaacagtacatgcaagctggactttggttcactggtgatgaggacataaagatccctgaaaatccacttgaacccttaccattcaaccggcaggagcacctcatcgaattcttttttagactgttcgcagactatgagaaggaccctcctcagctggattacacacagatgcttctctattttgcttgtcatcccgatacagttgagggagtataccgggcactctccgtggcagtaggtactcacgtgtttcagcaggtcaaggcctccatcccgagtgccgaaaaaacctcttcgaccgatgccggacccgctgaggagtttcccgaaccggaagaaaatgccgctcgggaagagagaaagctgaaggatgacaccgaaaaacgagaacagaaagacgaagagatccccgagaacgcaaacaatgagaaaatgagcatggagactttgctgaaggtgtttaaagggggaagcgaagcccaggattcaaaccggttcgcgagtcatttaaagatcgaaaacatttatgccgaaggctttatcaagacattccaggacctgggtgcgaaaaatttggagcccattgaggtagcagttttattaaaacatccctttatacaagatctgataagtaattattccgactacaaatttccagatatcaagatcatactgcagcgctccgagcatgtacaggggagcgatggcgagaggtcaccctctagacatactgaagaaaagaaata

SEQ ID NO: 59862 - DNA, 1410 bp, Artificial Sequence
  Description of Artificial Sequence: Synthetic coding sequence
atggataatcggaacacacagatgtacaccgaggaagagaagacagtgaacccttttttgcctagcacaccaggacccaaaaaggcgaagggcggaggggaagcggttgagacccaccccgcacccggacccctgcctcctcccgaagtcagagacattggggaacgccgtgagccggatcgggctcagcaacaaccccagaagcctgctgtggccgctgggacccagagcctcggcaacttccgccaagggttcatgaagtgcctgctggaagtcgagaaaatggaggcgtctcatagaagggcttctaaggccaggtctcagaccgcacagaagtcacctcggactcttacgccggtgccaacctccgcccctagcctcccacagacaccagcttctgtacccgctagtggaccaagctgggctcgcctgcccgcaccagggccagagccggcacccatgggggctcctgtccctacctcgatgccctgccctgtcctgctgggacctgccctggacctgggatggagaagaatggaactgttgcaccaatctagtgaacggacactctcttatgctaaagcaagacaggaacctgaggaacaaagcctccaaaaactgtatcagaacagggagaagtccgaggaacagctgaccttgaaacaggaggaggcttttcggagttatttcgaaatctttaacggaccgggagaggtggacgcccagtccttgaaaaacatcttgcttttaatgggctttagtgttacattagcacaggttgaggacgccttgatgagcgccgacgttaacggcgatgggcgagtggacttcaaggattttctagctgtcatgacagatactaggcggtttttttgctctgttgagcaaaatgcgctgtcagatatggctcctcacaacccgcacactctcctgtttgaaattctgagtctgttagttgagatgctcgccctgcctgaagccgtcctagaggagatcactaactactaccagaagaagttgaaagaggggacgtgcaaggctcaggagatggaggctgctgtcggcagactgcgccttcagaagctcccttataacccccagcaagaagagtcgtcggaggtgccagaaaggaaggtcctatctattctgagcagactcaaacaacagaattatgctcctaacttacaaagcccatacgcccaagtaccttgtatcctgctgtgccctcagctcgataagaagatggtaaggaggcagccttcaaaccactacgccctggatcagtgcacacctccgggactcgaccctgacattcggagccctttttttcagagcggtagtcagggcaaccgtgaacataattccgattcccgtaaatggctgtcatctgtaccagctcgaacccactag

SEQ ID NO: 59863 - DNA, 603 bp, Artificial Sequence
  Description of Artificial Sequence: Synthetic coding sequence
atggacaaccgaaatactcagatgtacaccgaggggaggaccaaagcacccggaacacagcctagcccaggcctgaggataactattaaacgcgcaggagtcgaaccaattatccctggcgtttctaaggtgatgtttcccgatgcctccgaagtgggcagcaagaagcatctcagctcagcatctcggggtccagaaaagggcccacgtctccgcgacgctttcgaaaaggggccaagcgagttgcggatccaagagcagggcccacctgccagacctggcaaaaagcaaccctcctgggtgcctcaggagggatcgcaggagcttcaggctggtcaggaccagtctgagctgggattgctcccatcatgggtcccggaggttcctgagggattgcagcaactcgggagcggaaaagagattaaagggcagcaaggccgacaaagaaaccgcggtatcggcgaagatcagcccccagagagttgccaggcaggccacggtgggagtcgtcttcttatccccgcacttcttgaagccgaagggggacggtccccagaggtgaagacctcgctggcaaacatggtgaagccgtgcctctattag

SEQ ID NO: 59864 - DNA, 1341 bp, Artificial Sequence
  Description of Artificial Sequence: Synthetic coding sequence
atggcacagcctggggcagtggagcatgcttgccatccgtctacactgggcggtcaaggcggaggctccctcgaagaggttagggacattggcgaacgtcgcgagcccgatagggcccagcagcagcctcaaaagcctgctgtcgccgctgggacacaaagcctgggcaacttccgccaggggtttatgaagtgtctgctggaagtggagaaaatggaagcctctcatagaagagcctcaaaggcacgttcccagactgcccaaaagtcgcctcggaccctcacccctgtgcccactagtgctccttccctgccacagaccccggcttcagtgcccgcaagtggcccatcatgggcaagattacctgccccaggaccagagccagctcccatgggcgcacccgtgccaacttcaatgccatgtcctgttctcttaggcccagccctcgaccttggatggcgccgtatggaacttttgcaccagtcatcagaacgaaccctgtcatatgccaaagcccgacaagagcctgaggaacaatctttgcaaaaactctaccagaacagggagaaatccgaagagcaactgaccctgaagcaggaagaggcatttcgaagttacttcgaaatctttaacggtccgggagaagtcgacgcccagtcgctgaagaatatcctgctccttatggggttctcagtcacattggcccaggtcgaggacgccttgatgtctgctgacgtcaatggggatggacgggttgacttcaaagatttccttgctgttatgaccgatacccgcaggttcttttgtagcgtagagcagaatgcattaagcgacatggccccacacaacccacacaccctgctatttgagatcttaagcctactcgtggagatgctcgctttaccggaagcggttctcgaggagattacaaattattatcagaagaaactaaaggagggcacctgcaaagcccaggagatggaggccgctgtcggcagactgaggcttcaaaaactgccttacaaccctcagcaggaggaatctagcgaggttccagagcgaaaggtgctgtctatcctgagtagactgaagcagcagaactacgctcccaacttacagtcaccatatgctcaggttccttgtatcttgctgtgtccacaactggacaagaagatggtgaggcgccagcctagcaatcattacgctcttgaccagtgtactccaccgggattggatccagatatcagaagccccttcttccaatccggaagtcagggaaatagggaacataacagcgacagccgcaagtggttgagcagcgttccagccaggacacactag

SEQ ID NO: 59865 - DNA, 810 bp, Artificial Sequence
  Description of Artificial Sequence: Synthetic coding sequence
atgaagcggagcttgaatgagaactcagcgaggtcaacagctgggtgtcttcccgtcccgttattcaatcagaaaaagagaaaccggcagcccctgacttctaatcctctgaaagatgactccgggatcagcaccccatctgataattacgattttccgcctctgcccactgactgggcctgggaggccgtgaatccagaactggcacccgttatgaaaacagttgacacgggacagattcctcactcagtatctaggcctctccgctcacaggactctgtgtttaatagtatccagagcaacaccggtcggtcccaaggagggtggtcgtatcgagatgggaataagaacacaagtttgaaaacatggaacaagaacgattttaagcctcagtgcaaaagaactaacttagttgcaaacgatgggaagaattcatgtcctgtaagtagcggcgcacagcaacagaagcagctgagaatccctgagccccctaacctatcacgtaataaggaaaccgagctgttacgtcaaacacactcttcaaagatctcaggatgcaccatgcgcggactggacaagaacagcgctctgcagacacttaaacctaatttccagcagaaccagtacaagaagcagatgttagacgacattcctgaagataacactctcaaagagacctcgctgtatcagctacagttcaaggaaaaggccagttcactacggattatctctgccgtgattgaatctatgaagtattggagggagcatgcacagaagaccgtccttctctttgaggtcctcggcagttag

SEQ ID NO: 59866 - DNA, 963 bp, Artificial Sequence
  Description of Artificial Sequence: Synthetic coding sequence
atgaagagatctctcaacgagaacagtgctcggagtactgcagattgggcctgggaagccgttaaccccgagctcgcccctgtgatgaaaacagtcgatacaggccagataccccactctgtctctagacccttgcgtagtcaggatagcgtttttaactcaatccagtcaaatacaggcaggtcccaggggggttggtcttatagggacggcaacaaaaatacaagtttgaaaacctggaacaagaatgacttcaagcctcagtgcaagcgaaccaacctcgtcgcaaacgatggcaagaatagctgcccagtgagcagtggcgcacagcaacagaaacaactcaggatccccgagccgcctaatctctcacggaacaaagaaacagagttactgagacagacacactcttccaagatcagcggctgtactatgaggggcctggacaaaaattctgccctgcagacacttaagccaaacttccaacagaaccagtacaagaaacaaatgctcgatgacatcccagaggacaacactttgaaagaaacttctctctatcagctccagtttaaggagaaggcgtcatctctgagaatcatctccgcagtgattgaatctatgaaatactggcgagagcacgcgcagaaaaccgtgctgcttttcgaagtgttggcagtcctggatagcgccgtgaccccaggtccctattacagcaagaccttcctgatgagagacggcaaaaatacactgccttgtgtgttttatgaaatcgatcgcgaactcccacgtttgatcagaggccgagttcaccgctgcgttggaaattatgaccagaaaaagaatattttccaatgcgtttccgtgaggccggcaagcgttagcgagcagaaaacatttcaggcattcgttaaaatcgcggacgtggagatgcagtactacatcaatgtcatgaacgagacatag

SEQ ID NO: 59867 - DNA, 1092 bp, Artificial Sequence
  Description of Artificial Sequence: Synthetic coding sequence
atgaaacgcagcctgaatgaaaatagtgcaaggagtacggccggatgcttgcctgtcccactctttaaccagaaaaagcggaatcggcagccgctgacatcaaaccccctgaaggatgactctgggatctctacaccctctgataactatgatttcccgccacttccaacggattgggcctgggaagctgtgaacccggaactggctcccgtgatgaagacagtggatacggggcagataccgcacagcgtgagtagaccccttagatcccaggacagcgtgttcaacagcattcagtccaatacaggtaggagccagggaggctggagctaccgggacggcaataaaaatacctccctaaaaacatggaataagaacgacttcaaacctcagtgtaagagaaccaacctcgttgctaacgatgggaaaaatagttgccctgtgtcctctggggctcagcagcagaagcaattgaggattcctgagcctcctaatctgtctagaaacaaagaaactgaattgctcaggcagacccacagttccaaaatatcaggctgtaccatgagagggcttgataagaacagcgcgctacagaccctgaagcctaacttccagcagaatcagtataaaaaacagatgcttgatgatatccccgaggataacaccctcaaggaaacttcgctgtaccaacttcaattcaaagagaaggcctctagcctccgtataatttcagccgtgatcgagagtatgaagtactggcgggagcatgctcagaaaacagtgcttctcttcgaggtcttagcagtgcttgactccgcggtgactcccggtccatattacagtaagactttcctgatgcgggatggcaagaacacactgccatgcgtcttttacgaaattgacagagagttgccaagattaattcggggaagggtgcataggtgtgtggggaactatgatcagaagaagaacatctttcagtgcgtgagcgtgcggcctgcctccgtgtccgaacagaaaactttccaggccttcgttaagatcgctgacgtggagatgcagtattatattaacgtgatgaatgagacatag

SEQ ID NO: 59868 - DNA, 1044 bp, Artificial Sequence
  Description of Artificial Sequence: Synthetic coding sequence
atgaagcgcagccttaacgagaacagcgcccgatccactgccggatgtcttcccgttcctttgttcaaccagaagaagcgaaacaggcaacctctgaccagcaaccccctaaaagacgattccgattgggcttgggaagccgtcaatcctgagctggctccagtaatgaaaacagtggacacgggccagattccacacagcgtgagccggccactgcgcagccaagactccgtattcaactccatccagagcaataccgggcgttcccagggcggatggtcttaccgggacggtaacaagaacacaagtctcaagacatggaacaaaaacgatttcaaaccgcagtgcaagagaacaaacctggtggccaatgatggaaaaaactcatgtccggtatcctccggagcccagcagcaaaaacaactgaggatccctgaacccccaaatctcagccggaacaaggagactgaactgctgcgacagacccactcctccaagatatccgggtgcactatgagggggctagacaaaaacagtgcgctgcagacgctgaagccaaactttcaacagaatcaatacaagaagcagatgcttgacgatatccctgaagacaatacactcaaggaaacaagtctataccagttgcagtttaaggaaaaggcaagttccctacgcatcattagcgctgtcatcgaatcgatgaagtattggcgcgagcacgcccagaagacagtgctgctgtttgaggtgctggctgtgctggactccgctgtgacaccgggtccttactattccaaaaccttcctgatgcgggacggaaagaacaccctcccatgcgtattctatgagatagatcgcgagctacctcggctgatccgcggacgagtgcaccgttgtgtgggaaactacgaccagaagaagaatatctttcagtgcgtgtcggtgagacccgcaagcgtctccgaacagaagaccttccaggctttcgtgaaaattgcagatgtggaaatgcagtactatatcaatgttatgaacgagacctag

SEQ ID NO: 59869 - DNA, 1092 bp, Artificial Sequence
  Description of Artificial Sequence: Synthetic coding sequence
atgaaacggtcgcttaatgaaaactcggccagaagcactgcaggatgtctgccagtgccactctttaatcagaagaaacggaatagacagccacttacttcgaatcctctgaaggatgatagcgggatctctactccaagtgacaactacgacttcccgcctctgcctacagattgggcttgggaggctgtgaatccagagttggcacccgtgatgaaaaccgtggacacaggacaaattccacactctgtgtctcgcccattgcgctctcaagactccgtgttcaatagcatccagagtaatactggcaggtcacaggggggttggtcctatagggatgggaacaagaatacaagccttaaaacttggaataagaacgacttcaagcctcaatgcaagaggaccaatcttgtggcaaacgatggcaaaaactcctgtcctgtaagcagtggggcacagcagcaaaaacagctgcggattcccgaaccccctaacttgagtaggaataaagagacggagttgctcaggcagacacacagctcgaagatttctggatgcactatgcgtggactggacaagaattcggccttacagaccctgaagcccaattttcagcagaatcagtacaagaaacagatgttggatgacatccctgaagataatacactgaaagaaaccagcctctatcagcttcaattcaaggaaaaagcgagttctttgcgaataatctctgctgtgattgaaagcatgaaatattggagagagcacgcccagaaaaccgtactgctttttgaagtcctcgccgtgcttgacagcgccgtgacccctgggccatattatagcaaaacatttttgatgagagatggaaaaaacacgctgccttgcgtgttttacgagattgaccgggagctcccaagacttatcagaggcagggtacatagatgtgtgggcaattacgaccagaaaaagaacatctttcagtgcgtcagcgttcggcctgcttccgtctccgagcagaagaccttccaggccttcgtgaagatcgccgacgtagaaatgcagtactacatcaatgtgatgaacgaaacctag

SEQ ID NO: 59870 - DNA, 1092 bp, Artificial Sequence
  Description of Artificial Sequence: Synthetic coding sequence
atgaagcgctcgttaaatgagaattccgccaggtccaccgctggatgcctgccagtgcccctgttcaaccagaaaaagagaaacaggcagcccttgacaagcaatccgctcaaagacgatagcggaatctccacgcccagtgacaattacgacttccccccattgccaaccgactgggcctgggaggctgttaatcctgagctggcccctgtgatgaaaaccgtcgataccgggcagatcccccactctgtatctaggcctctgcgatcccaggatagtgtctttaacagtatccagagtaacactggacgaagccagggtggatggagctatcgcgacggaaataagaataccagcctgaaaacgtggaataaaaacgacttcaagcctcagtgtaagaggacaaatctcgtggcaaatgacggaaaaaacagttgccccgtatcctctggcgcacaacaacagaaacagttacggatacccgaaccgccaaacctgtctcgcaacaaagaaacagagctgctacggcagacccacagctccaaaattagtggttgtacgatgagaggattggataagaatagtgcccttcaaaccctcaagcccaactttcagcagaatcaatacaagaagcagatgttggacgatattcctgaggataatacactgaaggaaacatcattgtaccagctgcaattcaaagagaaagctagcagcctccgaatcatatccgccgtcattgagagcatgaaatactggcgggagcacgcccaaaagacagtcctactctttgaagtgctagctgtgcttgacagcgcggtgacgcctggaccatattactccaaaacctttctcatgcgggatgggaaaaatactctcccctgcgtgttttatgagattgaccgggaactaccaaggcttatccgaggccgtgtgcaccgatgtgttgggaattacgaccagaaaaaaaacatttttcagtgcgttagtgttagaccagcgagcgtaagtgagcagaagaccttccaagcatttgtgaaaattgctgacgttgagatgcagtactacattaatgtgatgaatgaaacctag

SEQ ID NO: 59871 - DNA, 1275 bp, Artificial Sequence
  Description of Artificial Sequence: Synthetic coding sequence
atgggtagttcttccctttccgaggactaccgtcagtgcctggaacgagagctcagaaggggaagggccggtgtgtgcggcgacccgtcgctccgtgctgtcctttggcaaattttggtagaggatttcgatttacacggcgctttgcaggacgacgcccttgccctgctgaccgacggactctggggcagagctgacctcgctcctgcccttcgcggattagccagagctttcgaacttctggagcttgcagctgtccatctgtatctgcttccttggcgcaaggagttcacgaccatcaagacattctccggaggatatgtgcatgtgctgaaaggggtattgagtgacgatctcctactgaagtcatttcagaagatggggtacgtgagaagggactcccaccggctgatggtgaccgctttacctccagcttgtcagctggtccaggtagcgctgggctgttttgctctgagactagaatgcgagattctgggcgaagtgcttgctcaactgggaacctctgtattgcccgctgaagagcttcttcaagccagaagagccagtggagacgttgcctcatgcgtcgcctggctgcagcagaggcttgcccaagatgaagagcctccccctttgcctcccagagggtcccccgcagcataccgcgcaccactggacctttatcgcgatctgcaggaggacgaagggtccgaagacgccagtttgtatggtgagccttcaccaggacctgactcgcctcccgctgaattagcctaccgcccacccctgtgggaacaatccgcaaaactgtggggaaccggaggcagagcctgggagccccctgcagaagagttaccacaggcctccagccctccctacggagcattggaggaaggtctcgagcccgagccaagtgctttctcctttctttccctaaggagggagctgtcacgcccaggggatcttgctacccccgagagctccgccgctgccagcccaagaagaatccgggctgaaggggtgccagcttctgcttatcgcagtgtgtccgagccaccagggtaccaagcacattcgtgcctctcccccggagcccttccgaccctgtgttgcgacacttgtcgacaattacatgcagcccactgcgccgcactccctgcttgtaggcccggacacagcttacgcgtactcctgggggacgcgcagagaagactgtggctccaaagggcccagatggataccctcctttacaattctcccggagctcgcccttag

SEQ ID NO: 59872 - DNA, 459 bp, Artificial Sequence
  Description of Artificial Sequence: Synthetic coding sequence
atggggtcctcttctctgtcagaggactacagacagtgtctggaacgtgagctccgaagagggcgtgccggtgtgtgtggagatccttctctgcgagccgtgttatggcagatccttgtggaagactttgaccttcacggagcactgcaagacgatgcactcgccctgctcaccgacggactatggggcagagctgacctggccccagccctgaggggtcttgctagggcattcgaattacttgagctggcagccgtccatttgtacttgctgccttggcgcaaggaattcaccactatcaagacttttagtggcggatatgtgcatgtactgaaaggggtcctttcagatgacctattgctcaaaagtttccagaaaatgggctatgtcagacgggactcgcatcgtctgatgctgtgctggtcccagtctgcgggactctgcagagtgcatgggtag

SEQ ID NO: 59873 - DNA, 552 bp, Artificial Sequence
  Description of Artificial Sequence: Synthetic coding sequence
atgaaaaaagtgaagaaaaaacgtagcgaggcaagacggcatagggacagtacatcgcagcatgccagcagcaatagcacaagccagcagccttcgccagagagtacacctcagcaaccatccccagaatcgaccccccagcatagcagcctggaaacaacgtctcggcagcccgcattccaggccctgcccgctcctgagatccgcaggtcctcttgctgcttgctaagccctgatgccaatgtgaaggccgctccccagtccagaaaagccggacctctgatcagggccggtcctcactcctgcagttgcgcgacatgcccgtgcagctccgcatgctggcgacgactgggactgtgtcatagtcgcatctttgatgttctcctccccagggactggcaaatggcgcctgggcgaggcctgcccaacctgctgaccttttatcgtaagtctagtaggaaaccatcctctcatagaaatgcatgtcccccaagccccaggaactgcggctgtggtagcgggggtagcaggagctgcttgctgcatcactag

SEQ ID NO: 59874 - DNA, 579 bp, Artificial Sequence
  Description of Artificial Sequence: Synthetic coding sequence
atgaaaaaagttaagaaaaagcgctctgaggcacggagacaccgtgactcgacatcccaacacgcctcctccaactcgacatcacagcaacctagtccggagagcactcctcagcagccatctcctgagtcgacgcctcagcagccatctccggagtcgacaccacaacatagtagcctggaaacaacctcccgccagcctgctttccaagcactgcccgctccggagattcggaggtcgagttgttgtctgctgtctccagatgcaaatgttaaggctgcaccccagtcaagaaaagccggacccctgatacgagcaggcccacactcgtgctcatgtgccacctgcccctgcagctctgcctgttggcgtagactcgggctttgtcacagtcgtatcttcgacgtgcttctccccagagattggcagatggcccctggtaggggcctgccaaatctgctcactttttatcgcaagtcatcccgtaagcccagttctcatcggaacgcatgcccgccttcccctagaaactgcggctgcggctcaggaggtagcaggtcttgcctcctacaccactag

SEQ ID NO: 59875 - DNA, 579 bp, Artificial Sequence
  Description of Artificial Sequence: Synthetic coding sequence
atgaaaaaggtcaaaaagaaaaggagcgaagctaggaggcatcgggactccacttcccagcatgcctctagtaattctacttctcagcagccttcaccagagagtacaccacagcagccatcccccgaatctactccacagcagcccagcccagagagcacacctcagcacagcagtttagagactacgagccggcagcctgcgttccaagcactgcccgcacctgagataaggcgcagttcttgctgtctcctgagccccgatgctaatgttaaagcagctccacagagcagaaaggccggtcccctgataagagccggtccgcatagttgcagttgtgctacatgtccatgttcaagtgcctgctggcggaggctgggattgtgccattctagaatctttgacgtactgttaccccgagactggcagatggctcccggacggggtttacccaacctattaacattttacagaaaaagtagcagaaagccctcatcccaccgaaacgcctgcccgccaagtcctaggaactgtggatgtggcagcgggggatctagatcatgcctgctacaccactag

SEQ ID NO: 59876 - DNA, 579 bp, Artificial Sequence
  Description of Artificial Sequence: Synthetic coding sequence
atgaaaaaggtgaagaagaaacgttcagaggctcgtagacaccgggattcaactagccagcatgcaagtagtaattcaacctcacagcagccatccccagaatccacacctcagcagccatcacccgagtccacacctcagcagccctcacccgaaagcaccccccagcattctagccttgaaactacatcccgccagcctgcctttcaagccttacccgctccagagatcaggagaagttcgtgttgcctgctgtcccctgacgcgaacgtgaaagcggcaccccagtctcggaaagccggaccccttattcgggcaggaccccactcttgtagttgtgccacttgcccctgctcaagtgcctgctggcgtcggttgggtttatgccacagtcggatatttgatgtgctacttcccagggactggcagatggcacccggaaggggactgccaaacctgctcacgttctatcgcaaatcatcgaggaaacctagcagccatcgcaacgcctgtccaccttccccgaggaactgcggatgtggctctggaggctcccgctcttgcttgctgcaccattag

SEQ ID NO: 59877 - DNA, 579 bp, Artificial Sequence
  Description of Artificial Sequence: Synthetic coding sequence
atgaagaaagtgaaaaagaaaagaagcgaggcacgtagacatagagattcaacatctcaacacgctagctcaaacagtacatcccagcagccttctcccgaaagcacaccgcagcagccatcgcccgagagcactcctcaacagccttcgcccgagtcaacaccccagcactctagcctagagaccacatcccggcagcctgcatttcaggctctgcctgccccagaaatccgtagatcatcctgttgtctcctctctccggacgctaatgttaaggcggcaccccaaagccggaaagcgggtcccctgatcagagctggccctcactcatgctcctgcgctacatgcccttgctcgtcagcctgctggcggcgactggggctgtgccattcaaggatcttcgacgtgctgcttccacgagactggcagatggctccgggtcggggactgcctaatctactcacgttctatagaaaatcttcccgcaagccgtcaagccacaggaacgcatgccctccctcacccagaaattgtgggtgtgggtcagggggaagtcggtcttgcttgttgcatcactag

SEQ ID NO: 59878 - DNA, 21 bp, Artificial Sequence
  Description of Artificial Sequence: Synthetic coding sequence
tgatgtcttctccaccactag

SEQ ID NO: 59879 - DNA, 1005 bp, Artificial Sequence
  Description of Artificial Sequence: Synthetic coding sequence
atgcccctggaggtcgtagtggaacttcagatccgcgctatatcctgcccaggcgtgttcctgccaggtaaacaggacgtatacctgggagtatatctgatgaaccagtacctggagacaaactcattcccatccgcatttcctattatgatccaggagagtatgaggttcgaaaaaggaattgcaccgaaaattgagttctccacccgtacagctatccgggagtgcgtgttccttcacagaaatcggttcctggaagagaggcacgaaagtcgacgacctctttctacatctcacgagcccatattcccgctgaatacgattaagatgaagttgaaagaaaataatctcaatagactcccgaaaggtatgcaggccagagctccttctcagtacagcacaagacacttcttccaggaccagccagcccagctcaacctcgggaataatttcaaaatctctggcggatcaaagccccctttcgtggtacggcacgtggattcggccaagccatttggcgagaacatctcggaacaccatctgcgtaggagtcgccgaaaaagcaagttctcggactttccctttcctacacggcgagcgagctcccttgattccctcgcagccaatgtcaaagtgatcaaggagccagacgagcgaattgtattaagatcagatagttctagctgcctggattcatcccagtttggaaagtcttcttccagcaaacaaggggacgccgatttccacggaaaggccagctttgccacctaccagcatagcacttcccctgggcctctggaccagccattgttaagggagcggtttcatccgggatctcaatctacatggaagaatattcatgagcgggtttgtagcctcctgacctcccatcgcgctcagctgcatcagaacaaagaagacagtacttctgaggtgaactatattatcgagagaccgtcttacccactgaagaagtactcccttcatgaacaacgatacttttag

SEQ ID NO: 59880 - DNA, 903 bp, Artificial Sequence
  Description of Artificial Sequence: Synthetic coding sequence
atgtctcctagcatgctgactgggaactcccccagaggttgtcggttgccctccatcagctccaccacctgtgggcgtcagctcgagaaggtgcccgaaaagcgcgatagcgggatgacagaggtggaaaggacatattcagctaattgttctgatttcttggagagtaaaggatgcttcgcgaataccacgccttctggaaagagcgtcagttcctcatcatctgtggaaacgggcccatccgtcagcgagcccccaggtctccctcgtgtatctgcatatgtagatacgacggccgacctggaccgaaagctctcgttctcccattctgatcacagttctgagatgagcctgccagaagtacaaaaggataagtatccagaggagttctctctgctgaagttgcagacgaaggatgggcaccgacccgaatggaccttctacccaaggttctccagcaacattcacacctaccatgtgggtaagcagtgcttctttaacggtgtgtttttgggcaataagagatccctctctgaaagaaccgtcgataaatgttttggaaggaagaagtacgacattgacccgaggaatggtattcctaagctgacccctggggataacccatacatgtatcctgaacagtccaaaggctttcataaagcgggatccatgcttcctccagtgaatttcagcatcgttccttatgagaagaagttcgacacctttattccgttagagccgcttccacagattcccaatctgccgttttgggttaaggagaaagcgaactccctcaaaaatgaaatccaggaagtcgaagagttggacaactggcaacctgcagtgccactgatgcacatgctacatttgagcggagcgttggactttcctcgccaaagctag

SEQ ID NO: 59881 - DNA, 903 bp, Artificial Sequence
  Description of Artificial Sequence: Synthetic coding sequence
atgtccccctccatgcttacaggaaacagcccccgaggctgcaggttgccaagcattagttctaccacctgtggacggcaactggagaaggtcccggagaagagagattctggtatgaccgaagtcgaaagaacctacagcgccaattgcagcgacttcctggaatcgaaagggtgcttcgctaacaccactccaagtgggaagtctgtgtcatctagctcatccgtcgagaccgggccttctgtgtctgagccccctgggcttccacgggtgtcagcctatgttgatacaaccgcggatctggataggaaactgagctttagccactccgaccattcatctgagatgtccttacctgaagtgcagaaggacaagtatcctgaggagttctcactcctgaagctgcagacaaaggatggacacagaccagagtggactttctatccccgattcagcagtaatattcacacgtaccatgtgggcaagcagtgctttttcaatggagtgtttttggggaataaacggtccctcagtgagcgtaccgtagataagtgctttgggaggaagaaatatgatattgaccctcgaaatgggattccgaagttaacaccaggggacaatccctacatgtaccctgagcagagcaaaggtttccataaggctggaagtatgttaccccctgtgaatttctcaatcgttccctacgaaaagaagttcgatacctttatccctctggaaccactgccacaaatcccaaatttaccgttctgggtgaaagagaaagcgaactcccttaagaatgagattcaagaagtggaggaattagacaattggcagcctgcggttccgctgatgcacatgctgcacctgtccggcgcactggacttccccaggcaatcgtag

SEQ ID NO: 59882 - DNA, 1338 bp, Artificial Sequence
  Description of Artificial Sequence: Synthetic coding sequence
atgagccctcctggtatgtggcagcccggagtacaacagccgggaatctctcaacaggtgcctagtcatcccgacatgagtcagccaggaatgtcacagcaggtgccttcgcagccaggcatcaggcagcctgacacctcccagagctgtaagaaccaaaccgacatgtcccaacccgatgctaatcagagcagtctctcagactccaatcagaccggcattatccagcccagcccctcacttctgggcatgaaccagatggacatgaaccagtggagtgcctccctgtacgaaatgaatcaagtcgacatgaaacagcctagtatgtcccaggccggaatgcggcaatccggtactaatttgccggacataaatcaacccggtatgaaacaacccggtacgtggcagcttggacgaagtcagccgggaatgtggccgcaaagtctgtcagaactggttctctcggaggcttcgatttcccaaccaggccctcctcaaagggctccaagtcagagcggaccccgtcagtcctctacctctcaggctggaacaaaccagtccggaatttcccagcctgtgatgtggcagctggacatgcggcagagcggcggttcccagccgagcatgcggcaggtgggcacctcccagagtggaacctctcagatcggtatgagtcagcctggaacatggcagacgggcctgagccaaccagtgcccaggcagcctaacaagtcgcccccaggcatgtggcagagaggtatgtggcagccgggaatgagccagcaggttccctctcagctcgggatgaggcagccaggcaccagccagagtagtaagaatcagaccggtatgagccaccctgggagaggccaacctggcatctgggagcccggacctagccagcccggtttgagtcagcaggatctgaaccagctggtgctttctcagcccggactctctcagcctggacggagccagccatccgtgtcacagatggggatgaggcagacgagcatggattacttccagatccgccacgctgaagccggagattgccccgaaatcctccgcctgatcaaggagctggcagcttgcgagaacatgctggacgccatggaacttactgcggctgacttactccgagacggcttcggtgataaccccttattttattgtctgatcgctgaggttaatgatcaacagaagccctccggcaaattgacagtgggtttcgccatgtactacttcacctacgatagctggacagggaaggtgctatacctcgaggatttctacgtcacacaggcctatcaggattcccatcataactcaatgtag

SEQ ID NO: 59883 - DNA, 1527 bp, Artificial Sequence
  Description of Artificial Sequence: Synthetic coding sequence
atgtccccacccggaatgtggcagcctggcgtgcagcagccaggaatctctcagcaagtcccttctcatcctgatatgagccaacccggtatgtcgcagcaagtgccctctcagccagggataagacagcccgacacaagccagagctgtaaaaaccagacagacatgtcccagccagacgccaatcagtcctcactgtccgactccaatcagacagggatcatccagcctagtccttcactcttgggaatgaaccaaatggacatgaaccagtggagcgcctcattgtacgaaatgaatcaagtggatatgaagcaaccatctatgtcccaagccggaatgcgccaatccggtacaaacctgcctgatataaaccagcctggaatgaagcagcccggaacttggcagcttgggcgtagccagcctgggatgtggcctcagagtttgtcagagctagtcctgtcagaggcatcaattagccagccgggaccaccccaaagagctccatcccagtcgggtccgagacagtcttcgacctcccaggccggaaccaaccaatccggcataagccaacctgttatgtggcaactagacatgcgccaatctggtgggagccagcccagcatgagacaggtcgggacctcccagagcggaactagccaaattgggatgtcccagccaggaacgtggcagactggcttgtcccagccagtacctagacaaccaaataagagcccgcctggcatgtggcagcgaggaatgtggcagcctgggatgagccaacaggtgccctctcaactcggcatgcggcagcccggaacgagtcagagcagcaagaatcagactggaatgtcccacccaggtcgcggtcaaccgggtatttgggaaccaggaccaagccagcccggtttgtctcaacaggacctgaatcagttagtcctttcccagccaggactcagtcagccaggtaggagccaaccatcagtgtcccagatgggaatgcgacaaacaagcatggactattttcaaataagacacgcagaagctggggactgtcccgagattcttaggctaataaaggaactcgctgcctgtgaaaatatgttggacgcgatggaattgaccgccgctgatctactccgcgacggcttcggagacaatcccctcttttactgtttgattgcggaagtgaatgaccagcaaaaaccaagtggaaaactcactgttggattcgcaatgtactactttacctatgattcatggaccggtaaggtgctatatctggaggatttctacgtgacgcaggcctatcagggccttggaatcggcgcagagatgctcaaacggctgtcccagattgctatcacaacccaatgtaactgcatgcatttcctggtagtgatatggaatcaggcctccattaattactacacttcccgcggagccctagatctgagctctgaggaaggctggcacctctttcggtttaatcgtgaggaacttctggatatggcttgggaggagtag

SEQ ID NO: 59884 - DNA, 1899 bp, Artificial Sequence
  Description of Artificial Sequence: Synthetic coding sequence
atgaaccagtcggggacaaaccagagctccctctcagactctaatcaagccggaatcaaccagccatctacaaactctttgggcatgaaccagatggatatgaatcaaggcagtgcctccctttatgaaatgaaccaggtcgatatgaagcagccatctatgtctcaggccggaatgagacagagtggcaccaacctgcccgatatcaatcagcccgacatgaagcagccagacacctggcagctcgggaggagtcagccaggtatgttgcaacaagagctgtcacagctcgtgctctctaaggcgggaatttctcaaccagatccctcccaaccaggccctagccagtcagggcctagtcaaagtcgcatgcgtcagatcggaactaaccagtcgggcatgtctcagccagtgatgcaacagctggattcccaatctgggggtagtcagccctctatgcggcaggtgggcaccagtcagctggggacaagccagataggcatgtctcagccagggacctggcagaccggtctgagtcagcctgtcctgaggcaacccaatatgagtccaccaggcatgtggcaaccaggagtccagcagcctggtatcagtcagcaggtaccttcccaccccgatatgtcacagcccggtatgagccaacaggtgccctctcagcccggaatacgccagccagacacaagccaatcttgcaaaaaccaaactgatatgagccagcccgatgccaaccagtcaagcctttccgattcgaatcagaccggtattatccagccatcacccagtttactggggatgaaccagatggatatgaaccagtggtctgcaagcctttatgaaatgaaccaggtggatatgaaacaacctagtatgtctcaagcagggatgcgtcagagtgggacaaacctgcctgacatcaatcagcccggaatgaaacagcctggcacatggcaactcggacgatcccaaccaggaatgtggccacagtctttgtccgagctggtgcttagtgaggctagcatcagtcagccaggcccaccacagagagctccttcccagtcagggccacgccagagttctacgagtcaggctggtaccaatcagtccggaatctcccagcctgttatgtggcagctggatatgcgccagtctgggggttcccagccatccatgcggcaggtggggactagccagagcggtaccagccagattggcatgtcacagcccggaacttggcagacaggtctaagccagcctgtgccacgccagcccaacaagtccccccctgggatgtggcagcggggaatgtggcaaccaggaatgtcacagcaggtgccatcccagctgggaatgcgtcagccaggtacttcccagagtagtaagaatcagacaggcatgagccacccaggcagaggacagccaggaatctgggagcctggacccagtcagcccggtctatctcaacaggatctcaatcaactggtcctgagtcagccaggtctgtcacaacccggacgctcacagccctccgtttcccagatgggtatgagacagaccagcatggactacttccaaatccgacacgcagaggctggggattgcccagaaattctacgcctgatcaaggagctcgcagcttgcgaaaacatgctggatgccatggaattaacggctgccgacctgctcagagacgggtttggggataatcccctgttctactgcctcatcgctgaggtgaacgaccagcagaaaccgagtggaaagctcactgtgggttttgcaatgtactacttcacatatgatagctggaccgggaaagtcctctacctggaggatttttacgttacccaggcctatcaagattcacaccacaattctatgtag

SEQ ID NO: 59885 - DNA, 192 bp, Artificial Sequence
  Description of Artificial Sequence: Synthetic coding sequence
atgacaaggattaaaatcagcgtttgcatctgttttcgctatttcgagttttgtttcttctatgcgctgaacatcctgtttcagaaggtcagcgaggccaactcccagaccgaattgctgctaaggccccattgcaagaatattctgtttaacgtctcctttatgattgatcttcaagcggctcacttttag

SEQ ID NO: 59886 - DNA, 1062 bp, Artificial Sequence
  Description of Artificial Sequence: Synthetic coding sequence
atgggatctttgtattcagagtacctgaatccaaataaggtgcaggagcactataattatactaaggaaacgctggagacacaggaaaccacatcgaggcaggtcgcctcagcatttatcgttatcttatgctgcgccattgtggtcgaaaacctgctggtcctgatcgccgttgctcgtaattcaaagtttcattccgccatgtaccttttcttgggcaacctcgcagcctccgacctcctcgccggagtggcatttgtggcaaacaccttgctatccggctcagtgacactgagactgactcccgtgcagtggttcgcccgagaaggttcagctttcattaccttgtccgcttctgtcttttccctcctggccatcgccattgaacggcatgtggcgattgcaaaggtcaaattatacggctcagacaagtcctgcaggatgctgctgctgatcggtgcttcctggctaatcagtctcgtccttggcggactgcctatcttgggctggaactgtctcgggcatctggaagcctgttcaacagtcctgccactctacgcgaaacattatgttctgtgcgtggtcaccatcttcagcataatcctgctggccatcgtagctctgtacgtacgtatctactgtgtggttagaagtagccatgcggacatggccgcacctcagactctggccctcttgaagacggtgacaatcgtgctgggggtgtttatagtgtgctggttgcccgctttctcaatcctgctgcttgattatgcttgtcccgtgcactcgtgtcctattctgtataaagcgcattattttttcgcagtatccaccttgaactcactgcttaacccagtgatctatacatggagaagtcgcgatctgaggagagaggtgctgcggccactgcagtgttggagacccggagttggagtgcagggaaggagacgcggagggacccctggccaccatctgctgcccctgcggagctcatcttcgttagaaaggggaatgcatatgcccactagccccacatttctagaagggaataccgtggtttag

SEQ ID NO: 59887 - DNA, 789 bp, Artificial Sequence
  Description of Artificial Sequence: Synthetic coding sequence
atgctggccctggaggcagcacagttggacggtcctcattttagttgtctttaccctgacggcgtcttttatgatctcgatagttgtaagcacagctcctaccctgattccgaaggcgcacctgattctttgtgggactggaccgtggctccacctgtccctgcgactccatacgaagcatttgaccctgctgcagcagctttctcgcaccctcaagccgcacagttgtgctatgagccccctacctatagtcccgctggtaaccttgaactggcccctagcctagaggccccaggacccggattgccagcatacccaaccgagaacttcgcgagccagactcttgttccaccagcttacgccccataccccagccctgtgctgtctgaggaagaggacctgccgctcgactcccccgctttagaggtaagcgactctgagtctgacgaggccctcgtcgctggccctgagggcaaaggttcggaggcgggaactagaaaaaaattacggctgtaccaattcctcctgggcctcctgactcggggagacatgcgcgagtgcgtatggtgggtcgaaccgggtgccggagtgttccagttctcttccaagcacaaagagctcctggcgcgtagatggggtcagcagaaggggaatcgcaaaaggatgacctatcaaaagttagctcgcgctctacggaactatgcaaagactggtgaaattcgcaaggtaaagcggaaactcacttatcaatttgactccgccctcctccctgctgttcggcgagcctag

SEQ ID NO: 59888 - DNA, 768 bp, Artificial Sequence
  Description of Artificial Sequence: Synthetic coding sequence
atggcatcgtccgatctggagcaactctgctcacacgtgaacgaaaaaattggaaacataaagaagacactgtctcttcgtaactgcggccaagagcccacacttaaaactgtgctgaacaagatcggagacgagattatagtgatcaacgaactgctgaacaaactggaattggaaattcagtaccaggagcagactaataacagcctgaaagagctgtgcgaaagtctggaagaggactacaaagatatcgagcaccttaaagaaaatgtcccgtctcacctcccacaggtgaccgtcacccaaagttgtgtgaaagggtccgatctggacccagaagagcctatcaaggtggaagagcccgaaccggtcaagaaaccaccaaaggaacagcggtcgatcaaagagatgccattcattacttgcgacgagtttaacggagtcccatcatatatgaagagcagactgacttataaccagatcaacgacgtgatcaaggaaattaataaggcagtcatctccaaatacaaaattttacatcagcccaaaaaaagtatgaacagcgtgacacggaacctgtaccaccgttttatcgacgaagagacaaaggacactaaaggacgttacttcattgtcgaggccgatataaaagagtttacgactctcaaagccgacaaaaagttccacgtgttgctaaatattctcaggcattgtaggcgtctgtctgaggttaggggcggtgggctgaccagatacgtgataacctag

SEQ ID NO: 59889 - DNA, 381 bp, Artificial Sequence
  Description of Artificial Sequence: Synthetic coding sequence
atgtcaacaattaatatggaagccgaagtggataagctggaactgatgttccaaaaagctgagagcgacctggactacatccaatacagactagagtacgaaattaagactaatcaccctgattcggctagcgaaaaaaaccctgttaccctgttgaaggagctttccgttatcaaatctcaatatcaaactctttacgcccgtttcaaaccagtcgccgtggagcaaaaagaaactaagtcaaggatttgtgccggaatgacaaagacgatgaatgttatccagaaactgcagaaacagactgatctcgacctgtctccgttaaccaaagaggagaaaaccgcagccgagcagtttaaatcccacgtccccgacttgtag

SEQ ID NO: 59890 - DNA, 777 bp, Artificial Sequence
  Description of Artificial Sequence: Synthetic coding sequence
atgaaaactccgaacgcacaggaagctgagggccagcagacccgcgctgccgctggcagagctaccggcagcgctaatatgacaaagaagaaggtatcccaaaagaagcaacggggacggccttcgagccagccgcgaagaaacatcgttggttgtaggatctctcacggctggaaagagggcgacgaaccaataacgcagtggaaaggaacagttctagaccaggttcccataaacccatctctgtacctggtgaagtacgatggcatcgattgtgtttacggactggagctgcaccgcgacgagcgggtattaagcctaaagatccttagcgaccgcgttgccagttcgcacatcagcgatgcaaacctggccaacacaatcatcggcaaggctgtggagcacatgtttgagggcgagcatggcagcaaagacgagtggcgcggaatggtgcttgctcaggcaccaattatgaaggcctggttctatatcacatacgagaaggatcctgtgttatatatgtaccagctgttggacgactacaaagagggagatttacggattatgcccgagtcaagcgaatctcctccaacagaacgcgagccaggtggagtggtggatggtcttattggcaaacacgtggagtatacaaaagaggacgggtctaaacggatcggtatggtgattcaccaggtggaaaccaagccttccgtctattttattaagttcgatgacgacttccacatttacgtgtatgatcttgtaaagaaaagctag

SEQ ID NO: 59891 - DNA, 777 bp, Artificial Sequence
  Description of Artificial Sequence: Synthetic coding sequence
atgaagacaccaaatgctcaagaagcagaggggcagcaaacccgggctgccgcagggagggccactggatcagctaacatgaccaagaagaaagtgtcacagaaaaagcagcggggaagaccaagtagtcaacctcgacgtaacatcgtcggctgcagaataagccacggctggaaagagggcgatgaacctattacacagtggaagggcacagtgctggatcaggttccaattaacccgtcactgtatctggtaaagtacgatgggattgattgtgtgtacgggctcgagctgcacagggacgaaagagtactgagccttaagatcttgtctgaccgagttgcttctagccacatctccgatgctaacctagctaacacgataatcggaaaggcagtcgagcatatgttcgagggggaacatggtagcaaggacgagtggcgcggaatggtgttggcacaagccccaattatgaaggcctggttctacattacttacgagaaagaccctgtgttgtacatgtatcagttactcgacgattacaaggagggggatctccggatcatgcctgagtcctcagagagtcctcctactgagagggagccgggaggcgtagtagatggtctgatcggcaagcacgtggagtatacaaaggaggacggaagtaaacgaatcgggatggtgattcatcaggtggagactaaaccaagcgtgtacttcataaaatttgacgacgactttcacatatatgtttatgaccttgtaaaaaagagttag

SEQ ID NO: 59892 - DNA, 234 bp, Artificial Sequence
  Description of Artificial Sequence: Synthetic coding sequence
atgaagacaccgtttgggaaggccgctgccggacaacgaagtcgtaccggagctggacacgggtccgtgtctgttaccatgattaagcgcaaagccgcacataagaaacaccgctcccggccaacatctcagccaaggggaaacattgttgggtgccgaatccagcacggttggaaggatggcgacgaaccactgacccagtggaagggtaccgtactggatcaactcctatag

SEQ ID NO: 59893 - DNA, 777 bp, Artificial Sequence
  Description of Artificial Sequence: Synthetic coding sequence
atgaaaacgccatttggcaaggcagcagctgggcaaagatctaggacgggcgcaggacacgggtcagtgtctgtgactatgataaagaggaaagctgcccacaaaaagcacaggagccgcccaaccagtcaaccccgaggcaatattgtaggctgccggatccagcatggctggaaagatggagatgagcccctgactcagtggaagggaactgtccttgaccaagttcccgtgaacccgtctctttaccttatcaagtacgacgggttcgattgcgtgtatgggcttgaattacatagggatgagcgagtttccagccttgaggtcctgccgaacagagttgcttctagccggatatctgacacccacttggctgaaataatggtggggaaggccgtagagcatatctttgagacagaagaaggctccaaaaatgaatggcgaggcatggtgctggcccaagcaccagtgatgaacacgtggttttacattacgtacgaaaaagatcctgtactctacatgtaccaacttttagacgattacaaggacggagaccttcgaattttacaggatagcaatgattcccctctcgccgagcgggagcctggagaagttattgactctcttgtcggtaaacaggtggagtacgcaaaggacgacgggagcaagagaacagggatggtcatccatcaggttgaggcgaagccttcagtttatttcataaagttcgacgatgattttcacatttacgtctatgacctggttaaaacctcatag

SEQ ID NO: 59894 - DNA, 750 bp, Artificial Sequence
  Description of Artificial Sequence: Synthetic coding sequence
atgtccccaccaactgtgccccctatgggggtagatggcgtgagcgcctacttgatgaagaaacgacacacacaccgtaaacagcgccgaaaacctactttcctgactaggaggaacattgtaggctgtcggatccagcatggctggaaggagggaaacgaaccggtggagcagtggaaaggaactgtactggagcaggtctctgtaaagcccacactctatatcattaagtatgatggcaaggactccgtgtacggacttgaactgcaccgggacaaacgggtcctggctctcgaaatcctgccagaaagagtcccaacacctagaatcgactcccgtttggccgactcactgattggcaaagcagttgagcacgttttcgaaggggagcacggcactaaagacgagtggaagggcatggtcctcgccagggcccctgttatggatacatggttttacatcacatatgagaaggatcccgttctgtacatgtataccttactggatgactacaaggacggcgacctacgcatcatacccgattctaactattactttcctaccgcggaacaggagcccggtgaagtggtggacagcctcgtcggcaagcaggtggaacacgcgaaggacgacgggtctaagagaacaggcatctttattcatcaggtagtcgccaagccgtcagtctatttcattaaattcgacgatgatatccacatttacgtttatggactggtgaaaactccctag

SEQ ID NO: 59895 - DNA, 696 bp, Artificial Sequence
  Description of Artificial Sequence: Synthetic coding sequence
atgaaaaaacgacacacccacagaaaacagaggcggaaacccacatttttgacacgaagaaatatagtcggttgtcgaatccagcatgggtggaaggagggaaacgagcctgtggagcagtggaaaggaactgtcctcgagcaggtatccgttaagcccacactgtatatcatcaagtatgatgggaaggactccgtgtatggccttgaattacacagagataaacgcgtgctggcgttggagatcttacccgagcgggtgcctacaccacgcatagactcaaggctggccgattctcttattgggaaggccgttgagcatgtattcgagggcgaacatggcaccaaagacgagtggaagggtatggtcttagcccgagcgcctgtcatggacacttggttttacattacttatgaaaaggatccagtgctgtatatgtacacgctcctggacgactacaaggacggagacctgcgaattattccggattccaattactactttccaactgctgaacaggagccaggcgaggtggttgactcacttgtgggtaagcaggtggaacatgctaaggacgacgggtcaaagcggacagggattttcatccaccaggtggtcgccaaaccaagtgtatacttcattaagtttgacgatgacatccacatttacgtgtacggcctggttaaaactccctag

SEQ ID NO: 59896 - DNA, 792 bp, Artificial Sequence
  Description of Artificial Sequence: Synthetic coding sequence
atgggccaaacagccctggcagggggttcctcctccacccccactcctcaggccttgtaccccgatctctcatgccctgagggcctagaagagttactgtccgctcctcctcccgatctgggcgctcagaggcgccacggatggaacccgaaagactgcagtgagaacattgaggtgaaagagggtggactgtatttcgaaaggcggcctgtggcacagtcaactgacggcgcaagggggaaaagaggatacagcaggggcctgcatgcgtgggagatctcttggccactggagcagagaggaacacacgccgtggtgggagttgcaacggccctggctcctcttcagactgaccattacgccgctctgctgggatccaattccgagtcttggggatgggatatcggcagaggcaaattataccatcagtctaagggcccaggagcgccacagtacccagccggtacccagggggagcagcttgaagtgcccgagcggttgctcgtcgtgctcgacatggaggagggcacgcttggatatgctatcggcggaacctatctaggcccagctttccgcggtctcaaggggcgaacactgtaccccgctgtgtccgccgtgtggggtcaatgtcaggtaaggatcagatatttaggagaacgaagagcggagcctcactcccttctgcacctctccaggctgtgcgtccgccacaatctgggggacaccagactcgggcaggtgtctgccctgcccctgccccctgctatgaagagatacctcctgtaccagtag

SEQ ID NO: 59897 - DNA, 792 bp, Artificial Sequence
  Description of Artificial Sequence: Synthetic coding sequence
atgggccagacggcccttgctggcggttcctcatccactcctactcctcaggcgctttatccggatctaagctgccctgagggtcttgaagagctgctctctgccccacctcctgacctgggagcccaacgccgtcatgggtggaatcccaaagactgctcagagaatatcgaggttaaagagggcggtttgtacttcgagagacgccctgttgcacagtctactgatggggcacgcggaaaacggggatactcacggggtctccacgcatgggagatttcatggcctttggagcagcgtggtactcatgcggtggtcggtgtggccacagctcttgcacccctgcaaacagaccactacgctgccctgcttggtagtaactctgaaagttggggctgggacattggacggggtaagctataccatcaatccaaaggtccgggtgcacctcagtatcccgctggcactcagggcgagcagctggaggttcccgagagactgcttgtggtcctggatatggaagaaggaactctcgggtacgccatcggagggacttacttaggaccagcattcaggggtctgaaaggaagaacgctctatcccgctgtgtctgctgtgtggggccagtgccaggtccgcatcagataccttggggaacgcagggccgaaccacactcactgctgcacctgtctcggctgtgcgtcagacacaacctgggtgacactagactcggccaagtgagcgccctgccattacctcctgcaatgaagagatatctgctttatcaatag

SEQ ID NO: 59898 - DNA, 2424 bp, Artificial Sequence
  Description of Artificial Sequence: Synthetic coding sequence
atgcgcctcagtcctgcacccctgaaactttccagaacacctgctttgcttgccttggctctgcccctcgcagctgccctggccttctccgacgaaacgcttgataaggtccctaaatcagagggatattgctcgcgtattctgcgagcccaggggacccgcagagagggctacaccgagttcagtcttcgggttgaaggtgatccagacttctacaaaccaggtacctcctaccgagtcaccttaagtgcagcgcctccgtcttactttcggggattcacacttattgcccttcgagaaaaccgggagggggacaaggaagaagaccacgcaggaacttttcagataatcgatgaggaggagacccagttcatgagcaactgcccggttgctgtgacagagagtaccccaagacgcaggacaagaattcaggtattctggattgcccctcccgctggaactggctgcgtgattctgaaggcctctattgtgcaaaagcgaatcatctattttcaagacgaaggtagcctgacaaagaagctttgtgagcaggacagtacgttcgatggggtcactgacaaaccaatcctggactgttgcgcctgcgggaccgccaagtaccggctgaccttctacggcaattggtctgagaaaacccatcccaaggattatcccaggagagcaaaccattggagtgctatcataggtggctctcactctaaaaattacgtcctgtgggagtacggaggttatgcctcggaaggcgtgaaacaggttgcagagttagggagcccagtgaaaatggaggaggagatccggcagcagagcgacgaagttttgaccgtcattaaggccaaggcccagtggcccgcatggcagcctttgaacgtgcgagctgctccttccgccgaatttagtgtggaccgaaccaggcacttgatgagcttcttgaccatgatgggcccttcccccgattggaatgttggtctgtcagctgaggatctctgcacaaaagagtgcggctgggtccagaaggtcgtgcaggacctgatcccttgggatgctggtacagattccggcgtgacatacgagtctcctaacaagcctactattccacaggagaagattaggcccctcacgtctctagaccatcctcagtcgccattttacgatcctgagggagggagcatcacacaggttgcacgggtagtgatagaacgcatagcacgaaaaggcgaacagtgtaatatcgtgcccgacaacgtggatgacatagtggcagacttagctcctgaggagaaggacgaagatgatacgcccgagacttgcatctacagtaactggtcgccatggtccgcctgctcgtcctcaacatgtgataaaggcaagcggatgcgccagcgcatgttaaaagcccagctggatcttagcgttccttgccccgacacacaggatttccagccctgcatgggtccgggttgcagtgacgaggacggcagtacatgtaccatgagtgagtggattacttggagcccttgctctataagctgtggaatgggcatgaggtccagagaacggtatgttaagcaatttcccgaagatgggtcggtgtgcaccttaccaaccgaggaaactgagaagtgtaccgtaaatgaagagtgctccccctcctcctgtctcatgacagaatggggggagtgggacgagtgttccgccacctgtgggatgggcatgaagaaaaggcaccgtatgataaagatgaaccctgccgatgggtccatgtgcaaggccgagacctcacaggccgagaagtgtatgatgccggagtgtcatacaatcccttgcctcctgtctccttggagcgaatggtccgactgttccgtcacatgtggaaaggggatgcggacccgccagcgaatgctgaagtcccttgctgaacttggcgattgcaatgaggatctagaacaggtcgagaaatgtatgctccccgaatgccctattgactgcgaattaacagaatggagccagtggagcgaatgcaacaaaagttgcggcaaggggcatgtcatcagaacaagaatgatccagatggagcctcagtttggcggtgcaccatgtcctgaaactgtacaacgcaagaagtgtcgaatccgtaaatgcctgaggaatccctcaatacaaaagcttcgatggcgggaggccagagagtccagacggagtgagcagctcaaggaagaatctgaaggcgagcagttcccaggttgtagaatgcgcccatggacggcctggtctgagtgtactaaattatgtggcggtggaattcaggagagatacatgaccgtgaagaagcggtttaagagttctcagttcacatcttgcaaggacaagaaagagatccgagcatgtaatgtacacccttgctag

SEQ ID NO: 59899 - DNA, 1329 bp, Artificial Sequence
  Description of Artificial Sequence: Synthetic coding sequence
atgcggagaaccaggaggcccagattcgtcctgatgaacaaaatggatgatctgaacctgcactataggtttttgaactggcgcagacgaatacgcgaaatccgcgaggtcagagccttcagatatcaggagaggttcaagcacatcctggttgacggagataccctgtcatatcacggcaacagtggcgaagtgggatgctatgtggctagtagaccactgacaaaagatagtaactattttgaggtctccatcgtggacagcggcgtacgaggtacgatagccgtagggttagttccacagtactattccctggatcatcagcctggctggctgccggactccgtggcctaccacgcagacgatggaaagctgtacaacggtagagctaaaggaaggcaatttggaagtaaatgtaactcaggagacaggatcggttgtgggattgagccggtgtctttcgacgtccagacagcccagatctttttcactaaaaatgggaagcgagttggttcaactatcatgccgatgtctcctgacgggcttttccccgcagtgggcatgcatagtctgggcgaagaggtacgacttcacttgaacgctgagcttgggcgagaggatgatagtgtaatgatggtcgactcttacgaggacgaatggggaaggctgcatgatgtaagagtctgcgggactctactggaatatcttggtaaagggaaatcaattgtcgacgtcgggttggcccaggctcgccatccactgtcaacccggtcacactacttcgaagtggagattgtggatccgggtgaaaagtgttacatcgccctgggtctcgcccgtaaggactatccaaagaaccgtcacccgggatggagccgcggtagtgtagcataccacgctgacgatggcaagatttttcacggaagtggtgtgggcgatccgttcggacctcggtgctataagggcgacattatgggatgtgggattatgtttccaagagattacatcctcgattcagaaggggacagcgacgactcatgcgacacagtgattttatctccgaccgctagagccgtcaggaacgtgcgtaatgtcatgtatctgcatcaagagggcgaggaggaggaggaagaggaagaggaagaggaagatggcgaggaaatcgagcccgagcatgaaggcaggaaagtcgtggtattttttacgagaaacggaaagattatcggcaagaaagacgcggtcgttccaagtggagggttctttcctaccatcgggatgctcagctgcggcgagaaggttaaagttgacctgcatccactatccggatag

SEQ ID NO: 59900 - DNA, 1359 bp, Artificial Sequence
  Description of Artificial Sequence: Synthetic coding sequence
atgaatagcgggattctgcaggtgtttcaaagggccctgacatgccccatttgtatgaactacttcctggatccggtcaccatcgactgcgggcacagtttctgtcgtccttgcttgtacctgaactggcaggacacagccgtgctggcacagtgctccgagtgcaaaaaaaccacgaggcagagaaacctaaataccgatatctgcctcaaaaacatggcatttatcgccagaaaggcttcgcttcggcagtttctgtctagcgaggaacaaatttgtggaatgcacagggagaccaaaaagatgttctgtgaggtggacaagtcccttctctgcctgccatgttccaacagccaggagcacagaaaccatattcactgcccaatagagtgggcagcagaggagagaagagaggagctgctgaaaaaaatgcagtccctgtgggagaaagcttgtgagaacctcaggaatctgaatatggagaccactcggacaagatgctggaaggactacgtgagcttgcgcatcgaggccatccgggctgaataccaaaaaatgccagcgttcttgcacgaagaagaacagcatcatctagagcgcctccgcaaagagggggaggatatcttccaacagctcaatgaatcaaaggcgaggatggaacactctagagagcttttgaggggaatgtacgaagacctaaagcagatgtgccacaaagctgacgtggagttgctgcaagcgttcggagatatactccatcggtatgagtctctgttgctccaggtgtctgaacccgtgaatcctgagctgagcgcgggacctattaccgggctgctcgactccctgtcagggttccgggtggattttactctccagccagagcgcgctaacagtcatatatttttgtgcggagatttgcgttctatgaatgttggttgcgatccccaggacgatcctgatatcactgggaagtccgagtgtttcctcgtctggggcgcacaggcattcacttccggcaagtattactgggaggtgcatatgggggatagttggaactgggcttttggagtgtgcaataattactggaaagaaaagcgtcagaacgataaaatcgacggcgaagagggcttgtttttactgggctgtgtgaaggaggacacccactgttccctgtttacaacatctcccctcgttgtgcaatacgtgcctcgacctacaagtactgtcggcttgtttctagactgcgagggcaggacagtgagcttcgtagatgtcgatcagtcttcactgatctacaccatcccaaactgttctttctctccccctctccgaccaatcttttgctgtagccatttctag

SEQ ID NO: 59901 - DNA, 591 bp, Artificial Sequence
  Description of Artificial Sequence: Synthetic coding sequence
atggccacaagcgtgctgtgctgtcttcggtgctgtagggacggcggaacaggacatatacctctgaaggagatgcctgcagtacagctcgacacccagcacatgggaaccgatgtggtaatcgtaaagaacgggaggcgaatctgtgggacaggagggtgtctggcgtcagcacccctccaccagaataaatcctactttgaattcaagatccaatccacaggaatttgggggatcggcgtcgccacacagaaggtaaatctgaatcagatccctctgggacgtgacatgcactctctggtgatgcgtaacgacggggctctgtaccacaataatgaagaaaagaatagactccccgctaacagcctgcctcaggagggcgacgtggtcggaataacgtatgaccacgttgagctgaacgtttacctaaatggcaaaaacatgcattgccccgcatccggaatccggggtacggtatacccggtggtgtacgtggacgatagcgccatcttggattgtcagtttagcgagttttatcatactccgccacccggattcgagaaaatactgtttgagcagcagatcttttag

SEQ ID NO: 59902 - DNA, 474 bp, Artificial Sequence
  Description of Artificial Sequence: Synthetic coding sequence
atggctacaagtgtgttatgttgcctgcgctgctgtcgggacggtggaacgggacatatacctcttaaagagatgcccgctgtccaactggacacacaacacatgggcatctggggcataggcgtagcaacacagaaagtaaacctcaaccagattccgctggggcgagacatgcacagtttggtcatgaggaacgacggggctctttaccataacaacgaggagaagaatcggctgccagctaacagtctgccccaggagggcgatgtggtgggtatcacatatgaccacgtggaactcaatgtttatttaaacggaaagaacatgcactgtccagcttccggaatccggggaacagtgtaccctgtggtgtacgtagacgacagcgccattctggattgccagttttcagaattctaccacacccctcctccagggttcgaaaagatactgtttgagcagcagatattctag

SEQ ID NO: 59903 - DNA, 1059 bp, Artificial Sequence
  Description of Artificial Sequence: Synthetic coding sequence
atggacttcagagagatcctaatgatagccagcaagggtcaaggggtgaataatgtccccaagagatactccttggcggtgggacccccaaagaaggatccaaaagtgaaaggcgtccaatccgccgcagtgcaagcctttctaaaacgcaaagaagaagagctccgcaggaaagccctcgaggagaagagaaggaaggaggaactggtcaaaaagaggattgaactcaagcatgataagaaagctcgcgctatggcaaagcggaccaaagacaattttcacggttataatggcatcccaatcgaggagaagtctaaaaagcggcaggcaacggagagtcacacatcccaggggacagacagagaatacgagatggaagaggagaacgagttcctagagtacaaccacgccgagagcgaacaggagtatgaggaggagcaggaacccccaaaagtagaatctaagccaaaagtgccactgaagtccgccccaccccctatgaatttcaccgacctgttgcggctggctgaaaaaaagcagtttgaaccagtggagattaaagtggtgaagaagtccgaggagaggccaatgactgcagaagagctccgtgaacgcgaattcctggaacgtaagcatcggcgtaaaaaactcgaaaccgacggaaagttgccccctacagtctcaaagaaggccccatcccagaaagagagcgtgggtactaagctgtcaaagggctcaggagaccggcatcctagctctaaaggtatgcctcttccgcacgccgagaagaaatctaggcctagcatggccaatgaaaagcacttggctctgagttcctccaaaagcatgcccggtgaacggataaaagctggaagcggaaactcaagtcagccaagtctacgagaaggacacgataagcctgtttttaacggagccggaaagccacatagctccacgtcctcccctaaacacgtatggaaggagaacaaatatatgaagcgtgactggctgttctatttccaatgcatcgagtacatcaggcttctcttcatcttctag

SEQ ID NO: 59904 - DNA, 2058 bp, Artificial Sequence
  Description of Artificial Sequence: Synthetic coding sequence
atggattttcgggagatactcatgatcgctagcaaagggcagggggtcaataacgtccccaagaggtatagtcttgctgtgggccctcccaaaaaggatcccaaagttaagggagtgcagagcgctgcggtccaggcattcctgaagagaaaagaagaggaattgcgtcggaaggcactcgaggagaaacgccgaaaagaagaactggttaaaaagcgaattgaactaaagcacgataagaaagctcgagccatggcaaaacggacgaaggacaactttcacgggtacaatggaattccaatagaagagaagagcaaaaaacgccaggccacagaatcccatactagccagggaaccgatcgggagtatgaaatggaagaagagaatgaattcctcgagtataatcacgccgaaagcgaacaagagtacgaagaggagcaggaaccaccaaaggtagaatctaaacccaaagtgccactgaaaagtgcaccgcctcccatgaactttacagatttactgcgactggcggagaaaaagcagttcgagcccgtcgagataaaagtggtcaaaaaaagcgaagagaggccgatgaccgccgaagaactgagggagagggagtttctcgagcgcaagcataggcgtaaaaagctcgaaactgacggtaaactaccacctactgtgagcaagaaagccccatcccagaaggagtccgtgggcacaaaactgagcaaagggagcggtgacaggcatccctcatcgaaaggcatgcccctgccgcatgcggaaaagaaatctagaccaagcatggccaacgaaaagcatctggcgctttctagtagtaagagcatgccaggtgaaaggatcaaggccggaagcgggaattcatcacagcccagcttacgtgaaggccacgacaagcctgtgtttaacggcgcagggaagcctcattcctccacttcctccccgtcggtgcctaagaccagcgctagtagaactcagaagagcgctgtggagcacaaagcaaaaaaaagtctgtcccaccccagtcacagccgccctggcccaatggtaacgcctcataacaaagctaagtctccgggagttcggcaacccggatcatcatcgagctccgccccagggcagccgtctaccggtgtggctcgtcctactgttagctcaggtccggtgccgaggcgacagaatgggtcctcttcttctggtcccgaacgttcaatcagcgggagcaagaagcccactaacgattccaacccaagcaggaggaccgttagtggcacttgcgggcctggtcaacccgcaagttcgtcaggcggacctggaaggccaatttcaggaagtgtttcctctgctagacccctcggctcttccaggggcccaggaagaccggtgagcagtccacatgaactcaggaggcccgtgagcggcttaggacctcctggcaggtcagtctctggccctggcaggtccatttcagggtctataccagcagggagaaccgtgtcaaactccgtgccgggtagacctgtgtcatccctgggtcctgggcagaccgtgagcagtagtggaccaactattaagcccaagtgcacagtggtgtccgagactataagtagcaagaacattatcagtcgctcctctaacgggcaaatgaacggcatgaagccacctctgagtggatacagagccgctcaggggccacagaggctgccatttcctaccggttataagcgccaacgcgagtacgaggaggaagatgatgatgatgacgagtacgattcggaaatggaggactttattgaagacgagggggaaccacaggaagaaatctctaaacatatcagggaaatctttggatatgaccgtaagaaatataaagacgaaagcgactacgcccttaggtatatggaatctagctggaaggagcagcagaaggaggaagccaagagcctccgcctcggaatgcaggaggatctggaggagatgcgtcgcgaggaggaggagatgcagcgaagacgggcaaagaagctgaagcgcagatag

SEQ ID NO: 59905 - DNA, 1488 bp, Artificial Sequence
  Description of Artificial Sequence: Synthetic coding sequence
atgcagtggtcacctacgccaggagccagtgcttgccttgggtgggcctcaagtctggcttgcagcaccgctccaactcttctggggagggccggaagaggtcccctcatggcagcaaagtggttcaaggaatttcccctgaacttgaaaactgtttctgaacgagccaagccaggcggaggaggcggaaaattaagaaagaactcagaagcaggcggtgcaggccctgggcctgggaaagggaggaaaaacagtgccgctgagctgggatcaggaagggctggagtgggtccaaaggattctcgactatcgagggattcactccaagggctcattcaagccgctgccggtaaaggccgaaaaaacagtcgcgctaccgaggaggaaccacacagaggcgcaaccaaatctagcggctgtagtacgtatatcaatcgactcattaaggtggatacacaggaaaagaatgggaaatctaactaccccagtagctccagctcatcaagctcatcatccagttctgctagttctagtccctcctcactgggccctgagctagataagggaaagataattaagcagcaggagaccgttatcattctggaggattacgccgatccatatgatgccaaacgtactaaggggcagcgcgatgcagagcgggtcggagaaaatgatggatacatggagccgtatgatgctcagcagatgatcacagaaattagacggagaggatcaaaagacccgctggtaaaagccttgcagctgctcgactccccgtgcgaacccgcagatggtggcctaaaatccgagacactggccaagagacgctcctcgaaagatctgctcggaaaacccccacagctctacgacactccatacgaacccgctgaagggggaccaagggcggaggggaaagcgcgaccccctgatagccggctgccagagaatgacgaacgacctgctgcggagtatgagcagccttgggaatggaaaaaagagcagattgtacgtgcattgagcgtccagtttgagggagctgaacgcccatcctttcgcgaagaaacagtgaggcagcaccacagacaaaagagttggactcagaagatcctgaagcccgctctgagcgatcattccgagggcgagaaggtggacccaggcctgccactcgagaagcaaccatggtatcatggggcaatctctagggctgaggccgaatcgcgcctgcagccctgtaaggaggcgggatacctcgtgagaaacagcgaatccgggaactcccgctattctattgctctgaagacaagtcaggggtgcgtccatatcattgtggctcagactaaggacaataagtacacactgaaccagacttcagcagtgtttgatagcatcccagaagtggtacattactactcaaatgagaagctcccctttaaaggagcagagcatatgactttactttaccctgtgcacagtaagctgcattag

SEQ ID NO: 59906 - DNA, 1272 bp, Artificial Sequence
  Description of Artificial Sequence: Synthetic coding sequence
atgcagcaggagggtggaccagtcaggtccgccccatgcaggacagggaccctggaaggttctagacaaggctccccaggccatcgtaagcgggcatctcccaagggatccctgtcttccgctcagccccactcctggatgttgacgccgtctccattgaatagccattgcgcccatcgcgagcctatttcaagctctccccagccagtcgccaatggacctaagcaaaagaaaaagtcgaactggaggtctaccacacgcctccgcattatccggttgcgagacaggttggagccaagacctctggccattctggaggactacgccgatccatttgatgtgcaggagactggtgaaggtagcgctggagcctctggcgctcccgagaaggtcccagagaatgacggatacatggagccttatgaagcccagaaaatgatggccgagatcagaggctcaaaggagacagcaacccaaccactgccgctgtacgacacaccctatgagccggaggaggacggagcaacagctgaaggagagggcgctccctggcccagagagagtaggctccccgaagatgacgagcggccaccagaggaatacgaccagccatgggagtggaagaaagaacggatctctaaggcatttgccgtggatatcaaggtcataaaagacctaccttggccccctcccgtgggacagctcgattcgtcccctagtttaccggatggagaccgagacatatcaggccctgccagtccgctccctgagccctcacttgaggactcttccgcccaattcgaaggacccgaaaaaagctgtcttagccctggaagggaagaaaaggggaggctaccccctagattgtctgcgggtaatccaaaaagcgccaagcctctctcaatggagccctcttcaccactcggagagtggactgatccagccctcccgctcgagaatcaggtctggtatcatggggctatctcccggacagatgctgagaaccttctcaggctctgcaaggaggcatcttacctcgtgaggaattccgaaacctcgaagaacgattttagcctgtccctgaaaagtagccaaggcttcatgcacatgaagctgtctcggacgaaggagcacaaatatgtcttagggcagaattcaccaccattcagtagtgttccagagatcgtgcaccattatgctagtcgcaaactgcccatcaagggcgctgagcatatgtcactcctatacccagttgctatccgaaccttatag

SEQ ID NO: 59907 - DNA, 1302 bp, Artificial Sequence
  Description of Artificial Sequence: Synthetic coding sequence
atggtcgctcaatccttatccgatgctcaccacgcgctgactattatgctttccgagaggctctggctgggcctagaacttttgaacttcacaagacgtaagatcagttcagatccccctccctataacttcctggaagccagggaggccgctcttggtcacaggtggaggatgcaacaggagggcggtcctgttcgtagtgccccttgccgcaccgggacacttgaggggagcaggcaggggagccccggacataggaagcgtgcgagccccaagggcagtctatccagcgcccagccgcatagttggatgctcacaccatcccccctcaattctcattgcgcccatcgggaacctatatcatctagccctcaacccgtggccaacggcccaaagcaaaagaagaaatcgaactggagatctactacgcggctcaggatcatccgtttgagagatcgactcgaaccccgacccctggcgattctagaggactacgccgatccatttgatgttcaagagacaggggaaggatcggctggcgctagcggcgcaccagagaaagtacctgagaatgacgggtacatggaaccctacgaagcgcagaaaatgatggcagagattcgaggatctaaggagacggccactcagccacttcctctttacgacactccatacgagccagaggaagatggcgctacggcagagggcgagggagccccatggcctcgggagtcccgactccccgaggacgacgagcgcccaccagaggaatacgaccagccttgggaatggaagaaagaacgaatttcgaaagctttcgcagcacagttcgaagggccagaaaagagttgcctatctcctgggagggaggagaagggtcggttgcccccacgcttgagcgcgggtaacccaaaaagtgctaaaccccttagtatggagccctccagccctttgggcgagtggaccgacccagctctccctctagagaaccaggtctggtaccatggcgcaatttccagaacagacgccgaaaatctgcttcggctgtgcaaggaagcctcctacctcgttaggaattctgagacctctaaaaacgatttcagtctgagcttaaagtcgagccaggggttcatgcatatgaagctgagcaggaccaaagaacataagtatgttttaggacagaacagtcctccctttagctcagtgccggagattgtccaccactatgcttcccgaaagcttccaatcaagggagccgagcacatgagccttctgtatccagttgccatccgcacactgtag

SEQ ID NO: 59908 - DNA, 1110 bp, Artificial Sequence
  Description of Artificial Sequence: Synthetic coding sequence
atgcagcaggagggagggcctgttcgttcagctccttgccggaccggtactctcgagggctctcggcaaggaagccccggacacaggaagagggccagtcctaagggttctctctctagcgctcaacctcattcctggatgctcactccctctccgctaaactctcactgtgcacacagagaacccattagctcatccccccagccagtagctaacggacccaaacagaagaagaagagtaactggcgcagtacaacccggctccgcatcatcaggttgcgagacagactggagccccgtcccctggccattctggaggattacgctgacccattcgacgttcaagaaaccggcgaaggctctgccggagcgagcggcgctcctgagaaagtccccgagaacgatggttacatggagccatatgaggctcagaagatgatggcggagattcgcggttccaaggaaactgctacacagccgttgcccctctacgacacaccgtatgagcctgaagaagacggcgctaccgcagagggcgaaggcgcaccttggcctagggaatcacgcctgcctgaagatgacgaaagaccaccagaagagtacgatcagccatgggagtggaagaaagagcgcataagcaaggcattcgccgtcgacatcaaggtaattaaggacctcccatggcccccacccgtgggccagctggatagctcacctagcctgcccgacggggatcgcgatattagtggccctgcgagcccacttcccgagccctccctggaagacagctcagcccagttcgaaggccctgagaaatcttgtctaagccccggtagggaggaaaaaggtcgcctccctcctagattgagcgctggcaacccaaagtccgccaagccactctccatggaaccaagcagcccgttaggtgaatggacagatcctgctctacccctggagaaccaggtgtggtaccacggtgcaatttcccgtactgacgctgagaacctgagcggctgcgccaagaggccagcaacatggtgtgcaaccgtccgtcccgcacgcatgacaagccccagtccatcacgtgcagctcgggactcctgcacttag

SEQ ID NO: 59909 - DNA, 1101 bp, Artificial Sequence
  Description of Artificial Sequence: Synthetic coding sequence
atgcttcttagcggcgcaccgccagcggcacccccagcccctccgccagatatcctggccgcttataggctgcagcgcgaacgggacttcgaggatccctatagcggtgggtctagcgggagtgccgcactggccactccagtggcccctggccctaccccgcctcctcgccacggaagtcctccacacaggttgattcgcgttgagactcccggaccacccgctccgccagcagacgaacgcatctctggaccacctgcctcctcagatagactggcaatactggaagactatgccgaccctttcgacgtgcaggagacgggcgaggggtcagccggtgcgagcggggcacccgaaaaagtgcctgagaacgacggttatatggagccttatgaggctcagaagatgatggcagagattagaggcagcaaggagacagctacccagcctctgcctctctacgataccccttacgagcccgaagaggacggagccacagccgagggagagggggcaccatggccccgtgagtctaggttgccagaggacgatgagagaccgcctgaggagtatgaccaaccatgggagtggaagaaggaaaggatctccaaagcctttgctgctcaattcgaggggcctgagaaaagctgtctctctcctggcagggaggagaaaggacgtttgccgcctcgcctatctgccggaaatccgaaaagcgcgaaacccctgtccatggagccctcttcccctctgggcgagtggacagaccctgccctcccgcttgagaaccaggtgtggtaccatggcgctatttccagaaccgatgctgaaaacctgctgaggctctgtaaggaagcctcttatctcgttaggaactctgaaactagcaagaacgatttttctctttccttaaaaagctcccagggcttcatgcatatgaagctgtctcggacaaaagaacataaatacgtcctgggacagaattcgcccccatttagctctgtgcctgagattgtgcatcactatgcatcccggaagctgcccattaagggcgctgaacacatgtctcttctgtatccggttgccattcggactctgtag

SEQ ID NO: 59910 - DNA, 690 bp, Artificial Sequence
  Description of Artificial Sequence: Synthetic coding sequence
atgactccacaactgctcctagctctggtcctttgggccagctgccccccatgctccggaagaaagggaccccctgctgctctgacactgccgagggtgcagtgccgggcaagtcggtatcccatagccgtggattgcagctggactctccccccagccccaaacagtacctctcccgtgtcttttatcgcgacctaccgcctcggcatggctgctaggggccactcctggccttgccttcagcagacccccacaagcactagctgcactatcacggacgttcaattgttctccatggctccctatgtcctgaatgtcactgctgtccacccatggggatcttcctcctcattcgttcctttcatcaccgaacatataataaagcctgatccaccagaaggagtgcgcctaagccccctcgctgaaagacagttgcaggtgcagtgggaacccccaggctcttggccatttcctgagatcttcagcctgaaatactggattaggtacaaaaggcagggcgcagccagatttcatcgggtcggaccaattgaggccacatccttcattctcagagccgtgcgccctcgtgcgaggtactatgtacaggtggctgcccaagacctcacagattatggggagctgtctgattggagcctcccggctaccgccacaatgagtttgggtaagtag

SEQ ID NO: 59911 - DNA, 1023 bp, Artificial Sequence
  Description of Artificial Sequence: Synthetic coding sequence
atggctaagtggctgcgggactacctgagctttgggggacgcagaccacccccacagcctcctacgcctgattataccgaatccgatatactcagggcttatcgcgcacagaagaacctggatttcgaagatccttacgaagatgcggagtctagactcgagcccgacccggctggacccggagattcaaaaaacccaggagacgctaagtacggcagccccaaacatcgactgatcaaggtggaagcagccgatatggctcgggcaaaggcgttgctgggtggtcctggagaggagctggaggccgacactgaatacctggatccgttcgacgcccagccacacccggctcctcctgacgatggctatatggagccttatgacgcccagtgggtcatgtcagaattgcccggaaggggcgttcagctgtatgacacgccatatgaggagcaggaccccgaaacggcagacgggccaccgtccggacagaagccgaggcagagccggatgcctcaagaggacgagcggccagcggacgaatatgaccagccgtgggagtggaaaaaggatcacatttcacgcgcattcgcggtgcagtttgacagccccgagtgggaacggactcccggttctgctaaagaactgcggagaccacctccaaggagcccacagcccgcagaacgagtggacccagctctgccactggagaaacagccatggtttcatggccctcttaacagagcggacgccgaaagtttgctgtcactgtgcaaagagggcagctacttagtccggttgagcgagaccaacccacaggactgctctctgtctctcaggagctctcagggcttcctccatttaaagttcgcgagaacacgcgagaatcaggtggtcctcgggcagcactccggcccttttcctagtgtgcctgaattggtactgcattattcctctaggccactgccagtgcaaggtgccgagcacctggctctactctatccagtggtgacccagaccccctag

SEQ ID NO: 59912 - DNA, 3552 bp, Artificial Sequence
  Description of Artificial Sequence: Synthetic coding sequence
atgggtaatgccccaagtcaggatcccgaacgctcctcccctcccatgttgtccgccgatgacgccgaatatccgcgagaataccgcacgttgggagggggaggcggagggggttcaggcggacgtagattttctaatgtggggctggtgcacactagcgagagacgacataccgtaatcgccgctcagtctttagaggctctgtcaggactgcagaaggccgacgcagacaggaagcgggatgcgtttatggaccatctgaaatccaagtatccccagcatgccctggcactccgaggccaacaggaccgaatgcgggagcagccaaactactggtcatttaagaccagatccagtcgtcacacacaaggcgctcaacccggactagccgatcaagcagccaaactgtcatatgcttcagcagagagcctggagacgatgagcgaggcagagcttccactgggcttttcccgcatgaatcggttcagacagagtctgcccttgagccgaagcgcctcacagaccaaactgcggtctcctggagtcctgttcctccagtttggtgaggagacgagacgggtgcatattacccacgaggtatccagtctggacactctacatgcactgattgcgcacatgttcccgcaaaagttgaccatgggcatgctgaagtctccgaatacagccatactgattaaggatgaggcaaggaatgtgttttatgaacttgaagacgttcgcgacatccaggacagatcaataattaaaatataccgcaaagaacccttatatgcggcttttcctggttctcacctgactaatggggatctgaggcgcgaaatggtatatgccagtagggagagtagccctacccggagactcaataacttatcccccgcaccacatctcgcgagcgggtctccccctcccggactgccctctggcctgccatccggattacagagcggaagtccttcacgctctcgcctgtcatacgctggcggtcgaccaccttcctatgcgggatcgcccgtacatcatgctgctgaaaggcttggaggggcacccgcagcccagggagtgtccccctccccatccgccattttggagagaagggacgtgaaaccggacgaggatttggcctcaaaggccggaggcatggtgcttgtgaagggcgaaggcctatacgcagacccctacgggctgcttcacgaaggccgactgagtctggccgcagcggctggcgatcccttcgcttaccctggggcaggtggcctgtacaaaagaggcagtgtgcgcagtctcagtacgtattctgcagccgcactacaatcagaccttgaagactcactgtacaaagcggctgggggaggaggacctttgtacggcgatggctacgggttccggctcccaccatccagtccacagaagctggcggacgtggccgctccacccggagggcctcctccgcctcatagcccttacagcgggcctccgtcccgagggtcacccgtccgccagagtttccgcaaggattcaggcagtagcagcgtgttcgccgaaagccccggtggaaagacacgctccgccggatccgcatcaacggctggcgctcccccttcagagctgttccccggacctggcgagcggtcgctcgtggggttcggtccccctgttccagctaaggacaccgaaacccgcgaacggatggaggccatggagaagcagatcgcctcactgactgggctggttcagtcagcacttctgcgcggatcagaacccgaaacccctagcgaaaagatcgaaggctcgaacggagccgctaccccttcagcaccatgcggatctggtgggcgatcatctggtgccactcctgttagcggaccaccgccaccgagtgctagctccacaccagccggtcagcctaccgcagtatcccgattgcagatgcagcttcacctacgcggtctgcagaactcagcctctgacctgcgcggacagcttcagcaactgcgaaagcttcagctgcagaaccaagagtcagtgcgcgcactcctgaagcgcaccgaggctgagctctctatgagagtttcagaagccgctcggcgtcaggaggatcccctccaaagacaacgaacgctggttgaagaagaacgattgagatatctgaatgacgaagaactcattacccagcaactgaacgacctggagaaatccgtggagaagattcaaagggatgtgtcacacaaccatcggttagtaccagggcctgagctggaggaaaaggctcttgtgttgaagcagctcggagagactcttacagaattaaaggcccatttccccggactgcagagcaaaatgagagtggttcttcgagttgaggttgaagctgttaaattcttgaaggaggaacctcaacgcctagatggactgctgaaacggtgccgtggggtaacagacactttagcccagattcgtcgtcaggttgatgagggcgtgtggcctccgcctaataatcttctcagccagagtccaaagaaggtcaccgctgagacagatttcaacaagagtgtcgatttcgagatgccacccccttcgccgcctttgaacctccacgaactgagcggccctgcagagggcgcttcgttgacacccaagggcggaaacccgaccaagggccttgatacacctgggaagcgatcagtggacaaagccgtcagcgtcgaagccgcagagcgcgattgggaagaaaagcgtgccgctctcactcagtactctgctaaagacatcaacagactcttagaggaaacacaggcagaactcctgaaagctattcctgacttagactgtgcctcaaaagcccaccccggaccagcccctactcccgatcacaagcctcccaaagcaccacatggccagaaggccgctcctcggaccgaacctagcggccgacggggaagcgatgaattgactgtgccgaggtaccggaccgaaaagccaagtaagtcccccccacccccaccccctcgccgatcctttccaagttctcacggactgactaccacccggacaggcgaggttgtggtgacttccaagaaagactccgcatttataaaaaaggctgaaagcgaggaattagaagtgcagaaacctcaggtcaagcttagacgggctgtaagcgaagtcgcacgacctgcgtcgacccccccaataatggctagtgcaatcaaggatgaagacgatgaggatcgcattatcgcagaactggaaagcggaggtggctcagtaccccctatgaaagtggttactcccggagcatcccgacttaaggcagctcagggacaggcaggatcaccagacaagtcaaaacatggcaaacagcgagccgaatacatgcgtatccaggctcagcagcaagccacaaaaccatctaaggaaatgagcgggagtaatgagacctcttccccagtctccgaaaaaccttctgccagccgcacatccataccagtcttaactagttttggcgctaggaactcctcgatcagcttttag

SEQ ID NO: 59913 - DNA, 3108 bp, Artificial Sequence
  Description of Artificial Sequence: Synthetic coding sequence
atgtccgaagccgaactcccgctcggattttcacgcatgaacagattccgtcagtctctgcctctaagtcggtccgcatcacagacaaagctaaggagtccaggggttctgttcttacagttcggcgaagaaacccgtagggtgcatatcacccatgaggtgtcatccttagacaccctgcatgcactgatagcacacatgtttcctcaaaagctcactatggggatgctcaagtcaccaaatacagccatcctgattaaagatgaagctcggaacgttttctatgagctcgaagatgttagagacattcaggaccggagtataatcaagatctaccggaaggagccactttatgcggcatttccaggaagtcacctgacaaatggcgatttgaggcgggaaatggtctatgcctctcgagagtcgagcccaacacgaagactcaataaccttagcccagctccccatctggctagcgggtcccctccaccaggcctgcccagcgggttgccctcagggctgcagagcggatccccaagcagatcccgactcagttatgccggaggtcgcccaccatcctacgccggatccccagtacatcacgctgcagagagacttggtggcgcacccgcagctcagggcgtttctccgagcccaagtgcaatactggagcgacgcgatgtgaagcccgatgaagacctcgcctcaaaggctgggggtatggtgttggtgaagggagaaggcctctacgcagatccatatggacttctgcatgaggggaggctgtcactggcagccgcagccggtgatccctttgcataccctggggctggaggcctatacaagaggggctctgtgcgaagtctttcaacttactcagctgccgcactgcagtccgacctagaagattccctctacaaggcggctggcggaggtggcccactttacggagacggctacggattcagattaccccctagcagtccacaaaaactggctgatgtggcggctccccctggtggtccccctccacctcacagtccttatagcggtcccccaagccgcggatccccagttcgccaatcgtttcggaaggactccggcagctcaagcgtttttgctgagtcccctggcggaaagacccggtccgctggctctgcatcaaccgccggagccccaccgtccgaactctttcctggccctggggaaaggtcactcgtgggatttgggcctccggtgcctgcaaaggatactgagacacgggaaaggatggaagctatggaaaagcagatagcgtctctcacgggactcgtccaaagcgcactgttaagggggtctgagcctgaaacgccctctgaaaaaatagaaggctccaatggagctgccacaccctcagccccttgtggctcggggggtaggtccagtggtgccacccctgtgagtggaccccctcctccctccgccagctctactcctgccggtcaaccaacggccgtgtctaggttgcaaatgcagctgcacctgcggggtctccagaatagcgcatccgacctgcgaggacagctgcaacaactccgaaaactgcagctgcagaatcaagaatcagtgcgcgcactgctcaagaggaccgaagctgagctgagcatgagggtgtctgaagctgcccgtagacaggaagatccactgcagcggcaaaggacactggttgaagaggaaagactgagatacctcaatgatgaggagttgataacacagcagcttaacgacctcgagaagtctgtggagaagattcaacgggatgttagtcataaccatagactggttccaggccctgagctggaagaaaaggctctggttttgaagcaactcggagagacactgacggagttgaaggcccattttccgggtttacagtctaagatgcgcgtcgtcctgcgagtcgaggtagaagcagtaaagttcctaaaggaagaaccccagaggctggatgggctcctcaagagatgtcggggagtaaccgacacactggcccagattagacgccaggttgatgagggtgtgtggccaccacccaacaacctcctctcccagtctccaaagaaagttaccgcagaaacagactttaataaatcggtggactttgaaatgccgccaccttctccgccacttaacctccatgagctcagcgggcctgccgaaggcgcatccctgacaccaaaggggggtaatcccactaagggtctggatacccctggtaagcgctctgtcgataaagctgtctctgtcgaggccgctgagcgcgattgggaggagaaacgagctgctctgactcagtacagcgcaaaagacattaatcggctgcttgaggaaacgcaagcggaacttctgaaggcgatacctgacctcgattgtgcaagcaaggcccatcccggaccagcccctacacctgatcataaacccccaaaggccccacatggccagaaggctgcgcctagaacggaacctagcggtcgtcgagggtctgatgagttgaccgtacctcgctatcgcacagaaaagccttcaaagtccccaccaccaccacctccgaggcggagctttccttcttcacacggccttacaactacccggacgggggaagtggttgtgacgagcaagaaggatagcgcctttatcaagaaggctgagtctgaagaattggaggtacagaagccccaggtgaagttgagaagggccgtcagtgaagttgcgagacctgcttccactccccctatcatggccagtgctattaaagacgaggacgatgaagatcggatcattgccgaactcgaggtgtttgaaaggtccagtgtatcaagcctgcctcccacacctcggaggcagctcatacctacattactgagcccgcaggacctcggcccacccggaggaagcgcccctggcccaaccaggaaatccgggggaggatccgttccgcctatgaaagtcgtcaccccgggtgcctctagactgaaagcagcccagggccaagccggaagccccgacaagtccaagcacgggaaacaaagagccgagtatatgcggattcaggcccagcagcaggtttag

SEQ ID NO: 59914 - DNA, 2766 bp, Artificial Sequence
  Description of Artificial Sequence: Synthetic coding sequence
atggggatgttaaagtcgccaaacacggcaatcttgatcaaggatgaggccaggaacgtattctacgagctcgaagacgtaagagacatacaggacaggagcatcataaagatatatcgaaaagaacccctgtacgcagcgtttcccggtagtcacctgactaatggagaccttcgccgagaaatggtgtatgccagccgcgagtcttcccctaccaggcgcttgaataacctgtctccagcaccacaccttgcttctggctccccacctcccggactcccgtccgggctcccgagcggcttgcagtctggatccccctctaggagccgcttgtcttatgccggagggcgtcctccttcctacgctggcagccccgtccaccacgcagcagagcgtctgggcggtgcgcctgctgctcagggagtatcgccatctccaagcgccatactagagagacgcgatgtgaaaccagacgaagatcttgcgtccaaagctggcggaatggtgctggtgaagggcgagggcctctacgccgacccatacggcctcctgcacgaaggacggctttctctggcagctgccgctggagatccctttgcctaccccggagctgggggtctgtataaacggggatctgttcggagcctctcaacctacagcgctgccgctctgcagagcgacctggaagactccttatacaaagccgctgggggtgggggaccattatatggcgatggctacgggtttcgcttacccccatcatcacctcagaagctcgctgacgttgccgctcctcctggcggaccccctcccccacattctccctattccggtccacccagtcgcggaagcccagtgaggcagtctttcaggaaagactccgggagttcctcagtcttcgctgagtctcccggagggaagacacggtccgctggaagcgcatcaacagccggagcccctccttccgagctttttccgggacccggagagagatctttggtcggcttcggacctcctgtcccagcgaaggacactgagaccagagagcggatggaagcaatggaaaagcagattgcatcacttaccggactggtccagagcgccctcctcagaggcagcgagcccgagaccccctcagaaaaaatcgagggatctaatggggctgcaacaccttcggccccatgtggctccggaggaaggtcctccggggctaccccagtgtccggtccgccaccgccaagcgcctcctctacacccgctggtcaacccaccgccgtatcacgcctccagatgcagctccatctgaggggactgcaaaattcagcatctgatctacgaggccagctgcagcagctgcggaaactgcagcttcaaaaccaggagtctgttagggccttacttaaaaggacggaggctgagctcagtatgcgggtaagtgaagctgctagacgacaggaggatccactgcagaggcagcggacattagttgaagaagaacggcttcggtatttgaacgatgaagaactcattacccagcagttgaacgatctggagaagagtgtagagaagattcagcgggacgtcagccataatcaccggcttgttccaggaccagaactcgaagaaaaggctttggttctgaagcagttaggagagactctcactgaactcaaggcccattttcctggcttacagtcaaaaatgcgcgtggtgctgcgagtcgaggttgaggccgttaaatttctcaaagaagaaccacaacgattagacggactacttaagcgttgccgaggtgttacagatactcttgcgcaaatcaggcgccaagtcgatgaaggagtgtggccaccacccaacaatctgctgtctcaatctcccaagaaggtgacagcggagacagactttaataaaagtgtcgacttcgagatgcctcctccaagcccaccccttaacctccatgaactgtcaggccctgctgagggcgcaagcctgacaccgaaagggggaaaccccaccaaaggcctagatacgccaggtaaacggagtgtggacaaagcagtttctgtcgaagcagcagaacgagattgggaggaaaagcgtgccgcactgactcaatactctgctaaagacattaatcggctgctggaggagactcaagccgagcttctaaaggccattcccgacctcgactgtgcctccaaggctcatcccggtcccgctcccactcctgatcataagcccccaaaggctccccacgggcagaaggccgcacccagaacggagccatcaggtcgcagaggatccgatgagttaaccgtgcctaggtaccgaaccgagaagccatctaaaagccctccgcctcctcctcctcgcagatccttccccagcagccacggtctgactactaccagaaccggggaagtggtagtgacatccaaaaaggattcagccttcatcaaaaaggcagaaagcgaggaacttgaagtccagaaaccacaggtgaagcttagacgcgctgtcagcgaagtggcacggcctgcatccacacccccaataatggcttcggctatcaaagatgaggatgacgaagaccgtataatcgcagagctcgagtccggcggtggtagcgtgccacctatgaaggtggtcactccaggggcttctaggctcaaggccgctcagggccaagccggatcccctgataagagtaaacacgggaagcaaagagccgagtatatgcggatccaggcccagcagcaggtgtag

SEQ ID NO: 59915 - DNA, 1356 bp, Artificial Sequence
  Description of Artificial Sequence: Synthetic coding sequence
atggtctcccgggaccaggctcacctgggtccgaagtacgtgggactctgggatttcaaatctcgcacagatgaggaactctcttttagggctggagacgtgttccacgtggctcgtaaggaagaacaatggtggtgggcaaccctgctagacgaggcgggaggggcagtcgcgcagggatacgtccctcataactacctggccgaaagggagactgtagagtcagaaccctggttcttcggctgcatttcccgatctgaggccgttagacggttacaggcagagggcaatgccaccggagcctttctgattcgggtgtccgagaaaccctccgcagattacgtcctttccgtgagggatacccaggccgtccgccactacaagatttggagaagagccggtgggaggcttcatctcaacgaggctgtcagtttcctgagcctccccgagttagtgaactaccacagggctcagtctttgagccatggcctgcgcttggccgctccatgccggaaacatgagcctgaacccttgccacattgggatgactgggagcggccacgcgaagagttcactttatgtagaaagctgggaagtggctactttggagaggtctttgagggtctgtggaaagaccgggtacaagtagccattaaggtgatttctagggataatttactccatcagcagatgctccaaagcgaaatccaggcaatgaagaagctccgccacaagcacatcttagcgctgtacgctgtagtgagcgtgggcgaccctgtctacatcattacggaattaatggctaagggctccctcctagaattgcttcgggacagtgacgagaaggtgttgcccgtgtcagagctgctcgacatcgcatggcaggttgcagagggaatgtgctacttagaatctcaaaattatattcaccgggatctagctgcaaggaacatcctggtgggtgagaatacactgtgtaaagtaggagatttcgggctggctcgcctgatcaaagaagacgtgtatctgtcccatgatcataatattccttacaaatggaccgcgcctgaagctctgagccggggacattatagcacaaaatccgatgtatggtctttcggaatcttactgcatgaaatgttcagtcgcggacaggtgccctaccctggtatgagcaaccacgaggcattcctcagagtggacgctggctatcgtatgccatgccccctcgagtgtcctcctagtgtgcacaagctgatgctcacttgttggtgtagagaccccgagcaaaggccatgtttcaaggccctgagagagagattatctagctttaccagctacgagaatccaacttag

SEQ ID NO: 59916 - DNA, 468 bp, Artificial Sequence
  Description of Artificial Sequence: Synthetic coding sequence
atggctgtgcccggatgcaacaaagattctgtgagggccggatgcaagaaatgtggataccctgggcatctgacttttgaatgtcgaaacttcctcagggttgacccgaaacgagacatagtgttggatgttagtagcacatcttcagaagactccgatgaggagaacgaagaactcaacaaactccaagcactccaagagaaaaggattaacgaggaggaggaaaaaaaaaaggaaaaaagcaaagaaaagatcaagcttaaaaagaagcgcaagcggagctattctagttcctccactgaagaagacaccagcaagcagaagaaacagaaataccaaaaaaaagagaagaagaaagaaaagaagagtaaatctaagaaaggcaagcaccataaaaaagagaaaaagaaacgtaagaaagagaaacacagcagcaccccaaacagcagcgagttctccagaaagtag

SEQ ID NO: 59917 - DNA, 1704 bp, Artificial Sequence
  Description of Artificial Sequence: Synthetic coding sequence
atgagcgcaagtactggtggcggaggggacagtggaggaagcgggggaagctctagcagtagccaggcaagctgcggtcccgagtccagcgggtctgagctcgctttggctacgccagtccctcagatgcttcagggtctgctggggagtgacgacgaagaacaggaggatccaaaggactactgtaaggggggataccacccagttaagatcggggacgtgtttaatggaaggtaccatgtggtgaggaaactcggatggggccacttcagtaccgtttggctatgctgggatattcagagaaagcgttttgtagcactgaaagtagtcaagtcagccggacactatactgagacagccgtcgacgagatcaaactcctgaagtgcgtgagggactccgatccttctgacccaaagagggaaacgatcgtgcaactcattgacgactttcgcatcagcggggtgaacggcgtacatgtgtgtatggtgttggaagtccttggccaccaactgctaaaatggatcatcaaaagcaattaccagggactcccagttccttgtgtgaaatctatcgttcgacaagtgcttcacgggctggattatctccacactaaatgcaagatcatacacaccgatattaaaccggagaatatattattatgtgtcggtgatgcctacatccgcaggttggccgctgaggcaaccgagtggcagcaggccggagcacctccacctagccgatcaatcgtgtctaccgccccacaggaagtgctacagacgggcaagctgtccaagaataagaggaagaaaatgcgccgtaagcgcaagcagcagaaacgcctcctggaagagcgtttacgggatctgcagcgactcgaggccatggaggccgcaactcaagcggaggactcaggcctgcgcctggacggtgggtctggcagtacctcctcaagtggctgtcacccaggaggcgcacgggctggcccaagtccagcctcctcttctcctgctcccggaggaggtaggagcttatccgccggaagccagacgagtggattttcaggctcactgttctcaccagcaagttgttcgatcctctcaggatctagcaatcagcgtgaaaccggagggttgctatcccctagcacccccttcggcgctagcaatctcctggtgaaccctctggaaccccaaaacgccgacaaaatcaagataaagatcgcagatctgggaaacgcttgctgggtgcacaaacactttactgaagacatccagacccggcagtatcgggcagtagaggttcttatcggtgctgagtacggccctcctgcagacatctggagtaccgcctgtatggcatttgaactcgctactggggactatctctttgagccacactccggcgaagactatagccgagacgaggatcatatcgctcacattgtggaactgctgggagacatcccgcctgcattcgccctgagcggacgttattcaagggaattctttaatcgcaggggggagctcaggcacatccataatttgaaacactgggggctttacgaggtgctaatggagaaatacgaatggcctctggaacaggcaacacagttctcggccttcctactgccgatgatggagtacattcccgaaaaacgcgcatcggctgcagactgcctgcagcacccatggctcaacccctag

SEQ ID NO: 59918 - DNA, 1602 bp, Artificial Sequence
  Description of Artificial Sequence: Synthetic coding sequence
atgtcagcttcgacagggggagggggagacagcggcggttccgggggttcctcatcaagttctcaggcttcctgtggcccagagtcgagtggcagtgaacttgccctggccaccccagtgccccaaatgctgcagggactgttaggatcggatgatgaggaacaggaagacccaaaggactactgcaaagggggatatcatcccgtaaagatcggggatgtgtttaatggaagataccacgtggtcagaaagctgggttggggccacttctccaccgtatggctttgctgggatatacagcgcaagcgtttcgtggccctgaaagtcgtcaaaagcgcgggacactacacagagaccgctgtcgacgaaataaaactcctaaagtgcgtgagagactcggatccctctgacccaaaaagagaaaccatcgtccaattaattgatgattttcgcatcagcggggtgaacggtgtgcacgtttgcatggtactagaggttttggggcaccagctacttaagtggatcattaaatctaactaccagggtctaccggtcccatgcgtgaagagcattgttcgacaggtgctgcacggactagattacctgcacacaaaatgcaagatcatccacaccgacattaaacctgaaaacatccttctgtgcgttggcgatgcatatattaggaggcttgctgctgaggctactgagtggcagcaggccggagccccaccaccctcacggtccattgtgagcacggctccgcaggaagtgttaaccggtaaattaagtaagaacaagcggaaaaagatgcgacgcaaacgtaagcagcagaaacgacttctggaggagcgattgcgagatctccagcggttggaagctatggaggcagccacgcaggcagaggactcaggcttgcgtctggacggaggctcggggtcaacctcaagctcgggttttagcggtagtttgttctcgccggcttcttgcagtattttgagcggatcctctaaccaaagggaaacgggcggattgctgagtccatccacaccattcggcgcaagcaatctgttagttaatcctctcgaaccccagaacgctgataagataaaaatcaagatcgcagatttgggaaatgcttgttgggtgcacaagcatttcaccgaggacattcagactcgccagtaccgggctgtcgaagttctcataggcgctgaatatggcccaccagccgacatctggagcactgcttgtatggcgttcgagcttgcgaccggcgattacctctttgagccacactctggtgaagattactcacgtgacgaggaccatatcgctcacattgttgagctgctgggcgacatcccaccagctttcgccttatctggcagatactcaagagaattctttaaccgacgaggcgagctcaggcatatacacaatctgaaacattggggcctgtacgaggttcttatggaaaagtatgaatggccccttgagcaggccacccagttctcggccttccttttgcctatgatggagtacatccccgaaaaaagagcttccgctgctgactgtctacagcacccttggctgaatccgtag

SEQ ID NO: 59919 - DNA, 120 bp, Artificial Sequence
  Description of Artificial Sequence: Synthetic coding sequence
atgacaggcttttttaaaggcgcagaagaccggtactcgtcccatttatggcggccacagggtggtcccagaagcaagggtcccggaccgaggtcctggaacaccgagagcttaaggtag

SEQ ID NO: 59920 - DNA, 1023 bp, Artificial Sequence
  Description of Artificial Sequence: Synthetic coding sequence
atggtgacgttgagaaagaggacgctgaaggtgctgacgttccttgttctcttcatctttctgactagtttctttctgaactacagtcacactatggtagccactacgtggtttccaaaacagatggtcctggaactgtctgagaatctgaagcggctaattaagcatcgcccatgcacttgcacccattgcatagggcaacggaaattgtctgcctggtttgacgagagatttaatcagacgatgcagccccttcttacggcccaaaatgcgctcctggaggacgacacataccggtggtggctccgtctgcagagagagaagaagcccaataatctaaatgacaccatcaaggaactgtttagagtggtaccgggaaatgttgatcccatgcttgagaaacgaagcgtagggtgtcgaagatgtgccgtcgtgggcaatagcggaaatctgcgggagagtagttatgggcctgagatcgattcccacgacttcgtgctgcgtatgaacaaggctccaactgccggattcgaggccgatgtagggaccaaaaccacacaccacctcgtttatccagagtctttccgagagttgggggataatgtttctatgatcctagttccatttaaaaccatcgatctggaatgggtggtgagcgcgattactacaggcacaatttcacacacatacatcccagtacctgctaagattcgggtgaagcaagacaaaattctgatatatcatcccgctttcattaagtatgtattcgacaactggctgcaaggccacggacgctatccctctacgggtatcctgagcgtcattttctcaatgcacgtctgtgatgaagtggatctttatggatttggcgctgattcaaaaggcaactggcatcattattgggaaaataatccaagtgcaggtgcattccgaaaaaccggggtgcacgacgctgatttcgagagtaacgtcaccgccacgcttgcttccatcaataagatccggatcttcaagggaagatag

SEQ ID NO: 59921 - DNA, 1023 bp, Artificial Sequence
  Description of Artificial Sequence: Synthetic coding sequence
atggtgacgctccgcaagcgcacacttaaggtcctcacattcttagttttatttatcttcctgacctcattcttcctaaactactcacatacgatggtggctactacctggtttcctaagcagatggtgttggagctgtccgagaacctgaaacgactgattaagcacaggccatgtacctgtacgcactgtattggccaacgtaagctgtctgcatggttcgacgagcgctttaatcagacgatgcagcctctgctgactgcacagaatgccctgctggaagatgatacctataggtggtggctccgcctccaaagagagaagaaacctaataatttgaatgatactatcaaagagctattcagggtagtgcctggtaacgtcgatcccatgctcgagaagcggtcagtgggctgtcgaaggtgcgctgtggtggggaacagcgggaatctgcgggaatctagttatggacctgagattgactcccacgactttgtactgaggatgaacaaagcacctaccgccggtttcgaggctgacgtggggacgaaaacaacccaccacttagtgtaccccgagagtttccgtgagttgggagacaatgtgtctatgatcctagttccttttaagaccatcgaccttgaatgggttgtgtccgcgatcaccactgggacaatcagccatacatatatcccggtgcccgcaaagatccgcgtaaagcaggacaagatcctgatctaccaccctgcgttcataaaatacgtcttcgacaactggcttcagggccacggccgatacccctccaccgggattttgagtgtcatcttcagtatgcacgtgtgcgacgaggttgacctgtacggcttcggagcagactctaaagggaattggcaccactactgggagaataatccttctgctggagcgtttcgcaagactggtgtccacgacgccgacttcgaaagtaacgttaccgcgactcttgcctctatcaacaagatccgaatcttcaaggggcgatag

SEQ ID NO: 59922 - DNA, 150 bp, Artificial Sequence
  Description of Artificial Sequence: Synthetic coding sequence
atggtgactctgcgaaagcgcactctgaaggtcttaacctttcttgtattatttatatttctgacgagtttttttcttaactattcccatactatggtggctaccacctggttccccaagcagatggtgttggaactgagtgaaaactag

SEQ ID NO: 59923 - DNA, 1023 bp, Artificial Sequence
  Description of Artificial Sequence: Synthetic coding sequence
atggtgacactccggaaaaggaccttaaaagtactgaccttcttggttctgttcatttttttgacgagcttcttcctgaactattcacacacgatggttgccactacgtggttcccaaagcagatggtcttggagttgtctgagaatctaaaacggcttattaaacaccgcccttgcacctgtactcactgtatcggacagagaaagctcagtgcctggtttgacgagcgcttcaaccaaacgatgcaacctttgctaaccgcccaaaacgcccttcttgaagatgacacttataggtggtggctgcgactgcagcgcgagaagaaacccaataacttaaacgacaccattaaggaattgtttcgggtggtgcctggcaatgtcgacccgatgctcgagaagaggtccgtggggtgcagaagatgcgcagtggttggaaactccggtaacctccgggaatccagctatggccctgagattgacagccacgattttgttctgaggatgaataaggctccgaccgctgggttcgaagccgacgtgggcacaaagaccacgcatcacctcgtgtaccctgaaagcttcagggaattgggggacaacgtcagcatgatcctggttccattcaaaaccattgatctggagtgggtggtctctgccattaccacggggacgataagccacacatacatccctgtgcctgccaaaattcgggtaaagcaggataaaatcctcatctaccaccccgcatttatcaaatacgtcttcgacaactggctgcagggacatggcaggtatccctcaacaggaatattgtctgttatattcagcatgcatgtgtgcgacgaggtggatctgtatggctttggcgcagacagcaagggaaactggcaccactactgggaaaacaatccaagcgccggagcattcagaaagactggggtgcacgatgcagacttcgaatctaatgttacagcaaccctggccagcattaacaagattcgaatattcaaagggaggtag

SEQ ID NO: 59924 - DNA, 1023 bp, Artificial Sequence
  Description of Artificial Sequence: Synthetic coding sequence
atggtgaccctgagaaaacgaacgctgaaagtattgacatttctggtactctttatttttctcaccagcttctttcttaattactctcacacgatggtcgcgacaacctggttcccaaaacagatggtgttggaattatcagagaacctgaaacggcttataaagcaccgcccttgtacctgtactcattgtattgggcaacgaaaactttccgcatggttcgatgagagattcaaccagaccatgcagccgcttcttaccgcccaaaacgcactccttgaagatgatacatacagatggtggctcagactacagagagagaaaaaacctaacaacctgaacgatacgatcaaagaactgtttcgagtcgtccccggaaatgttgaccctatgctggagaagcgttcagtcggctgtcggagatgcgcggtggtgggcaactcgggaaacctgcgcgaatcttcatacggcccagagattgattcacacgacttcgtattgaggatgaataaagctccaaccgcaggctttgaagctgacgtcggaaccaagacgactcaccatcttgtgtaccccgagagtttccgcgaattgggcgacaatgtctccatgatactggttccttttaagacaatcgatcttgagtgggtggtctctgctatcacaaccggtaccatctctcatacatacatccccgtacctgcaaagatcagggtgaagcaggataaaattctcatctaccatcccgcttttattaagtatgttttcgacaactggcttcaaggtcacggcagatatccatccactggtattctcagcgtgatttttagcatgcacgtgtgtgacgaggtggatttgtacggattcggcgcagatagcaagggcaactggcatcactactgggaaaacaacccctcagctggcgcattccggaaaacaggagttcacgatgccgacttcgaatccaatgtaacagccacactggctagcatcaataaaatccggatcttcaaaggcagatag

SEQ ID NO: 59925 - DNA, 219 bp, Artificial Sequence
  Description of Artificial Sequence: Synthetic coding sequence
atggtgacccttaggaaaaggacgcttaaggttctaaccttcctggtcctgtttattttcctcacctcgttcttcttgaactacagccacacgatggttgccacgacatggttcccaaaacagatggtgctggagcttagcgaaaaccttaaaaggttgataaagcaccggccttgtacttgcacacactgtattggacagagaaaattgtccgcctag

SEQ ID NO: 59926 - DNA, 144 bp, Artificial Sequence
  Description of Artificial Sequence: Synthetic coding sequence
atggtgaccctgaggaaaagaactctgaaggtgctaactttcttggtcttattcatctttcttacctctttcttcctgaattattcccataccatggttgctacaacctggtttccaaagcaaatggtgctcgagctgtcatag

SEQ ID NO: 59927 - DNA, 1221 bp, Artificial Sequence
  Description of Artificial Sequence: Synthetic coding sequence
atgattcatactaacctgaaaaagaaattctcgtgttgcgtgctggtgtttctactgtttgctgtcatttgcgtgtggaaggaaaagaagaagggttcgtactacgattcattcaagcttcaaactaaggagttccaggtgctcaagtctctcgggaaactcgctatggggtctgactcccagagcgtttccagtagctccacacaggacccccacagaggcaggcaaacgctaggtagcctgcgaggcctggctaaggcaaaacctgaggcatcatttcaagtgtggaataaagatagctcctcgaaaaatctcatccctcgattacaaaagatttggaaaaactacttatcaatgaataaatacaaggtgagctataagggcccaggacccggtatcaagttcagcgctgaggccctccgatgccacctacgcgaccacgttaatgtgtctatggtagaagttacagatttccctttcaacacttcggagtgggagggctatttgcctaaagagtccatcaggactaaagccggtccatgggggagatgtgctgtggttagcagcgccggtagtctcaaatcctcgcagctgggcagagagatcgacgaccacgatgctgttctgcggttcaacggagctcctactgccaatttccagcaggatgtcggtacgaaaactacaatcagactgatgaatagtcagctcgtcaccacagagaaacggttcttgaaggattccctatacaatgagggcattctgattgtgtgggacccatcagtataccactcagatatccctaagtggtaccagaaccccgattataacttcttcaataattacaagacatatcgcaagttgcaccccaatcagcccttttacatactgaagcctcagatgccatgggaactgtgggacattctacaggagatcagccccgaggaaatacagcctaaccccccatcctccgggatgctcggaatcattatcatgatgacactgtgcgatcaggtggacatttatgagtttctcccaagcaaacgtaagacagatgtatgttattactaccaaaagttctttgactcagcctgcacaatgggcgcataccaccccctgctgtacgaaaagaatttggttaaacacctgaatcagggtaccgatgaagacatttatctgctgggaaaagccacactgcctgggtttaggaccattcattgttag

SEQ ID NO: 59928 - DNA, 228 bp, Artificial Sequence
  Description of Artificial Sequence: Synthetic coding sequence
atgatacacaccaacctcaaaaagaagttctcatgctgtgttctggtcttcctgctgtttgctgtgatttgcgtgtggaaagagaaaaaaaagggctcctactatgatagtttcaagctccaaacaaaagagttccaggtgctgaagtctctcgggaagttggcaatgggatccgactcccagtcggtttctagctcgagtacacaagaccctcataggggcagatag

SEQ ID NO: 59929 - DNA, 342 bp, Artificial Sequence
  Description of Artificial Sequence: Synthetic coding sequence
atgatccataccaatctcaaaaagaagttttcttgttgcgtgcttgtgtttttgcttttcgctgtaatttgcgtgtggaaggaaaagaagaagggaagttactatgacagcttcaagctgcagactaaagagtttcaagtgttaaaatctctcggaaagcttgccatgggcagtgacagccagtcagtgtccagttctagcacccaggatccccatcgaggtcgtcagactctgggctcacttaggggattagccaaagcaaaaccagaagcttcctttcaggtgtggaacaaagacagcagctccaagaatctcattccacggttacaaaagatttggtag

SEQ ID NO: 59930 - DNA, 384 bp, Artificial Sequence
  Description of Artificial Sequence: Synthetic coding sequence
atgatacacaccaacctgaaaaagaagtttagctgctgcgtcctcgttttcttgctgtttgctgttatctgtgtttggaaggagaagaagaaaggaagctactatgacagcttcaagctgcagacaaaagagttccaggtgctgaagtctctgggtaagctcgctatgggatctgattctcagtccgtatcttcgtccagcactcaggatccccaccgcggtaggcagacattaggctcactccgcggtcttgccaaggcaaagccggaggcctctttccaggtgtggaacaaggactcaagttcaaagaacctgatacctcgactgcagaaaatctggaagaattatctgtccatgaataaatacaaagtctcttataaatag

SEQ ID NO: 59931 - DNA, 129 bp, Artificial Sequence
  Description of Artificial Sequence: Synthetic coding sequence
atgatccataccaacctcaagaaaaagttctcatgctgtgtattggtcttcctcctgtttgctgtgatctgtgtgtggaaggagaagaaaaagggttcttactatgactctttcaagctccagacttag

SEQ ID NO: 59932 - DNA, 294 bp, Artificial Sequence
  Description of Artificial Sequence: Synthetic coding sequence
atgatccataccaatctgaaaaagaagttcagttgctgcgtgctggtcttcctgctgttcgccgtgatttgcgtatggaaggagaaaaaaaagggatcatactacgattcatttaaacttcagacaaaggagtttcaggttctgaaatcgctgggaaagctcgcaatggggtcagacagccagagcgtcagcagtagctctacccaggatccgcatagagggaggcagacattgggctccctgcggggtctggctaaggctaagcccgaggcatctttccaagtgtggaattag

SEQ ID NO: 59933 - DNA, 138 bp, Artificial Sequence
  Description of Artificial Sequence: Synthetic coding sequence
atgatacacaccaatctaaagaaaaagttttcttgctgcgttctcgtgttcctcctgttcgctgtgatttgcgtgtggaaggagaagaagaaaggatcatattatgattcattcaagctgcagacaaaggagttctag

SEQ ID NO: 59934 - DNA, 276 bp, Artificial Sequence
  Description of Artificial Sequence: Synthetic coding sequence
atgatccacaccaacctgaagaagaagttctcctgctgtgtcctggtcttcctcctctttgctgttatctgtgtgtggaaagagaagaagaaaggatcatattatgactcgtttaaactccagaccaaagagtttcaggtcctcaagagcctgggcaaattagctatgggatcagactcacaatctgtgagttcatccagcacccaagacccgcaccgcggtagacagaccctaggcagtttgaggggtctggcaaaggctaaacctgaagcctag

SEQ ID NO: 59935 - DNA, 1221 bp, Artificial Sequence
  Description of Artificial Sequence: Synthetic coding sequence
atgatccatacaaaccttaagaaaaagttctcatgttgcgtgctagtgtttctactgttcgcggtgatctgcgtgtggaaggagaagaaaaagggaagctactatgactcattcaagctccaaacaaaggaatttcaggtgcttaagagcctgggaaaattagccatggggtccgattcccagagcgtgagttcatcctccactcaagatccacacaggggccgtcagaccctgggaagtctgcgcggattagccaaagcaaagcccgaggccagcttccaggtctggaataaagacagctcaagtaagaacttaattccccgattacaaaagatttggaaaaactacctctccatgaataagtacaaggtgtcttacaaagggcctgggcctggaataaagttcagtgctgaggcactgcggtgccacctgagggatcacgtcaatgtgtctatggtggaggtaacggatttcccgtttaacacatccgagtgggaaggatacctccctaaagagagcattcgaacaaaagcaggtccctggggtaggtgtgcagtggttagttctgcgggaagtttaaagtcttcccagttgggcagagaaatcgacgatcacgacgccgtgcttaggtttaacggtgccccaaccgccaatttccagcaagacgtaggtactaaaactaccatccgattgatgaactcccaactggttactaccgagaagcgctttctgaaggactccctgtacaacgaaggcattctgattgtgtgggatccatcagtctatcattctgatattcccaagtggtaccagaatccggattataattttttcaataactacaaaacttacagaaagctgcaccctaaccagcctttctatatcttaaagccccagatgccatgggagctatgggacatcttacaggagatctcgcccgaagagattcagcccaatcctccctccagcggaatgctgggaattataataatgatgacactgtgcgaccaggtggacatctacgaattcctgcctagcaagcggaagaccgatgtctgttactactaccagaaattctttgactctgcatgcacgatgggcgcttaccatcccctgctctacgagaagaatctggttaagcatctcaatcaggggacggatgaggatatatatcttctgggaaaagccactctgccagggttccggaccatccactgttag

SEQ ID NO: 59936 - DNA, 297 bp, Artificial Sequence
  Description of Artificial Sequence: Synthetic coding sequence
atgatccataccaatctcaaaaagaaatttagttgctgcgttctcgtgttcctgctgtttgccgttatttgtgtgtggaaggagaaaaagaagggcagctactacgacagttttaagcttcaaaccaaagagttccaagtgttgaagtcactaggcaaactagccatgggttcagactctcagagcgtgagttctagttccacccaggacccgcaccgcggtcggcagactcttggcagtcttcgcggtttggctaaagccaagcccgaggcgtcgtttcaggtgtggaacaagtag

SEQ ID NO: 59937 - DNA, 528 bp, Artificial Sequence
  Description of Artificial Sequence: Synthetic coding sequence
atgaactctcaactggtcaccaccgaaaaaaggttcctcaaggacagcctctacaatgaaggtattcttatcgtctgggatcccagtgtgtaccatagcgatatccctaagtggtatcagaaccccgattacaatttcttcaacaactataagacttatcggaagctgcaccctaatcagccattctacattctgaaaccccagatgccctgggaactgtgggatatcctgcaggagatatctcctgaagaaatacagccgaatcccccatcatccgggatgttgggaatcataattatgatgactctgtgtgaccaagtggacatatacgaattcctacccagcaaaagaaaaacggatgtctgctattattatcagaagttctttgactctgcttgcacaatgggagcctatcatccactgctttacgaaaagaatctggttaagcacctaaatcagggcacagatgaagacatctatctgctggggaaagccaccttgcctggcttcagaactattcactgttag

SEQ ID NO: 59938 - DNA, 78 bp, Artificial Sequence
  Description of Artificial Sequence: Synthetic coding sequence
atgatccacacaaatctcaaaaagaagttctcatgttgtgtattggtgttcctcctgttcgccgtcatttgtgtatag

SEQ ID NO: 59939 - DNA, 876 bp, Artificial Sequence
  Description of Artificial Sequence: Synthetic coding sequence
atggagaaacttgctgcctccacagagcctcaggggccaaggccagtccttgggagggagtcggttcaagtcccggatgatcaggattttaggagtttccggtccgagtgcgaagcagaagtcggttggaacctgacatacagccgcgctggcgtttccgtttgggtgcaggccgtcgaaatggatcggactctccacaaaattaaatgtaggatggagtgttgcgatgtgccggctgaaacactttacgatgttctgcacgacattgaataccggaagaagtgggatagcaacgtgattgagacatttgatatcgcaagattgaccgtcaacgcagacgtgggatattattcatggagatgtcccaagccactgaaaaacagggatgtcataactctccgctcatggctgccgatgggtgccgactatatcataatgaattacagcgttaagcatcctaaataccctccccgaaaggaccttgttcgcgctgttagtattcagactggatacctgatccaatccacagggccaaaatcctgcgtaatcacatatctcgcccaggttgacccaaaggggtcccttcccaaatgggttgttaataagtcgtcccagttcttggccccaaaagcaatgaagaagatgtacaaagcatgtctgaagtatcctgaatggaagcaaaaacatctcccacactttaagccatggcttcacccagagcagagccccttgccttccctggctcttagtgagttgagtgtacagcacgctgactcactggaaaacatcgacgagagcgccgtcgcagaatcccgggaggagaggatgggaggcgctggcggagagggtagcgacgacgacaccagcctcacctag

SEQ ID NO: 59940 - DNA, 270 bp, Artificial Sequence
  Description of Artificial Sequence: Synthetic coding sequence
atggaaaagctagccgcatccaccgagcctcagggacccaggcctgtcctagggagggagtccgtccaagttcccgatgatcaagactttcgttcatttcggtctgaatgtgaggcggaggtgggctggaatctcacatattccagagcaggcgtcagtgtgtgggtgcaggccgttgagatggatcgaaccctgcataagattaagtgtcggatggagtgctgcgatgtcccggctgagaccctgtacgacgtactccatgatatttag

SEQ ID NO: 59941 - DNA, 759 bp, Artificial Sequence
  Description of Artificial Sequence: Synthetic coding sequence
atggagaaactggcggctagcacagagccgcaaggtcctaggcccgtgctgggcagagagagcgtgcaggtgcctgacgatcaggacttcagatctttccgcagtgaatgcgaggccgaggtgggttggaacttgacttattcccgcgcaggcgtgtctgtctgggtacaggcagtggagatggaccggactctgcataagatcaaatgtaggatggagtgctgcgacgtgcccgctgagaccctgtatgatgtgttgcacgatatcgaatatcgcaagaagtgggattccaacgttattgagacctttgatatcgccagactgactgtgaatgccgatgtggggtattactcctggcggtgcccaaaacctttgaagaatcgagacgtgataacacttagatcatggctgcctatgggcgcagattacattataatgaactacagcgtgaagcatccgaagtacccaccacgcaaagatctcgttcgcgcagtcagcatccaaacaggctatcttatccaaagcaccgggcctaagagctgcgtcattacttacctggcccaagtcgaccctaaaggctctctaccaaaatgggtcgtcaacaagtccagccagttcctggccccaaaggcaatgaaaaaaatgtataaagcctgcttaaagtaccccgagtggaaacaaaagcatctccctcacttcaagccctggttgcaccccgagcagagccctcttccatcacttgccctaagtgagctctag

SEQ ID NO: 59942 - DNA, 39 bp, Artificial Sequence
  Description of Artificial Sequence: Synthetic coding sequence
atggagaagctggcggcaagtaccgaaccccagggctag

SEQ ID NO: 59943 - DNA, 576 bp, Artificial Sequence
  Description of Artificial Sequence: Synthetic coding sequence
atggagaagctggcagcctccacagagccccagggacccaggcctgtgctgggaagggaatctgtacaggtgcctgacgaccaggattttcgctcgtttcgctctgaatgtgaggcagaggtcgggtggaatcttacgtactccagagcaggcgtgagcgtctgggtccaggcagttgagatggatagaacgttgcataagatcaagtgtaggatggaatgttgtgatgtgccggcagaaacgctctatgacgtgctgcacgatatcgagtataggaagaagtgggactctaacgtgattgaaacattcgatattgcccgactgactgttaacgctgatgtgggttactatagctggcgatgccccaagcccctgaaaaaccgcgacgtcatcacactgcgctcttggctccccatgggcgcagactatatcatcatgaattatagtgtgaaacacccaaaataccctcctaggaaggacttggtgagagctgtctctatacagacagggtatttgattcagagcaccggacctaagtcatgcgtgatcacatatcttgctcaggtggatccatag

SEQ ID NO: 59944 - DNA, 876 bp, Artificial Sequence
  Description of Artificial Sequence: Synthetic coding sequence
atggagaagctggccgcttctacggagccccaaggtccccgaccagtgcttggtcgggagtcagtacaggtccccgacgaccaggatttcaggtccttccgatccgagtgtgaggctgaagtaggctggaacttgacctattcccgagccggagtaagcgtctgggttcaggctgtcgaaatggaccggactctacacaagattaagtgccgcatggaatgctgcgatgttcctgccgagacgttatatgacgtgctgcacgatatcgaataccgaaaaaaatgggatagtaacgttatagagaccttcgacatcgcaagactgaccgtgaatgctgacgttggatactactcatggcgatgtcccaaacctcttaagaaccgcgatgttattaccctgcgaagctggcttccgatgggcgctgattacattattatgaactactcggtcaaacatccaaaatatcccccaagaaaggatctcgttcgcgcagtctctatccagaccgggtatctcattcagagcaccgggccaaagtcatgcgtgattacatatctggcgcaagttgatcccaagggcagtctgcccaagtgggtagttaacaagagttcacagtttctcgcgcctaaggctatgaagaaaatgtataaggcatgcctgaagtatccagaatggaagcaaaagcatcttccgcatttcaagccatggctccacccagaacagagtccacttccctcgctcgctctatccgaactgtccgtccagcatgcagatagcctcgagaacattgatgaatctgcagttgccgaaagcagggaggaacgtatgggcggagccggaggagaaggatccgacgatgacacgtccctgacttag

SEQ ID NO: 59945 - DNA, 417 bp, Artificial Sequence
  Description of Artificial Sequence: Synthetic coding sequence
atggaaaaactcgccgcaagcaccgagcctcaaggcccacgccctgtcctcggcagagaaagtgtgcaggtccccgatgaccaggactttcgctcatttaggagtgagtgtgaggcagaggtgggctggaatctgacgtattccagggcaggcgtgagcgtgtgggttcaggctgtggagatggaccggactctgcacaaaataaagtgccggatggaatgctgtgacgtccctgcggaaacattgtatgatgtgctccacgacatcgaataccggaagaaatgggactccaatgtaatcgaaacctttgatatagctcgtctgacagtgaatgccgatgttggatattatagctggagatgtcctaaacctctgaagaacagagacgttataacgcttaggtcgtggctcccctag

SEQ ID NO: 59946 - DNA, 14103 bp, Artificial Sequence
  Description of Artificial Sequence: Synthetic coding sequence
atggcgaacgttcaggtggctgtccgcgttcggcctctgtcaaagcgtgagacgaaggaaggagggcgaattatcgtcgaggttgacgggaaggtagcaaagataaggaacctgaaagtagataaccgcccagacggctttggagactcacgcgagaaagtcatggctttcggctttgattattgctattggagcgtgaacccagaagaccctcagtatgcctcccaagacgtagtgttccaggatctgggtatggaagtgctgagtggtgtcgcgaagggctacaatatttgcctctttgcctatggccaaactggtagcggcaaaacatataccatgctggggactcctgcgtcagtcggtctcactccccgtatctgcgagggcctcttcgtgcgcgaaaaagactgcgcgtcactgccttcatcttgtcgtatcaaagtgtctttcttggaaatatataacgagcgagttcgcgatctacttaagcagagtggccagaaaaagtcgtatactcttcgcgtgagggagcacccggaaatggggccttacgtgcaggggctgagccaacatgtggtgaccaactataagcaggtgattcaattactagaagagggaattgccaacaggatcacagccgctactcacgtgcacgaggcatctagccgtagtcatgcaatctttacgattcactacacccaggccattcttgaaaacaacctgccctctgagatggcatccaaaatcaatcttgttgacttggccggatccgaacgggcagacccatcctattgtaaagatcggattgccgagggtgcaaatatcaacaaatcattggtaacactgggcatcgtgatcagcacgctcgcacagaactcccaggtcttttcaagctgccagagtctgaacagttctgttagcaatgggggtgactcagggatcctgagctcaccaagcggcacatcgtcaggaggtgctccatctaggcgccagagttacataccctaccgagacagcgtgctgacttggctgctgaaagattcgctgggcggaaactcaaagaccataatggtagctaccgtcagccccgctcatacaagctactcagaaacaatgtctactctcagatacgccagtagtgccaagaacataataaacaagccgcgagttaatgaagatgctaatttgaaacttataagggagcttcgcgaggagatcgagcggcttaaggccctgctgctgtcttttgaattgcgaaacttctcctctttaagtgacgaaaatttgaaggagctggttcttcaaaatgagctgaagatcgatcagctgacaaaggactggactcaaaagtggaacgattggcaggctttgatggaacactatagcgtcgacattaataggcgcagggccggagttgttattgatagtagcctcccccatttgatggccctggaagatgatgtcttgagtaccggcgtggtcttatatcatctaaaagaaggcactacaaaaattgggcgaatcgattcagaccaggagcaggatatagtcctccagggccagtggatcgagagggaccactgtacaatcacaagcgcctgcggcgtagtcgtcctaagaccagcaagaggggcacgttgtacagtcaatggcagggaggtgaccgcttcctgcagactgactcaaggggcagtgattaccttagggaaggcgcagaaattcagattcaaccatcccgcagaagccgcagtgcttcggcagaggaggcaggtgggagaagccgcagctgggaggggatcccttgaatggctggaccttgatggtgacctcgccgcttcacggctcgggctgtccccgcttctgtggaaggagcggagagctctggaggagcagtgtgatgaagatcaccaaacccctcgggatggcgaaacgtcccatcgtgcacagatacagcagcagcagtcctacgtcgaagatttacgccatcaaatcctggctgaagaaataagggcagcaaaggagctcgagttcgaccaagcctggatctcccagcagataaaggaaaatcagcaatgcctgctacgagaagaaacctggctagcttcacttcagcagcaacagcaggaggatcaagtggccgaaaaagaactcgaggcaagtgtggccctcgacgcctggttgcagaccgaccctgaaatccagcccagcccgtttgtccagagccaaaaacgtgtggtgcacctgcagctcctgcggagacacaccttacgcgcagctgagcggaacgtgcggaggaagaaagtaagctttcaattggaacgtataattaagaaacagcgcctgcttgaagcgcaaaagcgccttgaaaaactgacaacactgtgttggctgcaggatgactccacccaggagccaccctaccaggtgctgtcccccgatgccaccgtcccgagacctccgtgccgctccaagttgacctcttgtagctcactttccccccagcgtctgtgctcaaaacacatgcctcaacttcacagcatctttctgtcatgggacccatctactacactgccccctaggccggatcctacacatcagaccagcgagaagacgagttctgaagaacacctcccccaggcagcttcgtaccccgctagaactggctgcttacgcaagaacggcctgcattcctcgggccacggccaaccctgcacagccagagccgctctggcgagaaaaggggcatctgcgcctgacgcttgtctgacaatgagtcccaactcagtgggaattcaagagatggagatgggagtgaaacaaccccatcagatggtgagccaaggcttggcctctctgcgaaagagtgcgaacaaattgaagcctcggcacgagcccaaaatcttcacttctacaacccagacgaggggcgcaaagggcctggcggaccctagccacacccaggccggatggcgtaaagaggggaaccttggaacccataaggcagccaagggtgcctcctgcaactctctgtaccctcacggtcctcgacagaccgcgggacacggcaaggcagtcaagactttctggactgagtataagccaccttctccaagcagagcttcaaaacgacatcaacgcgtgctagcaacccgggttaggaatataaccaaaaaaagctcccacctgcctctcggaagtcctcttaaacggcagcagaatacacgcgatccagatactatggtaccgcttactgactttagccctgtcatggaccacagtagggaaaaagacaatgatctcagcgacaccgattctaactactccctcgattctctgagctgcgtgtatgccaaagccctgattgaacccctgaagcccgaggagcggaaatgggattttcctgagccggagaattccgaaagcgacgacagccagctatctgaggacagtcttgcagagaaaagataccagagtcctaagaatcgcctgggaggcaacaggcccactaataacagaggacagcctcgtacccgcactcgcgctagcgtccgcggtttcacagctgcatctgactctgatctccttgctcagacccatcggtcctttagccttgactccctgatcgatgcagaggaagaacttggagaagaccagcaggaggaaccatttccgggatctgccgacgagatcccaaccgaaacattttggcatctcgaggattcctctttaccggtgatggatcaggaggcgatctgccggctgggccctatcaactatagaacagctgctagattagatgcggtgctgccaatgagctccagtttttaccttgacccacaatttcagccccactgtgagctgcagcctcactgtgagcttcagccccactgtgagctgcagcctcattgcgagcaagccgaatctcaggtggagccatcgtactctgagcaggccgatagcctgcaagggatgcagctctctagagagtcccccctcatgagcatggattcctggttttcatgtgactcaaaaatcaacccttcgtccccaccaggaatcgtaggaagcctgtgcccaagtccagacatgcaagagttccactcgtgtaagggggagcgccctgggtactggcctaacaccgaggaactcaagcctagtgatgccgaaacagttttgccttatagcagcaagctgcatcaaggttcgaccgaactcctctgcagcgcacgcgacgaacacacagcaagcgcagcagatacctccaggctgagcctctggggaattcagaggttgattcagccaggcgcagatgggacctttcaggggaggtgtattccagacatgacccaacagggatcgtcagaagcctcccacaacagtagcgtgtcgaacgtgttggcagccagcgccacaacgttaacccacgtgggcagcacccacgaacgcgattggagcgccttacaacagaaatatcttttggaactgtcctgccctgtcttggaagctatcggagctcccaagccagcctatccctatctcgaagaagacagcgggagcctggcccaggccagctctaagggcggagataccctgcttcccgtggggcctcgcgtcagcagcaatttgaatcttaacaatttccctgtacacttgtccaggatccgacgcctgcgagctgaaaaggagcaggacagtcttaacgccaagctggagggggtgtccgatttcttctctaccagcgagaaggaagcaagctacgacgaaacttacagcgcagacctggagagccttagtgccagcagatcaaccaatgcccaggtgttcgccactgaaaatgcaatccctgacagcatgacggaagcttgcgaggtaaagcaaaataatctggaagaatgcctccagtcgtgtcgtaagcctggcctgatgacctcaagcgacgaagacttctttcagaagaacgcatgccacagtaacgtgactacggccacaaaggctgatcactggagtcagggctgggcgcctcttcggaagaatagtgccgtgcaacccggacagctttcacccgacagccactaccctctggaggaagaaaagactgactgccaagagagctctaaggaagctgtccgcaggcacattaatgtctcctttgccctgccgtccggacctgagctttatttacactctgccccatggaatccgttgagctcctctttacaacccccattgctggagaccttctacgtgacaaagagtagggacgccctcactgagaccgccctagaaatccctgcatgtcgggaggtgcgggtccccagcccaccccctcgcgaagcctggggtttcggtcataatcaccaagcactgcaaggagcctatttgaagaataatctgccagtgttactgcagaaccagaatagtaagattgcatcaagtcagcaggtgaccgccgaaatcccagtagatctgaacacgagagaagtcattagagagtcagggaagtgccctgggaatatcactgaagaatcgcatgattctgtgtacagcagcgtgacccagaataggcacttccttccgtctacttccaccaaggtttgcgagtttgagaatcaagtggtcattctgaataaaaaacactcttttcccgcactggagggcggtgaagtgaccgcccaatcgtgttgcggtgcgagttccgattcaacagagtcagggaaaagcctgctgtttcgggagtccgaggccagggaagaggaagagttagaccagaacaccgtgttgcgacagacaattaacgtaagtctggaaaaagatatgcctggagaaagtgctgtctctctgaagagtagatcagtcgaccggagagtgtctagccctgtgatggtcgcccaggggggtggcccaacaccaaaatgggaggggaagaacgaaacggggctgctggaaaaaggtcttcgtcccaaggatagctccgaagagtttaagctgcccggaaccaaaccagcctatgaacgcttccagctcgtggcatgccctcaggagaggaatccctcagaatgcaagagccaggagatgctgaatccaaacagagaaccatccggcaaaaagcagaataagagggtaaataatacagatgaaatggcccgattaattcggtcagtgatgcaactggagaatggaatcctagagatcgagtctaagcaaaacaaacaggtgcatgctagtcatacccccggaacagataaagagctggtgtttcaggaccagaaagagcaggagaaaacggatcatgcattccgcccagactcctcgggcaatcctctgccgtccaaagatcagccatcgtccccaaggcagaccgatgacacagtcttccgcgattcagaggccggtgccatggaggtaaattctataggtaaccacccccaggttcaaaagatcacccctaatccctttcgctcaagggaaggggtgcgggagtcggaaccagtgcgcgaacacacccatccggcaggcagcgacaggccggcaagagatatatgtgacagtctcggtaaacacaccacatgtcgggaattcaccaatacgagcctgcacccgcaacgaatgaaggccttagcacgagccttacctctgcagccgcgtctcgagaggagttccaagaataatggacagtttgtgaaagcctcggcaagccttaagggacagccttggggcctggggtccttagaagagctcgagaccgtgaagggtttccaggagtcccaggtggccgaacacgtgtctagcagtaaccaagaagaaccgaaggcccaaggcaaagtcgaagaaatgccaatgcagcggggagggagcctccaagaggagaacaaagtgacccaaaagtttccctccctcagccagctgtgcagggacactttcttccgccaagaaaccgtgagccccctcctctcacgcacagaattttgcactgcacccttacatcaggatcttagcaacactctgcccttgaattcccccaggtggcccagaaggtgcctgcatgtgcccgtagccttgggaatcagtagcctggattgcgtcttggacctgaccatgttgaagatccacaactccccactggttaccggggtcgaacatcaggaccagtcaaccgaaacaaggtcccactctcctgaggggaatgtccggggtaggagttctgaggcccacacagcctggtgtggatccgtgagaagtatggccatgggctctcattcgcagtcaggcgtgccagagtccatcccgttgggcaccgaggaccgtatcagtgcctccacatccccacaggaccacggcaaagacctcagaataaccctgctgggtttctccactagcgaggactttgcctcagaggccgaagttgcagtgcaaaaagagattcgcgtctccagcctgaacaaggtaagctctcagcccgagaaacgggtgtccttcagtttggaggaggattctgatcaggcctccaagcccagacagaaggctgagaaggagacagaggatgtgggcctgacatccggcgtttccctcgcccctgtctctctgcctagagtaccatcacccgagccacgccttttggaacctagcgaccatgcttcaatgtgcctcgcaatcctggaagaaattcgtcaagctaaggcccagcgaaagcagctgcatgattttgtggccaggggtacagtgctaagttattgtgaaaccctgctggaacctgaatgtagctccagagttgccggaagacctcagtgcaaacaaatcgaccagagctcttccgaccagacaagaaatgagggagaggcaccagggttccacgtggcatctctgtccgcggaggcgggacagattgacctattgcccgacgagagaaaagtgcaggctacgagcctttctgctgactcttttgaaagcctgcccaacacagaaaccgatagggaaccctgggacccagtgcaggcattctctcacgccgcacccgctcaggatagaaagagacgcactggtgaattgcgacagtttgccggtgcatctgaaccctttatctgccactcctctagctcagagattattgagaaaaagaaggatgcaacgcggaccccaagctctgctgacccactggcgcctgattcgcctcgctccagcgcccctgtggaggaagtcaggcgcgtcgtgagcaagaaagtggtcgccgcacttccctctcaggccccttacgacgatccacgcgtaaccttacacgaactcagtcaatccgtcccccaagaaacagctgagggcattccccctggttcccaggattcttctcccgagcaccaagagcctaggactctggataccacatacggggaggtgtcagacaatctgttggtgaccgcccagggggaaaaaactgcccactttgaatcccaatctgtgacttgtgacgttcagaattccacaagtgcatcaggaccgaagcaggaccatgtacagtgccccgaggcctccacaggcttcgaggagggacgcgcatccccaaaacaagataccattttaccaggggctctcactcgcgtcgcacttgaagcacccacccagcagtgtgtgcagtgtaaggaaagcgtcggatccggtttgacagaagtttgtagggccggttctaagcattctcggcctataccactgccagatcaacggccatctgcgaacccgggaggcatcggcgaagaagctccttgtcggcatcctcgtgaggctttggacggaccggtcttttcaagaaatcctgagggctcacggactctcagcccatctaggggcaaagaatcacgaaccttgccgtgcaggcagccatgctcttcgcaaccggtggccactcacgcctattctagccacagtagcactctgctctgctttcgagacggagaccttggcaaagagcctttcaaggccgcacctcacaccattcaccctccttgtgttgtaccctcacgggcttatgaaatggatgaaaccggtgagatttcgcgagggcctgatgtccacctcacccatggtctggagcctaaggacgttaacagagagttcagattgactgagtccagcacgtgcgaaccctccacagtggccgctgtgttatcaagagcacaggggtgtaggtccccctccgccccagatgtacgaacgggctcattcagccatagcgccacagacgggtccgtggggctcattggcgttcccgagaaaaaggtggcggagaagcaggccagcactgaactggaagcggcatccttccctgctggtatgtactccgagcccttgcgacagtttcgagacagcagtgtaggggatcagaacgcacaggtgtgccagaccaatcccgaacctcctgctaccactcaagggccacatactctggatctgagcgaaggtagcgccgaatccaagctcgtagtagaaccccagcatgaatgtttggaaaacaccacaaggtgcttcctggagaagccacaattctccactgaactgagggatcataatcgtctggatagccaggccaagttcgtagcgagactcaaacatacgtgctctccccaagaagatagtccttggcaggaagaggagcaacatagggaccaggcttctgggggaggtgagggatttgctcaaggcgtgaacccactcccagatgaggatggcctggatggttgccaaattctggatgccggacgagaagaggtcgccgtggctaagcccccagtgtccaaaatcctgagtcagggcttcaaagacccggcaactgtgtcactcagacagaatgaaaccccccagcccgctgctcaacggagcgggcacctctataccggaagggaacaacccgcacccaatcatcgcggtagcttgcccgtgaccacaattttcagcgggccaaagcacagtcgctcctctcccacacctcagttttctgtggtgggctctagcagatccctgcaggagctcaacctgagtgtagagcctccgtcccccacagacgaggatactcaaggccctaatcgactgtggaatcctcaccttagggggtatagctcagggaaatcagtcgctaggaccagtcttcaagctgaagactcgaatcaaaaagcttccagccgactggacgatggaacaaccgaccaccgtcatctcaagccagccacaccaccttacccaatgccttcaacactaagccatatgcccacccctgatttcacgacctcttggatgagcgggactctagaacaagcacagcagggtaagagggaaaaactgggagtccaggtgcgcccagaaaactggtgtagtcaaatggacaaaggcatgctgcatttcggcagcagcgacatctcaccttatgccctcccctggaggcccgaagaaccagcgagaataagttggaaacaatacatgtccggctccgccgtagacgtgagttgctctcagaaaccacaggggcttactctcagcaacgtggctcgctgcagttctatggacaatggtctggaagaccagaacagtccttttcacagccacctgtcaacatacgccaatatttgcgatctgtcaacgacccatagttctaccgagaatgctcaaggatccaatgaagcatgggaagtgttcaggggaagcagctcaatagcgttaggcgacccccatattcccacgtctcctgaaggtgttgctccaacaagtggacacgacaggcggcctcagttccgaggacctagcggtgaggcggattgcctgagatccaagcctcctctcgctaaaggtagcgcagccggaccagtcgatgagatcatgctgttgtacccatcagaggcgggatgtccggtgggacaaacacgcaccaatacttttgagcagggcactcagactttaggttcgcggaggcactggagctcaacagacatctcattcgcccagcccgaggcatccgccgtctcagcgtttgatctcgcatcatggacgtctatgcacaacctctccctccacctgagtcagctgctacactcaacttccgaactgctgggctctttgagtcagcctgatgtggcccgacgcgagcagaatactaaaagagacatccctgacaaggctccccaagcgttaatgatggatggatccacgcagaccaccgtagacgagggcagtcagactgacttgactctgcccacgctgtgcctgcaaaccagcgaggccgaaccccagggggcaaacgtgatactggagggactgggttccgatacaagcacagtgagccaggaagaaggagacgtccccggagtaccacagaaaagagaggccgaggagacagcccaaaaaatggcccagttgctgtacctccaggaagagtccacaccatataaaccccaaagtccatccatcccttctagccatctccgctttcagaaagccccagttggtcagcacttgccaagcgtgagtccttccgtgtcagacgcttttttacccccatcttctcagcctgaagaatcctactgcctagtcgtatcttctccatctcctagcagtcctcactcccctgggctgttcccatctacctccgagtaccccggtgacagcagggttcagaagaagctcggacctacctctgcactgttcgttgatagagccagtagccccattctgacactgtctgctagtacccaggaaccaggtctgtcccccggtagtcttaccctgagtgctccatctacccatccagtggagggtcatcagaaactagacagttccccagatcccgtggacgccccaagaacacctatggacaattactcccagacaactgacgaattgggaggcagccagcggggacgatcgtccctacagaggtcgaatggccgatctttccttgaacttcatagccctcactcgccccagcagtctcctaagttacagtttagctttctcggacagcatccccaacagttgcagcccagaacaactattggggttcagtctcgccttctcccaccgcctttgagacatcgtagtcagagactggggaattctttcgttcctgaaaaggtcgcaagcccggagcattgccctttgagcggaagggagccctcgcagtggcagagcagaaccgagaatggaggagaaagtagcgcctcccccggagagcctcagagaactctcgatcgcccaagctcctggggtggtctacaacacctgtcaccatgccctgtgtccgaattaactgatacggccggactccgaggctctgctctgggattgccgcaggcctgtcagcctgaagagctgctgtgcttttcatgccagatgtgtatggctcccgagcatcagcaccattccctgcgagatctaccggtgcacaacaaattctctaattggtgtggtgttcagaagggcagccctggaggtttagacatgacagaggaagagttaggggcttcaggcgacctttcctcagaaaagcaggagcagtccccgcctcagccacccaacgaccactcccaggactcagagtggtcaaagagagaacaaatcccactgcaggtgggtgctcaaaatctttcactttccgtggagttgacagaagctaaactgcaccacgggtttggcgaagctgatgctcttctgcaagtgctgcagtcaggtaccggcgaagctttggccgctgacgaacctgtcactagcacgtggaaggaactctatgcacgacaaaaaaaagctattgaaacattgcgaagggaaagggccgagagactgggcaatttctgcaggacgcgcagtctgtccccccagaaacagctgtctctcctgcctaataaagatctgttcatttgggacctggacttgccttcaagaaggcgcgaatatctccagcaattgcgcaaagacgtggtggagactacccggagcccagagagcgtatcccgctcggcccacacaccgagtgatattgagttaatgctccaggattaccagcaggcccatgaagaggcaaaggtggagatagccagagcacgagaccagctacgggaaagaaccgagcaggaaaaactgcgaatccaccagaaaatcattagccagctgcttaaagaagaagataaactgcacacacttgccaactccagcagtctctgtacgagcagcaacggctccctgtcatccgggatgacaagcgggtataacagctcccctgcattaagcggccagctacagtttccagagaacatgggacacaccaacctgccggatagtagagacgtgtggatcggagatgaaagggggggtcacagcgcagtccggaaaaactccgcatacagtcaccgagcaagtcttgggtcttgttgttgcagtccttcatcactcagctccctgggcacgtgcttctctagctcttaccaagatcttgccaagcacgttgtggatacgtcaatggcagacgtcatggctgcatgttcagataacctccataacttattcagctgccaagcaaccgctggctggaattaccagggggaggaacaggccgtgcagttatactataaagtcttcagtccgaccaggcatgggtttctgggagcgggagtggtttcccagcctctgtctcgcgtctgggctgctgtgagtgaccctactgtctggccactctactacaagcccattcaaaccgccagactccaccagagagtcacgaattccataagccttgtgtatctggtctgtaacaccactctgtgtgcactgaaacagcccagagacttctgctgtgtttgcgtggaggccaaagaaggccacttaagtgtcatggccgcacagagtgtctacgacacttctatgcctcgcccatcaaggaagatggtgaggggagaaattctaccgtccgcgtggattctccagccgattaccgtggaggggaaggaggtgacgcgcgtcatttacctcgctcaggtggagttgggagcgccaggatttccacctcagctgctgagcagctttatcaaacgacagcctctggttattgcacgcttagcttcattcctgggcaggtaa

SEQ ID NO: 59947 - DNA, 570 bp, Artificial Sequence
  Description of Artificial Sequence: Synthetic coding sequence
atgacacttgcagcttacaaagagaagatgaaagaattgccactagtgagtctgttctgctcatgtttcttggcagatccactcaataagtcctcttacaagtatgaggctgacacagtagacctcaactggtgcgtcatatcagatatggaagttatcgagcttaataagtgcacctctggccagagcttcgaggtcattcttaagccaccctcatttgatggtgtacccgaattcaacgcctcgctgcccagaagacgggacccttctctggaggagattcagaagaaacttgaggccgcagaagaacgccgtaagtaccaggaagctgaactccttaaacacctcgccgagaaacgcgaacacgagcgtgaggtgatccagaaggcaattgaggagaataataactttatcaaaatggcgaaggaaaaactggcacaaaagatggaatctaataaagaaaatcgcgaggcgcacctggcggcaatgctcgagagactgcaggagaaggacaaacacgccgaggaagttcgcaaaaacaaagaactgaaggaggaggcgtcccggtag

SEQ ID NO: 59948 - DNA, 651 bp, Artificial Sequence
  Description of Artificial Sequence: Synthetic coding sequence
atgaccttggccgcttataaagaaaaaatgaaggagctgccgctggttagcctgttctgctcatgtttcttagcggaccccttaaacaagagcagctataagtacgagggatggtgtgggaggcagtgtcgaagaaaagacgagtctcaacgaaaggactctgcagattggagggagcggcgagcccaagctgataccgtggacttgaattggtgtgtgatttccgacatggaggtgatcgaactgaacaagtgcacatccggccagtcgtttgaagtgatcctgaagcctccctcatttgatggcgtgccagaatttaacgcaagtctacctaggaggcgtgatccttcgcttgaggaaattcaaaaaaaactcgaggcagcagaagaaagaagaaaataccaggaggcagagctgctgaaacacctggccgaaaaaagagaacatgaacgagaggtgatacaaaaggccatcgaagaaaataataactttattaaaatggcaaaggaaaaattggcccaaaagatggaaagtaacaaagaaaatagagaagctcacttggccgcaatgttggaaaggctgcaagaaaaggacaagcacgccgaggaagtacggaaaaacaaagaactgaaggaagaagccagccgctag

SEQ ID NO: 59949 - DNA, 945 bp, Artificial Sequence
  Description of Artificial Sequence: Synthetic coding sequence
atgagctttcttgtgagtaagcctgagagaattcggacgaatgacgccagtagcgagtctatcgcaagcttctctaagcaggaagtaatgtccagtttccttccagaaggcggttgctacgagctgttgacggtcataggcaaaggatttgaggatctgatgactgtgaatctagcaaggtacaagccaacaggtgagtatgtcactgtaagacggattaatctcgaggcctgcagcaatgaaatggtgacctttctgcaaggtgagctgcacgtctcaaaactctttaaccacccaaatatagtaccatatcgagcaactttcattgcggataacgagctctgggtggtgacctcatttatggcctacggttccgctaaggacctgatatgtacacacttcatggatgggatgaacgagcttgctatagcttatatccttcagggggtactgaaggcactcgattacatccaccacatgggttatgtgcatcgaagtgtgaaggcttcccacatactgatttccgtagacggaaaagtgtatctgtcaggactccgctccaacttatctatgattagccacggccagcgccagagagtggtccatgactttcctaaatacagcgtgaaggtgctgccctggctgtcaccagaggtcctacagcagaatctccagggatatgacgccaaatccgatatttactcagtggggatcacagcctgcgagctggccaatgggcacgtcccgttcaaggacatgccagccactcagatgcttctcgaaaaattaaacgggacagtgccttgtctgctggatacgtccaccattccagcagaggagctgactatgtctccttcacggtctgtggccaactccggactgtctgactcattgacgacctccacccctagaccatccaatggtcccgtcccagctccttcttag

SEQ ID NO: 59950 - DNA, 2073 bp, Artificial Sequence
  Description of Artificial Sequence: Synthetic coding sequence
atgggagccgtggccagggcacacgggggtttacgtgtagccagagccagagagtccgtggctggcggaaggcaccggggtgccggaagacctggagccagagcggctggcgcagcagctgggttggtgcgagctgaagccggaggaagacgggcaggaaggggtaggcggcctggtcggggactacccactggcggtggaggccttgctgctgctgccgttggcagagaggttgctcagggtctctgtgatgccattcggctggatggcggactcgatctcctcctccgattactccaggcgccagaacttgaaacacgggtgcaagctgctagactgctggagcagattttggtggccgagaacagggatagagtcgcccgaataggactgggcgtcatactgaacctagctaaagaaagagagccagtggagctcgcacgatcgggatctggtatacttgagcacatgttcaagcatagcgaagagacatgccaacgcttagtggctgccggtggactggacgcagtcctgtattggtgccggcgtaccgaccccgctctcctccggcattgcgctctggccctcgggaactgcgccttacacggtgggcaggctgtacaaagacgcatggtcgaaaaacgagctgccgaatggctgttccccctcgcctttagtaaggaagacgagctgctcagcctgcatgcatgcctggcagtggcagtgcttgccaccaataaggaggtggagcgggaggtggagaggtccgggacactcgcacttgtcgagccactagtggcttcactggacccaggacgattcgcccgttgcttagtggacgcaagcgacacctcgcagggacgcggacccgacgacctccagcgtcttgtcccacttttggattctaaccgtcttgaggcccagtgcatcggcgctttttacctgtgtgctgaagccgcaataaagagcttgcagggaaaaaccaaggttttctctgatattggggcaatccagtcactcaagaggctggtatcttattcaactaacggaaccaagtccgcacttgctaaacgggctctgcgactcttgggtgaagaagtcccgaggcccatcctgccatccgtgcctagttggaaggaggccgaagtacagacctggctacaacagattggtttttcaaagtactgtgagtccttccgcgagcagcaggtcgacggcgatttattattgcgcttgactgaagaggagttgcagacagatcttggaatgaagagcggtatcaccaggaagcgcttttttagggaactgaccgagctcaaaacttttgcaaactactctacttgcgacaggtcaaatctggctgattggctgggatcactggatcccagattcagacagtatacttatggcttggtgtcatgcgggctagatcgaagcctgctgcatcgcgtgtccgagcagcagttgttggaagactgtgggatacacctgggggtgcatcgtgctcgtatcctcaccgccgctcgcgaaatgctgcacagcccactaccgtgtacgggtggaaagcccagcggcgacacaccggacgtctttatctcatatcggaggaatagtggatcacagctggcctctctcttgaaggtccatctccagctgcatggattctcggttttcatcgatgtggaaaaactggaagcaggtaaattcgaagacaagttgatccagtccgtcatgggcgctcggaatttcgtactggtccttagccccggagcgctcgataaatgtatgcaggatcatgactgtaaggactgggttcacaaggagatcgtgactgctttatcatgcggcaagaatattgttcccattatcgatggctttgagtggccggaacctcaggttctgcccgaagatatgcaggccgtcctaaccttcaacgggattaaatggagccacgagtatcaggaggccaccatagagaaaataattcggttcctgcagggtaggtcatcacgtgacagctcagctggatcagacacctctctggaaggggctgcgcctatgggcccaacctag

SEQ ID NO: 59951 - DNA, 2169 bp, Artificial Sequence
  Description of Artificial Sequence: Synthetic coding sequence
atggtgttaacattactgctaagtgcttacaagttgtgtagattctttgcaatgagtggcccaagacgtggcgcagaaaggctggcagtccccggacctgacggagggggtggaaccggaccctggtgggcggctgggggacctggtcccagggtatctccaggcgcagggaccgaggtacaggacgcattagagcgggcactgccagagctgcagcaggctctatccgcgctgaagcaagctgggggtgcccgtgcagtcggagctggactggcagaagtcttccagttagtggaagaggcttggctgttagcagttggaagggaagtagctcagggcttgtgcgacgctataagactggatgggggtctcgacctgctgcttcgattgctccaggcacccgagctagagactagagtgcaagccgctcgtctgctggaacagatccttgtggctgaaaacagagacagggtggctaggattggccttggtgtcatcctgaatctggcgaaagagagagaacccgtggagctcgcgagaagcggtagtggcatcctggaacacatgttcaagcactcagaggagacatgccaacgcctcgtggctgcgggaggcctggacgccgtcctgtactggtgccggagaactgacccagcccttttaagacactgtgcgctggcgctgggaaactgcgctctgcacgggggacaagccgttcaacgtcgaatggtagagaagcgggctgctgagtggctatttcctttggcattttctaaggaagacgaactgctttcactccacgcctgcctagcagtcgcggtgctcgccacaaataaggaggtcgagcgggaggtcgagaggtctgggactttggccttagtagaaccactcgtggcctccctggaccctggaaggtttgcccgatgtctagtagacgcctccgatacaagtcagggcaggggccctgatgatttgcagcggctcgtgccactcttagactcaaacagacttgaggcccaatgcattggagccttctacctatgtgctgaagctgccatcaagtccctacagggaaagactaaggtctttagcgacatcggagccatacagtcactcaagcgcctggtgtcctatagcaccaacgggactaagagcgccctggccaagagggccttacggcttcttggtgaagaagtacctagaccaatcctcccatccgtgccttcttggaaggaagcggaagtccagacgtggttacagcagatcgggttcagcaaatattgtgagtcctttcgcgagcaacaggtggacggagatttgctgttaagacttactgaggaggagctgcagaccgatctggggatgaagtcgggcatcaccagaaagaggttcttcagagaattgacagagctgaagacctttgccaattactctacctgtgatagatctaacctggcggattggctgggctcacttgatcccagattccgccagtatacctacggattagtcagctgcgggcttgatcgatcactgcttcatcgcgtgtctgagcagcagcttttggaggactgcggcatccacctcggggtccatagggccaggattttgacagccgcacgggagatgctacacagtcctctgccatgcaccgggggaaagccatccggagacacaccggacgtgttcatttcatacaggagaaactccggcagccagttggcgagtctattgaaagtgcatctgcaactccatggatttagtgtgttcattgatgttgagaaacttgaggccggtaaattcgaggacaaactgatccaatcagtgatgggggcacgcaactttgtattggtgctgagccccggtgcactggacaagtgtatgcaggaccacgattgtaaggactgggttcacaaggagattgttacagcattgtcatgtggaaagaatatcgtcccaataattgatggtttcgaatggcctgagccacaggtgcttcccgaggacatgcaagccgttttgacgttcaacggaatcaagtggtctcatgagtatcaggaggccactatcgagaaaattattcgttttctgcagggacggtcctcgagagatagtagtgcaggttccgacaccagcctcgaaggagccgcacccatgggtcctacctag
